United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 153

SEQ ID NO: 6492545 - DNA, 16 bp, Homo sapiens
tgagcatcctgagccc

SEQ ID NO: 6492546 - DNA, 17 bp, Homo sapiens
tgagcatcctgagcccc

SEQ ID NO: 6492547 - DNA, 15 bp, Homo sapiens
tgagcatcctgcaag

SEQ ID NO: 6492548 - DNA, 12 bp, Homo sapiens
tgggcttctgtg

SEQ ID NO: 6492549 - DNA, 14 bp, Homo sapiens
tgggcttctgttct

SEQ ID NO: 6492550 - DNA, 16 bp, Homo sapiens
tgggcttctgttctct

SEQ ID NO: 6492551 - DNA, 20 bp, Homo sapiens
tgggcttctgttctctgctg

SEQ ID NO: 6492552 - DNA, 14 bp, Homo sapiens
tgggcttgattctg

SEQ ID NO: 6492553 - DNA, 14 bp, Homo sapiens
tgggcttgctattc

SEQ ID NO: 6492554 - DNA, 21 bp, Homo sapiens
tgggcttgctattctgtccct

SEQ ID NO: 6492555 - DNA, 22 bp, Homo sapiens
tgggcttggacttcctggggcc

SEQ ID NO: 6492556 - DNA, 14 bp, Homo sapiens
tgggcttggagatg

SEQ ID NO: 6492557 - DNA, 13 bp, Homo sapiens
tgggcttggctct

SEQ ID NO: 6492558 - DNA, 14 bp, Homo sapiens
tgggcttggctctt

SEQ ID NO: 6492559 - DNA, 13 bp, Homo sapiens
tgggcttgggcct

SEQ ID NO: 6492560 - DNA, 22 bp, Homo sapiens
tgggcttggggaccagagctgc

SEQ ID NO: 6492561 - DNA, 23 bp, Homo sapiens
tgggcttggggaccagagctgcc

SEQ ID NO: 6492562 - DNA, 22 bp, Homo sapiens
tgggcttgtgatttccatttct

SEQ ID NO: 6492563 - DNA, 18 bp, Homo sapiens
tgggcttgtgctcgggat

SEQ ID NO: 6492564 - DNA, 19 bp, Homo sapiens
tgggcttgtggggcctggg

SEQ ID NO: 6492565 - DNA, 22 bp, Homo sapiens
tgggcttgtggggcctgggagg

SEQ ID NO: 6492566 - DNA, 14 bp, Homo sapiens
tgggcttgttttct

SEQ ID NO: 6492567 - DNA, 19 bp, Homo sapiens
tgggctttcacgggcccca

SEQ ID NO: 6492568 - DNA, 11 bp, Homo sapiens
tgggctttctc

SEQ ID NO: 6492569 - DNA, 18 bp, Homo sapiens
tgggctttgcaggctctg

SEQ ID NO: 6492570 - DNA, 21 bp, Homo sapiens
tgggctttgcaggctctgggc

SEQ ID NO: 6492571 - DNA, 16 bp, Homo sapiens
tgggctttggggctgg

SEQ ID NO: 6492572 - DNA, 20 bp, Homo sapiens
tgggctttggtggccaggga

SEQ ID NO: 6492573 - DNA, 16 bp, Homo sapiens
tgggcttttccctggg

SEQ ID NO: 6492574 - DNA, 21 bp, Homo sapiens
tgggcttttggggagccagaa

SEQ ID NO: 6492575 - DNA, 22 bp, Homo sapiens
tgggctttttttttctctttct

SEQ ID NO: 6492576 - DNA, 15 bp, Homo sapiens
tggggaaaaaaaaga

SEQ ID NO: 6492577 - DNA, 16 bp, Homo sapiens
tggggaaaaaagcaca

SEQ ID NO: 6492578 - DNA, 21 bp, Homo sapiens
tggggaaaaaagcacatacat

SEQ ID NO: 6492579 - DNA, 15 bp, Homo sapiens
tggggaaaaattctt

SEQ ID NO: 6492580 - DNA, 17 bp, Homo sapiens
tggggaaaaattcttgg

SEQ ID NO: 6492581 - DNA, 21 bp, Homo sapiens
tggggaaaaggatgatggaaa

SEQ ID NO: 6492582 - DNA, 13 bp, Homo sapiens
tggggaaaatggc

SEQ ID NO: 6492583 - DNA, 14 bp, Homo sapiens
tggggaaaatggcc

SEQ ID NO: 6492584 - DNA, 19 bp, Homo sapiens
tggggaaaatggccatgca

SEQ ID NO: 6492585 - DNA, 21 bp, Homo sapiens
tggggaaaatggccatgcagg

SEQ ID NO: 6492586 - DNA, 23 bp, Homo sapiens
tggggaaaatggccatgcaggag

SEQ ID NO: 6492587 - DNA, 21 bp, Homo sapiens
tggggaaacaacatttatatg

SEQ ID NO: 6492588 - DNA, 14 bp, Homo sapiens
tggggaaacaattt

SEQ ID NO: 6492589 - DNA, 22 bp, Homo sapiens
tggggaaacaattttttgtgat

SEQ ID NO: 6492590 - DNA, 18 bp, Homo sapiens
tggggaaagacactgcct

SEQ ID NO: 6492591 - DNA, 22 bp, Homo sapiens
tggggaaagacactgcctgggc

SEQ ID NO: 6492592 - DNA, 10 bp, Homo sapiens
tggggaaagc

SEQ ID NO: 6492593 - DNA, 17 bp, Homo sapiens
tggggaaagcagaactg

SEQ ID NO: 6492594 - DNA, 23 bp, Homo sapiens
tggggaaagcctgaagggcctcc

SEQ ID NO: 6492595 - DNA, 22 bp, Homo sapiens
tggggaaaggggtcggctgacc

SEQ ID NO: 6492596 - DNA, 23 bp, Homo sapiens
tggggaaaggggtcggctgacca

SEQ ID NO: 6492597 - DNA, 20 bp, Homo sapiens
tggggaaaggggttggggtg

SEQ ID NO: 6492598 - DNA, 20 bp, Homo sapiens
tggggaaataaagtgcctta

SEQ ID NO: 6492599 - DNA, 19 bp, Homo sapiens
tggggaaatagcttcagga

SEQ ID NO: 6492600 - DNA, 14 bp, Homo sapiens
tggggaaatgtgga

SEQ ID NO: 6492601 - DNA, 19 bp, Homo sapiens
tggggaaccccgagctggg

SEQ ID NO: 6492602 - DNA, 23 bp, Homo sapiens
tggggaactcccccagaggtgga

SEQ ID NO: 6492603 - DNA, 21 bp, Homo sapiens
tggggaactctccctctggtc

SEQ ID NO: 6492604 - DNA, 13 bp, Homo sapiens
tggggaagaaaaa

SEQ ID NO: 6492605 - DNA, 14 bp, Homo sapiens
tggggaagaaaaaa

SEQ ID NO: 6492606 - DNA, 15 bp, Homo sapiens
tggggaagaaaaaat

SEQ ID NO: 6492607 - DNA, 17 bp, Homo sapiens
tggggaagaacagcccc

SEQ ID NO: 6492608 - DNA, 22 bp, Homo sapiens
tggggaagaacagccccggggc

SEQ ID NO: 6492609 - DNA, 14 bp, Homo sapiens
tggggaagacagtg

SEQ ID NO: 6492610 - DNA, 22 bp, Homo sapiens
tggggaagagagcctgcaggat

SEQ ID NO: 6492611 - DNA, 20 bp, Homo sapiens
tggggaagaggttttattta

SEQ ID NO: 6492612 - DNA, 23 bp, Homo sapiens
tggggaagaggttttatttacat

SEQ ID NO: 6492613 - DNA, 20 bp, Homo sapiens
tggggaagccaggtgagctc

SEQ ID NO: 6492614 - DNA, 15 bp, Homo sapiens
tggggaaggaccaac

SEQ ID NO: 6492615 - DNA, 13 bp, Homo sapiens
tggggaaggaggc

SEQ ID NO: 6492616 - DNA, 14 bp, Homo sapiens
tggggaaggcagag

SEQ ID NO: 6492617 - DNA, 16 bp, Homo sapiens
tggggaaggcagaggc

SEQ ID NO: 6492618 - DNA, 17 bp, Homo sapiens
tggggaaggcagaggct

SEQ ID NO: 6492619 - DNA, 13 bp, Homo sapiens
tggggaaggggag

SEQ ID NO: 6492620 - DNA, 18 bp, Homo sapiens
tggggaaggggcctgggc

SEQ ID NO: 6492621 - DNA, 21 bp, Homo sapiens
tggggaagggttttcttttct

SEQ ID NO: 6492622 - DNA, 23 bp, Homo sapiens
tggggaaggtggagcagctgcag

SEQ ID NO: 6492623 - DNA, 23 bp, Homo sapiens
tggggaagtacgtcccagcggcc

SEQ ID NO: 6492624 - DNA, 20 bp, Homo sapiens
tggggaagtgctccccacac

SEQ ID NO: 6492625 - DNA, 22 bp, Homo sapiens
tggggaagtgctccccacacgt

SEQ ID NO: 6492626 - DNA, 15 bp, Homo sapiens
tggggaagttcaagt

SEQ ID NO: 6492627 - DNA, 19 bp, Homo sapiens
tggggaagtttatttgaga

SEQ ID NO: 6492628 - DNA, 20 bp, Homo sapiens
tggggaagtttatttgagaa

SEQ ID NO: 6492629 - DNA, 17 bp, Homo sapiens
tggggaatgggcaggtg

SEQ ID NO: 6492630 - DNA, 16 bp, Homo sapiens
tggggaatttcctcta

SEQ ID NO: 6492631 - DNA, 15 bp, Homo sapiens
tggggacaagggctg

SEQ ID NO: 6492632 - DNA, 20 bp, Homo sapiens
tggggacacacattctgcct

SEQ ID NO: 6492633 - DNA, 18 bp, Homo sapiens
tggggacacaggatcctg

SEQ ID NO: 6492634 - DNA, 14 bp, Homo sapiens
tggggacaccccag

SEQ ID NO: 6492635 - DNA, 18 bp, Homo sapiens
tggggacagaccagccct

SEQ ID NO: 6492636 - DNA, 16 bp, Homo sapiens
tggggacagagaaggt

SEQ ID NO: 6492637 - DNA, 17 bp, Homo sapiens
tggggacagagcagaac

SEQ ID NO: 6492638 - DNA, 15 bp, Homo sapiens
tggggacagagccac

SEQ ID NO: 6492639 - DNA, 18 bp, Homo sapiens
tggggacagagccacccc

SEQ ID NO: 6492640 - DNA, 15 bp, Homo sapiens
tggggacagagtgtc

SEQ ID NO: 6492641 - DNA, 19 bp, Homo sapiens
tggggacagattcagtctt

SEQ ID NO: 6492642 - DNA, 22 bp, Homo sapiens
tggggacagcttcctcacaccc

SEQ ID NO: 6492643 - DNA, 20 bp, Homo sapiens
tggggacagctttcctgggt

SEQ ID NO: 6492644 - DNA, 13 bp, Homo sapiens
tggggacaggcct

SEQ ID NO: 6492645 - DNA, 23 bp, Homo sapiens
tggggacaggcctttctggcctg

SEQ ID NO: 6492646 - DNA, 13 bp, Homo sapiens
tggggacagggag

SEQ ID NO: 6492647 - DNA, 16 bp, Homo sapiens
tggggacagggagggg

SEQ ID NO: 6492648 - DNA, 22 bp, Homo sapiens
tggggacaggtaagtggcagga

SEQ ID NO: 6492649 - DNA, 15 bp, Homo sapiens
tggggacaggtagac

SEQ ID NO: 6492650 - DNA, 17 bp, Homo sapiens
tggggacagttggcaga

SEQ ID NO: 6492651 - DNA, 15 bp, Homo sapiens
tggggacataatttc

SEQ ID NO: 6492652 - DNA, 18 bp, Homo sapiens
tggggacatctctttgaa

SEQ ID NO: 6492653 - DNA, 20 bp, Homo sapiens
tggggacatctctttgaatt

SEQ ID NO: 6492654 - DNA, 15 bp, Homo sapiens
tggggaccacagagg

SEQ ID NO: 6492655 - DNA, 14 bp, Homo sapiens
tggggaccaggagc

SEQ ID NO: 6492656 - DNA, 17 bp, Homo sapiens
tggggaccaggagctag

SEQ ID NO: 6492657 - DNA, 13 bp, Homo sapiens
tggggacccagac

SEQ ID NO: 6492658 - DNA, 14 bp, Homo sapiens
tggggacccaggct

SEQ ID NO: 6492659 - DNA, 17 bp, Homo sapiens
tggggaccccaacctca

SEQ ID NO: 6492660 - DNA, 11 bp, Homo sapiens
tggggaccccc

SEQ ID NO: 6492661 - DNA, 16 bp, Homo sapiens
tggggaccccctcagg

SEQ ID NO: 6492662 - DNA, 19 bp, Homo sapiens
tggggacccgctgggggct

SEQ ID NO: 6492663 - DNA, 17 bp, Homo sapiens
tggggaccctgtagagt

SEQ ID NO: 6492664 - DNA, 20 bp, Homo sapiens
tggggaccggttcccacaag

SEQ ID NO: 6492665 - DNA, 22 bp, Homo sapiens
tggggacctggggtggggaggc

SEQ ID NO: 6492666 - DNA, 18 bp, Homo sapiens
tggggacgggggctgctt

SEQ ID NO: 6492667 - DNA, 22 bp, Homo sapiens
tggggacggggggccccagtca

SEQ ID NO: 6492668 - DNA, 17 bp, Homo sapiens
tggggactcaggaccag

SEQ ID NO: 6492669 - DNA, 19 bp, Homo sapiens
tggggactccggctgtgct

SEQ ID NO: 6492670 - DNA, 14 bp, Homo sapiens
tggggactcctcaa

SEQ ID NO: 6492671 - DNA, 21 bp, Homo sapiens
tggggactcctcaaaccactt

SEQ ID NO: 6492672 - DNA, 22 bp, Homo sapiens
tggggactctccaggcaccgcc

SEQ ID NO: 6492673 - DNA, 20 bp, Homo sapiens
tggggactctgccgctgtgt

SEQ ID NO: 6492674 - DNA, 14 bp, Homo sapiens
tggggactctgctt

SEQ ID NO: 6492675 - DNA, 19 bp, Homo sapiens
tggggactctgcttggctg

SEQ ID NO: 6492676 - DNA, 16 bp, Homo sapiens
tggggactctggcaca

SEQ ID NO: 6492677 - DNA, 18 bp, Homo sapiens
tggggactgcattggact

SEQ ID NO: 6492678 - DNA, 14 bp, Homo sapiens
tggggactgctacc

SEQ ID NO: 6492679 - DNA, 17 bp, Homo sapiens
tggggacttcaactgcc

SEQ ID NO: 6492680 - DNA, 23 bp, Homo sapiens
tggggacttccgctccctggata

SEQ ID NO: 6492681 - DNA, 17 bp, Homo sapiens
tggggagaaaagacaaa

SEQ ID NO: 6492682 - DNA, 18 bp, Homo sapiens
tggggagaaactgaagcc

SEQ ID NO: 6492683 - DNA, 19 bp, Homo sapiens
tggggagaaagggagcgag

SEQ ID NO: 6492684 - DNA, 15 bp, Homo sapiens
tggggagaaagtagt

SEQ ID NO: 6492685 - DNA, 19 bp, Homo sapiens
tggggagaaataaattttg

SEQ ID NO: 6492686 - DNA, 19 bp, Homo sapiens
tggggagaaatccctcaga

SEQ ID NO: 6492687 - DNA, 18 bp, Homo sapiens
tggggagaacccttcctg

SEQ ID NO: 6492688 - DNA, 16 bp, Homo sapiens
tggggagacagttgag

SEQ ID NO: 6492689 - DNA, 21 bp, Homo sapiens
tggggagacagttgagagcgg

SEQ ID NO: 6492690 - DNA, 22 bp, Homo sapiens
tggggagaccgagtgtggagct

SEQ ID NO: 6492691 - DNA, 19 bp, Homo sapiens
tggggagacttggggccag

SEQ ID NO: 6492692 - DNA, 13 bp, Homo sapiens
tggggagagacgg

SEQ ID NO: 6492693 - DNA, 20 bp, Homo sapiens
tggggagagataatgaggca

SEQ ID NO: 6492694 - DNA, 20 bp, Homo sapiens
tggggagagcggctggagaa

SEQ ID NO: 6492695 - DNA, 14 bp, Homo sapiens
tggggagagctggc

SEQ ID NO: 6492696 - DNA, 15 bp, Homo sapiens
tggggagaggaactc

SEQ ID NO: 6492697 - DNA, 22 bp, Homo sapiens
tggggagaggaactccttggcc

SEQ ID NO: 6492698 - DNA, 13 bp, Homo sapiens
tggggagaggcaa

SEQ ID NO: 6492699 - DNA, 20 bp, Homo sapiens
tggggagatgcttctctcct

SEQ ID NO: 6492700 - DNA, 23 bp, Homo sapiens
tggggagatgggggcttcttcct

SEQ ID NO: 6492701 - DNA, 22 bp, Homo sapiens
tggggagcacaggtgtctgcct

SEQ ID NO: 6492702 - DNA, 23 bp, Homo sapiens
tggggagcacttgcgtcctgcag

SEQ ID NO: 6492703 - DNA, 17 bp, Homo sapiens
tggggagcagagacact

SEQ ID NO: 6492704 - DNA, 14 bp, Homo sapiens
tggggagcagagta

SEQ ID NO: 6492705 - DNA, 15 bp, Homo sapiens
tggggagcagctgag

SEQ ID NO: 6492706 - DNA, 15 bp, Homo sapiens
tggggagcagctggg

SEQ ID NO: 6492707 - DNA, 16 bp, Homo sapiens
tggggagcaggaggcc

SEQ ID NO: 6492708 - DNA, 20 bp, Homo sapiens
tggggagcaggaggccaata

SEQ ID NO: 6492709 - DNA, 17 bp, Homo sapiens
tggggagcaggcagcca

SEQ ID NO: 6492710 - DNA, 14 bp, Homo sapiens
tggggagcaggtct

SEQ ID NO: 6492711 - DNA, 17 bp, Homo sapiens
tggggagcccaggcctg

SEQ ID NO: 6492712 - DNA, 12 bp, Homo sapiens
tggggagccctc

SEQ ID NO: 6492713 - DNA, 15 bp, Homo sapiens
tggggagccctcagg

SEQ ID NO: 6492714 - DNA, 23 bp, Homo sapiens
tggggagcgggggctaactggcc

SEQ ID NO: 6492715 - DNA, 17 bp, Homo sapiens
tggggagcgggtctgct

SEQ ID NO: 6492716 - DNA, 19 bp, Homo sapiens
tggggagcgggtctgctcc

SEQ ID NO: 6492717 - DNA, 20 bp, Homo sapiens
tggggagcgggtctgctccc

SEQ ID NO: 6492718 - DNA, 14 bp, Homo sapiens
tggggagctagagg

SEQ ID NO: 6492719 - DNA, 16 bp, Homo sapiens
tggggagctcctggcc

SEQ ID NO: 6492720 - DNA, 18 bp, Homo sapiens
tggggagctcctgggacc

SEQ ID NO: 6492721 - DNA, 13 bp, Homo sapiens
tggggagctggcc

SEQ ID NO: 6492722 - DNA, 23 bp, Homo sapiens
tggggagctggcctaggtgggag

SEQ ID NO: 6492723 - DNA, 20 bp, Homo sapiens
tggggaggaagggccaggag

SEQ ID NO: 6492724 - DNA, 13 bp, Homo sapiens
tggggaggactag

SEQ ID NO: 6492725 - DNA, 17 bp, Homo sapiens
tgagcatcctgcaaggt

SEQ ID NO: 6492726 - DNA, 18 bp, Homo sapiens
tgagcatcctgcaaggtg

SEQ ID NO: 6492727 - DNA, 15 bp, Homo sapiens
tgagcatcctggcag

SEQ ID NO: 6492728 - DNA, 14 bp, Homo sapiens
tgagcatctctgtg

SEQ ID NO: 6492729 - DNA, 15 bp, Homo sapiens
tgagcatctctgtgt

SEQ ID NO: 6492730 - DNA, 18 bp, Homo sapiens
tgagcatgcacactgaga

SEQ ID NO: 6492731 - DNA, 16 bp, Homo sapiens
tgagcatgcattttct

SEQ ID NO: 6492732 - DNA, 14 bp, Homo sapiens
tgagcatgctccct

SEQ ID NO: 6492733 - DNA, 18 bp, Homo sapiens
tgagcatggagacagcag

SEQ ID NO: 6492734 - DNA, 19 bp, Homo sapiens
tgagcatggagacagcagt

SEQ ID NO: 6492735 - DNA, 21 bp, Homo sapiens
tgagcatggagctgtcacctc

SEQ ID NO: 6492736 - DNA, 15 bp, Homo sapiens
tgagcatggggccag

SEQ ID NO: 6492737 - DNA, 15 bp, Homo sapiens
tgagcatggggcgct

SEQ ID NO: 6492738 - DNA, 15 bp, Homo sapiens
tgagcatgtttagac

SEQ ID NO: 6492739 - DNA, 16 bp, Homo sapiens
tgagcattagatttct

SEQ ID NO: 6492740 - DNA, 15 bp, Homo sapiens
tgagcattcaggcag

SEQ ID NO: 6492741 - DNA, 15 bp, Homo sapiens
tgagcattcttggtt

SEQ ID NO: 6492742 - DNA, 16 bp, Homo sapiens
tgagcatttagcacaa

SEQ ID NO: 6492743 - DNA, 13 bp, Homo sapiens
tgagccaaaatca

SEQ ID NO: 6492744 - DNA, 14 bp, Homo sapiens
tgagccaaaatgac

SEQ ID NO: 6492745 - DNA, 15 bp, Homo sapiens
tgagccaaagagaaa

SEQ ID NO: 6492746 - DNA, 15 bp, Homo sapiens
tgagccaaagccaga

SEQ ID NO: 6492747 - DNA, 18 bp, Homo sapiens
tgagccaaccttgctctt

SEQ ID NO: 6492748 - DNA, 21 bp, Homo sapiens
tgagccaaccttgctcttggg

SEQ ID NO: 6492749 - DNA, 23 bp, Homo sapiens
tgagccaaccttgctcttgggga

SEQ ID NO: 6492750 - DNA, 23 bp, Homo sapiens
tgagccaagaaacactgcctgcc

SEQ ID NO: 6492751 - DNA, 18 bp, Homo sapiens
tgagccaagatcgcacca

SEQ ID NO: 6492752 - DNA, 22 bp, Homo sapiens
tgagccaagattgcgccactgc

SEQ ID NO: 6492753 - DNA, 18 bp, Homo sapiens
tgagccaaggacagggct

SEQ ID NO: 6492754 - DNA, 13 bp, Homo sapiens
tgagccaagggag

SEQ ID NO: 6492755 - DNA, 18 bp, Homo sapiens
tgagccaagggagggaag

SEQ ID NO: 6492756 - DNA, 20 bp, Homo sapiens
tgagccaagggagggaaggg

SEQ ID NO: 6492757 - DNA, 23 bp, Homo sapiens
tgagccaagggagggaagggcca

SEQ ID NO: 6492758 - DNA, 21 bp, Homo sapiens
tgagccaaggggtctgctcct

SEQ ID NO: 6492759 - DNA, 22 bp, Homo sapiens
tgagccaaggggtctgctcctg

SEQ ID NO: 6492760 - DNA, 23 bp, Homo sapiens
tgagccaatctgcaatttctact

SEQ ID NO: 6492761 - DNA, 18 bp, Homo sapiens
tgagccacagaccacctg

SEQ ID NO: 6492762 - DNA, 18 bp, Homo sapiens
tgagccacagatgggcaa

SEQ ID NO: 6492763 - DNA, 19 bp, Homo sapiens
tgagccacagcagcatttt

SEQ ID NO: 6492764 - DNA, 17 bp, Homo sapiens
tgagccaccgctgccag

SEQ ID NO: 6492765 - DNA, 16 bp, Homo sapiens
tgagccaccgtgcctg

SEQ ID NO: 6492766 - DNA, 21 bp, Homo sapiens
tgagccaccgtgcctggccag

SEQ ID NO: 6492767 - DNA, 14 bp, Homo sapiens
tgagccactgcacc

SEQ ID NO: 6492768 - DNA, 16 bp, Homo sapiens
tgagccactgcaccca

SEQ ID NO: 6492769 - DNA, 18 bp, Homo sapiens
tgagccactgcaccgggc

SEQ ID NO: 6492770 - DNA, 17 bp, Homo sapiens
tgagccactgcacctga

SEQ ID NO: 6492771 - DNA, 12 bp, Homo sapiens
tgagccactgcg

SEQ ID NO: 6492772 - DNA, 15 bp, Homo sapiens
tgagccactgcgccc

SEQ ID NO: 6492773 - DNA, 17 bp, Homo sapiens
tgagccactgcgcccag

SEQ ID NO: 6492774 - DNA, 22 bp, Homo sapiens
tgagccactgcgcccggcccaa

SEQ ID NO: 6492775 - DNA, 17 bp, Homo sapiens
tgagccactgtgcccag

SEQ ID NO: 6492776 - DNA, 17 bp, Homo sapiens
tgagccactgtgcttgg

SEQ ID NO: 6492777 - DNA, 19 bp, Homo sapiens
tgagccactgtgcttggcc

SEQ ID NO: 6492778 - DNA, 22 bp, Homo sapiens
tgagccagaaaaaaaaaataaa

SEQ ID NO: 6492779 - DNA, 20 bp, Homo sapiens
tgagccagacaaatggagga

SEQ ID NO: 6492780 - DNA, 17 bp, Homo sapiens
tgagccagagggagctg

SEQ ID NO: 6492781 - DNA, 17 bp, Homo sapiens
tgagccagatttcactc

SEQ ID NO: 6492782 - DNA, 20 bp, Homo sapiens
tgagccagatttcactctcc

SEQ ID NO: 6492783 - DNA, 22 bp, Homo sapiens
tgagccagatttcactctcctt

SEQ ID NO: 6492784 - DNA, 13 bp, Homo sapiens
tgagccagcagct

SEQ ID NO: 6492785 - DNA, 12 bp, Homo sapiens
tgagccagcagg

SEQ ID NO: 6492786 - DNA, 13 bp, Homo sapiens
tgagccagctgca

SEQ ID NO: 6492787 - DNA, 23 bp, Homo sapiens
tgagccaggctagctggagcctg

SEQ ID NO: 6492788 - DNA, 17 bp, Homo sapiens
tgagccaggcttttctc

SEQ ID NO: 6492789 - DNA, 16 bp, Homo sapiens
tgagccagggaacagc

SEQ ID NO: 6492790 - DNA, 19 bp, Homo sapiens
tgagccagggaacagcccc

SEQ ID NO: 6492791 - DNA, 20 bp, Homo sapiens
tgagccagggaacagcccca

SEQ ID NO: 6492792 - DNA, 21 bp, Homo sapiens
tgagccagggaacagccccag

SEQ ID NO: 6492793 - DNA, 20 bp, Homo sapiens
tgagccaggtaatgagggac

SEQ ID NO: 6492794 - DNA, 16 bp, Homo sapiens
tgagccagtcccaggg

SEQ ID NO: 6492795 - DNA, 23 bp, Homo sapiens
tgagccagttcagtacctggagg

SEQ ID NO: 6492796 - DNA, 22 bp, Homo sapiens
tgagccataggtctaaatagga

SEQ ID NO: 6492797 - DNA, 20 bp, Homo sapiens
tgagccatcactagaagaaa

SEQ ID NO: 6492798 - DNA, 19 bp, Homo sapiens
tgagccatcatttcctggg

SEQ ID NO: 6492799 - DNA, 14 bp, Homo sapiens
tgagccatccccag

SEQ ID NO: 6492800 - DNA, 13 bp, Homo sapiens
tgagccatgagga

SEQ ID NO: 6492801 - DNA, 14 bp, Homo sapiens
tgagccatgaggag

SEQ ID NO: 6492802 - DNA, 15 bp, Homo sapiens
tgagccatgaggagc

SEQ ID NO: 6492803 - DNA, 22 bp, Homo sapiens
tgagccatgatttcccactgca

SEQ ID NO: 6492804 - DNA, 17 bp, Homo sapiens
tgagccatgcctccctg

SEQ ID NO: 6492805 - DNA, 18 bp, Homo sapiens
tgagccatgctacagtta

SEQ ID NO: 6492806 - DNA, 16 bp, Homo sapiens
tgagccattttttaaa

SEQ ID NO: 6492807 - DNA, 18 bp, Homo sapiens
tgagcccaaacaccctcc

SEQ ID NO: 6492808 - DNA, 17 bp, Homo sapiens
tgagcccaaccaggccc

SEQ ID NO: 6492809 - DNA, 15 bp, Homo sapiens
tgagcccacaaagcc

SEQ ID NO: 6492810 - DNA, 16 bp, Homo sapiens
tgagcccacaaagcct

SEQ ID NO: 6492811 - DNA, 16 bp, Homo sapiens
tgagcccacctcgtcc

SEQ ID NO: 6492812 - DNA, 13 bp, Homo sapiens
tgagcccactcta

SEQ ID NO: 6492813 - DNA, 22 bp, Homo sapiens
tgagcccactctactgccccag

SEQ ID NO: 6492814 - DNA, 19 bp, Homo sapiens
tgagcccactgcccacccc

SEQ ID NO: 6492815 - DNA, 23 bp, Homo sapiens
tgagcccactgcccaccccctca

SEQ ID NO: 6492816 - DNA, 12 bp, Homo sapiens
tgagcccactgt

SEQ ID NO: 6492817 - DNA, 15 bp, Homo sapiens
tgagcccagaaaaaa

SEQ ID NO: 6492818 - DNA, 14 bp, Homo sapiens
tgagcccagccacc

SEQ ID NO: 6492819 - DNA, 15 bp, Homo sapiens
tgagcccagctgcct

SEQ ID NO: 6492820 - DNA, 19 bp, Homo sapiens
tgagcccagctgcctggag

SEQ ID NO: 6492821 - DNA, 21 bp, Homo sapiens
tgagcccagctgcctggagag

SEQ ID NO: 6492822 - DNA, 17 bp, Homo sapiens
tgagcccagctgggtca

SEQ ID NO: 6492823 - DNA, 21 bp, Homo sapiens
tgagcccagctgggtcaggca

SEQ ID NO: 6492824 - DNA, 12 bp, Homo sapiens
tgagcccaggag

SEQ ID NO: 6492825 - DNA, 22 bp, Homo sapiens
tgagcccaggagtttgagacaa

SEQ ID NO: 6492826 - DNA, 12 bp, Homo sapiens
tgagcccaggcc

SEQ ID NO: 6492827 - DNA, 21 bp, Homo sapiens
tgagcccatgtggagtcagcc

SEQ ID NO: 6492828 - DNA, 22 bp, Homo sapiens
tgagcccatgtggagtcagcct

SEQ ID NO: 6492829 - DNA, 23 bp, Homo sapiens
tgagcccatgttctgcccccagc

SEQ ID NO: 6492830 - DNA, 15 bp, Homo sapiens
tgagcccattcttct

SEQ ID NO: 6492831 - DNA, 17 bp, Homo sapiens
tgagcccattcttctgg

SEQ ID NO: 6492832 - DNA, 18 bp, Homo sapiens
tgagcccattcttctggg

SEQ ID NO: 6492833 - DNA, 23 bp, Homo sapiens
tgagcccatttctggggggagaa

SEQ ID NO: 6492834 - DNA, 14 bp, Homo sapiens
tgagccccaagtcc

SEQ ID NO: 6492835 - DNA, 23 bp, Homo sapiens
tgagccccaagtcctgaagaggc

SEQ ID NO: 6492836 - DNA, 13 bp, Homo sapiens
tgagccccacagc

SEQ ID NO: 6492837 - DNA, 11 bp, Homo sapiens
tgagccccacc

SEQ ID NO: 6492838 - DNA, 13 bp, Homo sapiens
tgagccccagccc

SEQ ID NO: 6492839 - DNA, 13 bp, Homo sapiens
tgagccccagggg

SEQ ID NO: 6492840 - DNA, 22 bp, Homo sapiens
tgagccccaggggggcctcctc

SEQ ID NO: 6492841 - DNA, 23 bp, Homo sapiens
tgagccccagggtgcccagaact

SEQ ID NO: 6492842 - DNA, 15 bp, Homo sapiens
tgagccccagtgctg

SEQ ID NO: 6492843 - DNA, 16 bp, Homo sapiens
tgagccccatcttcac

SEQ ID NO: 6492844 - DNA, 19 bp, Homo sapiens
tgagcccccaccggaactg

SEQ ID NO: 6492845 - DNA, 17 bp, Homo sapiens
tgagcccccagcttcca

SEQ ID NO: 6492846 - DNA, 20 bp, Homo sapiens
tgagcccccccaacactgtg

SEQ ID NO: 6492847 - DNA, 13 bp, Homo sapiens
tgagccccctctc

SEQ ID NO: 6492848 - DNA, 19 bp, Homo sapiens
tgagccccctctcctgaag

SEQ ID NO: 6492849 - DNA, 15 bp, Homo sapiens
tgagccccctgcacc

SEQ ID NO: 6492850 - DNA, 19 bp, Homo sapiens
tgagccccctgcacccacc

SEQ ID NO: 6492851 - DNA, 21 bp, Homo sapiens
tgagccccctgcacccacccc

SEQ ID NO: 6492852 - DNA, 22 bp, Homo sapiens
tgagccccctgcacccacccct

SEQ ID NO: 6492853 - DNA, 13 bp, Homo sapiens
tgagccccctgtg

SEQ ID NO: 6492854 - DNA, 18 bp, Homo sapiens
tgagccccctgtgcccac

SEQ ID NO: 6492855 - DNA, 23 bp, Homo sapiens
tgagccccctgtgcccacccagg

SEQ ID NO: 6492856 - DNA, 16 bp, Homo sapiens
tgagccccgcagacct

SEQ ID NO: 6492857 - DNA, 22 bp, Homo sapiens
tgagccccgcagacctccccag

SEQ ID NO: 6492858 - DNA, 23 bp, Homo sapiens
tgagccccgcagacctccccagc

SEQ ID NO: 6492859 - DNA, 20 bp, Homo sapiens
tgagccccgccctcttcctg

SEQ ID NO: 6492860 - DNA, 21 bp, Homo sapiens
tgagccccgccctcttcctga

SEQ ID NO: 6492861 - DNA, 19 bp, Homo sapiens
tgagccccggaggtcgagg

SEQ ID NO: 6492862 - DNA, 14 bp, Homo sapiens
tgagcccctcccca

SEQ ID NO: 6492863 - DNA, 15 bp, Homo sapiens
tgagcccctccccag

SEQ ID NO: 6492864 - DNA, 19 bp, Homo sapiens
tgagcccctccccagccag

SEQ ID NO: 6492865 - DNA, 12 bp, Homo sapiens
tgagcccctcct

SEQ ID NO: 6492866 - DNA, 15 bp, Homo sapiens
tgagcccctggaggc

SEQ ID NO: 6492867 - DNA, 15 bp, Homo sapiens
tgagcccctgggact

SEQ ID NO: 6492868 - DNA, 18 bp, Homo sapiens
tgagcccctggtcttctc

SEQ ID NO: 6492869 - DNA, 19 bp, Homo sapiens
tgagcccctggtcttctct

SEQ ID NO: 6492870 - DNA, 17 bp, Homo sapiens
tgagcccctgtctagag

SEQ ID NO: 6492871 - DNA, 12 bp, Homo sapiens
tgagccccttcc

SEQ ID NO: 6492872 - DNA, 13 bp, Homo sapiens
tgagccccttcct

SEQ ID NO: 6492873 - DNA, 14 bp, Homo sapiens
tgagccccttcctt

SEQ ID NO: 6492874 - DNA, 22 bp, Homo sapiens
tgagcccctttgcctgtcaagt

SEQ ID NO: 6492875 - DNA, 20 bp, Homo sapiens
tgagcccgaatttctcactc

SEQ ID NO: 6492876 - DNA, 21 bp, Homo sapiens
tgagcccgggctgcctgggct

SEQ ID NO: 6492877 - DNA, 20 bp, Homo sapiens
tgagccctactccctgcaga

SEQ ID NO: 6492878 - DNA, 22 bp, Homo sapiens
tgagccctcagaacccttggct

SEQ ID NO: 6492879 - DNA, 13 bp, Homo sapiens
tgagccctcccca

SEQ ID NO: 6492880 - DNA, 23 bp, Homo sapiens
tgagccctccctcttcccagcac

SEQ ID NO: 6492881 - DNA, 23 bp, Homo sapiens
tgagccctccttcttgccctgag

SEQ ID NO: 6492882 - DNA, 18 bp, Homo sapiens
tgagccctctcactccag

SEQ ID NO: 6492883 - DNA, 13 bp, Homo sapiens
tgagccctgctct

SEQ ID NO: 6492884 - DNA, 18 bp, Homo sapiens
tgagccctggaccccagg

SEQ ID NO: 6492885 - DNA, 12 bp, Homo sapiens
tgagccctggct

SEQ ID NO: 6492886 - DNA, 13 bp, Homo sapiens
tgagccctggctc

SEQ ID NO: 6492887 - DNA, 14 bp, Homo sapiens
tgagccctggctcc

SEQ ID NO: 6492888 - DNA, 12 bp, Homo sapiens
tgagccctgggg

SEQ ID NO: 6492889 - DNA, 20 bp, Homo sapiens
tgagccctggggactgttcc

SEQ ID NO: 6492890 - DNA, 18 bp, Homo sapiens
tgagccctgtacccaccc

SEQ ID NO: 6492891 - DNA, 20 bp, Homo sapiens
tgagccctgtacccacccca

SEQ ID NO: 6492892 - DNA, 18 bp, Homo sapiens
tgagcccttctctgtgtt

SEQ ID NO: 6492893 - DNA, 21 bp, Homo sapiens
tgagcccttgcacaggccact

SEQ ID NO: 6492894 - DNA, 19 bp, Homo sapiens
tgagccgagatcacgccac

SEQ ID NO: 6492895 - DNA, 22 bp, Homo sapiens
tgagccgagatcacgccactgc

SEQ ID NO: 6492896 - DNA, 20 bp, Homo sapiens
tgagccgagatcgcgccact

SEQ ID NO: 6492897 - DNA, 19 bp, Homo sapiens
tgagccgagattgcaccac

SEQ ID NO: 6492898 - DNA, 23 bp, Homo sapiens
tgagccgagattgcgccactgca

SEQ ID NO: 6492899 - DNA, 22 bp, Homo sapiens
tgagccgcagggcctgctacgc

SEQ ID NO: 6492900 - DNA, 16 bp, Homo sapiens
tgagccgccaggaacc

SEQ ID NO: 6492901 - DNA, 14 bp, Homo sapiens
tgagccgcccaagg

SEQ ID NO: 6492902 - DNA, 18 bp, Homo sapiens
tgagccgcccaaggcctt

SEQ ID NO: 6492903 - DNA, 10 bp, Homo sapiens
tggggaggag

SEQ ID NO: 6492904 - DNA, 23 bp, Homo sapiens
tggggaggagagagggggagacc

SEQ ID NO: 6492905 - DNA, 21 bp, Homo sapiens
tggggaggagttgtctgtcct

SEQ ID NO: 6492906 - DNA, 13 bp, Homo sapiens
tggggaggcactc

SEQ ID NO: 6492907 - DNA, 15 bp, Homo sapiens
tggggaggcagaggg

SEQ ID NO: 6492908 - DNA, 14 bp, Homo sapiens
tggggaggcagcag

SEQ ID NO: 6492909 - DNA, 17 bp, Homo sapiens
tggggaggcagctccaa

SEQ ID NO: 6492910 - DNA, 13 bp, Homo sapiens
tggggaggcaggc

SEQ ID NO: 6492911 - DNA, 14 bp, Homo sapiens
tggggaggcaggca

SEQ ID NO: 6492912 - DNA, 13 bp, Homo sapiens
tggggaggccatt

SEQ ID NO: 6492913 - DNA, 21 bp, Homo sapiens
tggggaggccatttgctgccc

SEQ ID NO: 6492914 - DNA, 13 bp, Homo sapiens
tggggaggctgag

SEQ ID NO: 6492915 - DNA, 15 bp, Homo sapiens
tggggagggacaagg

SEQ ID NO: 6492916 - DNA, 18 bp, Homo sapiens
tggggagggacacagagg

SEQ ID NO: 6492917 - DNA, 19 bp, Homo sapiens
tggggagggagacagagac

SEQ ID NO: 6492918 - DNA, 15 bp, Homo sapiens
tggggagggagtctg

SEQ ID NO: 6492919 - DNA, 22 bp, Homo sapiens
tggggagggcaggtccagctct

SEQ ID NO: 6492920 - DNA, 17 bp, Homo sapiens
tggggagggccgtaccc

SEQ ID NO: 6492921 - DNA, 21 bp, Homo sapiens
tggggagggccgtaccccacc

SEQ ID NO: 6492922 - DNA, 14 bp, Homo sapiens
tggggagggcctct

SEQ ID NO: 6492923 - DNA, 16 bp, Homo sapiens
tggggagggcctctgg

SEQ ID NO: 6492924 - DNA, 19 bp, Homo sapiens
tggggagggcctctggaca

SEQ ID NO: 6492925 - DNA, 20 bp, Homo sapiens
tggggagggcctctggacag

SEQ ID NO: 6492926 - DNA, 22 bp, Homo sapiens
tggggaggggcctggcctgggt

SEQ ID NO: 6492927 - DNA, 21 bp, Homo sapiens
tggggaggggcctttgctgcc

SEQ ID NO: 6492928 - DNA, 15 bp, Homo sapiens
tggggaggggctgag

SEQ ID NO: 6492929 - DNA, 18 bp, Homo sapiens
tggggaggggctgaggat

SEQ ID NO: 6492930 - DNA, 15 bp, Homo sapiens
tggggaggggctgtg

SEQ ID NO: 6492931 - DNA, 11 bp, Homo sapiens
tggggaggggg

SEQ ID NO: 6492932 - DNA, 16 bp, Homo sapiens
tggggagggggaagag

SEQ ID NO: 6492933 - DNA, 22 bp, Homo sapiens
tggggagggggaagagaaattt

SEQ ID NO: 6492934 - DNA, 19 bp, Homo sapiens
tggggaggggggcgggtga

SEQ ID NO: 6492935 - DNA, 20 bp, Homo sapiens
tggggaggggggcgggtgac

SEQ ID NO: 6492936 - DNA, 22 bp, Homo sapiens
tggggaggggtcagctctggcc

SEQ ID NO: 6492937 - DNA, 17 bp, Homo sapiens
tggggagggtcaagggc

SEQ ID NO: 6492938 - DNA, 14 bp, Homo sapiens
tggggagggtgggc

SEQ ID NO: 6492939 - DNA, 17 bp, Homo sapiens
tggggagggtgggcgtg

SEQ ID NO: 6492940 - DNA, 19 bp, Homo sapiens
tggggaggtgggaggccag

SEQ ID NO: 6492941 - DNA, 21 bp, Homo sapiens
tggggagtaaacggcccaggc

SEQ ID NO: 6492942 - DNA, 21 bp, Homo sapiens
tggggagtacattcatctgga

SEQ ID NO: 6492943 - DNA, 22 bp, Homo sapiens
tggggagtattatggaaatcca

SEQ ID NO: 6492944 - DNA, 19 bp, Homo sapiens
tggggagtgggacagagtc

SEQ ID NO: 6492945 - DNA, 16 bp, Homo sapiens
tggggagttaagacct

SEQ ID NO: 6492946 - DNA, 17 bp, Homo sapiens
tggggagttaagacctg

SEQ ID NO: 6492947 - DNA, 17 bp, Homo sapiens
tggggagttataaaaat

SEQ ID NO: 6492948 - DNA, 15 bp, Homo sapiens
tggggataataatac

SEQ ID NO: 6492949 - DNA, 13 bp, Homo sapiens
tggggatagagga

SEQ ID NO: 6492950 - DNA, 15 bp, Homo sapiens
tggggatagaggaaa

SEQ ID NO: 6492951 - DNA, 20 bp, Homo sapiens
tggggatagatgtgtggaca

SEQ ID NO: 6492952 - DNA, 14 bp, Homo sapiens
tggggatagtctgg

SEQ ID NO: 6492953 - DNA, 15 bp, Homo sapiens
tggggatagtctggg

SEQ ID NO: 6492954 - DNA, 15 bp, Homo sapiens
tggggatataatact

SEQ ID NO: 6492955 - DNA, 17 bp, Homo sapiens
tggggatatcagggcac

SEQ ID NO: 6492956 - DNA, 13 bp, Homo sapiens
tggggatatgctt

SEQ ID NO: 6492957 - DNA, 21 bp, Homo sapiens
tggggatcacagagacattcc

SEQ ID NO: 6492958 - DNA, 23 bp, Homo sapiens
tggggatcagagtctggcctgcc

SEQ ID NO: 6492959 - DNA, 23 bp, Homo sapiens
tggggatccccgcctggccagga

SEQ ID NO: 6492960 - DNA, 20 bp, Homo sapiens
tggggatccctcccccccat

SEQ ID NO: 6492961 - DNA, 14 bp, Homo sapiens
tggggatctcaggg

SEQ ID NO: 6492962 - DNA, 21 bp, Homo sapiens
tggggatcttcccacaggagg

SEQ ID NO: 6492963 - DNA, 22 bp, Homo sapiens
tggggatcttcccacaggaggg

SEQ ID NO: 6492964 - DNA, 19 bp, Homo sapiens
tggggatggagaatgccag

SEQ ID NO: 6492965 - DNA, 15 bp, Homo sapiens
tggggatgggtgggg

SEQ ID NO: 6492966 - DNA, 19 bp, Homo sapiens
tggggatggtgatggagag

SEQ ID NO: 6492967 - DNA, 21 bp, Homo sapiens
tggggatgtaaccaagctgta

SEQ ID NO: 6492968 - DNA, 15 bp, Homo sapiens
tggggatgtgggagg

SEQ ID NO: 6492969 - DNA, 18 bp, Homo sapiens
tggggattcaggggcttt

SEQ ID NO: 6492970 - DNA, 18 bp, Homo sapiens
tggggattcttaaagttg

SEQ ID NO: 6492971 - DNA, 12 bp, Homo sapiens
tggggattcttg

SEQ ID NO: 6492972 - DNA, 15 bp, Homo sapiens
tggggatttctggtc

SEQ ID NO: 6492973 - DNA, 20 bp, Homo sapiens
tggggcaagacagaaaagtg

SEQ ID NO: 6492974 - DNA, 15 bp, Homo sapiens
tggggcaagatccag

SEQ ID NO: 6492975 - DNA, 15 bp, Homo sapiens
tggggcaagccaggg

SEQ ID NO: 6492976 - DNA, 16 bp, Homo sapiens
tggggcaagccagggc

SEQ ID NO: 6492977 - DNA, 20 bp, Homo sapiens
tggggcaagccagggcccag

SEQ ID NO: 6492978 - DNA, 21 bp, Homo sapiens
tggggcaatggggagaggcaa

SEQ ID NO: 6492979 - DNA, 18 bp, Homo sapiens
tggggcacagatgcctgg

SEQ ID NO: 6492980 - DNA, 16 bp, Homo sapiens
tggggcacggctctgg

SEQ ID NO: 6492981 - DNA, 20 bp, Homo sapiens
tggggcacggctctggggta

SEQ ID NO: 6492982 - DNA, 14 bp, Homo sapiens
tggggcactgggcg

SEQ ID NO: 6492983 - DNA, 23 bp, Homo sapiens
tggggcactgggcgtctgactcc

SEQ ID NO: 6492984 - DNA, 16 bp, Homo sapiens
tggggcagaaaggctg

SEQ ID NO: 6492985 - DNA, 17 bp, Homo sapiens
tggggcagaaaggctgc

SEQ ID NO: 6492986 - DNA, 18 bp, Homo sapiens
tggggcagaaatctgagg

SEQ ID NO: 6492987 - DNA, 13 bp, Homo sapiens
tggggcagacaca

SEQ ID NO: 6492988 - DNA, 10 bp, Homo sapiens
tggggcagag

SEQ ID NO: 6492989 - DNA, 22 bp, Homo sapiens
tggggcagagcttctcctgacc

SEQ ID NO: 6492990 - DNA, 14 bp, Homo sapiens
tggggcagaggggc

SEQ ID NO: 6492991 - DNA, 16 bp, Homo sapiens
tggggcagaggggcag

SEQ ID NO: 6492992 - DNA, 21 bp, Homo sapiens
tggggcagagtggagcccagg

SEQ ID NO: 6492993 - DNA, 23 bp, Homo sapiens
tggggcagagtggagcccagggt

SEQ ID NO: 6492994 - DNA, 19 bp, Homo sapiens
tggggcagcacacctctgg

SEQ ID NO: 6492995 - DNA, 18 bp, Homo sapiens
tggggcagcacagagagg

SEQ ID NO: 6492996 - DNA, 22 bp, Homo sapiens
tggggcagcacagagagggggc

SEQ ID NO: 6492997 - DNA, 13 bp, Homo sapiens
tggggcagccgtc

SEQ ID NO: 6492998 - DNA, 13 bp, Homo sapiens
tggggcagcctcc

SEQ ID NO: 6492999 - DNA, 19 bp, Homo sapiens
tggggcagcctccagtctg

SEQ ID NO: 6493000 - DNA, 20 bp, Homo sapiens
tggggcagctcctctgtctc

SEQ ID NO: 6493001 - DNA, 15 bp, Homo sapiens
tggggcagctgagca

SEQ ID NO: 6493002 - DNA, 16 bp, Homo sapiens
tggggcagcttgaggg

SEQ ID NO: 6493003 - DNA, 12 bp, Homo sapiens
tggggcaggacc

SEQ ID NO: 6493004 - DNA, 22 bp, Homo sapiens
tggggcaggaggggagtgaggc

SEQ ID NO: 6493005 - DNA, 19 bp, Homo sapiens
tggggcaggagtagctgag

SEQ ID NO: 6493006 - DNA, 21 bp, Homo sapiens
tggggcaggagtagctgagct

SEQ ID NO: 6493007 - DNA, 21 bp, Homo sapiens
tggggcaggagtgccaggacc

SEQ ID NO: 6493008 - DNA, 23 bp, Homo sapiens
tggggcaggattctctgcagccc

SEQ ID NO: 6493009 - DNA, 12 bp, Homo sapiens
tggggcaggcag

SEQ ID NO: 6493010 - DNA, 18 bp, Homo sapiens
tggggcaggctctctcct

SEQ ID NO: 6493011 - DNA, 17 bp, Homo sapiens
tggggcaggctggctgg

SEQ ID NO: 6493012 - DNA, 14 bp, Homo sapiens
tggggcaggctggg

SEQ ID NO: 6493013 - DNA, 18 bp, Homo sapiens
tggggcaggctgggccat

SEQ ID NO: 6493014 - DNA, 20 bp, Homo sapiens
tggggcaggctgggccatgt

SEQ ID NO: 6493015 - DNA, 14 bp, Homo sapiens
tggggcagggccca

SEQ ID NO: 6493016 - DNA, 19 bp, Homo sapiens
tggggcagggcccagggag

SEQ ID NO: 6493017 - DNA, 21 bp, Homo sapiens
tggggcagggcccagggaggt

SEQ ID NO: 6493018 - DNA, 13 bp, Homo sapiens
tggggcagggcct

SEQ ID NO: 6493019 - DNA, 17 bp, Homo sapiens
tggggcagggcctgggc

SEQ ID NO: 6493020 - DNA, 12 bp, Homo sapiens
tggggcaggggc

SEQ ID NO: 6493021 - DNA, 19 bp, Homo sapiens
tggggcaggggcaggaggg

SEQ ID NO: 6493022 - DNA, 19 bp, Homo sapiens
tggggcaggggcctgggcc

SEQ ID NO: 6493023 - DNA, 20 bp, Homo sapiens
tggggcaggggcctgggccg

SEQ ID NO: 6493024 - DNA, 20 bp, Homo sapiens
tggggcagggggttctggga

SEQ ID NO: 6493025 - DNA, 17 bp, Homo sapiens
tggggcagtagaaggtc

SEQ ID NO: 6493026 - DNA, 20 bp, Homo sapiens
tggggcatagaaactgagga

SEQ ID NO: 6493027 - DNA, 21 bp, Homo sapiens
tggggcatagaaactgaggag

SEQ ID NO: 6493028 - DNA, 19 bp, Homo sapiens
tggggcatccaccttcctg

SEQ ID NO: 6493029 - DNA, 17 bp, Homo sapiens
tggggcatcctggatga

SEQ ID NO: 6493030 - DNA, 21 bp, Homo sapiens
tggggcatggcaaatcagggg

SEQ ID NO: 6493031 - DNA, 24 bp, Homo sapiens
tggggcatggcaaatcaggggcca

SEQ ID NO: 6493032 - DNA, 23 bp, Homo sapiens
tggggcatggttccttccctggg

SEQ ID NO: 6493033 - DNA, 16 bp, Homo sapiens
tggggcatgtgtgcct

SEQ ID NO: 6493034 - DNA, 22 bp, Homo sapiens
tggggcatgtgtgcctgtggca

SEQ ID NO: 6493035 - DNA, 11 bp, Homo sapiens
tggggccaaga

SEQ ID NO: 6493036 - DNA, 14 bp, Homo sapiens
tggggccacagcca

SEQ ID NO: 6493037 - DNA, 15 bp, Homo sapiens
tggggccaccatccc

SEQ ID NO: 6493038 - DNA, 23 bp, Homo sapiens
tggggccagactggctgcacagc

SEQ ID NO: 6493039 - DNA, 16 bp, Homo sapiens
tggggccagatccagc

SEQ ID NO: 6493040 - DNA, 19 bp, Homo sapiens
tggggccagcactggaggg

SEQ ID NO: 6493041 - DNA, 12 bp, Homo sapiens
tggggccagccc

SEQ ID NO: 6493042 - DNA, 13 bp, Homo sapiens
tggggccagcccc

SEQ ID NO: 6493043 - DNA, 13 bp, Homo sapiens
tggggccagcgct

SEQ ID NO: 6493044 - DNA, 12 bp, Homo sapiens
tggggccaggaa

SEQ ID NO: 6493045 - DNA, 16 bp, Homo sapiens
tggggccaggccagga

SEQ ID NO: 6493046 - DNA, 19 bp, Homo sapiens
tggggccaggccaggacca

SEQ ID NO: 6493047 - DNA, 19 bp, Homo sapiens
tggggccaggccccatgga

SEQ ID NO: 6493048 - DNA, 17 bp, Homo sapiens
tggggccagggcagatg

SEQ ID NO: 6493049 - DNA, 21 bp, Homo sapiens
tggggccagttggtccccctt

SEQ ID NO: 6493050 - DNA, 20 bp, Homo sapiens
tggggccattgcttaccttg

SEQ ID NO: 6493051 - DNA, 13 bp, Homo sapiens
tggggcccaaatg

SEQ ID NO: 6493052 - DNA, 14 bp, Homo sapiens
tggggcccagcaca

SEQ ID NO: 6493053 - DNA, 21 bp, Homo sapiens
tggggcccaggaagcccacac

SEQ ID NO: 6493054 - DNA, 12 bp, Homo sapiens
tggggcccagtg

SEQ ID NO: 6493055 - DNA, 13 bp, Homo sapiens
tggggcccagtgc

SEQ ID NO: 6493056 - DNA, 14 bp, Homo sapiens
tggggcccagtgca

SEQ ID NO: 6493057 - DNA, 17 bp, Homo sapiens
tggggcccatggaggag

SEQ ID NO: 6493058 - DNA, 15 bp, Homo sapiens
tggggcccatggccc

SEQ ID NO: 6493059 - DNA, 17 bp, Homo sapiens
tggggcccatggcccca

SEQ ID NO: 6493060 - DNA, 19 bp, Homo sapiens
tggggcccatggccccagc

SEQ ID NO: 6493061 - DNA, 13 bp, Homo sapiens
tggggcccatggg

SEQ ID NO: 6493062 - DNA, 15 bp, Homo sapiens
tggggcccatggggt

SEQ ID NO: 6493063 - DNA, 15 bp, Homo sapiens
tggggccccaaagcc

SEQ ID NO: 6493064 - DNA, 19 bp, Homo sapiens
tggggccccaaagcccagc

SEQ ID NO: 6493065 - DNA, 20 bp, Homo sapiens
tggggccccaaagcccagcc

SEQ ID NO: 6493066 - DNA, 13 bp, Homo sapiens
tggggccccatct

SEQ ID NO: 6493067 - DNA, 17 bp, Homo sapiens
tggggcccccagcaccc

SEQ ID NO: 6493068 - DNA, 16 bp, Homo sapiens
tggggccccgctggga

SEQ ID NO: 6493069 - DNA, 18 bp, Homo sapiens
tggggccccggctcccac

SEQ ID NO: 6493070 - DNA, 17 bp, Homo sapiens
tggggcccctggcccag

SEQ ID NO: 6493071 - DNA, 21 bp, Homo sapiens
tggggcccctttttactcccc

SEQ ID NO: 6493072 - DNA, 22 bp, Homo sapiens
tggggcccctttttactcccct

SEQ ID NO: 6493073 - DNA, 18 bp, Homo sapiens
tggggcccgcctgccacc

SEQ ID NO: 6493074 - DNA, 12 bp, Homo sapiens
tggggccctcta

SEQ ID NO: 6493075 - DNA, 14 bp, Homo sapiens
tggggccctctatg

SEQ ID NO: 6493076 - DNA, 13 bp, Homo sapiens
tggggccctcttg

SEQ ID NO: 6493077 - DNA, 14 bp, Homo sapiens
tggggccctcttgc

SEQ ID NO: 6493078 - DNA, 20 bp, Homo sapiens
tggggccctcttgccagcct

SEQ ID NO: 6493079 - DNA, 16 bp, Homo sapiens
tggggccctgcctcct

SEQ ID NO: 6493080 - DNA, 23 bp, Homo sapiens
tggggccgaaaatgtttttaaag

SEQ ID NO: 6493081 - DNA, 19 bp, Homo sapiens
tggggccgccacggcctgg

SEQ ID NO: 6493082 - DNA, 19 bp, Homo sapiens
tgagccgcccaaggccttc

SEQ ID NO: 6493083 - DNA, 15 bp, Homo sapiens
tgagccgggcccctg

SEQ ID NO: 6493084 - DNA, 16 bp, Homo sapiens
tgagccgggcccctgg

SEQ ID NO: 6493085 - DNA, 19 bp, Homo sapiens
tgagccgggcccctgggct

SEQ ID NO: 6493086 - DNA, 19 bp, Homo sapiens
tgagccggtcaggcacaca

SEQ ID NO: 6493087 - DNA, 19 bp, Homo sapiens
tgagccgtgaactgtgcat

SEQ ID NO: 6493088 - DNA, 17 bp, Homo sapiens
tgagccgtgcagctggg

SEQ ID NO: 6493089 - DNA, 14 bp, Homo sapiens
tgagcctaaaaata

SEQ ID NO: 6493090 - DNA, 17 bp, Homo sapiens
tgagcctaactccctcc

SEQ ID NO: 6493091 - DNA, 16 bp, Homo sapiens
tgagcctacagatgaa

SEQ ID NO: 6493092 - DNA, 14 bp, Homo sapiens
tgagcctactgtct

SEQ ID NO: 6493093 - DNA, 17 bp, Homo sapiens
tgagcctactgtctcct

SEQ ID NO: 6493094 - DNA, 16 bp, Homo sapiens
tgagcctagccctggg

SEQ ID NO: 6493095 - DNA, 13 bp, Homo sapiens
tgagcctatgata

SEQ ID NO: 6493096 - DNA, 14 bp, Homo sapiens
tgagcctcacagca

SEQ ID NO: 6493097 - DNA, 21 bp, Homo sapiens
tgagcctcagcatcctggcac

SEQ ID NO: 6493098 - DNA, 14 bp, Homo sapiens
tgagcctcagtctc

SEQ ID NO: 6493099 - DNA, 16 bp, Homo sapiens
tgagcctccatttctg

SEQ ID NO: 6493100 - DNA, 17 bp, Homo sapiens
tgagcctcccccaaagc

SEQ ID NO: 6493101 - DNA, 17 bp, Homo sapiens
tgagcctcctgtgcctg

SEQ ID NO: 6493102 - DNA, 22 bp, Homo sapiens
tgagcctcctgtgcctggcccc

SEQ ID NO: 6493103 - DNA, 16 bp, Homo sapiens
tgagcctctccttgcc

SEQ ID NO: 6493104 - DNA, 12 bp, Homo sapiens
tgagcctctgct

SEQ ID NO: 6493105 - DNA, 16 bp, Homo sapiens
tgagcctctgctcccc

SEQ ID NO: 6493106 - DNA, 20 bp, Homo sapiens
tgagcctctttaacagcttt

SEQ ID NO: 6493107 - DNA, 15 bp, Homo sapiens
tgagcctctttgtaa

SEQ ID NO: 6493108 - DNA, 16 bp, Homo sapiens
tgagcctgacctttct

SEQ ID NO: 6493109 - DNA, 22 bp, Homo sapiens
tgagcctgacctttctgagtga

SEQ ID NO: 6493110 - DNA, 20 bp, Homo sapiens
tgagcctgccaaagtgcctg

SEQ ID NO: 6493111 - DNA, 23 bp, Homo sapiens
tgagcctgccaaagtgcctggga

SEQ ID NO: 6493112 - DNA, 18 bp, Homo sapiens
tgagcctgccccagctgg

SEQ ID NO: 6493113 - DNA, 22 bp, Homo sapiens
tgagcctgccccagctgggctg

SEQ ID NO: 6493114 - DNA, 18 bp, Homo sapiens
tgagcctgcccgctgcaa

SEQ ID NO: 6493115 - DNA, 11 bp, Homo sapiens
tgagcctggcc

SEQ ID NO: 6493116 - DNA, 13 bp, Homo sapiens
tgagcctggctct

SEQ ID NO: 6493117 - DNA, 17 bp, Homo sapiens
tgagcctggctggcaca

SEQ ID NO: 6493118 - DNA, 17 bp, Homo sapiens
tgagcctggctgtccaa

SEQ ID NO: 6493119 - DNA, 19 bp, Homo sapiens
tgagcctgggaggtcaagg

SEQ ID NO: 6493120 - DNA, 12 bp, Homo sapiens
tgagcctgggcc

SEQ ID NO: 6493121 - DNA, 15 bp, Homo sapiens
tgagcctgggccagg

SEQ ID NO: 6493122 - DNA, 12 bp, Homo sapiens
tgagcctgggct

SEQ ID NO: 6493123 - DNA, 13 bp, Homo sapiens
tgagcctgggctc

SEQ ID NO: 6493124 - DNA, 19 bp, Homo sapiens
tgagcctgtaatcctcagc

SEQ ID NO: 6493125 - DNA, 12 bp, Homo sapiens
tgagcctgtcca

SEQ ID NO: 6493126 - DNA, 12 bp, Homo sapiens
tgagcctgtctc

SEQ ID NO: 6493127 - DNA, 14 bp, Homo sapiens
tgagcctgtctctc

SEQ ID NO: 6493128 - DNA, 12 bp, Homo sapiens
tgagcctgttca

SEQ ID NO: 6493129 - DNA, 21 bp, Homo sapiens
tgagcctgttcattctgatgt

SEQ ID NO: 6493130 - DNA, 12 bp, Homo sapiens
tgagcctgttta

SEQ ID NO: 6493131 - DNA, 15 bp, Homo sapiens
tgagccttagctccc

SEQ ID NO: 6493132 - DNA, 19 bp, Homo sapiens
tgagccttagctcccagct

SEQ ID NO: 6493133 - DNA, 16 bp, Homo sapiens
tgagccttcagagtac

SEQ ID NO: 6493134 - DNA, 20 bp, Homo sapiens
tgagccttcaggccagctgg

SEQ ID NO: 6493135 - DNA, 22 bp, Homo sapiens
tgagccttcaggccagctgggt

SEQ ID NO: 6493136 - DNA, 17 bp, Homo sapiens
tgagccttgaactttga

SEQ ID NO: 6493137 - DNA, 18 bp, Homo sapiens
tgagccttgaactttgac

SEQ ID NO: 6493138 - DNA, 15 bp, Homo sapiens
tgagccttgagagaa

SEQ ID NO: 6493139 - DNA, 14 bp, Homo sapiens
tgagccttgcatgt

SEQ ID NO: 6493140 - DNA, 15 bp, Homo sapiens
tgagccttgctgcca

SEQ ID NO: 6493141 - DNA, 19 bp, Homo sapiens
tgagccttggcccacactg

SEQ ID NO: 6493142 - DNA, 16 bp, Homo sapiens
tgagccttttccctct

SEQ ID NO: 6493143 - DNA, 13 bp, Homo sapiens
tgagcgaaatcat

SEQ ID NO: 6493144 - DNA, 18 bp, Homo sapiens
tgagcgaaattgtcttta

SEQ ID NO: 6493145 - DNA, 17 bp, Homo sapiens
tgagcgaggaaaaacaa

SEQ ID NO: 6493146 - DNA, 23 bp, Homo sapiens
tgagcgaggagatgctccttggg

SEQ ID NO: 6493147 - DNA, 20 bp, Homo sapiens
tgagcgagtggatgctgtgc

SEQ ID NO: 6493148 - DNA, 15 bp, Homo sapiens
tgagcgatcatttat

SEQ ID NO: 6493149 - DNA, 17 bp, Homo sapiens
tgagcgatcatttattt

SEQ ID NO: 6493150 - DNA, 13 bp, Homo sapiens
tgagcgcaagcca

SEQ ID NO: 6493151 - DNA, 18 bp, Homo sapiens
tgagcgcacgcgcgcaca

SEQ ID NO: 6493152 - DNA, 22 bp, Homo sapiens
tgagcgcacgcgcgcacacaca

SEQ ID NO: 6493153 - DNA, 13 bp, Homo sapiens
tgagcgccacctc

SEQ ID NO: 6493154 - DNA, 15 bp, Homo sapiens
tgagcgcccccgagc

SEQ ID NO: 6493155 - DNA, 20 bp, Homo sapiens
tgagcgccccgcccccaccc

SEQ ID NO: 6493156 - DNA, 23 bp, Homo sapiens
tgagcgcctccatccaaggccag

SEQ ID NO: 6493157 - DNA, 22 bp, Homo sapiens
tgagcgctcctgccgcagagct

SEQ ID NO: 6493158 - DNA, 20 bp, Homo sapiens
tgagcgctggctccctgggc

SEQ ID NO: 6493159 - DNA, 13 bp, Homo sapiens
tgagcgctgtgga

SEQ ID NO: 6493160 - DNA, 14 bp, Homo sapiens
tgagcggcaccctg

SEQ ID NO: 6493161 - DNA, 16 bp, Homo sapiens
tgagcggcgcagagcc

SEQ ID NO: 6493162 - DNA, 17 bp, Homo sapiens
tgagcggcgcagagccc

SEQ ID NO: 6493163 - DNA, 16 bp, Homo sapiens
tgagcgggaggcagag

SEQ ID NO: 6493164 - DNA, 13 bp, Homo sapiens
tgagcgggtgggg

SEQ ID NO: 6493165 - DNA, 21 bp, Homo sapiens
tgagcggtgctgtcctcaggt

SEQ ID NO: 6493166 - DNA, 19 bp, Homo sapiens
tgagcgtcaaagaaaatgc

SEQ ID NO: 6493167 - DNA, 16 bp, Homo sapiens
tgagcgtcactgccca

SEQ ID NO: 6493168 - DNA, 17 bp, Homo sapiens
tgagcgtccagaaatgg

SEQ ID NO: 6493169 - DNA, 19 bp, Homo sapiens
tgagcgtcctaaggcatgt

SEQ ID NO: 6493170 - DNA, 15 bp, Homo sapiens
tgagcgtgacactca

SEQ ID NO: 6493171 - DNA, 22 bp, Homo sapiens
tgagcgtgcgcactgcatggga

SEQ ID NO: 6493172 - DNA, 20 bp, Homo sapiens
tgagcgtggaagggggagga

SEQ ID NO: 6493173 - DNA, 20 bp, Homo sapiens
tgagcgtggccttgggagga

SEQ ID NO: 6493174 - DNA, 23 bp, Homo sapiens
tgagcgtggccttgggaggacat

SEQ ID NO: 6493175 - DNA, 22 bp, Homo sapiens
tgagcgtgtagcgtcctgagga

SEQ ID NO: 6493176 - DNA, 16 bp, Homo sapiens
tgagcgtgtccacaga

SEQ ID NO: 6493177 - DNA, 21 bp, Homo sapiens
tgagctaaataaagatattgt

SEQ ID NO: 6493178 - DNA, 16 bp, Homo sapiens
tgagctaagcattttc

SEQ ID NO: 6493179 - DNA, 17 bp, Homo sapiens
tgagctaagcattttct

SEQ ID NO: 6493180 - DNA, 22 bp, Homo sapiens
tgagctaagcattttctcctgt

SEQ ID NO: 6493181 - DNA, 19 bp, Homo sapiens
tgagctacaacaaaaggac

SEQ ID NO: 6493182 - DNA, 15 bp, Homo sapiens
tgagctacaggacaa

SEQ ID NO: 6493183 - DNA, 14 bp, Homo sapiens
tgagctaccaggaa

SEQ ID NO: 6493184 - DNA, 21 bp, Homo sapiens
tgagctaccaggaagaggggc

SEQ ID NO: 6493185 - DNA, 19 bp, Homo sapiens
tgagctactggattcttat

SEQ ID NO: 6493186 - DNA, 17 bp, Homo sapiens
tgagctagaaccctctg

SEQ ID NO: 6493187 - DNA, 18 bp, Homo sapiens
tgagctagaaccctctgt

SEQ ID NO: 6493188 - DNA, 19 bp, Homo sapiens
tgagctagaagctggagga

SEQ ID NO: 6493189 - DNA, 14 bp, Homo sapiens
tgagctaggaattg

SEQ ID NO: 6493190 - DNA, 14 bp, Homo sapiens
tgagctatgactta

SEQ ID NO: 6493191 - DNA, 15 bp, Homo sapiens
tgagctatgacttaa

SEQ ID NO: 6493192 - DNA, 19 bp, Homo sapiens
tgagctatgacttaacata

SEQ ID NO: 6493193 - DNA, 23 bp, Homo sapiens
tgagctatgataagattgaaatt

SEQ ID NO: 6493194 - DNA, 20 bp, Homo sapiens
tgagctatgattatgccact

SEQ ID NO: 6493195 - DNA, 21 bp, Homo sapiens
tgagctatgattatgccactg

SEQ ID NO: 6493196 - DNA, 23 bp, Homo sapiens
tgagctatgattatgccactgct

SEQ ID NO: 6493197 - DNA, 15 bp, Homo sapiens
tgagctattcacctc

SEQ ID NO: 6493198 - DNA, 21 bp, Homo sapiens
tgagctatttccttccagcct

SEQ ID NO: 6493199 - DNA, 16 bp, Homo sapiens
tgagctattttcctct

SEQ ID NO: 6493200 - DNA, 23 bp, Homo sapiens
tgagctattttcctctggccgca

SEQ ID NO: 6493201 - DNA, 20 bp, Homo sapiens
tgagctcaaatctctgttac

SEQ ID NO: 6493202 - DNA, 21 bp, Homo sapiens
tgagctcacatgggactggga

SEQ ID NO: 6493203 - DNA, 16 bp, Homo sapiens
tgagctcagaccccca

SEQ ID NO: 6493204 - DNA, 20 bp, Homo sapiens
tgagctcagacccccactct

SEQ ID NO: 6493205 - DNA, 22 bp, Homo sapiens
tgagctcagacccccactctca

SEQ ID NO: 6493206 - DNA, 12 bp, Homo sapiens
tgagctcagctc

SEQ ID NO: 6493207 - DNA, 13 bp, Homo sapiens
tgagctcagctca

SEQ ID NO: 6493208 - DNA, 11 bp, Homo sapiens
tgagctcagga

SEQ ID NO: 6493209 - DNA, 12 bp, Homo sapiens
tgagctcaggca

SEQ ID NO: 6493210 - DNA, 19 bp, Homo sapiens
tgagctcaggctgagccca

SEQ ID NO: 6493211 - DNA, 15 bp, Homo sapiens
tgagctccaccctcc

SEQ ID NO: 6493212 - DNA, 16 bp, Homo sapiens
tgagctccaccctccc

SEQ ID NO: 6493213 - DNA, 20 bp, Homo sapiens
tgagctccaccctcccctct

SEQ ID NO: 6493214 - DNA, 18 bp, Homo sapiens
tgagctccacctctggtg

SEQ ID NO: 6493215 - DNA, 19 bp, Homo sapiens
tgagctccacctctggtgg

SEQ ID NO: 6493216 - DNA, 15 bp, Homo sapiens
tgagctccagacccc

SEQ ID NO: 6493217 - DNA, 20 bp, Homo sapiens
tgagctcccacaagcctgag

SEQ ID NO: 6493218 - DNA, 21 bp, Homo sapiens
tgagctcccacaagcctgagg

SEQ ID NO: 6493219 - DNA, 22 bp, Homo sapiens
tgagctcccacctcccttccca

SEQ ID NO: 6493220 - DNA, 21 bp, Homo sapiens
tgagctcccaggtgcagccag

SEQ ID NO: 6493221 - DNA, 20 bp, Homo sapiens
tgagctccccaatccaaccc

SEQ ID NO: 6493222 - DNA, 17 bp, Homo sapiens
tgagctcccctggagcc

SEQ ID NO: 6493223 - DNA, 19 bp, Homo sapiens
tgagctcccctggagccag

SEQ ID NO: 6493224 - DNA, 18 bp, Homo sapiens
tgagctccctcgctgtat

SEQ ID NO: 6493225 - DNA, 16 bp, Homo sapiens
tgagctcctctgggca

SEQ ID NO: 6493226 - DNA, 18 bp, Homo sapiens
tgagctcctctgggcagg

SEQ ID NO: 6493227 - DNA, 20 bp, Homo sapiens
tgagctcctgatcagaggca

SEQ ID NO: 6493228 - DNA, 12 bp, Homo sapiens
tgagctcctgcg

SEQ ID NO: 6493229 - DNA, 18 bp, Homo sapiens
tgagctcctgctcattgt

SEQ ID NO: 6493230 - DNA, 19 bp, Homo sapiens
tgagctccttaaggctctt

SEQ ID NO: 6493231 - DNA, 15 bp, Homo sapiens
tgagctcgcagcccc

SEQ ID NO: 6493232 - DNA, 20 bp, Homo sapiens
tgagctcgcagcccccgcgc

SEQ ID NO: 6493233 - DNA, 18 bp, Homo sapiens
tgagctcggggacaggtg

SEQ ID NO: 6493234 - DNA, 20 bp, Homo sapiens
tgagctcggggtccaccagt

SEQ ID NO: 6493235 - DNA, 22 bp, Homo sapiens
tgagctcggggtccaccagtgt

SEQ ID NO: 6493236 - DNA, 14 bp, Homo sapiens
tgagctcggtggac

SEQ ID NO: 6493237 - DNA, 21 bp, Homo sapiens
tgagctcggtggacccaggga

SEQ ID NO: 6493238 - DNA, 17 bp, Homo sapiens
tgagctctacccagggc

SEQ ID NO: 6493239 - DNA, 22 bp, Homo sapiens
tgagctctacccagggcctgca

SEQ ID NO: 6493240 - DNA, 20 bp, Homo sapiens
tgagctctattatgaatgtg

SEQ ID NO: 6493241 - DNA, 15 bp, Homo sapiens
tgagctctcaggccg

SEQ ID NO: 6493242 - DNA, 17 bp, Homo sapiens
tgagctctcaggccgag

SEQ ID NO: 6493243 - DNA, 21 bp, Homo sapiens
tgagctctcaggccgagagcc

SEQ ID NO: 6493244 - DNA, 21 bp, Homo sapiens
tgagctctccaggccaggtgg

SEQ ID NO: 6493245 - DNA, 16 bp, Homo sapiens
tgagctctcggaactg

SEQ ID NO: 6493246 - DNA, 19 bp, Homo sapiens
tgagctctctaatagaagt

SEQ ID NO: 6493247 - DNA, 13 bp, Homo sapiens
tgagctctctcag

SEQ ID NO: 6493248 - DNA, 14 bp, Homo sapiens
tgagctctctcaga

SEQ ID NO: 6493249 - DNA, 23 bp, Homo sapiens
tgagctctgagaggccctggatc

SEQ ID NO: 6493250 - DNA, 23 bp, Homo sapiens
tgagctctgcatttgtctattct

SEQ ID NO: 6493251 - DNA, 12 bp, Homo sapiens
tgagctctgcct

SEQ ID NO: 6493252 - DNA, 18 bp, Homo sapiens
tgagctctgcctcaactc

SEQ ID NO: 6493253 - DNA, 15 bp, Homo sapiens
tgagctcttcatgtt

SEQ ID NO: 6493254 - DNA, 16 bp, Homo sapiens
tgagctcttcatgttt

SEQ ID NO: 6493255 - DNA, 18 bp, Homo sapiens
tgagctcttcatgtttca

SEQ ID NO: 6493256 - DNA, 12 bp, Homo sapiens
tgagctcttccc

SEQ ID NO: 6493257 - DNA, 13 bp, Homo sapiens
tgagctcttccct

SEQ ID NO: 6493258 - DNA, 16 bp, Homo sapiens
tgagctcttgctatct

SEQ ID NO: 6493259 - DNA, 15 bp, Homo sapiens
tgagctcttggcagg

SEQ ID NO: 6493260 - DNA, 23 bp, Homo sapiens
tgagctgaacacatttgcccaat

SEQ ID NO: 6493261 - DNA, 15 bp, Homo sapiens
tggggccgcctgccc

SEQ ID NO: 6493262 - DNA, 16 bp, Homo sapiens
tggggccgcctgccct

SEQ ID NO: 6493263 - DNA, 23 bp, Homo sapiens
tggggccgcctgccctgccttgc

SEQ ID NO: 6493264 - DNA, 15 bp, Homo sapiens
tggggccgctggggt

SEQ ID NO: 6493265 - DNA, 16 bp, Homo sapiens
tggggccgctggggtc

SEQ ID NO: 6493266 - DNA, 15 bp, Homo sapiens
tggggccggagcctt

SEQ ID NO: 6493267 - DNA, 18 bp, Homo sapiens
tggggccggcggggccca

SEQ ID NO: 6493268 - DNA, 21 bp, Homo sapiens
tggggcctaataaaactgatg

SEQ ID NO: 6493269 - DNA, 21 bp, Homo sapiens
tggggcctagcgatctctcct

SEQ ID NO: 6493270 - DNA, 19 bp, Homo sapiens
tggggcctatcagtgtgcc

SEQ ID NO: 6493271 - DNA, 13 bp, Homo sapiens
tggggcctcaaga

SEQ ID NO: 6493272 - DNA, 20 bp, Homo sapiens
tggggcctcaatctaaggcc

SEQ ID NO: 6493273 - DNA, 23 bp, Homo sapiens
tggggcctcaatctaaggccttc

SEQ ID NO: 6493274 - DNA, 17 bp, Homo sapiens
tggggcctcagcctggg

SEQ ID NO: 6493275 - DNA, 18 bp, Homo sapiens
tggggcctcagcctgggg

SEQ ID NO: 6493276 - DNA, 19 bp, Homo sapiens
tggggcctcagcctggggc

SEQ ID NO: 6493277 - DNA, 21 bp, Homo sapiens
tggggcctcagcctggggctc

SEQ ID NO: 6493278 - DNA, 20 bp, Homo sapiens
tggggcctccagaactcact

SEQ ID NO: 6493279 - DNA, 11 bp, Homo sapiens
tggggcctctg

SEQ ID NO: 6493280 - DNA, 14 bp, Homo sapiens
tggggcctgagaga

SEQ ID NO: 6493281 - DNA, 16 bp, Homo sapiens
tggggcctgagagaat

SEQ ID NO: 6493282 - DNA, 18 bp, Homo sapiens
tggggcctgagagaattg

SEQ ID NO: 6493283 - DNA, 14 bp, Homo sapiens
tggggcctgcgggg

SEQ ID NO: 6493284 - DNA, 16 bp, Homo sapiens
tggggcctggacctgc

SEQ ID NO: 6493285 - DNA, 19 bp, Homo sapiens
tggggcctggacctgcctc

SEQ ID NO: 6493286 - DNA, 15 bp, Homo sapiens
tggggcctggagagg

SEQ ID NO: 6493287 - DNA, 19 bp, Homo sapiens
tggggcctggagaggggcc

SEQ ID NO: 6493288 - DNA, 12 bp, Homo sapiens
tggggcctggca

SEQ ID NO: 6493289 - DNA, 13 bp, Homo sapiens
tggggcctggcct

SEQ ID NO: 6493290 - DNA, 15 bp, Homo sapiens
tggggcctggcctat

SEQ ID NO: 6493291 - DNA, 23 bp, Homo sapiens
tggggcctggcctatttaagccc

SEQ ID NO: 6493292 - DNA, 12 bp, Homo sapiens
tggggcctggct

SEQ ID NO: 6493293 - DNA, 13 bp, Homo sapiens
tggggcctggctt

SEQ ID NO: 6493294 - DNA, 21 bp, Homo sapiens
tggggcctggcttgctccagg

SEQ ID NO: 6493295 - DNA, 11 bp, Homo sapiens
tggggcctggg

SEQ ID NO: 6493296 - DNA, 22 bp, Homo sapiens
tggggcctgggacaactgctcc

SEQ ID NO: 6493297 - DNA, 22 bp, Homo sapiens
tggggcctgggagggttcccct

SEQ ID NO: 6493298 - DNA, 15 bp, Homo sapiens
tggggcctgggctgt

SEQ ID NO: 6493299 - DNA, 19 bp, Homo sapiens
tggggcctgtactgcctgc

SEQ ID NO: 6493300 - DNA, 20 bp, Homo sapiens
tggggcctgtactgcctgct

SEQ ID NO: 6493301 - DNA, 14 bp, Homo sapiens
tggggcctgtggaa

SEQ ID NO: 6493302 - DNA, 16 bp, Homo sapiens
tggggcctgtggaatg

SEQ ID NO: 6493303 - DNA, 18 bp, Homo sapiens
tggggccttgatgactgc

SEQ ID NO: 6493304 - DNA, 20 bp, Homo sapiens
tggggccttgatgactgcct

SEQ ID NO: 6493305 - DNA, 13 bp, Homo sapiens
tggggcctttgcc

SEQ ID NO: 6493306 - DNA, 18 bp, Homo sapiens
tggggcctttgccagcag

SEQ ID NO: 6493307 - DNA, 22 bp, Homo sapiens
tggggcctttgccagcagagcc

SEQ ID NO: 6493308 - DNA, 19 bp, Homo sapiens
tggggcgaggcagaggaca

SEQ ID NO: 6493309 - DNA, 14 bp, Homo sapiens
tggggcgaggcagg

SEQ ID NO: 6493310 - DNA, 16 bp, Homo sapiens
tggggcgcgtgaggcc

SEQ ID NO: 6493311 - DNA, 17 bp, Homo sapiens
tggggcgggaaagccag

SEQ ID NO: 6493312 - DNA, 22 bp, Homo sapiens
tggggcgggggtctatacattc

SEQ ID NO: 6493313 - DNA, 19 bp, Homo sapiens
tggggcggtgtgtgtgcca

SEQ ID NO: 6493314 - DNA, 16 bp, Homo sapiens
tggggcgtgcagcagg

SEQ ID NO: 6493315 - DNA, 16 bp, Homo sapiens
tggggctaaatgaagt

SEQ ID NO: 6493316 - DNA, 23 bp, Homo sapiens
tggggctacagaatagggtggca

SEQ ID NO: 6493317 - DNA, 19 bp, Homo sapiens
tggggctactgtttcagtc

SEQ ID NO: 6493318 - DNA, 15 bp, Homo sapiens
tggggctagactggg

SEQ ID NO: 6493319 - DNA, 18 bp, Homo sapiens
tggggctaggggctgggg

SEQ ID NO: 6493320 - DNA, 20 bp, Homo sapiens
tggggctaggggctggggcc

SEQ ID NO: 6493321 - DNA, 17 bp, Homo sapiens
tggggctcacacacctg

SEQ ID NO: 6493322 - DNA, 20 bp, Homo sapiens
tggggctcacttttcatcct

SEQ ID NO: 6493323 - DNA, 21 bp, Homo sapiens
tggggctcagccacagcctga

SEQ ID NO: 6493324 - DNA, 13 bp, Homo sapiens
tggggctcccagc

SEQ ID NO: 6493325 - DNA, 20 bp, Homo sapiens
tggggctcccagccaggccc

SEQ ID NO: 6493326 - DNA, 21 bp, Homo sapiens
tggggctcccagccaggccct

SEQ ID NO: 6493327 - DNA, 15 bp, Homo sapiens
tggggctcccgcctc

SEQ ID NO: 6493328 - DNA, 20 bp, Homo sapiens
tggggctcccggcatcctga

SEQ ID NO: 6493329 - DNA, 22 bp, Homo sapiens
tggggctcccggcatcctgaaa

SEQ ID NO: 6493330 - DNA, 14 bp, Homo sapiens
tggggctccctctc

SEQ ID NO: 6493331 - DNA, 10 bp, Homo sapiens
tggggctcct

SEQ ID NO: 6493332 - DNA, 11 bp, Homo sapiens
tggggctccta

SEQ ID NO: 6493333 - DNA, 13 bp, Homo sapiens
tggggctcctacc

SEQ ID NO: 6493334 - DNA, 14 bp, Homo sapiens
tggggctcctacct

SEQ ID NO: 6493335 - DNA, 18 bp, Homo sapiens
tggggctcctacctgggg

SEQ ID NO: 6493336 - DNA, 16 bp, Homo sapiens
tggggctcctgggagg

SEQ ID NO: 6493337 - DNA, 11 bp, Homo sapiens
tggggctcctt

SEQ ID NO: 6493338 - DNA, 22 bp, Homo sapiens
tggggctccttctccaccccag

SEQ ID NO: 6493339 - DNA, 16 bp, Homo sapiens
tggggctcctttcccc

SEQ ID NO: 6493340 - DNA, 15 bp, Homo sapiens
tggggctcgtggcct

SEQ ID NO: 6493341 - DNA, 20 bp, Homo sapiens
tggggctctaacgcctgagc

SEQ ID NO: 6493342 - DNA, 13 bp, Homo sapiens
tggggctctggga

SEQ ID NO: 6493343 - DNA, 15 bp, Homo sapiens
tggggctctgtgcag

SEQ ID NO: 6493344 - DNA, 17 bp, Homo sapiens
tggggctctgtgcaggg

SEQ ID NO: 6493345 - DNA, 10 bp, Homo sapiens
tggggctctt

SEQ ID NO: 6493346 - DNA, 20 bp, Homo sapiens
tggggctgaacatgcctgcc

SEQ ID NO: 6493347 - DNA, 23 bp, Homo sapiens
tggggctgaccttcctcgcagag

SEQ ID NO: 6493348 - DNA, 17 bp, Homo sapiens
tggggctgagagtgggg

SEQ ID NO: 6493349 - DNA, 24 bp, Homo sapiens
tggggctgagccctcctgagggcc

SEQ ID NO: 6493350 - DNA, 15 bp, Homo sapiens
tggggctgagcctga

SEQ ID NO: 6493351 - DNA, 16 bp, Homo sapiens
tggggctgagcctgag

SEQ ID NO: 6493352 - DNA, 17 bp, Homo sapiens
tggggctgagcctgagg

SEQ ID NO: 6493353 - DNA, 19 bp, Homo sapiens
tggggctgagcctgaggcc

SEQ ID NO: 6493354 - DNA, 18 bp, Homo sapiens
tggggctgagtgcagagg

SEQ ID NO: 6493355 - DNA, 19 bp, Homo sapiens
tggggctgatctcagggaa

SEQ ID NO: 6493356 - DNA, 21 bp, Homo sapiens
tggggctgatctcagggaagc

SEQ ID NO: 6493357 - DNA, 17 bp, Homo sapiens
tggggctgatgaagaag

SEQ ID NO: 6493358 - DNA, 20 bp, Homo sapiens
tggggctgcaccggctggcc

SEQ ID NO: 6493359 - DNA, 16 bp, Homo sapiens
tggggctgcaggcagg

SEQ ID NO: 6493360 - DNA, 20 bp, Homo sapiens
tggggctgcagttggtctcc

SEQ ID NO: 6493361 - DNA, 14 bp, Homo sapiens
tggggctgccctcg

SEQ ID NO: 6493362 - DNA, 22 bp, Homo sapiens
tggggctgcgaaaacgttgacc

SEQ ID NO: 6493363 - DNA, 23 bp, Homo sapiens
tggggctgcgaaaacgttgaccc

SEQ ID NO: 6493364 - DNA, 12 bp, Homo sapiens
tggggctgctcc

SEQ ID NO: 6493365 - DNA, 18 bp, Homo sapiens
tggggctggaagcagaaa

SEQ ID NO: 6493366 - DNA, 20 bp, Homo sapiens
tggggctggcaccagcaggc

SEQ ID NO: 6493367 - DNA, 15 bp, Homo sapiens
tggggctggcatcaa

SEQ ID NO: 6493368 - DNA, 13 bp, Homo sapiens
tggggctggcccc

SEQ ID NO: 6493369 - DNA, 18 bp, Homo sapiens
tggggctggcttttctgt

SEQ ID NO: 6493370 - DNA, 12 bp, Homo sapiens
tggggctgggca

SEQ ID NO: 6493371 - DNA, 19 bp, Homo sapiens
tggggctggggaaggaagc

SEQ ID NO: 6493372 - DNA, 20 bp, Homo sapiens
tggggctggggcctggaggc

SEQ ID NO: 6493373 - DNA, 16 bp, Homo sapiens
tggggctgggggatgg

SEQ ID NO: 6493374 - DNA, 20 bp, Homo sapiens
tggggctgggggccagctcc

SEQ ID NO: 6493375 - DNA, 18 bp, Homo sapiens
tggggctggggggcaccc

SEQ ID NO: 6493376 - DNA, 13 bp, Homo sapiens
tggggctggggtg

SEQ ID NO: 6493377 - DNA, 19 bp, Homo sapiens
tggggctgggtccaccctg

SEQ ID NO: 6493378 - DNA, 18 bp, Homo sapiens
tggggctggtcctgggag

SEQ ID NO: 6493379 - DNA, 19 bp, Homo sapiens
tggggctggtcctgggagc

SEQ ID NO: 6493380 - DNA, 17 bp, Homo sapiens
tggggctggtgaggccg

SEQ ID NO: 6493381 - DNA, 13 bp, Homo sapiens
tggggctggtggg

SEQ ID NO: 6493382 - DNA, 12 bp, Homo sapiens
tggggctggttt

SEQ ID NO: 6493383 - DNA, 23 bp, Homo sapiens
tggggctgtatttttgaaatact

SEQ ID NO: 6493384 - DNA, 16 bp, Homo sapiens
tggggctgtcctgctg

SEQ ID NO: 6493385 - DNA, 20 bp, Homo sapiens
tggggctgtcctgctgccct

SEQ ID NO: 6493386 - DNA, 15 bp, Homo sapiens
tggggcttaatgaag

SEQ ID NO: 6493387 - DNA, 14 bp, Homo sapiens
tggggcttatcaga

SEQ ID NO: 6493388 - DNA, 13 bp, Homo sapiens
tggggcttcctgg

SEQ ID NO: 6493389 - DNA, 17 bp, Homo sapiens
tggggcttcctgggcag

SEQ ID NO: 6493390 - DNA, 15 bp, Homo sapiens
tggggcttctcctga

SEQ ID NO: 6493391 - DNA, 18 bp, Homo sapiens
tggggcttctcctgaccc

SEQ ID NO: 6493392 - DNA, 15 bp, Homo sapiens
tggggcttctctggg

SEQ ID NO: 6493393 - DNA, 12 bp, Homo sapiens
tggggcttctgt

SEQ ID NO: 6493394 - DNA, 19 bp, Homo sapiens
tggggcttctttctgctgg

SEQ ID NO: 6493395 - DNA, 23 bp, Homo sapiens
tggggcttctttctgctggctga

SEQ ID NO: 6493396 - DNA, 22 bp, Homo sapiens
tggggcttgaatttgcatgtct

SEQ ID NO: 6493397 - DNA, 14 bp, Homo sapiens
tggggcttgccagg

SEQ ID NO: 6493398 - DNA, 22 bp, Homo sapiens
tggggcttggaagggcgctgag

SEQ ID NO: 6493399 - DNA, 12 bp, Homo sapiens
tggggcttggcg

SEQ ID NO: 6493400 - DNA, 22 bp, Homo sapiens
tggggcttggggattgccacta

SEQ ID NO: 6493401 - DNA, 14 bp, Homo sapiens
tggggctttcccta

SEQ ID NO: 6493402 - DNA, 18 bp, Homo sapiens
tggggctttgccttgcag

SEQ ID NO: 6493403 - DNA, 20 bp, Homo sapiens
tggggcttttgtgccaggag

SEQ ID NO: 6493404 - DNA, 13 bp, Homo sapiens
tgggggaaaaaaa

SEQ ID NO: 6493405 - DNA, 19 bp, Homo sapiens
tgggggaaaaaaaagaaaa

SEQ ID NO: 6493406 - DNA, 15 bp, Homo sapiens
tgggggaaagcaaag

SEQ ID NO: 6493407 - DNA, 17 bp, Homo sapiens
tgggggaaagcaaagca

SEQ ID NO: 6493408 - DNA, 15 bp, Homo sapiens
tgggggaaagcacag

SEQ ID NO: 6493409 - DNA, 17 bp, Homo sapiens
tgggggaaatggtgcct

SEQ ID NO: 6493410 - DNA, 17 bp, Homo sapiens
tgggggaacagatgcta

SEQ ID NO: 6493411 - DNA, 17 bp, Homo sapiens
tgggggaagacctggca

SEQ ID NO: 6493412 - DNA, 11 bp, Homo sapiens
tgggggaagat

SEQ ID NO: 6493413 - DNA, 15 bp, Homo sapiens
tgggggaagccctgg

SEQ ID NO: 6493414 - DNA, 16 bp, Homo sapiens
tgggggaaggcgctgg

SEQ ID NO: 6493415 - DNA, 21 bp, Homo sapiens
tgggggaaggggaggagggga

SEQ ID NO: 6493416 - DNA, 20 bp, Homo sapiens
tgggggacactgtggcagca

SEQ ID NO: 6493417 - DNA, 23 bp, Homo sapiens
tgggggacatgctaaataactat

SEQ ID NO: 6493418 - DNA, 11 bp, Homo sapiens
tgggggacctt

SEQ ID NO: 6493419 - DNA, 19 bp, Homo sapiens
tgggggactccttccttga

SEQ ID NO: 6493420 - DNA, 22 bp, Homo sapiens
tgggggactgctttcagtgcct

SEQ ID NO: 6493421 - DNA, 12 bp, Homo sapiens
tgggggactggg

SEQ ID NO: 6493422 - DNA, 16 bp, Homo sapiens
tgggggactgtaagtt

SEQ ID NO: 6493423 - DNA, 21 bp, Homo sapiens
tgggggacttacatgattcat

SEQ ID NO: 6493424 - DNA, 15 bp, Homo sapiens
tgggggagagaggca

SEQ ID NO: 6493425 - DNA, 19 bp, Homo sapiens
tgggggagagcaggctggc

SEQ ID NO: 6493426 - DNA, 17 bp, Homo sapiens
tgggggagaggggagac

SEQ ID NO: 6493427 - DNA, 16 bp, Homo sapiens
tgggggagagggggag

SEQ ID NO: 6493428 - DNA, 20 bp, Homo sapiens
tgggggagcctctggaatgc

SEQ ID NO: 6493429 - DNA, 14 bp, Homo sapiens
tgggggagcctgga

SEQ ID NO: 6493430 - DNA, 21 bp, Homo sapiens
tgggggaggagcctctggctt

SEQ ID NO: 6493431 - DNA, 16 bp, Homo sapiens
tgggggaggcagggct

SEQ ID NO: 6493432 - DNA, 17 bp, Homo sapiens
tgggggaggcagggctg

SEQ ID NO: 6493433 - DNA, 13 bp, Homo sapiens
tgggggaggctct

SEQ ID NO: 6493434 - DNA, 14 bp, Homo sapiens
tgggggaggctctg

SEQ ID NO: 6493435 - DNA, 15 bp, Homo sapiens
tgggggaggctctga

SEQ ID NO: 6493436 - DNA, 21 bp, Homo sapiens
tgggggaggcttccagctcag

SEQ ID NO: 6493437 - DNA, 15 bp, Homo sapiens
tgggggagggaaagg

SEQ ID NO: 6493438 - DNA, 20 bp, Homo sapiens
tgggggagggaaagggaggg

SEQ ID NO: 6493439 - DNA, 12 bp, Homo sapiens
tgggggagggag

SEQ ID NO: 6493440 - DNA, 11 bp, Homo sapiens
tgggggagggc

SEQ ID NO: 6493441 - DNA, 14 bp, Homo sapiens
tgagctgaagaaat

SEQ ID NO: 6493442 - DNA, 15 bp, Homo sapiens
tgagctgaagacaaa

SEQ ID NO: 6493443 - DNA, 18 bp, Homo sapiens
tgagctgaaggtgaaaca

SEQ ID NO: 6493444 - DNA, 19 bp, Homo sapiens
tgagctgagatcgtgccgt

SEQ ID NO: 6493445 - DNA, 13 bp, Homo sapiens
tgagctgagcagg

SEQ ID NO: 6493446 - DNA, 14 bp, Homo sapiens
tgagctgagcaggc

SEQ ID NO: 6493447 - DNA, 14 bp, Homo sapiens
tgagctgagccagg

SEQ ID NO: 6493448 - DNA, 15 bp, Homo sapiens
tgagctgagccaggc

SEQ ID NO: 6493449 - DNA, 16 bp, Homo sapiens
tgagctgatataaatt

SEQ ID NO: 6493450 - DNA, 17 bp, Homo sapiens
tgagctgatataaattc

SEQ ID NO: 6493451 - DNA, 16 bp, Homo sapiens
tgagctgatctgcgga

SEQ ID NO: 6493452 - DNA, 12 bp, Homo sapiens
tgagctgcagcc

SEQ ID NO: 6493453 - DNA, 16 bp, Homo sapiens
tgagctgcagcctggc

SEQ ID NO: 6493454 - DNA, 20 bp, Homo sapiens
tgagctgcagcctggctggt

SEQ ID NO: 6493455 - DNA, 12 bp, Homo sapiens
tgagctgcaggt

SEQ ID NO: 6493456 - DNA, 16 bp, Homo sapiens
tgagctgccagaatca

SEQ ID NO: 6493457 - DNA, 20 bp, Homo sapiens
tgagctgcctccagcctggt

SEQ ID NO: 6493458 - DNA, 22 bp, Homo sapiens
tgagctgcctccagcctggtgg

SEQ ID NO: 6493459 - DNA, 16 bp, Homo sapiens
tgagctgcctgctctg

SEQ ID NO: 6493460 - DNA, 21 bp, Homo sapiens
tgagctgcctgctctgcagcc

SEQ ID NO: 6493461 - DNA, 20 bp, Homo sapiens
tgagctgcctgtaacttgag

SEQ ID NO: 6493462 - DNA, 12 bp, Homo sapiens
tgagctgccttc

SEQ ID NO: 6493463 - DNA, 16 bp, Homo sapiens
tgagctgccttcccta

SEQ ID NO: 6493464 - DNA, 19 bp, Homo sapiens
tgagctgctgactgccaat

SEQ ID NO: 6493465 - DNA, 13 bp, Homo sapiens
tgagctgctgtgc

SEQ ID NO: 6493466 - DNA, 18 bp, Homo sapiens
tgagctgctgtgcccagc

SEQ ID NO: 6493467 - DNA, 22 bp, Homo sapiens
tgagctgcttcactagggaatc

SEQ ID NO: 6493468 - DNA, 22 bp, Homo sapiens
tgagctggaaaggatgcttctg

SEQ ID NO: 6493469 - DNA, 23 bp, Homo sapiens
tgagctggaaaggatgcttctgc

SEQ ID NO: 6493470 - DNA, 21 bp, Homo sapiens
tgagctggaaggagtgagagg

SEQ ID NO: 6493471 - DNA, 18 bp, Homo sapiens
tgagctggacctcaccaa

SEQ ID NO: 6493472 - DNA, 22 bp, Homo sapiens
tgagctggagctaaggccagct

SEQ ID NO: 6493473 - DNA, 21 bp, Homo sapiens
tgagctggatagacttgggat

SEQ ID NO: 6493474 - DNA, 15 bp, Homo sapiens
tgagctggcaaccag

SEQ ID NO: 6493475 - DNA, 20 bp, Homo sapiens
tgagctggcaaccagccagc

SEQ ID NO: 6493476 - DNA, 17 bp, Homo sapiens
tgagctggcctcacctg

SEQ ID NO: 6493477 - DNA, 12 bp, Homo sapiens
tgagctggcctg

SEQ ID NO: 6493478 - DNA, 14 bp, Homo sapiens
tgagctggctgact

SEQ ID NO: 6493479 - DNA, 12 bp, Homo sapiens
tgagctgggaag

SEQ ID NO: 6493480 - DNA, 13 bp, Homo sapiens
tgagctgggaggg

SEQ ID NO: 6493481 - DNA, 14 bp, Homo sapiens
tgagctgggcatgg

SEQ ID NO: 6493482 - DNA, 21 bp, Homo sapiens
tgagctgggccctgggtgagg

SEQ ID NO: 6493483 - DNA, 19 bp, Homo sapiens
tgagctggggactcaggga

SEQ ID NO: 6493484 - DNA, 12 bp, Homo sapiens
tgagctggggag

SEQ ID NO: 6493485 - DNA, 20 bp, Homo sapiens
tgagctggggatgtctctca

SEQ ID NO: 6493486 - DNA, 12 bp, Homo sapiens
tgagctggggcc

SEQ ID NO: 6493487 - DNA, 20 bp, Homo sapiens
tgagctggggcctggagagg

SEQ ID NO: 6493488 - DNA, 23 bp, Homo sapiens
tgagctggggtgggagctcctcc

SEQ ID NO: 6493489 - DNA, 16 bp, Homo sapiens
tgagctggtgcctgct

SEQ ID NO: 6493490 - DNA, 13 bp, Homo sapiens
tgagctggttttc

SEQ ID NO: 6493491 - DNA, 15 bp, Homo sapiens
tgagctggttttctc

SEQ ID NO: 6493492 - DNA, 24 bp, Homo sapiens
tgagctggttttctctgatggcac

SEQ ID NO: 6493493 - DNA, 12 bp, Homo sapiens
tgagctgtcact

SEQ ID NO: 6493494 - DNA, 14 bp, Homo sapiens
tgagctgtcccaag

SEQ ID NO: 6493495 - DNA, 22 bp, Homo sapiens
tgagctgtcccaagtcctccgg

SEQ ID NO: 6493496 - DNA, 21 bp, Homo sapiens
tgagctgtctgaagcccaaag

SEQ ID NO: 6493497 - DNA, 16 bp, Homo sapiens
tgagctgtgccagctg

SEQ ID NO: 6493498 - DNA, 22 bp, Homo sapiens
tgagctgtgttttgtctgagcc

SEQ ID NO: 6493499 - DNA, 13 bp, Homo sapiens
tgagctgttatct

SEQ ID NO: 6493500 - DNA, 12 bp, Homo sapiens
tgagctgttgga

SEQ ID NO: 6493501 - DNA, 11 bp, Homo sapiens
tgagctgtttt

SEQ ID NO: 6493502 - DNA, 20 bp, Homo sapiens
tgagcttaaaatacaagact

SEQ ID NO: 6493503 - DNA, 18 bp, Homo sapiens
tgagcttaaataacaaaa

SEQ ID NO: 6493504 - DNA, 18 bp, Homo sapiens
tgagcttacattgaaaac

SEQ ID NO: 6493505 - DNA, 17 bp, Homo sapiens
tgagcttacgtagttct

SEQ ID NO: 6493506 - DNA, 21 bp, Homo sapiens
tgagcttagccttgtgccctg

SEQ ID NO: 6493507 - DNA, 22 bp, Homo sapiens
tgagcttagccttgtgccctgc

SEQ ID NO: 6493508 - DNA, 20 bp, Homo sapiens
tgagcttagctctgccctgg

SEQ ID NO: 6493509 - DNA, 15 bp, Homo sapiens
tgagcttatcatgct

SEQ ID NO: 6493510 - DNA, 16 bp, Homo sapiens
tgagcttcaaaatgag

SEQ ID NO: 6493511 - DNA, 15 bp, Homo sapiens
tgagcttcaatataa

SEQ ID NO: 6493512 - DNA, 21 bp, Homo sapiens
tgagcttcaatataagaagca

SEQ ID NO: 6493513 - DNA, 19 bp, Homo sapiens
tgagcttcggttctccaga

SEQ ID NO: 6493514 - DNA, 18 bp, Homo sapiens
tgagcttctattaaatgt

SEQ ID NO: 6493515 - DNA, 14 bp, Homo sapiens
tgagcttctgagac

SEQ ID NO: 6493516 - DNA, 14 bp, Homo sapiens
tgagcttgagagtt

SEQ ID NO: 6493517 - DNA, 14 bp, Homo sapiens
tgagcttgagctcc

SEQ ID NO: 6493518 - DNA, 21 bp, Homo sapiens
tgagcttgattctaaagggga

SEQ ID NO: 6493519 - DNA, 18 bp, Homo sapiens
tgagcttgcctaaaattc

SEQ ID NO: 6493520 - DNA, 15 bp, Homo sapiens
tgagcttgctggaga

SEQ ID NO: 6493521 - DNA, 20 bp, Homo sapiens
tgagcttggcagctgaacta

SEQ ID NO: 6493522 - DNA, 21 bp, Homo sapiens
tgagcttggccagaagggggc

SEQ ID NO: 6493523 - DNA, 24 bp, Homo sapiens
tgagcttgtcttttctgctgagga

SEQ ID NO: 6493524 - DNA, 20 bp, Homo sapiens
tgagctttccatgttgctgc

SEQ ID NO: 6493525 - DNA, 17 bp, Homo sapiens
tgagctttccggggagg

SEQ ID NO: 6493526 - DNA, 19 bp, Homo sapiens
tgagctttccggggaggag

SEQ ID NO: 6493527 - DNA, 18 bp, Homo sapiens
tgagctttctgaacagct

SEQ ID NO: 6493528 - DNA, 19 bp, Homo sapiens
tgagctttctgaacagctg

SEQ ID NO: 6493529 - DNA, 20 bp, Homo sapiens
tgagctttctgaacagctgg

SEQ ID NO: 6493530 - DNA, 15 bp, Homo sapiens
tgagctttgctgcta

SEQ ID NO: 6493531 - DNA, 15 bp, Homo sapiens
tgagctttggacaca

SEQ ID NO: 6493532 - DNA, 22 bp, Homo sapiens
tgagctttggacacacacagct

SEQ ID NO: 6493533 - DNA, 23 bp, Homo sapiens
tgagctttggacacacacagctt

SEQ ID NO: 6493534 - DNA, 22 bp, Homo sapiens
tgagctttggacgcacacagct

SEQ ID NO: 6493535 - DNA, 23 bp, Homo sapiens
tgagctttggacgcacacagctt

SEQ ID NO: 6493536 - DNA, 14 bp, Homo sapiens
tgagctttgttact

SEQ ID NO: 6493537 - DNA, 22 bp, Homo sapiens
tgagcttttcagttaagttgct

SEQ ID NO: 6493538 - DNA, 16 bp, Homo sapiens
tgagctttttgttccc

SEQ ID NO: 6493539 - DNA, 17 bp, Homo sapiens
tgagctttttgttccct

SEQ ID NO: 6493540 - DNA, 19 bp, Homo sapiens
tgagctttttgttccctca

SEQ ID NO: 6493541 - DNA, 22 bp, Homo sapiens
tgaggaaaaaatggtataaaag

SEQ ID NO: 6493542 - DNA, 16 bp, Homo sapiens
tgaggaaaaatatgtg

SEQ ID NO: 6493543 - DNA, 15 bp, Homo sapiens
tgaggaaaatggaag

SEQ ID NO: 6493544 - DNA, 20 bp, Homo sapiens
tgaggaaacttggacattta

SEQ ID NO: 6493545 - DNA, 16 bp, Homo sapiens
tgaggaaagacacaga

SEQ ID NO: 6493546 - DNA, 17 bp, Homo sapiens
tgaggaaagcacacagt

SEQ ID NO: 6493547 - DNA, 13 bp, Homo sapiens
tgaggaaaggagg

SEQ ID NO: 6493548 - DNA, 16 bp, Homo sapiens
tgaggaaaggccagct

SEQ ID NO: 6493549 - DNA, 19 bp, Homo sapiens
tgaggaaaggccagctggc

SEQ ID NO: 6493550 - DNA, 18 bp, Homo sapiens
tgaggaaagtcattggct

SEQ ID NO: 6493551 - DNA, 20 bp, Homo sapiens
tgaggaaataagacttttag

SEQ ID NO: 6493552 - DNA, 18 bp, Homo sapiens
tgaggaaatcaaagtgct

SEQ ID NO: 6493553 - DNA, 16 bp, Homo sapiens
tgaggaacctcaaact

SEQ ID NO: 6493554 - DNA, 15 bp, Homo sapiens
tgaggaactgtacag

SEQ ID NO: 6493555 - DNA, 17 bp, Homo sapiens
tgaggaactgtacagaa

SEQ ID NO: 6493556 - DNA, 19 bp, Homo sapiens
tgaggaactgtacagaaaa

SEQ ID NO: 6493557 - DNA, 21 bp, Homo sapiens
tgaggaactgtagatgatgta

SEQ ID NO: 6493558 - DNA, 17 bp, Homo sapiens
tgaggaagaacggggct

SEQ ID NO: 6493559 - DNA, 24 bp, Homo sapiens
tgaggaagaacggggctcttctca

SEQ ID NO: 6493560 - DNA, 19 bp, Homo sapiens
tgaggaagaatccatctgt

SEQ ID NO: 6493561 - DNA, 18 bp, Homo sapiens
tgaggaagacaagcattt

SEQ ID NO: 6493562 - DNA, 14 bp, Homo sapiens
tgaggaagagtctt

SEQ ID NO: 6493563 - DNA, 15 bp, Homo sapiens
tgaggaagcaaaagc

SEQ ID NO: 6493564 - DNA, 20 bp, Homo sapiens
tgaggaagcagttggggccc

SEQ ID NO: 6493565 - DNA, 20 bp, Homo sapiens
tgaggaagccccaagccatg

SEQ ID NO: 6493566 - DNA, 14 bp, Homo sapiens
tgaggaagccgctg

SEQ ID NO: 6493567 - DNA, 19 bp, Homo sapiens
tgaggaagccgctggggcc

SEQ ID NO: 6493568 - DNA, 17 bp, Homo sapiens
tgaggaagcgtgaaggc

SEQ ID NO: 6493569 - DNA, 16 bp, Homo sapiens
tgaggaagctccagtc

SEQ ID NO: 6493570 - DNA, 13 bp, Homo sapiens
tgaggaaggaaat

SEQ ID NO: 6493571 - DNA, 20 bp, Homo sapiens
tgaggaaggcaggaagagag

SEQ ID NO: 6493572 - DNA, 19 bp, Homo sapiens
tgaggaagtgagccagcag

SEQ ID NO: 6493573 - DNA, 19 bp, Homo sapiens
tgaggaagtggctgtccct

SEQ ID NO: 6493574 - DNA, 16 bp, Homo sapiens
tgaggaagttttgcat

SEQ ID NO: 6493575 - DNA, 14 bp, Homo sapiens
tgaggaagttttgt

SEQ ID NO: 6493576 - DNA, 20 bp, Homo sapiens
tgaggaagttttgtctaatt

SEQ ID NO: 6493577 - DNA, 22 bp, Homo sapiens
tgaggaataaagcttctctctg

SEQ ID NO: 6493578 - DNA, 18 bp, Homo sapiens
tgaggaataaatgccttt

SEQ ID NO: 6493579 - DNA, 19 bp, Homo sapiens
tgaggaataattatttatt

SEQ ID NO: 6493580 - DNA, 20 bp, Homo sapiens
tgaggaatagttgagcccca

SEQ ID NO: 6493581 - DNA, 16 bp, Homo sapiens
tgaggaatatttcaag

SEQ ID NO: 6493582 - DNA, 19 bp, Homo sapiens
tgaggaatcaacagggcag

SEQ ID NO: 6493583 - DNA, 17 bp, Homo sapiens
tgaggaatgctctgtgc

SEQ ID NO: 6493584 - DNA, 17 bp, Homo sapiens
tgaggaatgtatatgtt

SEQ ID NO: 6493585 - DNA, 19 bp, Homo sapiens
tgaggaatgtatatgtttt

SEQ ID NO: 6493586 - DNA, 23 bp, Homo sapiens
tgaggaattaagggttaccccac

SEQ ID NO: 6493587 - DNA, 21 bp, Homo sapiens
tgaggaattcttctgttctct

SEQ ID NO: 6493588 - DNA, 21 bp, Homo sapiens
tgaggaatttcacctgtaaac

SEQ ID NO: 6493589 - DNA, 13 bp, Homo sapiens
tgaggacacatgt

SEQ ID NO: 6493590 - DNA, 14 bp, Homo sapiens
tgaggacacatgtc

SEQ ID NO: 6493591 - DNA, 23 bp, Homo sapiens
tgaggacagaaagaccctgatgc

SEQ ID NO: 6493592 - DNA, 16 bp, Homo sapiens
tgaggacagaaggact

SEQ ID NO: 6493593 - DNA, 12 bp, Homo sapiens
tgaggacagagc

SEQ ID NO: 6493594 - DNA, 18 bp, Homo sapiens
tgaggacagatgcctcct

SEQ ID NO: 6493595 - DNA, 14 bp, Homo sapiens
tgaggacagctgtc

SEQ ID NO: 6493596 - DNA, 15 bp, Homo sapiens
tgaggacagctgtcc

SEQ ID NO: 6493597 - DNA, 18 bp, Homo sapiens
tgaggacaggctctagag

SEQ ID NO: 6493598 - DNA, 19 bp, Homo sapiens
tgaggacaggctctagaga

SEQ ID NO: 6493599 - DNA, 22 bp, Homo sapiens
tgaggacaggctctagagagag

SEQ ID NO: 6493600 - DNA, 17 bp, Homo sapiens
tgaggacataaatcttc

SEQ ID NO: 6493601 - DNA, 21 bp, Homo sapiens
tgaggacatggagagagactc

SEQ ID NO: 6493602 - DNA, 19 bp, Homo sapiens
tgaggacatggcttctgaa

SEQ ID NO: 6493603 - DNA, 21 bp, Homo sapiens
tgaggaccacactttgagaac

SEQ ID NO: 6493604 - DNA, 16 bp, Homo sapiens
tgaggaccagggtgga

SEQ ID NO: 6493605 - DNA, 20 bp, Homo sapiens
tgaggaccagggtggagctg

SEQ ID NO: 6493606 - DNA, 14 bp, Homo sapiens
tgaggacccagagc

SEQ ID NO: 6493607 - DNA, 22 bp, Homo sapiens
tgaggaccccttaatcttgctt

SEQ ID NO: 6493608 - DNA, 16 bp, Homo sapiens
tgaggacccgccggat

SEQ ID NO: 6493609 - DNA, 19 bp, Homo sapiens
tgaggaccctcagccccag

SEQ ID NO: 6493610 - DNA, 21 bp, Homo sapiens
tgaggaccctcagccccagga

SEQ ID NO: 6493611 - DNA, 16 bp, Homo sapiens
tgaggaccctcccagg

SEQ ID NO: 6493612 - DNA, 19 bp, Homo sapiens
tgaggaccgccccaaccct

SEQ ID NO: 6493613 - DNA, 20 bp, Homo sapiens
tgaggaccgctgataagcat

SEQ ID NO: 6493614 - DNA, 15 bp, Homo sapiens
tgaggacctccacct

SEQ ID NO: 6493615 - DNA, 17 bp, Homo sapiens
tgaggacctccacctgg

SEQ ID NO: 6493616 - DNA, 15 bp, Homo sapiens
tgaggacctgcggcc

SEQ ID NO: 6493617 - DNA, 16 bp, Homo sapiens
tgaggacctgcggcct

SEQ ID NO: 6493618 - DNA, 14 bp, Homo sapiens
tgaggacctttctg

SEQ ID NO: 6493619 - DNA, 16 bp, Homo sapiens
tgggggagggctgcga

SEQ ID NO: 6493620 - DNA, 20 bp, Homo sapiens
tgggggaggggagactttga

SEQ ID NO: 6493621 - DNA, 19 bp, Homo sapiens
tgggggaggggggggtggg

SEQ ID NO: 6493622 - DNA, 21 bp, Homo sapiens
tgggggaggtccctgccagtg

SEQ ID NO: 6493623 - DNA, 12 bp, Homo sapiens
tgggggagtgga

SEQ ID NO: 6493624 - DNA, 15 bp, Homo sapiens
tgggggagtggaata

SEQ ID NO: 6493625 - DNA, 11 bp, Homo sapiens
tgggggatgta

SEQ ID NO: 6493626 - DNA, 18 bp, Homo sapiens
tgggggatgtgaagaaat

SEQ ID NO: 6493627 - DNA, 14 bp, Homo sapiens
tgggggatgtggcc

SEQ ID NO: 6493628 - DNA, 21 bp, Homo sapiens
tgggggattcctgagctggcc

SEQ ID NO: 6493629 - DNA, 20 bp, Homo sapiens
tgggggcacagctgtctgcc

SEQ ID NO: 6493630 - DNA, 23 bp, Homo sapiens
tgggggcacagctgtctgccagg

SEQ ID NO: 6493631 - DNA, 23 bp, Homo sapiens
tgggggcactcagccacgaccag

SEQ ID NO: 6493632 - DNA, 15 bp, Homo sapiens
tgggggcagagcagc

SEQ ID NO: 6493633 - DNA, 13 bp, Homo sapiens
tgggggcagaggg

SEQ ID NO: 6493634 - DNA, 16 bp, Homo sapiens
tgggggcagagggcag

SEQ ID NO: 6493635 - DNA, 18 bp, Homo sapiens
tgggggcagagggcagag

SEQ ID NO: 6493636 - DNA, 14 bp, Homo sapiens
tgggggcagcccag

SEQ ID NO: 6493637 - DNA, 22 bp, Homo sapiens
tgggggcagcctgcgtggctga

SEQ ID NO: 6493638 - DNA, 16 bp, Homo sapiens
tgggggcagcggcccc

SEQ ID NO: 6493639 - DNA, 14 bp, Homo sapiens
tgggggcagggctg

SEQ ID NO: 6493640 - DNA, 16 bp, Homo sapiens
tgggggcagtctcccc

SEQ ID NO: 6493641 - DNA, 21 bp, Homo sapiens
tgggggcagtctccccttcct

SEQ ID NO: 6493642 - DNA, 22 bp, Homo sapiens
tgggggcagtctccccttcctg

SEQ ID NO: 6493643 - DNA, 23 bp, Homo sapiens
tgggggcagtctccccttcctgg

SEQ ID NO: 6493644 - DNA, 13 bp, Homo sapiens
tgggggcatcctg

SEQ ID NO: 6493645 - DNA, 21 bp, Homo sapiens
tgggggcatcctgcttcctga

SEQ ID NO: 6493646 - DNA, 18 bp, Homo sapiens
tgggggcatgggggaggc

SEQ ID NO: 6493647 - DNA, 23 bp, Homo sapiens
tgggggcatgggggaggctctga

SEQ ID NO: 6493648 - DNA, 17 bp, Homo sapiens
tgggggccacctgcctg

SEQ ID NO: 6493649 - DNA, 18 bp, Homo sapiens
tgggggccacctgcctgc

SEQ ID NO: 6493650 - DNA, 14 bp, Homo sapiens
tgggggccagctcc

SEQ ID NO: 6493651 - DNA, 20 bp, Homo sapiens
tgggggccagctccaggagg

SEQ ID NO: 6493652 - DNA, 13 bp, Homo sapiens
tgggggccagctg

SEQ ID NO: 6493653 - DNA, 14 bp, Homo sapiens
tgggggccagctgg

SEQ ID NO: 6493654 - DNA, 13 bp, Homo sapiens
tgggggccaggcc

SEQ ID NO: 6493655 - DNA, 19 bp, Homo sapiens
tgggggccccgtctcaggt

SEQ ID NO: 6493656 - DNA, 22 bp, Homo sapiens
tgggggccccgtctcaggtctg

SEQ ID NO: 6493657 - DNA, 19 bp, Homo sapiens
tgggggcccctcaggtcag

SEQ ID NO: 6493658 - DNA, 22 bp, Homo sapiens
tgggggcccgacaggtgggcct

SEQ ID NO: 6493659 - DNA, 23 bp, Homo sapiens
tgggggcccgacaggtgggcctg

SEQ ID NO: 6493660 - DNA, 17 bp, Homo sapiens
tgggggccgctggccca

SEQ ID NO: 6493661 - DNA, 12 bp, Homo sapiens
tgggggcctcct

SEQ ID NO: 6493662 - DNA, 17 bp, Homo sapiens
tgggggcctctgcctcc

SEQ ID NO: 6493663 - DNA, 15 bp, Homo sapiens
tgggggcctgctgtg

SEQ ID NO: 6493664 - DNA, 21 bp, Homo sapiens
tgggggcgccctctctgctcc

SEQ ID NO: 6493665 - DNA, 18 bp, Homo sapiens
tgggggcgggggagccaa

SEQ ID NO: 6493666 - DNA, 20 bp, Homo sapiens
tgggggctagaaaaaacata

SEQ ID NO: 6493667 - DNA, 14 bp, Homo sapiens
tgggggctcagcca

SEQ ID NO: 6493668 - DNA, 16 bp, Homo sapiens
tgggggctcagccagg

SEQ ID NO: 6493669 - DNA, 16 bp, Homo sapiens
tgggggctcctggcag

SEQ ID NO: 6493670 - DNA, 17 bp, Homo sapiens
tgggggctcctggcagt

SEQ ID NO: 6493671 - DNA, 18 bp, Homo sapiens
tgggggctcctggcagtg

SEQ ID NO: 6493672 - DNA, 14 bp, Homo sapiens
tgggggctctgcac

SEQ ID NO: 6493673 - DNA, 18 bp, Homo sapiens
tgggggctctggccaagg

SEQ ID NO: 6493674 - DNA, 21 bp, Homo sapiens
tgggggctgcagcatgttgct

SEQ ID NO: 6493675 - DNA, 13 bp, Homo sapiens
tgggggctgcagg

SEQ ID NO: 6493676 - DNA, 15 bp, Homo sapiens
tgggggctgcagggc

SEQ ID NO: 6493677 - DNA, 17 bp, Homo sapiens
tgggggctgcagggctg

SEQ ID NO: 6493678 - DNA, 21 bp, Homo sapiens
tgggggctgcagggctgggtc

SEQ ID NO: 6493679 - DNA, 11 bp, Homo sapiens
tgggggctgct

SEQ ID NO: 6493680 - DNA, 16 bp, Homo sapiens
tgggggctgctgcact

SEQ ID NO: 6493681 - DNA, 14 bp, Homo sapiens
tgggggctggacct

SEQ ID NO: 6493682 - DNA, 19 bp, Homo sapiens
tgggggctggacctgctga

SEQ ID NO: 6493683 - DNA, 11 bp, Homo sapiens
tgggggctggc

SEQ ID NO: 6493684 - DNA, 21 bp, Homo sapiens
tgggggctggctcccagggtg

SEQ ID NO: 6493685 - DNA, 13 bp, Homo sapiens
tgggggctgtcct

SEQ ID NO: 6493686 - DNA, 17 bp, Homo sapiens
tgggggctgtcctgctc

SEQ ID NO: 6493687 - DNA, 20 bp, Homo sapiens
tgggggctgtcctgctcacc

SEQ ID NO: 6493688 - DNA, 14 bp, Homo sapiens
tgggggcttccctg

SEQ ID NO: 6493689 - DNA, 23 bp, Homo sapiens
tgggggcttccctgggcctcagc

SEQ ID NO: 6493690 - DNA, 19 bp, Homo sapiens
tggggggaaagagggagca

SEQ ID NO: 6493691 - DNA, 20 bp, Homo sapiens
tggggggacagagactcaga

SEQ ID NO: 6493692 - DNA, 17 bp, Homo sapiens
tggggggacccagtgca

SEQ ID NO: 6493693 - DNA, 19 bp, Homo sapiens
tggggggacccagtgcaga

SEQ ID NO: 6493694 - DNA, 12 bp, Homo sapiens
tggggggagaga

SEQ ID NO: 6493695 - DNA, 13 bp, Homo sapiens
tggggggagggca

SEQ ID NO: 6493696 - DNA, 15 bp, Homo sapiens
tggggggagggcacc

SEQ ID NO: 6493697 - DNA, 16 bp, Homo sapiens
tggggggagggcaccc

SEQ ID NO: 6493698 - DNA, 20 bp, Homo sapiens
tggggggatttggctggtgc

SEQ ID NO: 6493699 - DNA, 17 bp, Homo sapiens
tggggggcacagccaga

SEQ ID NO: 6493700 - DNA, 19 bp, Homo sapiens
tggggggccaccatgaccc

SEQ ID NO: 6493701 - DNA, 17 bp, Homo sapiens
tggggggccgggcaggt

SEQ ID NO: 6493702 - DNA, 16 bp, Homo sapiens
tggggggcgggccagg

SEQ ID NO: 6493703 - DNA, 19 bp, Homo sapiens
tggggggctgaggtgggag

SEQ ID NO: 6493704 - DNA, 14 bp, Homo sapiens
tggggggctgatgg

SEQ ID NO: 6493705 - DNA, 17 bp, Homo sapiens
tggggggcttcatacac

SEQ ID NO: 6493706 - DNA, 22 bp, Homo sapiens
tgggggggagaaggcctcccct

SEQ ID NO: 6493707 - DNA, 13 bp, Homo sapiens
tgggggggcagag

SEQ ID NO: 6493708 - DNA, 16 bp, Homo sapiens
tgggggggctgccttt

SEQ ID NO: 6493709 - DNA, 18 bp, Homo sapiens
tggggggtgatgagggca

SEQ ID NO: 6493710 - DNA, 19 bp, Homo sapiens
tggggggtgatgagggcag

SEQ ID NO: 6493711 - DNA, 20 bp, Homo sapiens
tgggggtaaagtttgctcta

SEQ ID NO: 6493712 - DNA, 20 bp, Homo sapiens
tgggggtaagaaaagctggt

SEQ ID NO: 6493713 - DNA, 23 bp, Homo sapiens
tgggggtaagaaaagctggtctg

SEQ ID NO: 6493714 - DNA, 15 bp, Homo sapiens
tgggggtagagctga

SEQ ID NO: 6493715 - DNA, 14 bp, Homo sapiens
tgggggtagcctgg

SEQ ID NO: 6493716 - DNA, 21 bp, Homo sapiens
tgggggtagggggctggagga

SEQ ID NO: 6493717 - DNA, 18 bp, Homo sapiens
tgggggtattttctaatt

SEQ ID NO: 6493718 - DNA, 21 bp, Homo sapiens
tgggggtcacccatggcctca

SEQ ID NO: 6493719 - DNA, 19 bp, Homo sapiens
tgggggtcaggcagccagt

SEQ ID NO: 6493720 - DNA, 18 bp, Homo sapiens
tgggggtcagtgctgcct

SEQ ID NO: 6493721 - DNA, 14 bp, Homo sapiens
tgggggtcccagga

SEQ ID NO: 6493722 - DNA, 15 bp, Homo sapiens
tgggggtcccaggat

SEQ ID NO: 6493723 - DNA, 12 bp, Homo sapiens
tgggggtctgct

SEQ ID NO: 6493724 - DNA, 13 bp, Homo sapiens
tgggggtctggga

SEQ ID NO: 6493725 - DNA, 15 bp, Homo sapiens
tgggggtctgtgtgt

SEQ ID NO: 6493726 - DNA, 19 bp, Homo sapiens
tgggggtgccgctgtctct

SEQ ID NO: 6493727 - DNA, 21 bp, Homo sapiens
tgggggtgccgctttctctga

SEQ ID NO: 6493728 - DNA, 13 bp, Homo sapiens
tgggggtgcctgg

SEQ ID NO: 6493729 - DNA, 14 bp, Homo sapiens
tgggggtgcctggt

SEQ ID NO: 6493730 - DNA, 19 bp, Homo sapiens
tgggggtgctggatggaca

SEQ ID NO: 6493731 - DNA, 17 bp, Homo sapiens
tgggggtggaggaccga

SEQ ID NO: 6493732 - DNA, 21 bp, Homo sapiens
tgggggtggaggaccgaggct

SEQ ID NO: 6493733 - DNA, 16 bp, Homo sapiens
tgggggtggcaggcac

SEQ ID NO: 6493734 - DNA, 10 bp, Homo sapiens
tgggggtggg

SEQ ID NO: 6493735 - DNA, 11 bp, Homo sapiens
tgggggtggga

SEQ ID NO: 6493736 - DNA, 18 bp, Homo sapiens
tgggggtgggcagcagca

SEQ ID NO: 6493737 - DNA, 13 bp, Homo sapiens
tgggggtgggcca

SEQ ID NO: 6493738 - DNA, 16 bp, Homo sapiens
tgggggtgggccaggc

SEQ ID NO: 6493739 - DNA, 23 bp, Homo sapiens
tgggggtggggaggcccaaatga

SEQ ID NO: 6493740 - DNA, 12 bp, Homo sapiens
tgggggtggggc

SEQ ID NO: 6493741 - DNA, 14 bp, Homo sapiens
tgggggtggggctc

SEQ ID NO: 6493742 - DNA, 18 bp, Homo sapiens
tgggggtggggctcctac

SEQ ID NO: 6493743 - DNA, 16 bp, Homo sapiens
tgggggtggggctgca

SEQ ID NO: 6493744 - DNA, 11 bp, Homo sapiens
tgggggtgggt

SEQ ID NO: 6493745 - DNA, 22 bp, Homo sapiens
tgggggtgttcagccactgagg

SEQ ID NO: 6493746 - DNA, 19 bp, Homo sapiens
tgggggttctttcttcctc

SEQ ID NO: 6493747 - DNA, 18 bp, Homo sapiens
tgggggttgtaaattggc

SEQ ID NO: 6493748 - DNA, 20 bp, Homo sapiens
tgggggttttcaatgtgaaa

SEQ ID NO: 6493749 - DNA, 18 bp, Homo sapiens
tgggggttttccaagccc

SEQ ID NO: 6493750 - DNA, 12 bp, Homo sapiens
tgggggttttta

SEQ ID NO: 6493751 - DNA, 14 bp, Homo sapiens
tgggggtttttgaa

SEQ ID NO: 6493752 - DNA, 12 bp, Homo sapiens
tgggggtttttt

SEQ ID NO: 6493753 - DNA, 16 bp, Homo sapiens
tggggtaagccagagc

SEQ ID NO: 6493754 - DNA, 18 bp, Homo sapiens
tggggtaagccagagcct

SEQ ID NO: 6493755 - DNA, 21 bp, Homo sapiens
tggggtaagcggaataaacta

SEQ ID NO: 6493756 - DNA, 13 bp, Homo sapiens
tggggtacaggca

SEQ ID NO: 6493757 - DNA, 13 bp, Homo sapiens
tggggtaccacat

SEQ ID NO: 6493758 - DNA, 15 bp, Homo sapiens
tggggtactactctc

SEQ ID NO: 6493759 - DNA, 20 bp, Homo sapiens
tggggtactactctccagct

SEQ ID NO: 6493760 - DNA, 21 bp, Homo sapiens
tggggtactcttgatgtgaag

SEQ ID NO: 6493761 - DNA, 18 bp, Homo sapiens
tggggtagaaacattgta

SEQ ID NO: 6493762 - DNA, 16 bp, Homo sapiens
tggggtagagaggaca

SEQ ID NO: 6493763 - DNA, 20 bp, Homo sapiens
tggggtagctagaggaacca

SEQ ID NO: 6493764 - DNA, 17 bp, Homo sapiens
tggggtaggaggaacag

SEQ ID NO: 6493765 - DNA, 19 bp, Homo sapiens
tggggtaggaggaacaggt

SEQ ID NO: 6493766 - DNA, 15 bp, Homo sapiens
tggggtagggtgaga

SEQ ID NO: 6493767 - DNA, 19 bp, Homo sapiens
tggggtagggtgagaaggg

SEQ ID NO: 6493768 - DNA, 16 bp, Homo sapiens
tggggtatgtgtgtgt

SEQ ID NO: 6493769 - DNA, 20 bp, Homo sapiens
tggggtcaccaccctcccct

SEQ ID NO: 6493770 - DNA, 22 bp, Homo sapiens
tggggtcacttgggaagaggac

SEQ ID NO: 6493771 - DNA, 14 bp, Homo sapiens
tggggtcagcaggc

SEQ ID NO: 6493772 - DNA, 18 bp, Homo sapiens
tggggtcagccagggcca

SEQ ID NO: 6493773 - DNA, 14 bp, Homo sapiens
tggggtcagcccca

SEQ ID NO: 6493774 - DNA, 19 bp, Homo sapiens
tggggtcagccccaagggc

SEQ ID NO: 6493775 - DNA, 22 bp, Homo sapiens
tggggtcaggccgggcagagca

SEQ ID NO: 6493776 - DNA, 16 bp, Homo sapiens
tggggtcatgaagggc

SEQ ID NO: 6493777 - DNA, 21 bp, Homo sapiens
tggggtcatgaagggctggaa

SEQ ID NO: 6493778 - DNA, 20 bp, Homo sapiens
tggggtcattttgactggct

SEQ ID NO: 6493779 - DNA, 17 bp, Homo sapiens
tggggtcccactgctcg

SEQ ID NO: 6493780 - DNA, 13 bp, Homo sapiens
tggggtccccctc

SEQ ID NO: 6493781 - DNA, 18 bp, Homo sapiens
tggggtccccctcccact

SEQ ID NO: 6493782 - DNA, 17 bp, Homo sapiens
tggggtccctccacccc

SEQ ID NO: 6493783 - DNA, 19 bp, Homo sapiens
tggggtccctccaccccac

SEQ ID NO: 6493784 - DNA, 21 bp, Homo sapiens
tggggtcctagcccagtgctt

SEQ ID NO: 6493785 - DNA, 12 bp, Homo sapiens
tggggtcctggc

SEQ ID NO: 6493786 - DNA, 15 bp, Homo sapiens
tggggtcctggccat

SEQ ID NO: 6493787 - DNA, 19 bp, Homo sapiens
tggggtcctggccatccca

SEQ ID NO: 6493788 - DNA, 14 bp, Homo sapiens
tggggtcctgggct

SEQ ID NO: 6493789 - DNA, 16 bp, Homo sapiens
tggggtcctggggcct

SEQ ID NO: 6493790 - DNA, 22 bp, Homo sapiens
tggggtcctgtggggcccccac

SEQ ID NO: 6493791 - DNA, 23 bp, Homo sapiens
tggggtctattttataagggcac

SEQ ID NO: 6493792 - DNA, 13 bp, Homo sapiens
tggggtctccctc

SEQ ID NO: 6493793 - DNA, 19 bp, Homo sapiens
tggggtctcctcaggacca

SEQ ID NO: 6493794 - DNA, 21 bp, Homo sapiens
tggggtctctcacagacagga

SEQ ID NO: 6493795 - DNA, 14 bp, Homo sapiens
tggggtctctctcc

SEQ ID NO: 6493796 - DNA, 16 bp, Homo sapiens
tggggtctctgagcag

SEQ ID NO: 6493797 - DNA, 17 bp, Homo sapiens
tggggtctctgagcagt

SEQ ID NO: 6493798 - DNA, 15 bp, Homo sapiens
tggggtctctgcatc

SEQ ID NO: 6493799 - DNA, 20 bp, Homo sapiens
tgaggacgagacccccatcc

SEQ ID NO: 6493800 - DNA, 22 bp, Homo sapiens
tgaggacgagacccccatccag

SEQ ID NO: 6493801 - DNA, 21 bp, Homo sapiens
tgaggacgtgtctgttatttc

SEQ ID NO: 6493802 - DNA, 17 bp, Homo sapiens
tgaggactcggccactg

SEQ ID NO: 6493803 - DNA, 21 bp, Homo sapiens
tgaggactcggccactgtgtc

SEQ ID NO: 6493804 - DNA, 23 bp, Homo sapiens
tgaggactctttccgactgccca

SEQ ID NO: 6493805 - DNA, 17 bp, Homo sapiens
tgaggactgatttcaga

SEQ ID NO: 6493806 - DNA, 14 bp, Homo sapiens
tgaggactgggggc

SEQ ID NO: 6493807 - DNA, 23 bp, Homo sapiens
tgaggacttaaaatattcctgca

SEQ ID NO: 6493808 - DNA, 15 bp, Homo sapiens
tgaggacttcaagcc

SEQ ID NO: 6493809 - DNA, 23 bp, Homo sapiens
tgaggacttgggcgggacacagg

SEQ ID NO: 6493810 - DNA, 18 bp, Homo sapiens
tgaggacttgttaaagag

SEQ ID NO: 6493811 - DNA, 23 bp, Homo sapiens
tgaggactttggtcacccagact

SEQ ID NO: 6493812 - DNA, 22 bp, Homo sapiens
tgaggagaagggggtctctgtt

SEQ ID NO: 6493813 - DNA, 14 bp, Homo sapiens
tgaggagaatgaaa

SEQ ID NO: 6493814 - DNA, 23 bp, Homo sapiens
tgaggagacgaagtgaaaacaaa

SEQ ID NO: 6493815 - DNA, 19 bp, Homo sapiens
tgaggagagagacagagag

SEQ ID NO: 6493816 - DNA, 15 bp, Homo sapiens
tgaggagagggactg

SEQ ID NO: 6493817 - DNA, 23 bp, Homo sapiens
tgaggagagtctgaatattttca

SEQ ID NO: 6493818 - DNA, 22 bp, Homo sapiens
tgaggagatgaccagggatgct

SEQ ID NO: 6493819 - DNA, 19 bp, Homo sapiens
tgaggagatgcggccaaag

SEQ ID NO: 6493820 - DNA, 19 bp, Homo sapiens
tgaggagcagcaggagggg

SEQ ID NO: 6493821 - DNA, 16 bp, Homo sapiens
tgaggagcagccagga

SEQ ID NO: 6493822 - DNA, 21 bp, Homo sapiens
tgaggagcagcccacctgctg

SEQ ID NO: 6493823 - DNA, 22 bp, Homo sapiens
tgaggagcagcccacctgctgc

SEQ ID NO: 6493824 - DNA, 22 bp, Homo sapiens
tgaggagcccacggggcaaagc

SEQ ID NO: 6493825 - DNA, 20 bp, Homo sapiens
tgaggagcccatactcagcc

SEQ ID NO: 6493826 - DNA, 14 bp, Homo sapiens
tgaggagcgtggac

SEQ ID NO: 6493827 - DNA, 16 bp, Homo sapiens
tgaggagcgtggactc

SEQ ID NO: 6493828 - DNA, 12 bp, Homo sapiens
tgaggagctcaa

SEQ ID NO: 6493829 - DNA, 22 bp, Homo sapiens
tgaggagctcaacggtctggca

SEQ ID NO: 6493830 - DNA, 13 bp, Homo sapiens
tgaggagctgctg

SEQ ID NO: 6493831 - DNA, 19 bp, Homo sapiens
tgaggagctggaggggtgg

SEQ ID NO: 6493832 - DNA, 21 bp, Homo sapiens
tgaggagctggaggggtgggg

SEQ ID NO: 6493833 - DNA, 12 bp, Homo sapiens
tgaggagctggg

SEQ ID NO: 6493834 - DNA, 13 bp, Homo sapiens
tgaggaggaaaag

SEQ ID NO: 6493835 - DNA, 17 bp, Homo sapiens
tgaggaggaagcagaat

SEQ ID NO: 6493836 - DNA, 13 bp, Homo sapiens
tgaggaggaagga

SEQ ID NO: 6493837 - DNA, 21 bp, Homo sapiens
tgaggaggaaggagagaaggg

SEQ ID NO: 6493838 - DNA, 19 bp, Homo sapiens
tgaggaggagctggcctgc

SEQ ID NO: 6493839 - DNA, 23 bp, Homo sapiens
tgaggaggaggacacagcacaag

SEQ ID NO: 6493840 - DNA, 14 bp, Homo sapiens
tgaggaggaggcag

SEQ ID NO: 6493841 - DNA, 19 bp, Homo sapiens
tgaggaggaggcagaacca

SEQ ID NO: 6493842 - DNA, 20 bp, Homo sapiens
tgaggaggaggcagaaccag

SEQ ID NO: 6493843 - DNA, 13 bp, Homo sapiens
tgaggaggaggct

SEQ ID NO: 6493844 - DNA, 22 bp, Homo sapiens
tgaggaggatgtccctgggcca

SEQ ID NO: 6493845 - DNA, 24 bp, Homo sapiens
tgaggaggcagaaagcagaggctg

SEQ ID NO: 6493846 - DNA, 13 bp, Homo sapiens
tgaggaggcagag

SEQ ID NO: 6493847 - DNA, 16 bp, Homo sapiens
tgaggaggcagagagg

SEQ ID NO: 6493848 - DNA, 14 bp, Homo sapiens
tgaggaggcctcca

SEQ ID NO: 6493849 - DNA, 16 bp, Homo sapiens
tgaggaggcctccatc

SEQ ID NO: 6493850 - DNA, 16 bp, Homo sapiens
tgaggagggccctgag

SEQ ID NO: 6493851 - DNA, 19 bp, Homo sapiens
tgaggagggccctgaggaa

SEQ ID NO: 6493852 - DNA, 22 bp, Homo sapiens
tgaggagggccctgaggaataa

SEQ ID NO: 6493853 - DNA, 13 bp, Homo sapiens
tgaggaggggagg

SEQ ID NO: 6493854 - DNA, 16 bp, Homo sapiens
tgaggaggggcacctg

SEQ ID NO: 6493855 - DNA, 18 bp, Homo sapiens
tgaggaggggcacctgcc

SEQ ID NO: 6493856 - DNA, 22 bp, Homo sapiens
tgaggaggggcacctgccaccg

SEQ ID NO: 6493857 - DNA, 19 bp, Homo sapiens
tgaggaggggcaggtaaac

SEQ ID NO: 6493858 - DNA, 16 bp, Homo sapiens
tgaggagggggagaag

SEQ ID NO: 6493859 - DNA, 13 bp, Homo sapiens
tgaggagggtgcc

SEQ ID NO: 6493860 - DNA, 13 bp, Homo sapiens
tgaggagggtggg

SEQ ID NO: 6493861 - DNA, 17 bp, Homo sapiens
tgaggagggtgggggag

SEQ ID NO: 6493862 - DNA, 13 bp, Homo sapiens
tgaggaggtacaa

SEQ ID NO: 6493863 - DNA, 22 bp, Homo sapiens
tgaggagtagctgagaggaaga

SEQ ID NO: 6493864 - DNA, 23 bp, Homo sapiens
tgaggagtagctgagaggaagat

SEQ ID NO: 6493865 - DNA, 21 bp, Homo sapiens
tgaggagtattaagaatgcag

SEQ ID NO: 6493866 - DNA, 12 bp, Homo sapiens
tgaggagtccaa

SEQ ID NO: 6493867 - DNA, 15 bp, Homo sapiens
tgaggagtccaaaat

SEQ ID NO: 6493868 - DNA, 14 bp, Homo sapiens
tgaggagtctgagg

SEQ ID NO: 6493869 - DNA, 23 bp, Homo sapiens
tgaggagtggttgggctgtgcct

SEQ ID NO: 6493870 - DNA, 18 bp, Homo sapiens
tgaggagtgtcctgtctg

SEQ ID NO: 6493871 - DNA, 21 bp, Homo sapiens
tgaggagtgtcctgtctgctg

SEQ ID NO: 6493872 - DNA, 21 bp, Homo sapiens
tgaggagtttcctaaaagttc

SEQ ID NO: 6493873 - DNA, 16 bp, Homo sapiens
tgaggataacttcctt

SEQ ID NO: 6493874 - DNA, 17 bp, Homo sapiens
tgaggataactttttaa

SEQ ID NO: 6493875 - DNA, 16 bp, Homo sapiens
tgaggatacagctctt

SEQ ID NO: 6493876 - DNA, 20 bp, Homo sapiens
tgaggatacagctcttctca

SEQ ID NO: 6493877 - DNA, 18 bp, Homo sapiens
tgaggataccccaaagtc

SEQ ID NO: 6493878 - DNA, 14 bp, Homo sapiens
tgaggataggacag

SEQ ID NO: 6493879 - DNA, 15 bp, Homo sapiens
tgaggataggacaga

SEQ ID NO: 6493880 - DNA, 20 bp, Homo sapiens
tgaggatatattttcacttt

SEQ ID NO: 6493881 - DNA, 17 bp, Homo sapiens
tgaggatcagagtaatc

SEQ ID NO: 6493882 - DNA, 15 bp, Homo sapiens
tgaggatccagggca

SEQ ID NO: 6493883 - DNA, 19 bp, Homo sapiens
tgaggatccagggcagcag

SEQ ID NO: 6493884 - DNA, 21 bp, Homo sapiens
tgaggatccagggcagcaggc

SEQ ID NO: 6493885 - DNA, 19 bp, Homo sapiens
tgaggatcctcacaggagc

SEQ ID NO: 6493886 - DNA, 20 bp, Homo sapiens
tgaggatcctcacaggagca

SEQ ID NO: 6493887 - DNA, 22 bp, Homo sapiens
tgaggatcctcacaggagcaga

SEQ ID NO: 6493888 - DNA, 22 bp, Homo sapiens
tgaggatgaaaaaataacactg

SEQ ID NO: 6493889 - DNA, 20 bp, Homo sapiens
tgaggatgagacagggtttt

SEQ ID NO: 6493890 - DNA, 17 bp, Homo sapiens
tgaggatgcaacaaata

SEQ ID NO: 6493891 - DNA, 15 bp, Homo sapiens
tgaggatgcactggc

SEQ ID NO: 6493892 - DNA, 18 bp, Homo sapiens
tgaggatgcagagtcagc

SEQ ID NO: 6493893 - DNA, 13 bp, Homo sapiens
tgaggatgctgca

SEQ ID NO: 6493894 - DNA, 17 bp, Homo sapiens
tgaggatggatttagaa

SEQ ID NO: 6493895 - DNA, 14 bp, Homo sapiens
tgaggatgtatgtg

SEQ ID NO: 6493896 - DNA, 14 bp, Homo sapiens
tgaggattccaaaa

SEQ ID NO: 6493897 - DNA, 19 bp, Homo sapiens
tgaggatttagaagtgtca

SEQ ID NO: 6493898 - DNA, 17 bp, Homo sapiens
tgaggatttcctggagt

SEQ ID NO: 6493899 - DNA, 16 bp, Homo sapiens
tgaggatttctgatct

SEQ ID NO: 6493900 - DNA, 13 bp, Homo sapiens
tgaggcaaacagc

SEQ ID NO: 6493901 - DNA, 18 bp, Homo sapiens
tgaggcaaattaactgta

SEQ ID NO: 6493902 - DNA, 14 bp, Homo sapiens
tgaggcaagagaaa

SEQ ID NO: 6493903 - DNA, 17 bp, Homo sapiens
tgaggcaagagaaatga

SEQ ID NO: 6493904 - DNA, 22 bp, Homo sapiens
tgaggcaagagaaatgaggaag

SEQ ID NO: 6493905 - DNA, 17 bp, Homo sapiens
tgaggcaagccatggag

SEQ ID NO: 6493906 - DNA, 15 bp, Homo sapiens
tgaggcaaggcccag

SEQ ID NO: 6493907 - DNA, 16 bp, Homo sapiens
tgaggcaaggcccaga

SEQ ID NO: 6493908 - DNA, 19 bp, Homo sapiens
tgaggcaaggcccagacct

SEQ ID NO: 6493909 - DNA, 12 bp, Homo sapiens
tgaggcaataag

SEQ ID NO: 6493910 - DNA, 17 bp, Homo sapiens
tgaggcaatgtcaggaa

SEQ ID NO: 6493911 - DNA, 19 bp, Homo sapiens
tgaggcaccgtccaggccc

SEQ ID NO: 6493912 - DNA, 18 bp, Homo sapiens
tgaggcacctgcatatct

SEQ ID NO: 6493913 - DNA, 20 bp, Homo sapiens
tgaggcacctgcatatctct

SEQ ID NO: 6493914 - DNA, 16 bp, Homo sapiens
tgaggcactgataata

SEQ ID NO: 6493915 - DNA, 16 bp, Homo sapiens
tgaggcacttctgtca

SEQ ID NO: 6493916 - DNA, 19 bp, Homo sapiens
tgaggcagaacctggtggc

SEQ ID NO: 6493917 - DNA, 13 bp, Homo sapiens
tgaggcagaagaa

SEQ ID NO: 6493918 - DNA, 18 bp, Homo sapiens
tgaggcagaagaattgaa

SEQ ID NO: 6493919 - DNA, 15 bp, Homo sapiens
tgaggcagacagcag

SEQ ID NO: 6493920 - DNA, 17 bp, Homo sapiens
tgaggcagacagcagct

SEQ ID NO: 6493921 - DNA, 20 bp, Homo sapiens
tgaggcagacagcagctcag

SEQ ID NO: 6493922 - DNA, 20 bp, Homo sapiens
tgaggcagcacgtgcacaaa

SEQ ID NO: 6493923 - DNA, 23 bp, Homo sapiens
tgaggcagcgcattgttttgcat

SEQ ID NO: 6493924 - DNA, 15 bp, Homo sapiens
tgaggcaggagaatc

SEQ ID NO: 6493925 - DNA, 15 bp, Homo sapiens
tgaggcaggctttgt

SEQ ID NO: 6493926 - DNA, 13 bp, Homo sapiens
tgaggcagggaag

SEQ ID NO: 6493927 - DNA, 13 bp, Homo sapiens
tgaggcagggcaa

SEQ ID NO: 6493928 - DNA, 15 bp, Homo sapiens
tgaggcaggggcgga

SEQ ID NO: 6493929 - DNA, 13 bp, Homo sapiens
tgaggcagggtct

SEQ ID NO: 6493930 - DNA, 15 bp, Homo sapiens
tgaggcagggtctca

SEQ ID NO: 6493931 - DNA, 22 bp, Homo sapiens
tgaggcagggtctcactctgtt

SEQ ID NO: 6493932 - DNA, 14 bp, Homo sapiens
tgaggcaggtcccc

SEQ ID NO: 6493933 - DNA, 18 bp, Homo sapiens
tgaggcaggtgacagtga

SEQ ID NO: 6493934 - DNA, 20 bp, Homo sapiens
tgaggcaggtgacagtgagg

SEQ ID NO: 6493935 - DNA, 19 bp, Homo sapiens
tgaggcagtgggtcccact

SEQ ID NO: 6493936 - DNA, 23 bp, Homo sapiens
tgaggcagtgggtcccacttccc

SEQ ID NO: 6493937 - DNA, 17 bp, Homo sapiens
tgaggcagttaaataat

SEQ ID NO: 6493938 - DNA, 14 bp, Homo sapiens
tgaggcagtttgag

SEQ ID NO: 6493939 - DNA, 20 bp, Homo sapiens
tgaggcatgagaatcgcttg

SEQ ID NO: 6493940 - DNA, 23 bp, Homo sapiens
tgaggcatggcaattctggaagc

SEQ ID NO: 6493941 - DNA, 17 bp, Homo sapiens
tgaggcattcggggaag

SEQ ID NO: 6493942 - DNA, 22 bp, Homo sapiens
tgaggcatttgggtggtaagag

SEQ ID NO: 6493943 - DNA, 14 bp, Homo sapiens
tgaggccaaaacag

SEQ ID NO: 6493944 - DNA, 19 bp, Homo sapiens
tgaggccaagaatattgca

SEQ ID NO: 6493945 - DNA, 18 bp, Homo sapiens
tgaggccaagatggctgc

SEQ ID NO: 6493946 - DNA, 18 bp, Homo sapiens
tgaggccacacccagagt

SEQ ID NO: 6493947 - DNA, 12 bp, Homo sapiens
tgaggccacact

SEQ ID NO: 6493948 - DNA, 14 bp, Homo sapiens
tgaggccactgaag

SEQ ID NO: 6493949 - DNA, 16 bp, Homo sapiens
tgaggccactgaagag

SEQ ID NO: 6493950 - DNA, 22 bp, Homo sapiens
tgaggccactgctgcttctcca

SEQ ID NO: 6493951 - DNA, 15 bp, Homo sapiens
tgaggccactgtgtt

SEQ ID NO: 6493952 - DNA, 12 bp, Homo sapiens
tgaggccagaga

SEQ ID NO: 6493953 - DNA, 16 bp, Homo sapiens
tgaggccagagacaca

SEQ ID NO: 6493954 - DNA, 17 bp, Homo sapiens
tgaggccagaggaaggg

SEQ ID NO: 6493955 - DNA, 20 bp, Homo sapiens
tgaggccagcctggcctcct

SEQ ID NO: 6493956 - DNA, 22 bp, Homo sapiens
tgaggccagcctggcctcctgc

SEQ ID NO: 6493957 - DNA, 15 bp, Homo sapiens
tgaggccaggacttt

SEQ ID NO: 6493958 - DNA, 13 bp, Homo sapiens
tgaggccaggagt

SEQ ID NO: 6493959 - DNA, 16 bp, Homo sapiens
tgaggccagggcagag

SEQ ID NO: 6493960 - DNA, 14 bp, Homo sapiens
tgaggccagtggcc

SEQ ID NO: 6493961 - DNA, 15 bp, Homo sapiens
tgaggccatctcagg

SEQ ID NO: 6493962 - DNA, 16 bp, Homo sapiens
tgaggccatctcagga

SEQ ID NO: 6493963 - DNA, 22 bp, Homo sapiens
tgaggccatctcaggagatgga

SEQ ID NO: 6493964 - DNA, 23 bp, Homo sapiens
tgaggccatggactctgtcctga

SEQ ID NO: 6493965 - DNA, 15 bp, Homo sapiens
tgaggccattatttc

SEQ ID NO: 6493966 - DNA, 19 bp, Homo sapiens
tgaggccattccctgtagg

SEQ ID NO: 6493967 - DNA, 13 bp, Homo sapiens
tgaggcccaagga

SEQ ID NO: 6493968 - DNA, 15 bp, Homo sapiens
tgaggcccaaggagc

SEQ ID NO: 6493969 - DNA, 12 bp, Homo sapiens
tgaggcccagag

SEQ ID NO: 6493970 - DNA, 19 bp, Homo sapiens
tgaggcccagagagggaag

SEQ ID NO: 6493971 - DNA, 23 bp, Homo sapiens
tgaggcccagagagggaagatga

SEQ ID NO: 6493972 - DNA, 17 bp, Homo sapiens
tgaggcccagagggcct

SEQ ID NO: 6493973 - DNA, 19 bp, Homo sapiens
tgaggcccagcagagccgt

SEQ ID NO: 6493974 - DNA, 12 bp, Homo sapiens
tgaggcccagcc

SEQ ID NO: 6493975 - DNA, 13 bp, Homo sapiens
tgaggcccagcct

SEQ ID NO: 6493976 - DNA, 15 bp, Homo sapiens
tgaggcccagcctgt

SEQ ID NO: 6493977 - DNA, 21 bp, Homo sapiens
tggggtctctgcatcttcagt

SEQ ID NO: 6493978 - DNA, 21 bp, Homo sapiens
tggggtctggagttgatctgg

SEQ ID NO: 6493979 - DNA, 14 bp, Homo sapiens
tggggtctggcagc

SEQ ID NO: 6493980 - DNA, 13 bp, Homo sapiens
tggggtctgggag

SEQ ID NO: 6493981 - DNA, 14 bp, Homo sapiens
tggggtctgggagg

SEQ ID NO: 6493982 - DNA, 14 bp, Homo sapiens
tggggtctgggcag

SEQ ID NO: 6493983 - DNA, 22 bp, Homo sapiens
tggggtctgggcagtgccacag

SEQ ID NO: 6493984 - DNA, 13 bp, Homo sapiens
tggggtctgttct

SEQ ID NO: 6493985 - DNA, 23 bp, Homo sapiens
tggggtctgtttctggaaatgtt

SEQ ID NO: 6493986 - DNA, 20 bp, Homo sapiens
tggggtgaacagctggtgcc

SEQ ID NO: 6493987 - DNA, 13 bp, Homo sapiens
tggggtgaagctg

SEQ ID NO: 6493988 - DNA, 12 bp, Homo sapiens
tggggtgaatac

SEQ ID NO: 6493989 - DNA, 11 bp, Homo sapiens
tggggtgacag

SEQ ID NO: 6493990 - DNA, 12 bp, Homo sapiens
tggggtgacagt

SEQ ID NO: 6493991 - DNA, 15 bp, Homo sapiens
tggggtgacagtcat

SEQ ID NO: 6493992 - DNA, 22 bp, Homo sapiens
tggggtgacccggcaccccctg

SEQ ID NO: 6493993 - DNA, 22 bp, Homo sapiens
tggggtgagggagttagggaga

SEQ ID NO: 6493994 - DNA, 15 bp, Homo sapiens
tggggtgagggatca

SEQ ID NO: 6493995 - DNA, 16 bp, Homo sapiens
tggggtgataaggggc

SEQ ID NO: 6493996 - DNA, 17 bp, Homo sapiens
tggggtgatgctgggct

SEQ ID NO: 6493997 - DNA, 17 bp, Homo sapiens
tggggtgatggccagag

SEQ ID NO: 6493998 - DNA, 18 bp, Homo sapiens
tggggtgcagctgggtgg

SEQ ID NO: 6493999 - DNA, 19 bp, Homo sapiens
tggggtgcagggatgtggg

SEQ ID NO: 6494000 - DNA, 21 bp, Homo sapiens
tggggtgcatcccccagcact

SEQ ID NO: 6494001 - DNA, 15 bp, Homo sapiens
tggggtgcatcctcc

SEQ ID NO: 6494002 - DNA, 12 bp, Homo sapiens
tggggtgcatct

SEQ ID NO: 6494003 - DNA, 16 bp, Homo sapiens
tggggtgcatctcctc

SEQ ID NO: 6494004 - DNA, 15 bp, Homo sapiens
tggggtgcctgagcc

SEQ ID NO: 6494005 - DNA, 17 bp, Homo sapiens
tggggtgcctgagcccg

SEQ ID NO: 6494006 - DNA, 23 bp, Homo sapiens
tggggtgccttcactgggccagt

SEQ ID NO: 6494007 - DNA, 13 bp, Homo sapiens
tggggtgctggga

SEQ ID NO: 6494008 - DNA, 13 bp, Homo sapiens
tggggtgcttcct

SEQ ID NO: 6494009 - DNA, 14 bp, Homo sapiens
tggggtgcttcctt

SEQ ID NO: 6494010 - DNA, 17 bp, Homo sapiens
tggggtggagtgggaag

SEQ ID NO: 6494011 - DNA, 19 bp, Homo sapiens
tggggtggcacctgtttcc

SEQ ID NO: 6494012 - DNA, 18 bp, Homo sapiens
tggggtggccagggcttc

SEQ ID NO: 6494013 - DNA, 19 bp, Homo sapiens
tggggtggcgcgcctgcct

SEQ ID NO: 6494014 - DNA, 12 bp, Homo sapiens
tggggtggctgc

SEQ ID NO: 6494015 - DNA, 16 bp, Homo sapiens
tggggtggctgcagcc

SEQ ID NO: 6494016 - DNA, 14 bp, Homo sapiens
tggggtgggacagg

SEQ ID NO: 6494017 - DNA, 17 bp, Homo sapiens
tggggtgggagactttc

SEQ ID NO: 6494018 - DNA, 13 bp, Homo sapiens
tggggtgggagag

SEQ ID NO: 6494019 - DNA, 14 bp, Homo sapiens
tggggtgggagggc

SEQ ID NO: 6494020 - DNA, 15 bp, Homo sapiens
tggggtgggagggcg

SEQ ID NO: 6494021 - DNA, 12 bp, Homo sapiens
tggggtgggagt

SEQ ID NO: 6494022 - DNA, 12 bp, Homo sapiens
tggggtgggcct

SEQ ID NO: 6494023 - DNA, 16 bp, Homo sapiens
tggggtgggcctctgg

SEQ ID NO: 6494024 - DNA, 15 bp, Homo sapiens
tggggtgggctggag

SEQ ID NO: 6494025 - DNA, 18 bp, Homo sapiens
tggggtggggaagggaag

SEQ ID NO: 6494026 - DNA, 17 bp, Homo sapiens
tggggtggggacctcag

SEQ ID NO: 6494027 - DNA, 12 bp, Homo sapiens
tggggtggggca

SEQ ID NO: 6494028 - DNA, 15 bp, Homo sapiens
tggggtggggcggga

SEQ ID NO: 6494029 - DNA, 17 bp, Homo sapiens
tggggtggggcttggaa

SEQ ID NO: 6494030 - DNA, 22 bp, Homo sapiens
tggggtggggggatggtaagag

SEQ ID NO: 6494031 - DNA, 22 bp, Homo sapiens
tggggtggggggggtgctgggc

SEQ ID NO: 6494032 - DNA, 16 bp, Homo sapiens
tggggtgggggtgggc

SEQ ID NO: 6494033 - DNA, 22 bp, Homo sapiens
tggggtgggggtggggagacct

SEQ ID NO: 6494034 - DNA, 17 bp, Homo sapiens
tggggtgtggttccaga

SEQ ID NO: 6494035 - DNA, 18 bp, Homo sapiens
tggggtgttacagtagcc

SEQ ID NO: 6494036 - DNA, 23 bp, Homo sapiens
tggggttatctgaagtcagatct

SEQ ID NO: 6494037 - DNA, 23 bp, Homo sapiens
tggggttcaagaagtaatcagta

SEQ ID NO: 6494038 - DNA, 17 bp, Homo sapiens
tggggttcaagcccagg

SEQ ID NO: 6494039 - DNA, 15 bp, Homo sapiens
tggggttcagcccct

SEQ ID NO: 6494040 - DNA, 22 bp, Homo sapiens
tggggttcagcccctcctctgc

SEQ ID NO: 6494041 - DNA, 15 bp, Homo sapiens
tggggttcctgctgt

SEQ ID NO: 6494042 - DNA, 13 bp, Homo sapiens
tggggttctggaa

SEQ ID NO: 6494043 - DNA, 18 bp, Homo sapiens
tggggttgccagaggccc

SEQ ID NO: 6494044 - DNA, 20 bp, Homo sapiens
tggggttgccagaggccctg

SEQ ID NO: 6494045 - DNA, 21 bp, Homo sapiens
tggggttgccagaggccctgg

SEQ ID NO: 6494046 - DNA, 17 bp, Homo sapiens
tggggttgcccagcctg

SEQ ID NO: 6494047 - DNA, 19 bp, Homo sapiens
tggggttgccctgggggat

SEQ ID NO: 6494048 - DNA, 13 bp, Homo sapiens
tggggttggacat

SEQ ID NO: 6494049 - DNA, 19 bp, Homo sapiens
tggggttggcaacaggaca

SEQ ID NO: 6494050 - DNA, 21 bp, Homo sapiens
tggggttggcttccctggcat

SEQ ID NO: 6494051 - DNA, 17 bp, Homo sapiens
tggggttgggctctgcg

SEQ ID NO: 6494052 - DNA, 20 bp, Homo sapiens
tggggttgttgtctcatttt

SEQ ID NO: 6494053 - DNA, 19 bp, Homo sapiens
tggggtttaaatatccagg

SEQ ID NO: 6494054 - DNA, 21 bp, Homo sapiens
tggggtttaaatatccaggtg

SEQ ID NO: 6494055 - DNA, 23 bp, Homo sapiens
tggggtttaaatatccaggtgtg

SEQ ID NO: 6494056 - DNA, 16 bp, Homo sapiens
tggggtttcaccatat

SEQ ID NO: 6494057 - DNA, 16 bp, Homo sapiens
tggggtttccacacag

SEQ ID NO: 6494058 - DNA, 18 bp, Homo sapiens
tggggtttccacacaggc

SEQ ID NO: 6494059 - DNA, 20 bp, Homo sapiens
tggggtttccacacaggccc

SEQ ID NO: 6494060 - DNA, 21 bp, Homo sapiens
tggggtttccacacaggccca

SEQ ID NO: 6494061 - DNA, 14 bp, Homo sapiens
tggggtttcctgca

SEQ ID NO: 6494062 - DNA, 22 bp, Homo sapiens
tggggtttgaccacccacctga

SEQ ID NO: 6494063 - DNA, 23 bp, Homo sapiens
tggggtttgggcccctcagagcc

SEQ ID NO: 6494064 - DNA, 21 bp, Homo sapiens
tggggtttgtgtttgattggc

SEQ ID NO: 6494065 - DNA, 22 bp, Homo sapiens
tggggttttatggtggatgagg

SEQ ID NO: 6494066 - DNA, 17 bp, Homo sapiens
tggggttttatgtgtgg

SEQ ID NO: 6494067 - DNA, 20 bp, Homo sapiens
tggggttttcacttcctagg

SEQ ID NO: 6494068 - DNA, 16 bp, Homo sapiens
tggggtttttgccctg

SEQ ID NO: 6494069 - DNA, 20 bp, Homo sapiens
tggggttttttttttctgaa

SEQ ID NO: 6494070 - DNA, 22 bp, Homo sapiens
tggggttttttttttctgaata

SEQ ID NO: 6494071 - DNA, 17 bp, Homo sapiens
tgggtaaataaatgctg

SEQ ID NO: 6494072 - DNA, 13 bp, Homo sapiens
tgggtaagaaagc

SEQ ID NO: 6494073 - DNA, 15 bp, Homo sapiens
tgggtaagaggagca

SEQ ID NO: 6494074 - DNA, 19 bp, Homo sapiens
tgggtaagaggagcagagg

SEQ ID NO: 6494075 - DNA, 18 bp, Homo sapiens
tgggtaatcgatggggga

SEQ ID NO: 6494076 - DNA, 15 bp, Homo sapiens
tgggtacaagagcca

SEQ ID NO: 6494077 - DNA, 15 bp, Homo sapiens
tgggtacagagaggt

SEQ ID NO: 6494078 - DNA, 13 bp, Homo sapiens
tgggtaccaggcc

SEQ ID NO: 6494079 - DNA, 14 bp, Homo sapiens
tgggtaccaggcca

SEQ ID NO: 6494080 - DNA, 15 bp, Homo sapiens
tgggtaccaggccac

SEQ ID NO: 6494081 - DNA, 16 bp, Homo sapiens
tgggtaccatgctttt

SEQ ID NO: 6494082 - DNA, 18 bp, Homo sapiens
tgggtacccaaaacacat

SEQ ID NO: 6494083 - DNA, 17 bp, Homo sapiens
tgggtacccaggctggt

SEQ ID NO: 6494084 - DNA, 20 bp, Homo sapiens
tgggtactactgctgcaaag

SEQ ID NO: 6494085 - DNA, 23 bp, Homo sapiens
tgggtactggagcttttaaaaat

SEQ ID NO: 6494086 - DNA, 22 bp, Homo sapiens
tgggtactgtctcggcagaggt

SEQ ID NO: 6494087 - DNA, 20 bp, Homo sapiens
tgggtactttctgaaaattt

SEQ ID NO: 6494088 - DNA, 22 bp, Homo sapiens
tgggtagaaaaattattagaac

SEQ ID NO: 6494089 - DNA, 21 bp, Homo sapiens
tgggtagaagccacccttccc

SEQ ID NO: 6494090 - DNA, 13 bp, Homo sapiens
tgggtagaagcct

SEQ ID NO: 6494091 - DNA, 20 bp, Homo sapiens
tgggtagaatataaaataaa

SEQ ID NO: 6494092 - DNA, 16 bp, Homo sapiens
tgggtagacacacatg

SEQ ID NO: 6494093 - DNA, 16 bp, Homo sapiens
tgggtagatgtgcaat

SEQ ID NO: 6494094 - DNA, 20 bp, Homo sapiens
tgggtagcaattctacccag

SEQ ID NO: 6494095 - DNA, 13 bp, Homo sapiens
tgggtaggaaaat

SEQ ID NO: 6494096 - DNA, 14 bp, Homo sapiens
tgggtaggagccct

SEQ ID NO: 6494097 - DNA, 23 bp, Homo sapiens
tgggtaggccccacaaggcctgg

SEQ ID NO: 6494098 - DNA, 22 bp, Homo sapiens
tgggtaggccttggcccacctg

SEQ ID NO: 6494099 - DNA, 19 bp, Homo sapiens
tgggtaggttctgaacagc

SEQ ID NO: 6494100 - DNA, 17 bp, Homo sapiens
tgggtagtggggaagag

SEQ ID NO: 6494101 - DNA, 12 bp, Homo sapiens
tgggtataaaag

SEQ ID NO: 6494102 - DNA, 19 bp, Homo sapiens
tgggtatacctctaactgt

SEQ ID NO: 6494103 - DNA, 14 bp, Homo sapiens
tgggtatagatgtt

SEQ ID NO: 6494104 - DNA, 15 bp, Homo sapiens
tgggtatattcattt

SEQ ID NO: 6494105 - DNA, 19 bp, Homo sapiens
tgggtatattcatttcaaa

SEQ ID NO: 6494106 - DNA, 20 bp, Homo sapiens
tgggtatcaaacagctcagg

SEQ ID NO: 6494107 - DNA, 20 bp, Homo sapiens
tgggtatcaagacatagcat

SEQ ID NO: 6494108 - DNA, 14 bp, Homo sapiens
tgggtatcccacct

SEQ ID NO: 6494109 - DNA, 16 bp, Homo sapiens
tgggtatcccacctcc

SEQ ID NO: 6494110 - DNA, 20 bp, Homo sapiens
tgggtatcccacctccagcc

SEQ ID NO: 6494111 - DNA, 20 bp, Homo sapiens
tgggtatcccctgcctcctg

SEQ ID NO: 6494112 - DNA, 22 bp, Homo sapiens
tgggtatccttaatagaggagc

SEQ ID NO: 6494113 - DNA, 15 bp, Homo sapiens
tgggtatgttaacct

SEQ ID NO: 6494114 - DNA, 23 bp, Homo sapiens
tgggtatgttaacctaggcagtg

SEQ ID NO: 6494115 - DNA, 19 bp, Homo sapiens
tgggtattaccatgtaaat

SEQ ID NO: 6494116 - DNA, 14 bp, Homo sapiens
tgggtattgtaatc

SEQ ID NO: 6494117 - DNA, 24 bp, Homo sapiens
tgggtcaaaagagccctggctctg

SEQ ID NO: 6494118 - DNA, 23 bp, Homo sapiens
tgggtcaaagtggtacaggaagg

SEQ ID NO: 6494119 - DNA, 21 bp, Homo sapiens
tgggtcaacctttgtgtggct

SEQ ID NO: 6494120 - DNA, 13 bp, Homo sapiens
tgggtcaaggaat

SEQ ID NO: 6494121 - DNA, 15 bp, Homo sapiens
tgggtcaaggacagg

SEQ ID NO: 6494122 - DNA, 18 bp, Homo sapiens
tgggtcaaggacagggct

SEQ ID NO: 6494123 - DNA, 16 bp, Homo sapiens
tgggtcaattccttag

SEQ ID NO: 6494124 - DNA, 14 bp, Homo sapiens
tgggtcacaggaag

SEQ ID NO: 6494125 - DNA, 20 bp, Homo sapiens
tgggtcaccagacggggctg

SEQ ID NO: 6494126 - DNA, 18 bp, Homo sapiens
tgggtcacccctccagga

SEQ ID NO: 6494127 - DNA, 18 bp, Homo sapiens
tgggtcactacagggaga

SEQ ID NO: 6494128 - DNA, 16 bp, Homo sapiens
tgggtcagaacatgtt

SEQ ID NO: 6494129 - DNA, 18 bp, Homo sapiens
tgggtcagaaccctgcca

SEQ ID NO: 6494130 - DNA, 21 bp, Homo sapiens
tgggtcagacccatctctccc

SEQ ID NO: 6494131 - DNA, 14 bp, Homo sapiens
tgggtcagagaaaa

SEQ ID NO: 6494132 - DNA, 18 bp, Homo sapiens
tgggtcagatttatttgt

SEQ ID NO: 6494133 - DNA, 13 bp, Homo sapiens
tgggtcagcccag

SEQ ID NO: 6494134 - DNA, 23 bp, Homo sapiens
tgggtcagggccagactggaaga

SEQ ID NO: 6494135 - DNA, 20 bp, Homo sapiens
tgggtcaggggtacacagag

SEQ ID NO: 6494136 - DNA, 21 bp, Homo sapiens
tgggtcaggggtacacagagc

SEQ ID NO: 6494137 - DNA, 18 bp, Homo sapiens
tgggtcagggtgtgaggc

SEQ ID NO: 6494138 - DNA, 20 bp, Homo sapiens
tgggtcagggtgtgaggcca

SEQ ID NO: 6494139 - DNA, 15 bp, Homo sapiens
tgggtcagtgtgcca

SEQ ID NO: 6494140 - DNA, 16 bp, Homo sapiens
tgggtcagtgtgccac

SEQ ID NO: 6494141 - DNA, 17 bp, Homo sapiens
tgggtcagtgtgccacc

SEQ ID NO: 6494142 - DNA, 16 bp, Homo sapiens
tgggtcatagaaattc

SEQ ID NO: 6494143 - DNA, 14 bp, Homo sapiens
tgggtcatatggaa

SEQ ID NO: 6494144 - DNA, 22 bp, Homo sapiens
tgggtcatgatgctctttccca

SEQ ID NO: 6494145 - DNA, 16 bp, Homo sapiens
tgggtcatgggcctgt

SEQ ID NO: 6494146 - DNA, 17 bp, Homo sapiens
tgggtcatgggcctgtg

SEQ ID NO: 6494147 - DNA, 20 bp, Homo sapiens
tgggtcattgacctctcagg

SEQ ID NO: 6494148 - DNA, 21 bp, Homo sapiens
tgggtcattgacctctcaggg

SEQ ID NO: 6494149 - DNA, 16 bp, Homo sapiens
tgggtccaaataaaaa

SEQ ID NO: 6494150 - DNA, 22 bp, Homo sapiens
tgggtccaaataaaaactaaat

SEQ ID NO: 6494151 - DNA, 16 bp, Homo sapiens
tgggtccaccatgcag

SEQ ID NO: 6494152 - DNA, 12 bp, Homo sapiens
tgggtccagaag

SEQ ID NO: 6494153 - DNA, 18 bp, Homo sapiens
tgggtccaggaaggcagc

SEQ ID NO: 6494154 - DNA, 21 bp, Homo sapiens
tgggtccaggaaggcagctgc

SEQ ID NO: 6494155 - DNA, 20 bp, Homo sapiens
tgaggcccagcctgtcctgg

SEQ ID NO: 6494156 - DNA, 14 bp, Homo sapiens
tgaggcccagggag

SEQ ID NO: 6494157 - DNA, 20 bp, Homo sapiens
tgaggcccagggagaggcca

SEQ ID NO: 6494158 - DNA, 21 bp, Homo sapiens
tgaggccccagggctgtgggt

SEQ ID NO: 6494159 - DNA, 23 bp, Homo sapiens
tgaggccccagggctgtgggtgg

SEQ ID NO: 6494160 - DNA, 23 bp, Homo sapiens
tgaggcccccgcacgcaagcctc

SEQ ID NO: 6494161 - DNA, 22 bp, Homo sapiens
tgaggcccccgcagagactgtg

SEQ ID NO: 6494162 - DNA, 21 bp, Homo sapiens
tgaggcccctaggtgcccagg

SEQ ID NO: 6494163 - DNA, 14 bp, Homo sapiens
tgaggcccctgtgc

SEQ ID NO: 6494164 - DNA, 15 bp, Homo sapiens
tgaggcccctgtgca

SEQ ID NO: 6494165 - DNA, 19 bp, Homo sapiens
tgaggcccctgtgcagtag

SEQ ID NO: 6494166 - DNA, 20 bp, Homo sapiens
tgaggccctcactgagcctc

SEQ ID NO: 6494167 - DNA, 18 bp, Homo sapiens
tgaggccctccacacctg

SEQ ID NO: 6494168 - DNA, 15 bp, Homo sapiens
tgaggccctgggctg

SEQ ID NO: 6494169 - DNA, 12 bp, Homo sapiens
tgaggccctgtg

SEQ ID NO: 6494170 - DNA, 16 bp, Homo sapiens
tgaggccgcatctttc

SEQ ID NO: 6494171 - DNA, 20 bp, Homo sapiens
tgaggccgcggcctccccga

SEQ ID NO: 6494172 - DNA, 16 bp, Homo sapiens
tgaggccgctagaggc

SEQ ID NO: 6494173 - DNA, 18 bp, Homo sapiens
tgaggccgctagaggcct

SEQ ID NO: 6494174 - DNA, 14 bp, Homo sapiens
tgaggccggccctg

SEQ ID NO: 6494175 - DNA, 19 bp, Homo sapiens
tgaggccggccctgcccct

SEQ ID NO: 6494176 - DNA, 14 bp, Homo sapiens
tgaggccgttgctg

SEQ ID NO: 6494177 - DNA, 17 bp, Homo sapiens
tgaggcctatgcagaca

SEQ ID NO: 6494178 - DNA, 22 bp, Homo sapiens
tgaggcctccagcttcaggcag

SEQ ID NO: 6494179 - DNA, 13 bp, Homo sapiens
tgaggcctccctt

SEQ ID NO: 6494180 - DNA, 21 bp, Homo sapiens
tgaggcctcttggacctctgc

SEQ ID NO: 6494181 - DNA, 14 bp, Homo sapiens
tgaggcctgagacc

SEQ ID NO: 6494182 - DNA, 16 bp, Homo sapiens
tgaggcctgagaccca

SEQ ID NO: 6494183 - DNA, 23 bp, Homo sapiens
tgaggcctgagacccaggactcc

SEQ ID NO: 6494184 - DNA, 17 bp, Homo sapiens
tgaggcctgaggcctgt

SEQ ID NO: 6494185 - DNA, 19 bp, Homo sapiens
tgaggcctgccccctgggc

SEQ ID NO: 6494186 - DNA, 18 bp, Homo sapiens
tgaggcctgccctcaggg

SEQ ID NO: 6494187 - DNA, 17 bp, Homo sapiens
tgaggcctggactttcc

SEQ ID NO: 6494188 - DNA, 14 bp, Homo sapiens
tgaggcctggccag

SEQ ID NO: 6494189 - DNA, 15 bp, Homo sapiens
tgaggcctggccagg

SEQ ID NO: 6494190 - DNA, 22 bp, Homo sapiens
tgaggcctgggccgctgccacg

SEQ ID NO: 6494191 - DNA, 16 bp, Homo sapiens
tgaggcctgtctgtga

SEQ ID NO: 6494192 - DNA, 19 bp, Homo sapiens
tgaggcctttccccagtgt

SEQ ID NO: 6494193 - DNA, 14 bp, Homo sapiens
tgaggcggagctcc

SEQ ID NO: 6494194 - DNA, 15 bp, Homo sapiens
tgaggcggaggctgt

SEQ ID NO: 6494195 - DNA, 16 bp, Homo sapiens
tgaggcggaggctgtg

SEQ ID NO: 6494196 - DNA, 19 bp, Homo sapiens
tgaggcggaggctgtgctc

SEQ ID NO: 6494197 - DNA, 18 bp, Homo sapiens
tgaggcgggaaccctctg

SEQ ID NO: 6494198 - DNA, 20 bp, Homo sapiens
tgaggcgggtggatcacgag

SEQ ID NO: 6494199 - DNA, 14 bp, Homo sapiens
tgaggcgggtggct

SEQ ID NO: 6494200 - DNA, 17 bp, Homo sapiens
tgaggcgggtggctggt

SEQ ID NO: 6494201 - DNA, 19 bp, Homo sapiens
tgaggcgtgggatccagag

SEQ ID NO: 6494202 - DNA, 14 bp, Homo sapiens
tgaggctaaaacaa

SEQ ID NO: 6494203 - DNA, 23 bp, Homo sapiens
tgaggctagtgtggtgtttcctg

SEQ ID NO: 6494204 - DNA, 17 bp, Homo sapiens
tgaggctcaagaggccc

SEQ ID NO: 6494205 - DNA, 13 bp, Homo sapiens
tgaggctcagtct

SEQ ID NO: 6494206 - DNA, 16 bp, Homo sapiens
tgaggctcagtctctc

SEQ ID NO: 6494207 - DNA, 18 bp, Homo sapiens
tgaggctccacttggtct

SEQ ID NO: 6494208 - DNA, 15 bp, Homo sapiens
tgaggctcctgtgct

SEQ ID NO: 6494209 - DNA, 19 bp, Homo sapiens
tgaggctctctaagaaaag

SEQ ID NO: 6494210 - DNA, 16 bp, Homo sapiens
tgaggctctgtcactg

SEQ ID NO: 6494211 - DNA, 17 bp, Homo sapiens
tgaggctctttctgggc

SEQ ID NO: 6494212 - DNA, 23 bp, Homo sapiens
tgaggctgacatgctcacacatt

SEQ ID NO: 6494213 - DNA, 23 bp, Homo sapiens
tgaggctgactggatgtccagag

SEQ ID NO: 6494214 - DNA, 15 bp, Homo sapiens
tgaggctgagaaagc

SEQ ID NO: 6494215 - DNA, 12 bp, Homo sapiens
tgaggctgaggc

SEQ ID NO: 6494216 - DNA, 17 bp, Homo sapiens
tgaggctgaggcaggag

SEQ ID NO: 6494217 - DNA, 13 bp, Homo sapiens
tgaggctgcagcg

SEQ ID NO: 6494218 - DNA, 20 bp, Homo sapiens
tgaggctgctttccaaagcc

SEQ ID NO: 6494219 - DNA, 16 bp, Homo sapiens
tgaggctggactccag

SEQ ID NO: 6494220 - DNA, 22 bp, Homo sapiens
tgaggctggactccagatctgc

SEQ ID NO: 6494221 - DNA, 18 bp, Homo sapiens
tgaggctggataggagag

SEQ ID NO: 6494222 - DNA, 22 bp, Homo sapiens
tgaggctggataggagaggaaa

SEQ ID NO: 6494223 - DNA, 17 bp, Homo sapiens
tgaggctggcacaggac

SEQ ID NO: 6494224 - DNA, 17 bp, Homo sapiens
tgaggctggcatcctgg

SEQ ID NO: 6494225 - DNA, 20 bp, Homo sapiens
tgaggctggcatcctggctg

SEQ ID NO: 6494226 - DNA, 21 bp, Homo sapiens
tgaggctggcatcctggctgg

SEQ ID NO: 6494227 - DNA, 12 bp, Homo sapiens
tgaggctgggaa

SEQ ID NO: 6494228 - DNA, 14 bp, Homo sapiens
tgaggctgggcagg

SEQ ID NO: 6494229 - DNA, 14 bp, Homo sapiens
tgaggctgggccag

SEQ ID NO: 6494230 - DNA, 24 bp, Homo sapiens
tgaggctgggccagcctcagctca

SEQ ID NO: 6494231 - DNA, 13 bp, Homo sapiens
tgaggctggggct

SEQ ID NO: 6494232 - DNA, 23 bp, Homo sapiens
tgaggctggttttgatggctggg

SEQ ID NO: 6494233 - DNA, 12 bp, Homo sapiens
tgaggctgtcct

SEQ ID NO: 6494234 - DNA, 13 bp, Homo sapiens
tgaggctgtcctg

SEQ ID NO: 6494235 - DNA, 21 bp, Homo sapiens
tgaggctgtgcacctattctg

SEQ ID NO: 6494236 - DNA, 16 bp, Homo sapiens
tgaggctgtgtctctg

SEQ ID NO: 6494237 - DNA, 14 bp, Homo sapiens
tgaggcttaaacaa

SEQ ID NO: 6494238 - DNA, 15 bp, Homo sapiens
tgaggcttccagaga

SEQ ID NO: 6494239 - DNA, 16 bp, Homo sapiens
tgaggcttccagagag

SEQ ID NO: 6494240 - DNA, 13 bp, Homo sapiens
tgaggcttccagg

SEQ ID NO: 6494241 - DNA, 16 bp, Homo sapiens
tgaggcttccaggctc

SEQ ID NO: 6494242 - DNA, 17 bp, Homo sapiens
tgaggcttccaggctct

SEQ ID NO: 6494243 - DNA, 20 bp, Homo sapiens
tgaggcttccaggctcttcc

SEQ ID NO: 6494244 - DNA, 15 bp, Homo sapiens
tgaggcttcccagag

SEQ ID NO: 6494245 - DNA, 17 bp, Homo sapiens
tgaggcttctccttctc

SEQ ID NO: 6494246 - DNA, 18 bp, Homo sapiens
tgaggcttcttcctggat

SEQ ID NO: 6494247 - DNA, 12 bp, Homo sapiens
tgaggcttgccc

SEQ ID NO: 6494248 - DNA, 16 bp, Homo sapiens
tgaggcttgcccagga

SEQ ID NO: 6494249 - DNA, 18 bp, Homo sapiens
tgaggcttgcccaggagc

SEQ ID NO: 6494250 - DNA, 13 bp, Homo sapiens
tgaggcttgctga

SEQ ID NO: 6494251 - DNA, 16 bp, Homo sapiens
tgaggcttgctgagag

SEQ ID NO: 6494252 - DNA, 21 bp, Homo sapiens
tgaggcttgggcccagtagcc

SEQ ID NO: 6494253 - DNA, 16 bp, Homo sapiens
tgaggctttaaaaaga

SEQ ID NO: 6494254 - DNA, 14 bp, Homo sapiens
tgaggctttccatg

SEQ ID NO: 6494255 - DNA, 18 bp, Homo sapiens
tgaggctttggatttgac

SEQ ID NO: 6494256 - DNA, 23 bp, Homo sapiens
tgaggctttggatttgacattgc

SEQ ID NO: 6494257 - DNA, 20 bp, Homo sapiens
tgaggctttggtacccccaa

SEQ ID NO: 6494258 - DNA, 18 bp, Homo sapiens
tgaggctttgtgttgtaa

SEQ ID NO: 6494259 - DNA, 18 bp, Homo sapiens
tgaggcttttcccaccag

SEQ ID NO: 6494260 - DNA, 20 bp, Homo sapiens
tgaggcttttcccaccagct

SEQ ID NO: 6494261 - DNA, 19 bp, Homo sapiens
tgagggaaaacccaatgtc

SEQ ID NO: 6494262 - DNA, 17 bp, Homo sapiens
tgagggaaaagaaaaag

SEQ ID NO: 6494263 - DNA, 21 bp, Homo sapiens
tgagggaaatctgtaaagcca

SEQ ID NO: 6494264 - DNA, 16 bp, Homo sapiens
tgagggaaatgttttg

SEQ ID NO: 6494265 - DNA, 20 bp, Homo sapiens
tgagggaacagacaggagaa

SEQ ID NO: 6494266 - DNA, 13 bp, Homo sapiens
tgagggaagccca

SEQ ID NO: 6494267 - DNA, 22 bp, Homo sapiens
tgagggaagcccacccgcccca

SEQ ID NO: 6494268 - DNA, 12 bp, Homo sapiens
tgagggaaggag

SEQ ID NO: 6494269 - DNA, 15 bp, Homo sapiens
tgagggaatgacacc

SEQ ID NO: 6494270 - DNA, 16 bp, Homo sapiens
tgagggaatgacacca

SEQ ID NO: 6494271 - DNA, 19 bp, Homo sapiens
tgagggaatgacaccatca

SEQ ID NO: 6494272 - DNA, 14 bp, Homo sapiens
tgagggacagagcc

SEQ ID NO: 6494273 - DNA, 20 bp, Homo sapiens
tgagggacatatcagtgacc

SEQ ID NO: 6494274 - DNA, 13 bp, Homo sapiens
tgagggaccagcc

SEQ ID NO: 6494275 - DNA, 15 bp, Homo sapiens
tgagggaccttggag

SEQ ID NO: 6494276 - DNA, 23 bp, Homo sapiens
tgagggacgaggtcaaggagata

SEQ ID NO: 6494277 - DNA, 16 bp, Homo sapiens
tgagggactgcctctg

SEQ ID NO: 6494278 - DNA, 17 bp, Homo sapiens
tgagggagaacaagacc

SEQ ID NO: 6494279 - DNA, 22 bp, Homo sapiens
tgagggagaatcctcccttccc

SEQ ID NO: 6494280 - DNA, 20 bp, Homo sapiens
tgagggagagaactgagcat

SEQ ID NO: 6494281 - DNA, 20 bp, Homo sapiens
tgagggagctgggagaccct

SEQ ID NO: 6494282 - DNA, 14 bp, Homo sapiens
tgagggagcttagc

SEQ ID NO: 6494283 - DNA, 17 bp, Homo sapiens
tgagggaggaggcagga

SEQ ID NO: 6494284 - DNA, 14 bp, Homo sapiens
tgagggaggaggcc

SEQ ID NO: 6494285 - DNA, 19 bp, Homo sapiens
tgagggaggaggccacctc

SEQ ID NO: 6494286 - DNA, 20 bp, Homo sapiens
tgagggaggaggccacctct

SEQ ID NO: 6494287 - DNA, 23 bp, Homo sapiens
tgagggaggaggccacctctcca

SEQ ID NO: 6494288 - DNA, 14 bp, Homo sapiens
tgagggaggggaaa

SEQ ID NO: 6494289 - DNA, 18 bp, Homo sapiens
tgagggatcacagggccc

SEQ ID NO: 6494290 - DNA, 19 bp, Homo sapiens
tgagggatctgagtaggtc

SEQ ID NO: 6494291 - DNA, 15 bp, Homo sapiens
tgagggatgacttac

SEQ ID NO: 6494292 - DNA, 17 bp, Homo sapiens
tgagggatgggcctggc

SEQ ID NO: 6494293 - DNA, 20 bp, Homo sapiens
tgagggattttagcctcttc

SEQ ID NO: 6494294 - DNA, 17 bp, Homo sapiens
tgagggcaaaccaggct

SEQ ID NO: 6494295 - DNA, 19 bp, Homo sapiens
tgagggcaaaccaggctgc

SEQ ID NO: 6494296 - DNA, 20 bp, Homo sapiens
tgagggcaaaccaggctgca

SEQ ID NO: 6494297 - DNA, 12 bp, Homo sapiens
tgagggcaaatc

SEQ ID NO: 6494298 - DNA, 21 bp, Homo sapiens
tgagggcaagaggtgcctggg

SEQ ID NO: 6494299 - DNA, 22 bp, Homo sapiens
tgagggcagcactgggaagctg

SEQ ID NO: 6494300 - DNA, 15 bp, Homo sapiens
tgagggcagcagcca

SEQ ID NO: 6494301 - DNA, 22 bp, Homo sapiens
tgagggcagcagccagccctgc

SEQ ID NO: 6494302 - DNA, 14 bp, Homo sapiens
tgagggcagtgcaa

SEQ ID NO: 6494303 - DNA, 15 bp, Homo sapiens
tgagggcagtgcaag

SEQ ID NO: 6494304 - DNA, 19 bp, Homo sapiens
tgagggcagttcgcagcca

SEQ ID NO: 6494305 - DNA, 23 bp, Homo sapiens
tgagggcagttcgcagccaccct

SEQ ID NO: 6494306 - DNA, 23 bp, Homo sapiens
tgagggcatgtgcggctgaactg

SEQ ID NO: 6494307 - DNA, 18 bp, Homo sapiens
tgagggcatttggcttcc

SEQ ID NO: 6494308 - DNA, 15 bp, Homo sapiens
tgagggccaccagga

SEQ ID NO: 6494309 - DNA, 17 bp, Homo sapiens
tgagggccagggaccca

SEQ ID NO: 6494310 - DNA, 12 bp, Homo sapiens
tgagggcccaga

SEQ ID NO: 6494311 - DNA, 19 bp, Homo sapiens
tgagggcccagagcaggaa

SEQ ID NO: 6494312 - DNA, 22 bp, Homo sapiens
tgagggcccagccaggagcaga

SEQ ID NO: 6494313 - DNA, 17 bp, Homo sapiens
tgagggcccctctgccc

SEQ ID NO: 6494314 - DNA, 13 bp, Homo sapiens
tgagggccctgtg

SEQ ID NO: 6494315 - DNA, 15 bp, Homo sapiens
tgagggccctgtgga

SEQ ID NO: 6494316 - DNA, 17 bp, Homo sapiens
tgagggcctcagagcct

SEQ ID NO: 6494317 - DNA, 15 bp, Homo sapiens
tgagggcctgctgga

SEQ ID NO: 6494318 - DNA, 20 bp, Homo sapiens
tgagggcctgctggaggcct

SEQ ID NO: 6494319 - DNA, 19 bp, Homo sapiens
tgagggccttcttaagata

SEQ ID NO: 6494320 - DNA, 23 bp, Homo sapiens
tgagggcgtggggaatgggcagg

SEQ ID NO: 6494321 - DNA, 11 bp, Homo sapiens
tgagggctcca

SEQ ID NO: 6494322 - DNA, 13 bp, Homo sapiens
tgagggctgccag

SEQ ID NO: 6494323 - DNA, 11 bp, Homo sapiens
tgagggctggg

SEQ ID NO: 6494324 - DNA, 13 bp, Homo sapiens
tgagggctgggca

SEQ ID NO: 6494325 - DNA, 16 bp, Homo sapiens
tgagggctgggcccac

SEQ ID NO: 6494326 - DNA, 13 bp, Homo sapiens
tgaggggaaaaaa

SEQ ID NO: 6494327 - DNA, 23 bp, Homo sapiens
tgaggggaaaccttcacccagca

SEQ ID NO: 6494328 - DNA, 13 bp, Homo sapiens
tgaggggaagctg

SEQ ID NO: 6494329 - DNA, 16 bp, Homo sapiens
tgaggggaccaggagt

SEQ ID NO: 6494330 - DNA, 14 bp, Homo sapiens
tgaggggacccagc

SEQ ID NO: 6494331 - DNA, 15 bp, Homo sapiens
tgaggggactgcatg

SEQ ID NO: 6494332 - DNA, 16 bp, Homo sapiens
tgaggggagaggagac

SEQ ID NO: 6494333 - DNA, 11 bp, Homo sapiens
tgaggggagga

SEQ ID NO: 6494334 - DNA, 22 bp, Homo sapiens
tgggtccaggaaggcagctgct

SEQ ID NO: 6494335 - DNA, 12 bp, Homo sapiens
tgggtccaggag

SEQ ID NO: 6494336 - DNA, 13 bp, Homo sapiens
tgggtccaggagg

SEQ ID NO: 6494337 - DNA, 18 bp, Homo sapiens
tgggtccaggcctactcc

SEQ ID NO: 6494338 - DNA, 13 bp, Homo sapiens
tgggtccagggag

SEQ ID NO: 6494339 - DNA, 22 bp, Homo sapiens
tgggtccagggcctgacacccc

SEQ ID NO: 6494340 - DNA, 21 bp, Homo sapiens
tgggtccaggggcccctccag

SEQ ID NO: 6494341 - DNA, 16 bp, Homo sapiens
tgggtccattcagatg

SEQ ID NO: 6494342 - DNA, 17 bp, Homo sapiens
tgggtcccacttcccct

SEQ ID NO: 6494343 - DNA, 15 bp, Homo sapiens
tgggtcccagagacc

SEQ ID NO: 6494344 - DNA, 15 bp, Homo sapiens
tgggtcccagcctgg

SEQ ID NO: 6494345 - DNA, 12 bp, Homo sapiens
tgggtcccaggg

SEQ ID NO: 6494346 - DNA, 15 bp, Homo sapiens
tgggtcccagggctg

SEQ ID NO: 6494347 - DNA, 15 bp, Homo sapiens
tgggtccccagccct

SEQ ID NO: 6494348 - DNA, 13 bp, Homo sapiens
tgggtccccctcc

SEQ ID NO: 6494349 - DNA, 15 bp, Homo sapiens
tgggtccccctcctg

SEQ ID NO: 6494350 - DNA, 17 bp, Homo sapiens
tgggtccccctcctgca

SEQ ID NO: 6494351 - DNA, 18 bp, Homo sapiens
tgggtcccgcactctgcc

SEQ ID NO: 6494352 - DNA, 21 bp, Homo sapiens
tgggtcccgggttagcctggt

SEQ ID NO: 6494353 - DNA, 14 bp, Homo sapiens
tgggtcccttgctg

SEQ ID NO: 6494354 - DNA, 21 bp, Homo sapiens
tgggtccgataatatctttgt

SEQ ID NO: 6494355 - DNA, 17 bp, Homo sapiens
tgggtccgcatccctgc

SEQ ID NO: 6494356 - DNA, 19 bp, Homo sapiens
tgggtcctactcctggagc

SEQ ID NO: 6494357 - DNA, 20 bp, Homo sapiens
tgggtcctactcctggagca

SEQ ID NO: 6494358 - DNA, 20 bp, Homo sapiens
tgggtcctagcccttccctg

SEQ ID NO: 6494359 - DNA, 13 bp, Homo sapiens
tgggtcctcccag

SEQ ID NO: 6494360 - DNA, 15 bp, Homo sapiens
tgggtcctcggccca

SEQ ID NO: 6494361 - DNA, 17 bp, Homo sapiens
tgggtcctcggcccatc

SEQ ID NO: 6494362 - DNA, 23 bp, Homo sapiens
tgggtcctcggcccatctgtcca

SEQ ID NO: 6494363 - DNA, 14 bp, Homo sapiens
tgggtcctgaagaa

SEQ ID NO: 6494364 - DNA, 16 bp, Homo sapiens
tgggtcctgccagctg

SEQ ID NO: 6494365 - DNA, 12 bp, Homo sapiens
tgggtcctgcct

SEQ ID NO: 6494366 - DNA, 14 bp, Homo sapiens
tgggtcctgcctgc

SEQ ID NO: 6494367 - DNA, 16 bp, Homo sapiens
tgggtcctgcctgcag

SEQ ID NO: 6494368 - DNA, 17 bp, Homo sapiens
tgggtcctgcctgcagt

SEQ ID NO: 6494369 - DNA, 21 bp, Homo sapiens
tgggtcctgcctggtcctccc

SEQ ID NO: 6494370 - DNA, 15 bp, Homo sapiens
tgggtcctgggcagg

SEQ ID NO: 6494371 - DNA, 21 bp, Homo sapiens
tgggtcctgggtctttcatgg

SEQ ID NO: 6494372 - DNA, 22 bp, Homo sapiens
tgggtccttggctcccgggggc

SEQ ID NO: 6494373 - DNA, 18 bp, Homo sapiens
tgggtccttttcagaagt

SEQ ID NO: 6494374 - DNA, 21 bp, Homo sapiens
tgggtcgccctaccctcactc

SEQ ID NO: 6494375 - DNA, 17 bp, Homo sapiens
tgggtcggccctgccca

SEQ ID NO: 6494376 - DNA, 13 bp, Homo sapiens
tgggtcgggagag

SEQ ID NO: 6494377 - DNA, 16 bp, Homo sapiens
tgggtcgggagagggg

SEQ ID NO: 6494378 - DNA, 21 bp, Homo sapiens
tgggtcgggagaggggacgca

SEQ ID NO: 6494379 - DNA, 16 bp, Homo sapiens
tgggtcgtggtggaga

SEQ ID NO: 6494380 - DNA, 18 bp, Homo sapiens
tgggtctaatccttctca

SEQ ID NO: 6494381 - DNA, 14 bp, Homo sapiens
tgggtctattccag

SEQ ID NO: 6494382 - DNA, 19 bp, Homo sapiens
tgggtctattccagctcat

SEQ ID NO: 6494383 - DNA, 17 bp, Homo sapiens
tgggtctcactctctgg

SEQ ID NO: 6494384 - DNA, 16 bp, Homo sapiens
tgggtctcagtgtcct

SEQ ID NO: 6494385 - DNA, 20 bp, Homo sapiens
tgggtctcgctttgttgccc

SEQ ID NO: 6494386 - DNA, 14 bp, Homo sapiens
tgggtctctgaagg

SEQ ID NO: 6494387 - DNA, 14 bp, Homo sapiens
tgggtctctggaag

SEQ ID NO: 6494388 - DNA, 12 bp, Homo sapiens
tgggtctctggg

SEQ ID NO: 6494389 - DNA, 16 bp, Homo sapiens
tgggtctctgggcaca

SEQ ID NO: 6494390 - DNA, 22 bp, Homo sapiens
tgggtctctggggaccctccag

SEQ ID NO: 6494391 - DNA, 15 bp, Homo sapiens
tgggtctctgtgtgt

SEQ ID NO: 6494392 - DNA, 16 bp, Homo sapiens
tgggtctgaaaggaaa

SEQ ID NO: 6494393 - DNA, 13 bp, Homo sapiens
tgggtctgacctg

SEQ ID NO: 6494394 - DNA, 17 bp, Homo sapiens
tgggtctgacctggtgg

SEQ ID NO: 6494395 - DNA, 18 bp, Homo sapiens
tgggtctgacctggtggg

SEQ ID NO: 6494396 - DNA, 12 bp, Homo sapiens
tgggtctgagct

SEQ ID NO: 6494397 - DNA, 15 bp, Homo sapiens
tgggtctgagctgga

SEQ ID NO: 6494398 - DNA, 13 bp, Homo sapiens
tgggtctggagga

SEQ ID NO: 6494399 - DNA, 15 bp, Homo sapiens
tgggtctggctgagc

SEQ ID NO: 6494400 - DNA, 16 bp, Homo sapiens
tgggtctggggaggga

SEQ ID NO: 6494401 - DNA, 14 bp, Homo sapiens
tgggtctgtgcatt

SEQ ID NO: 6494402 - DNA, 14 bp, Homo sapiens
tgggtctgtgtctc

SEQ ID NO: 6494403 - DNA, 15 bp, Homo sapiens
tgggtctgttttcct

SEQ ID NO: 6494404 - DNA, 17 bp, Homo sapiens
tgggtcttatgcttcca

SEQ ID NO: 6494405 - DNA, 11 bp, Homo sapiens
tgggtcttcca

SEQ ID NO: 6494406 - DNA, 19 bp, Homo sapiens
tgggtctttaataaaacaa

SEQ ID NO: 6494407 - DNA, 20 bp, Homo sapiens
tgggtctttaataaaacaac

SEQ ID NO: 6494408 - DNA, 20 bp, Homo sapiens
tgggtcttttataggaaaaa

SEQ ID NO: 6494409 - DNA, 21 bp, Homo sapiens
tgggtcttttataggaaaaaa

SEQ ID NO: 6494410 - DNA, 17 bp, Homo sapiens
tgggtctttttctcttc

SEQ ID NO: 6494411 - DNA, 20 bp, Homo sapiens
tgggtctttttctcttctgt

SEQ ID NO: 6494412 - DNA, 15 bp, Homo sapiens
tgggtgaaagtgact

SEQ ID NO: 6494413 - DNA, 20 bp, Homo sapiens
tgggtgaaggcctggctgga

SEQ ID NO: 6494414 - DNA, 14 bp, Homo sapiens
tgggtgaaggctgg

SEQ ID NO: 6494415 - DNA, 16 bp, Homo sapiens
tgggtgaaggctggca

SEQ ID NO: 6494416 - DNA, 19 bp, Homo sapiens
tgggtgaaggctggcatga

SEQ ID NO: 6494417 - DNA, 16 bp, Homo sapiens
tgggtgaagtgcctgc

SEQ ID NO: 6494418 - DNA, 17 bp, Homo sapiens
tgggtgaagtgcctgct

SEQ ID NO: 6494419 - DNA, 14 bp, Homo sapiens
tgggtgaatcttga

SEQ ID NO: 6494420 - DNA, 17 bp, Homo sapiens
tgggtgacagagcaaga

SEQ ID NO: 6494421 - DNA, 21 bp, Homo sapiens
tgggtgacagagcgagacttt

SEQ ID NO: 6494422 - DNA, 15 bp, Homo sapiens
tgggtgacagagtga

SEQ ID NO: 6494423 - DNA, 13 bp, Homo sapiens
tgggtgacggtcc

SEQ ID NO: 6494424 - DNA, 12 bp, Homo sapiens
tgggtgagaaat

SEQ ID NO: 6494425 - DNA, 14 bp, Homo sapiens
tgggtgagaaattt

SEQ ID NO: 6494426 - DNA, 12 bp, Homo sapiens
tgggtgagagag

SEQ ID NO: 6494427 - DNA, 13 bp, Homo sapiens
tgggtgagagagg

SEQ ID NO: 6494428 - DNA, 18 bp, Homo sapiens
tgggtgagatgctggaga

SEQ ID NO: 6494429 - DNA, 21 bp, Homo sapiens
tgggtgagatgctggagaaga

SEQ ID NO: 6494430 - DNA, 15 bp, Homo sapiens
tgggtgagccaagga

SEQ ID NO: 6494431 - DNA, 21 bp, Homo sapiens
tgggtgagctctcaggccgag

SEQ ID NO: 6494432 - DNA, 13 bp, Homo sapiens
tgggtgaggggag

SEQ ID NO: 6494433 - DNA, 19 bp, Homo sapiens
tgggtgatcagaaggctgg

SEQ ID NO: 6494434 - DNA, 22 bp, Homo sapiens
tgggtgatgcttttgctgctgc

SEQ ID NO: 6494435 - DNA, 15 bp, Homo sapiens
tgggtgattatgaaa

SEQ ID NO: 6494436 - DNA, 20 bp, Homo sapiens
tgggtgattcctcccaggag

SEQ ID NO: 6494437 - DNA, 16 bp, Homo sapiens
tgggtgatttctagaa

SEQ ID NO: 6494438 - DNA, 15 bp, Homo sapiens
tgggtgcagctgggc

SEQ ID NO: 6494439 - DNA, 21 bp, Homo sapiens
tgggtgcagctgggcttggcc

SEQ ID NO: 6494440 - DNA, 14 bp, Homo sapiens
tgggtgcaggagcg

SEQ ID NO: 6494441 - DNA, 21 bp, Homo sapiens
tgggtgcatatgtacagaaga

SEQ ID NO: 6494442 - DNA, 15 bp, Homo sapiens
tgggtgccatgtgga

SEQ ID NO: 6494443 - DNA, 18 bp, Homo sapiens
tgggtgcccacagcccgc

SEQ ID NO: 6494444 - DNA, 20 bp, Homo sapiens
tgggtgcccgtatccagagt

SEQ ID NO: 6494445 - DNA, 13 bp, Homo sapiens
tgggtgccctgaa

SEQ ID NO: 6494446 - DNA, 19 bp, Homo sapiens
tgggtgccctggctccttg

SEQ ID NO: 6494447 - DNA, 15 bp, Homo sapiens
tgggtgccctgttga

SEQ ID NO: 6494448 - DNA, 20 bp, Homo sapiens
tgggtgccctttcctggcag

SEQ ID NO: 6494449 - DNA, 21 bp, Homo sapiens
tgggtgcctaggcctgggcag

SEQ ID NO: 6494450 - DNA, 13 bp, Homo sapiens
tgggtgcctcctg

SEQ ID NO: 6494451 - DNA, 15 bp, Homo sapiens
tgggtgcctcctgca

SEQ ID NO: 6494452 - DNA, 16 bp, Homo sapiens
tgggtgcctcctgcag

SEQ ID NO: 6494453 - DNA, 21 bp, Homo sapiens
tgggtgcgaccccatctgccc

SEQ ID NO: 6494454 - DNA, 22 bp, Homo sapiens
tgggtgcgaccccatctgccca

SEQ ID NO: 6494455 - DNA, 17 bp, Homo sapiens
tgggtgctagatccagc

SEQ ID NO: 6494456 - DNA, 20 bp, Homo sapiens
tgggtgctagatccagccca

SEQ ID NO: 6494457 - DNA, 14 bp, Homo sapiens
tgggtgctcagaat

SEQ ID NO: 6494458 - DNA, 22 bp, Homo sapiens
tgggtgctcagaataaggcagg

SEQ ID NO: 6494459 - DNA, 17 bp, Homo sapiens
tgggtgctcagggcatg

SEQ ID NO: 6494460 - DNA, 16 bp, Homo sapiens
tgggtgctctggctgg

SEQ ID NO: 6494461 - DNA, 18 bp, Homo sapiens
tgggtgctgatccttgca

SEQ ID NO: 6494462 - DNA, 13 bp, Homo sapiens
tgggtgctgccct

SEQ ID NO: 6494463 - DNA, 18 bp, Homo sapiens
tgggtgctggctgcccag

SEQ ID NO: 6494464 - DNA, 19 bp, Homo sapiens
tgggtggaaccaggaacct

SEQ ID NO: 6494465 - DNA, 18 bp, Homo sapiens
tgggtggaagcctcagag

SEQ ID NO: 6494466 - DNA, 17 bp, Homo sapiens
tgggtggaagggctggg

SEQ ID NO: 6494467 - DNA, 18 bp, Homo sapiens
tgggtggaagtgcccagc

SEQ ID NO: 6494468 - DNA, 12 bp, Homo sapiens
tgggtggagaag

SEQ ID NO: 6494469 - DNA, 16 bp, Homo sapiens
tgggtggagaagccat

SEQ ID NO: 6494470 - DNA, 17 bp, Homo sapiens
tgggtggagaagccatt

SEQ ID NO: 6494471 - DNA, 13 bp, Homo sapiens
tgggtggagaagg

SEQ ID NO: 6494472 - DNA, 19 bp, Homo sapiens
tgggtggagaagggagggt

SEQ ID NO: 6494473 - DNA, 20 bp, Homo sapiens
tgggtggagaagggagggtg

SEQ ID NO: 6494474 - DNA, 20 bp, Homo sapiens
tgggtggatataaatatata

SEQ ID NO: 6494475 - DNA, 21 bp, Homo sapiens
tgggtggcaccagcagcctgg

SEQ ID NO: 6494476 - DNA, 15 bp, Homo sapiens
tgggtggcactgcca

SEQ ID NO: 6494477 - DNA, 18 bp, Homo sapiens
tgggtggcaggggggctg

SEQ ID NO: 6494478 - DNA, 14 bp, Homo sapiens
tgggtggcccatcc

SEQ ID NO: 6494479 - DNA, 21 bp, Homo sapiens
tgggtggcccctgctgtctct

SEQ ID NO: 6494480 - DNA, 15 bp, Homo sapiens
tgggtggccggccct

SEQ ID NO: 6494481 - DNA, 19 bp, Homo sapiens
tgggtggccggccctgccc

SEQ ID NO: 6494482 - DNA, 20 bp, Homo sapiens
tgggtggccggccctgcccc

SEQ ID NO: 6494483 - DNA, 22 bp, Homo sapiens
tgggtggctcctgccactgacc

SEQ ID NO: 6494484 - DNA, 17 bp, Homo sapiens
tgggtgggacacagaga

SEQ ID NO: 6494485 - DNA, 12 bp, Homo sapiens
tgggtgggagag

SEQ ID NO: 6494486 - DNA, 21 bp, Homo sapiens
tgggtgggattttttcccttt

SEQ ID NO: 6494487 - DNA, 16 bp, Homo sapiens
tgggtgggcaggaaaa

SEQ ID NO: 6494488 - DNA, 18 bp, Homo sapiens
tgggtgggcaggaaaagg

SEQ ID NO: 6494489 - DNA, 20 bp, Homo sapiens
tgggtgggcagggaggggct

SEQ ID NO: 6494490 - DNA, 15 bp, Homo sapiens
tgggtgggcctgact

SEQ ID NO: 6494491 - DNA, 16 bp, Homo sapiens
tgggtgggcctggccc

SEQ ID NO: 6494492 - DNA, 23 bp, Homo sapiens
tgggtgggcctggccctgctttc

SEQ ID NO: 6494493 - DNA, 19 bp, Homo sapiens
tgggtgggctctgtgcagt

SEQ ID NO: 6494494 - DNA, 19 bp, Homo sapiens
tgggtggggacagaccagc

SEQ ID NO: 6494495 - DNA, 18 bp, Homo sapiens
tgggtggggaggccctgc

SEQ ID NO: 6494496 - DNA, 20 bp, Homo sapiens
tgggtggggcagcacacctc

SEQ ID NO: 6494497 - DNA, 14 bp, Homo sapiens
tgggtggggctcct

SEQ ID NO: 6494498 - DNA, 18 bp, Homo sapiens
tgggtggggctcctggga

SEQ ID NO: 6494499 - DNA, 22 bp, Homo sapiens
tgggtgggggctgtggccctgc

SEQ ID NO: 6494500 - DNA, 20 bp, Homo sapiens
tgggtggggggcattgagta

SEQ ID NO: 6494501 - DNA, 16 bp, Homo sapiens
tgggtggggggcttca

SEQ ID NO: 6494502 - DNA, 21 bp, Homo sapiens
tgggtggggggcttcatacac

SEQ ID NO: 6494503 - DNA, 13 bp, Homo sapiens
tgggtgggtgggc

SEQ ID NO: 6494504 - DNA, 16 bp, Homo sapiens
tgggtgggtgggccct

SEQ ID NO: 6494505 - DNA, 16 bp, Homo sapiens
tgggtgggtggtgggg

SEQ ID NO: 6494506 - DNA, 16 bp, Homo sapiens
tgggtggtaacaagag

SEQ ID NO: 6494507 - DNA, 19 bp, Homo sapiens
tgggtggtaactgccagcc

SEQ ID NO: 6494508 - DNA, 13 bp, Homo sapiens
tgggtggtaccct

SEQ ID NO: 6494509 - DNA, 14 bp, Homo sapiens
tgggtggtggatct

SEQ ID NO: 6494510 - DNA, 15 bp, Homo sapiens
tgggtggtggatctg

SEQ ID NO: 6494511 - DNA, 19 bp, Homo sapiens
tgggtggtttttattttta

SEQ ID NO: 6494512 - DNA, 14 bp, Homo sapiens
tgggtgtagccagg

SEQ ID NO: 6494513 - DNA, 20 bp, Homo sapiens
tgggtgtatttattttcctc

SEQ ID NO: 6494514 - DNA, 23 bp, Homo sapiens
tgggtgtcaagagggtctgagga

SEQ ID NO: 6494515 - DNA, 14 bp, Homo sapiens
tgaggggaggaggc

SEQ ID NO: 6494516 - DNA, 21 bp, Homo sapiens
tgaggggaggatcactggagc

SEQ ID NO: 6494517 - DNA, 13 bp, Homo sapiens
tgaggggaggggc

SEQ ID NO: 6494518 - DNA, 19 bp, Homo sapiens
tgaggggaggtggccagcc

SEQ ID NO: 6494519 - DNA, 13 bp, Homo sapiens
tgaggggcagtcc

SEQ ID NO: 6494520 - DNA, 22 bp, Homo sapiens
tgaggggcatctgcccctcccc

SEQ ID NO: 6494521 - DNA, 22 bp, Homo sapiens
tgaggggccaccccgtgcccct

SEQ ID NO: 6494522 - DNA, 17 bp, Homo sapiens
tgaggggccactgggcc

SEQ ID NO: 6494523 - DNA, 14 bp, Homo sapiens
tgaggggccaggcc

SEQ ID NO: 6494524 - DNA, 22 bp, Homo sapiens
tgaggggccagggaggaaggag

SEQ ID NO: 6494525 - DNA, 17 bp, Homo sapiens
tgaggggccccagcgtc

SEQ ID NO: 6494526 - DNA, 20 bp, Homo sapiens
tgaggggcccctggcccagg

SEQ ID NO: 6494527 - DNA, 18 bp, Homo sapiens
tgaggggccctccatgcg

SEQ ID NO: 6494528 - DNA, 18 bp, Homo sapiens
tgaggggccctggccagg

SEQ ID NO: 6494529 - DNA, 12 bp, Homo sapiens
tgaggggcctct

SEQ ID NO: 6494530 - DNA, 18 bp, Homo sapiens
tgaggggcctgccactct

SEQ ID NO: 6494531 - DNA, 20 bp, Homo sapiens
tgaggggcctgccactctcc

SEQ ID NO: 6494532 - DNA, 23 bp, Homo sapiens
tgaggggcctgcgcccagagctg

SEQ ID NO: 6494533 - DNA, 15 bp, Homo sapiens
tgaggggcctggaga

SEQ ID NO: 6494534 - DNA, 15 bp, Homo sapiens
tgaggggcttcaacc

SEQ ID NO: 6494535 - DNA, 17 bp, Homo sapiens
tgaggggcttcctgggt

SEQ ID NO: 6494536 - DNA, 16 bp, Homo sapiens
tgaggggctttctctt

SEQ ID NO: 6494537 - DNA, 14 bp, Homo sapiens
tgagggggaagtga

SEQ ID NO: 6494538 - DNA, 22 bp, Homo sapiens
tgagggggaatagtctagatgg

SEQ ID NO: 6494539 - DNA, 21 bp, Homo sapiens
tgagggggaattcctggaacc

SEQ ID NO: 6494540 - DNA, 20 bp, Homo sapiens
tgaggggggccgtgcccagg

SEQ ID NO: 6494541 - DNA, 16 bp, Homo sapiens
tgagggggtaaagcag

SEQ ID NO: 6494542 - DNA, 18 bp, Homo sapiens
tgagggggtgggggtgct

SEQ ID NO: 6494543 - DNA, 17 bp, Homo sapiens
tgaggggtatactagaa

SEQ ID NO: 6494544 - DNA, 15 bp, Homo sapiens
tgaggggtctcggat

SEQ ID NO: 6494545 - DNA, 16 bp, Homo sapiens
tgaggggtctcggatg

SEQ ID NO: 6494546 - DNA, 11 bp, Homo sapiens
tgaggggtgga

SEQ ID NO: 6494547 - DNA, 20 bp, Homo sapiens
tgaggggtgtccgagaggct

SEQ ID NO: 6494548 - DNA, 17 bp, Homo sapiens
tgaggggttacctccct

SEQ ID NO: 6494549 - DNA, 18 bp, Homo sapiens
tgaggggttacctccctc

SEQ ID NO: 6494550 - DNA, 13 bp, Homo sapiens
tgaggggttcctc

SEQ ID NO: 6494551 - DNA, 15 bp, Homo sapiens
tgaggggttcctccc

SEQ ID NO: 6494552 - DNA, 14 bp, Homo sapiens
tgaggggtttcttt

SEQ ID NO: 6494553 - DNA, 20 bp, Homo sapiens
tgaggggtttcttttggaaa

SEQ ID NO: 6494554 - DNA, 21 bp, Homo sapiens
tgagggtaataaacttagaat

SEQ ID NO: 6494555 - DNA, 22 bp, Homo sapiens
tgagggtaataaacttagaata

SEQ ID NO: 6494556 - DNA, 18 bp, Homo sapiens
tgagggtatgaagagctg

SEQ ID NO: 6494557 - DNA, 16 bp, Homo sapiens
tgagggtcagggcagt

SEQ ID NO: 6494558 - DNA, 16 bp, Homo sapiens
tgagggtccacctgga

SEQ ID NO: 6494559 - DNA, 19 bp, Homo sapiens
tgagggtcctgcagcctgc

SEQ ID NO: 6494560 - DNA, 21 bp, Homo sapiens
tgagggtcctgcagcctgcag

SEQ ID NO: 6494561 - DNA, 23 bp, Homo sapiens
tgagggtcctgcagcctgcagga

SEQ ID NO: 6494562 - DNA, 22 bp, Homo sapiens
tgagggtgactatggagctgag

SEQ ID NO: 6494563 - DNA, 21 bp, Homo sapiens
tgagggtgccccgcctgagtc

SEQ ID NO: 6494564 - DNA, 19 bp, Homo sapiens
tgagggtgcccttttccag

SEQ ID NO: 6494565 - DNA, 21 bp, Homo sapiens
tgagggtgcttgttccctctc

SEQ ID NO: 6494566 - DNA, 11 bp, Homo sapiens
tgagggtgggc

SEQ ID NO: 6494567 - DNA, 17 bp, Homo sapiens
tgagggtgggccagcat

SEQ ID NO: 6494568 - DNA, 20 bp, Homo sapiens
tgagggtggggtgccccagc

SEQ ID NO: 6494569 - DNA, 23 bp, Homo sapiens
tgagggtggggtgccccagctag

SEQ ID NO: 6494570 - DNA, 18 bp, Homo sapiens
tgagggtggtcagccaag

SEQ ID NO: 6494571 - DNA, 18 bp, Homo sapiens
tgagggtgtcggctgtga

SEQ ID NO: 6494572 - DNA, 19 bp, Homo sapiens
tgagggtgtcggctgtgag

SEQ ID NO: 6494573 - DNA, 14 bp, Homo sapiens
tgagggtgtttcct

SEQ ID NO: 6494574 - DNA, 14 bp, Homo sapiens
tgagggtgtttctt

SEQ ID NO: 6494575 - DNA, 22 bp, Homo sapiens
tgagggttcatcatccctccct

SEQ ID NO: 6494576 - DNA, 15 bp, Homo sapiens
tgagggtttccacct

SEQ ID NO: 6494577 - DNA, 19 bp, Homo sapiens
tgagggtttctgagctgct

SEQ ID NO: 6494578 - DNA, 15 bp, Homo sapiens
tgagggtttgtaatg

SEQ ID NO: 6494579 - DNA, 21 bp, Homo sapiens
tgagggtttgtaatggtgctt

SEQ ID NO: 6494580 - DNA, 15 bp, Homo sapiens
tgaggtaagtgtatg

SEQ ID NO: 6494581 - DNA, 22 bp, Homo sapiens
tgaggtactgagagtgaacaaa

SEQ ID NO: 6494582 - DNA, 16 bp, Homo sapiens
tgaggtagaggaaaat

SEQ ID NO: 6494583 - DNA, 21 bp, Homo sapiens
tgaggtaggcacaaatacatt

SEQ ID NO: 6494584 - DNA, 16 bp, Homo sapiens
tgaggtatcactgcag

SEQ ID NO: 6494585 - DNA, 15 bp, Homo sapiens
tgaggtatctgtgtt

SEQ ID NO: 6494586 - DNA, 23 bp, Homo sapiens
tgaggtatggccatgccctagac

SEQ ID NO: 6494587 - DNA, 16 bp, Homo sapiens
tgaggtcaacacaggt

SEQ ID NO: 6494588 - DNA, 14 bp, Homo sapiens
tgaggtcaagaaat

SEQ ID NO: 6494589 - DNA, 16 bp, Homo sapiens
tgaggtcaataaagca

SEQ ID NO: 6494590 - DNA, 17 bp, Homo sapiens
tgaggtcaataaagcag

SEQ ID NO: 6494591 - DNA, 23 bp, Homo sapiens
tgaggtcaataaagcagagccaa

SEQ ID NO: 6494592 - DNA, 13 bp, Homo sapiens
tgaggtcaccagg

SEQ ID NO: 6494593 - DNA, 16 bp, Homo sapiens
tgaggtcaccagggga

SEQ ID NO: 6494594 - DNA, 17 bp, Homo sapiens
tgaggtcaccaggggag

SEQ ID NO: 6494595 - DNA, 21 bp, Homo sapiens
tgaggtcaccaggggaggagc

SEQ ID NO: 6494596 - DNA, 13 bp, Homo sapiens
tgaggtcacctgg

SEQ ID NO: 6494597 - DNA, 15 bp, Homo sapiens
tgaggtcactgggtt

SEQ ID NO: 6494598 - DNA, 13 bp, Homo sapiens
tgaggtcagagcc

SEQ ID NO: 6494599 - DNA, 17 bp, Homo sapiens
tgaggtcagagcctgca

SEQ ID NO: 6494600 - DNA, 15 bp, Homo sapiens
tgaggtcagggagtg

SEQ ID NO: 6494601 - DNA, 22 bp, Homo sapiens
tgaggtcagggttttagagagc

SEQ ID NO: 6494602 - DNA, 12 bp, Homo sapiens
tgaggtcagtgt

SEQ ID NO: 6494603 - DNA, 14 bp, Homo sapiens
tgaggtcataaaca

SEQ ID NO: 6494604 - DNA, 15 bp, Homo sapiens
tgaggtcataaacac

SEQ ID NO: 6494605 - DNA, 17 bp, Homo sapiens
tgaggtccaccggcccc

SEQ ID NO: 6494606 - DNA, 15 bp, Homo sapiens
tgaggtcccaggcag

SEQ ID NO: 6494607 - DNA, 12 bp, Homo sapiens
tgaggtccctgt

SEQ ID NO: 6494608 - DNA, 23 bp, Homo sapiens
tgaggtccctgtgtgtaggctgg

SEQ ID NO: 6494609 - DNA, 15 bp, Homo sapiens
tgaggtcccttcaag

SEQ ID NO: 6494610 - DNA, 18 bp, Homo sapiens
tgaggtcctcaggtcagc

SEQ ID NO: 6494611 - DNA, 13 bp, Homo sapiens
tgaggtcctgagc

SEQ ID NO: 6494612 - DNA, 15 bp, Homo sapiens
tgaggtcctgagcac

SEQ ID NO: 6494613 - DNA, 18 bp, Homo sapiens
tgaggtcctgagcactgc

SEQ ID NO: 6494614 - DNA, 22 bp, Homo sapiens
tgaggtcctgcatttctcagtc

SEQ ID NO: 6494615 - DNA, 13 bp, Homo sapiens
tgaggtcctgggg

SEQ ID NO: 6494616 - DNA, 13 bp, Homo sapiens
tgaggtccttatg

SEQ ID NO: 6494617 - DNA, 17 bp, Homo sapiens
tgaggtctaaacaaata

SEQ ID NO: 6494618 - DNA, 23 bp, Homo sapiens
tgaggtctaggaacatacttcag

SEQ ID NO: 6494619 - DNA, 17 bp, Homo sapiens
tgaggtctcagcccctt

SEQ ID NO: 6494620 - DNA, 21 bp, Homo sapiens
tgaggtctcattcatccttat

SEQ ID NO: 6494621 - DNA, 16 bp, Homo sapiens
tgaggtctcgaccctg

SEQ ID NO: 6494622 - DNA, 19 bp, Homo sapiens
tgaggtctcgaccctgtcc

SEQ ID NO: 6494623 - DNA, 23 bp, Homo sapiens
tgaggtctcgctgatgctgggct

SEQ ID NO: 6494624 - DNA, 16 bp, Homo sapiens
tgaggtctcttttctc

SEQ ID NO: 6494625 - DNA, 17 bp, Homo sapiens
tgaggtctcttttctct

SEQ ID NO: 6494626 - DNA, 18 bp, Homo sapiens
tgaggtctcttttctcta

SEQ ID NO: 6494627 - DNA, 15 bp, Homo sapiens
tgaggtctgaaatgg

SEQ ID NO: 6494628 - DNA, 14 bp, Homo sapiens
tgaggtctgttctt

SEQ ID NO: 6494629 - DNA, 15 bp, Homo sapiens
tgaggtctgttcttt

SEQ ID NO: 6494630 - DNA, 13 bp, Homo sapiens
tgaggtctttaaa

SEQ ID NO: 6494631 - DNA, 24 bp, Homo sapiens
tgaggtctttctcctcaggacaag

SEQ ID NO: 6494632 - DNA, 18 bp, Homo sapiens
tgaggtcttttacataca

SEQ ID NO: 6494633 - DNA, 19 bp, Homo sapiens
tgaggtcttttgacatgtg

SEQ ID NO: 6494634 - DNA, 22 bp, Homo sapiens
tgaggtcttttgacatgtggaa

SEQ ID NO: 6494635 - DNA, 15 bp, Homo sapiens
tgaggtgaaacaatt

SEQ ID NO: 6494636 - DNA, 17 bp, Homo sapiens
tgaggtgaaagggagct

SEQ ID NO: 6494637 - DNA, 17 bp, Homo sapiens
tgaggtgaaatgggaga

SEQ ID NO: 6494638 - DNA, 18 bp, Homo sapiens
tgaggtgaaatgggagat

SEQ ID NO: 6494639 - DNA, 15 bp, Homo sapiens
tgaggtgaactccag

SEQ ID NO: 6494640 - DNA, 17 bp, Homo sapiens
tgaggtgataggcaagg

SEQ ID NO: 6494641 - DNA, 18 bp, Homo sapiens
tgaggtgataggcaagga

SEQ ID NO: 6494642 - DNA, 21 bp, Homo sapiens
tgaggtgatgaagacagcccg

SEQ ID NO: 6494643 - DNA, 16 bp, Homo sapiens
tgaggtgatgggtgca

SEQ ID NO: 6494644 - DNA, 17 bp, Homo sapiens
tgaggtgcagagtgccc

SEQ ID NO: 6494645 - DNA, 15 bp, Homo sapiens
tgaggtgcccaggag

SEQ ID NO: 6494646 - DNA, 13 bp, Homo sapiens
tgaggtgcctccc

SEQ ID NO: 6494647 - DNA, 15 bp, Homo sapiens
tgaggtgctatgttc

SEQ ID NO: 6494648 - DNA, 19 bp, Homo sapiens
tgaggtggaagagggctgc

SEQ ID NO: 6494649 - DNA, 16 bp, Homo sapiens
tgaggtggaagccctc

SEQ ID NO: 6494650 - DNA, 17 bp, Homo sapiens
tgaggtggaagccctcc

SEQ ID NO: 6494651 - DNA, 16 bp, Homo sapiens
tgaggtggcacttttt

SEQ ID NO: 6494652 - DNA, 23 bp, Homo sapiens
tgaggtggcactttttcatttgc

SEQ ID NO: 6494653 - DNA, 21 bp, Homo sapiens
tgaggtggcctccttgcttgt

SEQ ID NO: 6494654 - DNA, 13 bp, Homo sapiens
tgaggtgggagga

SEQ ID NO: 6494655 - DNA, 21 bp, Homo sapiens
tgaggtgggaggatctcttga

SEQ ID NO: 6494656 - DNA, 18 bp, Homo sapiens
tgaggtgggaggtggaag

SEQ ID NO: 6494657 - DNA, 21 bp, Homo sapiens
tgaggtgggaggtggaagaag

SEQ ID NO: 6494658 - DNA, 13 bp, Homo sapiens
tgaggtgggccca

SEQ ID NO: 6494659 - DNA, 15 bp, Homo sapiens
tgaggtgggcccagg

SEQ ID NO: 6494660 - DNA, 21 bp, Homo sapiens
tgaggtggggaaggagggact

SEQ ID NO: 6494661 - DNA, 18 bp, Homo sapiens
tgaggtgggggcagcggc

SEQ ID NO: 6494662 - DNA, 21 bp, Homo sapiens
tgaggtgggggtctggcctag

SEQ ID NO: 6494663 - DNA, 17 bp, Homo sapiens
tgaggtggtctgaatgt

SEQ ID NO: 6494664 - DNA, 21 bp, Homo sapiens
tgaggtggtctgaatgttctg

SEQ ID NO: 6494665 - DNA, 13 bp, Homo sapiens
tgaggtggtggac

SEQ ID NO: 6494666 - DNA, 18 bp, Homo sapiens
tgaggtgtcttaagcctt

SEQ ID NO: 6494667 - DNA, 15 bp, Homo sapiens
tgaggtgtgcctggc

SEQ ID NO: 6494668 - DNA, 15 bp, Homo sapiens
tgaggtgtgggggct

SEQ ID NO: 6494669 - DNA, 18 bp, Homo sapiens
tgaggtgtgggggctgca

SEQ ID NO: 6494670 - DNA, 15 bp, Homo sapiens
tgaggtgtgtcacaa

SEQ ID NO: 6494671 - DNA, 21 bp, Homo sapiens
tgaggttaaaatataaattaa

SEQ ID NO: 6494672 - DNA, 15 bp, Homo sapiens
tgaggttaagtttct

SEQ ID NO: 6494673 - DNA, 23 bp, Homo sapiens
tgaggttagcccaatggagaaat

SEQ ID NO: 6494674 - DNA, 21 bp, Homo sapiens
tgaggttaggtcatgaggaca

SEQ ID NO: 6494675 - DNA, 14 bp, Homo sapiens
tgaggttcagcaag

SEQ ID NO: 6494676 - DNA, 21 bp, Homo sapiens
tgaggttcagcaaggtgagag

SEQ ID NO: 6494677 - DNA, 19 bp, Homo sapiens
tgaggttcctctgcctgcc

SEQ ID NO: 6494678 - DNA, 22 bp, Homo sapiens
tgaggttcttaaagtttgcagt

SEQ ID NO: 6494679 - DNA, 22 bp, Homo sapiens
tgaggttctttcccacactgaa

SEQ ID NO: 6494680 - DNA, 24 bp, Homo sapiens
tgaggttgatatcggtgctatgtg

SEQ ID NO: 6494681 - DNA, 15 bp, Homo sapiens
tgaggttgcttacta

SEQ ID NO: 6494682 - DNA, 15 bp, Homo sapiens
tgaggttgctttgtt

SEQ ID NO: 6494683 - DNA, 20 bp, Homo sapiens
tgaggttgggaaggcacctg

SEQ ID NO: 6494684 - DNA, 19 bp, Homo sapiens
tgaggtttaacattaaagc

SEQ ID NO: 6494685 - DNA, 15 bp, Homo sapiens
tgaggtttcaccctt

SEQ ID NO: 6494686 - DNA, 16 bp, Homo sapiens
tgaggtttcagtagct

SEQ ID NO: 6494687 - DNA, 18 bp, Homo sapiens
tgaggtttgaaaagctga

SEQ ID NO: 6494688 - DNA, 22 bp, Homo sapiens
tgaggttttatttcatttttca

SEQ ID NO: 6494689 - DNA, 15 bp, Homo sapiens
tgaggttttgaataa

SEQ ID NO: 6494690 - DNA, 21 bp, Homo sapiens
tgagtaaaaactagaaggctt

SEQ ID NO: 6494691 - DNA, 23 bp, Homo sapiens
tgagtaaaaaggtggtatgtaat

SEQ ID NO: 6494692 - DNA, 18 bp, Homo sapiens
tgagtaaaacacatattc

SEQ ID NO: 6494693 - DNA, 17 bp, Homo sapiens
tgggtgtcaagtgcctg

SEQ ID NO: 6494694 - DNA, 15 bp, Homo sapiens
tgggtgtcccctggt

SEQ ID NO: 6494695 - DNA, 20 bp, Homo sapiens
tgggtgtccgccatccaggg

SEQ ID NO: 6494696 - DNA, 22 bp, Homo sapiens
tgggtgtcctgcagaagaagct

SEQ ID NO: 6494697 - DNA, 13 bp, Homo sapiens
tgggtgtctccct

SEQ ID NO: 6494698 - DNA, 14 bp, Homo sapiens
tgggtgtgagcagg

SEQ ID NO: 6494699 - DNA, 15 bp, Homo sapiens
tgggtgtgagcaggg

SEQ ID NO: 6494700 - DNA, 15 bp, Homo sapiens
tgggtgtgccaggct

SEQ ID NO: 6494701 - DNA, 14 bp, Homo sapiens
tgggtgtgccctgg

SEQ ID NO: 6494702 - DNA, 18 bp, Homo sapiens
tgggtgtgccctggctcc

SEQ ID NO: 6494703 - DNA, 13 bp, Homo sapiens
tgggtgtgctcca

SEQ ID NO: 6494704 - DNA, 16 bp, Homo sapiens
tgggtgtgtgcgcctg

SEQ ID NO: 6494705 - DNA, 17 bp, Homo sapiens
tgggtgtgtggcctccc

SEQ ID NO: 6494706 - DNA, 18 bp, Homo sapiens
tgggtgtgtggcctccct

SEQ ID NO: 6494707 - DNA, 22 bp, Homo sapiens
tgggtgtgtttcaggacagctg

SEQ ID NO: 6494708 - DNA, 15 bp, Homo sapiens
tgggtgttattttta

SEQ ID NO: 6494709 - DNA, 16 bp, Homo sapiens
tgggtgttcataactg

SEQ ID NO: 6494710 - DNA, 15 bp, Homo sapiens
tgggtgttcctggca

SEQ ID NO: 6494711 - DNA, 14 bp, Homo sapiens
tgggtgttctttcc

SEQ ID NO: 6494712 - DNA, 16 bp, Homo sapiens
tgggtgttctttcctg

SEQ ID NO: 6494713 - DNA, 22 bp, Homo sapiens
tgggtgtttgggaaaggcaggg

SEQ ID NO: 6494714 - DNA, 23 bp, Homo sapiens
tgggtgtttgggaaaggcagggc

SEQ ID NO: 6494715 - DNA, 18 bp, Homo sapiens
tgggttaaacaaaatgaa

SEQ ID NO: 6494716 - DNA, 19 bp, Homo sapiens
tgggttaaatattttgcta

SEQ ID NO: 6494717 - DNA, 14 bp, Homo sapiens
tgggttaacaaatg

SEQ ID NO: 6494718 - DNA, 15 bp, Homo sapiens
tgggttaacaaatga

SEQ ID NO: 6494719 - DNA, 13 bp, Homo sapiens
tgggttaacagta

SEQ ID NO: 6494720 - DNA, 14 bp, Homo sapiens
tgggttaatggcta

SEQ ID NO: 6494721 - DNA, 16 bp, Homo sapiens
tgggttaatggctagt

SEQ ID NO: 6494722 - DNA, 23 bp, Homo sapiens
tgggttaatggctagtactgtat

SEQ ID NO: 6494723 - DNA, 15 bp, Homo sapiens
tgggttagactgcca

SEQ ID NO: 6494724 - DNA, 21 bp, Homo sapiens
tgggttagcaatatttatagg

SEQ ID NO: 6494725 - DNA, 22 bp, Homo sapiens
tgggttagctaaaccaagaagg

SEQ ID NO: 6494726 - DNA, 18 bp, Homo sapiens
tgggttagggaaaacatt

SEQ ID NO: 6494727 - DNA, 14 bp, Homo sapiens
tgggttagtggatg

SEQ ID NO: 6494728 - DNA, 17 bp, Homo sapiens
tgggttatttattgaca

SEQ ID NO: 6494729 - DNA, 23 bp, Homo sapiens
tgggttcaagcgattcttctgct

SEQ ID NO: 6494730 - DNA, 21 bp, Homo sapiens
tgggttcacgtaatcctcctg

SEQ ID NO: 6494731 - DNA, 21 bp, Homo sapiens
tgggttcagaaatgctgcctg

SEQ ID NO: 6494732 - DNA, 22 bp, Homo sapiens
tgggttcagaaatgctgcctgc

SEQ ID NO: 6494733 - DNA, 14 bp, Homo sapiens
tgggttcaggcctg

SEQ ID NO: 6494734 - DNA, 20 bp, Homo sapiens
tgggttcattattggaatta

SEQ ID NO: 6494735 - DNA, 16 bp, Homo sapiens
tgggttcattccccgg

SEQ ID NO: 6494736 - DNA, 15 bp, Homo sapiens
tgggttccagacaga

SEQ ID NO: 6494737 - DNA, 20 bp, Homo sapiens
tgggttccagacagagtgga

SEQ ID NO: 6494738 - DNA, 12 bp, Homo sapiens
tgggttccagag

SEQ ID NO: 6494739 - DNA, 21 bp, Homo sapiens
tgggttccagcaattctcctg

SEQ ID NO: 6494740 - DNA, 15 bp, Homo sapiens
tgggttccattctca

SEQ ID NO: 6494741 - DNA, 14 bp, Homo sapiens
tgggttcctcctct

SEQ ID NO: 6494742 - DNA, 19 bp, Homo sapiens
tgggttcgttggggacatg

SEQ ID NO: 6494743 - DNA, 22 bp, Homo sapiens
tgggttctacccaggtgctagg

SEQ ID NO: 6494744 - DNA, 13 bp, Homo sapiens
tgggttctcttca

SEQ ID NO: 6494745 - DNA, 22 bp, Homo sapiens
tgggttctgactctggaccatg

SEQ ID NO: 6494746 - DNA, 19 bp, Homo sapiens
tgggttctgcctgccagct

SEQ ID NO: 6494747 - DNA, 21 bp, Homo sapiens
tgggttctgcctgccagctgc

SEQ ID NO: 6494748 - DNA, 22 bp, Homo sapiens
tgggttctgcctgccagctgca

SEQ ID NO: 6494749 - DNA, 21 bp, Homo sapiens
tgggttctggggcatcagcca

SEQ ID NO: 6494750 - DNA, 14 bp, Homo sapiens
tgggttctggggct

SEQ ID NO: 6494751 - DNA, 17 bp, Homo sapiens
tgggttctggggctgag

SEQ ID NO: 6494752 - DNA, 18 bp, Homo sapiens
tgggttgaatatagcctg

SEQ ID NO: 6494753 - DNA, 20 bp, Homo sapiens
tgggttgaatatagcctgcc

SEQ ID NO: 6494754 - DNA, 22 bp, Homo sapiens
tgggttgatctcttagaagcca

SEQ ID NO: 6494755 - DNA, 17 bp, Homo sapiens
tgggttggaaaacagta

SEQ ID NO: 6494756 - DNA, 15 bp, Homo sapiens
tgggttgggatcagg

SEQ ID NO: 6494757 - DNA, 15 bp, Homo sapiens
tgggttggtgcacag

SEQ ID NO: 6494758 - DNA, 20 bp, Homo sapiens
tgggttggtgcacagtgatt

SEQ ID NO: 6494759 - DNA, 16 bp, Homo sapiens
tgggttggtgcttcta

SEQ ID NO: 6494760 - DNA, 15 bp, Homo sapiens
tgggttgtcaccaag

SEQ ID NO: 6494761 - DNA, 21 bp, Homo sapiens
tgggttgttgcagagtaaatc

SEQ ID NO: 6494762 - DNA, 18 bp, Homo sapiens
tgggttgtttccaggaga

SEQ ID NO: 6494763 - DNA, 20 bp, Homo sapiens
tgggtttacaacaaacactg

SEQ ID NO: 6494764 - DNA, 19 bp, Homo sapiens
tgggtttagcccgaggctg

SEQ ID NO: 6494765 - DNA, 20 bp, Homo sapiens
tgggtttagcccgaggctgg

SEQ ID NO: 6494766 - DNA, 13 bp, Homo sapiens
tgggtttatttgg

SEQ ID NO: 6494767 - DNA, 20 bp, Homo sapiens
tgggtttcaagaaaatcttt

SEQ ID NO: 6494768 - DNA, 23 bp, Homo sapiens
tgggtttcaagaaaatctttgtt

SEQ ID NO: 6494769 - DNA, 22 bp, Homo sapiens
tgggtttcacaagtgaaaaaca

SEQ ID NO: 6494770 - DNA, 12 bp, Homo sapiens
tgggtttccctg

SEQ ID NO: 6494771 - DNA, 16 bp, Homo sapiens
tgggtttcggggtgaa

SEQ ID NO: 6494772 - DNA, 22 bp, Homo sapiens
tgggtttcggggtgaagcaagt

SEQ ID NO: 6494773 - DNA, 21 bp, Homo sapiens
tgggtttctaaagctgccagc

SEQ ID NO: 6494774 - DNA, 15 bp, Homo sapiens
tgggtttctaagcag

SEQ ID NO: 6494775 - DNA, 18 bp, Homo sapiens
tgggtttctcattaaagt

SEQ ID NO: 6494776 - DNA, 17 bp, Homo sapiens
tgggtttctctgtgctc

SEQ ID NO: 6494777 - DNA, 14 bp, Homo sapiens
tgggtttgagaaat

SEQ ID NO: 6494778 - DNA, 18 bp, Homo sapiens
tgggtttgccaagccctt

SEQ ID NO: 6494779 - DNA, 22 bp, Homo sapiens
tgggtttgccaagccctttgct

SEQ ID NO: 6494780 - DNA, 12 bp, Homo sapiens
tgggtttgccca

SEQ ID NO: 6494781 - DNA, 15 bp, Homo sapiens
tgggtttgcccagtc

SEQ ID NO: 6494782 - DNA, 17 bp, Homo sapiens
tgggtttggatctccaa

SEQ ID NO: 6494783 - DNA, 15 bp, Homo sapiens
tgggtttggcaggca

SEQ ID NO: 6494784 - DNA, 13 bp, Homo sapiens
tgggtttggccag

SEQ ID NO: 6494785 - DNA, 14 bp, Homo sapiens
tgggtttggccagg

SEQ ID NO: 6494786 - DNA, 14 bp, Homo sapiens
tgggtttggcccaa

SEQ ID NO: 6494787 - DNA, 20 bp, Homo sapiens
tgggtttggcccctggaacc

SEQ ID NO: 6494788 - DNA, 15 bp, Homo sapiens
tgggtttgggagcca

SEQ ID NO: 6494789 - DNA, 16 bp, Homo sapiens
tgggtttgggagccag

SEQ ID NO: 6494790 - DNA, 17 bp, Homo sapiens
tgggtttgggagccagg

SEQ ID NO: 6494791 - DNA, 19 bp, Homo sapiens
tgggtttgggagccaggac

SEQ ID NO: 6494792 - DNA, 20 bp, Homo sapiens
tgggtttgggcagtggagag

SEQ ID NO: 6494793 - DNA, 17 bp, Homo sapiens
tgggtttggtgtatggt

SEQ ID NO: 6494794 - DNA, 19 bp, Homo sapiens
tgggtttgttggtcacatg

SEQ ID NO: 6494795 - DNA, 19 bp, Homo sapiens
tgggtttgtttttcaaagc

SEQ ID NO: 6494796 - DNA, 22 bp, Homo sapiens
tgggttttaattttcagttcta

SEQ ID NO: 6494797 - DNA, 19 bp, Homo sapiens
tgggttttattgtccttca

SEQ ID NO: 6494798 - DNA, 22 bp, Homo sapiens
tgggttttcagcataaatggga

SEQ ID NO: 6494799 - DNA, 20 bp, Homo sapiens
tgggttttcaggggctttgg

SEQ ID NO: 6494800 - DNA, 18 bp, Homo sapiens
tgggttttctaactgtaa

SEQ ID NO: 6494801 - DNA, 22 bp, Homo sapiens
tgggttttctaactgtaaatca

SEQ ID NO: 6494802 - DNA, 18 bp, Homo sapiens
tgggttttgtaggtactt

SEQ ID NO: 6494803 - DNA, 14 bp, Homo sapiens
tgggttttgtctct

SEQ ID NO: 6494804 - DNA, 16 bp, Homo sapiens
tgggtttttcatcttt

SEQ ID NO: 6494805 - DNA, 19 bp, Homo sapiens
tgggtttttcctctgttaa

SEQ ID NO: 6494806 - DNA, 17 bp, Homo sapiens
tgggtttttggacttct

SEQ ID NO: 6494807 - DNA, 15 bp, Homo sapiens
tgggtttttgttacc

SEQ ID NO: 6494808 - DNA, 17 bp, Homo sapiens
tgggttttttaattgag

SEQ ID NO: 6494809 - DNA, 21 bp, Homo sapiens
tgggtttttttttttaaaaaa

SEQ ID NO: 6494810 - DNA, 13 bp, Homo sapiens
tggtaaaaaagaa

SEQ ID NO: 6494811 - DNA, 15 bp, Homo sapiens
tggtaaaaaagaaat

SEQ ID NO: 6494812 - DNA, 23 bp, Homo sapiens
tggtaaaaagattatatatcata

SEQ ID NO: 6494813 - DNA, 16 bp, Homo sapiens
tggtaaaaatgctgct

SEQ ID NO: 6494814 - DNA, 17 bp, Homo sapiens
tggtaaaaatgctgctc

SEQ ID NO: 6494815 - DNA, 19 bp, Homo sapiens
tggtaaaaatgctgctctc

SEQ ID NO: 6494816 - DNA, 14 bp, Homo sapiens
tggtaaaacacttg

SEQ ID NO: 6494817 - DNA, 18 bp, Homo sapiens
tggtaaaacagtttcatc

SEQ ID NO: 6494818 - DNA, 20 bp, Homo sapiens
tggtaaaacagtttcatcta

SEQ ID NO: 6494819 - DNA, 23 bp, Homo sapiens
tggtaaaatagtggatctcagtt

SEQ ID NO: 6494820 - DNA, 15 bp, Homo sapiens
tggtaaaatgaagaa

SEQ ID NO: 6494821 - DNA, 13 bp, Homo sapiens
tggtaaaatgtga

SEQ ID NO: 6494822 - DNA, 20 bp, Homo sapiens
tggtaaaatgtgaaaaacta

SEQ ID NO: 6494823 - DNA, 12 bp, Homo sapiens
tggtaaaccaag

SEQ ID NO: 6494824 - DNA, 19 bp, Homo sapiens
tggtaaacgctgtccctag

SEQ ID NO: 6494825 - DNA, 21 bp, Homo sapiens
tggtaaactatttgtctttca

SEQ ID NO: 6494826 - DNA, 21 bp, Homo sapiens
tggtaaagaaaagcctcagct

SEQ ID NO: 6494827 - DNA, 22 bp, Homo sapiens
tggtaaagaaaagcctcagctc

SEQ ID NO: 6494828 - DNA, 22 bp, Homo sapiens
tggtaaagagatgtcaaaatgt

SEQ ID NO: 6494829 - DNA, 22 bp, Homo sapiens
tggtaaagatattattcaccat

SEQ ID NO: 6494830 - DNA, 13 bp, Homo sapiens
tggtaaataactg

SEQ ID NO: 6494831 - DNA, 16 bp, Homo sapiens
tggtaaataactgtga

SEQ ID NO: 6494832 - DNA, 18 bp, Homo sapiens
tggtaaatatagaaccat

SEQ ID NO: 6494833 - DNA, 13 bp, Homo sapiens
tggtaaatgccac

SEQ ID NO: 6494834 - DNA, 14 bp, Homo sapiens
tggtaaatgtttct

SEQ ID NO: 6494835 - DNA, 14 bp, Homo sapiens
tggtaaattcagac

SEQ ID NO: 6494836 - DNA, 22 bp, Homo sapiens
tggtaaattcagacaacattat

SEQ ID NO: 6494837 - DNA, 20 bp, Homo sapiens
tggtaaattctggtatacat

SEQ ID NO: 6494838 - DNA, 14 bp, Homo sapiens
tggtaaatttttga

SEQ ID NO: 6494839 - DNA, 14 bp, Homo sapiens
tggtaacaagagga

SEQ ID NO: 6494840 - DNA, 13 bp, Homo sapiens
tggtaacagctct

SEQ ID NO: 6494841 - DNA, 16 bp, Homo sapiens
tggtaacagctctctt

SEQ ID NO: 6494842 - DNA, 21 bp, Homo sapiens
tggtaacagctctcttcttac

SEQ ID NO: 6494843 - DNA, 10 bp, Homo sapiens
tggtaacatt

SEQ ID NO: 6494844 - DNA, 22 bp, Homo sapiens
tggtaaccagccctgcacgacc

SEQ ID NO: 6494845 - DNA, 14 bp, Homo sapiens
tggtaacctgtggt

SEQ ID NO: 6494846 - DNA, 15 bp, Homo sapiens
tggtaacgaatttaa

SEQ ID NO: 6494847 - DNA, 14 bp, Homo sapiens
tggtaactgccagc

SEQ ID NO: 6494848 - DNA, 18 bp, Homo sapiens
tggtaactgccagccttg

SEQ ID NO: 6494849 - DNA, 21 bp, Homo sapiens
tggtaactggaaggccttcca

SEQ ID NO: 6494850 - DNA, 16 bp, Homo sapiens
tggtaacttctttgaa

SEQ ID NO: 6494851 - DNA, 22 bp, Homo sapiens
tggtaacttgagattcaagaca

SEQ ID NO: 6494852 - DNA, 10 bp, Homo sapiens
tggtaacttt

SEQ ID NO: 6494853 - DNA, 22 bp, Homo sapiens
tggtaactttgcaggcggccct

SEQ ID NO: 6494854 - DNA, 14 bp, Homo sapiens
tggtaacttttgta

SEQ ID NO: 6494855 - DNA, 22 bp, Homo sapiens
tggtaagaagccgggaacagac

SEQ ID NO: 6494856 - DNA, 16 bp, Homo sapiens
tggtaagacctctgag

SEQ ID NO: 6494857 - DNA, 12 bp, Homo sapiens
tggtaagagaaa

SEQ ID NO: 6494858 - DNA, 23 bp, Homo sapiens
tggtaagagaatgttatagtgaa

SEQ ID NO: 6494859 - DNA, 22 bp, Homo sapiens
tggtaagatgtcttgaaaacat

SEQ ID NO: 6494860 - DNA, 14 bp, Homo sapiens
tggtaagattgtta

SEQ ID NO: 6494861 - DNA, 19 bp, Homo sapiens
tggtaagattgttattaaa

SEQ ID NO: 6494862 - DNA, 14 bp, Homo sapiens
tggtaagcaaaact

SEQ ID NO: 6494863 - DNA, 18 bp, Homo sapiens
tggtaagcaacatggctt

SEQ ID NO: 6494864 - DNA, 19 bp, Homo sapiens
tggtaagcaacatggcttt

SEQ ID NO: 6494865 - DNA, 17 bp, Homo sapiens
tggtaagcgatttgaaa

SEQ ID NO: 6494866 - DNA, 12 bp, Homo sapiens
tggtaagggaag

SEQ ID NO: 6494867 - DNA, 16 bp, Homo sapiens
tggtaagggaccttca

SEQ ID NO: 6494868 - DNA, 23 bp, Homo sapiens
tggtaagtaccacatctacaatt

SEQ ID NO: 6494869 - DNA, 18 bp, Homo sapiens
tggtaataacaaacgtgt

SEQ ID NO: 6494870 - DNA, 16 bp, Homo sapiens
tggtaataagcactgt

SEQ ID NO: 6494871 - DNA, 22 bp, Homo sapiens
tgagtaaaccctatctgtgatt

SEQ ID NO: 6494872 - DNA, 17 bp, Homo sapiens
tgagtaaactgaggccc

SEQ ID NO: 6494873 - DNA, 16 bp, Homo sapiens
tgagtaaactgtttct

SEQ ID NO: 6494874 - DNA, 14 bp, Homo sapiens
tgagtaaagtgtta

SEQ ID NO: 6494875 - DNA, 16 bp, Homo sapiens
tgagtaaagtgttaat

SEQ ID NO: 6494876 - DNA, 20 bp, Homo sapiens
tgagtaaataaactcttcaa

SEQ ID NO: 6494877 - DNA, 20 bp, Homo sapiens
tgagtaaattggaaacattt

SEQ ID NO: 6494878 - DNA, 10 bp, Homo sapiens
tgagtaacat

SEQ ID NO: 6494879 - DNA, 19 bp, Homo sapiens
tgagtaacatttgctgttt

SEQ ID NO: 6494880 - DNA, 16 bp, Homo sapiens
tgagtaacttagaaaa

SEQ ID NO: 6494881 - DNA, 18 bp, Homo sapiens
tgagtaacttagaaaagt

SEQ ID NO: 6494882 - DNA, 20 bp, Homo sapiens
tgagtaacttagaaaagtgg

SEQ ID NO: 6494883 - DNA, 14 bp, Homo sapiens
tgagtaagagctgg

SEQ ID NO: 6494884 - DNA, 16 bp, Homo sapiens
tgagtaagagctggtg

SEQ ID NO: 6494885 - DNA, 13 bp, Homo sapiens
tgagtaagtgtgt

SEQ ID NO: 6494886 - DNA, 17 bp, Homo sapiens
tgagtaatattacattt

SEQ ID NO: 6494887 - DNA, 18 bp, Homo sapiens
tgagtaatattacatttc

SEQ ID NO: 6494888 - DNA, 20 bp, Homo sapiens
tgagtaatattacatttcat

SEQ ID NO: 6494889 - DNA, 23 bp, Homo sapiens
tgagtaatgcagacatttacatg

SEQ ID NO: 6494890 - DNA, 19 bp, Homo sapiens
tgagtaatggtgtagaaca

SEQ ID NO: 6494891 - DNA, 20 bp, Homo sapiens
tgagtaatgtgactaaagga

SEQ ID NO: 6494892 - DNA, 18 bp, Homo sapiens
tgagtaattaataaagaa

SEQ ID NO: 6494893 - DNA, 21 bp, Homo sapiens
tgagtacaaatgccttaaaat

SEQ ID NO: 6494894 - DNA, 21 bp, Homo sapiens
tgagtacagatactgtgagct

SEQ ID NO: 6494895 - DNA, 16 bp, Homo sapiens
tgagtacagtgaggag

SEQ ID NO: 6494896 - DNA, 17 bp, Homo sapiens
tgagtacattgtgccct

SEQ ID NO: 6494897 - DNA, 22 bp, Homo sapiens
tgagtaccaaatccacaagcca

SEQ ID NO: 6494898 - DNA, 19 bp, Homo sapiens
tgagtaccatgggctacag

SEQ ID NO: 6494899 - DNA, 17 bp, Homo sapiens
tgagtacctgcaaaaat

SEQ ID NO: 6494900 - DNA, 20 bp, Homo sapiens
tgagtacgttgtgcatttgg

SEQ ID NO: 6494901 - DNA, 14 bp, Homo sapiens
tgagtactacagtc

SEQ ID NO: 6494902 - DNA, 15 bp, Homo sapiens
tgagtactacagtcc

SEQ ID NO: 6494903 - DNA, 19 bp, Homo sapiens
tgagtactagaatttgtat

SEQ ID NO: 6494904 - DNA, 21 bp, Homo sapiens
tgagtactagaatttgtattt

SEQ ID NO: 6494905 - DNA, 17 bp, Homo sapiens
tgagtactcataaagga

SEQ ID NO: 6494906 - DNA, 20 bp, Homo sapiens
tgagtactccacactgcaca

SEQ ID NO: 6494907 - DNA, 15 bp, Homo sapiens
tgagtactgtactat

SEQ ID NO: 6494908 - DNA, 23 bp, Homo sapiens
tgagtagaaaggcctttaaaatt

SEQ ID NO: 6494909 - DNA, 19 bp, Homo sapiens
tgagtagacacatttaagg

SEQ ID NO: 6494910 - DNA, 14 bp, Homo sapiens
tgagtagaggctta

SEQ ID NO: 6494911 - DNA, 17 bp, Homo sapiens
tgagtagagttgatcaa

SEQ ID NO: 6494912 - DNA, 18 bp, Homo sapiens
tgagtagatattacttta

SEQ ID NO: 6494913 - DNA, 19 bp, Homo sapiens
tgagtagatccatttccat

SEQ ID NO: 6494914 - DNA, 15 bp, Homo sapiens
tgagtagatgggact

SEQ ID NO: 6494915 - DNA, 13 bp, Homo sapiens
tgagtagctgaga

SEQ ID NO: 6494916 - DNA, 11 bp, Homo sapiens
tgagtagctgg

SEQ ID NO: 6494917 - DNA, 15 bp, Homo sapiens
tgagtagctgggact

SEQ ID NO: 6494918 - DNA, 14 bp, Homo sapiens
tgagtagctgggcc

SEQ ID NO: 6494919 - DNA, 17 bp, Homo sapiens
tgagtagctttacactg

SEQ ID NO: 6494920 - DNA, 13 bp, Homo sapiens
tgagtaggccctg

SEQ ID NO: 6494921 - DNA, 14 bp, Homo sapiens
tgagtaggccctgc

SEQ ID NO: 6494922 - DNA, 17 bp, Homo sapiens
tgagtaggccctgcttt

SEQ ID NO: 6494923 - DNA, 18 bp, Homo sapiens
tgagtagtcttatgtaaa

SEQ ID NO: 6494924 - DNA, 15 bp, Homo sapiens
tgagtagtggccact

SEQ ID NO: 6494925 - DNA, 24 bp, Homo sapiens
tgagtataatacattacatgtaaa

SEQ ID NO: 6494926 - DNA, 18 bp, Homo sapiens
tgagtataatgaacactc

SEQ ID NO: 6494927 - DNA, 15 bp, Homo sapiens
tgagtatatgtaaca

SEQ ID NO: 6494928 - DNA, 15 bp, Homo sapiens
tgagtatattataat

SEQ ID NO: 6494929 - DNA, 21 bp, Homo sapiens
tgagtatcctttcagtgttat

SEQ ID NO: 6494930 - DNA, 20 bp, Homo sapiens
tgagtatgaacttgagatct

SEQ ID NO: 6494931 - DNA, 13 bp, Homo sapiens
tgagtatgtgaag

SEQ ID NO: 6494932 - DNA, 23 bp, Homo sapiens
tgagtatgtgaagatataagtaa

SEQ ID NO: 6494933 - DNA, 13 bp, Homo sapiens
tgagtatgtgtgg

SEQ ID NO: 6494934 - DNA, 18 bp, Homo sapiens
tgagtattaaaatgtatg

SEQ ID NO: 6494935 - DNA, 17 bp, Homo sapiens
tgagtattacacattaa

SEQ ID NO: 6494936 - DNA, 17 bp, Homo sapiens
tgagtattcattttgca

SEQ ID NO: 6494937 - DNA, 12 bp, Homo sapiens
tgagtattgttt

SEQ ID NO: 6494938 - DNA, 19 bp, Homo sapiens
tgagtatttatttaaataa

SEQ ID NO: 6494939 - DNA, 14 bp, Homo sapiens
tgagtatttctgtt

SEQ ID NO: 6494940 - DNA, 19 bp, Homo sapiens
tgagtatttctgttccttt

SEQ ID NO: 6494941 - DNA, 18 bp, Homo sapiens
tgagtatttgcgtccgca

SEQ ID NO: 6494942 - DNA, 16 bp, Homo sapiens
tgagtatttgctgttt

SEQ ID NO: 6494943 - DNA, 16 bp, Homo sapiens
tgagtatttttaaaaa

SEQ ID NO: 6494944 - DNA, 22 bp, Homo sapiens
tgagtatttttaaaaaatatgt

SEQ ID NO: 6494945 - DNA, 15 bp, Homo sapiens
tgagtcaaaaaatct

SEQ ID NO: 6494946 - DNA, 16 bp, Homo sapiens
tgagtcaaaagcctgg

SEQ ID NO: 6494947 - DNA, 12 bp, Homo sapiens
tgagtcaaatcc

SEQ ID NO: 6494948 - DNA, 14 bp, Homo sapiens
tgagtcaaatccag

SEQ ID NO: 6494949 - DNA, 20 bp, Homo sapiens
tgagtcaatagcttgtcttc

SEQ ID NO: 6494950 - DNA, 13 bp, Homo sapiens
tgagtcaatcagc

SEQ ID NO: 6494951 - DNA, 15 bp, Homo sapiens
tgagtcaatgtgcag

SEQ ID NO: 6494952 - DNA, 18 bp, Homo sapiens
tgagtcaatgtgcagtgt

SEQ ID NO: 6494953 - DNA, 22 bp, Homo sapiens
tgagtcacaaaataaagctgtg

SEQ ID NO: 6494954 - DNA, 19 bp, Homo sapiens
tgagtcacaggtgtgggat

SEQ ID NO: 6494955 - DNA, 16 bp, Homo sapiens
tgagtcacccatgaag

SEQ ID NO: 6494956 - DNA, 22 bp, Homo sapiens
tgagtcaccctacctgtgcctg

SEQ ID NO: 6494957 - DNA, 13 bp, Homo sapiens
tgagtcacctcct

SEQ ID NO: 6494958 - DNA, 14 bp, Homo sapiens
tgagtcacctgctc

SEQ ID NO: 6494959 - DNA, 17 bp, Homo sapiens
tgagtcacctgctccag

SEQ ID NO: 6494960 - DNA, 22 bp, Homo sapiens
tgagtcagagatttggagatgt

SEQ ID NO: 6494961 - DNA, 21 bp, Homo sapiens
tgagtcagatgggtctgatat

SEQ ID NO: 6494962 - DNA, 14 bp, Homo sapiens
tgagtcagcacctt

SEQ ID NO: 6494963 - DNA, 16 bp, Homo sapiens
tgagtcagggcccaga

SEQ ID NO: 6494964 - DNA, 17 bp, Homo sapiens
tgagtcagggcccagag

SEQ ID NO: 6494965 - DNA, 18 bp, Homo sapiens
tgagtcagggcccagagg

SEQ ID NO: 6494966 - DNA, 21 bp, Homo sapiens
tgagtcagtctctctctccct

SEQ ID NO: 6494967 - DNA, 20 bp, Homo sapiens
tgagtcatctgttagggcct

SEQ ID NO: 6494968 - DNA, 20 bp, Homo sapiens
tgagtcatgatctccctgcc

SEQ ID NO: 6494969 - DNA, 23 bp, Homo sapiens
tgagtcatttaaatgtgtacaat

SEQ ID NO: 6494970 - DNA, 18 bp, Homo sapiens
tgagtcatttgtttaaac

SEQ ID NO: 6494971 - DNA, 23 bp, Homo sapiens
tgagtccacgcccaccagccttg

SEQ ID NO: 6494972 - DNA, 19 bp, Homo sapiens
tgagtccagaagtttgaga

SEQ ID NO: 6494973 - DNA, 15 bp, Homo sapiens
tgagtccagagcttg

SEQ ID NO: 6494974 - DNA, 13 bp, Homo sapiens
tgagtccagctcc

SEQ ID NO: 6494975 - DNA, 15 bp, Homo sapiens
tgagtccagctcccc

SEQ ID NO: 6494976 - DNA, 12 bp, Homo sapiens
tgagtccagctt

SEQ ID NO: 6494977 - DNA, 15 bp, Homo sapiens
tgagtccatgtccta

SEQ ID NO: 6494978 - DNA, 19 bp, Homo sapiens
tgagtccatgtcctatgcc

SEQ ID NO: 6494979 - DNA, 20 bp, Homo sapiens
tgagtccattctcccaggta

SEQ ID NO: 6494980 - DNA, 22 bp, Homo sapiens
tgagtccattctcccaggtacc

SEQ ID NO: 6494981 - DNA, 16 bp, Homo sapiens
tgagtcccaggagctg

SEQ ID NO: 6494982 - DNA, 18 bp, Homo sapiens
tgagtcccccagagatgt

SEQ ID NO: 6494983 - DNA, 16 bp, Homo sapiens
tgagtccccttacaag

SEQ ID NO: 6494984 - DNA, 22 bp, Homo sapiens
tgagtccctcacgtttcttccc

SEQ ID NO: 6494985 - DNA, 18 bp, Homo sapiens
tgagtcccttccaggcca

SEQ ID NO: 6494986 - DNA, 17 bp, Homo sapiens
tgagtccgcctgcgcct

SEQ ID NO: 6494987 - DNA, 16 bp, Homo sapiens
tgagtcctagagctac

SEQ ID NO: 6494988 - DNA, 21 bp, Homo sapiens
tgagtcctcaagcttctcaga

SEQ ID NO: 6494989 - DNA, 16 bp, Homo sapiens
tgagtcctgagcgaaa

SEQ ID NO: 6494990 - DNA, 11 bp, Homo sapiens
tgagtcctggc

SEQ ID NO: 6494991 - DNA, 22 bp, Homo sapiens
tgagtcctggcatgggaatgaa

SEQ ID NO: 6494992 - DNA, 15 bp, Homo sapiens
tgagtcctggcccaa

SEQ ID NO: 6494993 - DNA, 18 bp, Homo sapiens
tgagtcctggtccctctg

SEQ ID NO: 6494994 - DNA, 21 bp, Homo sapiens
tgagtcctggtccctctgagg

SEQ ID NO: 6494995 - DNA, 22 bp, Homo sapiens
tgagtcctggtccctctgaggc

SEQ ID NO: 6494996 - DNA, 16 bp, Homo sapiens
tgagtcctgttgaaga

SEQ ID NO: 6494997 - DNA, 18 bp, Homo sapiens
tgagtcctgttgaagact

SEQ ID NO: 6494998 - DNA, 17 bp, Homo sapiens
tgagtcgcgcaccgaaa

SEQ ID NO: 6494999 - DNA, 16 bp, Homo sapiens
tgagtcggctgggcag

SEQ ID NO: 6495000 - DNA, 20 bp, Homo sapiens
tgagtcggctgggcagggcc

SEQ ID NO: 6495001 - DNA, 19 bp, Homo sapiens
tgagtcgtacagaaagctg

SEQ ID NO: 6495002 - DNA, 15 bp, Homo sapiens
tgagtctagatgttt

SEQ ID NO: 6495003 - DNA, 23 bp, Homo sapiens
tgagtctatgttcaaagactgtg

SEQ ID NO: 6495004 - DNA, 19 bp, Homo sapiens
tgagtctcaagggtggcag

SEQ ID NO: 6495005 - DNA, 18 bp, Homo sapiens
tgagtctcctctctgaga

SEQ ID NO: 6495006 - DNA, 21 bp, Homo sapiens
tgagtctcctctctgagactg

SEQ ID NO: 6495007 - DNA, 13 bp, Homo sapiens
tgagtctctgaat

SEQ ID NO: 6495008 - DNA, 14 bp, Homo sapiens
tgagtctctggggc

SEQ ID NO: 6495009 - DNA, 15 bp, Homo sapiens
tgagtctgaaggctg

SEQ ID NO: 6495010 - DNA, 17 bp, Homo sapiens
tgagtctgaaggctggg

SEQ ID NO: 6495011 - DNA, 20 bp, Homo sapiens
tgagtctgaattctgctcta

SEQ ID NO: 6495012 - DNA, 14 bp, Homo sapiens
tgagtctgcataaa

SEQ ID NO: 6495013 - DNA, 19 bp, Homo sapiens
tgagtctgcataaacttca

SEQ ID NO: 6495014 - DNA, 20 bp, Homo sapiens
tgagtctgcataaacttcat

SEQ ID NO: 6495015 - DNA, 17 bp, Homo sapiens
tgagtctggacctccat

SEQ ID NO: 6495016 - DNA, 15 bp, Homo sapiens
tgagtctggcaaaca

SEQ ID NO: 6495017 - DNA, 18 bp, Homo sapiens
tgagtctggcaaacatgt

SEQ ID NO: 6495018 - DNA, 23 bp, Homo sapiens
tgagtctgggatattctttagct

SEQ ID NO: 6495019 - DNA, 21 bp, Homo sapiens
tgagtctgggcagctgtccct

SEQ ID NO: 6495020 - DNA, 15 bp, Homo sapiens
tgagtctgtaatttt

SEQ ID NO: 6495021 - DNA, 23 bp, Homo sapiens
tgagtctgtcataatatttgaac

SEQ ID NO: 6495022 - DNA, 12 bp, Homo sapiens
tgagtctgtcct

SEQ ID NO: 6495023 - DNA, 13 bp, Homo sapiens
tgagtctgtcctt

SEQ ID NO: 6495024 - DNA, 12 bp, Homo sapiens
tgagtctgtgga

SEQ ID NO: 6495025 - DNA, 19 bp, Homo sapiens
tgagtctgtggacactgtg

SEQ ID NO: 6495026 - DNA, 21 bp, Homo sapiens
tgagtctgtgtggccagcagc

SEQ ID NO: 6495027 - DNA, 14 bp, Homo sapiens
tgagtctgtttccc

SEQ ID NO: 6495028 - DNA, 18 bp, Homo sapiens
tgagtctgtttcccaagc

SEQ ID NO: 6495029 - DNA, 16 bp, Homo sapiens
tgagtctgttttgtaa

SEQ ID NO: 6495030 - DNA, 21 bp, Homo sapiens
tgagtcttaactgtatttcag

SEQ ID NO: 6495031 - DNA, 18 bp, Homo sapiens
tgagtcttcatgttccca

SEQ ID NO: 6495032 - DNA, 17 bp, Homo sapiens
tgagtcttggcggcagc

SEQ ID NO: 6495033 - DNA, 12 bp, Homo sapiens
tgagtcttgtaa

SEQ ID NO: 6495034 - DNA, 21 bp, Homo sapiens
tgagtctttaacatcttgaac

SEQ ID NO: 6495035 - DNA, 20 bp, Homo sapiens
tgagtctttggttctaagga

SEQ ID NO: 6495036 - DNA, 21 bp, Homo sapiens
tgagtctttggttctaaggac

SEQ ID NO: 6495037 - DNA, 18 bp, Homo sapiens
tgagtgaaagttgccatt

SEQ ID NO: 6495038 - DNA, 19 bp, Homo sapiens
tgagtgaagtattgctgaa

SEQ ID NO: 6495039 - DNA, 20 bp, Homo sapiens
tgagtgaatgagtaaataaa

SEQ ID NO: 6495040 - DNA, 20 bp, Homo sapiens
tgagtgacaaagcctctgaa

SEQ ID NO: 6495041 - DNA, 19 bp, Homo sapiens
tgagtgacaatagaagaaa

SEQ ID NO: 6495042 - DNA, 20 bp, Homo sapiens
tgagtgacaatagaagaaat

SEQ ID NO: 6495043 - DNA, 15 bp, Homo sapiens
tgagtgacagctttc

SEQ ID NO: 6495044 - DNA, 20 bp, Homo sapiens
tgagtgacagctttctggga

SEQ ID NO: 6495045 - DNA, 15 bp, Homo sapiens
tgagtgaccgggggc

SEQ ID NO: 6495046 - DNA, 21 bp, Homo sapiens
tgagtgaccgggggctgctgg

SEQ ID NO: 6495047 - DNA, 19 bp, Homo sapiens
tgagtgacctcacttctgg

SEQ ID NO: 6495048 - DNA, 19 bp, Homo sapiens
tgagtgacctccttctgca

SEQ ID NO: 6495049 - DNA, 16 bp, Homo sapiens
tggtaatatatatatt

SEQ ID NO: 6495050 - DNA, 22 bp, Homo sapiens
tggtaatcagaaataataacct

SEQ ID NO: 6495051 - DNA, 23 bp, Homo sapiens
tggtaatcccctaaaataacagt

SEQ ID NO: 6495052 - DNA, 22 bp, Homo sapiens
tggtaatctttacctgtataca

SEQ ID NO: 6495053 - DNA, 14 bp, Homo sapiens
tggtaatgtgtcaa

SEQ ID NO: 6495054 - DNA, 21 bp, Homo sapiens
tggtaattatcattttagaag

SEQ ID NO: 6495055 - DNA, 14 bp, Homo sapiens
tggtaattgggaac

SEQ ID NO: 6495056 - DNA, 15 bp, Homo sapiens
tggtaattgtacaat

SEQ ID NO: 6495057 - DNA, 22 bp, Homo sapiens
tggtaatttgtatctgaaggag

SEQ ID NO: 6495058 - DNA, 13 bp, Homo sapiens
tggtaattttgat

SEQ ID NO: 6495059 - DNA, 22 bp, Homo sapiens
tggtacaaacctgcatggtgtt

SEQ ID NO: 6495060 - DNA, 20 bp, Homo sapiens
tggtacaatctggctcactg

SEQ ID NO: 6495061 - DNA, 15 bp, Homo sapiens
tggtacacatgtgtt

SEQ ID NO: 6495062 - DNA, 14 bp, Homo sapiens
tggtacagagaagc

SEQ ID NO: 6495063 - DNA, 17 bp, Homo sapiens
tggtacagagaagccag

SEQ ID NO: 6495064 - DNA, 17 bp, Homo sapiens
tggtacagcttctggag

SEQ ID NO: 6495065 - DNA, 20 bp, Homo sapiens
tggtacaggaaggcttgcag

SEQ ID NO: 6495066 - DNA, 21 bp, Homo sapiens
tggtacaggaaggcttgcagt

SEQ ID NO: 6495067 - DNA, 16 bp, Homo sapiens
tggtacatggccagtg

SEQ ID NO: 6495068 - DNA, 13 bp, Homo sapiens
tggtacatgtctt

SEQ ID NO: 6495069 - DNA, 18 bp, Homo sapiens
tggtaccagataactttt

SEQ ID NO: 6495070 - DNA, 13 bp, Homo sapiens
tggtaccagccct

SEQ ID NO: 6495071 - DNA, 15 bp, Homo sapiens
tggtaccagctcact

SEQ ID NO: 6495072 - DNA, 22 bp, Homo sapiens
tggtaccaggcccgcactgggg

SEQ ID NO: 6495073 - DNA, 15 bp, Homo sapiens
tggtaccaggtctcc

SEQ ID NO: 6495074 - DNA, 13 bp, Homo sapiens
tggtacccagcca

SEQ ID NO: 6495075 - DNA, 14 bp, Homo sapiens
tggtacccagccat

SEQ ID NO: 6495076 - DNA, 17 bp, Homo sapiens
tggtacccagccatctg

SEQ ID NO: 6495077 - DNA, 18 bp, Homo sapiens
tggtacccagccatctgc

SEQ ID NO: 6495078 - DNA, 21 bp, Homo sapiens
tggtacccagccatctgccca

SEQ ID NO: 6495079 - DNA, 19 bp, Homo sapiens
tggtacccccaaaccccca

SEQ ID NO: 6495080 - DNA, 16 bp, Homo sapiens
tggtacccccttctgg

SEQ ID NO: 6495081 - DNA, 15 bp, Homo sapiens
tggtaccctcctggc

SEQ ID NO: 6495082 - DNA, 14 bp, Homo sapiens
tggtaccctctgga

SEQ ID NO: 6495083 - DNA, 14 bp, Homo sapiens
tggtaccctggcag

SEQ ID NO: 6495084 - DNA, 16 bp, Homo sapiens
tggtaccctggcagag

SEQ ID NO: 6495085 - DNA, 18 bp, Homo sapiens
tggtaccctggcagagaa

SEQ ID NO: 6495086 - DNA, 15 bp, Homo sapiens
tggtaccggatgcag

SEQ ID NO: 6495087 - DNA, 19 bp, Homo sapiens
tggtacctatttggtgcta

SEQ ID NO: 6495088 - DNA, 13 bp, Homo sapiens
tggtacctgccct

SEQ ID NO: 6495089 - DNA, 15 bp, Homo sapiens
tggtaccttgcacac

SEQ ID NO: 6495090 - DNA, 17 bp, Homo sapiens
tggtacctttctagcct

SEQ ID NO: 6495091 - DNA, 16 bp, Homo sapiens
tggtactaaggagaat

SEQ ID NO: 6495092 - DNA, 20 bp, Homo sapiens
tggtactataaaagctttct

SEQ ID NO: 6495093 - DNA, 18 bp, Homo sapiens
tggtactcccaaactgac

SEQ ID NO: 6495094 - DNA, 21 bp, Homo sapiens
tggtactcccaaactgacaat

SEQ ID NO: 6495095 - DNA, 22 bp, Homo sapiens
tggtactcccaaactgacaatt

SEQ ID NO: 6495096 - DNA, 13 bp, Homo sapiens
tggtactctccta

SEQ ID NO: 6495097 - DNA, 17 bp, Homo sapiens
tggtactctcctagaga

SEQ ID NO: 6495098 - DNA, 16 bp, Homo sapiens
tggtactctgaaacac

SEQ ID NO: 6495099 - DNA, 20 bp, Homo sapiens
tggtactctgtgtctggcag

SEQ ID NO: 6495100 - DNA, 15 bp, Homo sapiens
tggtactgctgtctt

SEQ ID NO: 6495101 - DNA, 22 bp, Homo sapiens
tggtactggcaataagatacac

SEQ ID NO: 6495102 - DNA, 17 bp, Homo sapiens
tggtactgtacagctgg

SEQ ID NO: 6495103 - DNA, 22 bp, Homo sapiens
tggtacttaagctcccctgcct

SEQ ID NO: 6495104 - DNA, 19 bp, Homo sapiens
tggtacttattactgctaa

SEQ ID NO: 6495105 - DNA, 17 bp, Homo sapiens
tggtacttcctttctcc

SEQ ID NO: 6495106 - DNA, 12 bp, Homo sapiens
tggtacttggca

SEQ ID NO: 6495107 - DNA, 14 bp, Homo sapiens
tggtacttggcacc

SEQ ID NO: 6495108 - DNA, 16 bp, Homo sapiens
tggtacttggcaccaa

SEQ ID NO: 6495109 - DNA, 19 bp, Homo sapiens
tggtactttattcttgctg

SEQ ID NO: 6495110 - DNA, 14 bp, Homo sapiens
tggtactttctgta

SEQ ID NO: 6495111 - DNA, 17 bp, Homo sapiens
tggtactttgcagctgc

SEQ ID NO: 6495112 - DNA, 20 bp, Homo sapiens
tggtacttttgagtgtgtgt

SEQ ID NO: 6495113 - DNA, 14 bp, Homo sapiens
tggtagaaaatgca

SEQ ID NO: 6495114 - DNA, 16 bp, Homo sapiens
tggtagaaaatgcacc

SEQ ID NO: 6495115 - DNA, 12 bp, Homo sapiens
tggtagaaacaa

SEQ ID NO: 6495116 - DNA, 16 bp, Homo sapiens
tggtagaagccagtac

SEQ ID NO: 6495117 - DNA, 19 bp, Homo sapiens
tggtagaagtttggctgct

SEQ ID NO: 6495118 - DNA, 19 bp, Homo sapiens
tggtagacaatttgcctta

SEQ ID NO: 6495119 - DNA, 22 bp, Homo sapiens
tggtagagaccgagcctctgtc

SEQ ID NO: 6495120 - DNA, 15 bp, Homo sapiens
tggtagaggcctggg

SEQ ID NO: 6495121 - DNA, 17 bp, Homo sapiens
tggtagaggcctggggc

SEQ ID NO: 6495122 - DNA, 11 bp, Homo sapiens
tggtagagttt

SEQ ID NO: 6495123 - DNA, 14 bp, Homo sapiens
tggtagagtttatt

SEQ ID NO: 6495124 - DNA, 20 bp, Homo sapiens
tggtagatcttcaatttgga

SEQ ID NO: 6495125 - DNA, 18 bp, Homo sapiens
tggtagatgacaaatatt

SEQ ID NO: 6495126 - DNA, 20 bp, Homo sapiens
tggtagattaaatatagatt

SEQ ID NO: 6495127 - DNA, 21 bp, Homo sapiens
tggtagatttcctcctcccag

SEQ ID NO: 6495128 - DNA, 17 bp, Homo sapiens
tggtagatttttttcat

SEQ ID NO: 6495129 - DNA, 23 bp, Homo sapiens
tggtagcacatgtctgtcctcag

SEQ ID NO: 6495130 - DNA, 17 bp, Homo sapiens
tggtagctagtgattta

SEQ ID NO: 6495131 - DNA, 12 bp, Homo sapiens
tggtagctcagg

SEQ ID NO: 6495132 - DNA, 14 bp, Homo sapiens
tggtagctccagcg

SEQ ID NO: 6495133 - DNA, 15 bp, Homo sapiens
tggtagctccagcga

SEQ ID NO: 6495134 - DNA, 18 bp, Homo sapiens
tggtagctccagcgatgg

SEQ ID NO: 6495135 - DNA, 22 bp, Homo sapiens
tggtagctgaaaaaactatatt

SEQ ID NO: 6495136 - DNA, 14 bp, Homo sapiens
tggtagctgagggg

SEQ ID NO: 6495137 - DNA, 15 bp, Homo sapiens
tggtagctgagggga

SEQ ID NO: 6495138 - DNA, 20 bp, Homo sapiens
tggtagcttgtatcaaatgt

SEQ ID NO: 6495139 - DNA, 17 bp, Homo sapiens
tggtagcttttcccttc

SEQ ID NO: 6495140 - DNA, 18 bp, Homo sapiens
tggtaggaatagcatgtc

SEQ ID NO: 6495141 - DNA, 12 bp, Homo sapiens
tggtaggaattt

SEQ ID NO: 6495142 - DNA, 22 bp, Homo sapiens
tggtaggaccaagcatcttggg

SEQ ID NO: 6495143 - DNA, 19 bp, Homo sapiens
tggtaggaccctcgagagc

SEQ ID NO: 6495144 - DNA, 21 bp, Homo sapiens
tggtaggaggaggcatggaaa

SEQ ID NO: 6495145 - DNA, 17 bp, Homo sapiens
tggtaggattgctgggg

SEQ ID NO: 6495146 - DNA, 15 bp, Homo sapiens
tggtaggatttatat

SEQ ID NO: 6495147 - DNA, 21 bp, Homo sapiens
tggtaggccttttaacatttt

SEQ ID NO: 6495148 - DNA, 23 bp, Homo sapiens
tggtagggatatggcaggactcc

SEQ ID NO: 6495149 - DNA, 22 bp, Homo sapiens
tggtagggatgaggtctgataa

SEQ ID NO: 6495150 - DNA, 22 bp, Homo sapiens
tggtaggggagggcaggcttgg

SEQ ID NO: 6495151 - DNA, 19 bp, Homo sapiens
tggtagggtgggagtggtt

SEQ ID NO: 6495152 - DNA, 15 bp, Homo sapiens
tggtaggtaaatcta

SEQ ID NO: 6495153 - DNA, 14 bp, Homo sapiens
tggtaggtactttt

SEQ ID NO: 6495154 - DNA, 22 bp, Homo sapiens
tggtaggtactttttgtgaaga

SEQ ID NO: 6495155 - DNA, 18 bp, Homo sapiens
tggtagtaaaacacagag

SEQ ID NO: 6495156 - DNA, 16 bp, Homo sapiens
tggtagtaatttcctt

SEQ ID NO: 6495157 - DNA, 13 bp, Homo sapiens
tggtagtatctcg

SEQ ID NO: 6495158 - DNA, 15 bp, Homo sapiens
tggtagtcctcccaa

SEQ ID NO: 6495159 - DNA, 22 bp, Homo sapiens
tggtagtcctcccaagctgtgc

SEQ ID NO: 6495160 - DNA, 21 bp, Homo sapiens
tggtagtctaaccaaatgcat

SEQ ID NO: 6495161 - DNA, 15 bp, Homo sapiens
tggtagtgttcagta

SEQ ID NO: 6495162 - DNA, 23 bp, Homo sapiens
tggtagttcattgtaaatgaaca

SEQ ID NO: 6495163 - DNA, 18 bp, Homo sapiens
tggtagttctgtgcctcc

SEQ ID NO: 6495164 - DNA, 17 bp, Homo sapiens
tggtagttgaggaaagc

SEQ ID NO: 6495165 - DNA, 17 bp, Homo sapiens
tggtagtttctgtggtt

SEQ ID NO: 6495166 - DNA, 16 bp, Homo sapiens
tggtagttttttcatc

SEQ ID NO: 6495167 - DNA, 16 bp, Homo sapiens
tggtataagaagactt

SEQ ID NO: 6495168 - DNA, 18 bp, Homo sapiens
tggtataaggtacatatt

SEQ ID NO: 6495169 - DNA, 19 bp, Homo sapiens
tggtataagtaactttatt

SEQ ID NO: 6495170 - DNA, 15 bp, Homo sapiens
tggtataattatttt

SEQ ID NO: 6495171 - DNA, 14 bp, Homo sapiens
tggtataattgaaa

SEQ ID NO: 6495172 - DNA, 14 bp, Homo sapiens
tggtatacatgtgt

SEQ ID NO: 6495173 - DNA, 13 bp, Homo sapiens
tggtatatataca

SEQ ID NO: 6495174 - DNA, 14 bp, Homo sapiens
tggtatatgtcatt

SEQ ID NO: 6495175 - DNA, 20 bp, Homo sapiens
tggtatatttgtgtatgtgt

SEQ ID NO: 6495176 - DNA, 18 bp, Homo sapiens
tggtatcaaaattacata

SEQ ID NO: 6495177 - DNA, 21 bp, Homo sapiens
tggtatcctcatcatgatgga

SEQ ID NO: 6495178 - DNA, 20 bp, Homo sapiens
tggtatctaattctttaatg

SEQ ID NO: 6495179 - DNA, 13 bp, Homo sapiens
tggtatctcagaa

SEQ ID NO: 6495180 - DNA, 22 bp, Homo sapiens
tggtatctcagaaagtgcctga

SEQ ID NO: 6495181 - DNA, 16 bp, Homo sapiens
tggtatctcaggtctg

SEQ ID NO: 6495182 - DNA, 20 bp, Homo sapiens
tggtatctcaggtctgaatc

SEQ ID NO: 6495183 - DNA, 15 bp, Homo sapiens
tggtatgaaacaaat

SEQ ID NO: 6495184 - DNA, 22 bp, Homo sapiens
tggtatgaaataaattctgact

SEQ ID NO: 6495185 - DNA, 23 bp, Homo sapiens
tggtatgaaataaattctgactt

SEQ ID NO: 6495186 - DNA, 21 bp, Homo sapiens
tggtatgaacttgaggacaca

SEQ ID NO: 6495187 - DNA, 22 bp, Homo sapiens
tggtatgaacttgaggacacat

SEQ ID NO: 6495188 - DNA, 18 bp, Homo sapiens
tggtatgaataattgcat

SEQ ID NO: 6495189 - DNA, 16 bp, Homo sapiens
tggtatgacttaaaat

SEQ ID NO: 6495190 - DNA, 22 bp, Homo sapiens
tggtatgatgctgccggcacag

SEQ ID NO: 6495191 - DNA, 16 bp, Homo sapiens
tggtatgcattcttta

SEQ ID NO: 6495192 - DNA, 16 bp, Homo sapiens
tggtatgccaacttaa

SEQ ID NO: 6495193 - DNA, 16 bp, Homo sapiens
tggtatgctggccagc

SEQ ID NO: 6495194 - DNA, 18 bp, Homo sapiens
tggtatgctggccagcac

SEQ ID NO: 6495195 - DNA, 22 bp, Homo sapiens
tggtatgctggccagcaccctc

SEQ ID NO: 6495196 - DNA, 17 bp, Homo sapiens
tggtatggttgtataca

SEQ ID NO: 6495197 - DNA, 19 bp, Homo sapiens
tggtatgtagcccggccag

SEQ ID NO: 6495198 - DNA, 19 bp, Homo sapiens
tggtatgtatattttcagt

SEQ ID NO: 6495199 - DNA, 13 bp, Homo sapiens
tggtatgtctctt

SEQ ID NO: 6495200 - DNA, 17 bp, Homo sapiens
tggtatgtgccaggctt

SEQ ID NO: 6495201 - DNA, 17 bp, Homo sapiens
tggtatgtgggtgaccc

SEQ ID NO: 6495202 - DNA, 20 bp, Homo sapiens
tggtatgtgggtgaccctgg

SEQ ID NO: 6495203 - DNA, 19 bp, Homo sapiens
tggtatgtgtgtgtatgct

SEQ ID NO: 6495204 - DNA, 13 bp, Homo sapiens
tggtattaaagaa

SEQ ID NO: 6495205 - DNA, 14 bp, Homo sapiens
tggtattaaagaat

SEQ ID NO: 6495206 - DNA, 19 bp, Homo sapiens
tggtattaaagaatgctgc

SEQ ID NO: 6495207 - DNA, 17 bp, Homo sapiens
tggtattaatcttgtgt

SEQ ID NO: 6495208 - DNA, 15 bp, Homo sapiens
tggtattacaaaaca

SEQ ID NO: 6495209 - DNA, 14 bp, Homo sapiens
tggtattacacagt

SEQ ID NO: 6495210 - DNA, 21 bp, Homo sapiens
tggtattctgttctggaggaa

SEQ ID NO: 6495211 - DNA, 22 bp, Homo sapiens
tggtattggccgatgagctggt

SEQ ID NO: 6495212 - DNA, 16 bp, Homo sapiens
tggtattgtaatatta

SEQ ID NO: 6495213 - DNA, 18 bp, Homo sapiens
tggtattgtaatattaaa

SEQ ID NO: 6495214 - DNA, 13 bp, Homo sapiens
tggtattgtattt

SEQ ID NO: 6495215 - DNA, 19 bp, Homo sapiens
tggtattgtatttattcaa

SEQ ID NO: 6495216 - DNA, 23 bp, Homo sapiens
tggtattgtatttattcaataaa

SEQ ID NO: 6495217 - DNA, 20 bp, Homo sapiens
tggtattgtgagatgatttg

SEQ ID NO: 6495218 - DNA, 21 bp, Homo sapiens
tggtattgtgagatgatttgt

SEQ ID NO: 6495219 - DNA, 13 bp, Homo sapiens
tggtatttaacag

SEQ ID NO: 6495220 - DNA, 21 bp, Homo sapiens
tggtatttatctattgtaaga

SEQ ID NO: 6495221 - DNA, 23 bp, Homo sapiens
tggtatttatctgcaaggttgta

SEQ ID NO: 6495222 - DNA, 14 bp, Homo sapiens
tggtatttatgtaa

SEQ ID NO: 6495223 - DNA, 15 bp, Homo sapiens
tggtatttgaaacac

SEQ ID NO: 6495224 - DNA, 14 bp, Homo sapiens
tggtattttaacat

SEQ ID NO: 6495225 - DNA, 22 bp, Homo sapiens
tggtattttcaatagccactaa

SEQ ID NO: 6495226 - DNA, 16 bp, Homo sapiens
tggtattttcagagaa

SEQ ID NO: 6495227 - DNA, 16 bp, Homo sapiens
tgagtgactcggtgta

SEQ ID NO: 6495228 - DNA, 18 bp, Homo sapiens
tgagtgagaagataaaaa

SEQ ID NO: 6495229 - DNA, 14 bp, Homo sapiens
tgagtgagcctggc

SEQ ID NO: 6495230 - DNA, 19 bp, Homo sapiens
tgagtgagcctggctcttg

SEQ ID NO: 6495231 - DNA, 22 bp, Homo sapiens
tgagtgagggtttctgagctgc

SEQ ID NO: 6495232 - DNA, 17 bp, Homo sapiens
tgagtgaggttcttgta

SEQ ID NO: 6495233 - DNA, 21 bp, Homo sapiens
tgagtgaggttcttgtaccac

SEQ ID NO: 6495234 - DNA, 16 bp, Homo sapiens
tgagtgagtgggagag

SEQ ID NO: 6495235 - DNA, 14 bp, Homo sapiens
tgagtgatagagct

SEQ ID NO: 6495236 - DNA, 18 bp, Homo sapiens
tgagtgatcactggtatt

SEQ ID NO: 6495237 - DNA, 14 bp, Homo sapiens
tgagtgattatttg

SEQ ID NO: 6495238 - DNA, 12 bp, Homo sapiens
tgagtgcaaatc

SEQ ID NO: 6495239 - DNA, 15 bp, Homo sapiens
tgagtgcaagagcct

SEQ ID NO: 6495240 - DNA, 16 bp, Homo sapiens
tgagtgcaagagcctg

SEQ ID NO: 6495241 - DNA, 16 bp, Homo sapiens
tgagtgcacctgcctc

SEQ ID NO: 6495242 - DNA, 22 bp, Homo sapiens
tgagtgcacctgcctccaccag

SEQ ID NO: 6495243 - DNA, 23 bp, Homo sapiens
tgagtgcacctgcctccaccagc

SEQ ID NO: 6495244 - DNA, 12 bp, Homo sapiens
tgagtgcagcca

SEQ ID NO: 6495245 - DNA, 13 bp, Homo sapiens
tgagtgcagccaa

SEQ ID NO: 6495246 - DNA, 15 bp, Homo sapiens
tgagtgcagccaaag

SEQ ID NO: 6495247 - DNA, 20 bp, Homo sapiens
tgagtgcagccaaaggggag

SEQ ID NO: 6495248 - DNA, 17 bp, Homo sapiens
tgagtgcagctctggag

SEQ ID NO: 6495249 - DNA, 14 bp, Homo sapiens
tgagtgcaggccca

SEQ ID NO: 6495250 - DNA, 16 bp, Homo sapiens
tgagtgcaggcccacc

SEQ ID NO: 6495251 - DNA, 18 bp, Homo sapiens
tgagtgcaggcccaccct

SEQ ID NO: 6495252 - DNA, 15 bp, Homo sapiens
tgagtgcagtcctga

SEQ ID NO: 6495253 - DNA, 20 bp, Homo sapiens
tgagtgccaccacactcagc

SEQ ID NO: 6495254 - DNA, 14 bp, Homo sapiens
tgagtgccatgctt

SEQ ID NO: 6495255 - DNA, 16 bp, Homo sapiens
tgagtgccatgctttt

SEQ ID NO: 6495256 - DNA, 21 bp, Homo sapiens
tgagtgccccacttctggcca

SEQ ID NO: 6495257 - DNA, 14 bp, Homo sapiens
tgagtgcctggcca

SEQ ID NO: 6495258 - DNA, 17 bp, Homo sapiens
tgagtgccttacacaat

SEQ ID NO: 6495259 - DNA, 18 bp, Homo sapiens
tgagtgccttctgtgggg

SEQ ID NO: 6495260 - DNA, 15 bp, Homo sapiens
tgagtgccttttgca

SEQ ID NO: 6495261 - DNA, 22 bp, Homo sapiens
tgagtgcgcagatctgtgcctg

SEQ ID NO: 6495262 - DNA, 17 bp, Homo sapiens
tgagtgcgcctcaccag

SEQ ID NO: 6495263 - DNA, 16 bp, Homo sapiens
tgagtgcgtctgaggg

SEQ ID NO: 6495264 - DNA, 21 bp, Homo sapiens
tgagtgctaagagcctctgga

SEQ ID NO: 6495265 - DNA, 22 bp, Homo sapiens
tgagtgcttgttagagagaaag

SEQ ID NO: 6495266 - DNA, 20 bp, Homo sapiens
tgagtggaaagtcacctaca

SEQ ID NO: 6495267 - DNA, 12 bp, Homo sapiens
tgagtggaaata

SEQ ID NO: 6495268 - DNA, 16 bp, Homo sapiens
tgagtggaagggagga

SEQ ID NO: 6495269 - DNA, 15 bp, Homo sapiens
tgagtggaatgtggt

SEQ ID NO: 6495270 - DNA, 12 bp, Homo sapiens
tgagtggacagc

SEQ ID NO: 6495271 - DNA, 15 bp, Homo sapiens
tgagtggacagcagc

SEQ ID NO: 6495272 - DNA, 16 bp, Homo sapiens
tgagtggacagcagct

SEQ ID NO: 6495273 - DNA, 16 bp, Homo sapiens
tgagtggaggaagccc

SEQ ID NO: 6495274 - DNA, 22 bp, Homo sapiens
tgagtggagtttccaacagagg

SEQ ID NO: 6495275 - DNA, 22 bp, Homo sapiens
tgagtggatggaggagaaataa

SEQ ID NO: 6495276 - DNA, 14 bp, Homo sapiens
tgagtggatggatg

SEQ ID NO: 6495277 - DNA, 15 bp, Homo sapiens
tgagtggatggatgg

SEQ ID NO: 6495278 - DNA, 19 bp, Homo sapiens
tgagtggatggatggacag

SEQ ID NO: 6495279 - DNA, 12 bp, Homo sapiens
tgagtggcagca

SEQ ID NO: 6495280 - DNA, 15 bp, Homo sapiens
tgagtggcagcagcc

SEQ ID NO: 6495281 - DNA, 13 bp, Homo sapiens
tgagtggcagcca

SEQ ID NO: 6495282 - DNA, 14 bp, Homo sapiens
tgagtggcagccat

SEQ ID NO: 6495283 - DNA, 18 bp, Homo sapiens
tgagtggcagccatgcct

SEQ ID NO: 6495284 - DNA, 20 bp, Homo sapiens
tgagtggcagccatgcctca

SEQ ID NO: 6495285 - DNA, 17 bp, Homo sapiens
tgagtggcagccgcctc

SEQ ID NO: 6495286 - DNA, 21 bp, Homo sapiens
tgagtggcaggggacaggagt

SEQ ID NO: 6495287 - DNA, 13 bp, Homo sapiens
tgagtggcatgtg

SEQ ID NO: 6495288 - DNA, 22 bp, Homo sapiens
tgagtggcatgtgggttgtgat

SEQ ID NO: 6495289 - DNA, 14 bp, Homo sapiens
tgagtggccagcca

SEQ ID NO: 6495290 - DNA, 20 bp, Homo sapiens
tgagtggccagccagtgcca

SEQ ID NO: 6495291 - DNA, 17 bp, Homo sapiens
tgagtggccccacctgt

SEQ ID NO: 6495292 - DNA, 19 bp, Homo sapiens
tgagtggcttcactcctgc

SEQ ID NO: 6495293 - DNA, 13 bp, Homo sapiens
tgagtgggaagcc

SEQ ID NO: 6495294 - DNA, 15 bp, Homo sapiens
tgagtgggagaaggc

SEQ ID NO: 6495295 - DNA, 19 bp, Homo sapiens
tgagtgggagagtacctgt

SEQ ID NO: 6495296 - DNA, 22 bp, Homo sapiens
tgagtgggagagtacctgtgtg

SEQ ID NO: 6495297 - DNA, 17 bp, Homo sapiens
tgagtgggaggcgtgcc

SEQ ID NO: 6495298 - DNA, 21 bp, Homo sapiens
tgagtgggaggcgtgcccccc

SEQ ID NO: 6495299 - DNA, 15 bp, Homo sapiens
tgagtgggccccctc

SEQ ID NO: 6495300 - DNA, 16 bp, Homo sapiens
tgagtgggccccctct

SEQ ID NO: 6495301 - DNA, 18 bp, Homo sapiens
tgagtgggccctgcccgg

SEQ ID NO: 6495302 - DNA, 21 bp, Homo sapiens
tgagtgggccctgcccgggga

SEQ ID NO: 6495303 - DNA, 20 bp, Homo sapiens
tgagtggggagacacctcag

SEQ ID NO: 6495304 - DNA, 21 bp, Homo sapiens
tgagtggggttatctctgtgt

SEQ ID NO: 6495305 - DNA, 22 bp, Homo sapiens
tgagtggtcactggtcagggca

SEQ ID NO: 6495306 - DNA, 23 bp, Homo sapiens
tgagtggtcactggtcagggcag

SEQ ID NO: 6495307 - DNA, 20 bp, Homo sapiens
tgagtggtccacattctgct

SEQ ID NO: 6495308 - DNA, 21 bp, Homo sapiens
tgagtggtgaggggccactgg

SEQ ID NO: 6495309 - DNA, 22 bp, Homo sapiens
tgagtggtgaggggccactggg

SEQ ID NO: 6495310 - DNA, 14 bp, Homo sapiens
tgagtgtaaataat

SEQ ID NO: 6495311 - DNA, 16 bp, Homo sapiens
tgagtgtaaataattt

SEQ ID NO: 6495312 - DNA, 17 bp, Homo sapiens
tgagtgtaaataatttt

SEQ ID NO: 6495313 - DNA, 23 bp, Homo sapiens
tgagtgtaaataattttaaataa

SEQ ID NO: 6495314 - DNA, 17 bp, Homo sapiens
tgagtgtaacaagaaag

SEQ ID NO: 6495315 - DNA, 18 bp, Homo sapiens
tgagtgtacagattttat

SEQ ID NO: 6495316 - DNA, 11 bp, Homo sapiens
tgagtgtacca

SEQ ID NO: 6495317 - DNA, 12 bp, Homo sapiens
tgagtgtactgt

SEQ ID NO: 6495318 - DNA, 21 bp, Homo sapiens
tgagtgtatacatgtgtgggt

SEQ ID NO: 6495319 - DNA, 14 bp, Homo sapiens
tgagtgtatatata

SEQ ID NO: 6495320 - DNA, 19 bp, Homo sapiens
tgagtgtatgtatacacac

SEQ ID NO: 6495321 - DNA, 12 bp, Homo sapiens
tgagtgtatgtg

SEQ ID NO: 6495322 - DNA, 22 bp, Homo sapiens
tgagtgtattttttaaaattga

SEQ ID NO: 6495323 - DNA, 12 bp, Homo sapiens
tgagtgtgagag

SEQ ID NO: 6495324 - DNA, 15 bp, Homo sapiens
tgagtgtgagggcag

SEQ ID NO: 6495325 - DNA, 16 bp, Homo sapiens
tgagtgtgagggcagc

SEQ ID NO: 6495326 - DNA, 12 bp, Homo sapiens
tgagtgtgagtg

SEQ ID NO: 6495327 - DNA, 16 bp, Homo sapiens
tgagtgtgcatggagg

SEQ ID NO: 6495328 - DNA, 19 bp, Homo sapiens
tgagtgtgcggctgtgtgt

SEQ ID NO: 6495329 - DNA, 14 bp, Homo sapiens
tgagtgtggctccc

SEQ ID NO: 6495330 - DNA, 13 bp, Homo sapiens
tgagtgtgtgaag

SEQ ID NO: 6495331 - DNA, 21 bp, Homo sapiens
tgagtgtgtgtgcttgaatgt

SEQ ID NO: 6495332 - DNA, 14 bp, Homo sapiens
tgagtgttagaaaa

SEQ ID NO: 6495333 - DNA, 12 bp, Homo sapiens
tgagtgttcatt

SEQ ID NO: 6495334 - DNA, 14 bp, Homo sapiens
tgagtgttcatttt

SEQ ID NO: 6495335 - DNA, 23 bp, Homo sapiens
tgagtgttcattttagtgactgt

SEQ ID NO: 6495336 - DNA, 21 bp, Homo sapiens
tgagtgttcctttttaaatgt

SEQ ID NO: 6495337 - DNA, 23 bp, Homo sapiens
tgagtgttcctttttaaatgtga

SEQ ID NO: 6495338 - DNA, 16 bp, Homo sapiens
tgagtgttctcctctt

SEQ ID NO: 6495339 - DNA, 14 bp, Homo sapiens
tgagtgttctggga

SEQ ID NO: 6495340 - DNA, 22 bp, Homo sapiens
tgagtgtttttactacagttgt

SEQ ID NO: 6495341 - DNA, 21 bp, Homo sapiens
tgagttaaagagaggccccgg

SEQ ID NO: 6495342 - DNA, 17 bp, Homo sapiens
tgagttaacaggacagt

SEQ ID NO: 6495343 - DNA, 14 bp, Homo sapiens
tgagttacagaaat

SEQ ID NO: 6495344 - DNA, 16 bp, Homo sapiens
tgagttacagcctgtt

SEQ ID NO: 6495345 - DNA, 16 bp, Homo sapiens
tgagttactgtgcatt

SEQ ID NO: 6495346 - DNA, 17 bp, Homo sapiens
tgagttacttagaatgc

SEQ ID NO: 6495347 - DNA, 18 bp, Homo sapiens
tgagttacttagaatgcc

SEQ ID NO: 6495348 - DNA, 22 bp, Homo sapiens
tgagttacttagaatgccataa

SEQ ID NO: 6495349 - DNA, 24 bp, Homo sapiens
tgagttacttgctgccctgtgctc

SEQ ID NO: 6495350 - DNA, 20 bp, Homo sapiens
tgagttacttgtctgaggcc

SEQ ID NO: 6495351 - DNA, 22 bp, Homo sapiens
tgagttacttgtctgaggcctc

SEQ ID NO: 6495352 - DNA, 15 bp, Homo sapiens
tgagttagctttctt

SEQ ID NO: 6495353 - DNA, 17 bp, Homo sapiens
tgagttaggctttctct

SEQ ID NO: 6495354 - DNA, 23 bp, Homo sapiens
tgagttatcagggaacttagtaa

SEQ ID NO: 6495355 - DNA, 19 bp, Homo sapiens
tgagttatgaaaagataac

SEQ ID NO: 6495356 - DNA, 21 bp, Homo sapiens
tgagttattcataaagagaaa

SEQ ID NO: 6495357 - DNA, 21 bp, Homo sapiens
tgagttattgagattgtcctc

SEQ ID NO: 6495358 - DNA, 17 bp, Homo sapiens
tgagttattttaattat

SEQ ID NO: 6495359 - DNA, 23 bp, Homo sapiens
tgagttcacatgtgccctgcctt

SEQ ID NO: 6495360 - DNA, 18 bp, Homo sapiens
tgagttccagaaagtaaa

SEQ ID NO: 6495361 - DNA, 17 bp, Homo sapiens
tgagttcccaaagggag

SEQ ID NO: 6495362 - DNA, 22 bp, Homo sapiens
tgagttcccaaagggagggtgg

SEQ ID NO: 6495363 - DNA, 18 bp, Homo sapiens
tgagttcccgggagctgg

SEQ ID NO: 6495364 - DNA, 23 bp, Homo sapiens
tgagttcccgggagctgggccct

SEQ ID NO: 6495365 - DNA, 14 bp, Homo sapiens
tgagttcctagcca

SEQ ID NO: 6495366 - DNA, 13 bp, Homo sapiens
tgagttcctctgc

SEQ ID NO: 6495367 - DNA, 14 bp, Homo sapiens
tgagttcctctgca

SEQ ID NO: 6495368 - DNA, 15 bp, Homo sapiens
tgagttcctctgcag

SEQ ID NO: 6495369 - DNA, 16 bp, Homo sapiens
tgagttcctctgcagt

SEQ ID NO: 6495370 - DNA, 17 bp, Homo sapiens
tgagttcctctgcagtt

SEQ ID NO: 6495371 - DNA, 19 bp, Homo sapiens
tgagttccttataagaatt

SEQ ID NO: 6495372 - DNA, 22 bp, Homo sapiens
tgagttctacataagtaattca

SEQ ID NO: 6495373 - DNA, 18 bp, Homo sapiens
tgagttctcactatgttt

SEQ ID NO: 6495374 - DNA, 20 bp, Homo sapiens
tgagttctcactatgtttct

SEQ ID NO: 6495375 - DNA, 17 bp, Homo sapiens
tgagttctcagggctcc

SEQ ID NO: 6495376 - DNA, 22 bp, Homo sapiens
tgagttctcagggctcctgcct

SEQ ID NO: 6495377 - DNA, 15 bp, Homo sapiens
tgagttctccctgta

SEQ ID NO: 6495378 - DNA, 21 bp, Homo sapiens
tgagttctctttcttagtccc

SEQ ID NO: 6495379 - DNA, 20 bp, Homo sapiens
tgagttctgcacatacagat

SEQ ID NO: 6495380 - DNA, 21 bp, Homo sapiens
tgagttctgcacatacagatg

SEQ ID NO: 6495381 - DNA, 12 bp, Homo sapiens
tgagttcttact

SEQ ID NO: 6495382 - DNA, 15 bp, Homo sapiens
tgagttcttcctgta

SEQ ID NO: 6495383 - DNA, 13 bp, Homo sapiens
tgagttcttgttt

SEQ ID NO: 6495384 - DNA, 17 bp, Homo sapiens
tgagttctttcatctcc

SEQ ID NO: 6495385 - DNA, 23 bp, Homo sapiens
tgagttctttttcactctgtgtc

SEQ ID NO: 6495386 - DNA, 13 bp, Homo sapiens
tgagttgaagatc

SEQ ID NO: 6495387 - DNA, 19 bp, Homo sapiens
tgagttgagccttcaggcc

SEQ ID NO: 6495388 - DNA, 16 bp, Homo sapiens
tgagttgattgagaag

SEQ ID NO: 6495389 - DNA, 17 bp, Homo sapiens
tgagttgccaagacaaa

SEQ ID NO: 6495390 - DNA, 15 bp, Homo sapiens
tgagttgctggaaaa

SEQ ID NO: 6495391 - DNA, 17 bp, Homo sapiens
tgagttgctggaaaatc

SEQ ID NO: 6495392 - DNA, 21 bp, Homo sapiens
tgagttgcttcttcttgtgga

SEQ ID NO: 6495393 - DNA, 17 bp, Homo sapiens
tgagttggacttcagtc

SEQ ID NO: 6495394 - DNA, 18 bp, Homo sapiens
tgagttgggggagggaag

SEQ ID NO: 6495395 - DNA, 12 bp, Homo sapiens
tgagttgggggt

SEQ ID NO: 6495396 - DNA, 19 bp, Homo sapiens
tgagttgggggtattttct

SEQ ID NO: 6495397 - DNA, 21 bp, Homo sapiens
tgagttgggggtattttctaa

SEQ ID NO: 6495398 - DNA, 22 bp, Homo sapiens
tgagttgggggtgtggctctgc

SEQ ID NO: 6495399 - DNA, 19 bp, Homo sapiens
tgagttggggtctggcagc

SEQ ID NO: 6495400 - DNA, 19 bp, Homo sapiens
tgagttggttacctattgc

SEQ ID NO: 6495401 - DNA, 24 bp, Homo sapiens
tgagttgtactggttagattcatt

SEQ ID NO: 6495402 - DNA, 20 bp, Homo sapiens
tgagttgtataaaagttgta

SEQ ID NO: 6495403 - DNA, 18 bp, Homo sapiens
tgagttgtcacagaaatt

SEQ ID NO: 6495404 - DNA, 18 bp, Homo sapiens
tgagttgtgaaagttttg

SEQ ID NO: 6495405 - DNA, 20 bp, Homo sapiens
tggtattttcgtgcatttgt

SEQ ID NO: 6495406 - DNA, 17 bp, Homo sapiens
tggtcaaaagctggatt

SEQ ID NO: 6495407 - DNA, 16 bp, Homo sapiens
tggtcaaacaaactct

SEQ ID NO: 6495408 - DNA, 21 bp, Homo sapiens
tggtcaaacaaactctctgaa

SEQ ID NO: 6495409 - DNA, 13 bp, Homo sapiens
tggtcaaactttt

SEQ ID NO: 6495410 - DNA, 14 bp, Homo sapiens
tggtcaacatagtg

SEQ ID NO: 6495411 - DNA, 19 bp, Homo sapiens
tggtcaacatttctcatgt

SEQ ID NO: 6495412 - DNA, 20 bp, Homo sapiens
tggtcaacatttctcatgtt

SEQ ID NO: 6495413 - DNA, 17 bp, Homo sapiens
tggtcaacccgctgctt

SEQ ID NO: 6495414 - DNA, 14 bp, Homo sapiens
tggtcaacctcctg

SEQ ID NO: 6495415 - DNA, 16 bp, Homo sapiens
tggtcaacctcctgga

SEQ ID NO: 6495416 - DNA, 22 bp, Homo sapiens
tggtcaagatgggtcaagcaag

SEQ ID NO: 6495417 - DNA, 15 bp, Homo sapiens
tggtcaagattttga

SEQ ID NO: 6495418 - DNA, 17 bp, Homo sapiens
tggtcaaggccacctct

SEQ ID NO: 6495419 - DNA, 23 bp, Homo sapiens
tggtcaaggccacctctgcctct

SEQ ID NO: 6495420 - DNA, 19 bp, Homo sapiens
tggtcaagttcccaactga

SEQ ID NO: 6495421 - DNA, 18 bp, Homo sapiens
tggtcaataaaccactgt

SEQ ID NO: 6495422 - DNA, 22 bp, Homo sapiens
tggtcacaacttgatggctgcg

SEQ ID NO: 6495423 - DNA, 13 bp, Homo sapiens
tggtcacacaagg

SEQ ID NO: 6495424 - DNA, 19 bp, Homo sapiens
tggtcacagacccctgggg

SEQ ID NO: 6495425 - DNA, 20 bp, Homo sapiens
tggtcacagacccctggggg

SEQ ID NO: 6495426 - DNA, 20 bp, Homo sapiens
tggtcacagacttctggcct

SEQ ID NO: 6495427 - DNA, 17 bp, Homo sapiens
tggtcacagccaggcgc

SEQ ID NO: 6495428 - DNA, 13 bp, Homo sapiens
tggtcacagctgt

SEQ ID NO: 6495429 - DNA, 14 bp, Homo sapiens
tggtcacagctgta

SEQ ID NO: 6495430 - DNA, 22 bp, Homo sapiens
tggtcacaggaagtagaggagg

SEQ ID NO: 6495431 - DNA, 13 bp, Homo sapiens
tggtcacagggca

SEQ ID NO: 6495432 - DNA, 17 bp, Homo sapiens
tggtcacagggcatgcc

SEQ ID NO: 6495433 - DNA, 21 bp, Homo sapiens
tggtcacagtcctatgtacag

SEQ ID NO: 6495434 - DNA, 18 bp, Homo sapiens
tggtcaccaaggcagtgc

SEQ ID NO: 6495435 - DNA, 14 bp, Homo sapiens
tggtcaccagctcc

SEQ ID NO: 6495436 - DNA, 14 bp, Homo sapiens
tggtcaccctcagg

SEQ ID NO: 6495437 - DNA, 17 bp, Homo sapiens
tggtcaccctggggctg

SEQ ID NO: 6495438 - DNA, 15 bp, Homo sapiens
tggtcaccgagactc

SEQ ID NO: 6495439 - DNA, 23 bp, Homo sapiens
tggtcaccgagactcagcctctg

SEQ ID NO: 6495440 - DNA, 16 bp, Homo sapiens
tggtcacctcccatcc

SEQ ID NO: 6495441 - DNA, 13 bp, Homo sapiens
tggtcaccttcct

SEQ ID NO: 6495442 - DNA, 17 bp, Homo sapiens
tggtcaccttcctcagc

SEQ ID NO: 6495443 - DNA, 20 bp, Homo sapiens
tggtcacgtttggtgcttct

SEQ ID NO: 6495444 - DNA, 21 bp, Homo sapiens
tggtcactaaccaacaaggtt

SEQ ID NO: 6495445 - DNA, 15 bp, Homo sapiens
tggtcactatagctc

SEQ ID NO: 6495446 - DNA, 14 bp, Homo sapiens
tggtcactctgccc

SEQ ID NO: 6495447 - DNA, 15 bp, Homo sapiens
tggtcactctgccct

SEQ ID NO: 6495448 - DNA, 16 bp, Homo sapiens
tggtcactctgccctc

SEQ ID NO: 6495449 - DNA, 13 bp, Homo sapiens
tggtcactgctgt

SEQ ID NO: 6495450 - DNA, 17 bp, Homo sapiens
tggtcactggtcagggc

SEQ ID NO: 6495451 - DNA, 19 bp, Homo sapiens
tggtcactggtcagggcag

SEQ ID NO: 6495452 - DNA, 12 bp, Homo sapiens
tggtcactgtgc

SEQ ID NO: 6495453 - DNA, 17 bp, Homo sapiens
tggtcactgtgcactgc

SEQ ID NO: 6495454 - DNA, 14 bp, Homo sapiens
tggtcagagccaca

SEQ ID NO: 6495455 - DNA, 17 bp, Homo sapiens
tggtcagagccacaggg

SEQ ID NO: 6495456 - DNA, 22 bp, Homo sapiens
tggtcagcagatgccagtgaag

SEQ ID NO: 6495457 - DNA, 11 bp, Homo sapiens
tggtcagccca

SEQ ID NO: 6495458 - DNA, 12 bp, Homo sapiens
tggtcagcccaa

SEQ ID NO: 6495459 - DNA, 20 bp, Homo sapiens
tggtcagcggcctggggacg

SEQ ID NO: 6495460 - DNA, 16 bp, Homo sapiens
tggtcagcgttgcatg

SEQ ID NO: 6495461 - DNA, 13 bp, Homo sapiens
tggtcagctccct

SEQ ID NO: 6495462 - DNA, 22 bp, Homo sapiens
tggtcagctgccccaatgtgac

SEQ ID NO: 6495463 - DNA, 15 bp, Homo sapiens
tggtcaggaagcaag

SEQ ID NO: 6495464 - DNA, 19 bp, Homo sapiens
tggtcaggcaatgccctgc

SEQ ID NO: 6495465 - DNA, 13 bp, Homo sapiens
tggtcaggcccag

SEQ ID NO: 6495466 - DNA, 14 bp, Homo sapiens
tggtcaggcccagc

SEQ ID NO: 6495467 - DNA, 21 bp, Homo sapiens
tggtcaggctggtctcaaact

SEQ ID NO: 6495468 - DNA, 15 bp, Homo sapiens
tggtcagggcagggc

SEQ ID NO: 6495469 - DNA, 20 bp, Homo sapiens
tggtcagggtgtgggatctg

SEQ ID NO: 6495470 - DNA, 14 bp, Homo sapiens
tggtcaggtcccca

SEQ ID NO: 6495471 - DNA, 16 bp, Homo sapiens
tggtcagtattatcta

SEQ ID NO: 6495472 - DNA, 13 bp, Homo sapiens
tggtcagtgtgca

SEQ ID NO: 6495473 - DNA, 17 bp, Homo sapiens
tggtcagttttcacaga

SEQ ID NO: 6495474 - DNA, 19 bp, Homo sapiens
tggtcagttttcacagagg

SEQ ID NO: 6495475 - DNA, 20 bp, Homo sapiens
tggtcagttttcacagaggc

SEQ ID NO: 6495476 - DNA, 15 bp, Homo sapiens
tggtcatatacatat

SEQ ID NO: 6495477 - DNA, 17 bp, Homo sapiens
tggtcatatacatattg

SEQ ID NO: 6495478 - DNA, 20 bp, Homo sapiens
tggtcatcctgggcatgtcc

SEQ ID NO: 6495479 - DNA, 22 bp, Homo sapiens
tggtcatccttggtgctcttgc

SEQ ID NO: 6495480 - DNA, 23 bp, Homo sapiens
tggtcatgaatagaaaaaaaaca

SEQ ID NO: 6495481 - DNA, 20 bp, Homo sapiens
tggtcatgaattcatactct

SEQ ID NO: 6495482 - DNA, 15 bp, Homo sapiens
tggtcatgctcagcc

SEQ ID NO: 6495483 - DNA, 13 bp, Homo sapiens
tggtcatggaggc

SEQ ID NO: 6495484 - DNA, 22 bp, Homo sapiens
tggtcatgtgggtcttccaggg

SEQ ID NO: 6495485 - DNA, 19 bp, Homo sapiens
tggtcattcctaatgcatt

SEQ ID NO: 6495486 - DNA, 13 bp, Homo sapiens
tggtcatttgcca

SEQ ID NO: 6495487 - DNA, 21 bp, Homo sapiens
tggtcatttgccaactaattt

SEQ ID NO: 6495488 - DNA, 18 bp, Homo sapiens
tggtccaaaaaaaggaaa

SEQ ID NO: 6495489 - DNA, 19 bp, Homo sapiens
tggtccaaaaaaaggaaaa

SEQ ID NO: 6495490 - DNA, 20 bp, Homo sapiens
tggtccaaaaaaaggaaaaa

SEQ ID NO: 6495491 - DNA, 21 bp, Homo sapiens
tggtccaaaaaaaggaaaaat

SEQ ID NO: 6495492 - DNA, 17 bp, Homo sapiens
tggtccaaaataaaacc

SEQ ID NO: 6495493 - DNA, 11 bp, Homo sapiens
tggtccaaata

SEQ ID NO: 6495494 - DNA, 20 bp, Homo sapiens
tggtccaacagtttgatgct

SEQ ID NO: 6495495 - DNA, 21 bp, Homo sapiens
tggtccaacagtttgatgctg

SEQ ID NO: 6495496 - DNA, 15 bp, Homo sapiens
tggtccaattagttt

SEQ ID NO: 6495497 - DNA, 21 bp, Homo sapiens
tggtccaattagtttcctttt

SEQ ID NO: 6495498 - DNA, 19 bp, Homo sapiens
tggtccacactagaaagaa

SEQ ID NO: 6495499 - DNA, 21 bp, Homo sapiens
tggtccacagggcacctgcca

SEQ ID NO: 6495500 - DNA, 23 bp, Homo sapiens
tggtccacagggctcctgaagga

SEQ ID NO: 6495501 - DNA, 18 bp, Homo sapiens
tggtccacattctgctgc

SEQ ID NO: 6495502 - DNA, 19 bp, Homo sapiens
tggtccactcagggctgcc

SEQ ID NO: 6495503 - DNA, 11 bp, Homo sapiens
tggtccactgt

SEQ ID NO: 6495504 - DNA, 14 bp, Homo sapiens
tggtccactgtgtt

SEQ ID NO: 6495505 - DNA, 14 bp, Homo sapiens
tggtccacttttcc

SEQ ID NO: 6495506 - DNA, 16 bp, Homo sapiens
tggtccacttttccag

SEQ ID NO: 6495507 - DNA, 13 bp, Homo sapiens
tggtccagagtca

SEQ ID NO: 6495508 - DNA, 18 bp, Homo sapiens
tggtccagcgtcactcca

SEQ ID NO: 6495509 - DNA, 22 bp, Homo sapiens
tggtccagcgtcactccagtgc

SEQ ID NO: 6495510 - DNA, 13 bp, Homo sapiens
tggtccagctctg

SEQ ID NO: 6495511 - DNA, 21 bp, Homo sapiens
tggtccagctcttggcccctg

SEQ ID NO: 6495512 - DNA, 22 bp, Homo sapiens
tggtccagcttgctcttcagtg

SEQ ID NO: 6495513 - DNA, 12 bp, Homo sapiens
tggtccaggaga

SEQ ID NO: 6495514 - DNA, 16 bp, Homo sapiens
tggtccaggagaaggc

SEQ ID NO: 6495515 - DNA, 15 bp, Homo sapiens
tggtccaggccaggc

SEQ ID NO: 6495516 - DNA, 19 bp, Homo sapiens
tggtccaggcttgggctcc

SEQ ID NO: 6495517 - DNA, 14 bp, Homo sapiens
tggtccagggttga

SEQ ID NO: 6495518 - DNA, 23 bp, Homo sapiens
tggtccagtggggaacaggtccc

SEQ ID NO: 6495519 - DNA, 13 bp, Homo sapiens
tggtccagtgtca

SEQ ID NO: 6495520 - DNA, 19 bp, Homo sapiens
tggtccatagagagcaaga

SEQ ID NO: 6495521 - DNA, 22 bp, Homo sapiens
tggtccatcactattcaaggat

SEQ ID NO: 6495522 - DNA, 15 bp, Homo sapiens
tggtccatctctgaa

SEQ ID NO: 6495523 - DNA, 16 bp, Homo sapiens
tggtccatctctgaaa

SEQ ID NO: 6495524 - DNA, 20 bp, Homo sapiens
tggtccatgcccactgctgg

SEQ ID NO: 6495525 - DNA, 18 bp, Homo sapiens
tggtccatgctgatgatt

SEQ ID NO: 6495526 - DNA, 17 bp, Homo sapiens
tggtccatggaatgctt

SEQ ID NO: 6495527 - DNA, 22 bp, Homo sapiens
tggtccatgggccatatgaaaa

SEQ ID NO: 6495528 - DNA, 21 bp, Homo sapiens
tggtccatttcatgtgatcta

SEQ ID NO: 6495529 - DNA, 20 bp, Homo sapiens
tggtccatttgttcctgctt

SEQ ID NO: 6495530 - DNA, 13 bp, Homo sapiens
tggtcccacatcc

SEQ ID NO: 6495531 - DNA, 20 bp, Homo sapiens
tggtcccacatccctgggcc

SEQ ID NO: 6495532 - DNA, 23 bp, Homo sapiens
tggtcccacatccctgggcctgc

SEQ ID NO: 6495533 - DNA, 16 bp, Homo sapiens
tggtcccaccccacac

SEQ ID NO: 6495534 - DNA, 13 bp, Homo sapiens
tggtcccactcag

SEQ ID NO: 6495535 - DNA, 19 bp, Homo sapiens
tggtcccacttcacagctg

SEQ ID NO: 6495536 - DNA, 17 bp, Homo sapiens
tggtcccacttccccat

SEQ ID NO: 6495537 - DNA, 16 bp, Homo sapiens
tggtcccagacagctg

SEQ ID NO: 6495538 - DNA, 19 bp, Homo sapiens
tggtcccataggagcagcc

SEQ ID NO: 6495539 - DNA, 13 bp, Homo sapiens
tggtcccatcctc

SEQ ID NO: 6495540 - DNA, 21 bp, Homo sapiens
tggtcccccatgggctgctgg

SEQ ID NO: 6495541 - DNA, 15 bp, Homo sapiens
tggtcccctccctcg

SEQ ID NO: 6495542 - DNA, 15 bp, Homo sapiens
tggtcccctcctcag

SEQ ID NO: 6495543 - DNA, 17 bp, Homo sapiens
tggtcccctcctcagtg

SEQ ID NO: 6495544 - DNA, 18 bp, Homo sapiens
tggtcccctccttcccaa

SEQ ID NO: 6495545 - DNA, 22 bp, Homo sapiens
tggtcccctccttcccaagtga

SEQ ID NO: 6495546 - DNA, 13 bp, Homo sapiens
tggtccctcgtcc

SEQ ID NO: 6495547 - DNA, 16 bp, Homo sapiens
tggtccctgccctccc

SEQ ID NO: 6495548 - DNA, 21 bp, Homo sapiens
tggtccctgccctcccctgct

SEQ ID NO: 6495549 - DNA, 16 bp, Homo sapiens
tggtccctggaagctt

SEQ ID NO: 6495550 - DNA, 12 bp, Homo sapiens
tggtccctgggg

SEQ ID NO: 6495551 - DNA, 11 bp, Homo sapiens
tggtccctggt

SEQ ID NO: 6495552 - DNA, 18 bp, Homo sapiens
tggtccctggtccttcac

SEQ ID NO: 6495553 - DNA, 22 bp, Homo sapiens
tggtccctgttttcccacgagg

SEQ ID NO: 6495554 - DNA, 15 bp, Homo sapiens
tggtccctttaaaga

SEQ ID NO: 6495555 - DNA, 17 bp, Homo sapiens
tggtccgagctgaggac

SEQ ID NO: 6495556 - DNA, 19 bp, Homo sapiens
tggtccgctttcctggagc

SEQ ID NO: 6495557 - DNA, 16 bp, Homo sapiens
tggtccggacactcct

SEQ ID NO: 6495558 - DNA, 13 bp, Homo sapiens
tggtccgtgccca

SEQ ID NO: 6495559 - DNA, 16 bp, Homo sapiens
tggtcctaaaagcaaa

SEQ ID NO: 6495560 - DNA, 22 bp, Homo sapiens
tggtcctaaaagcaaaataaaa

SEQ ID NO: 6495561 - DNA, 19 bp, Homo sapiens
tggtcctaagtccctgccc

SEQ ID NO: 6495562 - DNA, 20 bp, Homo sapiens
tggtcctaagtccctgcccc

SEQ ID NO: 6495563 - DNA, 21 bp, Homo sapiens
tggtcctaagtccctgccccc

SEQ ID NO: 6495564 - DNA, 12 bp, Homo sapiens
tggtcctagaca

SEQ ID NO: 6495565 - DNA, 22 bp, Homo sapiens
tggtcctatttttgtgaagagg

SEQ ID NO: 6495566 - DNA, 14 bp, Homo sapiens
tggtcctcacactc

SEQ ID NO: 6495567 - DNA, 19 bp, Homo sapiens
tggtcctccactttgctgg

SEQ ID NO: 6495568 - DNA, 23 bp, Homo sapiens
tggtcctccatttcaactccaga

SEQ ID NO: 6495569 - DNA, 22 bp, Homo sapiens
tggtcctccgcctactgtccct

SEQ ID NO: 6495570 - DNA, 14 bp, Homo sapiens
tggtcctctctctg

SEQ ID NO: 6495571 - DNA, 15 bp, Homo sapiens
tggtcctcttgcctc

SEQ ID NO: 6495572 - DNA, 20 bp, Homo sapiens
tggtcctcttgcctcctgga

SEQ ID NO: 6495573 - DNA, 12 bp, Homo sapiens
tggtcctgcact

SEQ ID NO: 6495574 - DNA, 17 bp, Homo sapiens
tggtcctgcctaaattt

SEQ ID NO: 6495575 - DNA, 19 bp, Homo sapiens
tggtcctgcctaaatttca

SEQ ID NO: 6495576 - DNA, 23 bp, Homo sapiens
tggtcctgctgcagttgccagtc

SEQ ID NO: 6495577 - DNA, 10 bp, Homo sapiens
tggtcctgga

SEQ ID NO: 6495578 - DNA, 22 bp, Homo sapiens
tggtcctggacacctcccaggg

SEQ ID NO: 6495579 - DNA, 15 bp, Homo sapiens
tggtcctggcagggc

SEQ ID NO: 6495580 - DNA, 12 bp, Homo sapiens
tggtcctggctg

SEQ ID NO: 6495581 - DNA, 13 bp, Homo sapiens
tggtcctgggagc

SEQ ID NO: 6495582 - DNA, 13 bp, Homo sapiens
tggtcctgtcacc

SEQ ID NO: 6495583 - DNA, 16 bp, Homo sapiens
tggtcctgtcaccctg

SEQ ID NO: 6495584 - DNA, 22 bp, Homo sapiens
tgagttgttaccccaagcgccc

SEQ ID NO: 6495585 - DNA, 20 bp, Homo sapiens
tgagttgttcctagaggaga

SEQ ID NO: 6495586 - DNA, 18 bp, Homo sapiens
tgagttgttgccctgggt

SEQ ID NO: 6495587 - DNA, 24 bp, Homo sapiens
tgagttgttttggtgcctgcctct

SEQ ID NO: 6495588 - DNA, 14 bp, Homo sapiens
tgagttgtttttgt

SEQ ID NO: 6495589 - DNA, 16 bp, Homo sapiens
tgagttgtttttgtat

SEQ ID NO: 6495590 - DNA, 18 bp, Homo sapiens
tgagttgtttttgtatat

SEQ ID NO: 6495591 - DNA, 19 bp, Homo sapiens
tgagtttaaaaaaataaca

SEQ ID NO: 6495592 - DNA, 16 bp, Homo sapiens
tgagtttaaaaatcaa

SEQ ID NO: 6495593 - DNA, 19 bp, Homo sapiens
tgagtttaccatttgtaat

SEQ ID NO: 6495594 - DNA, 16 bp, Homo sapiens
tgagtttaccttgtat

SEQ ID NO: 6495595 - DNA, 14 bp, Homo sapiens
tgagtttagttttt

SEQ ID NO: 6495596 - DNA, 16 bp, Homo sapiens
tgagtttattctgatt

SEQ ID NO: 6495597 - DNA, 22 bp, Homo sapiens
tgagtttcagaaattctcaaaa

SEQ ID NO: 6495598 - DNA, 17 bp, Homo sapiens
tgagtttcagctggaaa

SEQ ID NO: 6495599 - DNA, 18 bp, Homo sapiens
tgagtttcagctggaaac

SEQ ID NO: 6495600 - DNA, 15 bp, Homo sapiens
tgagtttcatagcta

SEQ ID NO: 6495601 - DNA, 16 bp, Homo sapiens
tgagtttcatttttca

SEQ ID NO: 6495602 - DNA, 16 bp, Homo sapiens
tgagtttcctcaggct

SEQ ID NO: 6495603 - DNA, 23 bp, Homo sapiens
tgagtttctggctgaaaatggtg

SEQ ID NO: 6495604 - DNA, 13 bp, Homo sapiens
tgagtttcttaga

SEQ ID NO: 6495605 - DNA, 13 bp, Homo sapiens
tgagtttcttcta

SEQ ID NO: 6495606 - DNA, 16 bp, Homo sapiens
tgagtttctttcagat

SEQ ID NO: 6495607 - DNA, 17 bp, Homo sapiens
tgagtttctttcagatc

SEQ ID NO: 6495608 - DNA, 16 bp, Homo sapiens
tgagtttgagctgcct

SEQ ID NO: 6495609 - DNA, 17 bp, Homo sapiens
tgagtttgagctgcctt

SEQ ID NO: 6495610 - DNA, 18 bp, Homo sapiens
tgagtttgagctgccttc

SEQ ID NO: 6495611 - DNA, 13 bp, Homo sapiens
tgagtttgcctca

SEQ ID NO: 6495612 - DNA, 22 bp, Homo sapiens
tgagtttgcttatgtaatctca

SEQ ID NO: 6495613 - DNA, 16 bp, Homo sapiens
tgagtttgtaggtaaa

SEQ ID NO: 6495614 - DNA, 19 bp, Homo sapiens
tgagtttgtcgctcatgtg

SEQ ID NO: 6495615 - DNA, 22 bp, Homo sapiens
tgagtttgtggtaaccagccct

SEQ ID NO: 6495616 - DNA, 23 bp, Homo sapiens
tgagtttgtggtaaccagccctg

SEQ ID NO: 6495617 - DNA, 14 bp, Homo sapiens
tgagtttgtttctt

SEQ ID NO: 6495618 - DNA, 15 bp, Homo sapiens
tgagtttgtttcttg

SEQ ID NO: 6495619 - DNA, 16 bp, Homo sapiens
tgagttttaaagaagt

SEQ ID NO: 6495620 - DNA, 20 bp, Homo sapiens
tgagttttaaattatgtata

SEQ ID NO: 6495621 - DNA, 15 bp, Homo sapiens
tgagttttacaaatt

SEQ ID NO: 6495622 - DNA, 15 bp, Homo sapiens
tgagttttacattac

SEQ ID NO: 6495623 - DNA, 23 bp, Homo sapiens
tgagttttcacctcgaattttgt

SEQ ID NO: 6495624 - DNA, 15 bp, Homo sapiens
tgagttttcatttca

SEQ ID NO: 6495625 - DNA, 22 bp, Homo sapiens
tgagttttcatttcatatatct

SEQ ID NO: 6495626 - DNA, 18 bp, Homo sapiens
tgagttttctatttcact

SEQ ID NO: 6495627 - DNA, 13 bp, Homo sapiens
tgagttttgataa

SEQ ID NO: 6495628 - DNA, 21 bp, Homo sapiens
tgagtttttattttgtctctg

SEQ ID NO: 6495629 - DNA, 18 bp, Homo sapiens
tgagtttttcattatttg

SEQ ID NO: 6495630 - DNA, 19 bp, Homo sapiens
tgagtttttcctcccagtg

SEQ ID NO: 6495631 - DNA, 18 bp, Homo sapiens
tgagttttttctcttggg

SEQ ID NO: 6495632 - DNA, 19 bp, Homo sapiens
tgataaaaaattttgtaat

SEQ ID NO: 6495633 - DNA, 13 bp, Homo sapiens
tgataaaaactca

SEQ ID NO: 6495634 - DNA, 16 bp, Homo sapiens
tgataaaagatacatt

SEQ ID NO: 6495635 - DNA, 21 bp, Homo sapiens
tgataaaagcattgtttgtga

SEQ ID NO: 6495636 - DNA, 15 bp, Homo sapiens
tgataaaaggagaat

SEQ ID NO: 6495637 - DNA, 20 bp, Homo sapiens
tgataaaagttttgatattt

SEQ ID NO: 6495638 - DNA, 11 bp, Homo sapiens
tgataaaataa

SEQ ID NO: 6495639 - DNA, 13 bp, Homo sapiens
tgataaaataagt

SEQ ID NO: 6495640 - DNA, 15 bp, Homo sapiens
tgataaaataagtaa

SEQ ID NO: 6495641 - DNA, 21 bp, Homo sapiens
tgataaaatcccattgtattt

SEQ ID NO: 6495642 - DNA, 16 bp, Homo sapiens
tgataaaatgctttaa

SEQ ID NO: 6495643 - DNA, 17 bp, Homo sapiens
tgataaaatgtaaattt

SEQ ID NO: 6495644 - DNA, 15 bp, Homo sapiens
tgataaaatgttcct

SEQ ID NO: 6495645 - DNA, 16 bp, Homo sapiens
tgataaaatgttgaac

SEQ ID NO: 6495646 - DNA, 21 bp, Homo sapiens
tgataaaattgtgatgttttg

SEQ ID NO: 6495647 - DNA, 18 bp, Homo sapiens
tgataaacagttgaataa

SEQ ID NO: 6495648 - DNA, 23 bp, Homo sapiens
tgataaacagttgaataatttgt

SEQ ID NO: 6495649 - DNA, 22 bp, Homo sapiens
tgataaacattaaacactgtaa

SEQ ID NO: 6495650 - DNA, 14 bp, Homo sapiens
tgataaacctaata

SEQ ID NO: 6495651 - DNA, 16 bp, Homo sapiens
tgataaacctaatatt

SEQ ID NO: 6495652 - DNA, 17 bp, Homo sapiens
tgataaactcagatctg

SEQ ID NO: 6495653 - DNA, 15 bp, Homo sapiens
tgataaactgaattt

SEQ ID NO: 6495654 - DNA, 14 bp, Homo sapiens
tgataaactgacga

SEQ ID NO: 6495655 - DNA, 14 bp, Homo sapiens
tgataaactttgct

SEQ ID NO: 6495656 - DNA, 11 bp, Homo sapiens
tgataaagact

SEQ ID NO: 6495657 - DNA, 16 bp, Homo sapiens
tgataaagacttttat

SEQ ID NO: 6495658 - DNA, 15 bp, Homo sapiens
tgataaagagacagt

SEQ ID NO: 6495659 - DNA, 20 bp, Homo sapiens
tgataaagcctcaaggtttt

SEQ ID NO: 6495660 - DNA, 13 bp, Homo sapiens
tgataaaggaaat

SEQ ID NO: 6495661 - DNA, 16 bp, Homo sapiens
tgataaagtaaaaaag

SEQ ID NO: 6495662 - DNA, 19 bp, Homo sapiens
tgataaagtagtaaaaatt

SEQ ID NO: 6495663 - DNA, 16 bp, Homo sapiens
tgataaagtggaattg

SEQ ID NO: 6495664 - DNA, 15 bp, Homo sapiens
tgataaagttcctta

SEQ ID NO: 6495665 - DNA, 14 bp, Homo sapiens
tgataaagttgaga

SEQ ID NO: 6495666 - DNA, 17 bp, Homo sapiens
tgataaatagtgttatt

SEQ ID NO: 6495667 - DNA, 13 bp, Homo sapiens
tgataaatatata

SEQ ID NO: 6495668 - DNA, 17 bp, Homo sapiens
tgataaatatatggaca

SEQ ID NO: 6495669 - DNA, 21 bp, Homo sapiens
tgataaatattcacacttgaa

SEQ ID NO: 6495670 - DNA, 13 bp, Homo sapiens
tgataaatattta

SEQ ID NO: 6495671 - DNA, 15 bp, Homo sapiens
tgataaatcagactc

SEQ ID NO: 6495672 - DNA, 16 bp, Homo sapiens
tgataaatcagactct

SEQ ID NO: 6495673 - DNA, 15 bp, Homo sapiens
tgataaatcatttta

SEQ ID NO: 6495674 - DNA, 23 bp, Homo sapiens
tgataaatggaactattccatca

SEQ ID NO: 6495675 - DNA, 23 bp, Homo sapiens
tgataacaaccttttacattgtg

SEQ ID NO: 6495676 - DNA, 20 bp, Homo sapiens
tgataacaatgttttaacaa

SEQ ID NO: 6495677 - DNA, 18 bp, Homo sapiens
tgataacacttaaaattg

SEQ ID NO: 6495678 - DNA, 20 bp, Homo sapiens
tgataacagggattgatttt

SEQ ID NO: 6495679 - DNA, 22 bp, Homo sapiens
tgataacagggattgattttaa

SEQ ID NO: 6495680 - DNA, 14 bp, Homo sapiens
tgataacatggaaa

SEQ ID NO: 6495681 - DNA, 16 bp, Homo sapiens
tgataacatggaaatg

SEQ ID NO: 6495682 - DNA, 20 bp, Homo sapiens
tgataaccatagcattaata

SEQ ID NO: 6495683 - DNA, 18 bp, Homo sapiens
tgataactagatggtgct

SEQ ID NO: 6495684 - DNA, 21 bp, Homo sapiens
tgataactagatggtgctgag

SEQ ID NO: 6495685 - DNA, 17 bp, Homo sapiens
tgataactatttacata

SEQ ID NO: 6495686 - DNA, 11 bp, Homo sapiens
tgataactcac

SEQ ID NO: 6495687 - DNA, 22 bp, Homo sapiens
tgataactgtttatatgtgttg

SEQ ID NO: 6495688 - DNA, 15 bp, Homo sapiens
tgataacttggggag

SEQ ID NO: 6495689 - DNA, 13 bp, Homo sapiens
tgataacttgttt

SEQ ID NO: 6495690 - DNA, 14 bp, Homo sapiens
tgataactttgctt

SEQ ID NO: 6495691 - DNA, 14 bp, Homo sapiens
tgataagaacagag

SEQ ID NO: 6495692 - DNA, 20 bp, Homo sapiens
tgataagaaccttttgagtg

SEQ ID NO: 6495693 - DNA, 16 bp, Homo sapiens
tgataagaattcttaa

SEQ ID NO: 6495694 - DNA, 13 bp, Homo sapiens
tgataagacatga

SEQ ID NO: 6495695 - DNA, 17 bp, Homo sapiens
tgataagacattttgtt

SEQ ID NO: 6495696 - DNA, 20 bp, Homo sapiens
tgataagactgtttttaagt

SEQ ID NO: 6495697 - DNA, 18 bp, Homo sapiens
tgataagagaatcaacat

SEQ ID NO: 6495698 - DNA, 18 bp, Homo sapiens
tgataagatgaggaaata

SEQ ID NO: 6495699 - DNA, 13 bp, Homo sapiens
tgataagatggtt

SEQ ID NO: 6495700 - DNA, 16 bp, Homo sapiens
tgataaggatcagaac

SEQ ID NO: 6495701 - DNA, 19 bp, Homo sapiens
tgataaggcctactataca

SEQ ID NO: 6495702 - DNA, 20 bp, Homo sapiens
tgataaggcctactatacat

SEQ ID NO: 6495703 - DNA, 21 bp, Homo sapiens
tgataaggcctactatacatt

SEQ ID NO: 6495704 - DNA, 22 bp, Homo sapiens
tgataaggcctactatacatta

SEQ ID NO: 6495705 - DNA, 16 bp, Homo sapiens
tgataagggaaaagat

SEQ ID NO: 6495706 - DNA, 18 bp, Homo sapiens
tgataagggaaaagataa

SEQ ID NO: 6495707 - DNA, 13 bp, Homo sapiens
tgataaggggcct

SEQ ID NO: 6495708 - DNA, 21 bp, Homo sapiens
tgataaggggccttgctctga

SEQ ID NO: 6495709 - DNA, 12 bp, Homo sapiens
tgataagtaaat

SEQ ID NO: 6495710 - DNA, 18 bp, Homo sapiens
tgataagtaatgaaagtg

SEQ ID NO: 6495711 - DNA, 14 bp, Homo sapiens
tgataagtggaaaa

SEQ ID NO: 6495712 - DNA, 20 bp, Homo sapiens
tgataagtggaaaaaagaga

SEQ ID NO: 6495713 - DNA, 14 bp, Homo sapiens
tgataataaaattc

SEQ ID NO: 6495714 - DNA, 12 bp, Homo sapiens
tgataataaagg

SEQ ID NO: 6495715 - DNA, 23 bp, Homo sapiens
tgataataaattgaaattgtgaa

SEQ ID NO: 6495716 - DNA, 12 bp, Homo sapiens
tgataataataa

SEQ ID NO: 6495717 - DNA, 16 bp, Homo sapiens
tgataataatattgtt

SEQ ID NO: 6495718 - DNA, 18 bp, Homo sapiens
tgataataatattgtttt

SEQ ID NO: 6495719 - DNA, 21 bp, Homo sapiens
tgataatacagatttgtaaca

SEQ ID NO: 6495720 - DNA, 14 bp, Homo sapiens
tgataatacttgac

SEQ ID NO: 6495721 - DNA, 15 bp, Homo sapiens
tgataatagaagagt

SEQ ID NO: 6495722 - DNA, 18 bp, Homo sapiens
tgataatagcatttttgt

SEQ ID NO: 6495723 - DNA, 20 bp, Homo sapiens
tgataataggggattttaaa

SEQ ID NO: 6495724 - DNA, 21 bp, Homo sapiens
tgataataggtgggggaaaat

SEQ ID NO: 6495725 - DNA, 18 bp, Homo sapiens
tgataatatattgctaaa

SEQ ID NO: 6495726 - DNA, 21 bp, Homo sapiens
tgataatatattgtgttgact

SEQ ID NO: 6495727 - DNA, 22 bp, Homo sapiens
tgataatattagtgattctgat

SEQ ID NO: 6495728 - DNA, 24 bp, Homo sapiens
tgataatcaactgggctgaacact

SEQ ID NO: 6495729 - DNA, 13 bp, Homo sapiens
tgataatcagttt

SEQ ID NO: 6495730 - DNA, 20 bp, Homo sapiens
tgataatcattttgagtttg

SEQ ID NO: 6495731 - DNA, 23 bp, Homo sapiens
tgataatctgggcatctcgtgcc

SEQ ID NO: 6495732 - DNA, 15 bp, Homo sapiens
tgataatgaacagaa

SEQ ID NO: 6495733 - DNA, 16 bp, Homo sapiens
tgataatgaacagaac

SEQ ID NO: 6495734 - DNA, 18 bp, Homo sapiens
tgataatgaacagaacat

SEQ ID NO: 6495735 - DNA, 13 bp, Homo sapiens
tgataatgacact

SEQ ID NO: 6495736 - DNA, 15 bp, Homo sapiens
tgataatgacactgt

SEQ ID NO: 6495737 - DNA, 23 bp, Homo sapiens
tgataatgacactgtttcctgat

SEQ ID NO: 6495738 - DNA, 13 bp, Homo sapiens
tgataatgcagat

SEQ ID NO: 6495739 - DNA, 20 bp, Homo sapiens
tgataatgccccaaggacaa

SEQ ID NO: 6495740 - DNA, 18 bp, Homo sapiens
tgataatgttaaatttgt

SEQ ID NO: 6495741 - DNA, 21 bp, Homo sapiens
tgataatgttaaatttgtaag

SEQ ID NO: 6495742 - DNA, 21 bp, Homo sapiens
tgataatgttgtggtttgttg

SEQ ID NO: 6495743 - DNA, 15 bp, Homo sapiens
tgataattctcagta

SEQ ID NO: 6495744 - DNA, 14 bp, Homo sapiens
tgataattgcattc

SEQ ID NO: 6495745 - DNA, 14 bp, Homo sapiens
tgataattgtgtat

SEQ ID NO: 6495746 - DNA, 14 bp, Homo sapiens
tgataatttattgt

SEQ ID NO: 6495747 - DNA, 12 bp, Homo sapiens
tgataatttcag

SEQ ID NO: 6495748 - DNA, 14 bp, Homo sapiens
tgataattttcctt

SEQ ID NO: 6495749 - DNA, 17 bp, Homo sapiens
tgataattttcctttaa

SEQ ID NO: 6495750 - DNA, 17 bp, Homo sapiens
tgataattttgaaatga

SEQ ID NO: 6495751 - DNA, 15 bp, Homo sapiens
tgatacaaactttgt

SEQ ID NO: 6495752 - DNA, 21 bp, Homo sapiens
tgatacaaatgggaattcact

SEQ ID NO: 6495753 - DNA, 15 bp, Homo sapiens
tgatacaaatgttta

SEQ ID NO: 6495754 - DNA, 22 bp, Homo sapiens
tgatacaacaggattttcaagt

SEQ ID NO: 6495755 - DNA, 17 bp, Homo sapiens
tgatacaagattagaag

SEQ ID NO: 6495756 - DNA, 19 bp, Homo sapiens
tgatacacagtaattgtga

SEQ ID NO: 6495757 - DNA, 18 bp, Homo sapiens
tgatacaccattatgttt

SEQ ID NO: 6495758 - DNA, 20 bp, Homo sapiens
tgatacactgaatggaaata

SEQ ID NO: 6495759 - DNA, 18 bp, Homo sapiens
tgatacactgtatctaaa

SEQ ID NO: 6495760 - DNA, 19 bp, Homo sapiens
tgatacactgtatctaaaa

SEQ ID NO: 6495761 - DNA, 15 bp, Homo sapiens
tgatacagagtatat

SEQ ID NO: 6495762 - DNA, 17 bp, Homo sapiens
tgatacagagtatattt

SEQ ID NO: 6495763 - DNA, 19 bp, Homo sapiens
tggtcctgtcaccctggcc

SEQ ID NO: 6495764 - DNA, 16 bp, Homo sapiens
tggtcctgtctgtcct

SEQ ID NO: 6495765 - DNA, 12 bp, Homo sapiens
tggtcctgtgcc

SEQ ID NO: 6495766 - DNA, 13 bp, Homo sapiens
tggtcctgtgccc

SEQ ID NO: 6495767 - DNA, 16 bp, Homo sapiens
tggtcctgttaaccct

SEQ ID NO: 6495768 - DNA, 21 bp, Homo sapiens
tggtcctgttaaccctccacc

SEQ ID NO: 6495769 - DNA, 15 bp, Homo sapiens
tggtcctgttatgtc

SEQ ID NO: 6495770 - DNA, 13 bp, Homo sapiens
tggtcctgttttc

SEQ ID NO: 6495771 - DNA, 16 bp, Homo sapiens
tggtccttatttattt

SEQ ID NO: 6495772 - DNA, 20 bp, Homo sapiens
tggtccttcactggcgcctt

SEQ ID NO: 6495773 - DNA, 23 bp, Homo sapiens
tggtccttccaggcccccaccac

SEQ ID NO: 6495774 - DNA, 18 bp, Homo sapiens
tggtccttccctgatggc

SEQ ID NO: 6495775 - DNA, 21 bp, Homo sapiens
tggtccttccctgatggcctt

SEQ ID NO: 6495776 - DNA, 15 bp, Homo sapiens
tggtccttctgaccc

SEQ ID NO: 6495777 - DNA, 16 bp, Homo sapiens
tggtccttctttcctc

SEQ ID NO: 6495778 - DNA, 19 bp, Homo sapiens
tggtccttctttcctctta

SEQ ID NO: 6495779 - DNA, 20 bp, Homo sapiens
tggtcgaaagttagtaggat

SEQ ID NO: 6495780 - DNA, 17 bp, Homo sapiens
tggtcgaggagtaacaa

SEQ ID NO: 6495781 - DNA, 20 bp, Homo sapiens
tggtcgaggagtaacaatac

SEQ ID NO: 6495782 - DNA, 14 bp, Homo sapiens
tggtcgagtgacac

SEQ ID NO: 6495783 - DNA, 13 bp, Homo sapiens
tggtcgcccagga

SEQ ID NO: 6495784 - DNA, 15 bp, Homo sapiens
tggtcgctcctgccc

SEQ ID NO: 6495785 - DNA, 13 bp, Homo sapiens
tggtcggagaggg

SEQ ID NO: 6495786 - DNA, 14 bp, Homo sapiens
tggtcggagaggga

SEQ ID NO: 6495787 - DNA, 16 bp, Homo sapiens
tggtcggcaagagtga

SEQ ID NO: 6495788 - DNA, 22 bp, Homo sapiens
tggtcggggagctggggtacag

SEQ ID NO: 6495789 - DNA, 22 bp, Homo sapiens
tggtcgtcatgctgtccgtgct

SEQ ID NO: 6495790 - DNA, 17 bp, Homo sapiens
tggtcgtgaactcctga

SEQ ID NO: 6495791 - DNA, 13 bp, Homo sapiens
tggtcgttttttt

SEQ ID NO: 6495792 - DNA, 16 bp, Homo sapiens
tggtctaaagtgttta

SEQ ID NO: 6495793 - DNA, 17 bp, Homo sapiens
tggtctaaagtgtttag

SEQ ID NO: 6495794 - DNA, 18 bp, Homo sapiens
tggtctaagtccagtcca

SEQ ID NO: 6495795 - DNA, 21 bp, Homo sapiens
tggtctaatcctagtttgctg

SEQ ID NO: 6495796 - DNA, 20 bp, Homo sapiens
tggtctaatgattcaaatgt

SEQ ID NO: 6495797 - DNA, 19 bp, Homo sapiens
tggtctaatgtttaagcag

SEQ ID NO: 6495798 - DNA, 21 bp, Homo sapiens
tggtctaatgtttaagcagaa

SEQ ID NO: 6495799 - DNA, 15 bp, Homo sapiens
tggtctaatgtttgt

SEQ ID NO: 6495800 - DNA, 19 bp, Homo sapiens
tggtctaattcaactctgt

SEQ ID NO: 6495801 - DNA, 17 bp, Homo sapiens
tggtctacactgtgctg

SEQ ID NO: 6495802 - DNA, 21 bp, Homo sapiens
tggtctagaatggatttttcc

SEQ ID NO: 6495803 - DNA, 18 bp, Homo sapiens
tggtctagaccagggctg

SEQ ID NO: 6495804 - DNA, 15 bp, Homo sapiens
tggtctaggagctgt

SEQ ID NO: 6495805 - DNA, 23 bp, Homo sapiens
tggtctagtagcggatctcactc

SEQ ID NO: 6495806 - DNA, 18 bp, Homo sapiens
tggtctataaaataaact

SEQ ID NO: 6495807 - DNA, 19 bp, Homo sapiens
tggtctataaaataaactt

SEQ ID NO: 6495808 - DNA, 19 bp, Homo sapiens
tggtctatctttgagcgcc

SEQ ID NO: 6495809 - DNA, 12 bp, Homo sapiens
tggtctattttc

SEQ ID NO: 6495810 - DNA, 17 bp, Homo sapiens
tggtctattttgatttt

SEQ ID NO: 6495811 - DNA, 16 bp, Homo sapiens
tggtctcaaactcctg

SEQ ID NO: 6495812 - DNA, 16 bp, Homo sapiens
tggtctcaaactcttg

SEQ ID NO: 6495813 - DNA, 15 bp, Homo sapiens
tggtctcaccctgga

SEQ ID NO: 6495814 - DNA, 23 bp, Homo sapiens
tggtctcaccctggaggcacctg

SEQ ID NO: 6495815 - DNA, 13 bp, Homo sapiens
tggtctcaggata

SEQ ID NO: 6495816 - DNA, 17 bp, Homo sapiens
tggtctcaggcagcacc

SEQ ID NO: 6495817 - DNA, 14 bp, Homo sapiens
tggtctcagtgtta

SEQ ID NO: 6495818 - DNA, 21 bp, Homo sapiens
tggtctcatctcctttgctag

SEQ ID NO: 6495819 - DNA, 19 bp, Homo sapiens
tggtctccacctgtgcttg

SEQ ID NO: 6495820 - DNA, 14 bp, Homo sapiens
tggtctccactggg

SEQ ID NO: 6495821 - DNA, 23 bp, Homo sapiens
tggtctcccatatgcagaaatag

SEQ ID NO: 6495822 - DNA, 22 bp, Homo sapiens
tggtctccccaattctcccctc

SEQ ID NO: 6495823 - DNA, 15 bp, Homo sapiens
tggtctcccccagcc

SEQ ID NO: 6495824 - DNA, 14 bp, Homo sapiens
tggtctccctccag

SEQ ID NO: 6495825 - DNA, 19 bp, Homo sapiens
tggtctccctccagctgga

SEQ ID NO: 6495826 - DNA, 11 bp, Homo sapiens
tggtctcctct

SEQ ID NO: 6495827 - DNA, 12 bp, Homo sapiens
tggtctcctctc

SEQ ID NO: 6495828 - DNA, 16 bp, Homo sapiens
tggtctcctctcagct

SEQ ID NO: 6495829 - DNA, 21 bp, Homo sapiens
tggtctccttgcactttctca

SEQ ID NO: 6495830 - DNA, 17 bp, Homo sapiens
tggtctccttgggccct

SEQ ID NO: 6495831 - DNA, 21 bp, Homo sapiens
tggtctcgaactcctgacctt

SEQ ID NO: 6495832 - DNA, 19 bp, Homo sapiens
tggtctcgatatcctgatc

SEQ ID NO: 6495833 - DNA, 17 bp, Homo sapiens
tggtctcgatgctgctg

SEQ ID NO: 6495834 - DNA, 16 bp, Homo sapiens
tggtctcgtgttcgct

SEQ ID NO: 6495835 - DNA, 17 bp, Homo sapiens
tggtctcgtgttcgctg

SEQ ID NO: 6495836 - DNA, 19 bp, Homo sapiens
tggtctcgtgttcgctggc

SEQ ID NO: 6495837 - DNA, 21 bp, Homo sapiens
tggtctcgtgttcgctggctg

SEQ ID NO: 6495838 - DNA, 13 bp, Homo sapiens
tggtctctaggcc

SEQ ID NO: 6495839 - DNA, 17 bp, Homo sapiens
tggtctctaggctgggg

SEQ ID NO: 6495840 - DNA, 21 bp, Homo sapiens
tggtctctcgggccccccaca

SEQ ID NO: 6495841 - DNA, 17 bp, Homo sapiens
tggtctctctccctctg

SEQ ID NO: 6495842 - DNA, 22 bp, Homo sapiens
tggtctctctccctctgtcttt

SEQ ID NO: 6495843 - DNA, 17 bp, Homo sapiens
tggtctctgccccagcc

SEQ ID NO: 6495844 - DNA, 18 bp, Homo sapiens
tggtctctgccccagcct

SEQ ID NO: 6495845 - DNA, 20 bp, Homo sapiens
tggtctctgccccagcctgt

SEQ ID NO: 6495846 - DNA, 14 bp, Homo sapiens
tggtctctgtgcca

SEQ ID NO: 6495847 - DNA, 18 bp, Homo sapiens
tggtctcttcctgtctgg

SEQ ID NO: 6495848 - DNA, 15 bp, Homo sapiens
tggtctctttctttc

SEQ ID NO: 6495849 - DNA, 16 bp, Homo sapiens
tggtctctttctttcc

SEQ ID NO: 6495850 - DNA, 21 bp, Homo sapiens
tggtctgaactagttgagaga

SEQ ID NO: 6495851 - DNA, 14 bp, Homo sapiens
tggtctgaactgct

SEQ ID NO: 6495852 - DNA, 14 bp, Homo sapiens
tggtctgaatgttc

SEQ ID NO: 6495853 - DNA, 17 bp, Homo sapiens
tggtctgacccactgct

SEQ ID NO: 6495854 - DNA, 18 bp, Homo sapiens
tggtctgagcaccccctc

SEQ ID NO: 6495855 - DNA, 18 bp, Homo sapiens
tggtctgagctgtcccaa

SEQ ID NO: 6495856 - DNA, 17 bp, Homo sapiens
tggtctgaggatgtaga

SEQ ID NO: 6495857 - DNA, 15 bp, Homo sapiens
tggtctgagtggggc

SEQ ID NO: 6495858 - DNA, 20 bp, Homo sapiens
tggtctgagtggggcttcct

SEQ ID NO: 6495859 - DNA, 21 bp, Homo sapiens
tggtctgagtggggcttcctg

SEQ ID NO: 6495860 - DNA, 22 bp, Homo sapiens
tggtctgagtggggcttcctgg

SEQ ID NO: 6495861 - DNA, 14 bp, Homo sapiens
tggtctgattttga

SEQ ID NO: 6495862 - DNA, 11 bp, Homo sapiens
tggtctgcacc

SEQ ID NO: 6495863 - DNA, 19 bp, Homo sapiens
tggtctgcaccccacagga

SEQ ID NO: 6495864 - DNA, 15 bp, Homo sapiens
tggtctgcaggcagg

SEQ ID NO: 6495865 - DNA, 20 bp, Homo sapiens
tggtctgccaatctgtacaa

SEQ ID NO: 6495866 - DNA, 14 bp, Homo sapiens
tggtctgccagaat

SEQ ID NO: 6495867 - DNA, 18 bp, Homo sapiens
tggtctgccaggccccca

SEQ ID NO: 6495868 - DNA, 12 bp, Homo sapiens
tggtctgccctg

SEQ ID NO: 6495869 - DNA, 19 bp, Homo sapiens
tggtctgcctctgagccac

SEQ ID NO: 6495870 - DNA, 15 bp, Homo sapiens
tggtctgccttctgc

SEQ ID NO: 6495871 - DNA, 17 bp, Homo sapiens
tggtctgccttctgctg

SEQ ID NO: 6495872 - DNA, 19 bp, Homo sapiens
tggtctgctcgggcccagg

SEQ ID NO: 6495873 - DNA, 16 bp, Homo sapiens
tggtctggaaacagct

SEQ ID NO: 6495874 - DNA, 20 bp, Homo sapiens
tggtctggagcccctatcct

SEQ ID NO: 6495875 - DNA, 18 bp, Homo sapiens
tggtctggctctgctgga

SEQ ID NO: 6495876 - DNA, 13 bp, Homo sapiens
tggtctggggaga

SEQ ID NO: 6495877 - DNA, 21 bp, Homo sapiens
tggtctgggtggatgtgagca

SEQ ID NO: 6495878 - DNA, 14 bp, Homo sapiens
tggtctggtcaggc

SEQ ID NO: 6495879 - DNA, 14 bp, Homo sapiens
tggtctggtgccac

SEQ ID NO: 6495880 - DNA, 15 bp, Homo sapiens
tggtctggtgttcca

SEQ ID NO: 6495881 - DNA, 19 bp, Homo sapiens
tggtctgtagcaagctgag

SEQ ID NO: 6495882 - DNA, 20 bp, Homo sapiens
tggtctgtgctgccctgctc

SEQ ID NO: 6495883 - DNA, 20 bp, Homo sapiens
tggtctgtggatcagcattt

SEQ ID NO: 6495884 - DNA, 15 bp, Homo sapiens
tggtctgtgtgtgac

SEQ ID NO: 6495885 - DNA, 16 bp, Homo sapiens
tggtctgtgtgtgaca

SEQ ID NO: 6495886 - DNA, 23 bp, Homo sapiens
tggtctgtgtgtgtgtgtgtgcg

SEQ ID NO: 6495887 - DNA, 19 bp, Homo sapiens
tggtctgtgtgtgttcttc

SEQ ID NO: 6495888 - DNA, 20 bp, Homo sapiens
tggtctgttttggtcccctc

SEQ ID NO: 6495889 - DNA, 15 bp, Homo sapiens
tggtcttacagcagg

SEQ ID NO: 6495890 - DNA, 23 bp, Homo sapiens
tggtcttacatctgtgtggtata

SEQ ID NO: 6495891 - DNA, 16 bp, Homo sapiens
tggtcttactttgtta

SEQ ID NO: 6495892 - DNA, 17 bp, Homo sapiens
tggtcttaggtcttcct

SEQ ID NO: 6495893 - DNA, 21 bp, Homo sapiens
tggtcttaggtcttcctgtgg

SEQ ID NO: 6495894 - DNA, 23 bp, Homo sapiens
tggtcttaggtcttcctgtggct

SEQ ID NO: 6495895 - DNA, 23 bp, Homo sapiens
tggtcttatagtgtttggacagc

SEQ ID NO: 6495896 - DNA, 16 bp, Homo sapiens
tggtcttatttgtaaa

SEQ ID NO: 6495897 - DNA, 19 bp, Homo sapiens
tggtcttcaaattgtcttt

SEQ ID NO: 6495898 - DNA, 16 bp, Homo sapiens
tggtcttcaagcctgg

SEQ ID NO: 6495899 - DNA, 17 bp, Homo sapiens
tggtcttcaagcctggc

SEQ ID NO: 6495900 - DNA, 19 bp, Homo sapiens
tggtcttcaagcctggccc

SEQ ID NO: 6495901 - DNA, 13 bp, Homo sapiens
tggtcttcactgc

SEQ ID NO: 6495902 - DNA, 15 bp, Homo sapiens
tggtcttcactgcca

SEQ ID NO: 6495903 - DNA, 17 bp, Homo sapiens
tggtcttcagcctccct

SEQ ID NO: 6495904 - DNA, 22 bp, Homo sapiens
tggtcttccttctaccccaagg

SEQ ID NO: 6495905 - DNA, 17 bp, Homo sapiens
tggtcttctactgcctt

SEQ ID NO: 6495906 - DNA, 18 bp, Homo sapiens
tggtcttctactgccttg

SEQ ID NO: 6495907 - DNA, 21 bp, Homo sapiens
tggtcttctactgccttgaaa

SEQ ID NO: 6495908 - DNA, 23 bp, Homo sapiens
tggtcttctcgacaggtgccctt

SEQ ID NO: 6495909 - DNA, 14 bp, Homo sapiens
tggtcttctctaca

SEQ ID NO: 6495910 - DNA, 18 bp, Homo sapiens
tggtcttgaactcctggg

SEQ ID NO: 6495911 - DNA, 22 bp, Homo sapiens
tggtcttgaactcctgggctca

SEQ ID NO: 6495912 - DNA, 19 bp, Homo sapiens
tggtcttgaactcttggcc

SEQ ID NO: 6495913 - DNA, 22 bp, Homo sapiens
tggtcttgagccagtaatcttt

SEQ ID NO: 6495914 - DNA, 23 bp, Homo sapiens
tggtcttgagccagtaatcttta

SEQ ID NO: 6495915 - DNA, 17 bp, Homo sapiens
tggtcttgatctcctga

SEQ ID NO: 6495916 - DNA, 11 bp, Homo sapiens
tggtcttggag

SEQ ID NO: 6495917 - DNA, 16 bp, Homo sapiens
tggtcttggagaggag

SEQ ID NO: 6495918 - DNA, 17 bp, Homo sapiens
tggtcttggcagcacct

SEQ ID NO: 6495919 - DNA, 13 bp, Homo sapiens
tggtcttgtaaga

SEQ ID NO: 6495920 - DNA, 23 bp, Homo sapiens
tggtcttgtaagagctatacagt

SEQ ID NO: 6495921 - DNA, 19 bp, Homo sapiens
tggtcttgtggttgtgtgt

SEQ ID NO: 6495922 - DNA, 19 bp, Homo sapiens
tggtcttgtttaatatttg

SEQ ID NO: 6495923 - DNA, 14 bp, Homo sapiens
tggtctttaatgaa

SEQ ID NO: 6495924 - DNA, 22 bp, Homo sapiens
tggtctttcctatcatggagtg

SEQ ID NO: 6495925 - DNA, 15 bp, Homo sapiens
tggtctttctggaga

SEQ ID NO: 6495926 - DNA, 11 bp, Homo sapiens
tggtctttgaa

SEQ ID NO: 6495927 - DNA, 12 bp, Homo sapiens
tggtctttgaat

SEQ ID NO: 6495928 - DNA, 13 bp, Homo sapiens
tggtctttgaata

SEQ ID NO: 6495929 - DNA, 22 bp, Homo sapiens
tggtctttgaataaagtctgag

SEQ ID NO: 6495930 - DNA, 11 bp, Homo sapiens
tggtctttgct

SEQ ID NO: 6495931 - DNA, 15 bp, Homo sapiens
tggtctttgctccag

SEQ ID NO: 6495932 - DNA, 15 bp, Homo sapiens
tggtctttgctgctg

SEQ ID NO: 6495933 - DNA, 17 bp, Homo sapiens
tggtctttgctgctgct

SEQ ID NO: 6495934 - DNA, 18 bp, Homo sapiens
tggtctttgggataacct

SEQ ID NO: 6495935 - DNA, 19 bp, Homo sapiens
tggtctttgggcagggaat

SEQ ID NO: 6495936 - DNA, 15 bp, Homo sapiens
tggtctttgtaagag

SEQ ID NO: 6495937 - DNA, 18 bp, Homo sapiens
tggtctttgtctgcaggt

SEQ ID NO: 6495938 - DNA, 23 bp, Homo sapiens
tggtcttttcctccccattccta

SEQ ID NO: 6495939 - DNA, 20 bp, Homo sapiens
tggtcttttcctcgcttctt

SEQ ID NO: 6495940 - DNA, 18 bp, Homo sapiens
tggtcttttttctgggtc

SEQ ID NO: 6495941 - DNA, 24 bp, Homo sapiens
tggtgaaaccctgtctctactaaa

SEQ ID NO: 6495942 - DNA, 13 bp, Homo sapiens
tgatacagtctcc

SEQ ID NO: 6495943 - DNA, 14 bp, Homo sapiens
tgatacagtctcca

SEQ ID NO: 6495944 - DNA, 14 bp, Homo sapiens
tgatacataactaa

SEQ ID NO: 6495945 - DNA, 15 bp, Homo sapiens
tgatacataactaaa

SEQ ID NO: 6495946 - DNA, 16 bp, Homo sapiens
tgatacatataattct

SEQ ID NO: 6495947 - DNA, 16 bp, Homo sapiens
tgatacatccaaagca

SEQ ID NO: 6495948 - DNA, 19 bp, Homo sapiens
tgatacattagcagctatg

SEQ ID NO: 6495949 - DNA, 16 bp, Homo sapiens
tgatacattcaaattt

SEQ ID NO: 6495950 - DNA, 13 bp, Homo sapiens
tgatacattccca

SEQ ID NO: 6495951 - DNA, 14 bp, Homo sapiens
tgatacatttacat

SEQ ID NO: 6495952 - DNA, 19 bp, Homo sapiens
tgatacatttatcttctgt

SEQ ID NO: 6495953 - DNA, 13 bp, Homo sapiens
tgatacatttctg

SEQ ID NO: 6495954 - DNA, 18 bp, Homo sapiens
tgatacattttttaagct

SEQ ID NO: 6495955 - DNA, 17 bp, Homo sapiens
tgataccacctttactg

SEQ ID NO: 6495956 - DNA, 19 bp, Homo sapiens
tgataccacctttactgtg

SEQ ID NO: 6495957 - DNA, 23 bp, Homo sapiens
tgataccagcagcaactgaaaat

SEQ ID NO: 6495958 - DNA, 18 bp, Homo sapiens
tgataccaggcccaggag

SEQ ID NO: 6495959 - DNA, 18 bp, Homo sapiens
tgataccatatgaatgaa

SEQ ID NO: 6495960 - DNA, 23 bp, Homo sapiens
tgataccattctattctccagac

SEQ ID NO: 6495961 - DNA, 15 bp, Homo sapiens
tgatacccctgggga

SEQ ID NO: 6495962 - DNA, 19 bp, Homo sapiens
tgataccgaattgtgactc

SEQ ID NO: 6495963 - DNA, 18 bp, Homo sapiens
tgatacctattaaaggaa

SEQ ID NO: 6495964 - DNA, 23 bp, Homo sapiens
tgatacgtccgtgtgtcccagat

SEQ ID NO: 6495965 - DNA, 13 bp, Homo sapiens
tgatactaataaa

SEQ ID NO: 6495966 - DNA, 14 bp, Homo sapiens
tgatactaataaac

SEQ ID NO: 6495967 - DNA, 14 bp, Homo sapiens
tgatactacagttt

SEQ ID NO: 6495968 - DNA, 17 bp, Homo sapiens
tgatactacagtttgtt

SEQ ID NO: 6495969 - DNA, 17 bp, Homo sapiens
tgatactaccagggtct

SEQ ID NO: 6495970 - DNA, 18 bp, Homo sapiens
tgatactattcaatgcaa

SEQ ID NO: 6495971 - DNA, 23 bp, Homo sapiens
tgatactcgttattcatacaaat

SEQ ID NO: 6495972 - DNA, 15 bp, Homo sapiens
tgatactgaatgcat

SEQ ID NO: 6495973 - DNA, 17 bp, Homo sapiens
tgatactgaatgcataa

SEQ ID NO: 6495974 - DNA, 18 bp, Homo sapiens
tgatactgacaggtatca

SEQ ID NO: 6495975 - DNA, 18 bp, Homo sapiens
tgatactgactttttaaa

SEQ ID NO: 6495976 - DNA, 14 bp, Homo sapiens
tgatactgatgcca

SEQ ID NO: 6495977 - DNA, 18 bp, Homo sapiens
tgatactgcaactttaaa

SEQ ID NO: 6495978 - DNA, 18 bp, Homo sapiens
tgatactggaggaacact

SEQ ID NO: 6495979 - DNA, 18 bp, Homo sapiens
tgatactgtagaacctgt

SEQ ID NO: 6495980 - DNA, 20 bp, Homo sapiens
tgatactgtagaacctgtct

SEQ ID NO: 6495981 - DNA, 17 bp, Homo sapiens
tgatactgtctaagaat

SEQ ID NO: 6495982 - DNA, 14 bp, Homo sapiens
tgatactgtctctc

SEQ ID NO: 6495983 - DNA, 11 bp, Homo sapiens
tgatactgttg

SEQ ID NO: 6495984 - DNA, 13 bp, Homo sapiens
tgatactgttgca

SEQ ID NO: 6495985 - DNA, 19 bp, Homo sapiens
tgatactgttgcacgtgtg

SEQ ID NO: 6495986 - DNA, 14 bp, Homo sapiens
tgatactgtttctt

SEQ ID NO: 6495987 - DNA, 15 bp, Homo sapiens
tgatacttattcaaa

SEQ ID NO: 6495988 - DNA, 16 bp, Homo sapiens
tgatacttcaggtgct

SEQ ID NO: 6495989 - DNA, 17 bp, Homo sapiens
tgatacttcaggtgctt

SEQ ID NO: 6495990 - DNA, 23 bp, Homo sapiens
tgatacttcaggtgcttttgatg

SEQ ID NO: 6495991 - DNA, 14 bp, Homo sapiens
tgatacttgtaact

SEQ ID NO: 6495992 - DNA, 15 bp, Homo sapiens
tgatacttgtaactt

SEQ ID NO: 6495993 - DNA, 14 bp, Homo sapiens
tgatacttgttttc

SEQ ID NO: 6495994 - DNA, 21 bp, Homo sapiens
tgatactttaatttttataaa

SEQ ID NO: 6495995 - DNA, 11 bp, Homo sapiens
tgatactttag

SEQ ID NO: 6495996 - DNA, 14 bp, Homo sapiens
tgatactttagcca

SEQ ID NO: 6495997 - DNA, 23 bp, Homo sapiens
tgatactttagtacaatttcaac

SEQ ID NO: 6495998 - DNA, 18 bp, Homo sapiens
tgatacttttattgttat

SEQ ID NO: 6495999 - DNA, 21 bp, Homo sapiens
tgatacttttgacaacaaatt

SEQ ID NO: 6496000 - DNA, 20 bp, Homo sapiens
tgatacttttttgaaatcag

SEQ ID NO: 6496001 - DNA, 18 bp, Homo sapiens
tgatagaaaatccttcag

SEQ ID NO: 6496002 - DNA, 19 bp, Homo sapiens
tgatagaaaatccttcagc

SEQ ID NO: 6496003 - DNA, 12 bp, Homo sapiens
tgatagaaacag

SEQ ID NO: 6496004 - DNA, 21 bp, Homo sapiens
tgatagaaagaataaaatgtt

SEQ ID NO: 6496005 - DNA, 21 bp, Homo sapiens
tgatagaacaagaccctgtct

SEQ ID NO: 6496006 - DNA, 16 bp, Homo sapiens
tgatagaagaaggact

SEQ ID NO: 6496007 - DNA, 17 bp, Homo sapiens
tgatagacaattgaggt

SEQ ID NO: 6496008 - DNA, 18 bp, Homo sapiens
tgatagacaattgaggta

SEQ ID NO: 6496009 - DNA, 13 bp, Homo sapiens
tgatagacaccat

SEQ ID NO: 6496010 - DNA, 20 bp, Homo sapiens
tgatagacttactaataaaa

SEQ ID NO: 6496011 - DNA, 16 bp, Homo sapiens
tgatagactttgtgaa

SEQ ID NO: 6496012 - DNA, 14 bp, Homo sapiens
tgatagagcctttg

SEQ ID NO: 6496013 - DNA, 16 bp, Homo sapiens
tgatagatataaagga

SEQ ID NO: 6496014 - DNA, 17 bp, Homo sapiens
tgatagatgtttgactt

SEQ ID NO: 6496015 - DNA, 13 bp, Homo sapiens
tgatagcaaagcg

SEQ ID NO: 6496016 - DNA, 23 bp, Homo sapiens
tgatagcaagtgaatttttctct

SEQ ID NO: 6496017 - DNA, 13 bp, Homo sapiens
tgatagcacagac

SEQ ID NO: 6496018 - DNA, 14 bp, Homo sapiens
tgatagcacagacc

SEQ ID NO: 6496019 - DNA, 15 bp, Homo sapiens
tgatagcacagaccc

SEQ ID NO: 6496020 - DNA, 16 bp, Homo sapiens
tgatagcacagaccct

SEQ ID NO: 6496021 - DNA, 18 bp, Homo sapiens
tgatagcacagaccctgc

SEQ ID NO: 6496022 - DNA, 22 bp, Homo sapiens
tgatagcacagaccctgccctg

SEQ ID NO: 6496023 - DNA, 12 bp, Homo sapiens
tgatagcacttt

SEQ ID NO: 6496024 - DNA, 24 bp, Homo sapiens
tgatagcaggtgtaataagactat

SEQ ID NO: 6496025 - DNA, 15 bp, Homo sapiens
tgatagcatatgaca

SEQ ID NO: 6496026 - DNA, 16 bp, Homo sapiens
tgatagcattgtaagc

SEQ ID NO: 6496027 - DNA, 15 bp, Homo sapiens
tgatagccagacacg

SEQ ID NO: 6496028 - DNA, 16 bp, Homo sapiens
tgatagcccagaacaa

SEQ ID NO: 6496029 - DNA, 15 bp, Homo sapiens
tgatagcctcttaga

SEQ ID NO: 6496030 - DNA, 22 bp, Homo sapiens
tgatagcctgttacaggaatga

SEQ ID NO: 6496031 - DNA, 15 bp, Homo sapiens
tgatagcgttggaat

SEQ ID NO: 6496032 - DNA, 16 bp, Homo sapiens
tgatagcgttggaatt

SEQ ID NO: 6496033 - DNA, 20 bp, Homo sapiens
tgatagcgttggaattaaaa

SEQ ID NO: 6496034 - DNA, 19 bp, Homo sapiens
tgatagctacccacagagc

SEQ ID NO: 6496035 - DNA, 21 bp, Homo sapiens
tgatagctactgtagaaagga

SEQ ID NO: 6496036 - DNA, 21 bp, Homo sapiens
tgatagctgtttcaaatgtgc

SEQ ID NO: 6496037 - DNA, 17 bp, Homo sapiens
tgatagcttacactgag

SEQ ID NO: 6496038 - DNA, 21 bp, Homo sapiens
tgatagcttacactgaggact

SEQ ID NO: 6496039 - DNA, 14 bp, Homo sapiens
tgatagcttcgcat

SEQ ID NO: 6496040 - DNA, 18 bp, Homo sapiens
tgataggaaaagaaggct

SEQ ID NO: 6496041 - DNA, 18 bp, Homo sapiens
tgataggaaataaatgat

SEQ ID NO: 6496042 - DNA, 17 bp, Homo sapiens
tgataggaaggaaactg

SEQ ID NO: 6496043 - DNA, 21 bp, Homo sapiens
tgataggcctagtacaatctt

SEQ ID NO: 6496044 - DNA, 23 bp, Homo sapiens
tgataggcctagtacaatcttgg

SEQ ID NO: 6496045 - DNA, 17 bp, Homo sapiens
tgatagggatacatgct

SEQ ID NO: 6496046 - DNA, 15 bp, Homo sapiens
tgatagtcacctgct

SEQ ID NO: 6496047 - DNA, 22 bp, Homo sapiens
tgatagtccaatttttactcag

SEQ ID NO: 6496048 - DNA, 21 bp, Homo sapiens
tgatagtcctttttccaatgt

SEQ ID NO: 6496049 - DNA, 20 bp, Homo sapiens
tgatagtctttttttttaag

SEQ ID NO: 6496050 - DNA, 23 bp, Homo sapiens
tgatagtctttttttttaagtgt

SEQ ID NO: 6496051 - DNA, 17 bp, Homo sapiens
tgatagtgatgtatttt

SEQ ID NO: 6496052 - DNA, 18 bp, Homo sapiens
tgatagtgcaaggaatga

SEQ ID NO: 6496053 - DNA, 14 bp, Homo sapiens
tgatagtgcttctt

SEQ ID NO: 6496054 - DNA, 17 bp, Homo sapiens
tgatagtgcttcttgta

SEQ ID NO: 6496055 - DNA, 20 bp, Homo sapiens
tgatagtgtttcgttaagca

SEQ ID NO: 6496056 - DNA, 23 bp, Homo sapiens
tgatagtgtttcgttaagcagta

SEQ ID NO: 6496057 - DNA, 12 bp, Homo sapiens
tgatagttactg

SEQ ID NO: 6496058 - DNA, 14 bp, Homo sapiens
tgatagttactgtt

SEQ ID NO: 6496059 - DNA, 21 bp, Homo sapiens
tgatagttactgttgtgacct

SEQ ID NO: 6496060 - DNA, 22 bp, Homo sapiens
tgatagttgccttttcttcccc

SEQ ID NO: 6496061 - DNA, 24 bp, Homo sapiens
tgatagttgtaccgcaatgtgact

SEQ ID NO: 6496062 - DNA, 17 bp, Homo sapiens
tgatagtttcatttaca

SEQ ID NO: 6496063 - DNA, 14 bp, Homo sapiens
tgatagttttctag

SEQ ID NO: 6496064 - DNA, 13 bp, Homo sapiens
tgatataaacagc

SEQ ID NO: 6496065 - DNA, 15 bp, Homo sapiens
tgatataaacagctt

SEQ ID NO: 6496066 - DNA, 13 bp, Homo sapiens
tgatataaagaat

SEQ ID NO: 6496067 - DNA, 22 bp, Homo sapiens
tgatataaagaatgaaagtagc

SEQ ID NO: 6496068 - DNA, 23 bp, Homo sapiens
tgatataaaggaccctgtttctg

SEQ ID NO: 6496069 - DNA, 19 bp, Homo sapiens
tgatataaatcagattctt

SEQ ID NO: 6496070 - DNA, 13 bp, Homo sapiens
tgatataaattct

SEQ ID NO: 6496071 - DNA, 15 bp, Homo sapiens
tgatataaattctgt

SEQ ID NO: 6496072 - DNA, 16 bp, Homo sapiens
tgatataactttagaa

SEQ ID NO: 6496073 - DNA, 17 bp, Homo sapiens
tgatataactttagaaa

SEQ ID NO: 6496074 - DNA, 17 bp, Homo sapiens
tgatataagtgtgtgtt

SEQ ID NO: 6496075 - DNA, 23 bp, Homo sapiens
tgatataagtgtgtgtttttcat

SEQ ID NO: 6496076 - DNA, 21 bp, Homo sapiens
tgatataataattacttaatg

SEQ ID NO: 6496077 - DNA, 19 bp, Homo sapiens
tgatataattacttaatgt

SEQ ID NO: 6496078 - DNA, 14 bp, Homo sapiens
tgatatacaaagtg

SEQ ID NO: 6496079 - DNA, 16 bp, Homo sapiens
tgatatacaattagag

SEQ ID NO: 6496080 - DNA, 18 bp, Homo sapiens
tgatatacaattagagat

SEQ ID NO: 6496081 - DNA, 20 bp, Homo sapiens
tgatatacacagtggcaaaa

SEQ ID NO: 6496082 - DNA, 18 bp, Homo sapiens
tgatatacattgtgtgaa

SEQ ID NO: 6496083 - DNA, 18 bp, Homo sapiens
tgatatactccaggactt

SEQ ID NO: 6496084 - DNA, 21 bp, Homo sapiens
tgatatacttgagtgtgcaag

SEQ ID NO: 6496085 - DNA, 17 bp, Homo sapiens
tgatatagaattagctt

SEQ ID NO: 6496086 - DNA, 15 bp, Homo sapiens
tgatataggaaaata

SEQ ID NO: 6496087 - DNA, 18 bp, Homo sapiens
tgatatagtcagctgcct

SEQ ID NO: 6496088 - DNA, 22 bp, Homo sapiens
tgatatagtgctgtttaagcta

SEQ ID NO: 6496089 - DNA, 22 bp, Homo sapiens
tgatatataagtgtacatatgt

SEQ ID NO: 6496090 - DNA, 12 bp, Homo sapiens
tgatatatatgt

SEQ ID NO: 6496091 - DNA, 21 bp, Homo sapiens
tgatatatctcaaattgtaat

SEQ ID NO: 6496092 - DNA, 14 bp, Homo sapiens
tgatatatgtatct

SEQ ID NO: 6496093 - DNA, 17 bp, Homo sapiens
tgatatattctttccat

SEQ ID NO: 6496094 - DNA, 21 bp, Homo sapiens
tgatatattctttccatgcag

SEQ ID NO: 6496095 - DNA, 18 bp, Homo sapiens
tgatatcacctctcttca

SEQ ID NO: 6496096 - DNA, 11 bp, Homo sapiens
tgatatcagga

SEQ ID NO: 6496097 - DNA, 22 bp, Homo sapiens
tgatatcaggaaatatctgtga

SEQ ID NO: 6496098 - DNA, 17 bp, Homo sapiens
tgatatcattcagcatc

SEQ ID NO: 6496099 - DNA, 14 bp, Homo sapiens
tgatatccacaaat

SEQ ID NO: 6496100 - DNA, 20 bp, Homo sapiens
tgatatccagtaagcacatg

SEQ ID NO: 6496101 - DNA, 21 bp, Homo sapiens
tgatatccagtaagcacatgt

SEQ ID NO: 6496102 - DNA, 14 bp, Homo sapiens
tgatatccttctag

SEQ ID NO: 6496103 - DNA, 20 bp, Homo sapiens
tgatatcggtgctatgtgtt

SEQ ID NO: 6496104 - DNA, 15 bp, Homo sapiens
tgatatcgtgaaatc

SEQ ID NO: 6496105 - DNA, 17 bp, Homo sapiens
tgatatctataaaatag

SEQ ID NO: 6496106 - DNA, 20 bp, Homo sapiens
tgatatctttcctccctctt

SEQ ID NO: 6496107 - DNA, 11 bp, Homo sapiens
tgatatgaaaa

SEQ ID NO: 6496108 - DNA, 12 bp, Homo sapiens
tgatatgagtat

SEQ ID NO: 6496109 - DNA, 15 bp, Homo sapiens
tgatatgagtataca

SEQ ID NO: 6496110 - DNA, 15 bp, Homo sapiens
tgatatgataataat

SEQ ID NO: 6496111 - DNA, 15 bp, Homo sapiens
tgatatgcacaatgt

SEQ ID NO: 6496112 - DNA, 12 bp, Homo sapiens
tgatatgcagcc

SEQ ID NO: 6496113 - DNA, 18 bp, Homo sapiens
tgatatgcatatttgttt

SEQ ID NO: 6496114 - DNA, 17 bp, Homo sapiens
tgatatgcatgtagcat

SEQ ID NO: 6496115 - DNA, 15 bp, Homo sapiens
tgatatgctgagaaa

SEQ ID NO: 6496116 - DNA, 14 bp, Homo sapiens
tgatatgctgcttg

SEQ ID NO: 6496117 - DNA, 18 bp, Homo sapiens
tgatatgctgcttgtgac

SEQ ID NO: 6496118 - DNA, 20 bp, Homo sapiens
tgatatgctgcttgtgacct

SEQ ID NO: 6496119 - DNA, 16 bp, Homo sapiens
tgatatggagcaagag

SEQ ID NO: 6496120 - DNA, 18 bp, Homo sapiens
tgatatggcagaagacac

SEQ ID NO: 6496121 - DNA, 14 bp, Homo sapiens
tggtgaaacctcct

SEQ ID NO: 6496122 - DNA, 22 bp, Homo sapiens
tggtgaaagagtaaaaccaaag

SEQ ID NO: 6496123 - DNA, 23 bp, Homo sapiens
tggtgaaagctgagaactcctga

SEQ ID NO: 6496124 - DNA, 23 bp, Homo sapiens
tggtgaaataataaaatgcaaat

SEQ ID NO: 6496125 - DNA, 18 bp, Homo sapiens
tggtgaaatcttgtttgt

SEQ ID NO: 6496126 - DNA, 11 bp, Homo sapiens
tggtgaaatta

SEQ ID NO: 6496127 - DNA, 19 bp, Homo sapiens
tggtgaaatttattagtta

SEQ ID NO: 6496128 - DNA, 15 bp, Homo sapiens
tggtgaacagaacct

SEQ ID NO: 6496129 - DNA, 15 bp, Homo sapiens
tggtgaacattgcaa

SEQ ID NO: 6496130 - DNA, 20 bp, Homo sapiens
tggtgaacattgcaatagaa

SEQ ID NO: 6496131 - DNA, 14 bp, Homo sapiens
tggtgaactatatt

SEQ ID NO: 6496132 - DNA, 21 bp, Homo sapiens
tggtgaactgagctgggcagg

SEQ ID NO: 6496133 - DNA, 14 bp, Homo sapiens
tggtgaactgataa

SEQ ID NO: 6496134 - DNA, 19 bp, Homo sapiens
tggtgaactgttggagccc

SEQ ID NO: 6496135 - DNA, 14 bp, Homo sapiens
tggtgaagggaagt

SEQ ID NO: 6496136 - DNA, 18 bp, Homo sapiens
tggtgaagggaagtgggg

SEQ ID NO: 6496137 - DNA, 14 bp, Homo sapiens
tggtgaaggggctg

SEQ ID NO: 6496138 - DNA, 16 bp, Homo sapiens
tggtgaaggggctggt

SEQ ID NO: 6496139 - DNA, 16 bp, Homo sapiens
tggtgaagtaaattag

SEQ ID NO: 6496140 - DNA, 21 bp, Homo sapiens
tggtgaagtaacatgcatact

SEQ ID NO: 6496141 - DNA, 21 bp, Homo sapiens
tggtgaagtgtggctggtgtc

SEQ ID NO: 6496142 - DNA, 14 bp, Homo sapiens
tggtgaatttgaat

SEQ ID NO: 6496143 - DNA, 20 bp, Homo sapiens
tggtgaattttccaagaaca

SEQ ID NO: 6496144 - DNA, 15 bp, Homo sapiens
tggtgacagctgcaa

SEQ ID NO: 6496145 - DNA, 18 bp, Homo sapiens
tggtgacatcaggttttt

SEQ ID NO: 6496146 - DNA, 14 bp, Homo sapiens
tggtgacattgaaa

SEQ ID NO: 6496147 - DNA, 21 bp, Homo sapiens
tggtgaccaaaatttttaggt

SEQ ID NO: 6496148 - DNA, 18 bp, Homo sapiens
tggtgaccaccccctgtt

SEQ ID NO: 6496149 - DNA, 17 bp, Homo sapiens
tggtgacccagtcagag

SEQ ID NO: 6496150 - DNA, 13 bp, Homo sapiens
tggtgacccctgc

SEQ ID NO: 6496151 - DNA, 22 bp, Homo sapiens
tggtgacctcacacacctctgc

SEQ ID NO: 6496152 - DNA, 14 bp, Homo sapiens
tggtgacctctccg

SEQ ID NO: 6496153 - DNA, 22 bp, Homo sapiens
tggtgacctctgcctgaagtca

SEQ ID NO: 6496154 - DNA, 19 bp, Homo sapiens
tggtgactgaacgagggat

SEQ ID NO: 6496155 - DNA, 18 bp, Homo sapiens
tggtgactgcgatcttca

SEQ ID NO: 6496156 - DNA, 14 bp, Homo sapiens
tggtgactgtccca

SEQ ID NO: 6496157 - DNA, 14 bp, Homo sapiens
tggtgacttctgct

SEQ ID NO: 6496158 - DNA, 13 bp, Homo sapiens
tggtgacttgtct

SEQ ID NO: 6496159 - DNA, 15 bp, Homo sapiens
tggtgacttgtctgc

SEQ ID NO: 6496160 - DNA, 22 bp, Homo sapiens
tggtgacttgtctgcctcctgc

SEQ ID NO: 6496161 - DNA, 23 bp, Homo sapiens
tggtgacttgtctgcctcctgct

SEQ ID NO: 6496162 - DNA, 15 bp, Homo sapiens
tggtgactttggata

SEQ ID NO: 6496163 - DNA, 14 bp, Homo sapiens
tggtgactttgggg

SEQ ID NO: 6496164 - DNA, 19 bp, Homo sapiens
tggtgagaaatttctgtga

SEQ ID NO: 6496165 - DNA, 22 bp, Homo sapiens
tggtgagaactactcagggaat

SEQ ID NO: 6496166 - DNA, 23 bp, Homo sapiens
tggtgagaactactcagggaatg

SEQ ID NO: 6496167 - DNA, 19 bp, Homo sapiens
tggtgagaactgaggagcg

SEQ ID NO: 6496168 - DNA, 13 bp, Homo sapiens
tggtgagaaggtg

SEQ ID NO: 6496169 - DNA, 21 bp, Homo sapiens
tggtgagatacccagagagaa

SEQ ID NO: 6496170 - DNA, 12 bp, Homo sapiens
tggtgagcaagc

SEQ ID NO: 6496171 - DNA, 13 bp, Homo sapiens
tggtgagcaagca

SEQ ID NO: 6496172 - DNA, 21 bp, Homo sapiens
tggtgagcatgtaagtgttaa

SEQ ID NO: 6496173 - DNA, 17 bp, Homo sapiens
tggtgagcgatcattta

SEQ ID NO: 6496174 - DNA, 19 bp, Homo sapiens
tggtgagcgatcatttatt

SEQ ID NO: 6496175 - DNA, 18 bp, Homo sapiens
tggtgagctgggaagctg

SEQ ID NO: 6496176 - DNA, 13 bp, Homo sapiens
tggtgaggagcac

SEQ ID NO: 6496177 - DNA, 18 bp, Homo sapiens
tggtgaggcaggctttgt

SEQ ID NO: 6496178 - DNA, 15 bp, Homo sapiens
tggtgaggcccagcc

SEQ ID NO: 6496179 - DNA, 17 bp, Homo sapiens
tggtgaggcccagcctg

SEQ ID NO: 6496180 - DNA, 18 bp, Homo sapiens
tggtgaggccggccctgc

SEQ ID NO: 6496181 - DNA, 22 bp, Homo sapiens
tggtgaggccggccctgcccct

SEQ ID NO: 6496182 - DNA, 17 bp, Homo sapiens
tggtgaggccttgctcc

SEQ ID NO: 6496183 - DNA, 23 bp, Homo sapiens
tggtgaggctgacatgctcacac

SEQ ID NO: 6496184 - DNA, 17 bp, Homo sapiens
tggtgagggaagacgcc

SEQ ID NO: 6496185 - DNA, 21 bp, Homo sapiens
tggtgagggagaacctctcca

SEQ ID NO: 6496186 - DNA, 21 bp, Homo sapiens
tggtgagggcagttctgcacc

SEQ ID NO: 6496187 - DNA, 16 bp, Homo sapiens
tggtgaggggctttct

SEQ ID NO: 6496188 - DNA, 17 bp, Homo sapiens
tggtgaggggctttctc

SEQ ID NO: 6496189 - DNA, 18 bp, Homo sapiens
tggtgaggggctttctct

SEQ ID NO: 6496190 - DNA, 15 bp, Homo sapiens
tggtgaggtggccca

SEQ ID NO: 6496191 - DNA, 22 bp, Homo sapiens
tggtgagtcttggcggcagcag

SEQ ID NO: 6496192 - DNA, 21 bp, Homo sapiens
tggtgagtcttggttctaaag

SEQ ID NO: 6496193 - DNA, 18 bp, Homo sapiens
tggtgagtgcaagagcct

SEQ ID NO: 6496194 - DNA, 22 bp, Homo sapiens
tggtgagtgcaagagcctgaga

SEQ ID NO: 6496195 - DNA, 19 bp, Homo sapiens
tggtgagtggaagggagga

SEQ ID NO: 6496196 - DNA, 15 bp, Homo sapiens
tggtgagttaggaac

SEQ ID NO: 6496197 - DNA, 13 bp, Homo sapiens
tggtgataaaaat

SEQ ID NO: 6496198 - DNA, 15 bp, Homo sapiens
tggtgataagtggaa

SEQ ID NO: 6496199 - DNA, 21 bp, Homo sapiens
tggtgataatcgtcttcaaat

SEQ ID NO: 6496200 - DNA, 22 bp, Homo sapiens
tggtgataatcgtcttcaaatt

SEQ ID NO: 6496201 - DNA, 18 bp, Homo sapiens
tggtgatcaattaaatgt

SEQ ID NO: 6496202 - DNA, 19 bp, Homo sapiens
tggtgatccaaacaaaatg

SEQ ID NO: 6496203 - DNA, 18 bp, Homo sapiens
tggtgatctgtagacttc

SEQ ID NO: 6496204 - DNA, 18 bp, Homo sapiens
tggtgatgcctaaaggaa

SEQ ID NO: 6496205 - DNA, 13 bp, Homo sapiens
tggtgatggaaaa

SEQ ID NO: 6496206 - DNA, 12 bp, Homo sapiens
tggtgatggagt

SEQ ID NO: 6496207 - DNA, 17 bp, Homo sapiens
tggtgatgtaaaaatgc

SEQ ID NO: 6496208 - DNA, 20 bp, Homo sapiens
tggtgatgtaaaaatgcttc

SEQ ID NO: 6496209 - DNA, 18 bp, Homo sapiens
tggtgatgtaaaacagaa

SEQ ID NO: 6496210 - DNA, 19 bp, Homo sapiens
tggtgatgtccaaaagata

SEQ ID NO: 6496211 - DNA, 22 bp, Homo sapiens
tggtgatgttgaaatatgcata

SEQ ID NO: 6496212 - DNA, 16 bp, Homo sapiens
tggtgatttagcagga

SEQ ID NO: 6496213 - DNA, 14 bp, Homo sapiens
tggtgatttctgag

SEQ ID NO: 6496214 - DNA, 19 bp, Homo sapiens
tggtgatttgaaaaatata

SEQ ID NO: 6496215 - DNA, 20 bp, Homo sapiens
tggtgatttgaaaaatataa

SEQ ID NO: 6496216 - DNA, 16 bp, Homo sapiens
tggtgcaaaaaaaaac

SEQ ID NO: 6496217 - DNA, 17 bp, Homo sapiens
tggtgcaaaaaaaaact

SEQ ID NO: 6496218 - DNA, 19 bp, Homo sapiens
tggtgcaaaaaaaaactta

SEQ ID NO: 6496219 - DNA, 20 bp, Homo sapiens
tggtgcaaagattgcctctt

SEQ ID NO: 6496220 - DNA, 19 bp, Homo sapiens
tggtgcaaaggagccgcca

SEQ ID NO: 6496221 - DNA, 17 bp, Homo sapiens
tggtgcaaattcagaac

SEQ ID NO: 6496222 - DNA, 16 bp, Homo sapiens
tggtgcaatcacagct

SEQ ID NO: 6496223 - DNA, 14 bp, Homo sapiens
tggtgcaatgacct

SEQ ID NO: 6496224 - DNA, 19 bp, Homo sapiens
tggtgcaatgacctttcaa

SEQ ID NO: 6496225 - DNA, 20 bp, Homo sapiens
tggtgcaatgacctttcaat

SEQ ID NO: 6496226 - DNA, 18 bp, Homo sapiens
tggtgcaattaactctgg

SEQ ID NO: 6496227 - DNA, 13 bp, Homo sapiens
tggtgcaatttgt

SEQ ID NO: 6496228 - DNA, 19 bp, Homo sapiens
tggtgcacatgacatttgt

SEQ ID NO: 6496229 - DNA, 20 bp, Homo sapiens
tggtgcacgcaggcacagca

SEQ ID NO: 6496230 - DNA, 19 bp, Homo sapiens
tggtgcactttgtaaattc

SEQ ID NO: 6496231 - DNA, 19 bp, Homo sapiens
tggtgcagagaagctggac

SEQ ID NO: 6496232 - DNA, 22 bp, Homo sapiens
tggtgcagagaagctggacttc

SEQ ID NO: 6496233 - DNA, 18 bp, Homo sapiens
tggtgcagaggtgagcag

SEQ ID NO: 6496234 - DNA, 20 bp, Homo sapiens
tggtgcagaggtttcttgaa

SEQ ID NO: 6496235 - DNA, 21 bp, Homo sapiens
tggtgcagatgcctgcagtgc

SEQ ID NO: 6496236 - DNA, 21 bp, Homo sapiens
tggtgcagccccaggaccaag

SEQ ID NO: 6496237 - DNA, 22 bp, Homo sapiens
tggtgcagccttcccctccctg

SEQ ID NO: 6496238 - DNA, 21 bp, Homo sapiens
tggtgcaggtagacctgtctc

SEQ ID NO: 6496239 - DNA, 15 bp, Homo sapiens
tggtgcagtgtgaaa

SEQ ID NO: 6496240 - DNA, 18 bp, Homo sapiens
tggtgcatagaactgggt

SEQ ID NO: 6496241 - DNA, 22 bp, Homo sapiens
tggtgcatataaatatatttaa

SEQ ID NO: 6496242 - DNA, 19 bp, Homo sapiens
tggtgcattacagagagga

SEQ ID NO: 6496243 - DNA, 15 bp, Homo sapiens
tggtgcattcctgaa

SEQ ID NO: 6496244 - DNA, 15 bp, Homo sapiens
tggtgcattctgttt

SEQ ID NO: 6496245 - DNA, 14 bp, Homo sapiens
tggtgcattgttat

SEQ ID NO: 6496246 - DNA, 16 bp, Homo sapiens
tggtgcatttaaaatg

SEQ ID NO: 6496247 - DNA, 18 bp, Homo sapiens
tggtgccaaaaccaggcc

SEQ ID NO: 6496248 - DNA, 20 bp, Homo sapiens
tggtgccaaatagccccaga

SEQ ID NO: 6496249 - DNA, 22 bp, Homo sapiens
tggtgccaaatagccccagact

SEQ ID NO: 6496250 - DNA, 17 bp, Homo sapiens
tggtgccaatggaacct

SEQ ID NO: 6496251 - DNA, 23 bp, Homo sapiens
tggtgccacttcttaaaggcctg

SEQ ID NO: 6496252 - DNA, 14 bp, Homo sapiens
tggtgccagaggtt

SEQ ID NO: 6496253 - DNA, 21 bp, Homo sapiens
tggtgccagatcctcttctca

SEQ ID NO: 6496254 - DNA, 22 bp, Homo sapiens
tggtgccagatgtgggctcaga

SEQ ID NO: 6496255 - DNA, 19 bp, Homo sapiens
tggtgccaggcgcgtgtaa

SEQ ID NO: 6496256 - DNA, 16 bp, Homo sapiens
tggtgcccaccagctg

SEQ ID NO: 6496257 - DNA, 17 bp, Homo sapiens
tggtgcccaccagctgg

SEQ ID NO: 6496258 - DNA, 19 bp, Homo sapiens
tggtgcccaccagctggct

SEQ ID NO: 6496259 - DNA, 20 bp, Homo sapiens
tggtgcccaccagctggctc

SEQ ID NO: 6496260 - DNA, 17 bp, Homo sapiens
tggtgcccatgaagagg

SEQ ID NO: 6496261 - DNA, 17 bp, Homo sapiens
tggtgccccacagctac

SEQ ID NO: 6496262 - DNA, 14 bp, Homo sapiens
tggtgccccacctg

SEQ ID NO: 6496263 - DNA, 15 bp, Homo sapiens
tggtgccccacctgc

SEQ ID NO: 6496264 - DNA, 16 bp, Homo sapiens
tggtgccccacctgcc

SEQ ID NO: 6496265 - DNA, 14 bp, Homo sapiens
tggtgccccaggac

SEQ ID NO: 6496266 - DNA, 16 bp, Homo sapiens
tggtgccccaggacca

SEQ ID NO: 6496267 - DNA, 19 bp, Homo sapiens
tggtgccccaggaccagct

SEQ ID NO: 6496268 - DNA, 21 bp, Homo sapiens
tggtgccccaggaccagctca

SEQ ID NO: 6496269 - DNA, 21 bp, Homo sapiens
tggtgcccccagacagctgct

SEQ ID NO: 6496270 - DNA, 23 bp, Homo sapiens
tggtgccccccacccctggaaga

SEQ ID NO: 6496271 - DNA, 21 bp, Homo sapiens
tggtgcccctcgccagcttct

SEQ ID NO: 6496272 - DNA, 19 bp, Homo sapiens
tggtgcccctgctcactgg

SEQ ID NO: 6496273 - DNA, 17 bp, Homo sapiens
tggtgccctcctcactc

SEQ ID NO: 6496274 - DNA, 18 bp, Homo sapiens
tggtgccctcgcctcctc

SEQ ID NO: 6496275 - DNA, 19 bp, Homo sapiens
tggtgccctggatgcccag

SEQ ID NO: 6496276 - DNA, 13 bp, Homo sapiens
tggtgccctggcc

SEQ ID NO: 6496277 - DNA, 17 bp, Homo sapiens
tggtgcccttccctgga

SEQ ID NO: 6496278 - DNA, 19 bp, Homo sapiens
tggtgcctagtattgacaa

SEQ ID NO: 6496279 - DNA, 22 bp, Homo sapiens
tggtgcctagtattgacaaaat

SEQ ID NO: 6496280 - DNA, 17 bp, Homo sapiens
tggtgcctatatctgag

SEQ ID NO: 6496281 - DNA, 10 bp, Homo sapiens
tggtgcctca

SEQ ID NO: 6496282 - DNA, 15 bp, Homo sapiens
tggtgcctcactggg

SEQ ID NO: 6496283 - DNA, 20 bp, Homo sapiens
tggtgcctcactgggggctt

SEQ ID NO: 6496284 - DNA, 18 bp, Homo sapiens
tggtgcctctgtgcacag

SEQ ID NO: 6496285 - DNA, 21 bp, Homo sapiens
tggtgcctctgtgcacagtgg

SEQ ID NO: 6496286 - DNA, 14 bp, Homo sapiens
tggtgcctgagagg

SEQ ID NO: 6496287 - DNA, 18 bp, Homo sapiens
tggtgcctgagcccctca

SEQ ID NO: 6496288 - DNA, 21 bp, Homo sapiens
tggtgcctgattcggctgtct

SEQ ID NO: 6496289 - DNA, 13 bp, Homo sapiens
tggtgcctggcct

SEQ ID NO: 6496290 - DNA, 18 bp, Homo sapiens
tggtgcctggcctggcac

SEQ ID NO: 6496291 - DNA, 23 bp, Homo sapiens
tggtgcctggctggtttgcccag

SEQ ID NO: 6496292 - DNA, 23 bp, Homo sapiens
tggtgccttaccaagttgtgctt

SEQ ID NO: 6496293 - DNA, 12 bp, Homo sapiens
tggtgccttcat

SEQ ID NO: 6496294 - DNA, 14 bp, Homo sapiens
tggtgccttcattt

SEQ ID NO: 6496295 - DNA, 22 bp, Homo sapiens
tggtgcctttcctgttcagcat

SEQ ID NO: 6496296 - DNA, 16 bp, Homo sapiens
tggtgcgatctgggtt

SEQ ID NO: 6496297 - DNA, 21 bp, Homo sapiens
tggtgcgctgtgctccagcag

SEQ ID NO: 6496298 - DNA, 14 bp, Homo sapiens
tgatatgggactga

SEQ ID NO: 6496299 - DNA, 18 bp, Homo sapiens
tgatatgggtagtatttt

SEQ ID NO: 6496300 - DNA, 12 bp, Homo sapiens
tgatatgggtct

SEQ ID NO: 6496301 - DNA, 21 bp, Homo sapiens
tgatatggttcttattcactg

SEQ ID NO: 6496302 - DNA, 21 bp, Homo sapiens
tgatatgtaaacataattctt

SEQ ID NO: 6496303 - DNA, 20 bp, Homo sapiens
tgatatgtaagtacttccac

SEQ ID NO: 6496304 - DNA, 21 bp, Homo sapiens
tgatatgtctagggtgtgatt

SEQ ID NO: 6496305 - DNA, 15 bp, Homo sapiens
tgatatgtctttaaa

SEQ ID NO: 6496306 - DNA, 16 bp, Homo sapiens
tgatatgtctttaaaa

SEQ ID NO: 6496307 - DNA, 21 bp, Homo sapiens
tgatatgtgcttgtgtgtatg

SEQ ID NO: 6496308 - DNA, 13 bp, Homo sapiens
tgatatgtgtaat

SEQ ID NO: 6496309 - DNA, 18 bp, Homo sapiens
tgatatgtgtaatatcat

SEQ ID NO: 6496310 - DNA, 17 bp, Homo sapiens
tgatatgttgatgaaat

SEQ ID NO: 6496311 - DNA, 19 bp, Homo sapiens
tgatatgttggtagattct

SEQ ID NO: 6496312 - DNA, 14 bp, Homo sapiens
tgatattaaagatt

SEQ ID NO: 6496313 - DNA, 18 bp, Homo sapiens
tgatattaaagatttctt

SEQ ID NO: 6496314 - DNA, 13 bp, Homo sapiens
tgatattaaagga

SEQ ID NO: 6496315 - DNA, 14 bp, Homo sapiens
tgatattaaatttc

SEQ ID NO: 6496316 - DNA, 21 bp, Homo sapiens
tgatattaatcaaaattgtct

SEQ ID NO: 6496317 - DNA, 22 bp, Homo sapiens
tgatattaatttatcagattgc

SEQ ID NO: 6496318 - DNA, 17 bp, Homo sapiens
tgatattacatttattt

SEQ ID NO: 6496319 - DNA, 15 bp, Homo sapiens
tgatattatattaaa

SEQ ID NO: 6496320 - DNA, 16 bp, Homo sapiens
tgatattatattaaac

SEQ ID NO: 6496321 - DNA, 19 bp, Homo sapiens
tgatattatattaaacata

SEQ ID NO: 6496322 - DNA, 18 bp, Homo sapiens
tgatattatttcttctct

SEQ ID NO: 6496323 - DNA, 24 bp, Homo sapiens
tgatattatttcttctcttatcct

SEQ ID NO: 6496324 - DNA, 17 bp, Homo sapiens
tgatattcaaacacaca

SEQ ID NO: 6496325 - DNA, 22 bp, Homo sapiens
tgatattcagaattatgatgga

SEQ ID NO: 6496326 - DNA, 16 bp, Homo sapiens
tgatattcatattcaa

SEQ ID NO: 6496327 - DNA, 16 bp, Homo sapiens
tgatattccatagtat

SEQ ID NO: 6496328 - DNA, 19 bp, Homo sapiens
tgatattccatgaatgtat

SEQ ID NO: 6496329 - DNA, 20 bp, Homo sapiens
tgatattccatgaatgtatc

SEQ ID NO: 6496330 - DNA, 17 bp, Homo sapiens
tgatattcctacaaaga

SEQ ID NO: 6496331 - DNA, 22 bp, Homo sapiens
tgatattctaagaaatatctgt

SEQ ID NO: 6496332 - DNA, 15 bp, Homo sapiens
tgatattctaagact

SEQ ID NO: 6496333 - DNA, 16 bp, Homo sapiens
tgatattctttaaaca

SEQ ID NO: 6496334 - DNA, 17 bp, Homo sapiens
tgatattctttaaacaa

SEQ ID NO: 6496335 - DNA, 16 bp, Homo sapiens
tgatattgaaggaatt

SEQ ID NO: 6496336 - DNA, 17 bp, Homo sapiens
tgatattgacactgtcc

SEQ ID NO: 6496337 - DNA, 16 bp, Homo sapiens
tgatattgaccatgtg

SEQ ID NO: 6496338 - DNA, 21 bp, Homo sapiens
tgatattgaccatgtgattat

SEQ ID NO: 6496339 - DNA, 21 bp, Homo sapiens
tgatattgagacattaatttg

SEQ ID NO: 6496340 - DNA, 12 bp, Homo sapiens
tgatattgctgt

SEQ ID NO: 6496341 - DNA, 17 bp, Homo sapiens
tgatattggtgtgaatg

SEQ ID NO: 6496342 - DNA, 22 bp, Homo sapiens
tgatattgtcacctagcagata

SEQ ID NO: 6496343 - DNA, 17 bp, Homo sapiens
tgatattgtcttcatgt

SEQ ID NO: 6496344 - DNA, 17 bp, Homo sapiens
tgatattgtgaacattt

SEQ ID NO: 6496345 - DNA, 23 bp, Homo sapiens
tgatattgtgtaggaaatctgaa

SEQ ID NO: 6496346 - DNA, 14 bp, Homo sapiens
tgatattgtttaaa

SEQ ID NO: 6496347 - DNA, 15 bp, Homo sapiens
tgatattgtttaaaa

SEQ ID NO: 6496348 - DNA, 17 bp, Homo sapiens
tgatattgtttaaaatt

SEQ ID NO: 6496349 - DNA, 18 bp, Homo sapiens
tgatattgtttaaaattc

SEQ ID NO: 6496350 - DNA, 16 bp, Homo sapiens
tgatattgtttgctgt

SEQ ID NO: 6496351 - DNA, 17 bp, Homo sapiens
tgatattgtttgctgtt

SEQ ID NO: 6496352 - DNA, 19 bp, Homo sapiens
tgatattgtttgctgttgg

SEQ ID NO: 6496353 - DNA, 12 bp, Homo sapiens
tgatatttaaaa

SEQ ID NO: 6496354 - DNA, 13 bp, Homo sapiens
tgatatttaaaag

SEQ ID NO: 6496355 - DNA, 16 bp, Homo sapiens
tgatatttatttcctg

SEQ ID NO: 6496356 - DNA, 13 bp, Homo sapiens
tgatatttcagaa

SEQ ID NO: 6496357 - DNA, 16 bp, Homo sapiens
tgatatttcagaaata

SEQ ID NO: 6496358 - DNA, 19 bp, Homo sapiens
tgatatttccccatggttt

SEQ ID NO: 6496359 - DNA, 19 bp, Homo sapiens
tgatatttctctagtagtt

SEQ ID NO: 6496360 - DNA, 16 bp, Homo sapiens
tgatatttctgtgtag

SEQ ID NO: 6496361 - DNA, 19 bp, Homo sapiens
tgatatttctgtgtagtat

SEQ ID NO: 6496362 - DNA, 17 bp, Homo sapiens
tgatatttcttgctttc

SEQ ID NO: 6496363 - DNA, 18 bp, Homo sapiens
tgatatttgacagacatc

SEQ ID NO: 6496364 - DNA, 17 bp, Homo sapiens
tgatatttgcattgagg

SEQ ID NO: 6496365 - DNA, 16 bp, Homo sapiens
tgatatttggttattt

SEQ ID NO: 6496366 - DNA, 19 bp, Homo sapiens
tgatatttgtatttattct

SEQ ID NO: 6496367 - DNA, 16 bp, Homo sapiens
tgatatttgtgcattt

SEQ ID NO: 6496368 - DNA, 19 bp, Homo sapiens
tgatatttgtgcattttct

SEQ ID NO: 6496369 - DNA, 13 bp, Homo sapiens
tgatatttgtgta

SEQ ID NO: 6496370 - DNA, 14 bp, Homo sapiens
tgatattttcacag

SEQ ID NO: 6496371 - DNA, 20 bp, Homo sapiens
tgatattttcacatcttaat

SEQ ID NO: 6496372 - DNA, 16 bp, Homo sapiens
tgatattttccctttt

SEQ ID NO: 6496373 - DNA, 20 bp, Homo sapiens
tgatattttctgtgcctgaa

SEQ ID NO: 6496374 - DNA, 16 bp, Homo sapiens
tgatatttttatgtgc

SEQ ID NO: 6496375 - DNA, 20 bp, Homo sapiens
tgatatttttatgtgcagcg

SEQ ID NO: 6496376 - DNA, 20 bp, Homo sapiens
tgatatttttttaagtcttt

SEQ ID NO: 6496377 - DNA, 14 bp, Homo sapiens
tgatcaaaaataaa

SEQ ID NO: 6496378 - DNA, 15 bp, Homo sapiens
tgatcaaaaataaac

SEQ ID NO: 6496379 - DNA, 19 bp, Homo sapiens
tgatcaaaaataaactagt

SEQ ID NO: 6496380 - DNA, 18 bp, Homo sapiens
tgatcaaaaataatgcat

SEQ ID NO: 6496381 - DNA, 13 bp, Homo sapiens
tgatcaaaatcaa

SEQ ID NO: 6496382 - DNA, 12 bp, Homo sapiens
tgatcaaatgta

SEQ ID NO: 6496383 - DNA, 13 bp, Homo sapiens
tgatcaaatgttt

SEQ ID NO: 6496384 - DNA, 16 bp, Homo sapiens
tgatcaaatgtttaat

SEQ ID NO: 6496385 - DNA, 17 bp, Homo sapiens
tgatcaaattcattttt

SEQ ID NO: 6496386 - DNA, 22 bp, Homo sapiens
tgatcaaattcatttttttcac

SEQ ID NO: 6496387 - DNA, 14 bp, Homo sapiens
tgatcaacatcttt

SEQ ID NO: 6496388 - DNA, 23 bp, Homo sapiens
tgatcaacatcttttcttgcctc

SEQ ID NO: 6496389 - DNA, 23 bp, Homo sapiens
tgatcaagagtccggatttctaa

SEQ ID NO: 6496390 - DNA, 16 bp, Homo sapiens
tgatcaagatatatgt

SEQ ID NO: 6496391 - DNA, 12 bp, Homo sapiens
tgatcaaggagt

SEQ ID NO: 6496392 - DNA, 12 bp, Homo sapiens
tgatcaaggcct

SEQ ID NO: 6496393 - DNA, 22 bp, Homo sapiens
tgatcaagggaatgtaactgct

SEQ ID NO: 6496394 - DNA, 14 bp, Homo sapiens
tgatcaaggtgctc

SEQ ID NO: 6496395 - DNA, 21 bp, Homo sapiens
tgatcaagtcctttgtgaata

SEQ ID NO: 6496396 - DNA, 15 bp, Homo sapiens
tgatcaataaaatgt

SEQ ID NO: 6496397 - DNA, 19 bp, Homo sapiens
tgatcaataaaatgtgatt

SEQ ID NO: 6496398 - DNA, 21 bp, Homo sapiens
tgatcaatatttttatatcat

SEQ ID NO: 6496399 - DNA, 22 bp, Homo sapiens
tgatcaatctgcagtttgtgaa

SEQ ID NO: 6496400 - DNA, 19 bp, Homo sapiens
tgatcaatgacagagcctt

SEQ ID NO: 6496401 - DNA, 18 bp, Homo sapiens
tgatcaattatagtttct

SEQ ID NO: 6496402 - DNA, 22 bp, Homo sapiens
tgatcaattatagtttctgagg

SEQ ID NO: 6496403 - DNA, 16 bp, Homo sapiens
tgatcacaacttttct

SEQ ID NO: 6496404 - DNA, 15 bp, Homo sapiens
tgatcacactctggg

SEQ ID NO: 6496405 - DNA, 15 bp, Homo sapiens
tgatcacagatgtgc

SEQ ID NO: 6496406 - DNA, 21 bp, Homo sapiens
tgatcacagatgtgcccagag

SEQ ID NO: 6496407 - DNA, 22 bp, Homo sapiens
tgatcacagatgtgcccagagt

SEQ ID NO: 6496408 - DNA, 18 bp, Homo sapiens
tgatcacccccctgctta

SEQ ID NO: 6496409 - DNA, 19 bp, Homo sapiens
tgatcacccccctgcttag

SEQ ID NO: 6496410 - DNA, 16 bp, Homo sapiens
tgatcacctcagggca

SEQ ID NO: 6496411 - DNA, 13 bp, Homo sapiens
tgatcacggctca

SEQ ID NO: 6496412 - DNA, 18 bp, Homo sapiens
tgatcacggctcactgca

SEQ ID NO: 6496413 - DNA, 16 bp, Homo sapiens
tgatcactagcctgtc

SEQ ID NO: 6496414 - DNA, 22 bp, Homo sapiens
tgatcactccaggtagtttggg

SEQ ID NO: 6496415 - DNA, 18 bp, Homo sapiens
tgatcactggcaatgaaa

SEQ ID NO: 6496416 - DNA, 13 bp, Homo sapiens
tgatcactgtgaa

SEQ ID NO: 6496417 - DNA, 21 bp, Homo sapiens
tgatcactgtgaaccaacccc

SEQ ID NO: 6496418 - DNA, 16 bp, Homo sapiens
tgatcacttcatactt

SEQ ID NO: 6496419 - DNA, 21 bp, Homo sapiens
tgatcactttgttaaaaatat

SEQ ID NO: 6496420 - DNA, 21 bp, Homo sapiens
tgatcacttttgcacattccc

SEQ ID NO: 6496421 - DNA, 22 bp, Homo sapiens
tgatcagaactgggaaaacagt

SEQ ID NO: 6496422 - DNA, 15 bp, Homo sapiens
tgatcagaaggctgg

SEQ ID NO: 6496423 - DNA, 20 bp, Homo sapiens
tgatcagaaggctggggcca

SEQ ID NO: 6496424 - DNA, 12 bp, Homo sapiens
tgatcagacagc

SEQ ID NO: 6496425 - DNA, 20 bp, Homo sapiens
tgatcagacatacagctgcc

SEQ ID NO: 6496426 - DNA, 21 bp, Homo sapiens
tgatcagacatacagctgcct

SEQ ID NO: 6496427 - DNA, 18 bp, Homo sapiens
tgatcagacattcagaga

SEQ ID NO: 6496428 - DNA, 21 bp, Homo sapiens
tgatcagaccaaacagtgctg

SEQ ID NO: 6496429 - DNA, 20 bp, Homo sapiens
tgatcagagcattgtgcaat

SEQ ID NO: 6496430 - DNA, 23 bp, Homo sapiens
tgatcagagccgtggtcctttgg

SEQ ID NO: 6496431 - DNA, 12 bp, Homo sapiens
tgatcagaggca

SEQ ID NO: 6496432 - DNA, 19 bp, Homo sapiens
tgatcagaggtgtacacta

SEQ ID NO: 6496433 - DNA, 23 bp, Homo sapiens
tgatcagaggtgtacactaacat

SEQ ID NO: 6496434 - DNA, 19 bp, Homo sapiens
tgatcagatcttacaagtt

SEQ ID NO: 6496435 - DNA, 12 bp, Homo sapiens
tgatcagcagag

SEQ ID NO: 6496436 - DNA, 21 bp, Homo sapiens
tgatcagctttcaaagcattt

SEQ ID NO: 6496437 - DNA, 20 bp, Homo sapiens
tgatcaggacctccaagcca

SEQ ID NO: 6496438 - DNA, 13 bp, Homo sapiens
tgatcaggcccca

SEQ ID NO: 6496439 - DNA, 16 bp, Homo sapiens
tgatcaggcttcctgg

SEQ ID NO: 6496440 - DNA, 16 bp, Homo sapiens
tgatcagggatccaat

SEQ ID NO: 6496441 - DNA, 17 bp, Homo sapiens
tgatcagtagtttgcat

SEQ ID NO: 6496442 - DNA, 22 bp, Homo sapiens
tgatcagtgagctcaggagaga

SEQ ID NO: 6496443 - DNA, 22 bp, Homo sapiens
tgatcagtgattttcaaacctc

SEQ ID NO: 6496444 - DNA, 12 bp, Homo sapiens
tgatcagtgtta

SEQ ID NO: 6496445 - DNA, 21 bp, Homo sapiens
tgatcagttgctctctgttca

SEQ ID NO: 6496446 - DNA, 20 bp, Homo sapiens
tgatcataaactgactatca

SEQ ID NO: 6496447 - DNA, 15 bp, Homo sapiens
tgatcataagtctaa

SEQ ID NO: 6496448 - DNA, 21 bp, Homo sapiens
tgatcataagtctaaataaat

SEQ ID NO: 6496449 - DNA, 17 bp, Homo sapiens
tgatcatcatgtagaat

SEQ ID NO: 6496450 - DNA, 18 bp, Homo sapiens
tgatcatcgccagaggtg

SEQ ID NO: 6496451 - DNA, 16 bp, Homo sapiens
tgatcatctttgctga

SEQ ID NO: 6496452 - DNA, 14 bp, Homo sapiens
tgatcatgatgatg

SEQ ID NO: 6496453 - DNA, 15 bp, Homo sapiens
tgatcatgcaggaac

SEQ ID NO: 6496454 - DNA, 13 bp, Homo sapiens
tgatcatgcattg

SEQ ID NO: 6496455 - DNA, 14 bp, Homo sapiens
tgatcatgcattgt

SEQ ID NO: 6496456 - DNA, 17 bp, Homo sapiens
tgatcatgcattgttga

SEQ ID NO: 6496457 - DNA, 17 bp, Homo sapiens
tgatcatggtcagctca

SEQ ID NO: 6496458 - DNA, 16 bp, Homo sapiens
tgatcatgttgttaaa

SEQ ID NO: 6496459 - DNA, 19 bp, Homo sapiens
tgatcattcaccagtacat

SEQ ID NO: 6496460 - DNA, 14 bp, Homo sapiens
tgatcattgaaagt

SEQ ID NO: 6496461 - DNA, 21 bp, Homo sapiens
tgatcattgcagtatcagagg

SEQ ID NO: 6496462 - DNA, 13 bp, Homo sapiens
tgatcatttattt

SEQ ID NO: 6496463 - DNA, 20 bp, Homo sapiens
tgatcatttcacaccctttt

SEQ ID NO: 6496464 - DNA, 16 bp, Homo sapiens
tgatcatttgcagctg

SEQ ID NO: 6496465 - DNA, 18 bp, Homo sapiens
tgatcatttgcagctgct

SEQ ID NO: 6496466 - DNA, 19 bp, Homo sapiens
tgatcatttgcagctgctg

SEQ ID NO: 6496467 - DNA, 21 bp, Homo sapiens
tgatcatttgcagctgctggt

SEQ ID NO: 6496468 - DNA, 23 bp, Homo sapiens
tgatcattttagacactgggaga

SEQ ID NO: 6496469 - DNA, 17 bp, Homo sapiens
tgatcattttcccccca

SEQ ID NO: 6496470 - DNA, 18 bp, Homo sapiens
tgatcattttccccccac

SEQ ID NO: 6496471 - DNA, 19 bp, Homo sapiens
tgatcattttccccccact

SEQ ID NO: 6496472 - DNA, 12 bp, Homo sapiens
tgatcattttta

SEQ ID NO: 6496473 - DNA, 20 bp, Homo sapiens
tgatccaaagctggtcgagc

SEQ ID NO: 6496474 - DNA, 13 bp, Homo sapiens
tgatccaactaat

SEQ ID NO: 6496475 - DNA, 13 bp, Homo sapiens
tgatccaagctgg

SEQ ID NO: 6496476 - DNA, 16 bp, Homo sapiens
tggtgcggatggacac

SEQ ID NO: 6496477 - DNA, 16 bp, Homo sapiens
tggtgcggctggccat

SEQ ID NO: 6496478 - DNA, 19 bp, Homo sapiens
tggtgcgggcacaataaat

SEQ ID NO: 6496479 - DNA, 17 bp, Homo sapiens
tggtgcgggccaggtct

SEQ ID NO: 6496480 - DNA, 17 bp, Homo sapiens
tggtgcgggcctggccc

SEQ ID NO: 6496481 - DNA, 21 bp, Homo sapiens
tggtgcggtaggtgctggcct

SEQ ID NO: 6496482 - DNA, 15 bp, Homo sapiens
tggtgcgtgcctgta

SEQ ID NO: 6496483 - DNA, 17 bp, Homo sapiens
tggtgcgtgtggccctg

SEQ ID NO: 6496484 - DNA, 12 bp, Homo sapiens
tggtgctaactg

SEQ ID NO: 6496485 - DNA, 14 bp, Homo sapiens
tggtgctaactgta

SEQ ID NO: 6496486 - DNA, 15 bp, Homo sapiens
tggtgctaatatttt

SEQ ID NO: 6496487 - DNA, 16 bp, Homo sapiens
tggtgctaatgtgtct

SEQ ID NO: 6496488 - DNA, 16 bp, Homo sapiens
tggtgctagtaaattt

SEQ ID NO: 6496489 - DNA, 19 bp, Homo sapiens
tggtgctataacattctga

SEQ ID NO: 6496490 - DNA, 18 bp, Homo sapiens
tggtgctataggctggag

SEQ ID NO: 6496491 - DNA, 17 bp, Homo sapiens
tggtgctatttgaagaa

SEQ ID NO: 6496492 - DNA, 17 bp, Homo sapiens
tggtgctcagttgtaga

SEQ ID NO: 6496493 - DNA, 18 bp, Homo sapiens
tggtgctcctgcccagcc

SEQ ID NO: 6496494 - DNA, 16 bp, Homo sapiens
tggtgctctctgccac

SEQ ID NO: 6496495 - DNA, 15 bp, Homo sapiens
tggtgctgacctctg

SEQ ID NO: 6496496 - DNA, 13 bp, Homo sapiens
tggtgctgagaag

SEQ ID NO: 6496497 - DNA, 20 bp, Homo sapiens
tggtgctgagtgctatgtgt

SEQ ID NO: 6496498 - DNA, 15 bp, Homo sapiens
tggtgctgcaaggaa

SEQ ID NO: 6496499 - DNA, 15 bp, Homo sapiens
tggtgctgcccaggc

SEQ ID NO: 6496500 - DNA, 18 bp, Homo sapiens
tggtgctgcccaggcctc

SEQ ID NO: 6496501 - DNA, 20 bp, Homo sapiens
tggtgctgccgagggctggc

SEQ ID NO: 6496502 - DNA, 22 bp, Homo sapiens
tggtgctgccgagggctggccg

SEQ ID NO: 6496503 - DNA, 18 bp, Homo sapiens
tggtgctgggagatgctc

SEQ ID NO: 6496504 - DNA, 21 bp, Homo sapiens
tggtgctgggagatgctctct

SEQ ID NO: 6496505 - DNA, 14 bp, Homo sapiens
tggtgctggtttat

SEQ ID NO: 6496506 - DNA, 13 bp, Homo sapiens
tggtgctgtggcc

SEQ ID NO: 6496507 - DNA, 13 bp, Homo sapiens
tggtgctgtgtgc

SEQ ID NO: 6496508 - DNA, 21 bp, Homo sapiens
tggtgctgtgtgccccactcc

SEQ ID NO: 6496509 - DNA, 21 bp, Homo sapiens
tggtgctgtttaaagtcacat

SEQ ID NO: 6496510 - DNA, 13 bp, Homo sapiens
tggtgcttagaaa

SEQ ID NO: 6496511 - DNA, 17 bp, Homo sapiens
tggtgcttcagccctgg

SEQ ID NO: 6496512 - DNA, 12 bp, Homo sapiens
tggtgcttccca

SEQ ID NO: 6496513 - DNA, 18 bp, Homo sapiens
tggtgcttcccccacccc

SEQ ID NO: 6496514 - DNA, 17 bp, Homo sapiens
tggtgcttgactctcac

SEQ ID NO: 6496515 - DNA, 15 bp, Homo sapiens
tggtgcttggcagga

SEQ ID NO: 6496516 - DNA, 17 bp, Homo sapiens
tggtgcttgggagagtc

SEQ ID NO: 6496517 - DNA, 19 bp, Homo sapiens
tggtgcttgggagagtcag

SEQ ID NO: 6496518 - DNA, 18 bp, Homo sapiens
tggtgctttcctgtttct

SEQ ID NO: 6496519 - DNA, 20 bp, Homo sapiens
tggtgctttccttcatctcc

SEQ ID NO: 6496520 - DNA, 14 bp, Homo sapiens
tggtgctttgtgtc

SEQ ID NO: 6496521 - DNA, 15 bp, Homo sapiens
tggtgctttgtgtct

SEQ ID NO: 6496522 - DNA, 21 bp, Homo sapiens
tggtggaaagcgattcactgt

SEQ ID NO: 6496523 - DNA, 22 bp, Homo sapiens
tggtggaagaggttctcagcaa

SEQ ID NO: 6496524 - DNA, 21 bp, Homo sapiens
tggtggaatgcgggggagcag

SEQ ID NO: 6496525 - DNA, 18 bp, Homo sapiens
tggtggacagacccaggg

SEQ ID NO: 6496526 - DNA, 17 bp, Homo sapiens
tggtggacagtcctggg

SEQ ID NO: 6496527 - DNA, 21 bp, Homo sapiens
tggtggaccctactattcatg

SEQ ID NO: 6496528 - DNA, 22 bp, Homo sapiens
tggtggaccctactattcatgt

SEQ ID NO: 6496529 - DNA, 19 bp, Homo sapiens
tggtggagaatctgagggc

SEQ ID NO: 6496530 - DNA, 15 bp, Homo sapiens
tggtggagcagccag

SEQ ID NO: 6496531 - DNA, 13 bp, Homo sapiens
tggtggagccagg

SEQ ID NO: 6496532 - DNA, 20 bp, Homo sapiens
tggtggaggaagggctgggc

SEQ ID NO: 6496533 - DNA, 18 bp, Homo sapiens
tggtggagggcacttcag

SEQ ID NO: 6496534 - DNA, 21 bp, Homo sapiens
tggtggagggggaggggagaa

SEQ ID NO: 6496535 - DNA, 13 bp, Homo sapiens
tggtggaggtggg

SEQ ID NO: 6496536 - DNA, 21 bp, Homo sapiens
tggtggatatggtgcagagaa

SEQ ID NO: 6496537 - DNA, 19 bp, Homo sapiens
tggtggatctaagaagggc

SEQ ID NO: 6496538 - DNA, 23 bp, Homo sapiens
tggtggatgaggcttcttcctgg

SEQ ID NO: 6496539 - DNA, 23 bp, Homo sapiens
tggtggatggtgacttttgaaga

SEQ ID NO: 6496540 - DNA, 14 bp, Homo sapiens
tggtggatgtaaat

SEQ ID NO: 6496541 - DNA, 18 bp, Homo sapiens
tggtggcacacgcctgta

SEQ ID NO: 6496542 - DNA, 20 bp, Homo sapiens
tggtggcacacgcctgtagt

SEQ ID NO: 6496543 - DNA, 15 bp, Homo sapiens
tggtggcacaggcac

SEQ ID NO: 6496544 - DNA, 17 bp, Homo sapiens
tggtggcacaggcactg

SEQ ID NO: 6496545 - DNA, 20 bp, Homo sapiens
tggtggcagaatgaaaatca

SEQ ID NO: 6496546 - DNA, 17 bp, Homo sapiens
tggtggcagagtcctgg

SEQ ID NO: 6496547 - DNA, 19 bp, Homo sapiens
tggtggcagattttacaaa

SEQ ID NO: 6496548 - DNA, 23 bp, Homo sapiens
tggtggcagctcacctctccctt

SEQ ID NO: 6496549 - DNA, 13 bp, Homo sapiens
tggtggcagctgc

SEQ ID NO: 6496550 - DNA, 17 bp, Homo sapiens
tggtggcagctgggcag

SEQ ID NO: 6496551 - DNA, 22 bp, Homo sapiens
tggtggcagtaacatgcaacaa

SEQ ID NO: 6496552 - DNA, 21 bp, Homo sapiens
tggtggcagtgcagcaaccag

SEQ ID NO: 6496553 - DNA, 12 bp, Homo sapiens
tggtggcagtgg

SEQ ID NO: 6496554 - DNA, 17 bp, Homo sapiens
tggtggcagtggaggtg

SEQ ID NO: 6496555 - DNA, 13 bp, Homo sapiens
tggtggcagtggg

SEQ ID NO: 6496556 - DNA, 15 bp, Homo sapiens
tggtggcatggaagg

SEQ ID NO: 6496557 - DNA, 15 bp, Homo sapiens
tggtggcatttttgc

SEQ ID NO: 6496558 - DNA, 17 bp, Homo sapiens
tggtggcatttttgctt

SEQ ID NO: 6496559 - DNA, 18 bp, Homo sapiens
tggtggccaagcctggcc

SEQ ID NO: 6496560 - DNA, 19 bp, Homo sapiens
tggtggccaagcctggccc

SEQ ID NO: 6496561 - DNA, 20 bp, Homo sapiens
tggtggccatgctcctcttc

SEQ ID NO: 6496562 - DNA, 12 bp, Homo sapiens
tggtggcccagc

SEQ ID NO: 6496563 - DNA, 15 bp, Homo sapiens
tggtggcccctcccc

SEQ ID NO: 6496564 - DNA, 21 bp, Homo sapiens
tggtggccctctcccctgccc

SEQ ID NO: 6496565 - DNA, 12 bp, Homo sapiens
tggtggccctgg

SEQ ID NO: 6496566 - DNA, 14 bp, Homo sapiens
tggtggccctgggg

SEQ ID NO: 6496567 - DNA, 15 bp, Homo sapiens
tggtggccctgggga

SEQ ID NO: 6496568 - DNA, 16 bp, Homo sapiens
tggtggccgcccaccc

SEQ ID NO: 6496569 - DNA, 18 bp, Homo sapiens
tggtggccggtggttttg

SEQ ID NO: 6496570 - DNA, 17 bp, Homo sapiens
tggtggccgtcacgctt

SEQ ID NO: 6496571 - DNA, 22 bp, Homo sapiens
tggtggccgtcacgctttcatg

SEQ ID NO: 6496572 - DNA, 19 bp, Homo sapiens
tggtggcctatttcagctg

SEQ ID NO: 6496573 - DNA, 20 bp, Homo sapiens
tggtggcctatttcagctgc

SEQ ID NO: 6496574 - DNA, 15 bp, Homo sapiens
tggtggcctggtccc

SEQ ID NO: 6496575 - DNA, 16 bp, Homo sapiens
tggtggcctggtccct

SEQ ID NO: 6496576 - DNA, 17 bp, Homo sapiens
tggtggcggggtggggt

SEQ ID NO: 6496577 - DNA, 19 bp, Homo sapiens
tggtggcgttatggcagcc

SEQ ID NO: 6496578 - DNA, 14 bp, Homo sapiens
tggtggctcatgcc

SEQ ID NO: 6496579 - DNA, 23 bp, Homo sapiens
tggtggctgccagcttgtgagct

SEQ ID NO: 6496580 - DNA, 14 bp, Homo sapiens
tggtggctgggctg

SEQ ID NO: 6496581 - DNA, 13 bp, Homo sapiens
tggtggctgggtt

SEQ ID NO: 6496582 - DNA, 14 bp, Homo sapiens
tggtggctgtctct

SEQ ID NO: 6496583 - DNA, 23 bp, Homo sapiens
tggtggctgtctctgtccctcac

SEQ ID NO: 6496584 - DNA, 14 bp, Homo sapiens
tggtggctgtggaa

SEQ ID NO: 6496585 - DNA, 19 bp, Homo sapiens
tggtggcttaagtgagcag

SEQ ID NO: 6496586 - DNA, 15 bp, Homo sapiens
tggtggcttcagctc

SEQ ID NO: 6496587 - DNA, 20 bp, Homo sapiens
tggtgggaagcaagcagggg

SEQ ID NO: 6496588 - DNA, 23 bp, Homo sapiens
tggtgggaaggccggcagcgggc

SEQ ID NO: 6496589 - DNA, 22 bp, Homo sapiens
tggtgggaggcccggggccctt

SEQ ID NO: 6496590 - DNA, 21 bp, Homo sapiens
tggtgggaggggcgcccacct

SEQ ID NO: 6496591 - DNA, 14 bp, Homo sapiens
tggtgggattacag

SEQ ID NO: 6496592 - DNA, 19 bp, Homo sapiens
tggtgggattacaggtgtg

SEQ ID NO: 6496593 - DNA, 19 bp, Homo sapiens
tggtgggatttgctcctgg

SEQ ID NO: 6496594 - DNA, 15 bp, Homo sapiens
tggtgggctccagag

SEQ ID NO: 6496595 - DNA, 14 bp, Homo sapiens
tggtgggctggccc

SEQ ID NO: 6496596 - DNA, 14 bp, Homo sapiens
tggtgggcttcagg

SEQ ID NO: 6496597 - DNA, 18 bp, Homo sapiens
tggtgggcttcagggcag

SEQ ID NO: 6496598 - DNA, 13 bp, Homo sapiens
tggtgggcttctg

SEQ ID NO: 6496599 - DNA, 12 bp, Homo sapiens
tggtggggacca

SEQ ID NO: 6496600 - DNA, 11 bp, Homo sapiens
tggtggggagg

SEQ ID NO: 6496601 - DNA, 23 bp, Homo sapiens
tggtggggaggggcgctggccca

SEQ ID NO: 6496602 - DNA, 14 bp, Homo sapiens
tggtggggccaggc

SEQ ID NO: 6496603 - DNA, 17 bp, Homo sapiens
tggtggggccaggccag

SEQ ID NO: 6496604 - DNA, 20 bp, Homo sapiens
tggtggggccaggccaggac

SEQ ID NO: 6496605 - DNA, 21 bp, Homo sapiens
tggtggggccaggccaggacc

SEQ ID NO: 6496606 - DNA, 21 bp, Homo sapiens
tggtggggcccatggaggaga

SEQ ID NO: 6496607 - DNA, 22 bp, Homo sapiens
tggtggggcccccagcaccctc

SEQ ID NO: 6496608 - DNA, 19 bp, Homo sapiens
tggtggggctgagcctgag

SEQ ID NO: 6496609 - DNA, 16 bp, Homo sapiens
tggtggggctgtcctg

SEQ ID NO: 6496610 - DNA, 20 bp, Homo sapiens
tggtgggggaggagcctctg

SEQ ID NO: 6496611 - DNA, 18 bp, Homo sapiens
tggtgggggcctcggtgt

SEQ ID NO: 6496612 - DNA, 18 bp, Homo sapiens
tggtggggggtccagtct

SEQ ID NO: 6496613 - DNA, 17 bp, Homo sapiens
tggtgggggtagagctg

SEQ ID NO: 6496614 - DNA, 23 bp, Homo sapiens
tggtggggtctcctcaggaccag

SEQ ID NO: 6496615 - DNA, 17 bp, Homo sapiens
tggtggggtggcacctg

SEQ ID NO: 6496616 - DNA, 19 bp, Homo sapiens
tggtgggtaattgtacaat

SEQ ID NO: 6496617 - DNA, 23 bp, Homo sapiens
tggtgggtaattgtacaataaat

SEQ ID NO: 6496618 - DNA, 14 bp, Homo sapiens
tggtgggtctgagc

SEQ ID NO: 6496619 - DNA, 19 bp, Homo sapiens
tggtgggtctgagctggac

SEQ ID NO: 6496620 - DNA, 22 bp, Homo sapiens
tggtgggtctgcagctggtgtg

SEQ ID NO: 6496621 - DNA, 21 bp, Homo sapiens
tggtgggtgaaagaaatcatg

SEQ ID NO: 6496622 - DNA, 17 bp, Homo sapiens
tggtgggtgtggccagc

SEQ ID NO: 6496623 - DNA, 13 bp, Homo sapiens
tggtgggttgatg

SEQ ID NO: 6496624 - DNA, 22 bp, Homo sapiens
tggtgggtttcggggtgaagca

SEQ ID NO: 6496625 - DNA, 15 bp, Homo sapiens
tggtggtattctgtc

SEQ ID NO: 6496626 - DNA, 14 bp, Homo sapiens
tggtggtcagatgc

SEQ ID NO: 6496627 - DNA, 15 bp, Homo sapiens
tggtggtcagatgca

SEQ ID NO: 6496628 - DNA, 15 bp, Homo sapiens
tggtggtcagcccta

SEQ ID NO: 6496629 - DNA, 12 bp, Homo sapiens
tggtggtgggga

SEQ ID NO: 6496630 - DNA, 21 bp, Homo sapiens
tggtggttaaaagggaacaca

SEQ ID NO: 6496631 - DNA, 18 bp, Homo sapiens
tggtggttatgtcccatg

SEQ ID NO: 6496632 - DNA, 18 bp, Homo sapiens
tggtggttattttaaata

SEQ ID NO: 6496633 - DNA, 18 bp, Homo sapiens
tggtggttcattccacag

SEQ ID NO: 6496634 - DNA, 18 bp, Homo sapiens
tggtggttcctttgcacc

SEQ ID NO: 6496635 - DNA, 21 bp, Homo sapiens
tggtggttcctttgcaccctg

SEQ ID NO: 6496636 - DNA, 23 bp, Homo sapiens
tggtggttgggacccagtggcag

SEQ ID NO: 6496637 - DNA, 17 bp, Homo sapiens
tggtggtttacgcctat

SEQ ID NO: 6496638 - DNA, 16 bp, Homo sapiens
tggtggtttcagaaag

SEQ ID NO: 6496639 - DNA, 15 bp, Homo sapiens
tggtggtttgattgt

SEQ ID NO: 6496640 - DNA, 23 bp, Homo sapiens
tggtggttttcagagcaggaggc

SEQ ID NO: 6496641 - DNA, 22 bp, Homo sapiens
tggtgtaaaaaacaaacatttg

SEQ ID NO: 6496642 - DNA, 13 bp, Homo sapiens
tggtgtaaacttg

SEQ ID NO: 6496643 - DNA, 14 bp, Homo sapiens
tggtgtaaacttgt

SEQ ID NO: 6496644 - DNA, 14 bp, Homo sapiens
tggtgtaaagctgg

SEQ ID NO: 6496645 - DNA, 16 bp, Homo sapiens
tggtgtaaagctggcc

SEQ ID NO: 6496646 - DNA, 13 bp, Homo sapiens
tggtgtaataaga

SEQ ID NO: 6496647 - DNA, 14 bp, Homo sapiens
tggtgtaataagac

SEQ ID NO: 6496648 - DNA, 15 bp, Homo sapiens
tggtgtaataagaca

SEQ ID NO: 6496649 - DNA, 19 bp, Homo sapiens
tggtgtaataagacataac

SEQ ID NO: 6496650 - DNA, 18 bp, Homo sapiens
tggtgtaatcattttaaa

SEQ ID NO: 6496651 - DNA, 12 bp, Homo sapiens
tggtgtaatgca

SEQ ID NO: 6496652 - DNA, 16 bp, Homo sapiens
tggtgtaatgcacaat

SEQ ID NO: 6496653 - DNA, 21 bp, Homo sapiens
tggtgtactgggttaatggct

SEQ ID NO: 6496654 - DNA, 17 bp, Homo sapiens
tggtgtagaacactaat

SEQ ID NO: 6496655 - DNA, 21 bp, Homo sapiens
tgatccaagctggtcccactc

SEQ ID NO: 6496656 - DNA, 16 bp, Homo sapiens
tgatccacccaaccct

SEQ ID NO: 6496657 - DNA, 15 bp, Homo sapiens
tgatccacccacctc

SEQ ID NO: 6496658 - DNA, 20 bp, Homo sapiens
tgatccacccacctcagcct

SEQ ID NO: 6496659 - DNA, 20 bp, Homo sapiens
tgatccacccgccttcagcc

SEQ ID NO: 6496660 - DNA, 18 bp, Homo sapiens
tgatccactcgccttcat

SEQ ID NO: 6496661 - DNA, 13 bp, Homo sapiens
tgatccagaaaga

SEQ ID NO: 6496662 - DNA, 15 bp, Homo sapiens
tgatccagaacagtg

SEQ ID NO: 6496663 - DNA, 17 bp, Homo sapiens
tgatccagaagagccca

SEQ ID NO: 6496664 - DNA, 18 bp, Homo sapiens
tgatccagacaagtggga

SEQ ID NO: 6496665 - DNA, 11 bp, Homo sapiens
tgatccagccc

SEQ ID NO: 6496666 - DNA, 12 bp, Homo sapiens
tgatccagccct

SEQ ID NO: 6496667 - DNA, 22 bp, Homo sapiens
tgatccagccctggttctggct

SEQ ID NO: 6496668 - DNA, 14 bp, Homo sapiens
tgatccagcctttc

SEQ ID NO: 6496669 - DNA, 16 bp, Homo sapiens
tgatccagctgtgtgt

SEQ ID NO: 6496670 - DNA, 23 bp, Homo sapiens
tgatccaggattggcctgtgtct

SEQ ID NO: 6496671 - DNA, 19 bp, Homo sapiens
tgatccagtaacctcggag

SEQ ID NO: 6496672 - DNA, 23 bp, Homo sapiens
tgatccataaagacaatcactgc

SEQ ID NO: 6496673 - DNA, 20 bp, Homo sapiens
tgatccatagtgctacctgc

SEQ ID NO: 6496674 - DNA, 13 bp, Homo sapiens
tgatccatccagc

SEQ ID NO: 6496675 - DNA, 14 bp, Homo sapiens
tgatccatccatct

SEQ ID NO: 6496676 - DNA, 16 bp, Homo sapiens
tgatccatccatctcc

SEQ ID NO: 6496677 - DNA, 16 bp, Homo sapiens
tgatccatccatctct

SEQ ID NO: 6496678 - DNA, 21 bp, Homo sapiens
tgatccatgagtttgccctgg

SEQ ID NO: 6496679 - DNA, 14 bp, Homo sapiens
tgatccatgtaact

SEQ ID NO: 6496680 - DNA, 13 bp, Homo sapiens
tgatcccaccccc

SEQ ID NO: 6496681 - DNA, 16 bp, Homo sapiens
tgatcccaccccctcc

SEQ ID NO: 6496682 - DNA, 19 bp, Homo sapiens
tgatcccaccccctcctcc

SEQ ID NO: 6496683 - DNA, 23 bp, Homo sapiens
tgatcccaccccctcctccccca

SEQ ID NO: 6496684 - DNA, 12 bp, Homo sapiens
tgatcccagacc

SEQ ID NO: 6496685 - DNA, 16 bp, Homo sapiens
tgatcccagtcactcc

SEQ ID NO: 6496686 - DNA, 20 bp, Homo sapiens
tgatcccagtcactcctctc

SEQ ID NO: 6496687 - DNA, 15 bp, Homo sapiens
tgatcccatattctt

SEQ ID NO: 6496688 - DNA, 18 bp, Homo sapiens
tgatccccacgccacagc

SEQ ID NO: 6496689 - DNA, 18 bp, Homo sapiens
tgatcccccaaacagcat

SEQ ID NO: 6496690 - DNA, 20 bp, Homo sapiens
tgatccccgtctctgccctg

SEQ ID NO: 6496691 - DNA, 16 bp, Homo sapiens
tgatcccctctctgtg

SEQ ID NO: 6496692 - DNA, 22 bp, Homo sapiens
tgatcccctttggttttactac

SEQ ID NO: 6496693 - DNA, 23 bp, Homo sapiens
tgatccctcagtctgagaggtta

SEQ ID NO: 6496694 - DNA, 20 bp, Homo sapiens
tgatccctctgggggctctg

SEQ ID NO: 6496695 - DNA, 23 bp, Homo sapiens
tgatccctgaacccctggccagc

SEQ ID NO: 6496696 - DNA, 16 bp, Homo sapiens
tgatccctgatcaagc

SEQ ID NO: 6496697 - DNA, 15 bp, Homo sapiens
tgatccctgccaaaa

SEQ ID NO: 6496698 - DNA, 21 bp, Homo sapiens
tgatccctgttacccagagaa

SEQ ID NO: 6496699 - DNA, 16 bp, Homo sapiens
tgatcccttccccctg

SEQ ID NO: 6496700 - DNA, 21 bp, Homo sapiens
tgatcccttccccctgctgat

SEQ ID NO: 6496701 - DNA, 18 bp, Homo sapiens
tgatcccttctcctgccc

SEQ ID NO: 6496702 - DNA, 17 bp, Homo sapiens
tgatcccttgagatatg

SEQ ID NO: 6496703 - DNA, 18 bp, Homo sapiens
tgatccgcccacctcagc

SEQ ID NO: 6496704 - DNA, 22 bp, Homo sapiens
tgatccgcccgcctctgcctcc

SEQ ID NO: 6496705 - DNA, 15 bp, Homo sapiens
tgatccgcctgcctc

SEQ ID NO: 6496706 - DNA, 16 bp, Homo sapiens
tgatccgcctgcctct

SEQ ID NO: 6496707 - DNA, 22 bp, Homo sapiens
tgatccggctgctcctccagcc

SEQ ID NO: 6496708 - DNA, 19 bp, Homo sapiens
tgatccgtccgaggctgct

SEQ ID NO: 6496709 - DNA, 20 bp, Homo sapiens
tgatcctaactgaagagaca

SEQ ID NO: 6496710 - DNA, 15 bp, Homo sapiens
tgatcctaagaattt

SEQ ID NO: 6496711 - DNA, 18 bp, Homo sapiens
tgatcctagtgtctttaa

SEQ ID NO: 6496712 - DNA, 21 bp, Homo sapiens
tgatcctagtgtctttaaata

SEQ ID NO: 6496713 - DNA, 16 bp, Homo sapiens
tgatcctagttccacc

SEQ ID NO: 6496714 - DNA, 19 bp, Homo sapiens
tgatcctcacgccttggcc

SEQ ID NO: 6496715 - DNA, 15 bp, Homo sapiens
tgatcctcagcccct

SEQ ID NO: 6496716 - DNA, 17 bp, Homo sapiens
tgatcctccaacttcat

SEQ ID NO: 6496717 - DNA, 17 bp, Homo sapiens
tgatcctccaatgtcta

SEQ ID NO: 6496718 - DNA, 15 bp, Homo sapiens
tgatcctcccacctc

SEQ ID NO: 6496719 - DNA, 18 bp, Homo sapiens
tgatcctcccacctcagc

SEQ ID NO: 6496720 - DNA, 19 bp, Homo sapiens
tgatcctcccacctcagcc

SEQ ID NO: 6496721 - DNA, 15 bp, Homo sapiens
tgatcctcctgtctt

SEQ ID NO: 6496722 - DNA, 16 bp, Homo sapiens
tgatcctgcaattaaa

SEQ ID NO: 6496723 - DNA, 11 bp, Homo sapiens
tgatcctgcca

SEQ ID NO: 6496724 - DNA, 20 bp, Homo sapiens
tgatcctgctccagcagcac

SEQ ID NO: 6496725 - DNA, 17 bp, Homo sapiens
tgatcctgctgacctca

SEQ ID NO: 6496726 - DNA, 17 bp, Homo sapiens
tgatcctggaaatggtt

SEQ ID NO: 6496727 - DNA, 18 bp, Homo sapiens
tgatcctggaggcccagt

SEQ ID NO: 6496728 - DNA, 14 bp, Homo sapiens
tgatcctgtgaagt

SEQ ID NO: 6496729 - DNA, 19 bp, Homo sapiens
tgatccttctgagctccac

SEQ ID NO: 6496730 - DNA, 21 bp, Homo sapiens
tgatccttctgagctccacct

SEQ ID NO: 6496731 - DNA, 20 bp, Homo sapiens
tgatccttggtgctgtgtgc

SEQ ID NO: 6496732 - DNA, 22 bp, Homo sapiens
tgatcctttggggcttctgtga

SEQ ID NO: 6496733 - DNA, 18 bp, Homo sapiens
tgatccttttggagtcag

SEQ ID NO: 6496734 - DNA, 17 bp, Homo sapiens
tgatccttttttgtcat

SEQ ID NO: 6496735 - DNA, 19 bp, Homo sapiens
tgatccttttttgtcattt

SEQ ID NO: 6496736 - DNA, 22 bp, Homo sapiens
tgatccttttttgtcattttat

SEQ ID NO: 6496737 - DNA, 16 bp, Homo sapiens
tgatcgaaaaaataat

SEQ ID NO: 6496738 - DNA, 16 bp, Homo sapiens
tgatcgacttcttggt

SEQ ID NO: 6496739 - DNA, 17 bp, Homo sapiens
tgatcgacttcttggtt

SEQ ID NO: 6496740 - DNA, 17 bp, Homo sapiens
tgatcgcacaacctgca

SEQ ID NO: 6496741 - DNA, 15 bp, Homo sapiens
tgatcgccttattta

SEQ ID NO: 6496742 - DNA, 15 bp, Homo sapiens
tgatcgccttcccca

SEQ ID NO: 6496743 - DNA, 15 bp, Homo sapiens
tgatcgcctttccca

SEQ ID NO: 6496744 - DNA, 16 bp, Homo sapiens
tgatcggtctcctagg

SEQ ID NO: 6496745 - DNA, 18 bp, Homo sapiens
tgatcgtagacacaggga

SEQ ID NO: 6496746 - DNA, 17 bp, Homo sapiens
tgatcgtatatttctca

SEQ ID NO: 6496747 - DNA, 19 bp, Homo sapiens
tgatcgtgacgctgaataa

SEQ ID NO: 6496748 - DNA, 16 bp, Homo sapiens
tgatcgtgtgttgcca

SEQ ID NO: 6496749 - DNA, 19 bp, Homo sapiens
tgatctaaaatttgtaata

SEQ ID NO: 6496750 - DNA, 12 bp, Homo sapiens
tgatctaacaaa

SEQ ID NO: 6496751 - DNA, 13 bp, Homo sapiens
tgatctaacaaaa

SEQ ID NO: 6496752 - DNA, 17 bp, Homo sapiens
tgatctaacaaaataag

SEQ ID NO: 6496753 - DNA, 19 bp, Homo sapiens
tgatctaagcagttgcaat

SEQ ID NO: 6496754 - DNA, 21 bp, Homo sapiens
tgatctaaggcatgctcccag

SEQ ID NO: 6496755 - DNA, 16 bp, Homo sapiens
tgatctaataaacttt

SEQ ID NO: 6496756 - DNA, 15 bp, Homo sapiens
tgatctacccgtgcc

SEQ ID NO: 6496757 - DNA, 17 bp, Homo sapiens
tgatctacttgcctcat

SEQ ID NO: 6496758 - DNA, 20 bp, Homo sapiens
tgatctagatacaggactgg

SEQ ID NO: 6496759 - DNA, 21 bp, Homo sapiens
tgatctaggaagactttggaa

SEQ ID NO: 6496760 - DNA, 15 bp, Homo sapiens
tgatctaggtttaac

SEQ ID NO: 6496761 - DNA, 17 bp, Homo sapiens
tgatctaggtttaactc

SEQ ID NO: 6496762 - DNA, 19 bp, Homo sapiens
tgatctaggtttaactcag

SEQ ID NO: 6496763 - DNA, 15 bp, Homo sapiens
tgatctagttcctga

SEQ ID NO: 6496764 - DNA, 22 bp, Homo sapiens
tgatctatgtttgtgtgatttc

SEQ ID NO: 6496765 - DNA, 20 bp, Homo sapiens
tgatctattactctgacata

SEQ ID NO: 6496766 - DNA, 20 bp, Homo sapiens
tgatctattgctcatcagct

SEQ ID NO: 6496767 - DNA, 17 bp, Homo sapiens
tgatctcagctcactgc

SEQ ID NO: 6496768 - DNA, 22 bp, Homo sapiens
tgatctcagggaagcccagctc

SEQ ID NO: 6496769 - DNA, 15 bp, Homo sapiens
tgatctcagggcaga

SEQ ID NO: 6496770 - DNA, 14 bp, Homo sapiens
tgatctcattgttc

SEQ ID NO: 6496771 - DNA, 21 bp, Homo sapiens
tgatctccaggcaaaaggagt

SEQ ID NO: 6496772 - DNA, 20 bp, Homo sapiens
tgatctccatggcttcctcc

SEQ ID NO: 6496773 - DNA, 12 bp, Homo sapiens
tgatctcccctc

SEQ ID NO: 6496774 - DNA, 16 bp, Homo sapiens
tgatctccgtatgatg

SEQ ID NO: 6496775 - DNA, 18 bp, Homo sapiens
tgatctcctgacctcatg

SEQ ID NO: 6496776 - DNA, 22 bp, Homo sapiens
tgatctcctgacctcatgatcc

SEQ ID NO: 6496777 - DNA, 16 bp, Homo sapiens
tgatctcgactccccc

SEQ ID NO: 6496778 - DNA, 17 bp, Homo sapiens
tgatctcgtgatccgcc

SEQ ID NO: 6496779 - DNA, 22 bp, Homo sapiens
tgatctctactaccacaaggaa

SEQ ID NO: 6496780 - DNA, 18 bp, Homo sapiens
tgatctctgacctctgct

SEQ ID NO: 6496781 - DNA, 14 bp, Homo sapiens
tgatctcttagaag

SEQ ID NO: 6496782 - DNA, 18 bp, Homo sapiens
tgatctcttagaagccat

SEQ ID NO: 6496783 - DNA, 14 bp, Homo sapiens
tgatctcttcctgt

SEQ ID NO: 6496784 - DNA, 18 bp, Homo sapiens
tgatctgaatctgtttct

SEQ ID NO: 6496785 - DNA, 20 bp, Homo sapiens
tgatctgatgcaagcaagaa

SEQ ID NO: 6496786 - DNA, 22 bp, Homo sapiens
tgatctgcatatttctgtatat

SEQ ID NO: 6496787 - DNA, 18 bp, Homo sapiens
tgatctgcccttctctgc

SEQ ID NO: 6496788 - DNA, 20 bp, Homo sapiens
tgatctgcccttctctgcct

SEQ ID NO: 6496789 - DNA, 16 bp, Homo sapiens
tgatctgccgcctcag

SEQ ID NO: 6496790 - DNA, 15 bp, Homo sapiens
tgatctgctcagccc

SEQ ID NO: 6496791 - DNA, 16 bp, Homo sapiens
tgatctgctcagccct

SEQ ID NO: 6496792 - DNA, 19 bp, Homo sapiens
tgatctgctcagccctgga

SEQ ID NO: 6496793 - DNA, 17 bp, Homo sapiens
tgatctggaacccagac

SEQ ID NO: 6496794 - DNA, 19 bp, Homo sapiens
tgatctggaacccagactc

SEQ ID NO: 6496795 - DNA, 18 bp, Homo sapiens
tgatctgggaactcccaa

SEQ ID NO: 6496796 - DNA, 15 bp, Homo sapiens
tgatctgtatataca

SEQ ID NO: 6496797 - DNA, 11 bp, Homo sapiens
tgatctgtatt

SEQ ID NO: 6496798 - DNA, 13 bp, Homo sapiens
tgatctgtattaa

SEQ ID NO: 6496799 - DNA, 21 bp, Homo sapiens
tgatctgtattaagctccagt

SEQ ID NO: 6496800 - DNA, 22 bp, Homo sapiens
tgatctgtatttaatggttttt

SEQ ID NO: 6496801 - DNA, 20 bp, Homo sapiens
tgatctgtccttccaacctg

SEQ ID NO: 6496802 - DNA, 14 bp, Homo sapiens
tgatctgtctgtgg

SEQ ID NO: 6496803 - DNA, 17 bp, Homo sapiens
tgatctgtctgtggcaa

SEQ ID NO: 6496804 - DNA, 19 bp, Homo sapiens
tgatctgtctgtggcaaaa

SEQ ID NO: 6496805 - DNA, 14 bp, Homo sapiens
tgatctgtcttgta

SEQ ID NO: 6496806 - DNA, 17 bp, Homo sapiens
tgatctgtcttgtaata

SEQ ID NO: 6496807 - DNA, 19 bp, Homo sapiens
tgatctgtgaattgagctg

SEQ ID NO: 6496808 - DNA, 23 bp, Homo sapiens
tgatctgtgccttttttatatct

SEQ ID NO: 6496809 - DNA, 21 bp, Homo sapiens
tgatctgtgctttccagctca

SEQ ID NO: 6496810 - DNA, 22 bp, Homo sapiens
tgatctgtgctttccagctcac

SEQ ID NO: 6496811 - DNA, 16 bp, Homo sapiens
tgatctgtggagaatg

SEQ ID NO: 6496812 - DNA, 15 bp, Homo sapiens
tgatctgtgggcaca

SEQ ID NO: 6496813 - DNA, 17 bp, Homo sapiens
tgatctgttttacagga

SEQ ID NO: 6496814 - DNA, 23 bp, Homo sapiens
tgatcttacaagatattgatgat

SEQ ID NO: 6496815 - DNA, 20 bp, Homo sapiens
tgatcttacacgaagaaata

SEQ ID NO: 6496816 - DNA, 17 bp, Homo sapiens
tgatcttatttttctaa

SEQ ID NO: 6496817 - DNA, 15 bp, Homo sapiens
tgatcttcaacaaat

SEQ ID NO: 6496818 - DNA, 21 bp, Homo sapiens
tgatcttcaacaaattgccct

SEQ ID NO: 6496819 - DNA, 22 bp, Homo sapiens
tgatcttcaacaaattgccctt

SEQ ID NO: 6496820 - DNA, 13 bp, Homo sapiens
tgatcttcactgt

SEQ ID NO: 6496821 - DNA, 15 bp, Homo sapiens
tgatcttcactgtat

SEQ ID NO: 6496822 - DNA, 23 bp, Homo sapiens
tgatcttcccacgtgggcctccc

SEQ ID NO: 6496823 - DNA, 12 bp, Homo sapiens
tgatcttcctca

SEQ ID NO: 6496824 - DNA, 17 bp, Homo sapiens
tgatcttcctctgctaa

SEQ ID NO: 6496825 - DNA, 21 bp, Homo sapiens
tgatcttcctctgctaaattg

SEQ ID NO: 6496826 - DNA, 14 bp, Homo sapiens
tgatcttcttcatc

SEQ ID NO: 6496827 - DNA, 20 bp, Homo sapiens
tgatcttgaactcctgacct

SEQ ID NO: 6496828 - DNA, 16 bp, Homo sapiens
tgatcttgtaaaaata

SEQ ID NO: 6496829 - DNA, 14 bp, Homo sapiens
tgatcttgtgacat

SEQ ID NO: 6496830 - DNA, 19 bp, Homo sapiens
tgatcttgtgctcagcatg

SEQ ID NO: 6496831 - DNA, 23 bp, Homo sapiens
tgatcttgttactgtgatatttt

SEQ ID NO: 6496832 - DNA, 18 bp, Homo sapiens
tgatctttcaatatcatt

SEQ ID NO: 6496833 - DNA, 21 bp, Homo sapiens
tggtgtagccctcccactttg

SEQ ID NO: 6496834 - DNA, 16 bp, Homo sapiens
tggtgtagctacagag

SEQ ID NO: 6496835 - DNA, 17 bp, Homo sapiens
tggtgtagctacagaga

SEQ ID NO: 6496836 - DNA, 23 bp, Homo sapiens
tggtgtagtgtgtcagctctgtt

SEQ ID NO: 6496837 - DNA, 19 bp, Homo sapiens
tggtgtagttgaactgata

SEQ ID NO: 6496838 - DNA, 23 bp, Homo sapiens
tggtgtatagaagtttgtccatt

SEQ ID NO: 6496839 - DNA, 21 bp, Homo sapiens
tggtgtatatcatgaagcctt

SEQ ID NO: 6496840 - DNA, 15 bp, Homo sapiens
tggtgtatttgagaa

SEQ ID NO: 6496841 - DNA, 23 bp, Homo sapiens
tggtgtattttttaaaaaatttg

SEQ ID NO: 6496842 - DNA, 16 bp, Homo sapiens
tggtgtcaaattttta

SEQ ID NO: 6496843 - DNA, 18 bp, Homo sapiens
tggtgtcaccagcctgtt

SEQ ID NO: 6496844 - DNA, 19 bp, Homo sapiens
tggtgtcaccccagagcca

SEQ ID NO: 6496845 - DNA, 18 bp, Homo sapiens
tggtgtcagtatccaggc

SEQ ID NO: 6496846 - DNA, 20 bp, Homo sapiens
tggtgtcatgaggaaaaaaa

SEQ ID NO: 6496847 - DNA, 18 bp, Homo sapiens
tggtgtcattattccatc

SEQ ID NO: 6496848 - DNA, 15 bp, Homo sapiens
tggtgtcatttagta

SEQ ID NO: 6496849 - DNA, 18 bp, Homo sapiens
tggtgtccacctggcccc

SEQ ID NO: 6496850 - DNA, 16 bp, Homo sapiens
tggtgtccccttcccc

SEQ ID NO: 6496851 - DNA, 20 bp, Homo sapiens
tggtgtccccttcccctgct

SEQ ID NO: 6496852 - DNA, 23 bp, Homo sapiens
tggtgtccccttcccctgctgac

SEQ ID NO: 6496853 - DNA, 22 bp, Homo sapiens
tggtgtcccggtaccttccata

SEQ ID NO: 6496854 - DNA, 16 bp, Homo sapiens
tggtgtccctgcctgg

SEQ ID NO: 6496855 - DNA, 21 bp, Homo sapiens
tggtgtccctgcctggccctc

SEQ ID NO: 6496856 - DNA, 13 bp, Homo sapiens
tggtgtccctgcg

SEQ ID NO: 6496857 - DNA, 21 bp, Homo sapiens
tggtgtcctgaagctgctgga

SEQ ID NO: 6496858 - DNA, 20 bp, Homo sapiens
tggtgtcctgaccaccctcc

SEQ ID NO: 6496859 - DNA, 17 bp, Homo sapiens
tggtgtccttctcctct

SEQ ID NO: 6496860 - DNA, 14 bp, Homo sapiens
tggtgtccttcttc

SEQ ID NO: 6496861 - DNA, 19 bp, Homo sapiens
tggtgtcctttccctccac

SEQ ID NO: 6496862 - DNA, 15 bp, Homo sapiens
tggtgtcgggcatga

SEQ ID NO: 6496863 - DNA, 16 bp, Homo sapiens
tggtgtcgtctgtgaa

SEQ ID NO: 6496864 - DNA, 17 bp, Homo sapiens
tggtgtcgtctgtgaat

SEQ ID NO: 6496865 - DNA, 22 bp, Homo sapiens
tggtgtctcccaacatgggagg

SEQ ID NO: 6496866 - DNA, 17 bp, Homo sapiens
tggtgtctcttctttag

SEQ ID NO: 6496867 - DNA, 21 bp, Homo sapiens
tggtgtctcttttatgttcag

SEQ ID NO: 6496868 - DNA, 13 bp, Homo sapiens
tggtgtctgatgt

SEQ ID NO: 6496869 - DNA, 21 bp, Homo sapiens
tggtgtctgatgtgtgcccag

SEQ ID NO: 6496870 - DNA, 14 bp, Homo sapiens
tggtgtctgcctgt

SEQ ID NO: 6496871 - DNA, 18 bp, Homo sapiens
tggtgtcttgagaccagc

SEQ ID NO: 6496872 - DNA, 23 bp, Homo sapiens
tggtgtcttgagaccagcctgcc

SEQ ID NO: 6496873 - DNA, 14 bp, Homo sapiens
tggtgtgaactaaa

SEQ ID NO: 6496874 - DNA, 16 bp, Homo sapiens
tggtgtgaactaagtt

SEQ ID NO: 6496875 - DNA, 12 bp, Homo sapiens
tggtgtgaaggt

SEQ ID NO: 6496876 - DNA, 15 bp, Homo sapiens
tggtgtgaatgctgt

SEQ ID NO: 6496877 - DNA, 19 bp, Homo sapiens
tggtgtgaatgctgtacct

SEQ ID NO: 6496878 - DNA, 18 bp, Homo sapiens
tggtgtgaatttgccaga

SEQ ID NO: 6496879 - DNA, 19 bp, Homo sapiens
tggtgtgaatttgccagag

SEQ ID NO: 6496880 - DNA, 23 bp, Homo sapiens
tggtgtgaccactgcagaagaca

SEQ ID NO: 6496881 - DNA, 18 bp, Homo sapiens
tggtgtgaccatgttcat

SEQ ID NO: 6496882 - DNA, 18 bp, Homo sapiens
tggtgtgaggcccccgga

SEQ ID NO: 6496883 - DNA, 19 bp, Homo sapiens
tggtgtgaggctgggccag

SEQ ID NO: 6496884 - DNA, 19 bp, Homo sapiens
tggtgtgagtatcagaatt

SEQ ID NO: 6496885 - DNA, 17 bp, Homo sapiens
tggtgtgattgcacaga

SEQ ID NO: 6496886 - DNA, 16 bp, Homo sapiens
tggtgtgcatctgtgt

SEQ ID NO: 6496887 - DNA, 17 bp, Homo sapiens
tggtgtgccctgtgtgt

SEQ ID NO: 6496888 - DNA, 16 bp, Homo sapiens
tggtgtgcggaggcag

SEQ ID NO: 6496889 - DNA, 14 bp, Homo sapiens
tggtgtgctgaggt

SEQ ID NO: 6496890 - DNA, 14 bp, Homo sapiens
tggtgtggcctgtg

SEQ ID NO: 6496891 - DNA, 17 bp, Homo sapiens
tggtgtggggcgtggat

SEQ ID NO: 6496892 - DNA, 14 bp, Homo sapiens
tggtgtggtacaga

SEQ ID NO: 6496893 - DNA, 19 bp, Homo sapiens
tggtgtggtacagagaagc

SEQ ID NO: 6496894 - DNA, 13 bp, Homo sapiens
tggtgtgtcatgc

SEQ ID NO: 6496895 - DNA, 18 bp, Homo sapiens
tggtgtgtccctggacac

SEQ ID NO: 6496896 - DNA, 20 bp, Homo sapiens
tggtgtgtccctggacacag

SEQ ID NO: 6496897 - DNA, 23 bp, Homo sapiens
tggtgtgtccctggacacagctc

SEQ ID NO: 6496898 - DNA, 14 bp, Homo sapiens
tggtgtgtgaagtt

SEQ ID NO: 6496899 - DNA, 18 bp, Homo sapiens
tggtgtgtgtctctgaca

SEQ ID NO: 6496900 - DNA, 23 bp, Homo sapiens
tggtgtgttcaagaccagcctgg

SEQ ID NO: 6496901 - DNA, 15 bp, Homo sapiens
tggtgtgttcgtgga

SEQ ID NO: 6496902 - DNA, 21 bp, Homo sapiens
tggtgtgttggacagagaagg

SEQ ID NO: 6496903 - DNA, 22 bp, Homo sapiens
tggtgttaaaacacttctgtcc

SEQ ID NO: 6496904 - DNA, 19 bp, Homo sapiens
tggtgttaaagctgtacac

SEQ ID NO: 6496905 - DNA, 11 bp, Homo sapiens
tggtgttaaca

SEQ ID NO: 6496906 - DNA, 19 bp, Homo sapiens
tggtgttagggtgcagcca

SEQ ID NO: 6496907 - DNA, 19 bp, Homo sapiens
tggtgttatttgaaacttt

SEQ ID NO: 6496908 - DNA, 22 bp, Homo sapiens
tggtgttcaaaaaacttgtaaa

SEQ ID NO: 6496909 - DNA, 20 bp, Homo sapiens
tggtgttcataatttcagtt

SEQ ID NO: 6496910 - DNA, 23 bp, Homo sapiens
tggtgttccattgcctcttttca

SEQ ID NO: 6496911 - DNA, 14 bp, Homo sapiens
tggtgttcctgaag

SEQ ID NO: 6496912 - DNA, 16 bp, Homo sapiens
tggtgttcctggaagc

SEQ ID NO: 6496913 - DNA, 20 bp, Homo sapiens
tggtgttcctggaagcaggt

SEQ ID NO: 6496914 - DNA, 14 bp, Homo sapiens
tggtgttcctggcc

SEQ ID NO: 6496915 - DNA, 18 bp, Homo sapiens
tggtgttctaagactctg

SEQ ID NO: 6496916 - DNA, 21 bp, Homo sapiens
tggtgttctcaatgcttttct

SEQ ID NO: 6496917 - DNA, 17 bp, Homo sapiens
tggtgttctcctgctgc

SEQ ID NO: 6496918 - DNA, 19 bp, Homo sapiens
tggtgttctggcctctggc

SEQ ID NO: 6496919 - DNA, 13 bp, Homo sapiens
tggtgttgcagaa

SEQ ID NO: 6496920 - DNA, 18 bp, Homo sapiens
tggtgttggaggggcagg

SEQ ID NO: 6496921 - DNA, 22 bp, Homo sapiens
tggtgttggaggggcaggcctt

SEQ ID NO: 6496922 - DNA, 15 bp, Homo sapiens
tggtgttgggaaggg

SEQ ID NO: 6496923 - DNA, 14 bp, Homo sapiens
tggtgtttatgtga

SEQ ID NO: 6496924 - DNA, 19 bp, Homo sapiens
tggtgtttattataaagct

SEQ ID NO: 6496925 - DNA, 13 bp, Homo sapiens
tggtgtttattgc

SEQ ID NO: 6496926 - DNA, 21 bp, Homo sapiens
tggtgtttctagcactggcct

SEQ ID NO: 6496927 - DNA, 17 bp, Homo sapiens
tggtgtttgactgtaat

SEQ ID NO: 6496928 - DNA, 16 bp, Homo sapiens
tggtgtttgtaggctg

SEQ ID NO: 6496929 - DNA, 20 bp, Homo sapiens
tggtgtttgtaggctgtggg

SEQ ID NO: 6496930 - DNA, 21 bp, Homo sapiens
tggtgttttaaagagaatgta

SEQ ID NO: 6496931 - DNA, 22 bp, Homo sapiens
tggtgttttgcacttctgtaaa

SEQ ID NO: 6496932 - DNA, 19 bp, Homo sapiens
tggtgttttggatttggag

SEQ ID NO: 6496933 - DNA, 17 bp, Homo sapiens
tggtgttttgtcagact

SEQ ID NO: 6496934 - DNA, 15 bp, Homo sapiens
tggtgtttttacaga

SEQ ID NO: 6496935 - DNA, 12 bp, Homo sapiens
tggtgtttttct

SEQ ID NO: 6496936 - DNA, 14 bp, Homo sapiens
tggtgtttttctct

SEQ ID NO: 6496937 - DNA, 16 bp, Homo sapiens
tggtgtttttcttgta

SEQ ID NO: 6496938 - DNA, 18 bp, Homo sapiens
tggtgtttttcttgtaaa

SEQ ID NO: 6496939 - DNA, 17 bp, Homo sapiens
tggtgttttttgttact

SEQ ID NO: 6496940 - DNA, 19 bp, Homo sapiens
tggtgttttttgttactgt

SEQ ID NO: 6496941 - DNA, 20 bp, Homo sapiens
tggtgttttttttaagggca

SEQ ID NO: 6496942 - DNA, 20 bp, Homo sapiens
tggttaaaaaaaagaataaa

SEQ ID NO: 6496943 - DNA, 13 bp, Homo sapiens
tggttaaaaacct

SEQ ID NO: 6496944 - DNA, 15 bp, Homo sapiens
tggttaaaaacctgc

SEQ ID NO: 6496945 - DNA, 16 bp, Homo sapiens
tggttaaaaacctgcc

SEQ ID NO: 6496946 - DNA, 17 bp, Homo sapiens
tggttaaaaacttgtgt

SEQ ID NO: 6496947 - DNA, 18 bp, Homo sapiens
tggttaaaacatagcttt

SEQ ID NO: 6496948 - DNA, 22 bp, Homo sapiens
tggttaaaactgtacatttaaa

SEQ ID NO: 6496949 - DNA, 17 bp, Homo sapiens
tggttaaaagggaacac

SEQ ID NO: 6496950 - DNA, 14 bp, Homo sapiens
tggttaaaatgtga

SEQ ID NO: 6496951 - DNA, 21 bp, Homo sapiens
tggttaaccgggactacagaa

SEQ ID NO: 6496952 - DNA, 20 bp, Homo sapiens
tggttaaggccagggcctct

SEQ ID NO: 6496953 - DNA, 21 bp, Homo sapiens
tggttaagggacttgtcccaa

SEQ ID NO: 6496954 - DNA, 21 bp, Homo sapiens
tggttaagttggcttctgttt

SEQ ID NO: 6496955 - DNA, 16 bp, Homo sapiens
tggttaataaaactgc

SEQ ID NO: 6496956 - DNA, 14 bp, Homo sapiens
tggttaatcagtgt

SEQ ID NO: 6496957 - DNA, 16 bp, Homo sapiens
tggttaatccaactgt

SEQ ID NO: 6496958 - DNA, 14 bp, Homo sapiens
tggttaatgaaaaa

SEQ ID NO: 6496959 - DNA, 14 bp, Homo sapiens
tggttaatgtagta

SEQ ID NO: 6496960 - DNA, 15 bp, Homo sapiens
tggttaatttttcct

SEQ ID NO: 6496961 - DNA, 15 bp, Homo sapiens
tggttacaaattttt

SEQ ID NO: 6496962 - DNA, 21 bp, Homo sapiens
tggttacactgttagaacact

SEQ ID NO: 6496963 - DNA, 23 bp, Homo sapiens
tggttacactgttagaacactat

SEQ ID NO: 6496964 - DNA, 17 bp, Homo sapiens
tggttaccatgggtgtg

SEQ ID NO: 6496965 - DNA, 15 bp, Homo sapiens
tggttaccatgtctt

SEQ ID NO: 6496966 - DNA, 16 bp, Homo sapiens
tggttacctattgctg

SEQ ID NO: 6496967 - DNA, 19 bp, Homo sapiens
tggttacctattgctgtaa

SEQ ID NO: 6496968 - DNA, 23 bp, Homo sapiens
tggttacctgacctaaattagat

SEQ ID NO: 6496969 - DNA, 20 bp, Homo sapiens
tggttacgttggttaaataa

SEQ ID NO: 6496970 - DNA, 16 bp, Homo sapiens
tggttactagtacagg

SEQ ID NO: 6496971 - DNA, 22 bp, Homo sapiens
tggttactcagggttcatctgt

SEQ ID NO: 6496972 - DNA, 15 bp, Homo sapiens
tggttactcatttta

SEQ ID NO: 6496973 - DNA, 14 bp, Homo sapiens
tggttagaaatgca

SEQ ID NO: 6496974 - DNA, 21 bp, Homo sapiens
tggttagctcagccccagccc

SEQ ID NO: 6496975 - DNA, 22 bp, Homo sapiens
tggttagctcagccccagccca

SEQ ID NO: 6496976 - DNA, 23 bp, Homo sapiens
tggttagctcagccccagcccag

SEQ ID NO: 6496977 - DNA, 18 bp, Homo sapiens
tggttaggcattgtggga

SEQ ID NO: 6496978 - DNA, 22 bp, Homo sapiens
tggttagtagacactaattctg

SEQ ID NO: 6496979 - DNA, 21 bp, Homo sapiens
tggttagtagaggtacacttg

SEQ ID NO: 6496980 - DNA, 14 bp, Homo sapiens
tggttagtgatgca

SEQ ID NO: 6496981 - DNA, 24 bp, Homo sapiens
tggttagtgcatgtcacatgacat

SEQ ID NO: 6496982 - DNA, 13 bp, Homo sapiens
tggttagtgtact

SEQ ID NO: 6496983 - DNA, 14 bp, Homo sapiens
tggttagtgtgaaa

SEQ ID NO: 6496984 - DNA, 15 bp, Homo sapiens
tggttataaaagtga

SEQ ID NO: 6496985 - DNA, 16 bp, Homo sapiens
tggttataaaagtgat

SEQ ID NO: 6496986 - DNA, 20 bp, Homo sapiens
tggttataaaagtgattgtt

SEQ ID NO: 6496987 - DNA, 17 bp, Homo sapiens
tggttataacttaatga

SEQ ID NO: 6496988 - DNA, 13 bp, Homo sapiens
tggttatacatga

SEQ ID NO: 6496989 - DNA, 17 bp, Homo sapiens
tggttatacatgacact

SEQ ID NO: 6496990 - DNA, 21 bp, Homo sapiens
tggttatacatgacactgaaa

SEQ ID NO: 6496991 - DNA, 15 bp, Homo sapiens
tggttatagccctgc

SEQ ID NO: 6496992 - DNA, 14 bp, Homo sapiens
tggttatagtgcaa

SEQ ID NO: 6496993 - DNA, 21 bp, Homo sapiens
tggttatagtgcaatatattt

SEQ ID NO: 6496994 - DNA, 14 bp, Homo sapiens
tggttatcacacca

SEQ ID NO: 6496995 - DNA, 21 bp, Homo sapiens
tggttatgtcccatgaccttg

SEQ ID NO: 6496996 - DNA, 17 bp, Homo sapiens
tggttattagcaaggct

SEQ ID NO: 6496997 - DNA, 13 bp, Homo sapiens
tggttattatttt

SEQ ID NO: 6496998 - DNA, 18 bp, Homo sapiens
tggttattatttttgtca

SEQ ID NO: 6496999 - DNA, 14 bp, Homo sapiens
tggttattcattat

SEQ ID NO: 6497000 - DNA, 18 bp, Homo sapiens
tggttattcattattcct

SEQ ID NO: 6497001 - DNA, 13 bp, Homo sapiens
tggttattctaag

SEQ ID NO: 6497002 - DNA, 15 bp, Homo sapiens
tggttattggttttt

SEQ ID NO: 6497003 - DNA, 13 bp, Homo sapiens
tggttatttaacg

SEQ ID NO: 6497004 - DNA, 13 bp, Homo sapiens
tggttatttaatc

SEQ ID NO: 6497005 - DNA, 16 bp, Homo sapiens
tggttattttacatta

SEQ ID NO: 6497006 - DNA, 16 bp, Homo sapiens
tggttattttactttt

SEQ ID NO: 6497007 - DNA, 18 bp, Homo sapiens
tggttattttactttttg

SEQ ID NO: 6497008 - DNA, 23 bp, Homo sapiens
tggttattttctccatgtctgta

SEQ ID NO: 6497009 - DNA, 16 bp, Homo sapiens
tggttatttttataca

SEQ ID NO: 6497010 - DNA, 20 bp, Homo sapiens
tggttcaaacgggtgcctgg

SEQ ID NO: 6497011 - DNA, 23 bp, Homo sapiens
tggttcaagtattaagcagttca

SEQ ID NO: 6497012 - DNA, 18 bp, Homo sapiens
tggttcacctgtgactcc

SEQ ID NO: 6497013 - DNA, 19 bp, Homo sapiens
tggttcacctgtgactcct

SEQ ID NO: 6497014 - DNA, 17 bp, Homo sapiens
tggttcactcttggagc

SEQ ID NO: 6497015 - DNA, 20 bp, Homo sapiens
tggttcagaattaaactttt

SEQ ID NO: 6497016 - DNA, 16 bp, Homo sapiens
tggttcagacacagct

SEQ ID NO: 6497017 - DNA, 17 bp, Homo sapiens
tggttcagacacagctc

SEQ ID NO: 6497018 - DNA, 22 bp, Homo sapiens
tggttcagagactggcagccag

SEQ ID NO: 6497019 - DNA, 21 bp, Homo sapiens
tggttcagccttcgtgtggct

SEQ ID NO: 6497020 - DNA, 16 bp, Homo sapiens
tggttcagctaagcta

SEQ ID NO: 6497021 - DNA, 20 bp, Homo sapiens
tggttcagggttggcccctg

SEQ ID NO: 6497022 - DNA, 16 bp, Homo sapiens
tggttcagtcactgct

SEQ ID NO: 6497023 - DNA, 12 bp, Homo sapiens
tggttcagtcta

SEQ ID NO: 6497024 - DNA, 14 bp, Homo sapiens
tggttcagtctaga

SEQ ID NO: 6497025 - DNA, 13 bp, Homo sapiens
tggttcagtggga

SEQ ID NO: 6497026 - DNA, 14 bp, Homo sapiens
tggttcagtgggaa

SEQ ID NO: 6497027 - DNA, 15 bp, Homo sapiens
tggttcagtgggaat

SEQ ID NO: 6497028 - DNA, 13 bp, Homo sapiens
tggttcataaatg

SEQ ID NO: 6497029 - DNA, 19 bp, Homo sapiens
tggttcatatttatacttt

SEQ ID NO: 6497030 - DNA, 17 bp, Homo sapiens
tggttcatgcagacaaa

SEQ ID NO: 6497031 - DNA, 12 bp, Homo sapiens
tggttcatgctt

SEQ ID NO: 6497032 - DNA, 16 bp, Homo sapiens
tggttcattaattcta

SEQ ID NO: 6497033 - DNA, 15 bp, Homo sapiens
tggttcattccacag

SEQ ID NO: 6497034 - DNA, 21 bp, Homo sapiens
tggttccaaaccagtttattc

SEQ ID NO: 6497035 - DNA, 16 bp, Homo sapiens
tggttccagcctgcca

SEQ ID NO: 6497036 - DNA, 12 bp, Homo sapiens
tggttccagggt

SEQ ID NO: 6497037 - DNA, 20 bp, Homo sapiens
tggttccatgcagccttggg

SEQ ID NO: 6497038 - DNA, 15 bp, Homo sapiens
tggttccatgcctga

SEQ ID NO: 6497039 - DNA, 21 bp, Homo sapiens
tggttccattgtttggagaca

SEQ ID NO: 6497040 - DNA, 15 bp, Homo sapiens
tggttcccaatgtgt

SEQ ID NO: 6497041 - DNA, 12 bp, Homo sapiens
tggttcccagaa

SEQ ID NO: 6497042 - DNA, 14 bp, Homo sapiens
tggttccccaggag

SEQ ID NO: 6497043 - DNA, 11 bp, Homo sapiens
tggttcccctg

SEQ ID NO: 6497044 - DNA, 18 bp, Homo sapiens
tggttccctgctgcgctg

SEQ ID NO: 6497045 - DNA, 21 bp, Homo sapiens
tggttccctttgctccacccc

SEQ ID NO: 6497046 - DNA, 20 bp, Homo sapiens
tggttccggaatcctgtcct

SEQ ID NO: 6497047 - DNA, 11 bp, Homo sapiens
tggttcctaag

SEQ ID NO: 6497048 - DNA, 14 bp, Homo sapiens
tggttcctccagca

SEQ ID NO: 6497049 - DNA, 19 bp, Homo sapiens
tggttcctccagccacctc

SEQ ID NO: 6497050 - DNA, 14 bp, Homo sapiens
tggttcctctctcc

SEQ ID NO: 6497051 - DNA, 21 bp, Homo sapiens
tggttcctctctcccacccta

SEQ ID NO: 6497052 - DNA, 15 bp, Homo sapiens
tggttcctctctggt

SEQ ID NO: 6497053 - DNA, 16 bp, Homo sapiens
tggttcctgactggca

SEQ ID NO: 6497054 - DNA, 17 bp, Homo sapiens
tggttcctgctgtcctg

SEQ ID NO: 6497055 - DNA, 18 bp, Homo sapiens
tggttcctggggcatcca

SEQ ID NO: 6497056 - DNA, 23 bp, Homo sapiens
tggttcctggggtgccctccact

SEQ ID NO: 6497057 - DNA, 19 bp, Homo sapiens
tggttcctgtttgaaacta

SEQ ID NO: 6497058 - DNA, 14 bp, Homo sapiens
tggttccttccctg

SEQ ID NO: 6497059 - DNA, 14 bp, Homo sapiens
tggttccttctctg

SEQ ID NO: 6497060 - DNA, 16 bp, Homo sapiens
tggttccttctctggg

SEQ ID NO: 6497061 - DNA, 17 bp, Homo sapiens
tggttccttctctgggt

SEQ ID NO: 6497062 - DNA, 22 bp, Homo sapiens
tggttcggctctagggcctcag

SEQ ID NO: 6497063 - DNA, 17 bp, Homo sapiens
tggttcgtgctgtgctc

SEQ ID NO: 6497064 - DNA, 21 bp, Homo sapiens
tggttcgtgctgtgctctggc

SEQ ID NO: 6497065 - DNA, 13 bp, Homo sapiens
tggttctaaatat

SEQ ID NO: 6497066 - DNA, 19 bp, Homo sapiens
tggttctacaaatttttac

SEQ ID NO: 6497067 - DNA, 14 bp, Homo sapiens
tggttctacaatct

SEQ ID NO: 6497068 - DNA, 13 bp, Homo sapiens
tggttctatttta

SEQ ID NO: 6497069 - DNA, 20 bp, Homo sapiens
tggttctcagatcttgacag

SEQ ID NO: 6497070 - DNA, 13 bp, Homo sapiens
tggttctcatctt

SEQ ID NO: 6497071 - DNA, 17 bp, Homo sapiens
tggttctcatctttctt

SEQ ID NO: 6497072 - DNA, 14 bp, Homo sapiens
tggttctcatttgg

SEQ ID NO: 6497073 - DNA, 19 bp, Homo sapiens
tggttctccaagaaactga

SEQ ID NO: 6497074 - DNA, 21 bp, Homo sapiens
tggttctctgggcctcagttt

SEQ ID NO: 6497075 - DNA, 21 bp, Homo sapiens
tggttctcttcatccatttgt

SEQ ID NO: 6497076 - DNA, 18 bp, Homo sapiens
tggttctgagatggctcc

SEQ ID NO: 6497077 - DNA, 20 bp, Homo sapiens
tggttctgaggccagaaagg

SEQ ID NO: 6497078 - DNA, 17 bp, Homo sapiens
tggttctggccacccca

SEQ ID NO: 6497079 - DNA, 17 bp, Homo sapiens
tggttctggctgtttga

SEQ ID NO: 6497080 - DNA, 12 bp, Homo sapiens
tggttctgtgac

SEQ ID NO: 6497081 - DNA, 18 bp, Homo sapiens
tggttctgtgacccatct

SEQ ID NO: 6497082 - DNA, 13 bp, Homo sapiens
tggttctgtgcct

SEQ ID NO: 6497083 - DNA, 14 bp, Homo sapiens
tggttctgtgcctc

SEQ ID NO: 6497084 - DNA, 16 bp, Homo sapiens
tggttctgttttctaa

SEQ ID NO: 6497085 - DNA, 15 bp, Homo sapiens
tggttcttcaaatct

SEQ ID NO: 6497086 - DNA, 15 bp, Homo sapiens
tggttcttcatttat

SEQ ID NO: 6497087 - DNA, 23 bp, Homo sapiens
tggttcttcctttccctggagct

SEQ ID NO: 6497088 - DNA, 12 bp, Homo sapiens
tggttcttctca

SEQ ID NO: 6497089 - DNA, 17 bp, Homo sapiens
tggttcttctcttttcc

SEQ ID NO: 6497090 - DNA, 20 bp, Homo sapiens
tggttcttgacagtgagagg

SEQ ID NO: 6497091 - DNA, 15 bp, Homo sapiens
tggttcttgagggga

SEQ ID NO: 6497092 - DNA, 22 bp, Homo sapiens
tggttcttgaggggaccaggag

SEQ ID NO: 6497093 - DNA, 23 bp, Homo sapiens
tggttcttgaggggaccaggagt

SEQ ID NO: 6497094 - DNA, 13 bp, Homo sapiens
tggttcttgcctt

SEQ ID NO: 6497095 - DNA, 15 bp, Homo sapiens
tggttcttgccttcc

SEQ ID NO: 6497096 - DNA, 18 bp, Homo sapiens
tggttcttgccttcccct

SEQ ID NO: 6497097 - DNA, 19 bp, Homo sapiens
tggttcttgtattaagaat

SEQ ID NO: 6497098 - DNA, 20 bp, Homo sapiens
tggttctttatcatttctct

SEQ ID NO: 6497099 - DNA, 23 bp, Homo sapiens
tggttcttttaaaattaattttg

SEQ ID NO: 6497100 - DNA, 22 bp, Homo sapiens
tggttcttttttcagttatttt

SEQ ID NO: 6497101 - DNA, 20 bp, Homo sapiens
tggttgaaaaccacagtcag

SEQ ID NO: 6497102 - DNA, 23 bp, Homo sapiens
tggttgaactctggtggcacagg

SEQ ID NO: 6497103 - DNA, 22 bp, Homo sapiens
tggttgaagacaccagactgaa

SEQ ID NO: 6497104 - DNA, 22 bp, Homo sapiens
tggttgaccaaggtgcttttct

SEQ ID NO: 6497105 - DNA, 15 bp, Homo sapiens
tggttgagaaacatt

SEQ ID NO: 6497106 - DNA, 16 bp, Homo sapiens
tggttgagtgcaaatc

SEQ ID NO: 6497107 - DNA, 14 bp, Homo sapiens
tggttgatgccaaa

SEQ ID NO: 6497108 - DNA, 18 bp, Homo sapiens
tggttgatggaaaataaa

SEQ ID NO: 6497109 - DNA, 14 bp, Homo sapiens
tggttgatggtttt

SEQ ID NO: 6497110 - DNA, 18 bp, Homo sapiens
tggttgatgtttaaagag

SEQ ID NO: 6497111 - DNA, 19 bp, Homo sapiens
tggttgatttgtaacacag

SEQ ID NO: 6497112 - DNA, 20 bp, Homo sapiens
tggttgatttgtaacacagt

SEQ ID NO: 6497113 - DNA, 23 bp, Homo sapiens
tggttgcaattgtttaagaatca

SEQ ID NO: 6497114 - DNA, 22 bp, Homo sapiens
tggttgcactttagacattttt

SEQ ID NO: 6497115 - DNA, 23 bp, Homo sapiens
tggttgcagtctttcccccagga

SEQ ID NO: 6497116 - DNA, 17 bp, Homo sapiens
tggttgcataacagcag

SEQ ID NO: 6497117 - DNA, 23 bp, Homo sapiens
tggttgccagtagtaccttgttt

SEQ ID NO: 6497118 - DNA, 17 bp, Homo sapiens
tggttgcctcccccgcc

SEQ ID NO: 6497119 - DNA, 23 bp, Homo sapiens
tggttgcctctcttgccccttgt

SEQ ID NO: 6497120 - DNA, 17 bp, Homo sapiens
tggttgccttaaagaaa

SEQ ID NO: 6497121 - DNA, 17 bp, Homo sapiens
tggttgctgggcctcat

SEQ ID NO: 6497122 - DNA, 18 bp, Homo sapiens
tggttgctgggcctcatt

SEQ ID NO: 6497123 - DNA, 15 bp, Homo sapiens
tggttgctgtagaaa

SEQ ID NO: 6497124 - DNA, 18 bp, Homo sapiens
tggttgctttaatatcat

SEQ ID NO: 6497125 - DNA, 15 bp, Homo sapiens
tggttgctttgagcc

SEQ ID NO: 6497126 - DNA, 23 bp, Homo sapiens
tggttggaagctaccagagctct

SEQ ID NO: 6497127 - DNA, 16 bp, Homo sapiens
tggttggagaatttag

SEQ ID NO: 6497128 - DNA, 14 bp, Homo sapiens
tggttggagagccc

SEQ ID NO: 6497129 - DNA, 18 bp, Homo sapiens
tggttggagagccctgga

SEQ ID NO: 6497130 - DNA, 14 bp, Homo sapiens
tggttggaggcctg

SEQ ID NO: 6497131 - DNA, 15 bp, Homo sapiens
tggttggaggcctgg

SEQ ID NO: 6497132 - DNA, 16 bp, Homo sapiens
tggttggctggccttc

SEQ ID NO: 6497133 - DNA, 16 bp, Homo sapiens
tggttgggaatgagga

SEQ ID NO: 6497134 - DNA, 23 bp, Homo sapiens
tggttgggaatgaggaaaattct

SEQ ID NO: 6497135 - DNA, 18 bp, Homo sapiens
tggttgggaccaggccaa

SEQ ID NO: 6497136 - DNA, 23 bp, Homo sapiens
tggttgggacccagtggcagggc

SEQ ID NO: 6497137 - DNA, 16 bp, Homo sapiens
tggttgggctgtgcct

SEQ ID NO: 6497138 - DNA, 12 bp, Homo sapiens
tggttggggtgg

SEQ ID NO: 6497139 - DNA, 19 bp, Homo sapiens
tggttgggtggcaattcca

SEQ ID NO: 6497140 - DNA, 17 bp, Homo sapiens
tggttgggttgattgta

SEQ ID NO: 6497141 - DNA, 14 bp, Homo sapiens
tggttggtgtgaag

SEQ ID NO: 6497142 - DNA, 14 bp, Homo sapiens
tggttggttttata

SEQ ID NO: 6497143 - DNA, 17 bp, Homo sapiens
tggttggttttatttgt

SEQ ID NO: 6497144 - DNA, 16 bp, Homo sapiens
tggttggttttcttct

SEQ ID NO: 6497145 - DNA, 12 bp, Homo sapiens
tggttggttttt

SEQ ID NO: 6497146 - DNA, 15 bp, Homo sapiens
tggttggtttttaca

SEQ ID NO: 6497147 - DNA, 20 bp, Homo sapiens
tggttgtacgttttgcacat

SEQ ID NO: 6497148 - DNA, 13 bp, Homo sapiens
tggttgtatataa

SEQ ID NO: 6497149 - DNA, 14 bp, Homo sapiens
tggttgtatataaa

SEQ ID NO: 6497150 - DNA, 14 bp, Homo sapiens
tggttgtattagat

SEQ ID NO: 6497151 - DNA, 17 bp, Homo sapiens
tggttgtattctttgat

SEQ ID NO: 6497152 - DNA, 15 bp, Homo sapiens
tggttgtcaatatta

SEQ ID NO: 6497153 - DNA, 19 bp, Homo sapiens
tggttgtcatcactagtgg

SEQ ID NO: 6497154 - DNA, 19 bp, Homo sapiens
tggttgtgaaatgtaacat

SEQ ID NO: 6497155 - DNA, 20 bp, Homo sapiens
tggttgtgcacatgcttcag

SEQ ID NO: 6497156 - DNA, 12 bp, Homo sapiens
tggttgtgcctt

SEQ ID NO: 6497157 - DNA, 21 bp, Homo sapiens
tggttgtgccttcccttctct

SEQ ID NO: 6497158 - DNA, 13 bp, Homo sapiens
tggttgtgccttt

SEQ ID NO: 6497159 - DNA, 20 bp, Homo sapiens
tggttgtgtgtccccttgca

SEQ ID NO: 6497160 - DNA, 15 bp, Homo sapiens
tggttgtgttgaggt

SEQ ID NO: 6497161 - DNA, 22 bp, Homo sapiens
tggttgttagttatagatgtct

SEQ ID NO: 6497162 - DNA, 16 bp, Homo sapiens
tggttgttcctgcatc

SEQ ID NO: 6497163 - DNA, 15 bp, Homo sapiens
tggttgttgcatata

SEQ ID NO: 6497164 - DNA, 12 bp, Homo sapiens
tggttgttgcca

SEQ ID NO: 6497165 - DNA, 15 bp, Homo sapiens
tggttgttgccaggt

SEQ ID NO: 6497166 - DNA, 22 bp, Homo sapiens
tggttgttgccaggttgcagct

SEQ ID NO: 6497167 - DNA, 14 bp, Homo sapiens
tggttgtttctctg

SEQ ID NO: 6497168 - DNA, 20 bp, Homo sapiens
tggttgtttttgttctttgt

SEQ ID NO: 6497169 - DNA, 15 bp, Homo sapiens
tggtttaaaagaaaa

SEQ ID NO: 6497170 - DNA, 18 bp, Homo sapiens
tggtttaaaagaaaaaat

SEQ ID NO: 6497171 - DNA, 23 bp, Homo sapiens
tggtttaaaagacacacttgtcc

SEQ ID NO: 6497172 - DNA, 19 bp, Homo sapiens
tggtttaaagaaagtgtat

SEQ ID NO: 6497173 - DNA, 13 bp, Homo sapiens
tggtttaaataca

SEQ ID NO: 6497174 - DNA, 23 bp, Homo sapiens
tggtttaatgcaatagaagtgct

SEQ ID NO: 6497175 - DNA, 18 bp, Homo sapiens
tggtttaattatatttgc

SEQ ID NO: 6497176 - DNA, 15 bp, Homo sapiens
tggtttacagatgtt

SEQ ID NO: 6497177 - DNA, 20 bp, Homo sapiens
tggtttacaggccctgctcc

SEQ ID NO: 6497178 - DNA, 22 bp, Homo sapiens
tggtttacaggccctgctcctg

SEQ ID NO: 6497179 - DNA, 11 bp, Homo sapiens
tggtttacatt

SEQ ID NO: 6497180 - DNA, 23 bp, Homo sapiens
tggtttacatttaaagcattgct

SEQ ID NO: 6497181 - DNA, 22 bp, Homo sapiens
tggtttactcagggtctgatgt

SEQ ID NO: 6497182 - DNA, 14 bp, Homo sapiens
tggtttactgctgt

SEQ ID NO: 6497183 - DNA, 14 bp, Homo sapiens
tggtttactttcaa

SEQ ID NO: 6497184 - DNA, 23 bp, Homo sapiens
tggtttagcgttgttttgtggat

SEQ ID NO: 6497185 - DNA, 18 bp, Homo sapiens
tggtttagggttaagacg

SEQ ID NO: 6497186 - DNA, 14 bp, Homo sapiens
tggtttagtgtaaa

SEQ ID NO: 6497187 - DNA, 21 bp, Homo sapiens
tggtttagttataaaaggctt

SEQ ID NO: 6497188 - DNA, 17 bp, Homo sapiens
tggtttataataaactc

SEQ ID NO: 6497189 - DNA, 14 bp, Homo sapiens
tgatctttgagccc

SEQ ID NO: 6497190 - DNA, 16 bp, Homo sapiens
tgatctttgagcccat

SEQ ID NO: 6497191 - DNA, 13 bp, Homo sapiens
tgatctttgcaaa

SEQ ID NO: 6497192 - DNA, 23 bp, Homo sapiens
tgatctttgcagacaggcaagca

SEQ ID NO: 6497193 - DNA, 17 bp, Homo sapiens
tgatctttgggcatcag

SEQ ID NO: 6497194 - DNA, 15 bp, Homo sapiens
tgatctttgtttaaa

SEQ ID NO: 6497195 - DNA, 21 bp, Homo sapiens
tgatctttgtttaaatgccaa

SEQ ID NO: 6497196 - DNA, 16 bp, Homo sapiens
tgatctttttatacac

SEQ ID NO: 6497197 - DNA, 23 bp, Homo sapiens
tgatgaaaacaaaatcacagcac

SEQ ID NO: 6497198 - DNA, 16 bp, Homo sapiens
tgatgaaaagctttgt

SEQ ID NO: 6497199 - DNA, 23 bp, Homo sapiens
tgatgaaaagctttgtttgttct

SEQ ID NO: 6497200 - DNA, 16 bp, Homo sapiens
tgatgaaaataaagaa

SEQ ID NO: 6497201 - DNA, 19 bp, Homo sapiens
tgatgaaaataaagaatgg

SEQ ID NO: 6497202 - DNA, 15 bp, Homo sapiens
tgatgaaaataataa

SEQ ID NO: 6497203 - DNA, 17 bp, Homo sapiens
tgatgaaaataattttc

SEQ ID NO: 6497204 - DNA, 15 bp, Homo sapiens
tgatgaaaccttgaa

SEQ ID NO: 6497205 - DNA, 11 bp, Homo sapiens
tgatgaaagct

SEQ ID NO: 6497206 - DNA, 18 bp, Homo sapiens
tgatgaaagctttggcga

SEQ ID NO: 6497207 - DNA, 22 bp, Homo sapiens
tgatgaaatctgctagaaagtt

SEQ ID NO: 6497208 - DNA, 22 bp, Homo sapiens
tgatgaaatgaggtcagagcct

SEQ ID NO: 6497209 - DNA, 15 bp, Homo sapiens
tgatgaactttctct

SEQ ID NO: 6497210 - DNA, 15 bp, Homo sapiens
tgatgaagaaattta

SEQ ID NO: 6497211 - DNA, 17 bp, Homo sapiens
tgatgaagaagttgata

SEQ ID NO: 6497212 - DNA, 13 bp, Homo sapiens
tgatgaagaggag

SEQ ID NO: 6497213 - DNA, 23 bp, Homo sapiens
tgatgaagcaaggaagatataca

SEQ ID NO: 6497214 - DNA, 17 bp, Homo sapiens
tgatgaagctgaggctg

SEQ ID NO: 6497215 - DNA, 21 bp, Homo sapiens
tgatgaagctgaggctgctgc

SEQ ID NO: 6497216 - DNA, 17 bp, Homo sapiens
tgatgaataaaatgttt

SEQ ID NO: 6497217 - DNA, 16 bp, Homo sapiens
tgatgaataaacactt

SEQ ID NO: 6497218 - DNA, 22 bp, Homo sapiens
tgatgaataaacactttttctg

SEQ ID NO: 6497219 - DNA, 14 bp, Homo sapiens
tgatgaatactgta

SEQ ID NO: 6497220 - DNA, 16 bp, Homo sapiens
tgatgaatctacattt

SEQ ID NO: 6497221 - DNA, 17 bp, Homo sapiens
tgatgaatctacatttg

SEQ ID NO: 6497222 - DNA, 13 bp, Homo sapiens
tgatgaatcttgc

SEQ ID NO: 6497223 - DNA, 18 bp, Homo sapiens
tgatgaatgacaacattg

SEQ ID NO: 6497224 - DNA, 17 bp, Homo sapiens
tgatgaatgtactatgt

SEQ ID NO: 6497225 - DNA, 15 bp, Homo sapiens
tgatgaattcttcct

SEQ ID NO: 6497226 - DNA, 16 bp, Homo sapiens
tgatgaattcttcctc

SEQ ID NO: 6497227 - DNA, 20 bp, Homo sapiens
tgatgaattcttcctctcct

SEQ ID NO: 6497228 - DNA, 23 bp, Homo sapiens
tgatgaattcttcctctccttcc

SEQ ID NO: 6497229 - DNA, 24 bp, Homo sapiens
tgatgaattcttcctctccttccc

SEQ ID NO: 6497230 - DNA, 22 bp, Homo sapiens
tgatgaatttaccatcaaacaa

SEQ ID NO: 6497231 - DNA, 22 bp, Homo sapiens
tgatgaatttggtctgcctctg

SEQ ID NO: 6497232 - DNA, 18 bp, Homo sapiens
tgatgacaaaaaatgttt

SEQ ID NO: 6497233 - DNA, 20 bp, Homo sapiens
tgatgacaactacagaaaaa

SEQ ID NO: 6497234 - DNA, 17 bp, Homo sapiens
tgatgacaataaagctt

SEQ ID NO: 6497235 - DNA, 13 bp, Homo sapiens
tgatgacaatcaa

SEQ ID NO: 6497236 - DNA, 14 bp, Homo sapiens
tgatgacagacact

SEQ ID NO: 6497237 - DNA, 15 bp, Homo sapiens
tgatgaccaatctct

SEQ ID NO: 6497238 - DNA, 19 bp, Homo sapiens
tgatgaccaatctctgtga

SEQ ID NO: 6497239 - DNA, 16 bp, Homo sapiens
tgatgaccaattttaa

SEQ ID NO: 6497240 - DNA, 14 bp, Homo sapiens
tgatgacccactaa

SEQ ID NO: 6497241 - DNA, 18 bp, Homo sapiens
tgatgacccactaaagag

SEQ ID NO: 6497242 - DNA, 15 bp, Homo sapiens
tgatgacccaggctg

SEQ ID NO: 6497243 - DNA, 18 bp, Homo sapiens
tgatgacgggatgctctt

SEQ ID NO: 6497244 - DNA, 20 bp, Homo sapiens
tgatgacgggatgctcttta

SEQ ID NO: 6497245 - DNA, 14 bp, Homo sapiens
tgatgactcaagat

SEQ ID NO: 6497246 - DNA, 17 bp, Homo sapiens
tgatgactcgaaactga

SEQ ID NO: 6497247 - DNA, 15 bp, Homo sapiens
tgatgactcttctta

SEQ ID NO: 6497248 - DNA, 19 bp, Homo sapiens
tgatgactcttcttatcac

SEQ ID NO: 6497249 - DNA, 22 bp, Homo sapiens
tgatgactcttcttatcacact

SEQ ID NO: 6497250 - DNA, 16 bp, Homo sapiens
tgatgactggttgttc

SEQ ID NO: 6497251 - DNA, 19 bp, Homo sapiens
tgatgactggttgttcaaa

SEQ ID NO: 6497252 - DNA, 21 bp, Homo sapiens
tgatgacttagtacaaagttt

SEQ ID NO: 6497253 - DNA, 15 bp, Homo sapiens
tgatgacttgagccc

SEQ ID NO: 6497254 - DNA, 15 bp, Homo sapiens
tgatgacttgctgtc

SEQ ID NO: 6497255 - DNA, 19 bp, Homo sapiens
tgatgacttgctgtccagg

SEQ ID NO: 6497256 - DNA, 23 bp, Homo sapiens
tgatgactttctttttgtagctg

SEQ ID NO: 6497257 - DNA, 22 bp, Homo sapiens
tgatgagaattgtatgtcatgt

SEQ ID NO: 6497258 - DNA, 17 bp, Homo sapiens
tgatgagagaatgtgga

SEQ ID NO: 6497259 - DNA, 14 bp, Homo sapiens
tgatgagaggaaat

SEQ ID NO: 6497260 - DNA, 15 bp, Homo sapiens
tgatgagaggccagc

SEQ ID NO: 6497261 - DNA, 16 bp, Homo sapiens
tgatgagcatttagca

SEQ ID NO: 6497262 - DNA, 19 bp, Homo sapiens
tgatgagctgtgcacaaag

SEQ ID NO: 6497263 - DNA, 13 bp, Homo sapiens
tgatgaggaccca

SEQ ID NO: 6497264 - DNA, 14 bp, Homo sapiens
tgatgaggcatttt

SEQ ID NO: 6497265 - DNA, 14 bp, Homo sapiens
tgatgaggccctcc

SEQ ID NO: 6497266 - DNA, 17 bp, Homo sapiens
tgatgaggccctccaca

SEQ ID NO: 6497267 - DNA, 23 bp, Homo sapiens
tgatgaggccctccacacctgcg

SEQ ID NO: 6497268 - DNA, 22 bp, Homo sapiens
tgatgaggcctcttggacctct

SEQ ID NO: 6497269 - DNA, 12 bp, Homo sapiens
tgatgaggctgg

SEQ ID NO: 6497270 - DNA, 19 bp, Homo sapiens
tgatgagggcagcagccag

SEQ ID NO: 6497271 - DNA, 16 bp, Homo sapiens
tgatgaggtatttttt

SEQ ID NO: 6497272 - DNA, 19 bp, Homo sapiens
tgatgaggtattttttcct

SEQ ID NO: 6497273 - DNA, 18 bp, Homo sapiens
tgatgagtgtaacaagaa

SEQ ID NO: 6497274 - DNA, 20 bp, Homo sapiens
tgatgagttgatttataaag

SEQ ID NO: 6497275 - DNA, 13 bp, Homo sapiens
tgatgagttgtga

SEQ ID NO: 6497276 - DNA, 13 bp, Homo sapiens
tgatgatcaaaac

SEQ ID NO: 6497277 - DNA, 16 bp, Homo sapiens
tgatgatcactgtgaa

SEQ ID NO: 6497278 - DNA, 20 bp, Homo sapiens
tgatgatcctaggcatttgc

SEQ ID NO: 6497279 - DNA, 22 bp, Homo sapiens
tgatgatctttgcagacaggca

SEQ ID NO: 6497280 - DNA, 20 bp, Homo sapiens
tgatgatgaaatgaggtcag

SEQ ID NO: 6497281 - DNA, 13 bp, Homo sapiens
tgatgatgaccaa

SEQ ID NO: 6497282 - DNA, 16 bp, Homo sapiens
tgatgatgaccaagaa

SEQ ID NO: 6497283 - DNA, 16 bp, Homo sapiens
tgatgatgataataat

SEQ ID NO: 6497284 - DNA, 14 bp, Homo sapiens
tgatgatgatgatt

SEQ ID NO: 6497285 - DNA, 14 bp, Homo sapiens
tgatgatgcatgga

SEQ ID NO: 6497286 - DNA, 15 bp, Homo sapiens
tgatgatgctgtgac

SEQ ID NO: 6497287 - DNA, 21 bp, Homo sapiens
tgatgatgggaattgtgtgat

SEQ ID NO: 6497288 - DNA, 23 bp, Homo sapiens
tgatgatggggtgggagactttc

SEQ ID NO: 6497289 - DNA, 18 bp, Homo sapiens
tgatgatgtctacagaaa

SEQ ID NO: 6497290 - DNA, 19 bp, Homo sapiens
tgatgatgtctcttgtaga

SEQ ID NO: 6497291 - DNA, 21 bp, Homo sapiens
tgatgatgtctcttgtagaag

SEQ ID NO: 6497292 - DNA, 17 bp, Homo sapiens
tgatgatgtcttctggt

SEQ ID NO: 6497293 - DNA, 20 bp, Homo sapiens
tgatgatgtcttctggtgtc

SEQ ID NO: 6497294 - DNA, 16 bp, Homo sapiens
tgatgatgtgcctggg

SEQ ID NO: 6497295 - DNA, 12 bp, Homo sapiens
tgatgatgtgtt

SEQ ID NO: 6497296 - DNA, 13 bp, Homo sapiens
tgatgatgttaaa

SEQ ID NO: 6497297 - DNA, 14 bp, Homo sapiens
tgatgatgttaacc

SEQ ID NO: 6497298 - DNA, 16 bp, Homo sapiens
tgatgatgttgtaaaa

SEQ ID NO: 6497299 - DNA, 15 bp, Homo sapiens
tgatgattaaacacc

SEQ ID NO: 6497300 - DNA, 21 bp, Homo sapiens
tgatgattaaacacctgacac

SEQ ID NO: 6497301 - DNA, 16 bp, Homo sapiens
tgatgattgcttccac

SEQ ID NO: 6497302 - DNA, 14 bp, Homo sapiens
tgatgatttggggg

SEQ ID NO: 6497303 - DNA, 17 bp, Homo sapiens
tgatgattttaacagtt

SEQ ID NO: 6497304 - DNA, 17 bp, Homo sapiens
tgatgattttcatttca

SEQ ID NO: 6497305 - DNA, 21 bp, Homo sapiens
tgatgattttcatttcatgaa

SEQ ID NO: 6497306 - DNA, 13 bp, Homo sapiens
tgatgattttcct

SEQ ID NO: 6497307 - DNA, 14 bp, Homo sapiens
tgatgattttcctt

SEQ ID NO: 6497308 - DNA, 15 bp, Homo sapiens
tgatgattttgtaat

SEQ ID NO: 6497309 - DNA, 22 bp, Homo sapiens
tgatgattttgtaattcttatg

SEQ ID NO: 6497310 - DNA, 13 bp, Homo sapiens
tgatgcaaatctg

SEQ ID NO: 6497311 - DNA, 20 bp, Homo sapiens
tgatgcaaatgctcaaaacc

SEQ ID NO: 6497312 - DNA, 14 bp, Homo sapiens
tgatgcaaccaaaa

SEQ ID NO: 6497313 - DNA, 15 bp, Homo sapiens
tgatgcaagccagct

SEQ ID NO: 6497314 - DNA, 16 bp, Homo sapiens
tgatgcaaggattaca

SEQ ID NO: 6497315 - DNA, 22 bp, Homo sapiens
tgatgcaaggattacagaaact

SEQ ID NO: 6497316 - DNA, 23 bp, Homo sapiens
tgatgcaaggattacagaaactg

SEQ ID NO: 6497317 - DNA, 20 bp, Homo sapiens
tgatgcacagagaagctggg

SEQ ID NO: 6497318 - DNA, 16 bp, Homo sapiens
tgatgcacagtatctg

SEQ ID NO: 6497319 - DNA, 21 bp, Homo sapiens
tgatgcacagtatctgctgtt

SEQ ID NO: 6497320 - DNA, 12 bp, Homo sapiens
tgatgcagacac

SEQ ID NO: 6497321 - DNA, 18 bp, Homo sapiens
tgatgcagataaaatatt

SEQ ID NO: 6497322 - DNA, 12 bp, Homo sapiens
tgatgcagcatt

SEQ ID NO: 6497323 - DNA, 18 bp, Homo sapiens
tgatgcagcatttgataa

SEQ ID NO: 6497324 - DNA, 19 bp, Homo sapiens
tgatgcagctgttgagaaa

SEQ ID NO: 6497325 - DNA, 22 bp, Homo sapiens
tgatgcaggatttgttctctgt

SEQ ID NO: 6497326 - DNA, 21 bp, Homo sapiens
tgatgcaggcacttattgtaa

SEQ ID NO: 6497327 - DNA, 21 bp, Homo sapiens
tgatgcagtctcctctttaaa

SEQ ID NO: 6497328 - DNA, 22 bp, Homo sapiens
tgatgcatacagttttctagca

SEQ ID NO: 6497329 - DNA, 21 bp, Homo sapiens
tgatgcatcagaaagggaggg

SEQ ID NO: 6497330 - DNA, 22 bp, Homo sapiens
tgatgcatcgttttctttgctg

SEQ ID NO: 6497331 - DNA, 15 bp, Homo sapiens
tgatgcatgagctcc

SEQ ID NO: 6497332 - DNA, 17 bp, Homo sapiens
tgatgcatgagctccct

SEQ ID NO: 6497333 - DNA, 17 bp, Homo sapiens
tgatgcatgctttgaga

SEQ ID NO: 6497334 - DNA, 16 bp, Homo sapiens
tgatgcatgtctttta

SEQ ID NO: 6497335 - DNA, 11 bp, Homo sapiens
tgatgcatgtg

SEQ ID NO: 6497336 - DNA, 19 bp, Homo sapiens
tgatgcattaaaagaaaat

SEQ ID NO: 6497337 - DNA, 21 bp, Homo sapiens
tgatgcattaattaatggctt

SEQ ID NO: 6497338 - DNA, 24 bp, Homo sapiens
tgatgcattcccggtgcagaacag

SEQ ID NO: 6497339 - DNA, 11 bp, Homo sapiens
tgatgcatttt

SEQ ID NO: 6497340 - DNA, 18 bp, Homo sapiens
tgatgccaaaaaaaaata

SEQ ID NO: 6497341 - DNA, 17 bp, Homo sapiens
tgatgccaaagatgttt

SEQ ID NO: 6497342 - DNA, 15 bp, Homo sapiens
tgatgccaaagctgc

SEQ ID NO: 6497343 - DNA, 16 bp, Homo sapiens
tgatgccaaagctgct

SEQ ID NO: 6497344 - DNA, 18 bp, Homo sapiens
tgatgccaaagctgcttt

SEQ ID NO: 6497345 - DNA, 21 bp, Homo sapiens
tgatgccaaagctgctttctt

SEQ ID NO: 6497346 - DNA, 14 bp, Homo sapiens
tgatgccaagcttt

SEQ ID NO: 6497347 - DNA, 16 bp, Homo sapiens
tgatgccaaggggctg

SEQ ID NO: 6497348 - DNA, 22 bp, Homo sapiens
tgatgccaatactagtcacccc

SEQ ID NO: 6497349 - DNA, 23 bp, Homo sapiens
tgatgccacaccaagctgtgcca

SEQ ID NO: 6497350 - DNA, 21 bp, Homo sapiens
tgatgccaccttcagatcctt

SEQ ID NO: 6497351 - DNA, 14 bp, Homo sapiens
tgatgccagagggc

SEQ ID NO: 6497352 - DNA, 16 bp, Homo sapiens
tgatgccagagggcca

SEQ ID NO: 6497353 - DNA, 17 bp, Homo sapiens
tgatgccagagggccag

SEQ ID NO: 6497354 - DNA, 15 bp, Homo sapiens
tgatgccagctgtct

SEQ ID NO: 6497355 - DNA, 19 bp, Homo sapiens
tgatgccaggttctatttg

SEQ ID NO: 6497356 - DNA, 14 bp, Homo sapiens
tgatgccatgagga

SEQ ID NO: 6497357 - DNA, 23 bp, Homo sapiens
tgatgccatgtttagattccagg

SEQ ID NO: 6497358 - DNA, 14 bp, Homo sapiens
tgatgccatttgtc

SEQ ID NO: 6497359 - DNA, 14 bp, Homo sapiens
tgatgccccttccc

SEQ ID NO: 6497360 - DNA, 23 bp, Homo sapiens
tgatgccctcccctcagcgcagg

SEQ ID NO: 6497361 - DNA, 14 bp, Homo sapiens
tgatgccctcttct

SEQ ID NO: 6497362 - DNA, 21 bp, Homo sapiens
tgatgccgggcgccaggacag

SEQ ID NO: 6497363 - DNA, 15 bp, Homo sapiens
tgatgccgtgatcct

SEQ ID NO: 6497364 - DNA, 22 bp, Homo sapiens
tgatgcctcccggctttgcagg

SEQ ID NO: 6497365 - DNA, 21 bp, Homo sapiens
tgatgcctctgtcttctggac

SEQ ID NO: 6497366 - DNA, 22 bp, Homo sapiens
tgatgcctgcccgcaccctggc

SEQ ID NO: 6497367 - DNA, 12 bp, Homo sapiens
tggtttataatc

SEQ ID NO: 6497368 - DNA, 24 bp, Homo sapiens
tggtttataatttgatagatgttt

SEQ ID NO: 6497369 - DNA, 13 bp, Homo sapiens
tggtttatatttt

SEQ ID NO: 6497370 - DNA, 20 bp, Homo sapiens
tggtttatattttttcagtt

SEQ ID NO: 6497371 - DNA, 21 bp, Homo sapiens
tggtttatgagaactggttct

SEQ ID NO: 6497372 - DNA, 16 bp, Homo sapiens
tggtttattctttgca

SEQ ID NO: 6497373 - DNA, 14 bp, Homo sapiens
tggtttattttcac

SEQ ID NO: 6497374 - DNA, 18 bp, Homo sapiens
tggtttatttttgtaatg

SEQ ID NO: 6497375 - DNA, 16 bp, Homo sapiens
tggtttcaaactcctg

SEQ ID NO: 6497376 - DNA, 17 bp, Homo sapiens
tggtttcacagataaca

SEQ ID NO: 6497377 - DNA, 21 bp, Homo sapiens
tggtttcacggtgccaggttt

SEQ ID NO: 6497378 - DNA, 14 bp, Homo sapiens
tggtttcagaaagg

SEQ ID NO: 6497379 - DNA, 22 bp, Homo sapiens
tggtttcagaaagggcagcccc

SEQ ID NO: 6497380 - DNA, 14 bp, Homo sapiens
tggtttcagaaatg

SEQ ID NO: 6497381 - DNA, 15 bp, Homo sapiens
tggtttcagaaatgt

SEQ ID NO: 6497382 - DNA, 20 bp, Homo sapiens
tggtttcagcactagccaaa

SEQ ID NO: 6497383 - DNA, 13 bp, Homo sapiens
tggtttcagccaa

SEQ ID NO: 6497384 - DNA, 12 bp, Homo sapiens
tggtttcatgtt

SEQ ID NO: 6497385 - DNA, 17 bp, Homo sapiens
tggtttccaaggagctg

SEQ ID NO: 6497386 - DNA, 22 bp, Homo sapiens
tggtttccaaggagctgagaat

SEQ ID NO: 6497387 - DNA, 18 bp, Homo sapiens
tggtttcccaagagctac

SEQ ID NO: 6497388 - DNA, 17 bp, Homo sapiens
tggtttcccccttctac

SEQ ID NO: 6497389 - DNA, 20 bp, Homo sapiens
tggtttcccccttctacatt

SEQ ID NO: 6497390 - DNA, 19 bp, Homo sapiens
tggtttcccctgcactccc

SEQ ID NO: 6497391 - DNA, 20 bp, Homo sapiens
tggtttcccctgcactcccg

SEQ ID NO: 6497392 - DNA, 19 bp, Homo sapiens
tggtttcctcgagaggcac

SEQ ID NO: 6497393 - DNA, 19 bp, Homo sapiens
tggtttcctggcagcctgc

SEQ ID NO: 6497394 - DNA, 13 bp, Homo sapiens
tggtttcctttct

SEQ ID NO: 6497395 - DNA, 15 bp, Homo sapiens
tggtttcctttctca

SEQ ID NO: 6497396 - DNA, 15 bp, Homo sapiens
tggtttcgaactcct

SEQ ID NO: 6497397 - DNA, 15 bp, Homo sapiens
tggtttcggaaaaaa

SEQ ID NO: 6497398 - DNA, 18 bp, Homo sapiens
tggtttctacttcccctg

SEQ ID NO: 6497399 - DNA, 21 bp, Homo sapiens
tggtttctacttcccctggga

SEQ ID NO: 6497400 - DNA, 18 bp, Homo sapiens
tggtttctcagaatccaa

SEQ ID NO: 6497401 - DNA, 12 bp, Homo sapiens
tggtttctccag

SEQ ID NO: 6497402 - DNA, 17 bp, Homo sapiens
tggtttctcctggtaga

SEQ ID NO: 6497403 - DNA, 19 bp, Homo sapiens
tggtttctgcgtgctttat

SEQ ID NO: 6497404 - DNA, 15 bp, Homo sapiens
tggtttctgcttctc

SEQ ID NO: 6497405 - DNA, 14 bp, Homo sapiens
tggtttctgtgtgt

SEQ ID NO: 6497406 - DNA, 18 bp, Homo sapiens
tggtttcttattcaaaga

SEQ ID NO: 6497407 - DNA, 18 bp, Homo sapiens
tggtttcttcattcttta

SEQ ID NO: 6497408 - DNA, 19 bp, Homo sapiens
tggtttgaaagattatgat

SEQ ID NO: 6497409 - DNA, 13 bp, Homo sapiens
tggtttgaaattt

SEQ ID NO: 6497410 - DNA, 20 bp, Homo sapiens
tggtttgacaattttgtctt

SEQ ID NO: 6497411 - DNA, 13 bp, Homo sapiens
tggtttgagattg

SEQ ID NO: 6497412 - DNA, 20 bp, Homo sapiens
tggtttgatggtgacttcct

SEQ ID NO: 6497413 - DNA, 18 bp, Homo sapiens
tggtttgatttctagtat

SEQ ID NO: 6497414 - DNA, 21 bp, Homo sapiens
tggtttgcaaagaccacctcc

SEQ ID NO: 6497415 - DNA, 12 bp, Homo sapiens
tggtttgcacaa

SEQ ID NO: 6497416 - DNA, 15 bp, Homo sapiens
tggtttgcacataaa

SEQ ID NO: 6497417 - DNA, 15 bp, Homo sapiens
tggtttgcagagctt

SEQ ID NO: 6497418 - DNA, 17 bp, Homo sapiens
tggtttgcagatgacaa

SEQ ID NO: 6497419 - DNA, 19 bp, Homo sapiens
tggtttgcagcgactggca

SEQ ID NO: 6497420 - DNA, 15 bp, Homo sapiens
tggtttgcagctgtt

SEQ ID NO: 6497421 - DNA, 24 bp, Homo sapiens
tggtttgcagctgttttcaaagcc

SEQ ID NO: 6497422 - DNA, 12 bp, Homo sapiens
tggtttgcatga

SEQ ID NO: 6497423 - DNA, 17 bp, Homo sapiens
tggtttgccatgtcgct

SEQ ID NO: 6497424 - DNA, 17 bp, Homo sapiens
tggtttgccttccagaa

SEQ ID NO: 6497425 - DNA, 19 bp, Homo sapiens
tggtttgccttttatgtaa

SEQ ID NO: 6497426 - DNA, 14 bp, Homo sapiens
tggtttgctacttc

SEQ ID NO: 6497427 - DNA, 14 bp, Homo sapiens
tggtttggaaaata

SEQ ID NO: 6497428 - DNA, 11 bp, Homo sapiens
tggtttggaat

SEQ ID NO: 6497429 - DNA, 17 bp, Homo sapiens
tggtttggaatattaaa

SEQ ID NO: 6497430 - DNA, 16 bp, Homo sapiens
tggtttggaatgcttc

SEQ ID NO: 6497431 - DNA, 22 bp, Homo sapiens
tggtttggaatgcttcttctca

SEQ ID NO: 6497432 - DNA, 20 bp, Homo sapiens
tggtttggcaagaacttgtt

SEQ ID NO: 6497433 - DNA, 20 bp, Homo sapiens
tggtttggcatggtgagtgt

SEQ ID NO: 6497434 - DNA, 21 bp, Homo sapiens
tggtttggcccttctcctttt

SEQ ID NO: 6497435 - DNA, 22 bp, Homo sapiens
tggtttggcccttctccttttg

SEQ ID NO: 6497436 - DNA, 13 bp, Homo sapiens
tggtttggcctcc

SEQ ID NO: 6497437 - DNA, 16 bp, Homo sapiens
tggtttgggaaagatg

SEQ ID NO: 6497438 - DNA, 23 bp, Homo sapiens
tggtttggggcgaggcagaggac

SEQ ID NO: 6497439 - DNA, 17 bp, Homo sapiens
tggtttgggggagaaga

SEQ ID NO: 6497440 - DNA, 18 bp, Homo sapiens
tggtttgggggcgccctc

SEQ ID NO: 6497441 - DNA, 17 bp, Homo sapiens
tggtttggttttggaaa

SEQ ID NO: 6497442 - DNA, 15 bp, Homo sapiens
tggtttgtaaattaa

SEQ ID NO: 6497443 - DNA, 20 bp, Homo sapiens
tggtttgtcatatattcatg

SEQ ID NO: 6497444 - DNA, 21 bp, Homo sapiens
tggtttgtcatatattcatgt

SEQ ID NO: 6497445 - DNA, 15 bp, Homo sapiens
tggtttgtgagcctt

SEQ ID NO: 6497446 - DNA, 20 bp, Homo sapiens
tggtttgtgtcaaaactggt

SEQ ID NO: 6497447 - DNA, 11 bp, Homo sapiens
tggtttgtgtg

SEQ ID NO: 6497448 - DNA, 15 bp, Homo sapiens
tggtttgtgtgatca

SEQ ID NO: 6497449 - DNA, 15 bp, Homo sapiens
tggtttgttccctgt

SEQ ID NO: 6497450 - DNA, 21 bp, Homo sapiens
tggtttgtttataatgttatc

SEQ ID NO: 6497451 - DNA, 16 bp, Homo sapiens
tggtttgtttgcttaa

SEQ ID NO: 6497452 - DNA, 14 bp, Homo sapiens
tggttttaaaatac

SEQ ID NO: 6497453 - DNA, 21 bp, Homo sapiens
tggttttaaaatactgtagat

SEQ ID NO: 6497454 - DNA, 12 bp, Homo sapiens
tggttttaagaa

SEQ ID NO: 6497455 - DNA, 17 bp, Homo sapiens
tggttttaattgaagga

SEQ ID NO: 6497456 - DNA, 20 bp, Homo sapiens
tggttttaattgaaggaaag

SEQ ID NO: 6497457 - DNA, 21 bp, Homo sapiens
tggttttaattgaaggaaaga

SEQ ID NO: 6497458 - DNA, 17 bp, Homo sapiens
tggttttacacagagaa

SEQ ID NO: 6497459 - DNA, 14 bp, Homo sapiens
tggttttagatttt

SEQ ID NO: 6497460 - DNA, 21 bp, Homo sapiens
tggttttaggatacttaacaa

SEQ ID NO: 6497461 - DNA, 18 bp, Homo sapiens
tggttttataactatata

SEQ ID NO: 6497462 - DNA, 12 bp, Homo sapiens
tggttttatgat

SEQ ID NO: 6497463 - DNA, 15 bp, Homo sapiens
tggttttatgatgac

SEQ ID NO: 6497464 - DNA, 17 bp, Homo sapiens
tggttttattacaaatg

SEQ ID NO: 6497465 - DNA, 15 bp, Homo sapiens
tggttttcaaaataa

SEQ ID NO: 6497466 - DNA, 14 bp, Homo sapiens
tggttttccagagg

SEQ ID NO: 6497467 - DNA, 22 bp, Homo sapiens
tggttttcccctccctgggttc

SEQ ID NO: 6497468 - DNA, 22 bp, Homo sapiens
tggttttcctaaatgcagtgaa

SEQ ID NO: 6497469 - DNA, 14 bp, Homo sapiens
tggttttcctgaaa

SEQ ID NO: 6497470 - DNA, 13 bp, Homo sapiens
tggttttcctgtg

SEQ ID NO: 6497471 - DNA, 20 bp, Homo sapiens
tggttttctccaagagctac

SEQ ID NO: 6497472 - DNA, 16 bp, Homo sapiens
tggttttctctctgga

SEQ ID NO: 6497473 - DNA, 13 bp, Homo sapiens
tggttttctctga

SEQ ID NO: 6497474 - DNA, 13 bp, Homo sapiens
tggttttctgcca

SEQ ID NO: 6497475 - DNA, 20 bp, Homo sapiens
tggttttctggtggggctgt

SEQ ID NO: 6497476 - DNA, 13 bp, Homo sapiens
tggttttctgttc

SEQ ID NO: 6497477 - DNA, 21 bp, Homo sapiens
tggttttcttcttctcgtcct

SEQ ID NO: 6497478 - DNA, 21 bp, Homo sapiens
tggttttcttgccaccctctg

SEQ ID NO: 6497479 - DNA, 19 bp, Homo sapiens
tggttttcttttgccatga

SEQ ID NO: 6497480 - DNA, 18 bp, Homo sapiens
tggttttgaaatgtttcc

SEQ ID NO: 6497481 - DNA, 23 bp, Homo sapiens
tggttttgaatattaagctaaaa

SEQ ID NO: 6497482 - DNA, 19 bp, Homo sapiens
tggttttgatggctgggtc

SEQ ID NO: 6497483 - DNA, 17 bp, Homo sapiens
tggttttgcctctttaa

SEQ ID NO: 6497484 - DNA, 21 bp, Homo sapiens
tggttttgcctctttaaatta

SEQ ID NO: 6497485 - DNA, 11 bp, Homo sapiens
tggttttggaa

SEQ ID NO: 6497486 - DNA, 21 bp, Homo sapiens
tggttttgggaaaaattattt

SEQ ID NO: 6497487 - DNA, 19 bp, Homo sapiens
tggttttggggaaatgtgg

SEQ ID NO: 6497488 - DNA, 19 bp, Homo sapiens
tggttttgtacactgctgt

SEQ ID NO: 6497489 - DNA, 16 bp, Homo sapiens
tggttttgtgccatct

SEQ ID NO: 6497490 - DNA, 22 bp, Homo sapiens
tggttttgtgccatctgtagct

SEQ ID NO: 6497491 - DNA, 22 bp, Homo sapiens
tggttttgttttcaatgaatta

SEQ ID NO: 6497492 - DNA, 20 bp, Homo sapiens
tggtttttaaattttgtaat

SEQ ID NO: 6497493 - DNA, 15 bp, Homo sapiens
tggtttttacattca

SEQ ID NO: 6497494 - DNA, 12 bp, Homo sapiens
tggtttttactc

SEQ ID NO: 6497495 - DNA, 21 bp, Homo sapiens
tggtttttactgctctgagaa

SEQ ID NO: 6497496 - DNA, 13 bp, Homo sapiens
tggtttttatatt

SEQ ID NO: 6497497 - DNA, 15 bp, Homo sapiens
tggtttttatatttt

SEQ ID NO: 6497498 - DNA, 14 bp, Homo sapiens
tggtttttgttgag

SEQ ID NO: 6497499 - DNA, 22 bp, Homo sapiens
tggttttttaggtggagagaca

SEQ ID NO: 6497500 - DNA, 10 bp, Homo sapiens
tggttttttt

SEQ ID NO: 6497501 - DNA, 23 bp, Homo sapiens
tgtaaaaaaaccaccaaaaacaa

SEQ ID NO: 6497502 - DNA, 14 bp, Homo sapiens
tgtaaaaaaagcaa

SEQ ID NO: 6497503 - DNA, 23 bp, Homo sapiens
tgtaaaaaaagcaaaaatgacaa

SEQ ID NO: 6497504 - DNA, 15 bp, Homo sapiens
tgtaaaaaacaaaaa

SEQ ID NO: 6497505 - DNA, 16 bp, Homo sapiens
tgtaaaaaacaaaaaa

SEQ ID NO: 6497506 - DNA, 14 bp, Homo sapiens
tgtaaaaaagaaaa

SEQ ID NO: 6497507 - DNA, 15 bp, Homo sapiens
tgtaaaaaagtgttc

SEQ ID NO: 6497508 - DNA, 12 bp, Homo sapiens
tgtaaaaaatac

SEQ ID NO: 6497509 - DNA, 16 bp, Homo sapiens
tgtaaaaaatggagct

SEQ ID NO: 6497510 - DNA, 19 bp, Homo sapiens
tgtaaaaaatggagctcag

SEQ ID NO: 6497511 - DNA, 19 bp, Homo sapiens
tgtaaaaacacaaatgtgt

SEQ ID NO: 6497512 - DNA, 20 bp, Homo sapiens
tgtaaaaacacaaatgtgta

SEQ ID NO: 6497513 - DNA, 22 bp, Homo sapiens
tgtaaaaacacaaatgtgtact

SEQ ID NO: 6497514 - DNA, 16 bp, Homo sapiens
tgtaaaaacactgaaa

SEQ ID NO: 6497515 - DNA, 24 bp, Homo sapiens
tgtaaaaacagcattgctttctga

SEQ ID NO: 6497516 - DNA, 16 bp, Homo sapiens
tgtaaaaactgaagaa

SEQ ID NO: 6497517 - DNA, 12 bp, Homo sapiens
tgtaaaaacttt

SEQ ID NO: 6497518 - DNA, 12 bp, Homo sapiens
tgtaaaaagaaa

SEQ ID NO: 6497519 - DNA, 20 bp, Homo sapiens
tgtaaaaagaaattgtgaaa

SEQ ID NO: 6497520 - DNA, 12 bp, Homo sapiens
tgtaaaaagaca

SEQ ID NO: 6497521 - DNA, 16 bp, Homo sapiens
tgtaaaaagcctcctt

SEQ ID NO: 6497522 - DNA, 12 bp, Homo sapiens
tgtaaaaaggga

SEQ ID NO: 6497523 - DNA, 17 bp, Homo sapiens
tgtaaaaagggaaaaag

SEQ ID NO: 6497524 - DNA, 16 bp, Homo sapiens
tgtaaaaaggggagga

SEQ ID NO: 6497525 - DNA, 15 bp, Homo sapiens
tgtaaaaatactgtt

SEQ ID NO: 6497526 - DNA, 18 bp, Homo sapiens
tgtaaaaatagcaaaata

SEQ ID NO: 6497527 - DNA, 23 bp, Homo sapiens
tgtaaaaatatactgattttgaa

SEQ ID NO: 6497528 - DNA, 12 bp, Homo sapiens
tgtaaaaatatg

SEQ ID NO: 6497529 - DNA, 23 bp, Homo sapiens
tgtaaaaatcttttgaagcatag

SEQ ID NO: 6497530 - DNA, 13 bp, Homo sapiens
tgtaaaaatgtta

SEQ ID NO: 6497531 - DNA, 14 bp, Homo sapiens
tgtaaaaattcaga

SEQ ID NO: 6497532 - DNA, 16 bp, Homo sapiens
tgtaaaacaaaaaaca

SEQ ID NO: 6497533 - DNA, 18 bp, Homo sapiens
tgtaaaacaagaaatgct

SEQ ID NO: 6497534 - DNA, 12 bp, Homo sapiens
tgtaaaacaggt

SEQ ID NO: 6497535 - DNA, 22 bp, Homo sapiens
tgtaaaacaggtagaattatct

SEQ ID NO: 6497536 - DNA, 18 bp, Homo sapiens
tgtaaaaccaactaaata

SEQ ID NO: 6497537 - DNA, 15 bp, Homo sapiens
tgtaaaaccaggctg

SEQ ID NO: 6497538 - DNA, 16 bp, Homo sapiens
tgtaaaactgaggcac

SEQ ID NO: 6497539 - DNA, 14 bp, Homo sapiens
tgtaaaactgtgac

SEQ ID NO: 6497540 - DNA, 15 bp, Homo sapiens
tgtaaaactgtgaca

SEQ ID NO: 6497541 - DNA, 19 bp, Homo sapiens
tgtaaaactgtgacattcc

SEQ ID NO: 6497542 - DNA, 13 bp, Homo sapiens
tgtaaaacttctg

SEQ ID NO: 6497543 - DNA, 16 bp, Homo sapiens
tgtaaaacttctgctc

SEQ ID NO: 6497544 - DNA, 12 bp, Homo sapiens
tgtaaaagaaat

SEQ ID NO: 6497545 - DNA, 15 bp, Homo sapiens
tgtaaaagacactgg

SEQ ID NO: 6497546 - DNA, 18 bp, Homo sapiens
tgtaaaagacactggtgt

SEQ ID NO: 6497547 - DNA, 13 bp, Homo sapiens
tgtaaaagagctg

SEQ ID NO: 6497548 - DNA, 15 bp, Homo sapiens
tgatgcctgtgaact

SEQ ID NO: 6497549 - DNA, 21 bp, Homo sapiens
tgatgcgaaaacttgaatctg

SEQ ID NO: 6497550 - DNA, 16 bp, Homo sapiens
tgatgcgcagttgctg

SEQ ID NO: 6497551 - DNA, 18 bp, Homo sapiens
tgatgcgcttcaaagtgg

SEQ ID NO: 6497552 - DNA, 18 bp, Homo sapiens
tgatgcgtctacccagac

SEQ ID NO: 6497553 - DNA, 20 bp, Homo sapiens
tgatgcgtctacccagactc

SEQ ID NO: 6497554 - DNA, 16 bp, Homo sapiens
tgatgctaaataggag

SEQ ID NO: 6497555 - DNA, 15 bp, Homo sapiens
tgatgctaagtgatg

SEQ ID NO: 6497556 - DNA, 20 bp, Homo sapiens
tgatgctacaggatttgaaa

SEQ ID NO: 6497557 - DNA, 23 bp, Homo sapiens
tgatgctacaggatttgaaattg

SEQ ID NO: 6497558 - DNA, 16 bp, Homo sapiens
tgatgctaggttgttt

SEQ ID NO: 6497559 - DNA, 15 bp, Homo sapiens
tgatgctatttatgc

SEQ ID NO: 6497560 - DNA, 13 bp, Homo sapiens
tgatgctatttgc

SEQ ID NO: 6497561 - DNA, 20 bp, Homo sapiens
tgatgctatttgcaattcct

SEQ ID NO: 6497562 - DNA, 11 bp, Homo sapiens
tgatgctcagt

SEQ ID NO: 6497563 - DNA, 13 bp, Homo sapiens
tgatgctcatggt

SEQ ID NO: 6497564 - DNA, 16 bp, Homo sapiens
tgatgctcccaagcaa

SEQ ID NO: 6497565 - DNA, 15 bp, Homo sapiens
tgatgctccctcccc

SEQ ID NO: 6497566 - DNA, 17 bp, Homo sapiens
tgatgctccctcccctg

SEQ ID NO: 6497567 - DNA, 21 bp, Homo sapiens
tgatgctccctcccctgccct

SEQ ID NO: 6497568 - DNA, 23 bp, Homo sapiens
tgatgctccctcccctgccctgg

SEQ ID NO: 6497569 - DNA, 20 bp, Homo sapiens
tgatgctcccttgatggggt

SEQ ID NO: 6497570 - DNA, 21 bp, Homo sapiens
tgatgctcctccgggtctgcg

SEQ ID NO: 6497571 - DNA, 21 bp, Homo sapiens
tgatgctctggcttgccccag

SEQ ID NO: 6497572 - DNA, 15 bp, Homo sapiens
tgatgctgacaccag

SEQ ID NO: 6497573 - DNA, 13 bp, Homo sapiens
tgatgctgagccc

SEQ ID NO: 6497574 - DNA, 16 bp, Homo sapiens
tgatgctgagtcatgc

SEQ ID NO: 6497575 - DNA, 13 bp, Homo sapiens
tgatgctgccccg

SEQ ID NO: 6497576 - DNA, 22 bp, Homo sapiens
tgatgctgccccgttccctgtc

SEQ ID NO: 6497577 - DNA, 16 bp, Homo sapiens
tgatgctggagaggtt

SEQ ID NO: 6497578 - DNA, 13 bp, Homo sapiens
tgatgctgggacc

SEQ ID NO: 6497579 - DNA, 18 bp, Homo sapiens
tgatgctgggctgggtgc

SEQ ID NO: 6497580 - DNA, 18 bp, Homo sapiens
tgatgctgttctcttctt

SEQ ID NO: 6497581 - DNA, 19 bp, Homo sapiens
tgatgcttactacagaaag

SEQ ID NO: 6497582 - DNA, 22 bp, Homo sapiens
tgatgcttataataaagaaaac

SEQ ID NO: 6497583 - DNA, 18 bp, Homo sapiens
tgatgcttcttcagagac

SEQ ID NO: 6497584 - DNA, 21 bp, Homo sapiens
tgatgcttcttcagagactcc

SEQ ID NO: 6497585 - DNA, 19 bp, Homo sapiens
tgatgcttgatattttcta

SEQ ID NO: 6497586 - DNA, 16 bp, Homo sapiens
tgatgctttgagaaca

SEQ ID NO: 6497587 - DNA, 21 bp, Homo sapiens
tgatgctttgagaacatactt

SEQ ID NO: 6497588 - DNA, 22 bp, Homo sapiens
tgatgctttggaagatgcagaa

SEQ ID NO: 6497589 - DNA, 11 bp, Homo sapiens
tgatgcttttg

SEQ ID NO: 6497590 - DNA, 12 bp, Homo sapiens
tgatgcttttgc

SEQ ID NO: 6497591 - DNA, 15 bp, Homo sapiens
tgatgcttttgctgc

SEQ ID NO: 6497592 - DNA, 18 bp, Homo sapiens
tgatgcttttgctgctgc

SEQ ID NO: 6497593 - DNA, 11 bp, Homo sapiens
tgatggaaaaa

SEQ ID NO: 6497594 - DNA, 21 bp, Homo sapiens
tgatggaaaaagaatatattg

SEQ ID NO: 6497595 - DNA, 13 bp, Homo sapiens
tgatggaaaataa

SEQ ID NO: 6497596 - DNA, 15 bp, Homo sapiens
tgatggaaaatacca

SEQ ID NO: 6497597 - DNA, 17 bp, Homo sapiens
tgatggaaacaaagtgg

SEQ ID NO: 6497598 - DNA, 23 bp, Homo sapiens
tgatggaaacaaagtggaaggaa

SEQ ID NO: 6497599 - DNA, 22 bp, Homo sapiens
tgatggaaacgcacttacaagt

SEQ ID NO: 6497600 - DNA, 19 bp, Homo sapiens
tgatggaagaaaatggaat

SEQ ID NO: 6497601 - DNA, 15 bp, Homo sapiens
tgatggaagggcctt

SEQ ID NO: 6497602 - DNA, 12 bp, Homo sapiens
tgatggaagtgg

SEQ ID NO: 6497603 - DNA, 19 bp, Homo sapiens
tgatggaatatcatgaatg

SEQ ID NO: 6497604 - DNA, 19 bp, Homo sapiens
tgatggaatgtgccacctg

SEQ ID NO: 6497605 - DNA, 20 bp, Homo sapiens
tgatggaatttttttgtacg

SEQ ID NO: 6497606 - DNA, 14 bp, Homo sapiens
tgatggaccaaagc

SEQ ID NO: 6497607 - DNA, 16 bp, Homo sapiens
tgatggaccaaagcca

SEQ ID NO: 6497608 - DNA, 18 bp, Homo sapiens
tgatggaccaaagccacc

SEQ ID NO: 6497609 - DNA, 19 bp, Homo sapiens
tgatggaccaaagccacct

SEQ ID NO: 6497610 - DNA, 22 bp, Homo sapiens
tgatggaccaaagccacctgct

SEQ ID NO: 6497611 - DNA, 22 bp, Homo sapiens
tgatggaccgggtgggcctggc

SEQ ID NO: 6497612 - DNA, 14 bp, Homo sapiens
tgatggacctgccc

SEQ ID NO: 6497613 - DNA, 20 bp, Homo sapiens
tgatggaccttctagaatta

SEQ ID NO: 6497614 - DNA, 23 bp, Homo sapiens
tgatggaccttctagaattataa

SEQ ID NO: 6497615 - DNA, 18 bp, Homo sapiens
tgatggagaaggaaaagg

SEQ ID NO: 6497616 - DNA, 17 bp, Homo sapiens
tgatggagaaggaaggc

SEQ ID NO: 6497617 - DNA, 12 bp, Homo sapiens
tgatggagagga

SEQ ID NO: 6497618 - DNA, 23 bp, Homo sapiens
tgatggagaggacagagcagggg

SEQ ID NO: 6497619 - DNA, 16 bp, Homo sapiens
tgatggagaggagaac

SEQ ID NO: 6497620 - DNA, 10 bp, Homo sapiens
tgatggagat

SEQ ID NO: 6497621 - DNA, 15 bp, Homo sapiens
tgatggagcagagca

SEQ ID NO: 6497622 - DNA, 15 bp, Homo sapiens
tgatggagccccagg

SEQ ID NO: 6497623 - DNA, 11 bp, Homo sapiens
tgatggagggg

SEQ ID NO: 6497624 - DNA, 17 bp, Homo sapiens
tgatggaggtatttgaa

SEQ ID NO: 6497625 - DNA, 18 bp, Homo sapiens
tgatggaggtttcatact

SEQ ID NO: 6497626 - DNA, 15 bp, Homo sapiens
tgatggagtgtgagc

SEQ ID NO: 6497627 - DNA, 20 bp, Homo sapiens
tgatggagttccttctggtg

SEQ ID NO: 6497628 - DNA, 16 bp, Homo sapiens
tgatggatgagaaaaa

SEQ ID NO: 6497629 - DNA, 15 bp, Homo sapiens
tgatggatggcacaa

SEQ ID NO: 6497630 - DNA, 17 bp, Homo sapiens
tgatggatggcacaatg

SEQ ID NO: 6497631 - DNA, 14 bp, Homo sapiens
tgatggatggcaga

SEQ ID NO: 6497632 - DNA, 17 bp, Homo sapiens
tgatggatttaacagca

SEQ ID NO: 6497633 - DNA, 13 bp, Homo sapiens
tgatggcaaaaaa

SEQ ID NO: 6497634 - DNA, 20 bp, Homo sapiens
tgatggcaaaaaaaaaaaag

SEQ ID NO: 6497635 - DNA, 15 bp, Homo sapiens
tgatggcaacactga

SEQ ID NO: 6497636 - DNA, 19 bp, Homo sapiens
tgatggcaacagatctgga

SEQ ID NO: 6497637 - DNA, 17 bp, Homo sapiens
tgatggcaatattaaga

SEQ ID NO: 6497638 - DNA, 17 bp, Homo sapiens
tgatggcacagaaggat

SEQ ID NO: 6497639 - DNA, 15 bp, Homo sapiens
tgatggcacccacac

SEQ ID NO: 6497640 - DNA, 22 bp, Homo sapiens
tgatggcacttagctatcagaa

SEQ ID NO: 6497641 - DNA, 13 bp, Homo sapiens
tgatggcagagga

SEQ ID NO: 6497642 - DNA, 15 bp, Homo sapiens
tgatggcattactct

SEQ ID NO: 6497643 - DNA, 19 bp, Homo sapiens
tgatggcattactctgcac

SEQ ID NO: 6497644 - DNA, 15 bp, Homo sapiens
tgatggccaagagca

SEQ ID NO: 6497645 - DNA, 14 bp, Homo sapiens
tgatggccaagggg

SEQ ID NO: 6497646 - DNA, 14 bp, Homo sapiens
tgatggccagagga

SEQ ID NO: 6497647 - DNA, 15 bp, Homo sapiens
tgatggccagcccct

SEQ ID NO: 6497648 - DNA, 18 bp, Homo sapiens
tgatggccagcccctggg

SEQ ID NO: 6497649 - DNA, 13 bp, Homo sapiens
tgatggccaggcc

SEQ ID NO: 6497650 - DNA, 14 bp, Homo sapiens
tgatggccaggcct

SEQ ID NO: 6497651 - DNA, 14 bp, Homo sapiens
tgatggccatttct

SEQ ID NO: 6497652 - DNA, 16 bp, Homo sapiens
tgatggccatttctaa

SEQ ID NO: 6497653 - DNA, 19 bp, Homo sapiens
tgatggcccattctacttg

SEQ ID NO: 6497654 - DNA, 22 bp, Homo sapiens
tgatggccggctggttgtgggc

SEQ ID NO: 6497655 - DNA, 19 bp, Homo sapiens
tgatggccttaatttcctt

SEQ ID NO: 6497656 - DNA, 20 bp, Homo sapiens
tgatggccttaatttccttt

SEQ ID NO: 6497657 - DNA, 18 bp, Homo sapiens
tgatggccttacactgaa

SEQ ID NO: 6497658 - DNA, 17 bp, Homo sapiens
tgatggcctttggaccc

SEQ ID NO: 6497659 - DNA, 18 bp, Homo sapiens
tgatggcctttggaccca

SEQ ID NO: 6497660 - DNA, 20 bp, Homo sapiens
tgatggcgcgggaggcacca

SEQ ID NO: 6497661 - DNA, 16 bp, Homo sapiens
tgatggcgggcactgg

SEQ ID NO: 6497662 - DNA, 10 bp, Homo sapiens
tgatggctaa

SEQ ID NO: 6497663 - DNA, 19 bp, Homo sapiens
tgatggctaacttacaaag

SEQ ID NO: 6497664 - DNA, 22 bp, Homo sapiens
tgatggctaagatactgctgat

SEQ ID NO: 6497665 - DNA, 18 bp, Homo sapiens
tgatggctatgccttgca

SEQ ID NO: 6497666 - DNA, 17 bp, Homo sapiens
tgatggctatgttttgg

SEQ ID NO: 6497667 - DNA, 18 bp, Homo sapiens
tgatggctcaagacaagg

SEQ ID NO: 6497668 - DNA, 22 bp, Homo sapiens
tgatggctcagagagcatcttt

SEQ ID NO: 6497669 - DNA, 16 bp, Homo sapiens
tgatggctgcccctgc

SEQ ID NO: 6497670 - DNA, 22 bp, Homo sapiens
tgatggctgctagattttaatt

SEQ ID NO: 6497671 - DNA, 17 bp, Homo sapiens
tgatgggaaaatatttc

SEQ ID NO: 6497672 - DNA, 23 bp, Homo sapiens
tgatgggaaggaggggagccttt

SEQ ID NO: 6497673 - DNA, 11 bp, Homo sapiens
tgatgggaata

SEQ ID NO: 6497674 - DNA, 13 bp, Homo sapiens
tgatgggaataaa

SEQ ID NO: 6497675 - DNA, 16 bp, Homo sapiens
tgatgggcacttgaga

SEQ ID NO: 6497676 - DNA, 19 bp, Homo sapiens
tgatgggccgagccacctc

SEQ ID NO: 6497677 - DNA, 18 bp, Homo sapiens
tgatgggccttcagatta

SEQ ID NO: 6497678 - DNA, 15 bp, Homo sapiens
tgatgggcgagtccc

SEQ ID NO: 6497679 - DNA, 14 bp, Homo sapiens
tgatgggctggagc

SEQ ID NO: 6497680 - DNA, 14 bp, Homo sapiens
tgatgggctggggc

SEQ ID NO: 6497681 - DNA, 23 bp, Homo sapiens
tgatggggaagggtggatgtccc

SEQ ID NO: 6497682 - DNA, 21 bp, Homo sapiens
tgatggggaatccgtgtgtgt

SEQ ID NO: 6497683 - DNA, 19 bp, Homo sapiens
tgatggggagaaagggcaa

SEQ ID NO: 6497684 - DNA, 15 bp, Homo sapiens
tgatgggggaggggg

SEQ ID NO: 6497685 - DNA, 21 bp, Homo sapiens
tgatgggggccaggacaccag

SEQ ID NO: 6497686 - DNA, 18 bp, Homo sapiens
tgatggggtccagagagc

SEQ ID NO: 6497687 - DNA, 15 bp, Homo sapiens
tgatggggtgggcag

SEQ ID NO: 6497688 - DNA, 17 bp, Homo sapiens
tgatggggtgggcaggg

SEQ ID NO: 6497689 - DNA, 19 bp, Homo sapiens
tgatggggtgggcagggct

SEQ ID NO: 6497690 - DNA, 22 bp, Homo sapiens
tgatggggtgggcagggctggg

SEQ ID NO: 6497691 - DNA, 16 bp, Homo sapiens
tgatggggtttagcaa

SEQ ID NO: 6497692 - DNA, 20 bp, Homo sapiens
tgatgggtattagtggggga

SEQ ID NO: 6497693 - DNA, 15 bp, Homo sapiens
tgatgggtgctgccc

SEQ ID NO: 6497694 - DNA, 12 bp, Homo sapiens
tgatgggtgggc

SEQ ID NO: 6497695 - DNA, 14 bp, Homo sapiens
tgatggtactgatg

SEQ ID NO: 6497696 - DNA, 14 bp, Homo sapiens
tgatggtatttctt

SEQ ID NO: 6497697 - DNA, 16 bp, Homo sapiens
tgatggtcacttaaaa

SEQ ID NO: 6497698 - DNA, 16 bp, Homo sapiens
tgatggtcagctccct

SEQ ID NO: 6497699 - DNA, 21 bp, Homo sapiens
tgatggtcagctcccttctct

SEQ ID NO: 6497700 - DNA, 20 bp, Homo sapiens
tgatggtcaggatctcatga

SEQ ID NO: 6497701 - DNA, 16 bp, Homo sapiens
tgatggtgacaggtgt

SEQ ID NO: 6497702 - DNA, 15 bp, Homo sapiens
tgatggtgatgaaat

SEQ ID NO: 6497703 - DNA, 13 bp, Homo sapiens
tgatggtgcaatg

SEQ ID NO: 6497704 - DNA, 17 bp, Homo sapiens
tgatggtgcaatgacct

SEQ ID NO: 6497705 - DNA, 18 bp, Homo sapiens
tgatggtgccagagaggg

SEQ ID NO: 6497706 - DNA, 15 bp, Homo sapiens
tgatggtgctgacct

SEQ ID NO: 6497707 - DNA, 20 bp, Homo sapiens
tgatggtgtcattctgcctg

SEQ ID NO: 6497708 - DNA, 17 bp, Homo sapiens
tgatggtgtccttccct

SEQ ID NO: 6497709 - DNA, 22 bp, Homo sapiens
tgatggtgttttggggatgaga

SEQ ID NO: 6497710 - DNA, 19 bp, Homo sapiens
tgatggttcttcacctcct

SEQ ID NO: 6497711 - DNA, 15 bp, Homo sapiens
tgatggttgctttga

SEQ ID NO: 6497712 - DNA, 14 bp, Homo sapiens
tgatggttgtacat

SEQ ID NO: 6497713 - DNA, 13 bp, Homo sapiens
tgatggtttggaa

SEQ ID NO: 6497714 - DNA, 15 bp, Homo sapiens
tgatgtaaaaaatac

SEQ ID NO: 6497715 - DNA, 18 bp, Homo sapiens
tgatgtaaaaaatattaa

SEQ ID NO: 6497716 - DNA, 13 bp, Homo sapiens
tgatgtaaaacag

SEQ ID NO: 6497717 - DNA, 19 bp, Homo sapiens
tgatgtaaaatcttgtcat

SEQ ID NO: 6497718 - DNA, 15 bp, Homo sapiens
tgatgtaaatgaagt

SEQ ID NO: 6497719 - DNA, 19 bp, Homo sapiens
tgatgtaaatgaagtaact

SEQ ID NO: 6497720 - DNA, 14 bp, Homo sapiens
tgatgtaaggactg

SEQ ID NO: 6497721 - DNA, 20 bp, Homo sapiens
tgatgtaaggactgtaaaca

SEQ ID NO: 6497722 - DNA, 21 bp, Homo sapiens
tgatgtaaggatgggcatggt

SEQ ID NO: 6497723 - DNA, 17 bp, Homo sapiens
tgatgtacacattttgt

SEQ ID NO: 6497724 - DNA, 17 bp, Homo sapiens
tgatgtacagaacacaa

SEQ ID NO: 6497725 - DNA, 17 bp, Homo sapiens
tgatgtacagtctgtca

SEQ ID NO: 6497726 - DNA, 18 bp, Homo sapiens
tgatgtacagtctgtcat

SEQ ID NO: 6497727 - DNA, 20 bp, Homo sapiens
tgatgtacataactcctgtc

SEQ ID NO: 6497728 - DNA, 18 bp, Homo sapiens
tgtaaaagcaacatcagc

SEQ ID NO: 6497729 - DNA, 23 bp, Homo sapiens
tgtaaaagcacatgagaatgcta

SEQ ID NO: 6497730 - DNA, 13 bp, Homo sapiens
tgtaaaagctaag

SEQ ID NO: 6497731 - DNA, 16 bp, Homo sapiens
tgtaaaagtgtacaga

SEQ ID NO: 6497732 - DNA, 20 bp, Homo sapiens
tgtaaaagtgtacagactct

SEQ ID NO: 6497733 - DNA, 13 bp, Homo sapiens
tgtaaaagtgtct

SEQ ID NO: 6497734 - DNA, 16 bp, Homo sapiens
tgtaaaagttactaat

SEQ ID NO: 6497735 - DNA, 21 bp, Homo sapiens
tgtaaaagttactaatatatc

SEQ ID NO: 6497736 - DNA, 22 bp, Homo sapiens
tgtaaaagttactaatatatct

SEQ ID NO: 6497737 - DNA, 21 bp, Homo sapiens
tgtaaaagttataataactga

SEQ ID NO: 6497738 - DNA, 22 bp, Homo sapiens
tgtaaaagttataataactgaa

SEQ ID NO: 6497739 - DNA, 18 bp, Homo sapiens
tgtaaaataaaggctctg

SEQ ID NO: 6497740 - DNA, 19 bp, Homo sapiens
tgtaaaataaaggctctgt

SEQ ID NO: 6497741 - DNA, 20 bp, Homo sapiens
tgtaaaataaaggctctgtg

SEQ ID NO: 6497742 - DNA, 16 bp, Homo sapiens
tgtaaaataattctga

SEQ ID NO: 6497743 - DNA, 20 bp, Homo sapiens
tgtaaaatagcttgtatagt

SEQ ID NO: 6497744 - DNA, 13 bp, Homo sapiens
tgtaaaatagttt

SEQ ID NO: 6497745 - DNA, 18 bp, Homo sapiens
tgtaaaatatacttaaat

SEQ ID NO: 6497746 - DNA, 21 bp, Homo sapiens
tgtaaaatatagctgtacaaa

SEQ ID NO: 6497747 - DNA, 20 bp, Homo sapiens
tgtaaaatatttataaatga

SEQ ID NO: 6497748 - DNA, 20 bp, Homo sapiens
tgtaaaatattttgaatcaa

SEQ ID NO: 6497749 - DNA, 21 bp, Homo sapiens
tgtaaaatccacagctatatc

SEQ ID NO: 6497750 - DNA, 14 bp, Homo sapiens
tgtaaaatctttct

SEQ ID NO: 6497751 - DNA, 21 bp, Homo sapiens
tgtaaaatctttctttcttag

SEQ ID NO: 6497752 - DNA, 21 bp, Homo sapiens
tgtaaaatgaattgaaaaaca

SEQ ID NO: 6497753 - DNA, 14 bp, Homo sapiens
tgtaaaatgaattt

SEQ ID NO: 6497754 - DNA, 13 bp, Homo sapiens
tgtaaaatgagtt

SEQ ID NO: 6497755 - DNA, 17 bp, Homo sapiens
tgtaaaatgatactgta

SEQ ID NO: 6497756 - DNA, 21 bp, Homo sapiens
tgtaaaatgcaaaaaatctta

SEQ ID NO: 6497757 - DNA, 15 bp, Homo sapiens
tgtaaaatgcagtcc

SEQ ID NO: 6497758 - DNA, 18 bp, Homo sapiens
tgtaaaatgcagtccaga

SEQ ID NO: 6497759 - DNA, 11 bp, Homo sapiens
tgtaaaatggt

SEQ ID NO: 6497760 - DNA, 14 bp, Homo sapiens
tgtaaaatgtatat

SEQ ID NO: 6497761 - DNA, 18 bp, Homo sapiens
tgtaaaatgtcaagaaat

SEQ ID NO: 6497762 - DNA, 22 bp, Homo sapiens
tgtaaaattaatgtaataaagt

SEQ ID NO: 6497763 - DNA, 17 bp, Homo sapiens
tgtaaaattataaactt

SEQ ID NO: 6497764 - DNA, 19 bp, Homo sapiens
tgtaaaattataaactttt

SEQ ID NO: 6497765 - DNA, 20 bp, Homo sapiens
tgtaaaattgttaaccttgt

SEQ ID NO: 6497766 - DNA, 17 bp, Homo sapiens
tgtaaaatttcacttaa

SEQ ID NO: 6497767 - DNA, 13 bp, Homo sapiens
tgtaaaatttgga

SEQ ID NO: 6497768 - DNA, 22 bp, Homo sapiens
tgtaaaatttgtgtaaatttgt

SEQ ID NO: 6497769 - DNA, 21 bp, Homo sapiens
tgtaaacaaactgtgtaactg

SEQ ID NO: 6497770 - DNA, 17 bp, Homo sapiens
tgtaaacaacgtgtata

SEQ ID NO: 6497771 - DNA, 18 bp, Homo sapiens
tgtaaacacagtcaaaat

SEQ ID NO: 6497772 - DNA, 15 bp, Homo sapiens
tgtaaacacagtgtg

SEQ ID NO: 6497773 - DNA, 20 bp, Homo sapiens
tgtaaacacatctagtagtt

SEQ ID NO: 6497774 - DNA, 17 bp, Homo sapiens
tgtaaacactcagctgt

SEQ ID NO: 6497775 - DNA, 18 bp, Homo sapiens
tgtaaacactcagctgtt

SEQ ID NO: 6497776 - DNA, 20 bp, Homo sapiens
tgtaaacagaagcctgtttc

SEQ ID NO: 6497777 - DNA, 14 bp, Homo sapiens
tgtaaacagaagga

SEQ ID NO: 6497778 - DNA, 16 bp, Homo sapiens
tgtaaacagaaggaga

SEQ ID NO: 6497779 - DNA, 19 bp, Homo sapiens
tgtaaacagaataaaagtt

SEQ ID NO: 6497780 - DNA, 14 bp, Homo sapiens
tgtaaacagttctg

SEQ ID NO: 6497781 - DNA, 19 bp, Homo sapiens
tgtaaacataccaacatgt

SEQ ID NO: 6497782 - DNA, 14 bp, Homo sapiens
tgtaaacatgtgtt

SEQ ID NO: 6497783 - DNA, 17 bp, Homo sapiens
tgtaaacattcatattt

SEQ ID NO: 6497784 - DNA, 17 bp, Homo sapiens
tgtaaacattcatcaag

SEQ ID NO: 6497785 - DNA, 11 bp, Homo sapiens
tgtaaacattt

SEQ ID NO: 6497786 - DNA, 12 bp, Homo sapiens
tgtaaaccaaag

SEQ ID NO: 6497787 - DNA, 22 bp, Homo sapiens
tgtaaaccacaaggctgttgca

SEQ ID NO: 6497788 - DNA, 23 bp, Homo sapiens
tgtaaaccacataatttttgtac

SEQ ID NO: 6497789 - DNA, 19 bp, Homo sapiens
tgtaaaccgctttggcctg

SEQ ID NO: 6497790 - DNA, 19 bp, Homo sapiens
tgtaaacggtgctatttct

SEQ ID NO: 6497791 - DNA, 20 bp, Homo sapiens
tgtaaacgtctttttaagcc

SEQ ID NO: 6497792 - DNA, 22 bp, Homo sapiens
tgtaaactcatctgaaatgtta

SEQ ID NO: 6497793 - DNA, 21 bp, Homo sapiens
tgtaaactcgggggtgctggg

SEQ ID NO: 6497794 - DNA, 17 bp, Homo sapiens
tgtaaactctcttctct

SEQ ID NO: 6497795 - DNA, 14 bp, Homo sapiens
tgtaaactcttcac

SEQ ID NO: 6497796 - DNA, 12 bp, Homo sapiens
tgtaaactgcca

SEQ ID NO: 6497797 - DNA, 14 bp, Homo sapiens
tgtaaactgccata

SEQ ID NO: 6497798 - DNA, 19 bp, Homo sapiens
tgtaaactgtactagtctg

SEQ ID NO: 6497799 - DNA, 23 bp, Homo sapiens
tgtaaactgtactagtctgtgtg

SEQ ID NO: 6497800 - DNA, 20 bp, Homo sapiens
tgtaaactgtatcaaatctg

SEQ ID NO: 6497801 - DNA, 12 bp, Homo sapiens
tgtaaacttctg

SEQ ID NO: 6497802 - DNA, 14 bp, Homo sapiens
tgtaaacttctgaa

SEQ ID NO: 6497803 - DNA, 22 bp, Homo sapiens
tgtaaacttctgaagactgaga

SEQ ID NO: 6497804 - DNA, 12 bp, Homo sapiens
tgtaaacttgaa

SEQ ID NO: 6497805 - DNA, 13 bp, Homo sapiens
tgtaaacttgaaa

SEQ ID NO: 6497806 - DNA, 17 bp, Homo sapiens
tgtaaacttggaatcaa

SEQ ID NO: 6497807 - DNA, 18 bp, Homo sapiens
tgtaaacttggaatcaag

SEQ ID NO: 6497808 - DNA, 15 bp, Homo sapiens
tgtaaacttgggttt

SEQ ID NO: 6497809 - DNA, 14 bp, Homo sapiens
tgtaaacttgtaca

SEQ ID NO: 6497810 - DNA, 19 bp, Homo sapiens
tgtaaactttatcacttaa

SEQ ID NO: 6497811 - DNA, 12 bp, Homo sapiens
tgtaaactttga

SEQ ID NO: 6497812 - DNA, 16 bp, Homo sapiens
tgtaaactttgaaata

SEQ ID NO: 6497813 - DNA, 18 bp, Homo sapiens
tgtaaactttgaaatata

SEQ ID NO: 6497814 - DNA, 18 bp, Homo sapiens
tgtaaactttgcttctcc

SEQ ID NO: 6497815 - DNA, 15 bp, Homo sapiens
tgtaaactttttcaa

SEQ ID NO: 6497816 - DNA, 17 bp, Homo sapiens
tgtaaagaaagagagaa

SEQ ID NO: 6497817 - DNA, 20 bp, Homo sapiens
tgtaaagaaagagagaaaat

SEQ ID NO: 6497818 - DNA, 21 bp, Homo sapiens
tgtaaagaaagagagaaaata

SEQ ID NO: 6497819 - DNA, 13 bp, Homo sapiens
tgtaaagaaatgt

SEQ ID NO: 6497820 - DNA, 18 bp, Homo sapiens
tgtaaagacaaataaatg

SEQ ID NO: 6497821 - DNA, 18 bp, Homo sapiens
tgtaaagactgagcagaa

SEQ ID NO: 6497822 - DNA, 23 bp, Homo sapiens
tgtaaagagacctacctcaggtt

SEQ ID NO: 6497823 - DNA, 21 bp, Homo sapiens
tgtaaagatattgtatctcct

SEQ ID NO: 6497824 - DNA, 22 bp, Homo sapiens
tgtaaagatattgtatctcctt

SEQ ID NO: 6497825 - DNA, 14 bp, Homo sapiens
tgtaaagattgttt

SEQ ID NO: 6497826 - DNA, 14 bp, Homo sapiens
tgtaaagatttata

SEQ ID NO: 6497827 - DNA, 18 bp, Homo sapiens
tgtaaagatttctgttca

SEQ ID NO: 6497828 - DNA, 22 bp, Homo sapiens
tgtaaagatttgttgacagcaa

SEQ ID NO: 6497829 - DNA, 15 bp, Homo sapiens
tgtaaagcaaaatat

SEQ ID NO: 6497830 - DNA, 16 bp, Homo sapiens
tgtaaagcaaaatatt

SEQ ID NO: 6497831 - DNA, 18 bp, Homo sapiens
tgtaaagcgggaaggaca

SEQ ID NO: 6497832 - DNA, 12 bp, Homo sapiens
tgtaaagctaaa

SEQ ID NO: 6497833 - DNA, 15 bp, Homo sapiens
tgtaaagctggccct

SEQ ID NO: 6497834 - DNA, 18 bp, Homo sapiens
tgtaaagctgttaaaata

SEQ ID NO: 6497835 - DNA, 13 bp, Homo sapiens
tgtaaagcttgtc

SEQ ID NO: 6497836 - DNA, 12 bp, Homo sapiens
tgtaaaggaaat

SEQ ID NO: 6497837 - DNA, 15 bp, Homo sapiens
tgtaaaggaaataat

SEQ ID NO: 6497838 - DNA, 16 bp, Homo sapiens
tgtaaaggaatttaaa

SEQ ID NO: 6497839 - DNA, 16 bp, Homo sapiens
tgtaaaggactattta

SEQ ID NO: 6497840 - DNA, 23 bp, Homo sapiens
tgtaaaggagggagatctttccc

SEQ ID NO: 6497841 - DNA, 19 bp, Homo sapiens
tgtaaaggagtcaaaacta

SEQ ID NO: 6497842 - DNA, 18 bp, Homo sapiens
tgtaaaggcattctataa

SEQ ID NO: 6497843 - DNA, 13 bp, Homo sapiens
tgtaaaggtcaga

SEQ ID NO: 6497844 - DNA, 17 bp, Homo sapiens
tgtaaaggtgatgaatt

SEQ ID NO: 6497845 - DNA, 18 bp, Homo sapiens
tgtaaaggtgatgaattt

SEQ ID NO: 6497846 - DNA, 12 bp, Homo sapiens
tgtaaagtatgc

SEQ ID NO: 6497847 - DNA, 13 bp, Homo sapiens
tgtaaagtatgtg

SEQ ID NO: 6497848 - DNA, 18 bp, Homo sapiens
tgtaaagtatgtgagtag

SEQ ID NO: 6497849 - DNA, 21 bp, Homo sapiens
tgtaaagtatttgatgtacat

SEQ ID NO: 6497850 - DNA, 20 bp, Homo sapiens
tgtaaagtgaagaatccttt

SEQ ID NO: 6497851 - DNA, 22 bp, Homo sapiens
tgtaaagtgcaatgtcctgcat

SEQ ID NO: 6497852 - DNA, 12 bp, Homo sapiens
tgtaaagtgtgg

SEQ ID NO: 6497853 - DNA, 22 bp, Homo sapiens
tgtaaagtgtggtcccaacagg

SEQ ID NO: 6497854 - DNA, 18 bp, Homo sapiens
tgtaaagttatgtattta

SEQ ID NO: 6497855 - DNA, 21 bp, Homo sapiens
tgtaaagttatgtatttaaag

SEQ ID NO: 6497856 - DNA, 23 bp, Homo sapiens
tgtaaagttgaggggagaggaaa

SEQ ID NO: 6497857 - DNA, 19 bp, Homo sapiens
tgtaaagttgcctttattt

SEQ ID NO: 6497858 - DNA, 16 bp, Homo sapiens
tgtaaagtttctagaa

SEQ ID NO: 6497859 - DNA, 19 bp, Homo sapiens
tgtaaataaaaatagctat

SEQ ID NO: 6497860 - DNA, 14 bp, Homo sapiens
tgtaaataaaacat

SEQ ID NO: 6497861 - DNA, 21 bp, Homo sapiens
tgtaaataaaatgtgtacagt

SEQ ID NO: 6497862 - DNA, 14 bp, Homo sapiens
tgtaaataaataga

SEQ ID NO: 6497863 - DNA, 15 bp, Homo sapiens
tgtaaataagagatt

SEQ ID NO: 6497864 - DNA, 16 bp, Homo sapiens
tgtaaataagagttgc

SEQ ID NO: 6497865 - DNA, 20 bp, Homo sapiens
tgtaaataagttttttttct

SEQ ID NO: 6497866 - DNA, 23 bp, Homo sapiens
tgtaaataatacattatatttct

SEQ ID NO: 6497867 - DNA, 23 bp, Homo sapiens
tgtaaataatataaaatgtttca

SEQ ID NO: 6497868 - DNA, 14 bp, Homo sapiens
tgtaaataatgctt

SEQ ID NO: 6497869 - DNA, 15 bp, Homo sapiens
tgtaaataatgctta

SEQ ID NO: 6497870 - DNA, 16 bp, Homo sapiens
tgtaaataatttatta

SEQ ID NO: 6497871 - DNA, 20 bp, Homo sapiens
tgtaaataattttaaataac

SEQ ID NO: 6497872 - DNA, 15 bp, Homo sapiens
tgtaaataattttct

SEQ ID NO: 6497873 - DNA, 16 bp, Homo sapiens
tgtaaataattttcta

SEQ ID NO: 6497874 - DNA, 18 bp, Homo sapiens
tgtaaataattttctaag

SEQ ID NO: 6497875 - DNA, 12 bp, Homo sapiens
tgtaaatacaat

SEQ ID NO: 6497876 - DNA, 14 bp, Homo sapiens
tgtaaatacaattc

SEQ ID NO: 6497877 - DNA, 16 bp, Homo sapiens
tgtaaatacaattttg

SEQ ID NO: 6497878 - DNA, 17 bp, Homo sapiens
tgtaaatacaattttgt

SEQ ID NO: 6497879 - DNA, 19 bp, Homo sapiens
tgtaaatacaattttgttt

SEQ ID NO: 6497880 - DNA, 21 bp, Homo sapiens
tgtaaatacaattttgtttct

SEQ ID NO: 6497881 - DNA, 21 bp, Homo sapiens
tgtaaatacagtggatctcaa

SEQ ID NO: 6497882 - DNA, 13 bp, Homo sapiens
tgtaaatacataa

SEQ ID NO: 6497883 - DNA, 20 bp, Homo sapiens
tgtaaatacatcaaaaatgg

SEQ ID NO: 6497884 - DNA, 20 bp, Homo sapiens
tgtaaatacatgtgtggatg

SEQ ID NO: 6497885 - DNA, 19 bp, Homo sapiens
tgtaaataccaggattttt

SEQ ID NO: 6497886 - DNA, 19 bp, Homo sapiens
tgtaaatactggactcagg

SEQ ID NO: 6497887 - DNA, 23 bp, Homo sapiens
tgtaaatactttgtcctaagaga

SEQ ID NO: 6497888 - DNA, 21 bp, Homo sapiens
tgtaaatagaagagtttaaaa

SEQ ID NO: 6497889 - DNA, 15 bp, Homo sapiens
tgtaaatagctcagg

SEQ ID NO: 6497890 - DNA, 16 bp, Homo sapiens
tgtaaatagctcaggt

SEQ ID NO: 6497891 - DNA, 21 bp, Homo sapiens
tgtaaataggttcagatttta

SEQ ID NO: 6497892 - DNA, 16 bp, Homo sapiens
tgtaaatagtatttga

SEQ ID NO: 6497893 - DNA, 15 bp, Homo sapiens
tgtaaatagtgattt

SEQ ID NO: 6497894 - DNA, 19 bp, Homo sapiens
tgtaaatagttttaaatat

SEQ ID NO: 6497895 - DNA, 12 bp, Homo sapiens
tgtaaatataaa

SEQ ID NO: 6497896 - DNA, 16 bp, Homo sapiens
tgtaaatataaagacg

SEQ ID NO: 6497897 - DNA, 17 bp, Homo sapiens
tgtaaatataaagacgt

SEQ ID NO: 6497898 - DNA, 11 bp, Homo sapiens
tgtaaatatag

SEQ ID NO: 6497899 - DNA, 18 bp, Homo sapiens
tgtaaatatataaatata

SEQ ID NO: 6497900 - DNA, 13 bp, Homo sapiens
tgtaaatatatgt

SEQ ID NO: 6497901 - DNA, 22 bp, Homo sapiens
tgtaaatatatgtctgataatg

SEQ ID NO: 6497902 - DNA, 15 bp, Homo sapiens
tgtaaatatccacag

SEQ ID NO: 6497903 - DNA, 15 bp, Homo sapiens
tgtaaatatgtacat

SEQ ID NO: 6497904 - DNA, 15 bp, Homo sapiens
tgtaaatatgtgaca

SEQ ID NO: 6497905 - DNA, 20 bp, Homo sapiens
tgtaaatatgtttcaccctg

SEQ ID NO: 6497906 - DNA, 23 bp, Homo sapiens
tgtaaatattctacacatgtaaa

SEQ ID NO: 6497907 - DNA, 14 bp, Homo sapiens
tgatgtacatgtgt

SEQ ID NO: 6497908 - DNA, 15 bp, Homo sapiens
tgatgtacattacag

SEQ ID NO: 6497909 - DNA, 15 bp, Homo sapiens
tgatgtacctgatgc

SEQ ID NO: 6497910 - DNA, 19 bp, Homo sapiens
tgatgtactgattgagaag

SEQ ID NO: 6497911 - DNA, 20 bp, Homo sapiens
tgatgtagaaaagagacttc

SEQ ID NO: 6497912 - DNA, 14 bp, Homo sapiens
tgatgtagaaagat

SEQ ID NO: 6497913 - DNA, 15 bp, Homo sapiens
tgatgtaggagctgg

SEQ ID NO: 6497914 - DNA, 16 bp, Homo sapiens
tgatgtagtatgctta

SEQ ID NO: 6497915 - DNA, 17 bp, Homo sapiens
tgatgtagtgcctcttt

SEQ ID NO: 6497916 - DNA, 18 bp, Homo sapiens
tgatgtatagctttaaca

SEQ ID NO: 6497917 - DNA, 20 bp, Homo sapiens
tgatgtatagctttaacatt

SEQ ID NO: 6497918 - DNA, 21 bp, Homo sapiens
tgatgtatagctttaacattt

SEQ ID NO: 6497919 - DNA, 13 bp, Homo sapiens
tgatgtatataaa

SEQ ID NO: 6497920 - DNA, 15 bp, Homo sapiens
tgatgtatatgttta

SEQ ID NO: 6497921 - DNA, 16 bp, Homo sapiens
tgatgtatatgtttat

SEQ ID NO: 6497922 - DNA, 17 bp, Homo sapiens
tgatgtatgttatttga

SEQ ID NO: 6497923 - DNA, 20 bp, Homo sapiens
tgatgtattacatgactgtt

SEQ ID NO: 6497924 - DNA, 15 bp, Homo sapiens
tgatgtattctttta

SEQ ID NO: 6497925 - DNA, 20 bp, Homo sapiens
tgatgtcaagcaatggggaa

SEQ ID NO: 6497926 - DNA, 17 bp, Homo sapiens
tgatgtcaatttctgtg

SEQ ID NO: 6497927 - DNA, 19 bp, Homo sapiens
tgatgtcaatttctgtgtt

SEQ ID NO: 6497928 - DNA, 21 bp, Homo sapiens
tgatgtcacagtttgttcagt

SEQ ID NO: 6497929 - DNA, 23 bp, Homo sapiens
tgatgtcacagtttgttcagtga

SEQ ID NO: 6497930 - DNA, 12 bp, Homo sapiens
tgatgtcactca

SEQ ID NO: 6497931 - DNA, 16 bp, Homo sapiens
tgatgtcagccttgca

SEQ ID NO: 6497932 - DNA, 22 bp, Homo sapiens
tgatgtcagtatttcaactgct

SEQ ID NO: 6497933 - DNA, 21 bp, Homo sapiens
tgatgtcatgtacttcctgtg

SEQ ID NO: 6497934 - DNA, 14 bp, Homo sapiens
tgatgtccaaactt

SEQ ID NO: 6497935 - DNA, 18 bp, Homo sapiens
tgatgtccagggggagaa

SEQ ID NO: 6497936 - DNA, 19 bp, Homo sapiens
tgatgtcccaacttgtaaa

SEQ ID NO: 6497937 - DNA, 11 bp, Homo sapiens
tgatgtcccag

SEQ ID NO: 6497938 - DNA, 15 bp, Homo sapiens
tgatgtccctatgga

SEQ ID NO: 6497939 - DNA, 16 bp, Homo sapiens
tgatgtccctatggaa

SEQ ID NO: 6497940 - DNA, 15 bp, Homo sapiens
tgatgtcctgtaaac

SEQ ID NO: 6497941 - DNA, 21 bp, Homo sapiens
tgatgtcctgtaaacactcag

SEQ ID NO: 6497942 - DNA, 16 bp, Homo sapiens
tgatgtctcctaagca

SEQ ID NO: 6497943 - DNA, 20 bp, Homo sapiens
tgatgtctcctaagcacctg

SEQ ID NO: 6497944 - DNA, 18 bp, Homo sapiens
tgatgtctcttgtagaag

SEQ ID NO: 6497945 - DNA, 20 bp, Homo sapiens
tgatgtctgaggataccttc

SEQ ID NO: 6497946 - DNA, 12 bp, Homo sapiens
tgatgtctggtc

SEQ ID NO: 6497947 - DNA, 22 bp, Homo sapiens
tgatgtcttgagagcgctggcc

SEQ ID NO: 6497948 - DNA, 11 bp, Homo sapiens
tgatgtcttta

SEQ ID NO: 6497949 - DNA, 23 bp, Homo sapiens
tgatgtctttgttaagactgctg

SEQ ID NO: 6497950 - DNA, 17 bp, Homo sapiens
tgatgtctttttattaa

SEQ ID NO: 6497951 - DNA, 14 bp, Homo sapiens
tgatgtgaaaagca

SEQ ID NO: 6497952 - DNA, 13 bp, Homo sapiens
tgatgtgaaagat

SEQ ID NO: 6497953 - DNA, 14 bp, Homo sapiens
tgatgtgaaagata

SEQ ID NO: 6497954 - DNA, 20 bp, Homo sapiens
tgatgtgaagataatttgca

SEQ ID NO: 6497955 - DNA, 14 bp, Homo sapiens
tgatgtgaagccaa

SEQ ID NO: 6497956 - DNA, 16 bp, Homo sapiens
tgatgtgacaataata

SEQ ID NO: 6497957 - DNA, 21 bp, Homo sapiens
tgatgtgacattccatgacga

SEQ ID NO: 6497958 - DNA, 15 bp, Homo sapiens
tgatgtgacatttgt

SEQ ID NO: 6497959 - DNA, 13 bp, Homo sapiens
tgatgtgactttt

SEQ ID NO: 6497960 - DNA, 23 bp, Homo sapiens
tgatgtgactttttttggtataa

SEQ ID NO: 6497961 - DNA, 19 bp, Homo sapiens
tgatgtgatggaacacaca

SEQ ID NO: 6497962 - DNA, 22 bp, Homo sapiens
tgatgtgattatttttctttta

SEQ ID NO: 6497963 - DNA, 16 bp, Homo sapiens
tgatgtgatttatgca

SEQ ID NO: 6497964 - DNA, 17 bp, Homo sapiens
tgatgtgatttatgcat

SEQ ID NO: 6497965 - DNA, 23 bp, Homo sapiens
tgatgtgcacatatcaagaagtc

SEQ ID NO: 6497966 - DNA, 16 bp, Homo sapiens
tgatgtgcctgcttca

SEQ ID NO: 6497967 - DNA, 15 bp, Homo sapiens
tgatgtgcgtgctgt

SEQ ID NO: 6497968 - DNA, 18 bp, Homo sapiens
tgatgtgctcatcagaaa

SEQ ID NO: 6497969 - DNA, 12 bp, Homo sapiens
tgatgtgctgga

SEQ ID NO: 6497970 - DNA, 13 bp, Homo sapiens
tgatgtggagaaa

SEQ ID NO: 6497971 - DNA, 21 bp, Homo sapiens
tgatgtggaggaagagccacc

SEQ ID NO: 6497972 - DNA, 17 bp, Homo sapiens
tgatgtggagtggggca

SEQ ID NO: 6497973 - DNA, 18 bp, Homo sapiens
tgatgtggagtggggcag

SEQ ID NO: 6497974 - DNA, 18 bp, Homo sapiens
tgatgtggcaactgctga

SEQ ID NO: 6497975 - DNA, 16 bp, Homo sapiens
tgatgtgggaagaagt

SEQ ID NO: 6497976 - DNA, 13 bp, Homo sapiens
tgatgtgtacatc

SEQ ID NO: 6497977 - DNA, 20 bp, Homo sapiens
tgatgtgtgaaacctgacac

SEQ ID NO: 6497978 - DNA, 14 bp, Homo sapiens
tgatgtgtgcccag

SEQ ID NO: 6497979 - DNA, 15 bp, Homo sapiens
tgatgtgttcggttt

SEQ ID NO: 6497980 - DNA, 21 bp, Homo sapiens
tgatgtgttcggttttgttgt

SEQ ID NO: 6497981 - DNA, 18 bp, Homo sapiens
tgatgtgttgccactttc

SEQ ID NO: 6497982 - DNA, 14 bp, Homo sapiens
tgatgtgttgttct

SEQ ID NO: 6497983 - DNA, 14 bp, Homo sapiens
tgatgttaaaattc

SEQ ID NO: 6497984 - DNA, 17 bp, Homo sapiens
tgatgttaaaattccat

SEQ ID NO: 6497985 - DNA, 11 bp, Homo sapiens
tgatgttaaca

SEQ ID NO: 6497986 - DNA, 18 bp, Homo sapiens
tgatgttaacacattttg

SEQ ID NO: 6497987 - DNA, 21 bp, Homo sapiens
tgatgttaacacattttgtat

SEQ ID NO: 6497988 - DNA, 22 bp, Homo sapiens
tgatgttaaccagaataaagtt

SEQ ID NO: 6497989 - DNA, 15 bp, Homo sapiens
tgatgttaactatta

SEQ ID NO: 6497990 - DNA, 13 bp, Homo sapiens
tgatgttaagaac

SEQ ID NO: 6497991 - DNA, 17 bp, Homo sapiens
tgatgttacaaggtgtt

SEQ ID NO: 6497992 - DNA, 18 bp, Homo sapiens
tgatgttactgagatgtt

SEQ ID NO: 6497993 - DNA, 22 bp, Homo sapiens
tgatgttagaagaagaggaaga

SEQ ID NO: 6497994 - DNA, 21 bp, Homo sapiens
tgatgttcagagtggctcact

SEQ ID NO: 6497995 - DNA, 13 bp, Homo sapiens
tgatgttcagtgt

SEQ ID NO: 6497996 - DNA, 14 bp, Homo sapiens
tgatgttcagtgta

SEQ ID NO: 6497997 - DNA, 16 bp, Homo sapiens
tgatgttcagtgtaat

SEQ ID NO: 6497998 - DNA, 19 bp, Homo sapiens
tgatgttccacctgccaca

SEQ ID NO: 6497999 - DNA, 15 bp, Homo sapiens
tgatgttctaaggct

SEQ ID NO: 6498000 - DNA, 21 bp, Homo sapiens
tgatgttctaaggctctgaga

SEQ ID NO: 6498001 - DNA, 22 bp, Homo sapiens
tgatgttctaaggctctgagag

SEQ ID NO: 6498002 - DNA, 14 bp, Homo sapiens
tgatgttctttcca

SEQ ID NO: 6498003 - DNA, 17 bp, Homo sapiens
tgatgttgagggaacag

SEQ ID NO: 6498004 - DNA, 18 bp, Homo sapiens
tgatgttgataatttcag

SEQ ID NO: 6498005 - DNA, 15 bp, Homo sapiens
tgatgttgatgcaat

SEQ ID NO: 6498006 - DNA, 21 bp, Homo sapiens
tgatgttgctgttcacagctt

SEQ ID NO: 6498007 - DNA, 14 bp, Homo sapiens
tgatgttggctggg

SEQ ID NO: 6498008 - DNA, 15 bp, Homo sapiens
tgatgttggctggga

SEQ ID NO: 6498009 - DNA, 16 bp, Homo sapiens
tgatgttggctgggaa

SEQ ID NO: 6498010 - DNA, 11 bp, Homo sapiens
tgatgtttaca

SEQ ID NO: 6498011 - DNA, 17 bp, Homo sapiens
tgatgtttacatgtctg

SEQ ID NO: 6498012 - DNA, 17 bp, Homo sapiens
tgatgtttagaaaagta

SEQ ID NO: 6498013 - DNA, 21 bp, Homo sapiens
tgatgtttatgtactgtaaac

SEQ ID NO: 6498014 - DNA, 13 bp, Homo sapiens
tgatgtttccaga

SEQ ID NO: 6498015 - DNA, 23 bp, Homo sapiens
tgatgtttccagaaaatataaat

SEQ ID NO: 6498016 - DNA, 18 bp, Homo sapiens
tgatgtttccagctgcca

SEQ ID NO: 6498017 - DNA, 15 bp, Homo sapiens
tgatgtttctgtgaa

SEQ ID NO: 6498018 - DNA, 19 bp, Homo sapiens
tgatgtttctgtgaaattc

SEQ ID NO: 6498019 - DNA, 13 bp, Homo sapiens
tgatgtttgaaat

SEQ ID NO: 6498020 - DNA, 13 bp, Homo sapiens
tgatgtttgtcct

SEQ ID NO: 6498021 - DNA, 20 bp, Homo sapiens
tgatgtttgtggcctcagaa

SEQ ID NO: 6498022 - DNA, 17 bp, Homo sapiens
tgatgttttacgtgcaa

SEQ ID NO: 6498023 - DNA, 16 bp, Homo sapiens
tgatgttttgttcaaa

SEQ ID NO: 6498024 - DNA, 15 bp, Homo sapiens
tgatgtttttaaaat

SEQ ID NO: 6498025 - DNA, 16 bp, Homo sapiens
tgatgtttttaaaatc

SEQ ID NO: 6498026 - DNA, 21 bp, Homo sapiens
tgatgtttttaaaatcttatt

SEQ ID NO: 6498027 - DNA, 15 bp, Homo sapiens
tgatgtttttaaagg

SEQ ID NO: 6498028 - DNA, 18 bp, Homo sapiens
tgatgtttttaaaggttt

SEQ ID NO: 6498029 - DNA, 12 bp, Homo sapiens
tgatgtttttct

SEQ ID NO: 6498030 - DNA, 22 bp, Homo sapiens
tgatgttttttctgtaatgtaa

SEQ ID NO: 6498031 - DNA, 19 bp, Homo sapiens
tgattaaaaatatcaaatt

SEQ ID NO: 6498032 - DNA, 15 bp, Homo sapiens
tgattaaaatgagtt

SEQ ID NO: 6498033 - DNA, 23 bp, Homo sapiens
tgattaaaatgcttcctcccagc

SEQ ID NO: 6498034 - DNA, 15 bp, Homo sapiens
tgattaaaatggtga

SEQ ID NO: 6498035 - DNA, 17 bp, Homo sapiens
tgattaaacacctgaca

SEQ ID NO: 6498036 - DNA, 15 bp, Homo sapiens
tgattaaacagactt

SEQ ID NO: 6498037 - DNA, 15 bp, Homo sapiens
tgattaaacagcaaa

SEQ ID NO: 6498038 - DNA, 21 bp, Homo sapiens
tgattaaacagcaaagccata

SEQ ID NO: 6498039 - DNA, 20 bp, Homo sapiens
tgattaaacgtgcagactat

SEQ ID NO: 6498040 - DNA, 14 bp, Homo sapiens
tgattaaactgtat

SEQ ID NO: 6498041 - DNA, 22 bp, Homo sapiens
tgattaaagatgagctttgtct

SEQ ID NO: 6498042 - DNA, 21 bp, Homo sapiens
tgattaaagcagtaatatttt

SEQ ID NO: 6498043 - DNA, 14 bp, Homo sapiens
tgattaaaggcagc

SEQ ID NO: 6498044 - DNA, 12 bp, Homo sapiens
tgattaaagtgc

SEQ ID NO: 6498045 - DNA, 19 bp, Homo sapiens
tgattaaataagattctaa

SEQ ID NO: 6498046 - DNA, 12 bp, Homo sapiens
tgattaaatatt

SEQ ID NO: 6498047 - DNA, 13 bp, Homo sapiens
tgattaaatgaca

SEQ ID NO: 6498048 - DNA, 14 bp, Homo sapiens
tgattaaatgacac

SEQ ID NO: 6498049 - DNA, 21 bp, Homo sapiens
tgattaaattatcattgtttg

SEQ ID NO: 6498050 - DNA, 13 bp, Homo sapiens
tgattaaattatg

SEQ ID NO: 6498051 - DNA, 19 bp, Homo sapiens
tgattaacaaataaattgg

SEQ ID NO: 6498052 - DNA, 22 bp, Homo sapiens
tgattaacaatgtattttaata

SEQ ID NO: 6498053 - DNA, 13 bp, Homo sapiens
tgattaacatttg

SEQ ID NO: 6498054 - DNA, 20 bp, Homo sapiens
tgattaaccacttcagctga

SEQ ID NO: 6498055 - DNA, 22 bp, Homo sapiens
tgattaaccccttctttcatgt

SEQ ID NO: 6498056 - DNA, 22 bp, Homo sapiens
tgattaaccttttcaaattaat

SEQ ID NO: 6498057 - DNA, 24 bp, Homo sapiens
tgattaactcttagaagtgttgta

SEQ ID NO: 6498058 - DNA, 17 bp, Homo sapiens
tgattaacttatactgt

SEQ ID NO: 6498059 - DNA, 17 bp, Homo sapiens
tgattaaggactacaga

SEQ ID NO: 6498060 - DNA, 18 bp, Homo sapiens
tgattaaggactacagaa

SEQ ID NO: 6498061 - DNA, 17 bp, Homo sapiens
tgattaagggacatttc

SEQ ID NO: 6498062 - DNA, 12 bp, Homo sapiens
tgattaagtata

SEQ ID NO: 6498063 - DNA, 18 bp, Homo sapiens
tgattaagtatatctatc

SEQ ID NO: 6498064 - DNA, 18 bp, Homo sapiens
tgattaataagaacttga

SEQ ID NO: 6498065 - DNA, 15 bp, Homo sapiens
tgattaatcagctgt

SEQ ID NO: 6498066 - DNA, 17 bp, Homo sapiens
tgattaatccagaataa

SEQ ID NO: 6498067 - DNA, 14 bp, Homo sapiens
tgattaatccattt

SEQ ID NO: 6498068 - DNA, 14 bp, Homo sapiens
tgattaatgctaaa

SEQ ID NO: 6498069 - DNA, 12 bp, Homo sapiens
tgattaatgtac

SEQ ID NO: 6498070 - DNA, 14 bp, Homo sapiens
tgattaatgtttct

SEQ ID NO: 6498071 - DNA, 16 bp, Homo sapiens
tgattaatgttttcat

SEQ ID NO: 6498072 - DNA, 15 bp, Homo sapiens
tgattaattaaaaca

SEQ ID NO: 6498073 - DNA, 19 bp, Homo sapiens
tgattaattaaatagcttt

SEQ ID NO: 6498074 - DNA, 22 bp, Homo sapiens
tgattaatttctgccatttcat

SEQ ID NO: 6498075 - DNA, 15 bp, Homo sapiens
tgattacacaaaaca

SEQ ID NO: 6498076 - DNA, 17 bp, Homo sapiens
tgattacacaaaacaaa

SEQ ID NO: 6498077 - DNA, 14 bp, Homo sapiens
tgattacagtgcag

SEQ ID NO: 6498078 - DNA, 20 bp, Homo sapiens
tgattacataatcaaagcta

SEQ ID NO: 6498079 - DNA, 21 bp, Homo sapiens
tgattacatagatcagccatt

SEQ ID NO: 6498080 - DNA, 16 bp, Homo sapiens
tgattaccagggactg

SEQ ID NO: 6498081 - DNA, 16 bp, Homo sapiens
tgattaccagtctgat

SEQ ID NO: 6498082 - DNA, 19 bp, Homo sapiens
tgattaccagtctgattat

SEQ ID NO: 6498083 - DNA, 13 bp, Homo sapiens
tgattacctgaaa

SEQ ID NO: 6498084 - DNA, 18 bp, Homo sapiens
tgattacctgaaagccct

SEQ ID NO: 6498085 - DNA, 13 bp, Homo sapiens
tgattacctgcca

SEQ ID NO: 6498086 - DNA, 16 bp, Homo sapiens
tgattactctttgaga

SEQ ID NO: 6498087 - DNA, 19 bp, Homo sapiens
tgattactgcaatcactgt

SEQ ID NO: 6498088 - DNA, 15 bp, Homo sapiens
tgtaaatattgtgtg

SEQ ID NO: 6498089 - DNA, 16 bp, Homo sapiens
tgtaaatatttcataa

SEQ ID NO: 6498090 - DNA, 18 bp, Homo sapiens
tgtaaatatttcataaat

SEQ ID NO: 6498091 - DNA, 15 bp, Homo sapiens
tgtaaatatttgact

SEQ ID NO: 6498092 - DNA, 20 bp, Homo sapiens
tgtaaatattttgatacaaa

SEQ ID NO: 6498093 - DNA, 22 bp, Homo sapiens
tgtaaatattttgatacaaatg

SEQ ID NO: 6498094 - DNA, 20 bp, Homo sapiens
tgtaaatcaagaccaaagag

SEQ ID NO: 6498095 - DNA, 13 bp, Homo sapiens
tgtaaatcacttg

SEQ ID NO: 6498096 - DNA, 22 bp, Homo sapiens
tgtaaatcacttgtaaataaat

SEQ ID NO: 6498097 - DNA, 19 bp, Homo sapiens
tgtaaatcacttgttttat

SEQ ID NO: 6498098 - DNA, 22 bp, Homo sapiens
tgtaaatcacttgttttattga

SEQ ID NO: 6498099 - DNA, 21 bp, Homo sapiens
tgtaaatcatgttgatcatgt

SEQ ID NO: 6498100 - DNA, 20 bp, Homo sapiens
tgtaaatcctagacttgaaa

SEQ ID NO: 6498101 - DNA, 13 bp, Homo sapiens
tgtaaatcctgtg

SEQ ID NO: 6498102 - DNA, 13 bp, Homo sapiens
tgtaaatccttgt

SEQ ID NO: 6498103 - DNA, 20 bp, Homo sapiens
tgtaaatcgggaaggatggg

SEQ ID NO: 6498104 - DNA, 14 bp, Homo sapiens
tgtaaatctgccac

SEQ ID NO: 6498105 - DNA, 17 bp, Homo sapiens
tgtaaatctgtactttt

SEQ ID NO: 6498106 - DNA, 13 bp, Homo sapiens
tgtaaatctttgt

SEQ ID NO: 6498107 - DNA, 20 bp, Homo sapiens
tgtaaatgaaacttaagaat

SEQ ID NO: 6498108 - DNA, 21 bp, Homo sapiens
tgtaaatgaacacatggcaga

SEQ ID NO: 6498109 - DNA, 13 bp, Homo sapiens
tgtaaatgaagat

SEQ ID NO: 6498110 - DNA, 22 bp, Homo sapiens
tgtaaatgaagggtcatttctc

SEQ ID NO: 6498111 - DNA, 19 bp, Homo sapiens
tgtaaatgaccaagaaaaa

SEQ ID NO: 6498112 - DNA, 22 bp, Homo sapiens
tgtaaatgaccaagaaaaagaa

SEQ ID NO: 6498113 - DNA, 20 bp, Homo sapiens
tgtaaatgactttcataata

SEQ ID NO: 6498114 - DNA, 16 bp, Homo sapiens
tgtaaatgagacacat

SEQ ID NO: 6498115 - DNA, 16 bp, Homo sapiens
tgtaaatgatatgtct

SEQ ID NO: 6498116 - DNA, 23 bp, Homo sapiens
tgtaaatgcatattaaataataa

SEQ ID NO: 6498117 - DNA, 22 bp, Homo sapiens
tgtaaatgccttgcttgtatga

SEQ ID NO: 6498118 - DNA, 23 bp, Homo sapiens
tgtaaatgccttgcttgtatgat

SEQ ID NO: 6498119 - DNA, 20 bp, Homo sapiens
tgtaaatgctattatactgt

SEQ ID NO: 6498120 - DNA, 15 bp, Homo sapiens
tgtaaatgctggtat

SEQ ID NO: 6498121 - DNA, 21 bp, Homo sapiens
tgtaaatgcttaaatttcaga

SEQ ID NO: 6498122 - DNA, 17 bp, Homo sapiens
tgtaaatggagcttgta

SEQ ID NO: 6498123 - DNA, 18 bp, Homo sapiens
tgtaaatggagcttgtac

SEQ ID NO: 6498124 - DNA, 20 bp, Homo sapiens
tgtaaatggagcttgtacat

SEQ ID NO: 6498125 - DNA, 16 bp, Homo sapiens
tgtaaatggtgtacat

SEQ ID NO: 6498126 - DNA, 17 bp, Homo sapiens
tgtaaatggtgtacata

SEQ ID NO: 6498127 - DNA, 16 bp, Homo sapiens
tgtaaatggttttgtt

SEQ ID NO: 6498128 - DNA, 23 bp, Homo sapiens
tgtaaatggttttgttttgcacg

SEQ ID NO: 6498129 - DNA, 16 bp, Homo sapiens
tgtaaatgtaaactca

SEQ ID NO: 6498130 - DNA, 19 bp, Homo sapiens
tgtaaatgtactggtaatt

SEQ ID NO: 6498131 - DNA, 14 bp, Homo sapiens
tgtaaatgtattca

SEQ ID NO: 6498132 - DNA, 21 bp, Homo sapiens
tgtaaatgtattcattcttaa

SEQ ID NO: 6498133 - DNA, 14 bp, Homo sapiens
tgtaaatgtcctga

SEQ ID NO: 6498134 - DNA, 20 bp, Homo sapiens
tgtaaatgtctcactgagca

SEQ ID NO: 6498135 - DNA, 11 bp, Homo sapiens
tgtaaatgtta

SEQ ID NO: 6498136 - DNA, 19 bp, Homo sapiens
tgtaaatgttagtttcttg

SEQ ID NO: 6498137 - DNA, 16 bp, Homo sapiens
tgtaaatgttatttct

SEQ ID NO: 6498138 - DNA, 20 bp, Homo sapiens
tgtaaatgtttaatatctga

SEQ ID NO: 6498139 - DNA, 14 bp, Homo sapiens
tgtaaatgtttctt

SEQ ID NO: 6498140 - DNA, 15 bp, Homo sapiens
tgtaaattaactttt

SEQ ID NO: 6498141 - DNA, 15 bp, Homo sapiens
tgtaaattaagtgtg

SEQ ID NO: 6498142 - DNA, 20 bp, Homo sapiens
tgtaaattaccagtaaagtg

SEQ ID NO: 6498143 - DNA, 21 bp, Homo sapiens
tgtaaattaccagtaaagtgt

SEQ ID NO: 6498144 - DNA, 16 bp, Homo sapiens
tgtaaattagtttgac

SEQ ID NO: 6498145 - DNA, 19 bp, Homo sapiens
tgtaaattagtttgacact

SEQ ID NO: 6498146 - DNA, 10 bp, Homo sapiens
tgtaaattat

SEQ ID NO: 6498147 - DNA, 15 bp, Homo sapiens
tgtaaattatatttg

SEQ ID NO: 6498148 - DNA, 13 bp, Homo sapiens
tgtaaattatgta

SEQ ID NO: 6498149 - DNA, 17 bp, Homo sapiens
tgtaaattattgtaaac

SEQ ID NO: 6498150 - DNA, 22 bp, Homo sapiens
tgtaaattattgtaaacttttt

SEQ ID NO: 6498151 - DNA, 12 bp, Homo sapiens
tgtaaattattt

SEQ ID NO: 6498152 - DNA, 16 bp, Homo sapiens
tgtaaattatttatgt

SEQ ID NO: 6498153 - DNA, 18 bp, Homo sapiens
tgtaaattatttcataca

SEQ ID NO: 6498154 - DNA, 13 bp, Homo sapiens
tgtaaattatttg

SEQ ID NO: 6498155 - DNA, 14 bp, Homo sapiens
tgtaaattcagtct

SEQ ID NO: 6498156 - DNA, 15 bp, Homo sapiens
tgtaaattctgattt

SEQ ID NO: 6498157 - DNA, 19 bp, Homo sapiens
tgtaaattctgatttcttt

SEQ ID NO: 6498158 - DNA, 14 bp, Homo sapiens
tgtaaattgaagaa

SEQ ID NO: 6498159 - DNA, 22 bp, Homo sapiens
tgtaaattgatgggagaaatga

SEQ ID NO: 6498160 - DNA, 11 bp, Homo sapiens
tgtaaattggc

SEQ ID NO: 6498161 - DNA, 12 bp, Homo sapiens
tgtaaattggca

SEQ ID NO: 6498162 - DNA, 18 bp, Homo sapiens
tgtaaatttaactgcata

SEQ ID NO: 6498163 - DNA, 14 bp, Homo sapiens
tgtaaatttagtgt

SEQ ID NO: 6498164 - DNA, 15 bp, Homo sapiens
tgtaaatttataaat

SEQ ID NO: 6498165 - DNA, 16 bp, Homo sapiens
tgtaaatttatgtgat

SEQ ID NO: 6498166 - DNA, 23 bp, Homo sapiens
tgtaaattttaatgttaactttc

SEQ ID NO: 6498167 - DNA, 17 bp, Homo sapiens
tgtaaattttagagcat

SEQ ID NO: 6498168 - DNA, 21 bp, Homo sapiens
tgtaaattttagagcatacca

SEQ ID NO: 6498169 - DNA, 13 bp, Homo sapiens
tgtaacaagaaaa

SEQ ID NO: 6498170 - DNA, 14 bp, Homo sapiens
tgtaacaagaaagg

SEQ ID NO: 6498171 - DNA, 15 bp, Homo sapiens
tgtaacaagaaagga

SEQ ID NO: 6498172 - DNA, 17 bp, Homo sapiens
tgtaacaagaaaggaga

SEQ ID NO: 6498173 - DNA, 18 bp, Homo sapiens
tgtaacaagaaaggagag

SEQ ID NO: 6498174 - DNA, 20 bp, Homo sapiens
tgtaacaagaaagtggtctg

SEQ ID NO: 6498175 - DNA, 17 bp, Homo sapiens
tgtaacaagccacccca

SEQ ID NO: 6498176 - DNA, 18 bp, Homo sapiens
tgtaacaagccagatttt

SEQ ID NO: 6498177 - DNA, 21 bp, Homo sapiens
tgtaacaagttccattatgaa

SEQ ID NO: 6498178 - DNA, 15 bp, Homo sapiens
tgtaacaattgtgta

SEQ ID NO: 6498179 - DNA, 16 bp, Homo sapiens
tgtaacaattgtgtag

SEQ ID NO: 6498180 - DNA, 11 bp, Homo sapiens
tgtaacacaag

SEQ ID NO: 6498181 - DNA, 22 bp, Homo sapiens
tgtaacacataaacaattcatg

SEQ ID NO: 6498182 - DNA, 16 bp, Homo sapiens
tgtaacactagccgaa

SEQ ID NO: 6498183 - DNA, 15 bp, Homo sapiens
tgtaacactggccag

SEQ ID NO: 6498184 - DNA, 11 bp, Homo sapiens
tgtaacactgt

SEQ ID NO: 6498185 - DNA, 18 bp, Homo sapiens
tgtaacactgtgtacacc

SEQ ID NO: 6498186 - DNA, 22 bp, Homo sapiens
tgtaacactgtgtacacctcaa

SEQ ID NO: 6498187 - DNA, 13 bp, Homo sapiens
tgtaacagaaagg

SEQ ID NO: 6498188 - DNA, 17 bp, Homo sapiens
tgtaacagaaagggcaa

SEQ ID NO: 6498189 - DNA, 15 bp, Homo sapiens
tgtaacagacattgt

SEQ ID NO: 6498190 - DNA, 16 bp, Homo sapiens
tgtaacagacattgtt

SEQ ID NO: 6498191 - DNA, 12 bp, Homo sapiens
tgtaacagctcc

SEQ ID NO: 6498192 - DNA, 17 bp, Homo sapiens
tgtaacagctccttggg

SEQ ID NO: 6498193 - DNA, 18 bp, Homo sapiens
tgtaacagctccttggga

SEQ ID NO: 6498194 - DNA, 16 bp, Homo sapiens
tgtaacaggcttttat

SEQ ID NO: 6498195 - DNA, 18 bp, Homo sapiens
tgtaacaggtctcctctt

SEQ ID NO: 6498196 - DNA, 16 bp, Homo sapiens
tgtaacagtcaaatat

SEQ ID NO: 6498197 - DNA, 13 bp, Homo sapiens
tgtaacagttgtg

SEQ ID NO: 6498198 - DNA, 17 bp, Homo sapiens
tgtaacagttgtgtcat

SEQ ID NO: 6498199 - DNA, 20 bp, Homo sapiens
tgtaacagttgtgtcataaa

SEQ ID NO: 6498200 - DNA, 17 bp, Homo sapiens
tgtaacatactggcctg

SEQ ID NO: 6498201 - DNA, 17 bp, Homo sapiens
tgtaacatagtccagag

SEQ ID NO: 6498202 - DNA, 14 bp, Homo sapiens
tgtaacatatgcaa

SEQ ID NO: 6498203 - DNA, 12 bp, Homo sapiens
tgtaacatattt

SEQ ID NO: 6498204 - DNA, 21 bp, Homo sapiens
tgtaacatcataattacattc

SEQ ID NO: 6498205 - DNA, 19 bp, Homo sapiens
tgtaacatccaagccagag

SEQ ID NO: 6498206 - DNA, 20 bp, Homo sapiens
tgtaacatccagctctatgt

SEQ ID NO: 6498207 - DNA, 14 bp, Homo sapiens
tgtaacatctgcca

SEQ ID NO: 6498208 - DNA, 19 bp, Homo sapiens
tgtaacatgtctaaagtta

SEQ ID NO: 6498209 - DNA, 20 bp, Homo sapiens
tgtaacattaattctactaa

SEQ ID NO: 6498210 - DNA, 19 bp, Homo sapiens
tgtaacattgtaaagtatg

SEQ ID NO: 6498211 - DNA, 11 bp, Homo sapiens
tgtaacattta

SEQ ID NO: 6498212 - DNA, 14 bp, Homo sapiens
tgtaaccaagctgt

SEQ ID NO: 6498213 - DNA, 18 bp, Homo sapiens
tgtaaccacaactttcac

SEQ ID NO: 6498214 - DNA, 20 bp, Homo sapiens
tgtaaccacctctctgtctt

SEQ ID NO: 6498215 - DNA, 18 bp, Homo sapiens
tgtaaccagcagtcacag

SEQ ID NO: 6498216 - DNA, 20 bp, Homo sapiens
tgtaaccagtgcagaaatga

SEQ ID NO: 6498217 - DNA, 16 bp, Homo sapiens
tgtaaccagttataaa

SEQ ID NO: 6498218 - DNA, 15 bp, Homo sapiens
tgtaaccatatgatt

SEQ ID NO: 6498219 - DNA, 13 bp, Homo sapiens
tgtaaccatttta

SEQ ID NO: 6498220 - DNA, 22 bp, Homo sapiens
tgtaaccattttataaagtgct

SEQ ID NO: 6498221 - DNA, 19 bp, Homo sapiens
tgtaacctcagctctggga

SEQ ID NO: 6498222 - DNA, 23 bp, Homo sapiens
tgtaacctcagctctgggagagg

SEQ ID NO: 6498223 - DNA, 13 bp, Homo sapiens
tgtaacctcgtgt

SEQ ID NO: 6498224 - DNA, 19 bp, Homo sapiens
tgtaacctgttgctgtgtt

SEQ ID NO: 6498225 - DNA, 21 bp, Homo sapiens
tgtaacgattgacaccaaaat

SEQ ID NO: 6498226 - DNA, 19 bp, Homo sapiens
tgtaacgcaagttcccagt

SEQ ID NO: 6498227 - DNA, 16 bp, Homo sapiens
tgtaacgtggcactgg

SEQ ID NO: 6498228 - DNA, 18 bp, Homo sapiens
tgtaacgttgctgtggga

SEQ ID NO: 6498229 - DNA, 23 bp, Homo sapiens
tgtaactaaaataattttgtaat

SEQ ID NO: 6498230 - DNA, 17 bp, Homo sapiens
tgtaactaatagatttt

SEQ ID NO: 6498231 - DNA, 18 bp, Homo sapiens
tgtaactacaaagctttg

SEQ ID NO: 6498232 - DNA, 18 bp, Homo sapiens
tgtaactactttataact

SEQ ID NO: 6498233 - DNA, 18 bp, Homo sapiens
tgtaactaggctcagaga

SEQ ID NO: 6498234 - DNA, 19 bp, Homo sapiens
tgtaactatagtccagctt

SEQ ID NO: 6498235 - DNA, 18 bp, Homo sapiens
tgtaactatatcatcctt

SEQ ID NO: 6498236 - DNA, 12 bp, Homo sapiens
tgtaactatgtt

SEQ ID NO: 6498237 - DNA, 13 bp, Homo sapiens
tgtaactatgttt

SEQ ID NO: 6498238 - DNA, 17 bp, Homo sapiens
tgtaactatgttttatc

SEQ ID NO: 6498239 - DNA, 17 bp, Homo sapiens
tgtaactattaaccttt

SEQ ID NO: 6498240 - DNA, 18 bp, Homo sapiens
tgtaactattgggtgaat

SEQ ID NO: 6498241 - DNA, 19 bp, Homo sapiens
tgtaactatttcttcagag

SEQ ID NO: 6498242 - DNA, 12 bp, Homo sapiens
tgtaactcacat

SEQ ID NO: 6498243 - DNA, 21 bp, Homo sapiens
tgtaactcaccgtgctgtctt

SEQ ID NO: 6498244 - DNA, 12 bp, Homo sapiens
tgtaactccacc

SEQ ID NO: 6498245 - DNA, 13 bp, Homo sapiens
tgtaactccacca

SEQ ID NO: 6498246 - DNA, 21 bp, Homo sapiens
tgtaactccagatagagaaat

SEQ ID NO: 6498247 - DNA, 19 bp, Homo sapiens
tgtaactcctccatccatg

SEQ ID NO: 6498248 - DNA, 21 bp, Homo sapiens
tgtaactcctccatccatgtg

SEQ ID NO: 6498249 - DNA, 12 bp, Homo sapiens
tgtaactctaaa

SEQ ID NO: 6498250 - DNA, 15 bp, Homo sapiens
tgtaactctccagcc

SEQ ID NO: 6498251 - DNA, 15 bp, Homo sapiens
tgtaactctttggct

SEQ ID NO: 6498252 - DNA, 17 bp, Homo sapiens
tgtaactgaagcataaa

SEQ ID NO: 6498253 - DNA, 11 bp, Homo sapiens
tgtaactgccc

SEQ ID NO: 6498254 - DNA, 16 bp, Homo sapiens
tgtaactgcccagccc

SEQ ID NO: 6498255 - DNA, 18 bp, Homo sapiens
tgtaactgcccagcccct

SEQ ID NO: 6498256 - DNA, 14 bp, Homo sapiens
tgtaactgctcaga

SEQ ID NO: 6498257 - DNA, 22 bp, Homo sapiens
tgtaactgctcttgggcaatat

SEQ ID NO: 6498258 - DNA, 23 bp, Homo sapiens
tgtaactgctcttgggcaatatt

SEQ ID NO: 6498259 - DNA, 21 bp, Homo sapiens
tgtaactggcagttttccatt

SEQ ID NO: 6498260 - DNA, 22 bp, Homo sapiens
tgtaactggctgctccctgctc

SEQ ID NO: 6498261 - DNA, 16 bp, Homo sapiens
tgtaactgggttcaaa

SEQ ID NO: 6498262 - DNA, 21 bp, Homo sapiens
tgtaactggtagtgttcagta

SEQ ID NO: 6498263 - DNA, 21 bp, Homo sapiens
tgtaactgtcttctagcagtg

SEQ ID NO: 6498264 - DNA, 20 bp, Homo sapiens
tgtaactgttaccattggaa

SEQ ID NO: 6498265 - DNA, 14 bp, Homo sapiens
tgtaacttaaagat

SEQ ID NO: 6498266 - DNA, 21 bp, Homo sapiens
tgtaacttaattataagctat

SEQ ID NO: 6498267 - DNA, 14 bp, Homo sapiens
tgattactgtcaat

SEQ ID NO: 6498268 - DNA, 17 bp, Homo sapiens
tgattactgtcaataaa

SEQ ID NO: 6498269 - DNA, 20 bp, Homo sapiens
tgattagagtggttattcat

SEQ ID NO: 6498270 - DNA, 15 bp, Homo sapiens
tgattagataaagat

SEQ ID NO: 6498271 - DNA, 13 bp, Homo sapiens
tgattagatcaca

SEQ ID NO: 6498272 - DNA, 11 bp, Homo sapiens
tgattagatga

SEQ ID NO: 6498273 - DNA, 12 bp, Homo sapiens
tgattagcagtt

SEQ ID NO: 6498274 - DNA, 19 bp, Homo sapiens
tgattagcctcgtctttca

SEQ ID NO: 6498275 - DNA, 16 bp, Homo sapiens
tgattagctttgtgtt

SEQ ID NO: 6498276 - DNA, 21 bp, Homo sapiens
tgattaggtatgtttgtaact

SEQ ID NO: 6498277 - DNA, 21 bp, Homo sapiens
tgattagtaagtcttgcctat

SEQ ID NO: 6498278 - DNA, 15 bp, Homo sapiens
tgattagtatgctat

SEQ ID NO: 6498279 - DNA, 15 bp, Homo sapiens
tgattagttatgtct

SEQ ID NO: 6498280 - DNA, 22 bp, Homo sapiens
tgattagttatgtcttttaata

SEQ ID NO: 6498281 - DNA, 19 bp, Homo sapiens
tgattagttgacagtatta

SEQ ID NO: 6498282 - DNA, 22 bp, Homo sapiens
tgattagttgacagtattaaca

SEQ ID NO: 6498283 - DNA, 13 bp, Homo sapiens
tgattataaatgt

SEQ ID NO: 6498284 - DNA, 21 bp, Homo sapiens
tgattataaatgtttggaaag

SEQ ID NO: 6498285 - DNA, 16 bp, Homo sapiens
tgattatacaaaagag

SEQ ID NO: 6498286 - DNA, 15 bp, Homo sapiens
tgattataccatgtg

SEQ ID NO: 6498287 - DNA, 21 bp, Homo sapiens
tgattatagaaggctgtctta

SEQ ID NO: 6498288 - DNA, 21 bp, Homo sapiens
tgattatagcaatgtgatttt

SEQ ID NO: 6498289 - DNA, 22 bp, Homo sapiens
tgattatagttaagcaaatttc

SEQ ID NO: 6498290 - DNA, 14 bp, Homo sapiens
tgattatatattgt

SEQ ID NO: 6498291 - DNA, 16 bp, Homo sapiens
tgattatattgttttt

SEQ ID NO: 6498292 - DNA, 13 bp, Homo sapiens
tgattatatttca

SEQ ID NO: 6498293 - DNA, 17 bp, Homo sapiens
tgattatcatttatttt

SEQ ID NO: 6498294 - DNA, 12 bp, Homo sapiens
tgattatgaaat

SEQ ID NO: 6498295 - DNA, 15 bp, Homo sapiens
tgattatgaaatgcc

SEQ ID NO: 6498296 - DNA, 21 bp, Homo sapiens
tgattatgaattacatttgta

SEQ ID NO: 6498297 - DNA, 19 bp, Homo sapiens
tgattatgattagttatgt

SEQ ID NO: 6498298 - DNA, 22 bp, Homo sapiens
tgattatggacatcgatatgaa

SEQ ID NO: 6498299 - DNA, 16 bp, Homo sapiens
tgattatgtaagcatt

SEQ ID NO: 6498300 - DNA, 14 bp, Homo sapiens
tgattattacaaca

SEQ ID NO: 6498301 - DNA, 18 bp, Homo sapiens
tgattattacaacaagca

SEQ ID NO: 6498302 - DNA, 17 bp, Homo sapiens
tgattattacttctgtt

SEQ ID NO: 6498303 - DNA, 16 bp, Homo sapiens
tgattattatgtttat

SEQ ID NO: 6498304 - DNA, 20 bp, Homo sapiens
tgattattatgtttattaca

SEQ ID NO: 6498305 - DNA, 14 bp, Homo sapiens
tgattattatttaa

SEQ ID NO: 6498306 - DNA, 16 bp, Homo sapiens
tgattattcagtgtca

SEQ ID NO: 6498307 - DNA, 13 bp, Homo sapiens
tgattattgaatg

SEQ ID NO: 6498308 - DNA, 17 bp, Homo sapiens
tgattattgagaaagga

SEQ ID NO: 6498309 - DNA, 13 bp, Homo sapiens
tgattattgtatt

SEQ ID NO: 6498310 - DNA, 16 bp, Homo sapiens
tgattatttatgacct

SEQ ID NO: 6498311 - DNA, 16 bp, Homo sapiens
tgattatttcacttta

SEQ ID NO: 6498312 - DNA, 13 bp, Homo sapiens
tgattatttgtat

SEQ ID NO: 6498313 - DNA, 12 bp, Homo sapiens
tgattattttag

SEQ ID NO: 6498314 - DNA, 15 bp, Homo sapiens
tgattattttagcta

SEQ ID NO: 6498315 - DNA, 21 bp, Homo sapiens
tgattatttttcttttaaaga

SEQ ID NO: 6498316 - DNA, 20 bp, Homo sapiens
tgattatttttttctgtaaa

SEQ ID NO: 6498317 - DNA, 18 bp, Homo sapiens
tgattattttttttttct

SEQ ID NO: 6498318 - DNA, 13 bp, Homo sapiens
tgattcaaaatat

SEQ ID NO: 6498319 - DNA, 14 bp, Homo sapiens
tgattcaaaatatt

SEQ ID NO: 6498320 - DNA, 18 bp, Homo sapiens
tgattcaaagtagtttta

SEQ ID NO: 6498321 - DNA, 20 bp, Homo sapiens
tgattcaaatatcaaaagga

SEQ ID NO: 6498322 - DNA, 14 bp, Homo sapiens
tgattcaaatgtta

SEQ ID NO: 6498323 - DNA, 14 bp, Homo sapiens
tgattcaaatgttt

SEQ ID NO: 6498324 - DNA, 15 bp, Homo sapiens
tgattcaaatgtttt

SEQ ID NO: 6498325 - DNA, 16 bp, Homo sapiens
tgattcaaatgtttta

SEQ ID NO: 6498326 - DNA, 13 bp, Homo sapiens
tgattcaacctga

SEQ ID NO: 6498327 - DNA, 14 bp, Homo sapiens
tgattcaactaaaa

SEQ ID NO: 6498328 - DNA, 17 bp, Homo sapiens
tgattcaagaacaagca

SEQ ID NO: 6498329 - DNA, 16 bp, Homo sapiens
tgattcaaggctcaga

SEQ ID NO: 6498330 - DNA, 20 bp, Homo sapiens
tgattcaaggctcagaagga

SEQ ID NO: 6498331 - DNA, 19 bp, Homo sapiens
tgattcaataaaatgcact

SEQ ID NO: 6498332 - DNA, 16 bp, Homo sapiens
tgattcaatctgtaaa

SEQ ID NO: 6498333 - DNA, 21 bp, Homo sapiens
tgattcaatctgtaaactgtg

SEQ ID NO: 6498334 - DNA, 14 bp, Homo sapiens
tgattcaatgtgaa

SEQ ID NO: 6498335 - DNA, 17 bp, Homo sapiens
tgattcaattaacatat

SEQ ID NO: 6498336 - DNA, 19 bp, Homo sapiens
tgattcaattttttaatgt

SEQ ID NO: 6498337 - DNA, 12 bp, Homo sapiens
tgattcacagtg

SEQ ID NO: 6498338 - DNA, 15 bp, Homo sapiens
tgattcacatgtttt

SEQ ID NO: 6498339 - DNA, 16 bp, Homo sapiens
tgattcacatgttttc

SEQ ID NO: 6498340 - DNA, 21 bp, Homo sapiens
tgattcacatgttttcaaatg

SEQ ID NO: 6498341 - DNA, 24 bp, Homo sapiens
tgattcaccaaaatagtcttctca

SEQ ID NO: 6498342 - DNA, 21 bp, Homo sapiens
tgattcacctcttcctctggt

SEQ ID NO: 6498343 - DNA, 16 bp, Homo sapiens
tgattcactattagag

SEQ ID NO: 6498344 - DNA, 12 bp, Homo sapiens
tgattcactgca

SEQ ID NO: 6498345 - DNA, 17 bp, Homo sapiens
tgattcactgcatggct

SEQ ID NO: 6498346 - DNA, 20 bp, Homo sapiens
tgattcacttcacgctttca

SEQ ID NO: 6498347 - DNA, 21 bp, Homo sapiens
tgattcagaaaatgttctgtt

SEQ ID NO: 6498348 - DNA, 14 bp, Homo sapiens
tgattcagaaattg

SEQ ID NO: 6498349 - DNA, 16 bp, Homo sapiens
tgattcagaaattgga

SEQ ID NO: 6498350 - DNA, 16 bp, Homo sapiens
tgattcagacagctgc

SEQ ID NO: 6498351 - DNA, 12 bp, Homo sapiens
tgattcagcatt

SEQ ID NO: 6498352 - DNA, 21 bp, Homo sapiens
tgattcagcattttttatcag

SEQ ID NO: 6498353 - DNA, 19 bp, Homo sapiens
tgattcagctcattatgaa

SEQ ID NO: 6498354 - DNA, 21 bp, Homo sapiens
tgattcagctcattatgaaaa

SEQ ID NO: 6498355 - DNA, 14 bp, Homo sapiens
tgattcagctctgc

SEQ ID NO: 6498356 - DNA, 20 bp, Homo sapiens
tgattcaggaggtcatctga

SEQ ID NO: 6498357 - DNA, 19 bp, Homo sapiens
tgattcaggcttataacaa

SEQ ID NO: 6498358 - DNA, 19 bp, Homo sapiens
tgattcagggttatttgag

SEQ ID NO: 6498359 - DNA, 14 bp, Homo sapiens
tgattcaggtgcag

SEQ ID NO: 6498360 - DNA, 14 bp, Homo sapiens
tgattcagtatctt

SEQ ID NO: 6498361 - DNA, 22 bp, Homo sapiens
tgattcagtatcttagagttta

SEQ ID NO: 6498362 - DNA, 16 bp, Homo sapiens
tgattcagtcttctgg

SEQ ID NO: 6498363 - DNA, 18 bp, Homo sapiens
tgattcagtcttctggat

SEQ ID NO: 6498364 - DNA, 12 bp, Homo sapiens
tgattcagtgtt

SEQ ID NO: 6498365 - DNA, 24 bp, Homo sapiens
tgattcagtgttaaatgtgatgaa

SEQ ID NO: 6498366 - DNA, 12 bp, Homo sapiens
tgattcataaca

SEQ ID NO: 6498367 - DNA, 13 bp, Homo sapiens
tgattcataacaa

SEQ ID NO: 6498368 - DNA, 16 bp, Homo sapiens
tgattcataacaatgt

SEQ ID NO: 6498369 - DNA, 15 bp, Homo sapiens
tgattcataatgact

SEQ ID NO: 6498370 - DNA, 17 bp, Homo sapiens
tgattcatactcctttt

SEQ ID NO: 6498371 - DNA, 20 bp, Homo sapiens
tgattcatagtaaaatacct

SEQ ID NO: 6498372 - DNA, 16 bp, Homo sapiens
tgattcatagtaactt

SEQ ID NO: 6498373 - DNA, 18 bp, Homo sapiens
tgattcatagtaacttct

SEQ ID NO: 6498374 - DNA, 19 bp, Homo sapiens
tgattcatagtaacttctt

SEQ ID NO: 6498375 - DNA, 14 bp, Homo sapiens
tgattcatattgca

SEQ ID NO: 6498376 - DNA, 15 bp, Homo sapiens
tgattcatattgcat

SEQ ID NO: 6498377 - DNA, 19 bp, Homo sapiens
tgattcatatttaatttga

SEQ ID NO: 6498378 - DNA, 15 bp, Homo sapiens
tgattcatcctggga

SEQ ID NO: 6498379 - DNA, 16 bp, Homo sapiens
tgattcatctctggtt

SEQ ID NO: 6498380 - DNA, 17 bp, Homo sapiens
tgattcatctttcagaa

SEQ ID NO: 6498381 - DNA, 18 bp, Homo sapiens
tgattcatctttcagaaa

SEQ ID NO: 6498382 - DNA, 19 bp, Homo sapiens
tgattcatctttcagaaat

SEQ ID NO: 6498383 - DNA, 19 bp, Homo sapiens
tgattcatgccaattagca

SEQ ID NO: 6498384 - DNA, 16 bp, Homo sapiens
tgattcatttgaataa

SEQ ID NO: 6498385 - DNA, 20 bp, Homo sapiens
tgattcatttgaataaaaag

SEQ ID NO: 6498386 - DNA, 17 bp, Homo sapiens
tgattcattttaacatc

SEQ ID NO: 6498387 - DNA, 19 bp, Homo sapiens
tgattcattttcctgttca

SEQ ID NO: 6498388 - DNA, 11 bp, Homo sapiens
tgattccaaat

SEQ ID NO: 6498389 - DNA, 17 bp, Homo sapiens
tgattccaaatatgtat

SEQ ID NO: 6498390 - DNA, 21 bp, Homo sapiens
tgattccaacaggcgtgggat

SEQ ID NO: 6498391 - DNA, 15 bp, Homo sapiens
tgattccaagggccc

SEQ ID NO: 6498392 - DNA, 17 bp, Homo sapiens
tgattccaagggcccag

SEQ ID NO: 6498393 - DNA, 21 bp, Homo sapiens
tgattccactacacctggctg

SEQ ID NO: 6498394 - DNA, 14 bp, Homo sapiens
tgattccagcaaga

SEQ ID NO: 6498395 - DNA, 15 bp, Homo sapiens
tgattccagccatca

SEQ ID NO: 6498396 - DNA, 19 bp, Homo sapiens
tgattccattttacttcca

SEQ ID NO: 6498397 - DNA, 18 bp, Homo sapiens
tgattcccaagctctgct

SEQ ID NO: 6498398 - DNA, 18 bp, Homo sapiens
tgattcccacccaaaccc

SEQ ID NO: 6498399 - DNA, 15 bp, Homo sapiens
tgattcccagagcag

SEQ ID NO: 6498400 - DNA, 16 bp, Homo sapiens
tgattcccagatgtgt

SEQ ID NO: 6498401 - DNA, 16 bp, Homo sapiens
tgattcccataacata

SEQ ID NO: 6498402 - DNA, 11 bp, Homo sapiens
tgattccccac

SEQ ID NO: 6498403 - DNA, 20 bp, Homo sapiens
tgattcccgcatggttttta

SEQ ID NO: 6498404 - DNA, 18 bp, Homo sapiens
tgattccctcctgctact

SEQ ID NO: 6498405 - DNA, 18 bp, Homo sapiens
tgattcccttgttattca

SEQ ID NO: 6498406 - DNA, 14 bp, Homo sapiens
tgattcccttttct

SEQ ID NO: 6498407 - DNA, 16 bp, Homo sapiens
tgattcctaaggccca

SEQ ID NO: 6498408 - DNA, 17 bp, Homo sapiens
tgattcctaaggcccag

SEQ ID NO: 6498409 - DNA, 15 bp, Homo sapiens
tgattcctacccctc

SEQ ID NO: 6498410 - DNA, 22 bp, Homo sapiens
tgattcctctcatttccagctt

SEQ ID NO: 6498411 - DNA, 15 bp, Homo sapiens
tgattcctgctgcct

SEQ ID NO: 6498412 - DNA, 20 bp, Homo sapiens
tgattccttcctgttctgaa

SEQ ID NO: 6498413 - DNA, 15 bp, Homo sapiens
tgattccttgagttt

SEQ ID NO: 6498414 - DNA, 23 bp, Homo sapiens
tgattccttgagtttcatatata

SEQ ID NO: 6498415 - DNA, 22 bp, Homo sapiens
tgattccttgatggagatattt

SEQ ID NO: 6498416 - DNA, 15 bp, Homo sapiens
tgattcctttaacaa

SEQ ID NO: 6498417 - DNA, 20 bp, Homo sapiens
tgattccttttgatggggag

SEQ ID NO: 6498418 - DNA, 23 bp, Homo sapiens
tgattccttttgatggggagaaa

SEQ ID NO: 6498419 - DNA, 23 bp, Homo sapiens
tgattcgaagggtcttaaagaat

SEQ ID NO: 6498420 - DNA, 23 bp, Homo sapiens
tgattcgagctatatttaagtat

SEQ ID NO: 6498421 - DNA, 22 bp, Homo sapiens
tgattcgaggtcctcctggcct

SEQ ID NO: 6498422 - DNA, 16 bp, Homo sapiens
tgattcgcccaaagcc

SEQ ID NO: 6498423 - DNA, 20 bp, Homo sapiens
tgattcggatttgacaaaat

SEQ ID NO: 6498424 - DNA, 18 bp, Homo sapiens
tgattcggggctgacctt

SEQ ID NO: 6498425 - DNA, 18 bp, Homo sapiens
tgattcgtagatttaata

SEQ ID NO: 6498426 - DNA, 17 bp, Homo sapiens
tgattcgtatgatcagt

SEQ ID NO: 6498427 - DNA, 15 bp, Homo sapiens
tgattctaatgtctt

SEQ ID NO: 6498428 - DNA, 13 bp, Homo sapiens
tgattctatgtaa

SEQ ID NO: 6498429 - DNA, 15 bp, Homo sapiens
tgattctatgtaact

SEQ ID NO: 6498430 - DNA, 20 bp, Homo sapiens
tgattctatgtaatgtaaac

SEQ ID NO: 6498431 - DNA, 16 bp, Homo sapiens
tgattctattatatat

SEQ ID NO: 6498432 - DNA, 16 bp, Homo sapiens
tgattctcagggctgg

SEQ ID NO: 6498433 - DNA, 19 bp, Homo sapiens
tgattctcagggtctctgc

SEQ ID NO: 6498434 - DNA, 22 bp, Homo sapiens
tgattctcagggtctctgctgc

SEQ ID NO: 6498435 - DNA, 14 bp, Homo sapiens
tgattctcatgcac

SEQ ID NO: 6498436 - DNA, 15 bp, Homo sapiens
tgattctcatgcact

SEQ ID NO: 6498437 - DNA, 22 bp, Homo sapiens
tgattctcatgcactgcaaata

SEQ ID NO: 6498438 - DNA, 13 bp, Homo sapiens
tgattctcatgcc

SEQ ID NO: 6498439 - DNA, 13 bp, Homo sapiens
tgattctccattt

SEQ ID NO: 6498440 - DNA, 14 bp, Homo sapiens
tgattctcctctcc

SEQ ID NO: 6498441 - DNA, 15 bp, Homo sapiens
tgattctcctctccc

SEQ ID NO: 6498442 - DNA, 16 bp, Homo sapiens
tgattctcctctccca

SEQ ID NO: 6498443 - DNA, 21 bp, Homo sapiens
tgattctcctgcctcagcctt

SEQ ID NO: 6498444 - DNA, 15 bp, Homo sapiens
tgattctcctgtcag

SEQ ID NO: 6498445 - DNA, 19 bp, Homo sapiens
tgattctccttcagccctc

SEQ ID NO: 6498446 - DNA, 23 bp, Homo sapiens
tgattctccttcagccctcaccc

SEQ ID NO: 6498447 - DNA, 14 bp, Homo sapiens
tgtaacttagcttt

SEQ ID NO: 6498448 - DNA, 15 bp, Homo sapiens
tgtaacttagcttta

SEQ ID NO: 6498449 - DNA, 17 bp, Homo sapiens
tgtaacttatattgaag

SEQ ID NO: 6498450 - DNA, 18 bp, Homo sapiens
tgtaacttatattgaaga

SEQ ID NO: 6498451 - DNA, 17 bp, Homo sapiens
tgtaacttatgtagata

SEQ ID NO: 6498452 - DNA, 14 bp, Homo sapiens
tgtaacttcaaata

SEQ ID NO: 6498453 - DNA, 15 bp, Homo sapiens
tgtaacttccaaata

SEQ ID NO: 6498454 - DNA, 17 bp, Homo sapiens
tgtaacttccaaataaa

SEQ ID NO: 6498455 - DNA, 19 bp, Homo sapiens
tgtaacttccaaataaata

SEQ ID NO: 6498456 - DNA, 13 bp, Homo sapiens
tgtaacttcctgc

SEQ ID NO: 6498457 - DNA, 14 bp, Homo sapiens
tgtaacttcctgct

SEQ ID NO: 6498458 - DNA, 15 bp, Homo sapiens
tgtaacttcctgctg

SEQ ID NO: 6498459 - DNA, 17 bp, Homo sapiens
tgtaacttcctgctgca

SEQ ID NO: 6498460 - DNA, 19 bp, Homo sapiens
tgtaacttcctgctgcacc

SEQ ID NO: 6498461 - DNA, 23 bp, Homo sapiens
tgtaacttcctgctgcaccctgc

SEQ ID NO: 6498462 - DNA, 23 bp, Homo sapiens
tgtaacttgccatccgcacagaa

SEQ ID NO: 6498463 - DNA, 16 bp, Homo sapiens
tgtaacttgcttaaat

SEQ ID NO: 6498464 - DNA, 22 bp, Homo sapiens
tgtaacttgcttaaatttctta

SEQ ID NO: 6498465 - DNA, 18 bp, Homo sapiens
tgtaacttgggctgtaaa

SEQ ID NO: 6498466 - DNA, 22 bp, Homo sapiens
tgtaacttgggctgtaaagcaa

SEQ ID NO: 6498467 - DNA, 15 bp, Homo sapiens
tgtaacttgtgcttt

SEQ ID NO: 6498468 - DNA, 17 bp, Homo sapiens
tgtaacttgttgcagac

SEQ ID NO: 6498469 - DNA, 17 bp, Homo sapiens
tgtaactttctctatga

SEQ ID NO: 6498470 - DNA, 16 bp, Homo sapiens
tgtaactttttacatt

SEQ ID NO: 6498471 - DNA, 18 bp, Homo sapiens
tgtaactttttacattac

SEQ ID NO: 6498472 - DNA, 21 bp, Homo sapiens
tgtaacttttttattttaaga

SEQ ID NO: 6498473 - DNA, 18 bp, Homo sapiens
tgtaactttttttcagtt

SEQ ID NO: 6498474 - DNA, 19 bp, Homo sapiens
tgtaactttttttcagttc

SEQ ID NO: 6498475 - DNA, 18 bp, Homo sapiens
tgtaagaaaagctgatga

SEQ ID NO: 6498476 - DNA, 18 bp, Homo sapiens
tgtaagaaaatatcactt

SEQ ID NO: 6498477 - DNA, 22 bp, Homo sapiens
tgtaagaaaccaatcaagataa

SEQ ID NO: 6498478 - DNA, 15 bp, Homo sapiens
tgtaagaaatacaga

SEQ ID NO: 6498479 - DNA, 17 bp, Homo sapiens
tgtaagaaatacagact

SEQ ID NO: 6498480 - DNA, 15 bp, Homo sapiens
tgtaagaaatgtata

SEQ ID NO: 6498481 - DNA, 16 bp, Homo sapiens
tgtaagaacaatgcca

SEQ ID NO: 6498482 - DNA, 19 bp, Homo sapiens
tgtaagaacaatgccaggg

SEQ ID NO: 6498483 - DNA, 16 bp, Homo sapiens
tgtaagaacacatttt

SEQ ID NO: 6498484 - DNA, 19 bp, Homo sapiens
tgtaagaacacattttaaa

SEQ ID NO: 6498485 - DNA, 15 bp, Homo sapiens
tgtaagaactaaaga

SEQ ID NO: 6498486 - DNA, 13 bp, Homo sapiens
tgtaagaactgta

SEQ ID NO: 6498487 - DNA, 15 bp, Homo sapiens
tgtaagaactgtaca

SEQ ID NO: 6498488 - DNA, 16 bp, Homo sapiens
tgtaagaactgtacat

SEQ ID NO: 6498489 - DNA, 19 bp, Homo sapiens
tgtaagaactgtacattgt

SEQ ID NO: 6498490 - DNA, 20 bp, Homo sapiens
tgtaagaagctgtgaatatt

SEQ ID NO: 6498491 - DNA, 21 bp, Homo sapiens
tgtaagacaaaggttttcctc

SEQ ID NO: 6498492 - DNA, 17 bp, Homo sapiens
tgtaagacacacagcct

SEQ ID NO: 6498493 - DNA, 18 bp, Homo sapiens
tgtaagacacacagcctt

SEQ ID NO: 6498494 - DNA, 18 bp, Homo sapiens
tgtaagacacgtgcaaca

SEQ ID NO: 6498495 - DNA, 20 bp, Homo sapiens
tgtaagacagtgccctgaga

SEQ ID NO: 6498496 - DNA, 22 bp, Homo sapiens
tgtaagacccttattgctgtcc

SEQ ID NO: 6498497 - DNA, 15 bp, Homo sapiens
tgtaagagcttgctc

SEQ ID NO: 6498498 - DNA, 23 bp, Homo sapiens
tgtaagaggtactaaaaacactg

SEQ ID NO: 6498499 - DNA, 18 bp, Homo sapiens
tgtaagagtgtagaagca

SEQ ID NO: 6498500 - DNA, 19 bp, Homo sapiens
tgtaagagtgtagaagcat

SEQ ID NO: 6498501 - DNA, 13 bp, Homo sapiens
tgtaagataaaaa

SEQ ID NO: 6498502 - DNA, 22 bp, Homo sapiens
tgtaagatatttgcagtttttc

SEQ ID NO: 6498503 - DNA, 21 bp, Homo sapiens
tgtaagattatagattctaaa

SEQ ID NO: 6498504 - DNA, 23 bp, Homo sapiens
tgtaagattatagattctaaaga

SEQ ID NO: 6498505 - DNA, 21 bp, Homo sapiens
tgtaagatttgtttttaaact

SEQ ID NO: 6498506 - DNA, 23 bp, Homo sapiens
tgtaagatttgtttttaaactgt

SEQ ID NO: 6498507 - DNA, 14 bp, Homo sapiens
tgtaagattttgaa

SEQ ID NO: 6498508 - DNA, 15 bp, Homo sapiens
tgtaagattttgaaa

SEQ ID NO: 6498509 - DNA, 17 bp, Homo sapiens
tgtaagattttgaaaac

SEQ ID NO: 6498510 - DNA, 16 bp, Homo sapiens
tgtaagcaacttgctt

SEQ ID NO: 6498511 - DNA, 18 bp, Homo sapiens
tgtaagcaacttgcttct

SEQ ID NO: 6498512 - DNA, 17 bp, Homo sapiens
tgtaagcagattacaat

SEQ ID NO: 6498513 - DNA, 18 bp, Homo sapiens
tgtaagccaaagaaatga

SEQ ID NO: 6498514 - DNA, 14 bp, Homo sapiens
tgtaagccagagtc

SEQ ID NO: 6498515 - DNA, 17 bp, Homo sapiens
tgtaagccagagtcaac

SEQ ID NO: 6498516 - DNA, 19 bp, Homo sapiens
tgtaagccatcagaagtta

SEQ ID NO: 6498517 - DNA, 15 bp, Homo sapiens
tgtaagctctttgaa

SEQ ID NO: 6498518 - DNA, 14 bp, Homo sapiens
tgtaagctgaaaat

SEQ ID NO: 6498519 - DNA, 15 bp, Homo sapiens
tgtaagctgtttatt

SEQ ID NO: 6498520 - DNA, 16 bp, Homo sapiens
tgtaagctgtttattt

SEQ ID NO: 6498521 - DNA, 22 bp, Homo sapiens
tgtaagctgtttattttatatt

SEQ ID NO: 6498522 - DNA, 19 bp, Homo sapiens
tgtaagcttagattttctg

SEQ ID NO: 6498523 - DNA, 17 bp, Homo sapiens
tgtaagctttgttctgg

SEQ ID NO: 6498524 - DNA, 15 bp, Homo sapiens
tgtaaggaactggaa

SEQ ID NO: 6498525 - DNA, 19 bp, Homo sapiens
tgtaaggaatgcttggaat

SEQ ID NO: 6498526 - DNA, 17 bp, Homo sapiens
tgtaaggacttgtgcct

SEQ ID NO: 6498527 - DNA, 17 bp, Homo sapiens
tgtaaggatgggcatgg

SEQ ID NO: 6498528 - DNA, 15 bp, Homo sapiens
tgtaaggcatgaagg

SEQ ID NO: 6498529 - DNA, 15 bp, Homo sapiens
tgtaaggccttagcc

SEQ ID NO: 6498530 - DNA, 14 bp, Homo sapiens
tgtaaggctgtgta

SEQ ID NO: 6498531 - DNA, 18 bp, Homo sapiens
tgtaagggaaactgccag

SEQ ID NO: 6498532 - DNA, 15 bp, Homo sapiens
tgtaagggcagtgcc

SEQ ID NO: 6498533 - DNA, 14 bp, Homo sapiens
tgtaagggctttaa

SEQ ID NO: 6498534 - DNA, 22 bp, Homo sapiens
tgtaaggtaatttctgtgtatt

SEQ ID NO: 6498535 - DNA, 14 bp, Homo sapiens
tgtaaggtcttctt

SEQ ID NO: 6498536 - DNA, 16 bp, Homo sapiens
tgtaaggtctttgtaa

SEQ ID NO: 6498537 - DNA, 20 bp, Homo sapiens
tgtaaggttttttttgtacg

SEQ ID NO: 6498538 - DNA, 17 bp, Homo sapiens
tgtaagtaaatgtctgt

SEQ ID NO: 6498539 - DNA, 17 bp, Homo sapiens
tgtaagtaagtaagaaa

SEQ ID NO: 6498540 - DNA, 22 bp, Homo sapiens
tgtaagtaataatttgtaaatt

SEQ ID NO: 6498541 - DNA, 14 bp, Homo sapiens
tgtaagtaattatc

SEQ ID NO: 6498542 - DNA, 13 bp, Homo sapiens
tgtaagtataaga

SEQ ID NO: 6498543 - DNA, 13 bp, Homo sapiens
tgtaagtcaggag

SEQ ID NO: 6498544 - DNA, 14 bp, Homo sapiens
tgtaagtcaggagt

SEQ ID NO: 6498545 - DNA, 17 bp, Homo sapiens
tgtaagtgaaaaacatg

SEQ ID NO: 6498546 - DNA, 18 bp, Homo sapiens
tgtaagtgaaaaacatga

SEQ ID NO: 6498547 - DNA, 18 bp, Homo sapiens
tgtaagtgagagagacaa

SEQ ID NO: 6498548 - DNA, 21 bp, Homo sapiens
tgtaagtgagtgtgctgctgt

SEQ ID NO: 6498549 - DNA, 16 bp, Homo sapiens
tgtaagtgctacataa

SEQ ID NO: 6498550 - DNA, 15 bp, Homo sapiens
tgtaagtgtagctca

SEQ ID NO: 6498551 - DNA, 15 bp, Homo sapiens
tgtaagtgtgtgtgt

SEQ ID NO: 6498552 - DNA, 22 bp, Homo sapiens
tgtaagttatgtgttaaattta

SEQ ID NO: 6498553 - DNA, 13 bp, Homo sapiens
tgtaagttatgtt

SEQ ID NO: 6498554 - DNA, 16 bp, Homo sapiens
tgtaagttatttcttg

SEQ ID NO: 6498555 - DNA, 18 bp, Homo sapiens
tgtaagttgagaaaaatt

SEQ ID NO: 6498556 - DNA, 15 bp, Homo sapiens
tgtaagttgtaagga

SEQ ID NO: 6498557 - DNA, 18 bp, Homo sapiens
tgtaagttgtacaaatgt

SEQ ID NO: 6498558 - DNA, 19 bp, Homo sapiens
tgtaagttgtacaaatgta

SEQ ID NO: 6498559 - DNA, 19 bp, Homo sapiens
tgtaagtttaattatctgc

SEQ ID NO: 6498560 - DNA, 20 bp, Homo sapiens
tgtaagtttacctatgtaac

SEQ ID NO: 6498561 - DNA, 14 bp, Homo sapiens
tgtaagtttcaggt

SEQ ID NO: 6498562 - DNA, 21 bp, Homo sapiens
tgtaagtttcaggtgacatgt

SEQ ID NO: 6498563 - DNA, 23 bp, Homo sapiens
tgtaagtttcaggtgacatgtga

SEQ ID NO: 6498564 - DNA, 14 bp, Homo sapiens
tgtaagtttctaag

SEQ ID NO: 6498565 - DNA, 15 bp, Homo sapiens
tgtaagtttctaaga

SEQ ID NO: 6498566 - DNA, 20 bp, Homo sapiens
tgtaataaaaatttgtttaa

SEQ ID NO: 6498567 - DNA, 13 bp, Homo sapiens
tgtaataaaactg

SEQ ID NO: 6498568 - DNA, 21 bp, Homo sapiens
tgtaataaaacttatgctagt

SEQ ID NO: 6498569 - DNA, 23 bp, Homo sapiens
tgtaataaacccttaactggcat

SEQ ID NO: 6498570 - DNA, 12 bp, Homo sapiens
tgtaataaactc

SEQ ID NO: 6498571 - DNA, 13 bp, Homo sapiens
tgtaataaagtat

SEQ ID NO: 6498572 - DNA, 13 bp, Homo sapiens
tgtaataaagtgt

SEQ ID NO: 6498573 - DNA, 14 bp, Homo sapiens
tgtaataaagtgtt

SEQ ID NO: 6498574 - DNA, 18 bp, Homo sapiens
tgtaataaagtgttttca

SEQ ID NO: 6498575 - DNA, 19 bp, Homo sapiens
tgtaataaagtgttttcag

SEQ ID NO: 6498576 - DNA, 22 bp, Homo sapiens
tgtaataaatatgtttcacaca

SEQ ID NO: 6498577 - DNA, 11 bp, Homo sapiens
tgtaataaatc

SEQ ID NO: 6498578 - DNA, 13 bp, Homo sapiens
tgtaataaatgta

SEQ ID NO: 6498579 - DNA, 19 bp, Homo sapiens
tgtaataaatgtattaact

SEQ ID NO: 6498580 - DNA, 13 bp, Homo sapiens
tgtaataaattca

SEQ ID NO: 6498581 - DNA, 14 bp, Homo sapiens
tgtaataacattta

SEQ ID NO: 6498582 - DNA, 15 bp, Homo sapiens
tgtaataagaaagta

SEQ ID NO: 6498583 - DNA, 23 bp, Homo sapiens
tgtaataagaaagtataaagtca

SEQ ID NO: 6498584 - DNA, 13 bp, Homo sapiens
tgtaataagacat

SEQ ID NO: 6498585 - DNA, 21 bp, Homo sapiens
tgtaataagcacttgcctgga

SEQ ID NO: 6498586 - DNA, 23 bp, Homo sapiens
tgtaataagcacttgcctggaat

SEQ ID NO: 6498587 - DNA, 18 bp, Homo sapiens
tgtaataataaaaccaaa

SEQ ID NO: 6498588 - DNA, 17 bp, Homo sapiens
tgtaataatacctcaat

SEQ ID NO: 6498589 - DNA, 23 bp, Homo sapiens
tgtaataatacctcaatgtttga

SEQ ID NO: 6498590 - DNA, 14 bp, Homo sapiens
tgtaataatagact

SEQ ID NO: 6498591 - DNA, 18 bp, Homo sapiens
tgtaataatgtaacatga

SEQ ID NO: 6498592 - DNA, 22 bp, Homo sapiens
tgtaataatgtaacatgatttc

SEQ ID NO: 6498593 - DNA, 13 bp, Homo sapiens
tgtaataatgtac

SEQ ID NO: 6498594 - DNA, 15 bp, Homo sapiens
tgtaataatgttatt

SEQ ID NO: 6498595 - DNA, 14 bp, Homo sapiens
tgtaatacacatat

SEQ ID NO: 6498596 - DNA, 17 bp, Homo sapiens
tgtaatactgtagaaat

SEQ ID NO: 6498597 - DNA, 20 bp, Homo sapiens
tgtaatactgtagaaatatt

SEQ ID NO: 6498598 - DNA, 18 bp, Homo sapiens
tgtaatacttcttgtgtg

SEQ ID NO: 6498599 - DNA, 16 bp, Homo sapiens
tgtaatagagaatatt

SEQ ID NO: 6498600 - DNA, 20 bp, Homo sapiens
tgtaatagggaaaattctaa

SEQ ID NO: 6498601 - DNA, 22 bp, Homo sapiens
tgtaatagtggctttcatttct

SEQ ID NO: 6498602 - DNA, 23 bp, Homo sapiens
tgtaatagtggctttcatttctt

SEQ ID NO: 6498603 - DNA, 20 bp, Homo sapiens
tgtaatataaatttaagcaa

SEQ ID NO: 6498604 - DNA, 16 bp, Homo sapiens
tgtaatataatgtatt

SEQ ID NO: 6498605 - DNA, 15 bp, Homo sapiens
tgtaatatatacata

SEQ ID NO: 6498606 - DNA, 15 bp, Homo sapiens
tgtaatatatcctgt

SEQ ID NO: 6498607 - DNA, 22 bp, Homo sapiens
tgtaatatattgccagtatata

SEQ ID NO: 6498608 - DNA, 16 bp, Homo sapiens
tgtaatatatttatat

SEQ ID NO: 6498609 - DNA, 21 bp, Homo sapiens
tgtaatatatttatatacttt

SEQ ID NO: 6498610 - DNA, 17 bp, Homo sapiens
tgtaatatcagttacag

SEQ ID NO: 6498611 - DNA, 18 bp, Homo sapiens
tgtaatatcagttacagt

SEQ ID NO: 6498612 - DNA, 22 bp, Homo sapiens
tgtaatatcagttacagtggca

SEQ ID NO: 6498613 - DNA, 18 bp, Homo sapiens
tgtaatatcatttcataa

SEQ ID NO: 6498614 - DNA, 19 bp, Homo sapiens
tgtaatatcatttcataaa

SEQ ID NO: 6498615 - DNA, 21 bp, Homo sapiens
tgtaatatcattttatagaaa

SEQ ID NO: 6498616 - DNA, 17 bp, Homo sapiens
tgtaatatgagaatgta

SEQ ID NO: 6498617 - DNA, 22 bp, Homo sapiens
tgtaatatggaaatcttttaca

SEQ ID NO: 6498618 - DNA, 13 bp, Homo sapiens
tgtaatatgtaca

SEQ ID NO: 6498619 - DNA, 18 bp, Homo sapiens
tgtaatattctctgatgt

SEQ ID NO: 6498620 - DNA, 13 bp, Homo sapiens
tgtaatattgtaa

SEQ ID NO: 6498621 - DNA, 14 bp, Homo sapiens
tgtaatatttacaa

SEQ ID NO: 6498622 - DNA, 15 bp, Homo sapiens
tgtaatatttacaat

SEQ ID NO: 6498623 - DNA, 21 bp, Homo sapiens
tgtaatatttacaatgtatta

SEQ ID NO: 6498624 - DNA, 16 bp, Homo sapiens
tgtaatatttacataa

SEQ ID NO: 6498625 - DNA, 18 bp, Homo sapiens
tgtaatatttagctgtaa

SEQ ID NO: 6498626 - DNA, 15 bp, Homo sapiens
tgattctctcttctc

SEQ ID NO: 6498627 - DNA, 16 bp, Homo sapiens
tgattctctcttctct

SEQ ID NO: 6498628 - DNA, 17 bp, Homo sapiens
tgattctctcttctctc

SEQ ID NO: 6498629 - DNA, 15 bp, Homo sapiens
tgattctctgtggtt

SEQ ID NO: 6498630 - DNA, 15 bp, Homo sapiens
tgattctcttgagat

SEQ ID NO: 6498631 - DNA, 20 bp, Homo sapiens
tgattctgaaatttttttcc

SEQ ID NO: 6498632 - DNA, 19 bp, Homo sapiens
tgattctgatgtactctaa

SEQ ID NO: 6498633 - DNA, 17 bp, Homo sapiens
tgattctgatttcagtt

SEQ ID NO: 6498634 - DNA, 22 bp, Homo sapiens
tgattctgatttcagtttttca

SEQ ID NO: 6498635 - DNA, 17 bp, Homo sapiens
tgattctgcttgagaat

SEQ ID NO: 6498636 - DNA, 17 bp, Homo sapiens
tgattctgcttttacca

SEQ ID NO: 6498637 - DNA, 19 bp, Homo sapiens
tgattctgcttttaccatg

SEQ ID NO: 6498638 - DNA, 14 bp, Homo sapiens
tgattctggcttta

SEQ ID NO: 6498639 - DNA, 21 bp, Homo sapiens
tgattctgtcccccacgtgga

SEQ ID NO: 6498640 - DNA, 15 bp, Homo sapiens
tgattctgtgtgttt

SEQ ID NO: 6498641 - DNA, 19 bp, Homo sapiens
tgattctgttctacttgat

SEQ ID NO: 6498642 - DNA, 13 bp, Homo sapiens
tgattctgtttcc

SEQ ID NO: 6498643 - DNA, 14 bp, Homo sapiens
tgattctgtttcct

SEQ ID NO: 6498644 - DNA, 13 bp, Homo sapiens
tgattcttaacac

SEQ ID NO: 6498645 - DNA, 15 bp, Homo sapiens
tgattcttgattcct

SEQ ID NO: 6498646 - DNA, 19 bp, Homo sapiens
tgattcttgattcctggct

SEQ ID NO: 6498647 - DNA, 21 bp, Homo sapiens
tgattcttgattttcaagctt

SEQ ID NO: 6498648 - DNA, 14 bp, Homo sapiens
tgattcttgtgtca

SEQ ID NO: 6498649 - DNA, 23 bp, Homo sapiens
tgattctttaatagaagttttat

SEQ ID NO: 6498650 - DNA, 21 bp, Homo sapiens
tgattctttcaatccacagta

SEQ ID NO: 6498651 - DNA, 19 bp, Homo sapiens
tgattctttgttacaggca

SEQ ID NO: 6498652 - DNA, 13 bp, Homo sapiens
tgattgaaacatg

SEQ ID NO: 6498653 - DNA, 12 bp, Homo sapiens
tgattgaaagaa

SEQ ID NO: 6498654 - DNA, 19 bp, Homo sapiens
tgattgaaccatttgggat

SEQ ID NO: 6498655 - DNA, 19 bp, Homo sapiens
tgattgaagtatctgtacc

SEQ ID NO: 6498656 - DNA, 15 bp, Homo sapiens
tgattgaatctactt

SEQ ID NO: 6498657 - DNA, 14 bp, Homo sapiens
tgattgacacacag

SEQ ID NO: 6498658 - DNA, 13 bp, Homo sapiens
tgattgacagctt

SEQ ID NO: 6498659 - DNA, 12 bp, Homo sapiens
tgattgacattt

SEQ ID NO: 6498660 - DNA, 16 bp, Homo sapiens
tgattgacctgctccg

SEQ ID NO: 6498661 - DNA, 14 bp, Homo sapiens
tgattgagaaagat

SEQ ID NO: 6498662 - DNA, 17 bp, Homo sapiens
tgattgagagtaactta

SEQ ID NO: 6498663 - DNA, 23 bp, Homo sapiens
tgattgaggataaaaaggaagga

SEQ ID NO: 6498664 - DNA, 16 bp, Homo sapiens
tgattgagtcagtgtt

SEQ ID NO: 6498665 - DNA, 21 bp, Homo sapiens
tgattgatcacacagtgttag

SEQ ID NO: 6498666 - DNA, 15 bp, Homo sapiens
tgattgatgtacaga

SEQ ID NO: 6498667 - DNA, 14 bp, Homo sapiens
tgattgattcagta

SEQ ID NO: 6498668 - DNA, 13 bp, Homo sapiens
tgattgatttgaa

SEQ ID NO: 6498669 - DNA, 20 bp, Homo sapiens
tgattgatttttttctcctt

SEQ ID NO: 6498670 - DNA, 12 bp, Homo sapiens
tgattgcacaga

SEQ ID NO: 6498671 - DNA, 13 bp, Homo sapiens
tgattgcacagaa

SEQ ID NO: 6498672 - DNA, 20 bp, Homo sapiens
tgattgcacagaatttgtat

SEQ ID NO: 6498673 - DNA, 17 bp, Homo sapiens
tgattgcacgtgcctgt

SEQ ID NO: 6498674 - DNA, 14 bp, Homo sapiens
tgattgcactaaat

SEQ ID NO: 6498675 - DNA, 19 bp, Homo sapiens
tgattgcactaaataaact

SEQ ID NO: 6498676 - DNA, 21 bp, Homo sapiens
tgattgcagaattgtttagat

SEQ ID NO: 6498677 - DNA, 15 bp, Homo sapiens
tgattgcatattttg

SEQ ID NO: 6498678 - DNA, 19 bp, Homo sapiens
tgattgcctcaataaagct

SEQ ID NO: 6498679 - DNA, 17 bp, Homo sapiens
tgattgcctttttataa

SEQ ID NO: 6498680 - DNA, 18 bp, Homo sapiens
tgattgcgagaattttca

SEQ ID NO: 6498681 - DNA, 13 bp, Homo sapiens
tgattgctatcag

SEQ ID NO: 6498682 - DNA, 14 bp, Homo sapiens
tgattgctcccagg

SEQ ID NO: 6498683 - DNA, 16 bp, Homo sapiens
tgattgctcccaggat

SEQ ID NO: 6498684 - DNA, 22 bp, Homo sapiens
tgattgctgtgtccaactccag

SEQ ID NO: 6498685 - DNA, 12 bp, Homo sapiens
tgattgctttgc

SEQ ID NO: 6498686 - DNA, 17 bp, Homo sapiens
tgattgcttttaaaatt

SEQ ID NO: 6498687 - DNA, 20 bp, Homo sapiens
tgattgcttttaaaatttta

SEQ ID NO: 6498688 - DNA, 20 bp, Homo sapiens
tgattggaaaataataaaag

SEQ ID NO: 6498689 - DNA, 21 bp, Homo sapiens
tgattggaaaataataaaaga

SEQ ID NO: 6498690 - DNA, 22 bp, Homo sapiens
tgattggaaaataataaaagaa

SEQ ID NO: 6498691 - DNA, 19 bp, Homo sapiens
tgattggaagggcttttca

SEQ ID NO: 6498692 - DNA, 15 bp, Homo sapiens
tgattggacctggcc

SEQ ID NO: 6498693 - DNA, 20 bp, Homo sapiens
tgattggacctggcccagtg

SEQ ID NO: 6498694 - DNA, 21 bp, Homo sapiens
tgattggaggggggaggtggg

SEQ ID NO: 6498695 - DNA, 14 bp, Homo sapiens
tgattggattattc

SEQ ID NO: 6498696 - DNA, 17 bp, Homo sapiens
tgattggattattcatt

SEQ ID NO: 6498697 - DNA, 18 bp, Homo sapiens
tgattggcagcttcaaaa

SEQ ID NO: 6498698 - DNA, 20 bp, Homo sapiens
tgattggcagcttcaaaaca

SEQ ID NO: 6498699 - DNA, 17 bp, Homo sapiens
tgattggccagccgagc

SEQ ID NO: 6498700 - DNA, 21 bp, Homo sapiens
tgattggcctgtagagttgct

SEQ ID NO: 6498701 - DNA, 12 bp, Homo sapiens
tgattggctcac

SEQ ID NO: 6498702 - DNA, 14 bp, Homo sapiens
tgattggctgcagg

SEQ ID NO: 6498703 - DNA, 19 bp, Homo sapiens
tgattggcttaaatccagt

SEQ ID NO: 6498704 - DNA, 16 bp, Homo sapiens
tgattggcttgtagaa

SEQ ID NO: 6498705 - DNA, 23 bp, Homo sapiens
tgattggcttgtagaattgttat

SEQ ID NO: 6498706 - DNA, 11 bp, Homo sapiens
tgattggcttt

SEQ ID NO: 6498707 - DNA, 18 bp, Homo sapiens
tgattgggaaaacatttg

SEQ ID NO: 6498708 - DNA, 12 bp, Homo sapiens
tgattgggaata

SEQ ID NO: 6498709 - DNA, 16 bp, Homo sapiens
tgattgggaataaata

SEQ ID NO: 6498710 - DNA, 20 bp, Homo sapiens
tgattgggaataaatatgcc

SEQ ID NO: 6498711 - DNA, 15 bp, Homo sapiens
tgattgggacagagg

SEQ ID NO: 6498712 - DNA, 18 bp, Homo sapiens
tgattgggaggtgcgtgt

SEQ ID NO: 6498713 - DNA, 23 bp, Homo sapiens
tgattgggcacatcatttcaaga

SEQ ID NO: 6498714 - DNA, 23 bp, Homo sapiens
tgattgggtgggattttttccct

SEQ ID NO: 6498715 - DNA, 21 bp, Homo sapiens
tgattggtgcaacccttaccc

SEQ ID NO: 6498716 - DNA, 17 bp, Homo sapiens
tgattgtaaaatagctt

SEQ ID NO: 6498717 - DNA, 15 bp, Homo sapiens
tgattgtaacatatt

SEQ ID NO: 6498718 - DNA, 18 bp, Homo sapiens
tgattgtaacgttgctgt

SEQ ID NO: 6498719 - DNA, 23 bp, Homo sapiens
tgattgtacagaatcattgctta

SEQ ID NO: 6498720 - DNA, 14 bp, Homo sapiens
tgattgtacttgga

SEQ ID NO: 6498721 - DNA, 17 bp, Homo sapiens
tgattgtataagcatgc

SEQ ID NO: 6498722 - DNA, 14 bp, Homo sapiens
tgattgtataatgt

SEQ ID NO: 6498723 - DNA, 18 bp, Homo sapiens
tgattgtataatgtgatt

SEQ ID NO: 6498724 - DNA, 20 bp, Homo sapiens
tgattgtataatgtgatttt

SEQ ID NO: 6498725 - DNA, 17 bp, Homo sapiens
tgattgtatgttgagga

SEQ ID NO: 6498726 - DNA, 13 bp, Homo sapiens
tgattgtatttgt

SEQ ID NO: 6498727 - DNA, 21 bp, Homo sapiens
tgattgtcaaatacagcattt

SEQ ID NO: 6498728 - DNA, 14 bp, Homo sapiens
tgattgtcagccac

SEQ ID NO: 6498729 - DNA, 22 bp, Homo sapiens
tgattgtcagccacctccctct

SEQ ID NO: 6498730 - DNA, 14 bp, Homo sapiens
tgattgtctttccc

SEQ ID NO: 6498731 - DNA, 15 bp, Homo sapiens
tgattgtgaaggatt

SEQ ID NO: 6498732 - DNA, 18 bp, Homo sapiens
tgattgtggaatggagat

SEQ ID NO: 6498733 - DNA, 16 bp, Homo sapiens
tgattgtgtctcttgg

SEQ ID NO: 6498734 - DNA, 18 bp, Homo sapiens
tgattgtgttgagtgaag

SEQ ID NO: 6498735 - DNA, 15 bp, Homo sapiens
tgattgtgttttcct

SEQ ID NO: 6498736 - DNA, 19 bp, Homo sapiens
tgattgttaatttacagct

SEQ ID NO: 6498737 - DNA, 14 bp, Homo sapiens
tgattgttatgtaa

SEQ ID NO: 6498738 - DNA, 15 bp, Homo sapiens
tgattgttatgtaaa

SEQ ID NO: 6498739 - DNA, 13 bp, Homo sapiens
tgattgttcctcc

SEQ ID NO: 6498740 - DNA, 22 bp, Homo sapiens
tgattgttcttttgtttcatta

SEQ ID NO: 6498741 - DNA, 18 bp, Homo sapiens
tgattgttgagacgcctt

SEQ ID NO: 6498742 - DNA, 12 bp, Homo sapiens
tgattgtttaca

SEQ ID NO: 6498743 - DNA, 13 bp, Homo sapiens
tgattgtttacag

SEQ ID NO: 6498744 - DNA, 14 bp, Homo sapiens
tgattgtttacagt

SEQ ID NO: 6498745 - DNA, 13 bp, Homo sapiens
tgattgtttattt

SEQ ID NO: 6498746 - DNA, 22 bp, Homo sapiens
tgattgtttcttcttcatgctt

SEQ ID NO: 6498747 - DNA, 17 bp, Homo sapiens
tgattgtttgatgaata

SEQ ID NO: 6498748 - DNA, 20 bp, Homo sapiens
tgatttaaaaaataaatata

SEQ ID NO: 6498749 - DNA, 19 bp, Homo sapiens
tgatttaaaaagtgagaaa

SEQ ID NO: 6498750 - DNA, 16 bp, Homo sapiens
tgatttaaaacatgta

SEQ ID NO: 6498751 - DNA, 17 bp, Homo sapiens
tgatttaaacacattaa

SEQ ID NO: 6498752 - DNA, 18 bp, Homo sapiens
tgatttaaacacattaaa

SEQ ID NO: 6498753 - DNA, 21 bp, Homo sapiens
tgatttaaagactacaataaa

SEQ ID NO: 6498754 - DNA, 18 bp, Homo sapiens
tgatttaaatagaacttg

SEQ ID NO: 6498755 - DNA, 16 bp, Homo sapiens
tgatttaacactatcc

SEQ ID NO: 6498756 - DNA, 13 bp, Homo sapiens
tgatttaacactt

SEQ ID NO: 6498757 - DNA, 12 bp, Homo sapiens
tgatttaacatt

SEQ ID NO: 6498758 - DNA, 15 bp, Homo sapiens
tgatttaagcatttt

SEQ ID NO: 6498759 - DNA, 18 bp, Homo sapiens
tgatttaagcattttact

SEQ ID NO: 6498760 - DNA, 17 bp, Homo sapiens
tgatttaataaaataat

SEQ ID NO: 6498761 - DNA, 19 bp, Homo sapiens
tgatttaataaaataattc

SEQ ID NO: 6498762 - DNA, 21 bp, Homo sapiens
tgatttaataaaataattcta

SEQ ID NO: 6498763 - DNA, 20 bp, Homo sapiens
tgatttaatagtgttaatca

SEQ ID NO: 6498764 - DNA, 15 bp, Homo sapiens
tgatttaatatggat

SEQ ID NO: 6498765 - DNA, 14 bp, Homo sapiens
tgatttaatccaga

SEQ ID NO: 6498766 - DNA, 18 bp, Homo sapiens
tgatttaatgttttctgc

SEQ ID NO: 6498767 - DNA, 22 bp, Homo sapiens
tgatttaatgttttctgctgtt

SEQ ID NO: 6498768 - DNA, 13 bp, Homo sapiens
tgatttacaagca

SEQ ID NO: 6498769 - DNA, 13 bp, Homo sapiens
tgatttacagttt

SEQ ID NO: 6498770 - DNA, 13 bp, Homo sapiens
tgatttacatgta

SEQ ID NO: 6498771 - DNA, 14 bp, Homo sapiens
tgatttacatgtat

SEQ ID NO: 6498772 - DNA, 17 bp, Homo sapiens
tgatttacatgtatggt

SEQ ID NO: 6498773 - DNA, 16 bp, Homo sapiens
tgatttacctttggaa

SEQ ID NO: 6498774 - DNA, 18 bp, Homo sapiens
tgatttacctttggaatt

SEQ ID NO: 6498775 - DNA, 16 bp, Homo sapiens
tgatttactaacagta

SEQ ID NO: 6498776 - DNA, 19 bp, Homo sapiens
tgatttactaacagtaact

SEQ ID NO: 6498777 - DNA, 15 bp, Homo sapiens
tgatttactcttaga

SEQ ID NO: 6498778 - DNA, 21 bp, Homo sapiens
tgatttagaactgtatgtcag

SEQ ID NO: 6498779 - DNA, 20 bp, Homo sapiens
tgatttagagatgataatcc

SEQ ID NO: 6498780 - DNA, 17 bp, Homo sapiens
tgatttagattgagtaa

SEQ ID NO: 6498781 - DNA, 14 bp, Homo sapiens
tgatttagcaagca

SEQ ID NO: 6498782 - DNA, 21 bp, Homo sapiens
tgatttagcaatgctgtgaat

SEQ ID NO: 6498783 - DNA, 22 bp, Homo sapiens
tgatttagcaatgctgtgaata

SEQ ID NO: 6498784 - DNA, 23 bp, Homo sapiens
tgatttagcaatgctgtgaataa

SEQ ID NO: 6498785 - DNA, 16 bp, Homo sapiens
tgatttaggagaagcc

SEQ ID NO: 6498786 - DNA, 15 bp, Homo sapiens
tgatttaggcttcta

SEQ ID NO: 6498787 - DNA, 17 bp, Homo sapiens
tgatttataaacagaca

SEQ ID NO: 6498788 - DNA, 16 bp, Homo sapiens
tgatttataaatttga

SEQ ID NO: 6498789 - DNA, 12 bp, Homo sapiens
tgatttatacca

SEQ ID NO: 6498790 - DNA, 23 bp, Homo sapiens
tgatttatccagaatgcttctct

SEQ ID NO: 6498791 - DNA, 22 bp, Homo sapiens
tgatttatctgagtcaactcct

SEQ ID NO: 6498792 - DNA, 20 bp, Homo sapiens
tgatttatgatcacttggaa

SEQ ID NO: 6498793 - DNA, 10 bp, Homo sapiens
tgatttatgg

SEQ ID NO: 6498794 - DNA, 16 bp, Homo sapiens
tgatttatggtttttt

SEQ ID NO: 6498795 - DNA, 19 bp, Homo sapiens
tgatttattaacttaataa

SEQ ID NO: 6498796 - DNA, 22 bp, Homo sapiens
tgatttattaacttaataatca

SEQ ID NO: 6498797 - DNA, 23 bp, Homo sapiens
tgatttattaatatatattatct

SEQ ID NO: 6498798 - DNA, 12 bp, Homo sapiens
tgatttatttct

SEQ ID NO: 6498799 - DNA, 13 bp, Homo sapiens
tgatttatttgga

SEQ ID NO: 6498800 - DNA, 18 bp, Homo sapiens
tgatttattttgtatgaa

SEQ ID NO: 6498801 - DNA, 14 bp, Homo sapiens
tgatttcaaaatga

SEQ ID NO: 6498802 - DNA, 20 bp, Homo sapiens
tgatttcaaagttttgttgt

SEQ ID NO: 6498803 - DNA, 13 bp, Homo sapiens
tgatttcaaatgc

SEQ ID NO: 6498804 - DNA, 17 bp, Homo sapiens
tgatttcaaatgcagtc

SEQ ID NO: 6498805 - DNA, 18 bp, Homo sapiens
tgatttcaagatgttata

SEQ ID NO: 6498806 - DNA, 21 bp, Homo sapiens
tgtaatatttagctgtaaact

SEQ ID NO: 6498807 - DNA, 15 bp, Homo sapiens
tgtaatatttcttca

SEQ ID NO: 6498808 - DNA, 20 bp, Homo sapiens
tgtaatatttcttcaagtga

SEQ ID NO: 6498809 - DNA, 15 bp, Homo sapiens
tgtaatattttgctg

SEQ ID NO: 6498810 - DNA, 15 bp, Homo sapiens
tgtaatcaagccttt

SEQ ID NO: 6498811 - DNA, 23 bp, Homo sapiens
tgtaatcaagcctttatggctgc

SEQ ID NO: 6498812 - DNA, 13 bp, Homo sapiens
tgtaatcaataaa

SEQ ID NO: 6498813 - DNA, 14 bp, Homo sapiens
tgtaatcaataaac

SEQ ID NO: 6498814 - DNA, 14 bp, Homo sapiens
tgtaatcaatgttt

SEQ ID NO: 6498815 - DNA, 20 bp, Homo sapiens
tgtaatcaatgtttcttcta

SEQ ID NO: 6498816 - DNA, 19 bp, Homo sapiens
tgtaatcacactctcttct

SEQ ID NO: 6498817 - DNA, 15 bp, Homo sapiens
tgtaatcacagctac

SEQ ID NO: 6498818 - DNA, 19 bp, Homo sapiens
tgtaatcagctctcctggc

SEQ ID NO: 6498819 - DNA, 15 bp, Homo sapiens
tgtaatcaggcaagg

SEQ ID NO: 6498820 - DNA, 14 bp, Homo sapiens
tgtaatcagtttta

SEQ ID NO: 6498821 - DNA, 13 bp, Homo sapiens
tgtaatcatttat

SEQ ID NO: 6498822 - DNA, 21 bp, Homo sapiens
tgtaatcatttatcttatcta

SEQ ID NO: 6498823 - DNA, 12 bp, Homo sapiens
tgtaatcatttg

SEQ ID NO: 6498824 - DNA, 17 bp, Homo sapiens
tgtaatcccagcacact

SEQ ID NO: 6498825 - DNA, 19 bp, Homo sapiens
tgtaatcccagcactttgg

SEQ ID NO: 6498826 - DNA, 22 bp, Homo sapiens
tgtaatcccagctacccaggag

SEQ ID NO: 6498827 - DNA, 23 bp, Homo sapiens
tgtaatcccagctactagggagg

SEQ ID NO: 6498828 - DNA, 23 bp, Homo sapiens
tgtaatcccagctattcaggagg

SEQ ID NO: 6498829 - DNA, 21 bp, Homo sapiens
tgtaatcccagtactttggaa

SEQ ID NO: 6498830 - DNA, 20 bp, Homo sapiens
tgtaatcccagttactcggg

SEQ ID NO: 6498831 - DNA, 16 bp, Homo sapiens
tgtaatccgaatctct

SEQ ID NO: 6498832 - DNA, 20 bp, Homo sapiens
tgtaatcctcagctgacaca

SEQ ID NO: 6498833 - DNA, 21 bp, Homo sapiens
tgtaatcctgtatattatggt

SEQ ID NO: 6498834 - DNA, 22 bp, Homo sapiens
tgtaatcctgtatattatggtg

SEQ ID NO: 6498835 - DNA, 16 bp, Homo sapiens
tgtaatcgttatgtgt

SEQ ID NO: 6498836 - DNA, 18 bp, Homo sapiens
tgtaatcgttatgtgtgt

SEQ ID NO: 6498837 - DNA, 19 bp, Homo sapiens
tgtaatcgttatgtgtgta

SEQ ID NO: 6498838 - DNA, 21 bp, Homo sapiens
tgtaatctaagtatatgtgag

SEQ ID NO: 6498839 - DNA, 16 bp, Homo sapiens
tgtaatctaccagtgg

SEQ ID NO: 6498840 - DNA, 17 bp, Homo sapiens
tgtaatctcgtttcaaa

SEQ ID NO: 6498841 - DNA, 18 bp, Homo sapiens
tgtaatctcgtttcaaaa

SEQ ID NO: 6498842 - DNA, 15 bp, Homo sapiens
tgtaatctctcatgg

SEQ ID NO: 6498843 - DNA, 19 bp, Homo sapiens
tgtaatctctctgcagctg

SEQ ID NO: 6498844 - DNA, 20 bp, Homo sapiens
tgtaatctctctgcagctgc

SEQ ID NO: 6498845 - DNA, 22 bp, Homo sapiens
tgtaatctctctgcagctgccg

SEQ ID NO: 6498846 - DNA, 15 bp, Homo sapiens
tgtaatctctgatta

SEQ ID NO: 6498847 - DNA, 20 bp, Homo sapiens
tgtaatctctgtcaaggtaa

SEQ ID NO: 6498848 - DNA, 21 bp, Homo sapiens
tgtaatctttcatagccatac

SEQ ID NO: 6498849 - DNA, 17 bp, Homo sapiens
tgtaatcttttatttaa

SEQ ID NO: 6498850 - DNA, 15 bp, Homo sapiens
tgtaatgaaaatgaa

SEQ ID NO: 6498851 - DNA, 16 bp, Homo sapiens
tgtaatgaaacacctt

SEQ ID NO: 6498852 - DNA, 11 bp, Homo sapiens
tgtaatgaata

SEQ ID NO: 6498853 - DNA, 17 bp, Homo sapiens
tgtaatgaatatctgct

SEQ ID NO: 6498854 - DNA, 15 bp, Homo sapiens
tgtaatgacaaaaga

SEQ ID NO: 6498855 - DNA, 21 bp, Homo sapiens
tgtaatgacagagagttctgg

SEQ ID NO: 6498856 - DNA, 12 bp, Homo sapiens
tgtaatgacagg

SEQ ID NO: 6498857 - DNA, 17 bp, Homo sapiens
tgtaatgactgagattt

SEQ ID NO: 6498858 - DNA, 15 bp, Homo sapiens
tgtaatgaggaaaaa

SEQ ID NO: 6498859 - DNA, 15 bp, Homo sapiens
tgtaatgcacaattt

SEQ ID NO: 6498860 - DNA, 19 bp, Homo sapiens
tgtaatgcactcctgcccc

SEQ ID NO: 6498861 - DNA, 16 bp, Homo sapiens
tgtaatgcactgtttt

SEQ ID NO: 6498862 - DNA, 18 bp, Homo sapiens
tgtaatgcactgttttta

SEQ ID NO: 6498863 - DNA, 23 bp, Homo sapiens
tgtaatgccaatatgacacagct

SEQ ID NO: 6498864 - DNA, 13 bp, Homo sapiens
tgtaatgctgcac

SEQ ID NO: 6498865 - DNA, 18 bp, Homo sapiens
tgtaatgctgcacttcct

SEQ ID NO: 6498866 - DNA, 18 bp, Homo sapiens
tgtaatgctgcctcagga

SEQ ID NO: 6498867 - DNA, 22 bp, Homo sapiens
tgtaatgctgcctcaggaccca

SEQ ID NO: 6498868 - DNA, 20 bp, Homo sapiens
tgtaatggagcatcaagcca

SEQ ID NO: 6498869 - DNA, 20 bp, Homo sapiens
tgtaatgggatctatttttg

SEQ ID NO: 6498870 - DNA, 19 bp, Homo sapiens
tgtaatggtgcttattaag

SEQ ID NO: 6498871 - DNA, 13 bp, Homo sapiens
tgtaatgtaaata

SEQ ID NO: 6498872 - DNA, 18 bp, Homo sapiens
tgtaatgtaaataaacta

SEQ ID NO: 6498873 - DNA, 16 bp, Homo sapiens
tgtaatgtaaatacat

SEQ ID NO: 6498874 - DNA, 23 bp, Homo sapiens
tgtaatgtatacttgaaaaatgt

SEQ ID NO: 6498875 - DNA, 15 bp, Homo sapiens
tgtaatgtatcttat

SEQ ID NO: 6498876 - DNA, 17 bp, Homo sapiens
tgtaatgtatcttattt

SEQ ID NO: 6498877 - DNA, 16 bp, Homo sapiens
tgtaatgtcaccacct

SEQ ID NO: 6498878 - DNA, 19 bp, Homo sapiens
tgtaatgtcaccaccttcc

SEQ ID NO: 6498879 - DNA, 22 bp, Homo sapiens
tgtaatgtccctttcagagaca

SEQ ID NO: 6498880 - DNA, 13 bp, Homo sapiens
tgtaatgtggtca

SEQ ID NO: 6498881 - DNA, 18 bp, Homo sapiens
tgtaatgtgtactggtca

SEQ ID NO: 6498882 - DNA, 20 bp, Homo sapiens
tgtaatgtgtggtggcctca

SEQ ID NO: 6498883 - DNA, 13 bp, Homo sapiens
tgtaatgttactg

SEQ ID NO: 6498884 - DNA, 16 bp, Homo sapiens
tgtaatgttactgatc

SEQ ID NO: 6498885 - DNA, 17 bp, Homo sapiens
tgtaatgttactgatca

SEQ ID NO: 6498886 - DNA, 19 bp, Homo sapiens
tgtaatgtttttatttcaa

SEQ ID NO: 6498887 - DNA, 18 bp, Homo sapiens
tgtaattaaattatggta

SEQ ID NO: 6498888 - DNA, 16 bp, Homo sapiens
tgtaattaagtgcaat

SEQ ID NO: 6498889 - DNA, 20 bp, Homo sapiens
tgtaattaataactttctct

SEQ ID NO: 6498890 - DNA, 14 bp, Homo sapiens
tgtaattaatattc

SEQ ID NO: 6498891 - DNA, 23 bp, Homo sapiens
tgtaattacctgtcatctgggcc

SEQ ID NO: 6498892 - DNA, 17 bp, Homo sapiens
tgtaattacttattgta

SEQ ID NO: 6498893 - DNA, 14 bp, Homo sapiens
tgtaattagctctg

SEQ ID NO: 6498894 - DNA, 17 bp, Homo sapiens
tgtaattagctctgggg

SEQ ID NO: 6498895 - DNA, 21 bp, Homo sapiens
tgtaattatatctaaaatatt

SEQ ID NO: 6498896 - DNA, 14 bp, Homo sapiens
tgtaattatatctg

SEQ ID NO: 6498897 - DNA, 16 bp, Homo sapiens
tgtaattatgatttgg

SEQ ID NO: 6498898 - DNA, 11 bp, Homo sapiens
tgtaattattg

SEQ ID NO: 6498899 - DNA, 14 bp, Homo sapiens
tgtaattcaaaaga

SEQ ID NO: 6498900 - DNA, 13 bp, Homo sapiens
tgtaattcaagct

SEQ ID NO: 6498901 - DNA, 14 bp, Homo sapiens
tgtaattcaggact

SEQ ID NO: 6498902 - DNA, 14 bp, Homo sapiens
tgtaattcagtgta

SEQ ID NO: 6498903 - DNA, 21 bp, Homo sapiens
tgtaattcctacctccctgca

SEQ ID NO: 6498904 - DNA, 18 bp, Homo sapiens
tgtaattctaataatgca

SEQ ID NO: 6498905 - DNA, 17 bp, Homo sapiens
tgtaattcttatgacta

SEQ ID NO: 6498906 - DNA, 19 bp, Homo sapiens
tgtaattcttatgactaaa

SEQ ID NO: 6498907 - DNA, 22 bp, Homo sapiens
tgtaattcttctcctttgtcaa

SEQ ID NO: 6498908 - DNA, 13 bp, Homo sapiens
tgtaattgacact

SEQ ID NO: 6498909 - DNA, 15 bp, Homo sapiens
tgtaattgcttacat

SEQ ID NO: 6498910 - DNA, 17 bp, Homo sapiens
tgtaattgcttacattt

SEQ ID NO: 6498911 - DNA, 21 bp, Homo sapiens
tgtaattggaatcttcacctc

SEQ ID NO: 6498912 - DNA, 23 bp, Homo sapiens
tgtaattggaatcttcacctcag

SEQ ID NO: 6498913 - DNA, 18 bp, Homo sapiens
tgtaattggcttttgaat

SEQ ID NO: 6498914 - DNA, 17 bp, Homo sapiens
tgtaattgtaattccaa

SEQ ID NO: 6498915 - DNA, 18 bp, Homo sapiens
tgtaattgtaattttgaa

SEQ ID NO: 6498916 - DNA, 19 bp, Homo sapiens
tgtaattgttgtttgtatg

SEQ ID NO: 6498917 - DNA, 20 bp, Homo sapiens
tgtaattgttgtttgtatgt

SEQ ID NO: 6498918 - DNA, 19 bp, Homo sapiens
tgtaattgtttgtctttaa

SEQ ID NO: 6498919 - DNA, 18 bp, Homo sapiens
tgtaatttaaaattgtga

SEQ ID NO: 6498920 - DNA, 22 bp, Homo sapiens
tgtaatttaaaattgtgatgtg

SEQ ID NO: 6498921 - DNA, 21 bp, Homo sapiens
tgtaatttaaacaggcccagc

SEQ ID NO: 6498922 - DNA, 23 bp, Homo sapiens
tgtaatttaaacaggcccagcat

SEQ ID NO: 6498923 - DNA, 23 bp, Homo sapiens
tgtaatttaaacatttgttcctg

SEQ ID NO: 6498924 - DNA, 17 bp, Homo sapiens
tgtaatttaaatgaaag

SEQ ID NO: 6498925 - DNA, 15 bp, Homo sapiens
tgtaatttaatgaaa

SEQ ID NO: 6498926 - DNA, 20 bp, Homo sapiens
tgtaatttagaaactgattt

SEQ ID NO: 6498927 - DNA, 14 bp, Homo sapiens
tgtaatttatgcaa

SEQ ID NO: 6498928 - DNA, 12 bp, Homo sapiens
tgtaatttcaaa

SEQ ID NO: 6498929 - DNA, 21 bp, Homo sapiens
tgtaatttctgccaataaatt

SEQ ID NO: 6498930 - DNA, 12 bp, Homo sapiens
tgtaatttgaat

SEQ ID NO: 6498931 - DNA, 23 bp, Homo sapiens
tgtaatttgaataagatccaatt

SEQ ID NO: 6498932 - DNA, 18 bp, Homo sapiens
tgtaatttgaatgagttt

SEQ ID NO: 6498933 - DNA, 14 bp, Homo sapiens
tgtaatttgaattg

SEQ ID NO: 6498934 - DNA, 15 bp, Homo sapiens
tgtaatttgaattgg

SEQ ID NO: 6498935 - DNA, 16 bp, Homo sapiens
tgtaatttgcattact

SEQ ID NO: 6498936 - DNA, 15 bp, Homo sapiens
tgtaatttgtacagg

SEQ ID NO: 6498937 - DNA, 17 bp, Homo sapiens
tgtaatttgtgtaataa

SEQ ID NO: 6498938 - DNA, 14 bp, Homo sapiens
tgtaatttgtttga

SEQ ID NO: 6498939 - DNA, 22 bp, Homo sapiens
tgtaattttaaaagtctatttt

SEQ ID NO: 6498940 - DNA, 14 bp, Homo sapiens
tgtaattttaaagt

SEQ ID NO: 6498941 - DNA, 15 bp, Homo sapiens
tgtaattttactttt

SEQ ID NO: 6498942 - DNA, 16 bp, Homo sapiens
tgtaattttacttttt

SEQ ID NO: 6498943 - DNA, 17 bp, Homo sapiens
tgtaattttagtattaa

SEQ ID NO: 6498944 - DNA, 23 bp, Homo sapiens
tgtaattttattttaaaatttca

SEQ ID NO: 6498945 - DNA, 20 bp, Homo sapiens
tgtaattttgtgtaagaaat

SEQ ID NO: 6498946 - DNA, 16 bp, Homo sapiens
tgtaattttgtttgta

SEQ ID NO: 6498947 - DNA, 19 bp, Homo sapiens
tgtaattttgtttgtaatc

SEQ ID NO: 6498948 - DNA, 19 bp, Homo sapiens
tgtaatttttctgtataga

SEQ ID NO: 6498949 - DNA, 23 bp, Homo sapiens
tgtaatttttggggaaaaaagca

SEQ ID NO: 6498950 - DNA, 20 bp, Homo sapiens
tgtaatttttttatcgtcac

SEQ ID NO: 6498951 - DNA, 19 bp, Homo sapiens
tgtaatttttttgaaaaaa

SEQ ID NO: 6498952 - DNA, 17 bp, Homo sapiens
tgtacaaaaaaatcttc

SEQ ID NO: 6498953 - DNA, 18 bp, Homo sapiens
tgtacaaaaacaaaacaa

SEQ ID NO: 6498954 - DNA, 20 bp, Homo sapiens
tgtacaaaaattatgcaatt

SEQ ID NO: 6498955 - DNA, 19 bp, Homo sapiens
tgtacaaaatatccaagcc

SEQ ID NO: 6498956 - DNA, 14 bp, Homo sapiens
tgtacaaaatggaa

SEQ ID NO: 6498957 - DNA, 20 bp, Homo sapiens
tgtacaaaatggaattcatt

SEQ ID NO: 6498958 - DNA, 24 bp, Homo sapiens
tgtacaaaattaagcaaatgttaa

SEQ ID NO: 6498959 - DNA, 22 bp, Homo sapiens
tgtacaaactatttcagaatat

SEQ ID NO: 6498960 - DNA, 23 bp, Homo sapiens
tgtacaaagggaagcagagcctg

SEQ ID NO: 6498961 - DNA, 20 bp, Homo sapiens
tgtacaaagtagagaagtat

SEQ ID NO: 6498962 - DNA, 21 bp, Homo sapiens
tgtacaaagtagagaagtatc

SEQ ID NO: 6498963 - DNA, 13 bp, Homo sapiens
tgtacaaagtatt

SEQ ID NO: 6498964 - DNA, 20 bp, Homo sapiens
tgtacaaagtattaagcata

SEQ ID NO: 6498965 - DNA, 17 bp, Homo sapiens
tgtacaaagttttcctt

SEQ ID NO: 6498966 - DNA, 22 bp, Homo sapiens
tgtacaaagttttcctttgtaa

SEQ ID NO: 6498967 - DNA, 15 bp, Homo sapiens
tgtacaaataaacct

SEQ ID NO: 6498968 - DNA, 18 bp, Homo sapiens
tgtacaaataaacctgag

SEQ ID NO: 6498969 - DNA, 14 bp, Homo sapiens
tgtacaaataatat

SEQ ID NO: 6498970 - DNA, 20 bp, Homo sapiens
tgtacaaataatattgcctt

SEQ ID NO: 6498971 - DNA, 17 bp, Homo sapiens
tgtacaaatacatgtgt

SEQ ID NO: 6498972 - DNA, 20 bp, Homo sapiens
tgtacaaatacatgtgtata

SEQ ID NO: 6498973 - DNA, 11 bp, Homo sapiens
tgtacaaatga

SEQ ID NO: 6498974 - DNA, 16 bp, Homo sapiens
tgtacaaatgaaattt

SEQ ID NO: 6498975 - DNA, 21 bp, Homo sapiens
tgtacaacaatgctttgataa

SEQ ID NO: 6498976 - DNA, 13 bp, Homo sapiens
tgtacaaccctga

SEQ ID NO: 6498977 - DNA, 20 bp, Homo sapiens
tgtacaagagtccctttgaa

SEQ ID NO: 6498978 - DNA, 22 bp, Homo sapiens
tgtacaagagtccctttgaaga

SEQ ID NO: 6498979 - DNA, 20 bp, Homo sapiens
tgtacaaggacagcccctcc

SEQ ID NO: 6498980 - DNA, 23 bp, Homo sapiens
tgtacaaggacagcccctcctcc

SEQ ID NO: 6498981 - DNA, 15 bp, Homo sapiens
tgtacaaggatgaaa

SEQ ID NO: 6498982 - DNA, 17 bp, Homo sapiens
tgtacaaggtaattgtt

SEQ ID NO: 6498983 - DNA, 14 bp, Homo sapiens
tgatttcaatacac

SEQ ID NO: 6498984 - DNA, 15 bp, Homo sapiens
tgatttcaatgattg

SEQ ID NO: 6498985 - DNA, 19 bp, Homo sapiens
tgatttcacaaatattaaa

SEQ ID NO: 6498986 - DNA, 16 bp, Homo sapiens
tgatttcacagtgtgt

SEQ ID NO: 6498987 - DNA, 14 bp, Homo sapiens
tgatttcactagaa

SEQ ID NO: 6498988 - DNA, 11 bp, Homo sapiens
tgatttcagaa

SEQ ID NO: 6498989 - DNA, 13 bp, Homo sapiens
tgatttcagaaac

SEQ ID NO: 6498990 - DNA, 21 bp, Homo sapiens
tgatttcagactgcagagggg

SEQ ID NO: 6498991 - DNA, 17 bp, Homo sapiens
tgatttcagctcactgc

SEQ ID NO: 6498992 - DNA, 19 bp, Homo sapiens
tgatttcagtaagtctcat

SEQ ID NO: 6498993 - DNA, 20 bp, Homo sapiens
tgatttcagttctaggaaaa

SEQ ID NO: 6498994 - DNA, 21 bp, Homo sapiens
tgatttcagttctaggaaaat

SEQ ID NO: 6498995 - DNA, 13 bp, Homo sapiens
tgatttcagtttt

SEQ ID NO: 6498996 - DNA, 22 bp, Homo sapiens
tgatttcagtttttcatttgtt

SEQ ID NO: 6498997 - DNA, 23 bp, Homo sapiens
tgatttcagtttttcatttgttt

SEQ ID NO: 6498998 - DNA, 15 bp, Homo sapiens
tgatttcatattgat

SEQ ID NO: 6498999 - DNA, 18 bp, Homo sapiens
tgatttcatgattagaca

SEQ ID NO: 6499000 - DNA, 16 bp, Homo sapiens
tgatttcatgtactgc

SEQ ID NO: 6499001 - DNA, 17 bp, Homo sapiens
tgatttcatgtactgca

SEQ ID NO: 6499002 - DNA, 13 bp, Homo sapiens
tgatttcattcaa

SEQ ID NO: 6499003 - DNA, 15 bp, Homo sapiens
tgatttccaggcccc

SEQ ID NO: 6499004 - DNA, 14 bp, Homo sapiens
tgatttccatccaa

SEQ ID NO: 6499005 - DNA, 15 bp, Homo sapiens
tgatttccatccaaa

SEQ ID NO: 6499006 - DNA, 16 bp, Homo sapiens
tgatttccatccaaac

SEQ ID NO: 6499007 - DNA, 19 bp, Homo sapiens
tgatttccatctctggtaa

SEQ ID NO: 6499008 - DNA, 22 bp, Homo sapiens
tgatttccatttctgatgtctc

SEQ ID NO: 6499009 - DNA, 15 bp, Homo sapiens
tgatttcccactgca

SEQ ID NO: 6499010 - DNA, 21 bp, Homo sapiens
tgatttcccctccaaggtatg

SEQ ID NO: 6499011 - DNA, 13 bp, Homo sapiens
tgatttcccctct

SEQ ID NO: 6499012 - DNA, 17 bp, Homo sapiens
tgatttccccttttgca

SEQ ID NO: 6499013 - DNA, 18 bp, Homo sapiens
tgatttccctccagagaa

SEQ ID NO: 6499014 - DNA, 20 bp, Homo sapiens
tgatttcccttttttcttcc

SEQ ID NO: 6499015 - DNA, 14 bp, Homo sapiens
tgatttcctgtgtc

SEQ ID NO: 6499016 - DNA, 19 bp, Homo sapiens
tgatttcctgtgtcaatcc

SEQ ID NO: 6499017 - DNA, 15 bp, Homo sapiens
tgatttccttcaatg

SEQ ID NO: 6499018 - DNA, 13 bp, Homo sapiens
tgatttccttgaa

SEQ ID NO: 6499019 - DNA, 14 bp, Homo sapiens
tgatttccttgaat

SEQ ID NO: 6499020 - DNA, 16 bp, Homo sapiens
tgatttccttgaatgt

SEQ ID NO: 6499021 - DNA, 19 bp, Homo sapiens
tgatttccttgaatgtggc

SEQ ID NO: 6499022 - DNA, 17 bp, Homo sapiens
tgatttctagaaagcct

SEQ ID NO: 6499023 - DNA, 21 bp, Homo sapiens
tgatttctagcaggcaggaag

SEQ ID NO: 6499024 - DNA, 15 bp, Homo sapiens
tgatttctagtatct

SEQ ID NO: 6499025 - DNA, 23 bp, Homo sapiens
tgatttctagttatttattctgg

SEQ ID NO: 6499026 - DNA, 16 bp, Homo sapiens
tgatttctatgctgag

SEQ ID NO: 6499027 - DNA, 17 bp, Homo sapiens
tgatttctatggctttc

SEQ ID NO: 6499028 - DNA, 20 bp, Homo sapiens
tgatttctatggctttcaaa

SEQ ID NO: 6499029 - DNA, 11 bp, Homo sapiens
tgatttctcac

SEQ ID NO: 6499030 - DNA, 14 bp, Homo sapiens
tgatttctgaacta

SEQ ID NO: 6499031 - DNA, 22 bp, Homo sapiens
tgatttcttaggggaaggagaa

SEQ ID NO: 6499032 - DNA, 21 bp, Homo sapiens
tgatttcttattgaatttgtt

SEQ ID NO: 6499033 - DNA, 12 bp, Homo sapiens
tgatttcttctt

SEQ ID NO: 6499034 - DNA, 18 bp, Homo sapiens
tgatttcttcttcattcc

SEQ ID NO: 6499035 - DNA, 18 bp, Homo sapiens
tgatttctttaaaagaat

SEQ ID NO: 6499036 - DNA, 16 bp, Homo sapiens
tgatttctttccttcc

SEQ ID NO: 6499037 - DNA, 20 bp, Homo sapiens
tgatttcttttcttcctggc

SEQ ID NO: 6499038 - DNA, 19 bp, Homo sapiens
tgatttgacccactcacac

SEQ ID NO: 6499039 - DNA, 21 bp, Homo sapiens
tgatttgacccactcacactt

SEQ ID NO: 6499040 - DNA, 20 bp, Homo sapiens
tgatttgactgtttttaccc

SEQ ID NO: 6499041 - DNA, 23 bp, Homo sapiens
tgatttgactgtttttacccata

SEQ ID NO: 6499042 - DNA, 14 bp, Homo sapiens
tgatttgagatttt

SEQ ID NO: 6499043 - DNA, 18 bp, Homo sapiens
tgatttgatctttgttta

SEQ ID NO: 6499044 - DNA, 13 bp, Homo sapiens
tgatttgatgtga

SEQ ID NO: 6499045 - DNA, 17 bp, Homo sapiens
tgatttgcaacactgcc

SEQ ID NO: 6499046 - DNA, 18 bp, Homo sapiens
tgatttgcaacactgcca

SEQ ID NO: 6499047 - DNA, 11 bp, Homo sapiens
tgatttgcaat

SEQ ID NO: 6499048 - DNA, 23 bp, Homo sapiens
tgatttgcaatgggatgtatgaa

SEQ ID NO: 6499049 - DNA, 16 bp, Homo sapiens
tgatttgcatggattt

SEQ ID NO: 6499050 - DNA, 18 bp, Homo sapiens
tgatttgccgacatgttt

SEQ ID NO: 6499051 - DNA, 14 bp, Homo sapiens
tgatttgcctgcct

SEQ ID NO: 6499052 - DNA, 12 bp, Homo sapiens
tgatttgctatc

SEQ ID NO: 6499053 - DNA, 20 bp, Homo sapiens
tgatttgctctttgacaact

SEQ ID NO: 6499054 - DNA, 15 bp, Homo sapiens
tgatttgctgttttc

SEQ ID NO: 6499055 - DNA, 12 bp, Homo sapiens
tgatttggaaaa

SEQ ID NO: 6499056 - DNA, 22 bp, Homo sapiens
tgatttggaagagaggcacctg

SEQ ID NO: 6499057 - DNA, 22 bp, Homo sapiens
tgatttggccgttttgtgaaga

SEQ ID NO: 6499058 - DNA, 20 bp, Homo sapiens
tgatttgggctgaatgtatg

SEQ ID NO: 6499059 - DNA, 17 bp, Homo sapiens
tgatttggggatatttt

SEQ ID NO: 6499060 - DNA, 21 bp, Homo sapiens
tgatttggggatgtttgcccc

SEQ ID NO: 6499061 - DNA, 18 bp, Homo sapiens
tgatttggggattcagat

SEQ ID NO: 6499062 - DNA, 22 bp, Homo sapiens
tgatttggggattcagatttct

SEQ ID NO: 6499063 - DNA, 20 bp, Homo sapiens
tgatttgggtttttttgttg

SEQ ID NO: 6499064 - DNA, 19 bp, Homo sapiens
tgatttggtcctgcctaaa

SEQ ID NO: 6499065 - DNA, 17 bp, Homo sapiens
tgatttgtaacccactg

SEQ ID NO: 6499066 - DNA, 15 bp, Homo sapiens
tgatttgtaatatga

SEQ ID NO: 6499067 - DNA, 23 bp, Homo sapiens
tgatttgtacagattctttatta

SEQ ID NO: 6499068 - DNA, 13 bp, Homo sapiens
tgatttgtacttg

SEQ ID NO: 6499069 - DNA, 18 bp, Homo sapiens
tgatttgtatgttaaagt

SEQ ID NO: 6499070 - DNA, 21 bp, Homo sapiens
tgatttgtcccagaattttct

SEQ ID NO: 6499071 - DNA, 14 bp, Homo sapiens
tgatttgtcccagc

SEQ ID NO: 6499072 - DNA, 15 bp, Homo sapiens
tgatttgtcccagcc

SEQ ID NO: 6499073 - DNA, 22 bp, Homo sapiens
tgatttgtcccagcctggggct

SEQ ID NO: 6499074 - DNA, 21 bp, Homo sapiens
tgatttgtctctgagccccct

SEQ ID NO: 6499075 - DNA, 14 bp, Homo sapiens
tgatttgtcttccc

SEQ ID NO: 6499076 - DNA, 14 bp, Homo sapiens
tgattttaaaactt

SEQ ID NO: 6499077 - DNA, 15 bp, Homo sapiens
tgattttaaaaggtt

SEQ ID NO: 6499078 - DNA, 16 bp, Homo sapiens
tgattttaaaaggttg

SEQ ID NO: 6499079 - DNA, 14 bp, Homo sapiens
tgattttaaaatgt

SEQ ID NO: 6499080 - DNA, 17 bp, Homo sapiens
tgattttaaaatgtaca

SEQ ID NO: 6499081 - DNA, 19 bp, Homo sapiens
tgattttaaagaacagtga

SEQ ID NO: 6499082 - DNA, 22 bp, Homo sapiens
tgattttaaaggcagagaagtt

SEQ ID NO: 6499083 - DNA, 14 bp, Homo sapiens
tgattttaaatttg

SEQ ID NO: 6499084 - DNA, 13 bp, Homo sapiens
tgattttaacaat

SEQ ID NO: 6499085 - DNA, 17 bp, Homo sapiens
tgattttaacaataact

SEQ ID NO: 6499086 - DNA, 18 bp, Homo sapiens
tgattttaacaataacta

SEQ ID NO: 6499087 - DNA, 14 bp, Homo sapiens
tgattttaacagtt

SEQ ID NO: 6499088 - DNA, 15 bp, Homo sapiens
tgattttaactctgt

SEQ ID NO: 6499089 - DNA, 13 bp, Homo sapiens
tgattttaacttt

SEQ ID NO: 6499090 - DNA, 15 bp, Homo sapiens
tgattttaagacaag

SEQ ID NO: 6499091 - DNA, 21 bp, Homo sapiens
tgattttaatgaaatcaaatg

SEQ ID NO: 6499092 - DNA, 12 bp, Homo sapiens
tgattttaatgg

SEQ ID NO: 6499093 - DNA, 21 bp, Homo sapiens
tgattttaatggattgttaat

SEQ ID NO: 6499094 - DNA, 16 bp, Homo sapiens
tgattttaattcaggt

SEQ ID NO: 6499095 - DNA, 18 bp, Homo sapiens
tgattttacaaattaata

SEQ ID NO: 6499096 - DNA, 20 bp, Homo sapiens
tgattttacaaattaatatt

SEQ ID NO: 6499097 - DNA, 14 bp, Homo sapiens
tgattttacagaga

SEQ ID NO: 6499098 - DNA, 16 bp, Homo sapiens
tgattttacagagaat

SEQ ID NO: 6499099 - DNA, 16 bp, Homo sapiens
tgattttagatttctt

SEQ ID NO: 6499100 - DNA, 14 bp, Homo sapiens
tgattttatacata

SEQ ID NO: 6499101 - DNA, 15 bp, Homo sapiens
tgattttatacatag

SEQ ID NO: 6499102 - DNA, 18 bp, Homo sapiens
tgattttatgatcagtgt

SEQ ID NO: 6499103 - DNA, 18 bp, Homo sapiens
tgattttcaaatatgtaa

SEQ ID NO: 6499104 - DNA, 22 bp, Homo sapiens
tgattttcaaatatgtaaactt

SEQ ID NO: 6499105 - DNA, 10 bp, Homo sapiens
tgattttcat

SEQ ID NO: 6499106 - DNA, 13 bp, Homo sapiens
tgattttcatcaa

SEQ ID NO: 6499107 - DNA, 15 bp, Homo sapiens
tgattttcatcaatt

SEQ ID NO: 6499108 - DNA, 16 bp, Homo sapiens
tgattttcatcaattt

SEQ ID NO: 6499109 - DNA, 13 bp, Homo sapiens
tgattttcattgc

SEQ ID NO: 6499110 - DNA, 17 bp, Homo sapiens
tgattttcattgtaaat

SEQ ID NO: 6499111 - DNA, 22 bp, Homo sapiens
tgattttccatctaaaaatata

SEQ ID NO: 6499112 - DNA, 12 bp, Homo sapiens
tgattttcctcc

SEQ ID NO: 6499113 - DNA, 16 bp, Homo sapiens
tgattttcctgtgtcc

SEQ ID NO: 6499114 - DNA, 22 bp, Homo sapiens
tgattttcctttgtagctactt

SEQ ID NO: 6499115 - DNA, 13 bp, Homo sapiens
tgattttctggat

SEQ ID NO: 6499116 - DNA, 12 bp, Homo sapiens
tgattttctgtt

SEQ ID NO: 6499117 - DNA, 13 bp, Homo sapiens
tgattttctgttg

SEQ ID NO: 6499118 - DNA, 14 bp, Homo sapiens
tgattttcttgcca

SEQ ID NO: 6499119 - DNA, 16 bp, Homo sapiens
tgattttgaacttttt

SEQ ID NO: 6499120 - DNA, 19 bp, Homo sapiens
tgattttgatattttcaca

SEQ ID NO: 6499121 - DNA, 18 bp, Homo sapiens
tgattttgccctcctgcc

SEQ ID NO: 6499122 - DNA, 20 bp, Homo sapiens
tgattttgccctcctgccca

SEQ ID NO: 6499123 - DNA, 14 bp, Homo sapiens
tgattttgtacaga

SEQ ID NO: 6499124 - DNA, 16 bp, Homo sapiens
tgattttgtacagaat

SEQ ID NO: 6499125 - DNA, 20 bp, Homo sapiens
tgattttgtagttaatttat

SEQ ID NO: 6499126 - DNA, 13 bp, Homo sapiens
tgattttgtatat

SEQ ID NO: 6499127 - DNA, 18 bp, Homo sapiens
tgattttgtatatgaaaa

SEQ ID NO: 6499128 - DNA, 20 bp, Homo sapiens
tgattttgtttactgaaatt

SEQ ID NO: 6499129 - DNA, 11 bp, Homo sapiens
tgatttttaaa

SEQ ID NO: 6499130 - DNA, 19 bp, Homo sapiens
tgatttttaaagaaaagtt

SEQ ID NO: 6499131 - DNA, 14 bp, Homo sapiens
tgatttttaaagtt

SEQ ID NO: 6499132 - DNA, 16 bp, Homo sapiens
tgatttttaagtacaa

SEQ ID NO: 6499133 - DNA, 15 bp, Homo sapiens
tgatttttaatggaa

SEQ ID NO: 6499134 - DNA, 13 bp, Homo sapiens
tgatttttactgt

SEQ ID NO: 6499135 - DNA, 14 bp, Homo sapiens
tgatttttatcaca

SEQ ID NO: 6499136 - DNA, 18 bp, Homo sapiens
tgatttttatcaggcttt

SEQ ID NO: 6499137 - DNA, 13 bp, Homo sapiens
tgatttttatcca

SEQ ID NO: 6499138 - DNA, 19 bp, Homo sapiens
tgatttttatccatttctt

SEQ ID NO: 6499139 - DNA, 20 bp, Homo sapiens
tgatttttatgatgatgaaa

SEQ ID NO: 6499140 - DNA, 19 bp, Homo sapiens
tgatttttctggaggttga

SEQ ID NO: 6499141 - DNA, 23 bp, Homo sapiens
tgatttttgagcccttgtttcag

SEQ ID NO: 6499142 - DNA, 13 bp, Homo sapiens
tgatttttgctat

SEQ ID NO: 6499143 - DNA, 13 bp, Homo sapiens
tgatttttgtctc

SEQ ID NO: 6499144 - DNA, 20 bp, Homo sapiens
tgatttttgtgtatccagta

SEQ ID NO: 6499145 - DNA, 13 bp, Homo sapiens
tgattttttaaaa

SEQ ID NO: 6499146 - DNA, 18 bp, Homo sapiens
tgattttttaagcagact

SEQ ID NO: 6499147 - DNA, 19 bp, Homo sapiens
tgattttttaaggagctgg

SEQ ID NO: 6499148 - DNA, 15 bp, Homo sapiens
tgattttttattcaa

SEQ ID NO: 6499149 - DNA, 14 bp, Homo sapiens
tgattttttgaaag

SEQ ID NO: 6499150 - DNA, 18 bp, Homo sapiens
tgatttttttaaagtagt

SEQ ID NO: 6499151 - DNA, 18 bp, Homo sapiens
tgatttttttaatagtgc

SEQ ID NO: 6499152 - DNA, 21 bp, Homo sapiens
tgatttttttaatagtgcttt

SEQ ID NO: 6499153 - DNA, 17 bp, Homo sapiens
tgatttttttgttgttg

SEQ ID NO: 6499154 - DNA, 15 bp, Homo sapiens
tgattttttttctct

SEQ ID NO: 6499155 - DNA, 23 bp, Homo sapiens
tgatttttttttagaacagaaaa

SEQ ID NO: 6499156 - DNA, 18 bp, Homo sapiens
tgattttttttttaactt

SEQ ID NO: 6499157 - DNA, 22 bp, Homo sapiens
tgattttttttttaacttgaaa

SEQ ID NO: 6499158 - DNA, 23 bp, Homo sapiens
tgattttttttttaacttgaaaa

SEQ ID NO: 6499159 - DNA, 22 bp, Homo sapiens
tgatttttttttttttcctgtc

SEQ ID NO: 6499160 - DNA, 15 bp, Homo sapiens
tgcaaaaaaaattag

SEQ ID NO: 6499161 - DNA, 20 bp, Homo sapiens
tgcaaaaaaaattagccggg

SEQ ID NO: 6499162 - DNA, 15 bp, Homo sapiens
tgcaaaaaaagcctc

SEQ ID NO: 6499163 - DNA, 18 bp, Homo sapiens
tgcaaaaaaattaaaatg

SEQ ID NO: 6499164 - DNA, 18 bp, Homo sapiens
tgtacaaggtaattgttt

SEQ ID NO: 6499165 - DNA, 13 bp, Homo sapiens
tgtacaaggtatg

SEQ ID NO: 6499166 - DNA, 17 bp, Homo sapiens
tgtacaagttttgtata

SEQ ID NO: 6499167 - DNA, 12 bp, Homo sapiens
tgtacaataaaa

SEQ ID NO: 6499168 - DNA, 13 bp, Homo sapiens
tgtacaataaatt

SEQ ID NO: 6499169 - DNA, 15 bp, Homo sapiens
tgtacaataagttac

SEQ ID NO: 6499170 - DNA, 21 bp, Homo sapiens
tgtacaataagttacttgaaa

SEQ ID NO: 6499171 - DNA, 15 bp, Homo sapiens
tgtacaatacaatgt

SEQ ID NO: 6499172 - DNA, 20 bp, Homo sapiens
tgtacaatacaatgtacaat

SEQ ID NO: 6499173 - DNA, 14 bp, Homo sapiens
tgtacaatatttaa

SEQ ID NO: 6499174 - DNA, 18 bp, Homo sapiens
tgtacaatattttaagca

SEQ ID NO: 6499175 - DNA, 19 bp, Homo sapiens
tgtacaatattttaagcat

SEQ ID NO: 6499176 - DNA, 20 bp, Homo sapiens
tgtacaatattttaagcatt

SEQ ID NO: 6499177 - DNA, 15 bp, Homo sapiens
tgtacaatcatgaac

SEQ ID NO: 6499178 - DNA, 13 bp, Homo sapiens
tgtacaatcatgt

SEQ ID NO: 6499179 - DNA, 17 bp, Homo sapiens
tgtacaatggtttattc

SEQ ID NO: 6499180 - DNA, 18 bp, Homo sapiens
tgtacaatggtttattcc

SEQ ID NO: 6499181 - DNA, 21 bp, Homo sapiens
tgtacaatggtttattcccaa

SEQ ID NO: 6499182 - DNA, 18 bp, Homo sapiens
tgtacaatgtacacactg

SEQ ID NO: 6499183 - DNA, 21 bp, Homo sapiens
tgtacaattaattatcttttc

SEQ ID NO: 6499184 - DNA, 18 bp, Homo sapiens
tgtacaattttaaagttc

SEQ ID NO: 6499185 - DNA, 18 bp, Homo sapiens
tgtacaattttatataat

SEQ ID NO: 6499186 - DNA, 21 bp, Homo sapiens
tgtacacaacacctaaaacca

SEQ ID NO: 6499187 - DNA, 21 bp, Homo sapiens
tgtacacaactcactcctttt

SEQ ID NO: 6499188 - DNA, 11 bp, Homo sapiens
tgtacacagaa

SEQ ID NO: 6499189 - DNA, 12 bp, Homo sapiens
tgtacacagact

SEQ ID NO: 6499190 - DNA, 12 bp, Homo sapiens
tgtacacagtca

SEQ ID NO: 6499191 - DNA, 17 bp, Homo sapiens
tgtacacatatttgaag

SEQ ID NO: 6499192 - DNA, 13 bp, Homo sapiens
tgtacacattaag

SEQ ID NO: 6499193 - DNA, 15 bp, Homo sapiens
tgtacacattaaggt

SEQ ID NO: 6499194 - DNA, 20 bp, Homo sapiens
tgtacacatttcttaaaaca

SEQ ID NO: 6499195 - DNA, 20 bp, Homo sapiens
tgtacaccactttcccacac

SEQ ID NO: 6499196 - DNA, 22 bp, Homo sapiens
tgtacaccccaggacagtttat

SEQ ID NO: 6499197 - DNA, 16 bp, Homo sapiens
tgtacacctcaaatac

SEQ ID NO: 6499198 - DNA, 15 bp, Homo sapiens
tgtacactaacattt

SEQ ID NO: 6499199 - DNA, 17 bp, Homo sapiens
tgtacactaacatttcc

SEQ ID NO: 6499200 - DNA, 12 bp, Homo sapiens
tgtacactgctg

SEQ ID NO: 6499201 - DNA, 13 bp, Homo sapiens
tgtacactgctgt

SEQ ID NO: 6499202 - DNA, 22 bp, Homo sapiens
tgtacactggatatgttgttaa

SEQ ID NO: 6499203 - DNA, 15 bp, Homo sapiens
tgtacacttaattac

SEQ ID NO: 6499204 - DNA, 20 bp, Homo sapiens
tgtacactttctgtctcaaa

SEQ ID NO: 6499205 - DNA, 21 bp, Homo sapiens
tgtacactttttacagcagca

SEQ ID NO: 6499206 - DNA, 15 bp, Homo sapiens
tgtacagaaaacatg

SEQ ID NO: 6499207 - DNA, 21 bp, Homo sapiens
tgtacagaaaagggcggcttc

SEQ ID NO: 6499208 - DNA, 18 bp, Homo sapiens
tgtacagaaaatagcttt

SEQ ID NO: 6499209 - DNA, 19 bp, Homo sapiens
tgtacagaaaatagctttt

SEQ ID NO: 6499210 - DNA, 15 bp, Homo sapiens
tgtacagaaacaact

SEQ ID NO: 6499211 - DNA, 16 bp, Homo sapiens
tgtacagaaacaactg

SEQ ID NO: 6499212 - DNA, 11 bp, Homo sapiens
tgtacagaaca

SEQ ID NO: 6499213 - DNA, 15 bp, Homo sapiens
tgtacagaacacaaa

SEQ ID NO: 6499214 - DNA, 18 bp, Homo sapiens
tgtacagaagaaactgaa

SEQ ID NO: 6499215 - DNA, 15 bp, Homo sapiens
tgtacagaatatttc

SEQ ID NO: 6499216 - DNA, 23 bp, Homo sapiens
tgtacagaatatttctattgaat

SEQ ID NO: 6499217 - DNA, 21 bp, Homo sapiens
tgtacagaattctgctacctc

SEQ ID NO: 6499218 - DNA, 18 bp, Homo sapiens
tgtacagaatttccactg

SEQ ID NO: 6499219 - DNA, 13 bp, Homo sapiens
tgtacagaatttt

SEQ ID NO: 6499220 - DNA, 15 bp, Homo sapiens
tgtacagaattttta

SEQ ID NO: 6499221 - DNA, 20 bp, Homo sapiens
tgtacagacatatttaactg

SEQ ID NO: 6499222 - DNA, 22 bp, Homo sapiens
tgtacagacatatttaactggt

SEQ ID NO: 6499223 - DNA, 21 bp, Homo sapiens
tgtacagaccacctttcacaa

SEQ ID NO: 6499224 - DNA, 13 bp, Homo sapiens
tgtacagagactc

SEQ ID NO: 6499225 - DNA, 11 bp, Homo sapiens
tgtacagagcc

SEQ ID NO: 6499226 - DNA, 18 bp, Homo sapiens
tgtacagaggaagctgtt

SEQ ID NO: 6499227 - DNA, 18 bp, Homo sapiens
tgtacagaggtcagcaca

SEQ ID NO: 6499228 - DNA, 17 bp, Homo sapiens
tgtacagagtggcccct

SEQ ID NO: 6499229 - DNA, 17 bp, Homo sapiens
tgtacagatatcgagag

SEQ ID NO: 6499230 - DNA, 14 bp, Homo sapiens
tgtacagatatgca

SEQ ID NO: 6499231 - DNA, 15 bp, Homo sapiens
tgtacagatcaagaa

SEQ ID NO: 6499232 - DNA, 15 bp, Homo sapiens
tgtacagatgatgta

SEQ ID NO: 6499233 - DNA, 20 bp, Homo sapiens
tgtacagattgctgcttctg

SEQ ID NO: 6499234 - DNA, 20 bp, Homo sapiens
tgtacagattttatttgtaa

SEQ ID NO: 6499235 - DNA, 20 bp, Homo sapiens
tgtacagcaagatgtttctt

SEQ ID NO: 6499236 - DNA, 21 bp, Homo sapiens
tgtacagcaagatgtttcttg

SEQ ID NO: 6499237 - DNA, 22 bp, Homo sapiens
tgtacagcaaggagatttacaa

SEQ ID NO: 6499238 - DNA, 18 bp, Homo sapiens
tgtacagctcccttccct

SEQ ID NO: 6499239 - DNA, 15 bp, Homo sapiens
tgtacagctctcccc

SEQ ID NO: 6499240 - DNA, 20 bp, Homo sapiens
tgtacaggaagtagttctaa

SEQ ID NO: 6499241 - DNA, 19 bp, Homo sapiens
tgtacaggacatgtactga

SEQ ID NO: 6499242 - DNA, 22 bp, Homo sapiens
tgtacaggacatgtactgagac

SEQ ID NO: 6499243 - DNA, 13 bp, Homo sapiens
tgtacaggctgag

SEQ ID NO: 6499244 - DNA, 18 bp, Homo sapiens
tgtacaggctgagacaca

SEQ ID NO: 6499245 - DNA, 15 bp, Homo sapiens
tgtacaggggccatg

SEQ ID NO: 6499246 - DNA, 14 bp, Homo sapiens
tgtacagtagattt

SEQ ID NO: 6499247 - DNA, 18 bp, Homo sapiens
tgtacagtagattttcca

SEQ ID NO: 6499248 - DNA, 20 bp, Homo sapiens
tgtacagtagattttccaaa

SEQ ID NO: 6499249 - DNA, 20 bp, Homo sapiens
tgtacagtatgtgtctagca

SEQ ID NO: 6499250 - DNA, 16 bp, Homo sapiens
tgtacagtatttttca

SEQ ID NO: 6499251 - DNA, 16 bp, Homo sapiens
tgtacagtctgtcatg

SEQ ID NO: 6499252 - DNA, 23 bp, Homo sapiens
tgtacagtctgtcatgaacatgt

SEQ ID NO: 6499253 - DNA, 17 bp, Homo sapiens
tgtacagtcttgtatta

SEQ ID NO: 6499254 - DNA, 21 bp, Homo sapiens
tgtacagtgtcagatgaggaa

SEQ ID NO: 6499255 - DNA, 22 bp, Homo sapiens
tgtacagtgtctgtgccatgga

SEQ ID NO: 6499256 - DNA, 14 bp, Homo sapiens
tgtacagtgtcttt

SEQ ID NO: 6499257 - DNA, 14 bp, Homo sapiens
tgtacagttcagtt

SEQ ID NO: 6499258 - DNA, 22 bp, Homo sapiens
tgtacagttgactggctttcct

SEQ ID NO: 6499259 - DNA, 15 bp, Homo sapiens
tgtacagttgggaaa

SEQ ID NO: 6499260 - DNA, 15 bp, Homo sapiens
tgtacagtttaacag

SEQ ID NO: 6499261 - DNA, 15 bp, Homo sapiens
tgtacagtttgctgt

SEQ ID NO: 6499262 - DNA, 11 bp, Homo sapiens
tgtacataaaa

SEQ ID NO: 6499263 - DNA, 13 bp, Homo sapiens
tgtacataaaaga

SEQ ID NO: 6499264 - DNA, 16 bp, Homo sapiens
tgtacataaaagaatt

SEQ ID NO: 6499265 - DNA, 18 bp, Homo sapiens
tgtacataaaattttcta

SEQ ID NO: 6499266 - DNA, 19 bp, Homo sapiens
tgtacataaacaatgatgc

SEQ ID NO: 6499267 - DNA, 18 bp, Homo sapiens
tgtacataaactgtcact

SEQ ID NO: 6499268 - DNA, 14 bp, Homo sapiens
tgtacataactgaa

SEQ ID NO: 6499269 - DNA, 19 bp, Homo sapiens
tgtacataatgcgtgcata

SEQ ID NO: 6499270 - DNA, 17 bp, Homo sapiens
tgtacataattgcatga

SEQ ID NO: 6499271 - DNA, 14 bp, Homo sapiens
tgtacatacaaatt

SEQ ID NO: 6499272 - DNA, 18 bp, Homo sapiens
tgtacatacattcatact

SEQ ID NO: 6499273 - DNA, 15 bp, Homo sapiens
tgtacatacattgta

SEQ ID NO: 6499274 - DNA, 21 bp, Homo sapiens
tgtacataccggggctcctct

SEQ ID NO: 6499275 - DNA, 21 bp, Homo sapiens
tgtacatacctccttgcacaa

SEQ ID NO: 6499276 - DNA, 15 bp, Homo sapiens
tgtacatactttttg

SEQ ID NO: 6499277 - DNA, 14 bp, Homo sapiens
tgtacatagagcaa

SEQ ID NO: 6499278 - DNA, 23 bp, Homo sapiens
tgtacatagagtgagaagaaaga

SEQ ID NO: 6499279 - DNA, 14 bp, Homo sapiens
tgtacatagattta

SEQ ID NO: 6499280 - DNA, 16 bp, Homo sapiens
tgtacatagcctatat

SEQ ID NO: 6499281 - DNA, 23 bp, Homo sapiens
tgtacatagcctatatttacagt

SEQ ID NO: 6499282 - DNA, 20 bp, Homo sapiens
tgtacatagtaaagtatttt

SEQ ID NO: 6499283 - DNA, 12 bp, Homo sapiens
tgtacatagtcc

SEQ ID NO: 6499284 - DNA, 14 bp, Homo sapiens
tgtacatagtcctt

SEQ ID NO: 6499285 - DNA, 17 bp, Homo sapiens
tgtacatagtgctaaca

SEQ ID NO: 6499286 - DNA, 17 bp, Homo sapiens
tgtacatagtggtcatt

SEQ ID NO: 6499287 - DNA, 20 bp, Homo sapiens
tgtacatagtggtcatttgg

SEQ ID NO: 6499288 - DNA, 16 bp, Homo sapiens
tgtacatagtgtaatg

SEQ ID NO: 6499289 - DNA, 22 bp, Homo sapiens
tgtacatagttatttttctctt

SEQ ID NO: 6499290 - DNA, 22 bp, Homo sapiens
tgtacatataggagcaatacta

SEQ ID NO: 6499291 - DNA, 17 bp, Homo sapiens
tgtacatatatgtataa

SEQ ID NO: 6499292 - DNA, 18 bp, Homo sapiens
tgtacatatatgtataat

SEQ ID NO: 6499293 - DNA, 22 bp, Homo sapiens
tgtacatatatgtataatatat

SEQ ID NO: 6499294 - DNA, 15 bp, Homo sapiens
tgtacatatctttga

SEQ ID NO: 6499295 - DNA, 19 bp, Homo sapiens
tgtacatatctttgagttc

SEQ ID NO: 6499296 - DNA, 22 bp, Homo sapiens
tgtacatatggaaatcctgtta

SEQ ID NO: 6499297 - DNA, 18 bp, Homo sapiens
tgtacatatggaaatgtt

SEQ ID NO: 6499298 - DNA, 13 bp, Homo sapiens
tgtacatatgtaa

SEQ ID NO: 6499299 - DNA, 16 bp, Homo sapiens
tgtacatatgtaaaat

SEQ ID NO: 6499300 - DNA, 18 bp, Homo sapiens
tgtacatatgtaaaataa

SEQ ID NO: 6499301 - DNA, 19 bp, Homo sapiens
tgtacatatgtaaaatatt

SEQ ID NO: 6499302 - DNA, 20 bp, Homo sapiens
tgtacatatgtgctggaatt

SEQ ID NO: 6499303 - DNA, 22 bp, Homo sapiens
tgtacatattagcgacaacaga

SEQ ID NO: 6499304 - DNA, 19 bp, Homo sapiens
tgtacatatttgtggaata

SEQ ID NO: 6499305 - DNA, 19 bp, Homo sapiens
tgtacatcagacagaaggg

SEQ ID NO: 6499306 - DNA, 15 bp, Homo sapiens
tgtacatcatgttat

SEQ ID NO: 6499307 - DNA, 20 bp, Homo sapiens
tgtacatcatgttattttat

SEQ ID NO: 6499308 - DNA, 13 bp, Homo sapiens
tgtacatcccaaa

SEQ ID NO: 6499309 - DNA, 17 bp, Homo sapiens
tgtacatcccatgtaac

SEQ ID NO: 6499310 - DNA, 21 bp, Homo sapiens
tgtacatcccatgtaacagaa

SEQ ID NO: 6499311 - DNA, 21 bp, Homo sapiens
tgtacatcgtttactttttaa

SEQ ID NO: 6499312 - DNA, 14 bp, Homo sapiens
tgtacatctatttt

SEQ ID NO: 6499313 - DNA, 20 bp, Homo sapiens
tgtacatctattttggattg

SEQ ID NO: 6499314 - DNA, 21 bp, Homo sapiens
tgtacatctattttggattgt

SEQ ID NO: 6499315 - DNA, 22 bp, Homo sapiens
tgtacatctcccctttgctaac

SEQ ID NO: 6499316 - DNA, 14 bp, Homo sapiens
tgtacatctggcct

SEQ ID NO: 6499317 - DNA, 13 bp, Homo sapiens
tgtacatctttca

SEQ ID NO: 6499318 - DNA, 14 bp, Homo sapiens
tgtacatgaaaaca

SEQ ID NO: 6499319 - DNA, 16 bp, Homo sapiens
tgtacatgaaaacaca

SEQ ID NO: 6499320 - DNA, 19 bp, Homo sapiens
tgtacatgaagaatgtagc

SEQ ID NO: 6499321 - DNA, 23 bp, Homo sapiens
tgtacatgataagacattttgtt

SEQ ID NO: 6499322 - DNA, 19 bp, Homo sapiens
tgtacatggcagagtttgt

SEQ ID NO: 6499323 - DNA, 23 bp, Homo sapiens
tgtacatgggactatgcttttct

SEQ ID NO: 6499324 - DNA, 22 bp, Homo sapiens
tgtacatgggactgattctgtt

SEQ ID NO: 6499325 - DNA, 14 bp, Homo sapiens
tgtacatgtattaa

SEQ ID NO: 6499326 - DNA, 21 bp, Homo sapiens
tgtacatgtgtgcagagcaga

SEQ ID NO: 6499327 - DNA, 13 bp, Homo sapiens
tgtacattacact

SEQ ID NO: 6499328 - DNA, 14 bp, Homo sapiens
tgtacattacacta

SEQ ID NO: 6499329 - DNA, 16 bp, Homo sapiens
tgtacattacactaaa

SEQ ID NO: 6499330 - DNA, 20 bp, Homo sapiens
tgtacattacagattaaaga

SEQ ID NO: 6499331 - DNA, 22 bp, Homo sapiens
tgtacattactgtatgtataaa

SEQ ID NO: 6499332 - DNA, 22 bp, Homo sapiens
tgtacattagtcattcaataaa

SEQ ID NO: 6499333 - DNA, 15 bp, Homo sapiens
tgtacattatgaaga

SEQ ID NO: 6499334 - DNA, 23 bp, Homo sapiens
tgtacattccctgcatccaatct

SEQ ID NO: 6499335 - DNA, 18 bp, Homo sapiens
tgtacattcctgatactg

SEQ ID NO: 6499336 - DNA, 15 bp, Homo sapiens
tgtacattctaaaat

SEQ ID NO: 6499337 - DNA, 21 bp, Homo sapiens
tgtacattctgcctagagtgt

SEQ ID NO: 6499338 - DNA, 15 bp, Homo sapiens
tgtacattcttccat

SEQ ID NO: 6499339 - DNA, 18 bp, Homo sapiens
tgtacattggtctttcta

SEQ ID NO: 6499340 - DNA, 24 bp, Homo sapiens
tgtacattgtgagctctggttatt

SEQ ID NO: 6499341 - DNA, 14 bp, Homo sapiens
tgtacatttaaaat

SEQ ID NO: 6499342 - DNA, 22 bp, Homo sapiens
tgcaaaaaagccaagccctccg

SEQ ID NO: 6499343 - DNA, 12 bp, Homo sapiens
tgcaaaaaatag

SEQ ID NO: 6499344 - DNA, 13 bp, Homo sapiens
tgcaaaaacatat

SEQ ID NO: 6499345 - DNA, 16 bp, Homo sapiens
tgcaaaaactgtaaaa

SEQ ID NO: 6499346 - DNA, 15 bp, Homo sapiens
tgcaaaaagaaaaaa

SEQ ID NO: 6499347 - DNA, 19 bp, Homo sapiens
tgcaaaaagaaaaaaagaa

SEQ ID NO: 6499348 - DNA, 21 bp, Homo sapiens
tgcaaaaagctagtcaacagt

SEQ ID NO: 6499349 - DNA, 16 bp, Homo sapiens
tgcaaaaagcttctgt

SEQ ID NO: 6499350 - DNA, 18 bp, Homo sapiens
tgcaaaaagcttctgtgg

SEQ ID NO: 6499351 - DNA, 15 bp, Homo sapiens
tgcaaaaaggactgg

SEQ ID NO: 6499352 - DNA, 20 bp, Homo sapiens
tgcaaaaagtacatagtgaa

SEQ ID NO: 6499353 - DNA, 23 bp, Homo sapiens
tgcaaaaataaaaggaaaaccag

SEQ ID NO: 6499354 - DNA, 17 bp, Homo sapiens
tgcaaaaatccaaatat

SEQ ID NO: 6499355 - DNA, 21 bp, Homo sapiens
tgcaaaaatccaaatattgtt

SEQ ID NO: 6499356 - DNA, 16 bp, Homo sapiens
tgcaaaaatgacccaa

SEQ ID NO: 6499357 - DNA, 18 bp, Homo sapiens
tgcaaaaatgagttgtca

SEQ ID NO: 6499358 - DNA, 19 bp, Homo sapiens
tgcaaaaatgagttttcac

SEQ ID NO: 6499359 - DNA, 16 bp, Homo sapiens
tgcaaaaattatatat

SEQ ID NO: 6499360 - DNA, 20 bp, Homo sapiens
tgcaaaaattcagagtcctt

SEQ ID NO: 6499361 - DNA, 12 bp, Homo sapiens
tgcaaaacaaac

SEQ ID NO: 6499362 - DNA, 19 bp, Homo sapiens
tgcaaaacagcgtttaaga

SEQ ID NO: 6499363 - DNA, 18 bp, Homo sapiens
tgcaaaacatgctacctg

SEQ ID NO: 6499364 - DNA, 23 bp, Homo sapiens
tgcaaaaccggcaacctgtaact

SEQ ID NO: 6499365 - DNA, 20 bp, Homo sapiens
tgcaaaaccttgtgaactga

SEQ ID NO: 6499366 - DNA, 14 bp, Homo sapiens
tgcaaaacctttga

SEQ ID NO: 6499367 - DNA, 16 bp, Homo sapiens
tgcaaaaccttttact

SEQ ID NO: 6499368 - DNA, 18 bp, Homo sapiens
tgcaaaaccttttactgg

SEQ ID NO: 6499369 - DNA, 20 bp, Homo sapiens
tgcaaaacggatgagttatt

SEQ ID NO: 6499370 - DNA, 21 bp, Homo sapiens
tgcaaaacggatgagttatta

SEQ ID NO: 6499371 - DNA, 16 bp, Homo sapiens
tgcaaaactagacaaa

SEQ ID NO: 6499372 - DNA, 21 bp, Homo sapiens
tgcaaaagaagtttctggagc

SEQ ID NO: 6499373 - DNA, 20 bp, Homo sapiens
tgcaaaagcagctaaatgta

SEQ ID NO: 6499374 - DNA, 15 bp, Homo sapiens
tgcaaaagcttcaaa

SEQ ID NO: 6499375 - DNA, 19 bp, Homo sapiens
tgcaaaaggactctcagga

SEQ ID NO: 6499376 - DNA, 18 bp, Homo sapiens
tgcaaaaggcctgtgatc

SEQ ID NO: 6499377 - DNA, 22 bp, Homo sapiens
tgcaaaaggctgattactgaaa

SEQ ID NO: 6499378 - DNA, 23 bp, Homo sapiens
tgcaaaagtggggctaaatgaag

SEQ ID NO: 6499379 - DNA, 11 bp, Homo sapiens
tgcaaaataag

SEQ ID NO: 6499380 - DNA, 13 bp, Homo sapiens
tgcaaaatacatg

SEQ ID NO: 6499381 - DNA, 13 bp, Homo sapiens
tgcaaaatagaag

SEQ ID NO: 6499382 - DNA, 18 bp, Homo sapiens
tgcaaaatagaagaagag

SEQ ID NO: 6499383 - DNA, 16 bp, Homo sapiens
tgcaaaatagacatct

SEQ ID NO: 6499384 - DNA, 20 bp, Homo sapiens
tgcaaaatcagttttcctct

SEQ ID NO: 6499385 - DNA, 20 bp, Homo sapiens
tgcaaaatggaaatgtaata

SEQ ID NO: 6499386 - DNA, 22 bp, Homo sapiens
tgcaaaatggaaatgtaataat

SEQ ID NO: 6499387 - DNA, 19 bp, Homo sapiens
tgcaaaatggtcagtatta

SEQ ID NO: 6499388 - DNA, 21 bp, Homo sapiens
tgcaaaattaaatctagacat

SEQ ID NO: 6499389 - DNA, 18 bp, Homo sapiens
tgcaaaattacctacccc

SEQ ID NO: 6499390 - DNA, 23 bp, Homo sapiens
tgcaaaattagtacctcaaagta

SEQ ID NO: 6499391 - DNA, 14 bp, Homo sapiens
tgcaaaattgtttt

SEQ ID NO: 6499392 - DNA, 17 bp, Homo sapiens
tgcaaaattgttttcac

SEQ ID NO: 6499393 - DNA, 15 bp, Homo sapiens
tgcaaaatttagaag

SEQ ID NO: 6499394 - DNA, 14 bp, Homo sapiens
tgcaaacaaacaag

SEQ ID NO: 6499395 - DNA, 22 bp, Homo sapiens
tgcaaacaagaaacgtgtcaca

SEQ ID NO: 6499396 - DNA, 14 bp, Homo sapiens
tgcaaacaataaac

SEQ ID NO: 6499397 - DNA, 16 bp, Homo sapiens
tgcaaacacaccttgg

SEQ ID NO: 6499398 - DNA, 15 bp, Homo sapiens
tgcaaacagaaatca

SEQ ID NO: 6499399 - DNA, 14 bp, Homo sapiens
tgcaaacagaacag

SEQ ID NO: 6499400 - DNA, 19 bp, Homo sapiens
tgcaaacagaacagggtca

SEQ ID NO: 6499401 - DNA, 22 bp, Homo sapiens
tgcaaacaggttgttttctact

SEQ ID NO: 6499402 - DNA, 17 bp, Homo sapiens
tgcaaacagttcttgga

SEQ ID NO: 6499403 - DNA, 22 bp, Homo sapiens
tgcaaacatggggttggctggg

SEQ ID NO: 6499404 - DNA, 14 bp, Homo sapiens
tgcaaacatttctt

SEQ ID NO: 6499405 - DNA, 13 bp, Homo sapiens
tgcaaaccatcat

SEQ ID NO: 6499406 - DNA, 21 bp, Homo sapiens
tgcaaaccatcattgaaatct

SEQ ID NO: 6499407 - DNA, 21 bp, Homo sapiens
tgcaaacccaactaagccagg

SEQ ID NO: 6499408 - DNA, 22 bp, Homo sapiens
tgcaaaccctggtggtatttta

SEQ ID NO: 6499409 - DNA, 16 bp, Homo sapiens
tgcaaaccctttgtat

SEQ ID NO: 6499410 - DNA, 17 bp, Homo sapiens
tgcaaaccctttgtatt

SEQ ID NO: 6499411 - DNA, 18 bp, Homo sapiens
tgcaaaccctttgtatta

SEQ ID NO: 6499412 - DNA, 21 bp, Homo sapiens
tgcaaaccctttgtattataa

SEQ ID NO: 6499413 - DNA, 19 bp, Homo sapiens
tgcaaaccgttaggaaaac

SEQ ID NO: 6499414 - DNA, 17 bp, Homo sapiens
tgcaaacctcagaggga

SEQ ID NO: 6499415 - DNA, 22 bp, Homo sapiens
tgcaaacctgacccctgctcag

SEQ ID NO: 6499416 - DNA, 23 bp, Homo sapiens
tgcaaacctgacccctgctcagt

SEQ ID NO: 6499417 - DNA, 15 bp, Homo sapiens
tgcaaaccttcctgg

SEQ ID NO: 6499418 - DNA, 17 bp, Homo sapiens
tgcaaaccttcctggga

SEQ ID NO: 6499419 - DNA, 21 bp, Homo sapiens
tgcaaacgctgcctgcccgta

SEQ ID NO: 6499420 - DNA, 23 bp, Homo sapiens
tgcaaactatgagttcacatgtg

SEQ ID NO: 6499421 - DNA, 16 bp, Homo sapiens
tgcaaactcactgctc

SEQ ID NO: 6499422 - DNA, 15 bp, Homo sapiens
tgcaaactctataaa

SEQ ID NO: 6499423 - DNA, 16 bp, Homo sapiens
tgcaaactgctttatt

SEQ ID NO: 6499424 - DNA, 11 bp, Homo sapiens
tgcaaactggg

SEQ ID NO: 6499425 - DNA, 22 bp, Homo sapiens
tgcaaactgggctggaagatat

SEQ ID NO: 6499426 - DNA, 23 bp, Homo sapiens
tgcaaactgggctggaagatatt

SEQ ID NO: 6499427 - DNA, 12 bp, Homo sapiens
tgcaaagaaaat

SEQ ID NO: 6499428 - DNA, 16 bp, Homo sapiens
tgcaaagaaaatcaga

SEQ ID NO: 6499429 - DNA, 17 bp, Homo sapiens
tgcaaagaaaattctca

SEQ ID NO: 6499430 - DNA, 19 bp, Homo sapiens
tgcaaagaaaattctcaag

SEQ ID NO: 6499431 - DNA, 20 bp, Homo sapiens
tgcaaagaactccagagtca

SEQ ID NO: 6499432 - DNA, 22 bp, Homo sapiens
tgcaaagacagtatttattggt

SEQ ID NO: 6499433 - DNA, 18 bp, Homo sapiens
tgcaaagactctgagcca

SEQ ID NO: 6499434 - DNA, 20 bp, Homo sapiens
tgcaaagactctgagccaag

SEQ ID NO: 6499435 - DNA, 17 bp, Homo sapiens
tgcaaagagacatttca

SEQ ID NO: 6499436 - DNA, 20 bp, Homo sapiens
tgcaaagagacatttcaaaa

SEQ ID NO: 6499437 - DNA, 15 bp, Homo sapiens
tgcaaagaggcaaga

SEQ ID NO: 6499438 - DNA, 22 bp, Homo sapiens
tgcaaagcaaaacagactgtgt

SEQ ID NO: 6499439 - DNA, 14 bp, Homo sapiens
tgcaaagcacacct

SEQ ID NO: 6499440 - DNA, 18 bp, Homo sapiens
tgcaaagcactgacttct

SEQ ID NO: 6499441 - DNA, 21 bp, Homo sapiens
tgcaaagcagagtgaaattca

SEQ ID NO: 6499442 - DNA, 22 bp, Homo sapiens
tgcaaagcagagtgaaattcaa

SEQ ID NO: 6499443 - DNA, 17 bp, Homo sapiens
tgcaaagccaaggcagc

SEQ ID NO: 6499444 - DNA, 14 bp, Homo sapiens
tgcaaagcccagct

SEQ ID NO: 6499445 - DNA, 13 bp, Homo sapiens
tgcaaagccttta

SEQ ID NO: 6499446 - DNA, 15 bp, Homo sapiens
tgcaaagcgacagat

SEQ ID NO: 6499447 - DNA, 17 bp, Homo sapiens
tgcaaagcgacagattc

SEQ ID NO: 6499448 - DNA, 16 bp, Homo sapiens
tgcaaaggataaattt

SEQ ID NO: 6499449 - DNA, 13 bp, Homo sapiens
tgcaaaggctggg

SEQ ID NO: 6499450 - DNA, 12 bp, Homo sapiens
tgcaaaggcttc

SEQ ID NO: 6499451 - DNA, 20 bp, Homo sapiens
tgcaaagggctgccttgctg

SEQ ID NO: 6499452 - DNA, 17 bp, Homo sapiens
tgcaaaggtggggagaa

SEQ ID NO: 6499453 - DNA, 18 bp, Homo sapiens
tgcaaagtacaatgtgtt

SEQ ID NO: 6499454 - DNA, 19 bp, Homo sapiens
tgcaaagtataaatttgtg

SEQ ID NO: 6499455 - DNA, 21 bp, Homo sapiens
tgcaaagtataaatttgtgta

SEQ ID NO: 6499456 - DNA, 22 bp, Homo sapiens
tgcaaagtataaatttgtgtaa

SEQ ID NO: 6499457 - DNA, 17 bp, Homo sapiens
tgcaaagtattgtaaat

SEQ ID NO: 6499458 - DNA, 18 bp, Homo sapiens
tgcaaagtattgtaaatt

SEQ ID NO: 6499459 - DNA, 20 bp, Homo sapiens
tgcaaagtattgtaaattat

SEQ ID NO: 6499460 - DNA, 21 bp, Homo sapiens
tgcaaagtcatgcaaaggctg

SEQ ID NO: 6499461 - DNA, 19 bp, Homo sapiens
tgcaaagtctccagaagaa

SEQ ID NO: 6499462 - DNA, 20 bp, Homo sapiens
tgcaaagtgattcactgtgc

SEQ ID NO: 6499463 - DNA, 14 bp, Homo sapiens
tgcaaagtgcaaat

SEQ ID NO: 6499464 - DNA, 17 bp, Homo sapiens
tgcaaagtgcaaatact

SEQ ID NO: 6499465 - DNA, 18 bp, Homo sapiens
tgcaaagtgcaaatactc

SEQ ID NO: 6499466 - DNA, 15 bp, Homo sapiens
tgcaaagtgccctca

SEQ ID NO: 6499467 - DNA, 15 bp, Homo sapiens
tgcaaagtggcaggg

SEQ ID NO: 6499468 - DNA, 21 bp, Homo sapiens
tgcaaagtgttttctcagaac

SEQ ID NO: 6499469 - DNA, 19 bp, Homo sapiens
tgcaaagtgttttgtacca

SEQ ID NO: 6499470 - DNA, 18 bp, Homo sapiens
tgcaaagttattccccat

SEQ ID NO: 6499471 - DNA, 23 bp, Homo sapiens
tgcaaagttccctacttcctgtg

SEQ ID NO: 6499472 - DNA, 20 bp, Homo sapiens
tgcaaagttctgtgtttaat

SEQ ID NO: 6499473 - DNA, 19 bp, Homo sapiens
tgcaaagtttgtgtcaata

SEQ ID NO: 6499474 - DNA, 22 bp, Homo sapiens
tgcaaagttttctttccaaaat

SEQ ID NO: 6499475 - DNA, 20 bp, Homo sapiens
tgcaaataaaacccaatact

SEQ ID NO: 6499476 - DNA, 17 bp, Homo sapiens
tgcaaataacaaatgcc

SEQ ID NO: 6499477 - DNA, 13 bp, Homo sapiens
tgcaaataactta

SEQ ID NO: 6499478 - DNA, 18 bp, Homo sapiens
tgcaaataacttacaaga

SEQ ID NO: 6499479 - DNA, 18 bp, Homo sapiens
tgcaaataagtgtatttt

SEQ ID NO: 6499480 - DNA, 17 bp, Homo sapiens
tgcaaatagaaaacagg

SEQ ID NO: 6499481 - DNA, 20 bp, Homo sapiens
tgcaaatagattcagagaaa

SEQ ID NO: 6499482 - DNA, 21 bp, Homo sapiens
tgcaaatagattcagagaaat

SEQ ID NO: 6499483 - DNA, 17 bp, Homo sapiens
tgcaaatagtagacatt

SEQ ID NO: 6499484 - DNA, 23 bp, Homo sapiens
tgcaaatagtagagtatcagttg

SEQ ID NO: 6499485 - DNA, 19 bp, Homo sapiens
tgcaaatagtttcaaatga

SEQ ID NO: 6499486 - DNA, 21 bp, Homo sapiens
tgcaaatattgctattgttta

SEQ ID NO: 6499487 - DNA, 19 bp, Homo sapiens
tgcaaatattggttagtat

SEQ ID NO: 6499488 - DNA, 20 bp, Homo sapiens
tgcaaatcaggcttttgttt

SEQ ID NO: 6499489 - DNA, 10 bp, Homo sapiens
tgcaaatcct

SEQ ID NO: 6499490 - DNA, 21 bp, Homo sapiens
tgcaaatcctatgtgatttta

SEQ ID NO: 6499491 - DNA, 14 bp, Homo sapiens
tgcaaatctgatgg

SEQ ID NO: 6499492 - DNA, 14 bp, Homo sapiens
tgcaaatctgttac

SEQ ID NO: 6499493 - DNA, 21 bp, Homo sapiens
tgcaaatgaaggaatgcaata

SEQ ID NO: 6499494 - DNA, 17 bp, Homo sapiens
tgcaaatgaatcattgt

SEQ ID NO: 6499495 - DNA, 15 bp, Homo sapiens
tgcaaatgaatgcct

SEQ ID NO: 6499496 - DNA, 23 bp, Homo sapiens
tgcaaatgaatgcctttcaaaca

SEQ ID NO: 6499497 - DNA, 13 bp, Homo sapiens
tgcaaatgagatt

SEQ ID NO: 6499498 - DNA, 18 bp, Homo sapiens
tgcaaatgagctctgaaa

SEQ ID NO: 6499499 - DNA, 21 bp, Homo sapiens
tgcaaatgagttcaggactac

SEQ ID NO: 6499500 - DNA, 18 bp, Homo sapiens
tgcaaatggagataaaag

SEQ ID NO: 6499501 - DNA, 20 bp, Homo sapiens
tgcaaatgggagctgagcag

SEQ ID NO: 6499502 - DNA, 22 bp, Homo sapiens
tgcaaatgggagctgagcagcc

SEQ ID NO: 6499503 - DNA, 22 bp, Homo sapiens
tgcaaatggtggttgtttcttc

SEQ ID NO: 6499504 - DNA, 20 bp, Homo sapiens
tgcaaatgtaattgatttat

SEQ ID NO: 6499505 - DNA, 18 bp, Homo sapiens
tgcaaatgtcatcagaac

SEQ ID NO: 6499506 - DNA, 19 bp, Homo sapiens
tgcaaatgtcttccaggtc

SEQ ID NO: 6499507 - DNA, 16 bp, Homo sapiens
tgcaaatgtgcatttt

SEQ ID NO: 6499508 - DNA, 15 bp, Homo sapiens
tgcaaatgttttgaa

SEQ ID NO: 6499509 - DNA, 12 bp, Homo sapiens
tgcaaattaaag

SEQ ID NO: 6499510 - DNA, 14 bp, Homo sapiens
tgcaaattaacagt

SEQ ID NO: 6499511 - DNA, 13 bp, Homo sapiens
tgcaaattattct

SEQ ID NO: 6499512 - DNA, 21 bp, Homo sapiens
tgcaaattattctagtcaact

SEQ ID NO: 6499513 - DNA, 15 bp, Homo sapiens
tgcaaattatttatt

SEQ ID NO: 6499514 - DNA, 15 bp, Homo sapiens
tgcaaattcagaact

SEQ ID NO: 6499515 - DNA, 22 bp, Homo sapiens
tgcaaattgattgtctttcccc

SEQ ID NO: 6499516 - DNA, 11 bp, Homo sapiens
tgcaaattgtg

SEQ ID NO: 6499517 - DNA, 17 bp, Homo sapiens
tgcaaatttagtttgtt

SEQ ID NO: 6499518 - DNA, 17 bp, Homo sapiens
tgtacatttaataatat

SEQ ID NO: 6499519 - DNA, 21 bp, Homo sapiens
tgtacatttatgatttaataa

SEQ ID NO: 6499520 - DNA, 16 bp, Homo sapiens
tgtacatttatgtgtg

SEQ ID NO: 6499521 - DNA, 17 bp, Homo sapiens
tgtacatttatgtgtga

SEQ ID NO: 6499522 - DNA, 16 bp, Homo sapiens
tgtacatttattcata

SEQ ID NO: 6499523 - DNA, 19 bp, Homo sapiens
tgtacatttatttattact

SEQ ID NO: 6499524 - DNA, 10 bp, Homo sapiens
tgtacatttc

SEQ ID NO: 6499525 - DNA, 17 bp, Homo sapiens
tgtacatttctcaggct

SEQ ID NO: 6499526 - DNA, 13 bp, Homo sapiens
tgtacatttctga

SEQ ID NO: 6499527 - DNA, 18 bp, Homo sapiens
tgtacatttgaaaatatt

SEQ ID NO: 6499528 - DNA, 16 bp, Homo sapiens
tgtacatttgatttga

SEQ ID NO: 6499529 - DNA, 16 bp, Homo sapiens
tgtacatttgggagtt

SEQ ID NO: 6499530 - DNA, 17 bp, Homo sapiens
tgtacattttgttgtaa

SEQ ID NO: 6499531 - DNA, 19 bp, Homo sapiens
tgtacattttgttgtaaaa

SEQ ID NO: 6499532 - DNA, 23 bp, Homo sapiens
tgtaccaaaattcatctgtctat

SEQ ID NO: 6499533 - DNA, 15 bp, Homo sapiens
tgtaccaaaatttta

SEQ ID NO: 6499534 - DNA, 20 bp, Homo sapiens
tgtaccaaatctgacatatt

SEQ ID NO: 6499535 - DNA, 18 bp, Homo sapiens
tgtaccaaccatccaatt

SEQ ID NO: 6499536 - DNA, 20 bp, Homo sapiens
tgtaccaagtgcttcctaca

SEQ ID NO: 6499537 - DNA, 16 bp, Homo sapiens
tgtaccacaccctgcc

SEQ ID NO: 6499538 - DNA, 17 bp, Homo sapiens
tgtaccacaccctgcct

SEQ ID NO: 6499539 - DNA, 18 bp, Homo sapiens
tgtaccacaccctgcctg

SEQ ID NO: 6499540 - DNA, 19 bp, Homo sapiens
tgtaccacaccctgcctgc

SEQ ID NO: 6499541 - DNA, 13 bp, Homo sapiens
tgtaccactgcta

SEQ ID NO: 6499542 - DNA, 16 bp, Homo sapiens
tgtaccactgctaata

SEQ ID NO: 6499543 - DNA, 17 bp, Homo sapiens
tgtaccactgctaataa

SEQ ID NO: 6499544 - DNA, 17 bp, Homo sapiens
tgtaccacttctgtggg

SEQ ID NO: 6499545 - DNA, 19 bp, Homo sapiens
tgtaccacttctgtgggca

SEQ ID NO: 6499546 - DNA, 21 bp, Homo sapiens
tgtaccacttctgtgggcatg

SEQ ID NO: 6499547 - DNA, 16 bp, Homo sapiens
tgtaccacttttgcaa

SEQ ID NO: 6499548 - DNA, 13 bp, Homo sapiens
tgtaccagcccag

SEQ ID NO: 6499549 - DNA, 17 bp, Homo sapiens
tgtaccagcccagatgt

SEQ ID NO: 6499550 - DNA, 20 bp, Homo sapiens
tgtaccagcccagatgtttt

SEQ ID NO: 6499551 - DNA, 15 bp, Homo sapiens
tgtaccagcccaggc

SEQ ID NO: 6499552 - DNA, 19 bp, Homo sapiens
tgtaccagctgctgtgctg

SEQ ID NO: 6499553 - DNA, 17 bp, Homo sapiens
tgtaccagggctctgta

SEQ ID NO: 6499554 - DNA, 21 bp, Homo sapiens
tgtaccagtgaatttttgcaa

SEQ ID NO: 6499555 - DNA, 22 bp, Homo sapiens
tgtaccagtgaatttttgcaat

SEQ ID NO: 6499556 - DNA, 14 bp, Homo sapiens
tgtaccagtgtgaa

SEQ ID NO: 6499557 - DNA, 11 bp, Homo sapiens
tgtaccagtta

SEQ ID NO: 6499558 - DNA, 14 bp, Homo sapiens
tgtaccagttaatt

SEQ ID NO: 6499559 - DNA, 15 bp, Homo sapiens
tgtaccatcatttta

SEQ ID NO: 6499560 - DNA, 16 bp, Homo sapiens
tgtaccatcattttat

SEQ ID NO: 6499561 - DNA, 23 bp, Homo sapiens
tgtaccatgtacctaatccaaat

SEQ ID NO: 6499562 - DNA, 16 bp, Homo sapiens
tgtaccatgttaaaga

SEQ ID NO: 6499563 - DNA, 19 bp, Homo sapiens
tgtaccattccttcaaata

SEQ ID NO: 6499564 - DNA, 15 bp, Homo sapiens
tgtaccattctgttg

SEQ ID NO: 6499565 - DNA, 12 bp, Homo sapiens
tgtacccacccc

SEQ ID NO: 6499566 - DNA, 15 bp, Homo sapiens
tgtacccagatgcct

SEQ ID NO: 6499567 - DNA, 22 bp, Homo sapiens
tgtacccagtagggtttgacat

SEQ ID NO: 6499568 - DNA, 18 bp, Homo sapiens
tgtacccattgcagaccc

SEQ ID NO: 6499569 - DNA, 17 bp, Homo sapiens
tgtacccccgcccaggc

SEQ ID NO: 6499570 - DNA, 17 bp, Homo sapiens
tgtaccctatgttcact

SEQ ID NO: 6499571 - DNA, 17 bp, Homo sapiens
tgtaccctctgaaatac

SEQ ID NO: 6499572 - DNA, 22 bp, Homo sapiens
tgtacccttcttgtctctctgg

SEQ ID NO: 6499573 - DNA, 15 bp, Homo sapiens
tgtaccgcaatgtga

SEQ ID NO: 6499574 - DNA, 23 bp, Homo sapiens
tgtaccgcccggcagccccttct

SEQ ID NO: 6499575 - DNA, 21 bp, Homo sapiens
tgtaccgcgtctaccctggga

SEQ ID NO: 6499576 - DNA, 22 bp, Homo sapiens
tgtaccgcgtctaccctgggat

SEQ ID NO: 6499577 - DNA, 19 bp, Homo sapiens
tgtacctatggctgcctgc

SEQ ID NO: 6499578 - DNA, 20 bp, Homo sapiens
tgtacctatttctgatgatg

SEQ ID NO: 6499579 - DNA, 18 bp, Homo sapiens
tgtacctctaagtacata

SEQ ID NO: 6499580 - DNA, 18 bp, Homo sapiens
tgtacctctctctgctcc

SEQ ID NO: 6499581 - DNA, 14 bp, Homo sapiens
tgtacctctgcctc

SEQ ID NO: 6499582 - DNA, 23 bp, Homo sapiens
tgtacctcttgagccttgaactt

SEQ ID NO: 6499583 - DNA, 17 bp, Homo sapiens
tgtacctggtgacccct

SEQ ID NO: 6499584 - DNA, 16 bp, Homo sapiens
tgtacctgtaggaaac

SEQ ID NO: 6499585 - DNA, 16 bp, Homo sapiens
tgtacctgtgtacata

SEQ ID NO: 6499586 - DNA, 19 bp, Homo sapiens
tgtacctgtgtacataact

SEQ ID NO: 6499587 - DNA, 20 bp, Homo sapiens
tgtaccttaagatattgaag

SEQ ID NO: 6499588 - DNA, 12 bp, Homo sapiens
tgtaccttttgc

SEQ ID NO: 6499589 - DNA, 16 bp, Homo sapiens
tgtacgaacccctccc

SEQ ID NO: 6499590 - DNA, 17 bp, Homo sapiens
tgtacgaggcttctcta

SEQ ID NO: 6499591 - DNA, 14 bp, Homo sapiens
tgtacgcaattctc

SEQ ID NO: 6499592 - DNA, 18 bp, Homo sapiens
tgtacgcgtttgtctcgt

SEQ ID NO: 6499593 - DNA, 16 bp, Homo sapiens
tgtacgtagccacagg

SEQ ID NO: 6499594 - DNA, 17 bp, Homo sapiens
tgtacgtatcatttcta

SEQ ID NO: 6499595 - DNA, 22 bp, Homo sapiens
tgtacgtatgaatgatatcttt

SEQ ID NO: 6499596 - DNA, 17 bp, Homo sapiens
tgtacgtccagcctgcc

SEQ ID NO: 6499597 - DNA, 15 bp, Homo sapiens
tgtacgtctgacagg

SEQ ID NO: 6499598 - DNA, 14 bp, Homo sapiens
tgtacgtctggtgt

SEQ ID NO: 6499599 - DNA, 12 bp, Homo sapiens
tgtacgtggaga

SEQ ID NO: 6499600 - DNA, 17 bp, Homo sapiens
tgtacgtgggagaggca

SEQ ID NO: 6499601 - DNA, 20 bp, Homo sapiens
tgtacgtttgtatgtgtgta

SEQ ID NO: 6499602 - DNA, 16 bp, Homo sapiens
tgtacgttttgcacat

SEQ ID NO: 6499603 - DNA, 21 bp, Homo sapiens
tgtacgttttgcacattttgt

SEQ ID NO: 6499604 - DNA, 14 bp, Homo sapiens
tgtactaaacattt

SEQ ID NO: 6499605 - DNA, 17 bp, Homo sapiens
tgtactaaacatttcct

SEQ ID NO: 6499606 - DNA, 16 bp, Homo sapiens
tgtactaaagccaaac

SEQ ID NO: 6499607 - DNA, 17 bp, Homo sapiens
tgtactaacccagtctt

SEQ ID NO: 6499608 - DNA, 20 bp, Homo sapiens
tgtactaacccagtctttct

SEQ ID NO: 6499609 - DNA, 21 bp, Homo sapiens
tgtactaacccagtctttctt

SEQ ID NO: 6499610 - DNA, 19 bp, Homo sapiens
tgtactaacctacagagat

SEQ ID NO: 6499611 - DNA, 16 bp, Homo sapiens
tgtactaactagcatt

SEQ ID NO: 6499612 - DNA, 19 bp, Homo sapiens
tgtactaagaatgtcctta

SEQ ID NO: 6499613 - DNA, 21 bp, Homo sapiens
tgtactaattaacatataata

SEQ ID NO: 6499614 - DNA, 12 bp, Homo sapiens
tgtactacaatt

SEQ ID NO: 6499615 - DNA, 14 bp, Homo sapiens
tgtactacagctat

SEQ ID NO: 6499616 - DNA, 19 bp, Homo sapiens
tgtactacagctatatttg

SEQ ID NO: 6499617 - DNA, 20 bp, Homo sapiens
tgtactacagctatatttga

SEQ ID NO: 6499618 - DNA, 15 bp, Homo sapiens
tgtactacatttgca

SEQ ID NO: 6499619 - DNA, 23 bp, Homo sapiens
tgtactactctagggagtatgct

SEQ ID NO: 6499620 - DNA, 13 bp, Homo sapiens
tgtactactgcct

SEQ ID NO: 6499621 - DNA, 19 bp, Homo sapiens
tgtactagagatctggttt

SEQ ID NO: 6499622 - DNA, 21 bp, Homo sapiens
tgtactagtactgtgtactgt

SEQ ID NO: 6499623 - DNA, 18 bp, Homo sapiens
tgtactagtcctctagaa

SEQ ID NO: 6499624 - DNA, 16 bp, Homo sapiens
tgtactagtgtccgca

SEQ ID NO: 6499625 - DNA, 18 bp, Homo sapiens
tgtactatcctgtaaata

SEQ ID NO: 6499626 - DNA, 14 bp, Homo sapiens
tgtactatctagtg

SEQ ID NO: 6499627 - DNA, 19 bp, Homo sapiens
tgtactatggaaaatcagc

SEQ ID NO: 6499628 - DNA, 21 bp, Homo sapiens
tgtactatggaaaatcagctg

SEQ ID NO: 6499629 - DNA, 19 bp, Homo sapiens
tgtactatggctgtatttt

SEQ ID NO: 6499630 - DNA, 12 bp, Homo sapiens
tgtactatgtta

SEQ ID NO: 6499631 - DNA, 15 bp, Homo sapiens
tgtactattgcagac

SEQ ID NO: 6499632 - DNA, 18 bp, Homo sapiens
tgtactattgcagacctg

SEQ ID NO: 6499633 - DNA, 16 bp, Homo sapiens
tgtactattgtttaaa

SEQ ID NO: 6499634 - DNA, 22 bp, Homo sapiens
tgtactattgtttaaaaacagg

SEQ ID NO: 6499635 - DNA, 17 bp, Homo sapiens
tgtactcacatataaca

SEQ ID NO: 6499636 - DNA, 21 bp, Homo sapiens
tgtactcacatataacatgca

SEQ ID NO: 6499637 - DNA, 17 bp, Homo sapiens
tgtactcactgagtaac

SEQ ID NO: 6499638 - DNA, 15 bp, Homo sapiens
tgtactcagagcaga

SEQ ID NO: 6499639 - DNA, 18 bp, Homo sapiens
tgtactcagtggacagtg

SEQ ID NO: 6499640 - DNA, 23 bp, Homo sapiens
tgtactcagtggacagtgctgtt

SEQ ID NO: 6499641 - DNA, 14 bp, Homo sapiens
tgtactcatcggca

SEQ ID NO: 6499642 - DNA, 18 bp, Homo sapiens
tgtactccagcctgggca

SEQ ID NO: 6499643 - DNA, 12 bp, Homo sapiens
tgtactcccagg

SEQ ID NO: 6499644 - DNA, 20 bp, Homo sapiens
tgtactcgcttgtgcagaaa

SEQ ID NO: 6499645 - DNA, 23 bp, Homo sapiens
tgtactcgcttgtgcagaaaaca

SEQ ID NO: 6499646 - DNA, 15 bp, Homo sapiens
tgtactctacaaaat

SEQ ID NO: 6499647 - DNA, 12 bp, Homo sapiens
tgtactctagga

SEQ ID NO: 6499648 - DNA, 16 bp, Homo sapiens
tgtactctaggacttc

SEQ ID NO: 6499649 - DNA, 21 bp, Homo sapiens
tgtactctaggacttcaaagt

SEQ ID NO: 6499650 - DNA, 14 bp, Homo sapiens
tgtactctcctttt

SEQ ID NO: 6499651 - DNA, 15 bp, Homo sapiens
tgtactctgctttat

SEQ ID NO: 6499652 - DNA, 16 bp, Homo sapiens
tgtactcttaggatat

SEQ ID NO: 6499653 - DNA, 20 bp, Homo sapiens
tgtactcttatatttttctg

SEQ ID NO: 6499654 - DNA, 22 bp, Homo sapiens
tgtactcttctgactgccccct

SEQ ID NO: 6499655 - DNA, 16 bp, Homo sapiens
tgtactcttgctgatg

SEQ ID NO: 6499656 - DNA, 15 bp, Homo sapiens
tgtactgaaagcaaa

SEQ ID NO: 6499657 - DNA, 22 bp, Homo sapiens
tgtactgaaagcaaatgctttg

SEQ ID NO: 6499658 - DNA, 18 bp, Homo sapiens
tgtactgaagtaaaacaa

SEQ ID NO: 6499659 - DNA, 22 bp, Homo sapiens
tgtactgaataggttccccaat

SEQ ID NO: 6499660 - DNA, 12 bp, Homo sapiens
tgtactgaattc

SEQ ID NO: 6499661 - DNA, 14 bp, Homo sapiens
tgtactgaattctt

SEQ ID NO: 6499662 - DNA, 16 bp, Homo sapiens
tgtactgaattcttta

SEQ ID NO: 6499663 - DNA, 20 bp, Homo sapiens
tgtactgaatttttttgtaa

SEQ ID NO: 6499664 - DNA, 23 bp, Homo sapiens
tgtactgaatttttttgtaataa

SEQ ID NO: 6499665 - DNA, 19 bp, Homo sapiens
tgtactgagacaaaaagga

SEQ ID NO: 6499666 - DNA, 17 bp, Homo sapiens
tgtactgatactattca

SEQ ID NO: 6499667 - DNA, 17 bp, Homo sapiens
tgtactgattcaagaac

SEQ ID NO: 6499668 - DNA, 22 bp, Homo sapiens
tgtactgcaaagtcgccagtca

SEQ ID NO: 6499669 - DNA, 20 bp, Homo sapiens
tgtactgcaaagtgtatgca

SEQ ID NO: 6499670 - DNA, 12 bp, Homo sapiens
tgtactgcatgt

SEQ ID NO: 6499671 - DNA, 12 bp, Homo sapiens
tgtactgcctgc

SEQ ID NO: 6499672 - DNA, 18 bp, Homo sapiens
tgtactgctagtacctgt

SEQ ID NO: 6499673 - DNA, 12 bp, Homo sapiens
tgtactgggaca

SEQ ID NO: 6499674 - DNA, 19 bp, Homo sapiens
tgtactgggttaatggcta

SEQ ID NO: 6499675 - DNA, 16 bp, Homo sapiens
tgtactggtaattgta

SEQ ID NO: 6499676 - DNA, 20 bp, Homo sapiens
tgtactggtaattgtacaat

SEQ ID NO: 6499677 - DNA, 16 bp, Homo sapiens
tgtactggttcattgt

SEQ ID NO: 6499678 - DNA, 22 bp, Homo sapiens
tgtactgtaattttgtttgtaa

SEQ ID NO: 6499679 - DNA, 13 bp, Homo sapiens
tgtactgtacata

SEQ ID NO: 6499680 - DNA, 15 bp, Homo sapiens
tgtactgtacataaa

SEQ ID NO: 6499681 - DNA, 16 bp, Homo sapiens
tgtactgtactaattc

SEQ ID NO: 6499682 - DNA, 12 bp, Homo sapiens
tgtactgtagtt

SEQ ID NO: 6499683 - DNA, 13 bp, Homo sapiens
tgtactgtatgca

SEQ ID NO: 6499684 - DNA, 17 bp, Homo sapiens
tgtactgtatgcagttt

SEQ ID NO: 6499685 - DNA, 16 bp, Homo sapiens
tgtactgtctgttatg

SEQ ID NO: 6499686 - DNA, 21 bp, Homo sapiens
tgtactgtgacctaagaacaa

SEQ ID NO: 6499687 - DNA, 11 bp, Homo sapiens
tgtactgtgct

SEQ ID NO: 6499688 - DNA, 19 bp, Homo sapiens
tgtactgtgtcataaacag

SEQ ID NO: 6499689 - DNA, 13 bp, Homo sapiens
tgtactgttcata

SEQ ID NO: 6499690 - DNA, 16 bp, Homo sapiens
tgtactgttctgtgtc

SEQ ID NO: 6499691 - DNA, 15 bp, Homo sapiens
tgtactgttgaaaaa

SEQ ID NO: 6499692 - DNA, 19 bp, Homo sapiens
tgtactgttgctttaatat

SEQ ID NO: 6499693 - DNA, 14 bp, Homo sapiens
tgtacttaaatgag

SEQ ID NO: 6499694 - DNA, 20 bp, Homo sapiens
tgtacttaaatgagttactt

SEQ ID NO: 6499695 - DNA, 22 bp, Homo sapiens
tgtacttaaatgagttacttag

SEQ ID NO: 6499696 - DNA, 17 bp, Homo sapiens
tgtacttaaattacaca

SEQ ID NO: 6499697 - DNA, 13 bp, Homo sapiens
tgcaaatttcaaa

SEQ ID NO: 6499698 - DNA, 18 bp, Homo sapiens
tgcaaatttctataaatt

SEQ ID NO: 6499699 - DNA, 19 bp, Homo sapiens
tgcaaatttctataaattt

SEQ ID NO: 6499700 - DNA, 16 bp, Homo sapiens
tgcaaatttgtaaact

SEQ ID NO: 6499701 - DNA, 15 bp, Homo sapiens
tgcaaattttaactg

SEQ ID NO: 6499702 - DNA, 16 bp, Homo sapiens
tgcaaattttgcattt

SEQ ID NO: 6499703 - DNA, 17 bp, Homo sapiens
tgcaaattttgcattta

SEQ ID NO: 6499704 - DNA, 18 bp, Homo sapiens
tgcaacaaaaatgtgggt

SEQ ID NO: 6499705 - DNA, 12 bp, Homo sapiens
tgcaacaaaata

SEQ ID NO: 6499706 - DNA, 18 bp, Homo sapiens
tgcaacaaaatatttaat

SEQ ID NO: 6499707 - DNA, 13 bp, Homo sapiens
tgcaacaaaattc

SEQ ID NO: 6499708 - DNA, 13 bp, Homo sapiens
tgcaacaacatgt

SEQ ID NO: 6499709 - DNA, 16 bp, Homo sapiens
tgcaacaagagcaaaa

SEQ ID NO: 6499710 - DNA, 21 bp, Homo sapiens
tgcaacaagctcatccctgga

SEQ ID NO: 6499711 - DNA, 17 bp, Homo sapiens
tgcaacaataataaatg

SEQ ID NO: 6499712 - DNA, 14 bp, Homo sapiens
tgcaacaatgtgtg

SEQ ID NO: 6499713 - DNA, 20 bp, Homo sapiens
tgcaacacaacatttgtgtc

SEQ ID NO: 6499714 - DNA, 13 bp, Homo sapiens
tgcaacacacaga

SEQ ID NO: 6499715 - DNA, 15 bp, Homo sapiens
tgcaacacacagaca

SEQ ID NO: 6499716 - DNA, 19 bp, Homo sapiens
tgcaacactcaagtctatt

SEQ ID NO: 6499717 - DNA, 18 bp, Homo sapiens
tgcaacactgccaaacat

SEQ ID NO: 6499718 - DNA, 18 bp, Homo sapiens
tgcaacagactgccttat

SEQ ID NO: 6499719 - DNA, 21 bp, Homo sapiens
tgcaacagactgccttatatt

SEQ ID NO: 6499720 - DNA, 22 bp, Homo sapiens
tgcaacagcaaattaatgtgta

SEQ ID NO: 6499721 - DNA, 13 bp, Homo sapiens
tgcaacagcagtg

SEQ ID NO: 6499722 - DNA, 15 bp, Homo sapiens
tgcaacaggcactca

SEQ ID NO: 6499723 - DNA, 14 bp, Homo sapiens
tgcaacaggctggg

SEQ ID NO: 6499724 - DNA, 19 bp, Homo sapiens
tgcaacaggctgggcttca

SEQ ID NO: 6499725 - DNA, 14 bp, Homo sapiens
tgcaacaggcttgt

SEQ ID NO: 6499726 - DNA, 24 bp, Homo sapiens
tgcaacagggtatggactatctgt

SEQ ID NO: 6499727 - DNA, 15 bp, Homo sapiens
tgcaacaggtaaaca

SEQ ID NO: 6499728 - DNA, 13 bp, Homo sapiens
tgcaacagtagca

SEQ ID NO: 6499729 - DNA, 13 bp, Homo sapiens
tgcaacataacaa

SEQ ID NO: 6499730 - DNA, 15 bp, Homo sapiens
tgcaacatataaagt

SEQ ID NO: 6499731 - DNA, 21 bp, Homo sapiens
tgcaacatggattccaaagca

SEQ ID NO: 6499732 - DNA, 13 bp, Homo sapiens
tgcaacatttatt

SEQ ID NO: 6499733 - DNA, 15 bp, Homo sapiens
tgcaacatttctgta

SEQ ID NO: 6499734 - DNA, 18 bp, Homo sapiens
tgcaaccaaaagggaaaa

SEQ ID NO: 6499735 - DNA, 19 bp, Homo sapiens
tgcaaccaaaagggaaaaa

SEQ ID NO: 6499736 - DNA, 20 bp, Homo sapiens
tgcaaccaaactcccatcag

SEQ ID NO: 6499737 - DNA, 13 bp, Homo sapiens
tgcaaccactctg

SEQ ID NO: 6499738 - DNA, 17 bp, Homo sapiens
tgcaaccactctgtggc

SEQ ID NO: 6499739 - DNA, 15 bp, Homo sapiens
tgcaaccagaattgt

SEQ ID NO: 6499740 - DNA, 20 bp, Homo sapiens
tgcaaccagaattgtcctca

SEQ ID NO: 6499741 - DNA, 20 bp, Homo sapiens
tgcaaccaggaacagcaaat

SEQ ID NO: 6499742 - DNA, 17 bp, Homo sapiens
tgcaaccaggcagctga

SEQ ID NO: 6499743 - DNA, 21 bp, Homo sapiens
tgcaaccaggcagctgagacc

SEQ ID NO: 6499744 - DNA, 22 bp, Homo sapiens
tgcaaccatgggcaccaggcaa

SEQ ID NO: 6499745 - DNA, 16 bp, Homo sapiens
tgcaacccaaggactg

SEQ ID NO: 6499746 - DNA, 20 bp, Homo sapiens
tgcaacccaaggactgaggg

SEQ ID NO: 6499747 - DNA, 21 bp, Homo sapiens
tgcaacccaaggactgaggga

SEQ ID NO: 6499748 - DNA, 21 bp, Homo sapiens
tgcaacccatgagcgtccagg

SEQ ID NO: 6499749 - DNA, 20 bp, Homo sapiens
tgcaaccctggtgtgctggg

SEQ ID NO: 6499750 - DNA, 23 bp, Homo sapiens
tgcaaccctggtgtgctgggcga

SEQ ID NO: 6499751 - DNA, 17 bp, Homo sapiens
tgcaacccttacccctt

SEQ ID NO: 6499752 - DNA, 16 bp, Homo sapiens
tgcaaccgtctgttat

SEQ ID NO: 6499753 - DNA, 18 bp, Homo sapiens
tgcaacctcaccttcctg

SEQ ID NO: 6499754 - DNA, 13 bp, Homo sapiens
tgcaacctcacta

SEQ ID NO: 6499755 - DNA, 13 bp, Homo sapiens
tgcaacctccacc

SEQ ID NO: 6499756 - DNA, 21 bp, Homo sapiens
tgcaacctccaccttctgggt

SEQ ID NO: 6499757 - DNA, 21 bp, Homo sapiens
tgcaacctccgcatcccgggt

SEQ ID NO: 6499758 - DNA, 21 bp, Homo sapiens
tgcaacctccgccttccgggt

SEQ ID NO: 6499759 - DNA, 20 bp, Homo sapiens
tgcaacctcgctggactctc

SEQ ID NO: 6499760 - DNA, 21 bp, Homo sapiens
tgcaacctctacctcctgggt

SEQ ID NO: 6499761 - DNA, 14 bp, Homo sapiens
tgcaacctctgccc

SEQ ID NO: 6499762 - DNA, 14 bp, Homo sapiens
tgcaacctctgcct

SEQ ID NO: 6499763 - DNA, 15 bp, Homo sapiens
tgcaacctctgcctc

SEQ ID NO: 6499764 - DNA, 20 bp, Homo sapiens
tgcaacctctgcctcctggg

SEQ ID NO: 6499765 - DNA, 20 bp, Homo sapiens
tgcaacctctgtctcccggg

SEQ ID NO: 6499766 - DNA, 20 bp, Homo sapiens
tgcaacctcttcctcctggt

SEQ ID NO: 6499767 - DNA, 18 bp, Homo sapiens
tgcaacctcttggcctga

SEQ ID NO: 6499768 - DNA, 19 bp, Homo sapiens
tgcaacctgattgtgtctc

SEQ ID NO: 6499769 - DNA, 20 bp, Homo sapiens
tgcaacctgattgtgtctct

SEQ ID NO: 6499770 - DNA, 18 bp, Homo sapiens
tgcaacctgtggctcagg

SEQ ID NO: 6499771 - DNA, 23 bp, Homo sapiens
tgcaacctgtggctcaggggagc

SEQ ID NO: 6499772 - DNA, 21 bp, Homo sapiens
tgcaaccttcgccacctgggt

SEQ ID NO: 6499773 - DNA, 17 bp, Homo sapiens
tgcaaccttgtacttta

SEQ ID NO: 6499774 - DNA, 19 bp, Homo sapiens
tgcaaccttgtttattaaa

SEQ ID NO: 6499775 - DNA, 18 bp, Homo sapiens
tgcaacgctcactggttt

SEQ ID NO: 6499776 - DNA, 13 bp, Homo sapiens
tgcaacggcatga

SEQ ID NO: 6499777 - DNA, 18 bp, Homo sapiens
tgcaacggcatgattttg

SEQ ID NO: 6499778 - DNA, 16 bp, Homo sapiens
tgcaacggccagggtt

SEQ ID NO: 6499779 - DNA, 19 bp, Homo sapiens
tgcaacgggattgaagggt

SEQ ID NO: 6499780 - DNA, 19 bp, Homo sapiens
tgcaactaactgactctgt

SEQ ID NO: 6499781 - DNA, 22 bp, Homo sapiens
tgcaactaactgactctgttat

SEQ ID NO: 6499782 - DNA, 18 bp, Homo sapiens
tgcaactaaggacaaatt

SEQ ID NO: 6499783 - DNA, 19 bp, Homo sapiens
tgcaactaaggacaaatta

SEQ ID NO: 6499784 - DNA, 21 bp, Homo sapiens
tgcaactaaggacaaattagc

SEQ ID NO: 6499785 - DNA, 19 bp, Homo sapiens
tgcaactaggtatttctaa

SEQ ID NO: 6499786 - DNA, 16 bp, Homo sapiens
tgcaactcaaggactt

SEQ ID NO: 6499787 - DNA, 14 bp, Homo sapiens
tgcaactcagcccc

SEQ ID NO: 6499788 - DNA, 13 bp, Homo sapiens
tgcaactccagcg

SEQ ID NO: 6499789 - DNA, 22 bp, Homo sapiens
tgcaactccagcgtcctcagca

SEQ ID NO: 6499790 - DNA, 20 bp, Homo sapiens
tgcaactccatcctcctgtg

SEQ ID NO: 6499791 - DNA, 16 bp, Homo sapiens
tgcaactccatgccta

SEQ ID NO: 6499792 - DNA, 14 bp, Homo sapiens
tgcaactcctgtaa

SEQ ID NO: 6499793 - DNA, 19 bp, Homo sapiens
tgcaactctaactctgaga

SEQ ID NO: 6499794 - DNA, 22 bp, Homo sapiens
tgcaactctgaagggtaattat

SEQ ID NO: 6499795 - DNA, 13 bp, Homo sapiens
tgcaactcttgta

SEQ ID NO: 6499796 - DNA, 16 bp, Homo sapiens
tgcaactgaatacttg

SEQ ID NO: 6499797 - DNA, 20 bp, Homo sapiens
tgcaactgctcagctctggt

SEQ ID NO: 6499798 - DNA, 13 bp, Homo sapiens
tgcaactggccag

SEQ ID NO: 6499799 - DNA, 16 bp, Homo sapiens
tgcaactggccagcca

SEQ ID NO: 6499800 - DNA, 22 bp, Homo sapiens
tgcaacttagatctctcctgca

SEQ ID NO: 6499801 - DNA, 15 bp, Homo sapiens
tgcaacttcctttga

SEQ ID NO: 6499802 - DNA, 14 bp, Homo sapiens
tgcaacttctgcct

SEQ ID NO: 6499803 - DNA, 14 bp, Homo sapiens
tgcaacttctttct

SEQ ID NO: 6499804 - DNA, 17 bp, Homo sapiens
tgcaacttctttttatt

SEQ ID NO: 6499805 - DNA, 17 bp, Homo sapiens
tgcaacttgattcttgt

SEQ ID NO: 6499806 - DNA, 16 bp, Homo sapiens
tgcaacttgtaaatgt

SEQ ID NO: 6499807 - DNA, 20 bp, Homo sapiens
tgcaactttagaaagaaatt

SEQ ID NO: 6499808 - DNA, 11 bp, Homo sapiens
tgcaacttttt

SEQ ID NO: 6499809 - DNA, 19 bp, Homo sapiens
tgcaagaaaactaggcaat

SEQ ID NO: 6499810 - DNA, 22 bp, Homo sapiens
tgcaagaaaggggacccaagaa

SEQ ID NO: 6499811 - DNA, 23 bp, Homo sapiens
tgcaagaaccaaacgtattttat

SEQ ID NO: 6499812 - DNA, 21 bp, Homo sapiens
tgcaagaactcatcactgtgg

SEQ ID NO: 6499813 - DNA, 14 bp, Homo sapiens
tgcaagaagaatat

SEQ ID NO: 6499814 - DNA, 13 bp, Homo sapiens
tgcaagaatctaa

SEQ ID NO: 6499815 - DNA, 22 bp, Homo sapiens
tgcaagaatgaaatgaatgatt

SEQ ID NO: 6499816 - DNA, 21 bp, Homo sapiens
tgcaagaattaaaactgagtc

SEQ ID NO: 6499817 - DNA, 21 bp, Homo sapiens
tgcaagaatttctggaagaaa

SEQ ID NO: 6499818 - DNA, 20 bp, Homo sapiens
tgcaagacacaggctcagca

SEQ ID NO: 6499819 - DNA, 16 bp, Homo sapiens
tgcaagaccacggagg

SEQ ID NO: 6499820 - DNA, 18 bp, Homo sapiens
tgcaagaccacggaggga

SEQ ID NO: 6499821 - DNA, 22 bp, Homo sapiens
tgcaagaccagtattctaaagt

SEQ ID NO: 6499822 - DNA, 21 bp, Homo sapiens
tgcaagaccgtttgtccactt

SEQ ID NO: 6499823 - DNA, 13 bp, Homo sapiens
tgcaagactcgaa

SEQ ID NO: 6499824 - DNA, 20 bp, Homo sapiens
tgcaagagaacattttactg

SEQ ID NO: 6499825 - DNA, 22 bp, Homo sapiens
tgcaagagaacattttactgtt

SEQ ID NO: 6499826 - DNA, 12 bp, Homo sapiens
tgcaagagaagg

SEQ ID NO: 6499827 - DNA, 23 bp, Homo sapiens
tgcaagagacagagcccccaagc

SEQ ID NO: 6499828 - DNA, 18 bp, Homo sapiens
tgcaagagactctggcct

SEQ ID NO: 6499829 - DNA, 23 bp, Homo sapiens
tgcaagagactttgtcacttatt

SEQ ID NO: 6499830 - DNA, 18 bp, Homo sapiens
tgcaagagcctgagactg

SEQ ID NO: 6499831 - DNA, 19 bp, Homo sapiens
tgcaagagcctgagactgg

SEQ ID NO: 6499832 - DNA, 17 bp, Homo sapiens
tgcaagagtgattgcag

SEQ ID NO: 6499833 - DNA, 13 bp, Homo sapiens
tgcaagagtggac

SEQ ID NO: 6499834 - DNA, 20 bp, Homo sapiens
tgcaagagtgggctttccag

SEQ ID NO: 6499835 - DNA, 21 bp, Homo sapiens
tgcaagagtgggctttccagg

SEQ ID NO: 6499836 - DNA, 22 bp, Homo sapiens
tgcaagagtgggctttccaggg

SEQ ID NO: 6499837 - DNA, 15 bp, Homo sapiens
tgcaagagtttcttg

SEQ ID NO: 6499838 - DNA, 16 bp, Homo sapiens
tgcaagataattttca

SEQ ID NO: 6499839 - DNA, 15 bp, Homo sapiens
tgcaagatgcttggt

SEQ ID NO: 6499840 - DNA, 22 bp, Homo sapiens
tgcaagatggacacgagccaca

SEQ ID NO: 6499841 - DNA, 23 bp, Homo sapiens
tgcaagatggacacgagccacaa

SEQ ID NO: 6499842 - DNA, 17 bp, Homo sapiens
tgcaagattctgtgggc

SEQ ID NO: 6499843 - DNA, 20 bp, Homo sapiens
tgcaagattctgtgggcagc

SEQ ID NO: 6499844 - DNA, 18 bp, Homo sapiens
tgcaagatttaacactaa

SEQ ID NO: 6499845 - DNA, 16 bp, Homo sapiens
tgcaagcactcggggt

SEQ ID NO: 6499846 - DNA, 17 bp, Homo sapiens
tgcaagcagaggaccag

SEQ ID NO: 6499847 - DNA, 18 bp, Homo sapiens
tgcaagcagattccctgt

SEQ ID NO: 6499848 - DNA, 16 bp, Homo sapiens
tgcaagcagcctcctg

SEQ ID NO: 6499849 - DNA, 19 bp, Homo sapiens
tgcaagcaggactttgagg

SEQ ID NO: 6499850 - DNA, 17 bp, Homo sapiens
tgcaagcagggctctgc

SEQ ID NO: 6499851 - DNA, 23 bp, Homo sapiens
tgcaagcagtttcaataaagttt

SEQ ID NO: 6499852 - DNA, 22 bp, Homo sapiens
tgcaagcatttttccatctgtg

SEQ ID NO: 6499853 - DNA, 15 bp, Homo sapiens
tgcaagccactatgt

SEQ ID NO: 6499854 - DNA, 17 bp, Homo sapiens
tgcaagccactatgtcc

SEQ ID NO: 6499855 - DNA, 13 bp, Homo sapiens
tgcaagccaggga

SEQ ID NO: 6499856 - DNA, 21 bp, Homo sapiens
tgcaagcccactggccagctc

SEQ ID NO: 6499857 - DNA, 13 bp, Homo sapiens
tgcaagccccagg

SEQ ID NO: 6499858 - DNA, 15 bp, Homo sapiens
tgcaagccccagggc

SEQ ID NO: 6499859 - DNA, 23 bp, Homo sapiens
tgcaagccccagggcctgggggc

SEQ ID NO: 6499860 - DNA, 23 bp, Homo sapiens
tgcaagcccctgctccagaagat

SEQ ID NO: 6499861 - DNA, 12 bp, Homo sapiens
tgcaagcctgcg

SEQ ID NO: 6499862 - DNA, 12 bp, Homo sapiens
tgcaagctccag

SEQ ID NO: 6499863 - DNA, 17 bp, Homo sapiens
tgcaagctccagtagct

SEQ ID NO: 6499864 - DNA, 19 bp, Homo sapiens
tgcaagctccgcctcccgg

SEQ ID NO: 6499865 - DNA, 23 bp, Homo sapiens
tgcaagctctggaattgttgaat

SEQ ID NO: 6499866 - DNA, 14 bp, Homo sapiens
tgcaagcttattta

SEQ ID NO: 6499867 - DNA, 15 bp, Homo sapiens
tgcaagcttggtcaa

SEQ ID NO: 6499868 - DNA, 18 bp, Homo sapiens
tgcaagcttggtcaaact

SEQ ID NO: 6499869 - DNA, 20 bp, Homo sapiens
tgcaagcttggtcaaacttt

SEQ ID NO: 6499870 - DNA, 21 bp, Homo sapiens
tgcaagcttggtcaaactttt

SEQ ID NO: 6499871 - DNA, 15 bp, Homo sapiens
tgcaagctttaacag

SEQ ID NO: 6499872 - DNA, 18 bp, Homo sapiens
tgcaagctttaacagact

SEQ ID NO: 6499873 - DNA, 13 bp, Homo sapiens
tgcaagcttttcc

SEQ ID NO: 6499874 - DNA, 15 bp, Homo sapiens
tgtacttaactattc

SEQ ID NO: 6499875 - DNA, 16 bp, Homo sapiens
tgtacttaataaattc

SEQ ID NO: 6499876 - DNA, 21 bp, Homo sapiens
tgtacttaataaattcagata

SEQ ID NO: 6499877 - DNA, 16 bp, Homo sapiens
tgtacttacatgggtg

SEQ ID NO: 6499878 - DNA, 19 bp, Homo sapiens
tgtacttattacagtctta

SEQ ID NO: 6499879 - DNA, 17 bp, Homo sapiens
tgtacttcaaccagcct

SEQ ID NO: 6499880 - DNA, 24 bp, Homo sapiens
tgtacttcagttctcatcttgtaa

SEQ ID NO: 6499881 - DNA, 21 bp, Homo sapiens
tgtacttcataagatattctt

SEQ ID NO: 6499882 - DNA, 23 bp, Homo sapiens
tgtacttcataagatattcttta

SEQ ID NO: 6499883 - DNA, 18 bp, Homo sapiens
tgtacttccaatttataa

SEQ ID NO: 6499884 - DNA, 11 bp, Homo sapiens
tgtacttcctg

SEQ ID NO: 6499885 - DNA, 17 bp, Homo sapiens
tgtacttcctgagtggc

SEQ ID NO: 6499886 - DNA, 16 bp, Homo sapiens
tgtacttcctgtgtac

SEQ ID NO: 6499887 - DNA, 19 bp, Homo sapiens
tgtacttcctgtgtactct

SEQ ID NO: 6499888 - DNA, 21 bp, Homo sapiens
tgtacttcgtcttctaatttc

SEQ ID NO: 6499889 - DNA, 18 bp, Homo sapiens
tgtacttctctgtgtgca

SEQ ID NO: 6499890 - DNA, 18 bp, Homo sapiens
tgtacttctgtgttcatt

SEQ ID NO: 6499891 - DNA, 16 bp, Homo sapiens
tgtacttcttgaatat

SEQ ID NO: 6499892 - DNA, 13 bp, Homo sapiens
tgtacttgaaaaa

SEQ ID NO: 6499893 - DNA, 21 bp, Homo sapiens
tgtacttgaaaaatgttttta

SEQ ID NO: 6499894 - DNA, 14 bp, Homo sapiens
tgtacttgatactg

SEQ ID NO: 6499895 - DNA, 22 bp, Homo sapiens
tgtacttgctcttgatgcctgg

SEQ ID NO: 6499896 - DNA, 22 bp, Homo sapiens
tgtacttgcttgtattgtaaat

SEQ ID NO: 6499897 - DNA, 15 bp, Homo sapiens
tgtacttgtcaaaga

SEQ ID NO: 6499898 - DNA, 20 bp, Homo sapiens
tgtacttgtttcatctggtt

SEQ ID NO: 6499899 - DNA, 20 bp, Homo sapiens
tgtactttatatcttgttta

SEQ ID NO: 6499900 - DNA, 20 bp, Homo sapiens
tgtactttatttttctgata

SEQ ID NO: 6499901 - DNA, 17 bp, Homo sapiens
tgtactttatttttgta

SEQ ID NO: 6499902 - DNA, 22 bp, Homo sapiens
tgtactttccctgtgtaccctc

SEQ ID NO: 6499903 - DNA, 15 bp, Homo sapiens
tgtactttcttccct

SEQ ID NO: 6499904 - DNA, 14 bp, Homo sapiens
tgtactttgaaaac

SEQ ID NO: 6499905 - DNA, 12 bp, Homo sapiens
tgtactttgact

SEQ ID NO: 6499906 - DNA, 17 bp, Homo sapiens
tgtactttgattcacat

SEQ ID NO: 6499907 - DNA, 13 bp, Homo sapiens
tgtactttgccat

SEQ ID NO: 6499908 - DNA, 13 bp, Homo sapiens
tgtactttgcttc

SEQ ID NO: 6499909 - DNA, 14 bp, Homo sapiens
tgtactttgtacaa

SEQ ID NO: 6499910 - DNA, 13 bp, Homo sapiens
tgtactttgtgct

SEQ ID NO: 6499911 - DNA, 18 bp, Homo sapiens
tgtacttttaagactttg

SEQ ID NO: 6499912 - DNA, 21 bp, Homo sapiens
tgtacttttagtagagacagt

SEQ ID NO: 6499913 - DNA, 21 bp, Homo sapiens
tgtacttttctggttccaaac

SEQ ID NO: 6499914 - DNA, 15 bp, Homo sapiens
tgtactttttagtaa

SEQ ID NO: 6499915 - DNA, 20 bp, Homo sapiens
tgtactttttagtaatttct

SEQ ID NO: 6499916 - DNA, 18 bp, Homo sapiens
tgtactttttagttgttc

SEQ ID NO: 6499917 - DNA, 15 bp, Homo sapiens
tgtactttttattca

SEQ ID NO: 6499918 - DNA, 17 bp, Homo sapiens
tgtactttttggcataa

SEQ ID NO: 6499919 - DNA, 18 bp, Homo sapiens
tgtactttttgttccaga

SEQ ID NO: 6499920 - DNA, 20 bp, Homo sapiens
tgtacttttttaaaaagaaa

SEQ ID NO: 6499921 - DNA, 15 bp, Homo sapiens
tgtacttttttcaaa

SEQ ID NO: 6499922 - DNA, 19 bp, Homo sapiens
tgtagaaaaatccctccac

SEQ ID NO: 6499923 - DNA, 19 bp, Homo sapiens
tgtagaaaagggaactgaa

SEQ ID NO: 6499924 - DNA, 12 bp, Homo sapiens
tgtagaaaaggt

SEQ ID NO: 6499925 - DNA, 18 bp, Homo sapiens
tgtagaaactggaagctg

SEQ ID NO: 6499926 - DNA, 18 bp, Homo sapiens
tgtagaaacttaaacaca

SEQ ID NO: 6499927 - DNA, 16 bp, Homo sapiens
tgtagaaagatacact

SEQ ID NO: 6499928 - DNA, 22 bp, Homo sapiens
tgtagaaaggaagccttgctca

SEQ ID NO: 6499929 - DNA, 23 bp, Homo sapiens
tgtagaaaggaagccttgctcat

SEQ ID NO: 6499930 - DNA, 18 bp, Homo sapiens
tgtagaaatattataaat

SEQ ID NO: 6499931 - DNA, 18 bp, Homo sapiens
tgtagaaatattgctcta

SEQ ID NO: 6499932 - DNA, 22 bp, Homo sapiens
tgtagaaatattgctctaattc

SEQ ID NO: 6499933 - DNA, 13 bp, Homo sapiens
tgtagaaatctgt

SEQ ID NO: 6499934 - DNA, 13 bp, Homo sapiens
tgtagaaattaaa

SEQ ID NO: 6499935 - DNA, 16 bp, Homo sapiens
tgtagaaattctaact

SEQ ID NO: 6499936 - DNA, 15 bp, Homo sapiens
tgtagaaattcttaa

SEQ ID NO: 6499937 - DNA, 21 bp, Homo sapiens
tgtagaaattcttaatttgga

SEQ ID NO: 6499938 - DNA, 15 bp, Homo sapiens
tgtagaacactaatt

SEQ ID NO: 6499939 - DNA, 18 bp, Homo sapiens
tgtagaacactaattcat

SEQ ID NO: 6499940 - DNA, 18 bp, Homo sapiens
tgtagaacatagatgcta

SEQ ID NO: 6499941 - DNA, 20 bp, Homo sapiens
tgtagaactcactctgggct

SEQ ID NO: 6499942 - DNA, 16 bp, Homo sapiens
tgtagaactgatttta

SEQ ID NO: 6499943 - DNA, 15 bp, Homo sapiens
tgtagaacttgaact

SEQ ID NO: 6499944 - DNA, 16 bp, Homo sapiens
tgtagaagaaagcaaa

SEQ ID NO: 6499945 - DNA, 14 bp, Homo sapiens
tgtagaagagggag

SEQ ID NO: 6499946 - DNA, 16 bp, Homo sapiens
tgtagaagagggagaa

SEQ ID NO: 6499947 - DNA, 18 bp, Homo sapiens
tgtagaagagggagaagg

SEQ ID NO: 6499948 - DNA, 21 bp, Homo sapiens
tgtagaagatggactctgaaa

SEQ ID NO: 6499949 - DNA, 16 bp, Homo sapiens
tgtagaagcattcctt

SEQ ID NO: 6499950 - DNA, 19 bp, Homo sapiens
tgtagaaggagtagctgcc

SEQ ID NO: 6499951 - DNA, 22 bp, Homo sapiens
tgtagaagtaggaagtgaaaat

SEQ ID NO: 6499952 - DNA, 20 bp, Homo sapiens
tgtagaagtgagtttgtaaa

SEQ ID NO: 6499953 - DNA, 14 bp, Homo sapiens
tgtagaataaatgg

SEQ ID NO: 6499954 - DNA, 21 bp, Homo sapiens
tgtagaataaatggtttctca

SEQ ID NO: 6499955 - DNA, 16 bp, Homo sapiens
tgtagaataggcaggg

SEQ ID NO: 6499956 - DNA, 15 bp, Homo sapiens
tgtagaatattcaga

SEQ ID NO: 6499957 - DNA, 13 bp, Homo sapiens
tgtagaatgtaat

SEQ ID NO: 6499958 - DNA, 12 bp, Homo sapiens
tgtagacactct

SEQ ID NO: 6499959 - DNA, 15 bp, Homo sapiens
tgtagacattttgaa

SEQ ID NO: 6499960 - DNA, 19 bp, Homo sapiens
tgtagacattttgaaataa

SEQ ID NO: 6499961 - DNA, 21 bp, Homo sapiens
tgtagacctagggaggacctt

SEQ ID NO: 6499962 - DNA, 15 bp, Homo sapiens
tgtagacctgagctg

SEQ ID NO: 6499963 - DNA, 20 bp, Homo sapiens
tgtagacctttctccctcct

SEQ ID NO: 6499964 - DNA, 17 bp, Homo sapiens
tgtagacgatatactcc

SEQ ID NO: 6499965 - DNA, 16 bp, Homo sapiens
tgtagactatatacat

SEQ ID NO: 6499966 - DNA, 22 bp, Homo sapiens
tgtagactatggaatgtcagtg

SEQ ID NO: 6499967 - DNA, 19 bp, Homo sapiens
tgtagactcttgctcctgc

SEQ ID NO: 6499968 - DNA, 15 bp, Homo sapiens
tgtagactgtgccag

SEQ ID NO: 6499969 - DNA, 14 bp, Homo sapiens
tgtagactgtttca

SEQ ID NO: 6499970 - DNA, 18 bp, Homo sapiens
tgtagacttactttccta

SEQ ID NO: 6499971 - DNA, 23 bp, Homo sapiens
tgtagacttcctttataatattt

SEQ ID NO: 6499972 - DNA, 22 bp, Homo sapiens
tgtagagaaaaaaaaatatgtg

SEQ ID NO: 6499973 - DNA, 17 bp, Homo sapiens
tgtagagaaaacatgca

SEQ ID NO: 6499974 - DNA, 23 bp, Homo sapiens
tgtagagaacacgcgtatttaca

SEQ ID NO: 6499975 - DNA, 12 bp, Homo sapiens
tgtagagacttc

SEQ ID NO: 6499976 - DNA, 15 bp, Homo sapiens
tgtagagagagacct

SEQ ID NO: 6499977 - DNA, 13 bp, Homo sapiens
tgtagagagtggg

SEQ ID NO: 6499978 - DNA, 14 bp, Homo sapiens
tgtagagcaagcca

SEQ ID NO: 6499979 - DNA, 17 bp, Homo sapiens
tgtagagcaagccagtg

SEQ ID NO: 6499980 - DNA, 16 bp, Homo sapiens
tgtagagcacatttag

SEQ ID NO: 6499981 - DNA, 13 bp, Homo sapiens
tgtagagccagcc

SEQ ID NO: 6499982 - DNA, 12 bp, Homo sapiens
tgtagagccagg

SEQ ID NO: 6499983 - DNA, 18 bp, Homo sapiens
tgtagagcccctactgtg

SEQ ID NO: 6499984 - DNA, 16 bp, Homo sapiens
tgtagaggagaaactg

SEQ ID NO: 6499985 - DNA, 17 bp, Homo sapiens
tgtagaggcataaacct

SEQ ID NO: 6499986 - DNA, 22 bp, Homo sapiens
tgtagagtaacacataacattg

SEQ ID NO: 6499987 - DNA, 17 bp, Homo sapiens
tgtagagtgtagactgt

SEQ ID NO: 6499988 - DNA, 13 bp, Homo sapiens
tgtagagttaaga

SEQ ID NO: 6499989 - DNA, 20 bp, Homo sapiens
tgtagagttttgtcattcag

SEQ ID NO: 6499990 - DNA, 17 bp, Homo sapiens
tgtagataacactatgg

SEQ ID NO: 6499991 - DNA, 17 bp, Homo sapiens
tgtagataatacagttc

SEQ ID NO: 6499992 - DNA, 22 bp, Homo sapiens
tgtagataatactgtctaggaa

SEQ ID NO: 6499993 - DNA, 20 bp, Homo sapiens
tgtagatacaatcagctgct

SEQ ID NO: 6499994 - DNA, 21 bp, Homo sapiens
tgtagatagttaaaagactgc

SEQ ID NO: 6499995 - DNA, 15 bp, Homo sapiens
tgtagatatatattt

SEQ ID NO: 6499996 - DNA, 16 bp, Homo sapiens
tgtagatatatatttc

SEQ ID NO: 6499997 - DNA, 22 bp, Homo sapiens
tgtagatattgtgaagtacata

SEQ ID NO: 6499998 - DNA, 15 bp, Homo sapiens
tgtagatatttgaaa

SEQ ID NO: 6499999 - DNA, 14 bp, Homo sapiens
tgtagatatttggc

SEQ ID NO: 6500000 - DNA, 15 bp, Homo sapiens
tgtagatatttggct

SEQ ID NO: 6500001 - DNA, 22 bp, Homo sapiens
tgtagatatttggcttaaatat

SEQ ID NO: 6500002 - DNA, 14 bp, Homo sapiens
tgtagatcaggttt

SEQ ID NO: 6500003 - DNA, 13 bp, Homo sapiens
tgtagatcccaag

SEQ ID NO: 6500004 - DNA, 19 bp, Homo sapiens
tgtagatgaaaaagcatgt

SEQ ID NO: 6500005 - DNA, 21 bp, Homo sapiens
tgtagatgaaaaagcatgtac

SEQ ID NO: 6500006 - DNA, 13 bp, Homo sapiens
tgtagatgaacat

SEQ ID NO: 6500007 - DNA, 12 bp, Homo sapiens
tgtagatgatgt

SEQ ID NO: 6500008 - DNA, 15 bp, Homo sapiens
tgtagatgatgtatt

SEQ ID NO: 6500009 - DNA, 13 bp, Homo sapiens
tgtagatgcagaa

SEQ ID NO: 6500010 - DNA, 18 bp, Homo sapiens
tgtagatgcagaaaaaga

SEQ ID NO: 6500011 - DNA, 16 bp, Homo sapiens
tgtagatggaaaaact

SEQ ID NO: 6500012 - DNA, 23 bp, Homo sapiens
tgtagatggaaaaacttgtgcta

SEQ ID NO: 6500013 - DNA, 16 bp, Homo sapiens
tgtagatggagcaagt

SEQ ID NO: 6500014 - DNA, 20 bp, Homo sapiens
tgtagatggcactttagtga

SEQ ID NO: 6500015 - DNA, 16 bp, Homo sapiens
tgtagatggcgatgtg

SEQ ID NO: 6500016 - DNA, 16 bp, Homo sapiens
tgtagatgttctagga

SEQ ID NO: 6500017 - DNA, 17 bp, Homo sapiens
tgtagatgttctaggat

SEQ ID NO: 6500018 - DNA, 15 bp, Homo sapiens
tgtagatgttgtctt

SEQ ID NO: 6500019 - DNA, 14 bp, Homo sapiens
tgtagattcagtgg

SEQ ID NO: 6500020 - DNA, 16 bp, Homo sapiens
tgtagatttatttcat

SEQ ID NO: 6500021 - DNA, 20 bp, Homo sapiens
tgtagatttcagtagtttct

SEQ ID NO: 6500022 - DNA, 21 bp, Homo sapiens
tgtagatttcagtagtttcta

SEQ ID NO: 6500023 - DNA, 16 bp, Homo sapiens
tgtagatttgaaaatt

SEQ ID NO: 6500024 - DNA, 12 bp, Homo sapiens
tgtagatttgat

SEQ ID NO: 6500025 - DNA, 17 bp, Homo sapiens
tgtagattttatagtgt

SEQ ID NO: 6500026 - DNA, 18 bp, Homo sapiens
tgtagattttatagtgtg

SEQ ID NO: 6500027 - DNA, 20 bp, Homo sapiens
tgtagcaaaacgcatggagt

SEQ ID NO: 6500028 - DNA, 18 bp, Homo sapiens
tgtagcaaaccctgtcaa

SEQ ID NO: 6500029 - DNA, 19 bp, Homo sapiens
tgtagcaaaccctgtcaaa

SEQ ID NO: 6500030 - DNA, 22 bp, Homo sapiens
tgtagcaaaccctgtcaaacat

SEQ ID NO: 6500031 - DNA, 22 bp, Homo sapiens
tgtagcaaattccaatacatta

SEQ ID NO: 6500032 - DNA, 21 bp, Homo sapiens
tgtagcaaatttgtttaatct

SEQ ID NO: 6500033 - DNA, 20 bp, Homo sapiens
tgtagcaataagctggacta

SEQ ID NO: 6500034 - DNA, 13 bp, Homo sapiens
tgtagcaatatat

SEQ ID NO: 6500035 - DNA, 18 bp, Homo sapiens
tgtagcaatatatttgta

SEQ ID NO: 6500036 - DNA, 21 bp, Homo sapiens
tgtagcaatggccagagcctc

SEQ ID NO: 6500037 - DNA, 19 bp, Homo sapiens
tgtagcaccttttctcctc

SEQ ID NO: 6500038 - DNA, 20 bp, Homo sapiens
tgtagcacgctgcctgccaa

SEQ ID NO: 6500039 - DNA, 22 bp, Homo sapiens
tgtagcacgctgcctgccaaag

SEQ ID NO: 6500040 - DNA, 19 bp, Homo sapiens
tgtagcactactacagaaa

SEQ ID NO: 6500041 - DNA, 17 bp, Homo sapiens
tgtagcactgacagatt

SEQ ID NO: 6500042 - DNA, 22 bp, Homo sapiens
tgtagcactgacagatttccat

SEQ ID NO: 6500043 - DNA, 12 bp, Homo sapiens
tgtagcagaaac

SEQ ID NO: 6500044 - DNA, 12 bp, Homo sapiens
tgtagcagcagc

SEQ ID NO: 6500045 - DNA, 13 bp, Homo sapiens
tgtagcagcagcc

SEQ ID NO: 6500046 - DNA, 17 bp, Homo sapiens
tgtagcaggttctaggc

SEQ ID NO: 6500047 - DNA, 23 bp, Homo sapiens
tgtagcagtgagaaaaagctcct

SEQ ID NO: 6500048 - DNA, 22 bp, Homo sapiens
tgtagcagtgagtcatatctta

SEQ ID NO: 6500049 - DNA, 13 bp, Homo sapiens
tgtagcagtgtgc

SEQ ID NO: 6500050 - DNA, 15 bp, Homo sapiens
tgtagcatataggtg

SEQ ID NO: 6500051 - DNA, 14 bp, Homo sapiens
tgtagcatcctgga

SEQ ID NO: 6500052 - DNA, 16 bp, Homo sapiens
tgtagcatcctggaat

SEQ ID NO: 6500053 - DNA, 17 bp, Homo sapiens
tgcaagcttttcctaat

SEQ ID NO: 6500054 - DNA, 15 bp, Homo sapiens
tgcaaggaaaataat

SEQ ID NO: 6500055 - DNA, 14 bp, Homo sapiens
tgcaaggaaggaaa

SEQ ID NO: 6500056 - DNA, 15 bp, Homo sapiens
tgcaaggaaggaaag

SEQ ID NO: 6500057 - DNA, 16 bp, Homo sapiens
tgcaaggaaggaaaga

SEQ ID NO: 6500058 - DNA, 16 bp, Homo sapiens
tgcaaggacaagcaat

SEQ ID NO: 6500059 - DNA, 15 bp, Homo sapiens
tgcaaggaccaggac

SEQ ID NO: 6500060 - DNA, 17 bp, Homo sapiens
tgcaaggaccaggactc

SEQ ID NO: 6500061 - DNA, 22 bp, Homo sapiens
tgcaaggactcccggagcctgt

SEQ ID NO: 6500062 - DNA, 21 bp, Homo sapiens
tgcaaggatttttccatgtgt

SEQ ID NO: 6500063 - DNA, 13 bp, Homo sapiens
tgcaaggcaaaga

SEQ ID NO: 6500064 - DNA, 18 bp, Homo sapiens
tgcaaggcaaagtaaaat

SEQ ID NO: 6500065 - DNA, 11 bp, Homo sapiens
tgcaaggcact

SEQ ID NO: 6500066 - DNA, 17 bp, Homo sapiens
tgcaaggcactgtacta

SEQ ID NO: 6500067 - DNA, 15 bp, Homo sapiens
tgcaaggcagccgtg

SEQ ID NO: 6500068 - DNA, 12 bp, Homo sapiens
tgcaaggcccac

SEQ ID NO: 6500069 - DNA, 17 bp, Homo sapiens
tgcaaggcccacaggag

SEQ ID NO: 6500070 - DNA, 21 bp, Homo sapiens
tgcaaggccctctatttctct

SEQ ID NO: 6500071 - DNA, 24 bp, Homo sapiens
tgcaaggccgctgttcacccacag

SEQ ID NO: 6500072 - DNA, 23 bp, Homo sapiens
tgcaaggcctggtgtttcttgat

SEQ ID NO: 6500073 - DNA, 17 bp, Homo sapiens
tgcaaggcggtacacta

SEQ ID NO: 6500074 - DNA, 18 bp, Homo sapiens
tgcaaggcggtacactac

SEQ ID NO: 6500075 - DNA, 12 bp, Homo sapiens
tgcaagggaatg

SEQ ID NO: 6500076 - DNA, 18 bp, Homo sapiens
tgcaagggaatgaatcca

SEQ ID NO: 6500077 - DNA, 22 bp, Homo sapiens
tgcaagggacaggaaggtctga

SEQ ID NO: 6500078 - DNA, 21 bp, Homo sapiens
tgcaagggactgtgtgttgcc

SEQ ID NO: 6500079 - DNA, 21 bp, Homo sapiens
tgcaagggcagaacactaacc

SEQ ID NO: 6500080 - DNA, 18 bp, Homo sapiens
tgcaagggcccagagtga

SEQ ID NO: 6500081 - DNA, 20 bp, Homo sapiens
tgcaagggcggcctttccca

SEQ ID NO: 6500082 - DNA, 15 bp, Homo sapiens
tgcaagggctcccca

SEQ ID NO: 6500083 - DNA, 16 bp, Homo sapiens
tgcaagggctccccac

SEQ ID NO: 6500084 - DNA, 21 bp, Homo sapiens
tgcaaggggaaacctgtgaaa

SEQ ID NO: 6500085 - DNA, 14 bp, Homo sapiens
tgcaaggggctcag

SEQ ID NO: 6500086 - DNA, 21 bp, Homo sapiens
tgcaaggtattacactctgta

SEQ ID NO: 6500087 - DNA, 12 bp, Homo sapiens
tgcaaggtcact

SEQ ID NO: 6500088 - DNA, 16 bp, Homo sapiens
tgcaaggtctttggtt

SEQ ID NO: 6500089 - DNA, 19 bp, Homo sapiens
tgcaaggtgaaacgactca

SEQ ID NO: 6500090 - DNA, 23 bp, Homo sapiens
tgcaaggtgataggaaaactgaa

SEQ ID NO: 6500091 - DNA, 17 bp, Homo sapiens
tgcaaggtgcacctgcc

SEQ ID NO: 6500092 - DNA, 18 bp, Homo sapiens
tgcaaggtgcacctgccc

SEQ ID NO: 6500093 - DNA, 16 bp, Homo sapiens
tgcaaggtgctggtgg

SEQ ID NO: 6500094 - DNA, 13 bp, Homo sapiens
tgcaaggtggcct

SEQ ID NO: 6500095 - DNA, 20 bp, Homo sapiens
tgcaaggtggcctctgcctg

SEQ ID NO: 6500096 - DNA, 15 bp, Homo sapiens
tgcaaggtggccttt

SEQ ID NO: 6500097 - DNA, 22 bp, Homo sapiens
tgcaaggtggcctttgtgctgc

SEQ ID NO: 6500098 - DNA, 14 bp, Homo sapiens
tgcaaggttccaca

SEQ ID NO: 6500099 - DNA, 19 bp, Homo sapiens
tgcaaggttccacagagta

SEQ ID NO: 6500100 - DNA, 15 bp, Homo sapiens
tgcaagtactgctgt

SEQ ID NO: 6500101 - DNA, 16 bp, Homo sapiens
tgcaagtagctggctg

SEQ ID NO: 6500102 - DNA, 15 bp, Homo sapiens
tgcaagtatgtgagt

SEQ ID NO: 6500103 - DNA, 19 bp, Homo sapiens
tgcaagtatgttttagcat

SEQ ID NO: 6500104 - DNA, 22 bp, Homo sapiens
tgcaagtatgttttagcatgtg

SEQ ID NO: 6500105 - DNA, 14 bp, Homo sapiens
tgcaagtcactaaa

SEQ ID NO: 6500106 - DNA, 14 bp, Homo sapiens
tgcaagtcagagga

SEQ ID NO: 6500107 - DNA, 14 bp, Homo sapiens
tgcaagtcatggct

SEQ ID NO: 6500108 - DNA, 16 bp, Homo sapiens
tgcaagtcatggctgt

SEQ ID NO: 6500109 - DNA, 19 bp, Homo sapiens
tgcaagtccatagctgagc

SEQ ID NO: 6500110 - DNA, 16 bp, Homo sapiens
tgcaagtccttttgta

SEQ ID NO: 6500111 - DNA, 20 bp, Homo sapiens
tgcaagtccttttgtaaagt

SEQ ID NO: 6500112 - DNA, 14 bp, Homo sapiens
tgcaagtctgccga

SEQ ID NO: 6500113 - DNA, 23 bp, Homo sapiens
tgcaagtctggacaaatgtatag

SEQ ID NO: 6500114 - DNA, 12 bp, Homo sapiens
tgcaagtctgtg

SEQ ID NO: 6500115 - DNA, 13 bp, Homo sapiens
tgcaagtctgtga

SEQ ID NO: 6500116 - DNA, 15 bp, Homo sapiens
tgcaagtctgtgagt

SEQ ID NO: 6500117 - DNA, 24 bp, Homo sapiens
tgcaagtctgtgagtgcgtctgag

SEQ ID NO: 6500118 - DNA, 17 bp, Homo sapiens
tgcaagtgaaataatat

SEQ ID NO: 6500119 - DNA, 19 bp, Homo sapiens
tgcaagtgaacttgggagg

SEQ ID NO: 6500120 - DNA, 16 bp, Homo sapiens
tgcaagtgacatctct

SEQ ID NO: 6500121 - DNA, 16 bp, Homo sapiens
tgcaagtgagaagctg

SEQ ID NO: 6500122 - DNA, 20 bp, Homo sapiens
tgcaagtgcccgccctgccc

SEQ ID NO: 6500123 - DNA, 15 bp, Homo sapiens
tgcaagtgctcaggg

SEQ ID NO: 6500124 - DNA, 23 bp, Homo sapiens
tgcaagtgctggagtctcctgag

SEQ ID NO: 6500125 - DNA, 22 bp, Homo sapiens
tgcaagtggagctgtctgtctc

SEQ ID NO: 6500126 - DNA, 20 bp, Homo sapiens
tgcaagtgggagatgaaaac

SEQ ID NO: 6500127 - DNA, 17 bp, Homo sapiens
tgcaagtggttaagaat

SEQ ID NO: 6500128 - DNA, 15 bp, Homo sapiens
tgcaagtgtctggag

SEQ ID NO: 6500129 - DNA, 23 bp, Homo sapiens
tgcaagtgtgtgcacatgtgtgc

SEQ ID NO: 6500130 - DNA, 18 bp, Homo sapiens
tgcaagtgtttctgttct

SEQ ID NO: 6500131 - DNA, 17 bp, Homo sapiens
tgcaagttagggtctat

SEQ ID NO: 6500132 - DNA, 21 bp, Homo sapiens
tgcaagttatattagtgaaga

SEQ ID NO: 6500133 - DNA, 17 bp, Homo sapiens
tgcaagttcattttaaa

SEQ ID NO: 6500134 - DNA, 19 bp, Homo sapiens
tgcaagttcattttaaatg

SEQ ID NO: 6500135 - DNA, 13 bp, Homo sapiens
tgcaagttgagga

SEQ ID NO: 6500136 - DNA, 18 bp, Homo sapiens
tgcaagttgaggacttct

SEQ ID NO: 6500137 - DNA, 20 bp, Homo sapiens
tgcaagtttcccgccaggag

SEQ ID NO: 6500138 - DNA, 12 bp, Homo sapiens
tgcaataaaaaa

SEQ ID NO: 6500139 - DNA, 14 bp, Homo sapiens
tgcaataaaactcc

SEQ ID NO: 6500140 - DNA, 16 bp, Homo sapiens
tgcaataaaatagtat

SEQ ID NO: 6500141 - DNA, 22 bp, Homo sapiens
tgcaataaaattatttgcaggt

SEQ ID NO: 6500142 - DNA, 17 bp, Homo sapiens
tgcaataaaatttaaaa

SEQ ID NO: 6500143 - DNA, 17 bp, Homo sapiens
tgcaataaagttattca

SEQ ID NO: 6500144 - DNA, 16 bp, Homo sapiens
tgcaataaatattatt

SEQ ID NO: 6500145 - DNA, 23 bp, Homo sapiens
tgcaataaatctgacccagtgcc

SEQ ID NO: 6500146 - DNA, 15 bp, Homo sapiens
tgcaataacagctgc

SEQ ID NO: 6500147 - DNA, 17 bp, Homo sapiens
tgcaataacagctgcaa

SEQ ID NO: 6500148 - DNA, 21 bp, Homo sapiens
tgcaataacagttttaagatg

SEQ ID NO: 6500149 - DNA, 14 bp, Homo sapiens
tgcaataactctgg

SEQ ID NO: 6500150 - DNA, 14 bp, Homo sapiens
tgcaataacttcta

SEQ ID NO: 6500151 - DNA, 16 bp, Homo sapiens
tgcaataacttctata

SEQ ID NO: 6500152 - DNA, 15 bp, Homo sapiens
tgcaataacttctga

SEQ ID NO: 6500153 - DNA, 17 bp, Homo sapiens
tgcaataacttctgacc

SEQ ID NO: 6500154 - DNA, 21 bp, Homo sapiens
tgcaataagaatttagggaga

SEQ ID NO: 6500155 - DNA, 23 bp, Homo sapiens
tgcaataaggatttattctcaga

SEQ ID NO: 6500156 - DNA, 23 bp, Homo sapiens
tgcaataatatcaaaacaagtac

SEQ ID NO: 6500157 - DNA, 16 bp, Homo sapiens
tgcaataatccacccc

SEQ ID NO: 6500158 - DNA, 18 bp, Homo sapiens
tgcaataatccaccccca

SEQ ID NO: 6500159 - DNA, 15 bp, Homo sapiens
tgcaataatgcagta

SEQ ID NO: 6500160 - DNA, 20 bp, Homo sapiens
tgcaataatttgtacaatgg

SEQ ID NO: 6500161 - DNA, 17 bp, Homo sapiens
tgcaatacaagtttcat

SEQ ID NO: 6500162 - DNA, 18 bp, Homo sapiens
tgcaatacaagtttcatc

SEQ ID NO: 6500163 - DNA, 23 bp, Homo sapiens
tgcaatacaagtttcatccagaa

SEQ ID NO: 6500164 - DNA, 17 bp, Homo sapiens
tgcaatacattgttcag

SEQ ID NO: 6500165 - DNA, 16 bp, Homo sapiens
tgcaatagaaggtgat

SEQ ID NO: 6500166 - DNA, 13 bp, Homo sapiens
tgcaatagcagtt

SEQ ID NO: 6500167 - DNA, 23 bp, Homo sapiens
tgcaatagcagttataacagatg

SEQ ID NO: 6500168 - DNA, 14 bp, Homo sapiens
tgcaatagtcagag

SEQ ID NO: 6500169 - DNA, 20 bp, Homo sapiens
tgcaatagtgcaacatctct

SEQ ID NO: 6500170 - DNA, 16 bp, Homo sapiens
tgcaatataagcataa

SEQ ID NO: 6500171 - DNA, 22 bp, Homo sapiens
tgcaatatatctaaattgaata

SEQ ID NO: 6500172 - DNA, 14 bp, Homo sapiens
tgcaatatattttg

SEQ ID NO: 6500173 - DNA, 15 bp, Homo sapiens
tgcaatatattttgt

SEQ ID NO: 6500174 - DNA, 18 bp, Homo sapiens
tgcaatatattttgtatg

SEQ ID NO: 6500175 - DNA, 20 bp, Homo sapiens
tgcaatatattttgtatgca

SEQ ID NO: 6500176 - DNA, 20 bp, Homo sapiens
tgcaatatcaacaacaagtt

SEQ ID NO: 6500177 - DNA, 21 bp, Homo sapiens
tgcaatatcaacaacaagttg

SEQ ID NO: 6500178 - DNA, 14 bp, Homo sapiens
tgcaatatctgaag

SEQ ID NO: 6500179 - DNA, 20 bp, Homo sapiens
tgcaatatggatttcttaga

SEQ ID NO: 6500180 - DNA, 12 bp, Homo sapiens
tgcaatatgtaa

SEQ ID NO: 6500181 - DNA, 15 bp, Homo sapiens
tgcaatatgtaacat

SEQ ID NO: 6500182 - DNA, 17 bp, Homo sapiens
tgcaatatgtaacatgt

SEQ ID NO: 6500183 - DNA, 21 bp, Homo sapiens
tgcaatattaatgcctttaaa

SEQ ID NO: 6500184 - DNA, 19 bp, Homo sapiens
tgcaatattcctggtatta

SEQ ID NO: 6500185 - DNA, 22 bp, Homo sapiens
tgcaatatttcccccttactac

SEQ ID NO: 6500186 - DNA, 16 bp, Homo sapiens
tgcaatatttcctcat

SEQ ID NO: 6500187 - DNA, 19 bp, Homo sapiens
tgcaatatttcctcatgtg

SEQ ID NO: 6500188 - DNA, 13 bp, Homo sapiens
tgcaatatttgta

SEQ ID NO: 6500189 - DNA, 20 bp, Homo sapiens
tgcaatatttgtaaggcttg

SEQ ID NO: 6500190 - DNA, 16 bp, Homo sapiens
tgcaatcactgtgcta

SEQ ID NO: 6500191 - DNA, 17 bp, Homo sapiens
tgcaatcaggattttaa

SEQ ID NO: 6500192 - DNA, 13 bp, Homo sapiens
tgcaatcatatgt

SEQ ID NO: 6500193 - DNA, 17 bp, Homo sapiens
tgcaatcatatgtgatc

SEQ ID NO: 6500194 - DNA, 17 bp, Homo sapiens
tgcaatccaatgcactg

SEQ ID NO: 6500195 - DNA, 17 bp, Homo sapiens
tgcaatccatgtatctg

SEQ ID NO: 6500196 - DNA, 15 bp, Homo sapiens
tgcaatccatttatt

SEQ ID NO: 6500197 - DNA, 13 bp, Homo sapiens
tgcaatcccagca

SEQ ID NO: 6500198 - DNA, 15 bp, Homo sapiens
tgcaatccttacaaa

SEQ ID NO: 6500199 - DNA, 17 bp, Homo sapiens
tgcaatccttacaaatg

SEQ ID NO: 6500200 - DNA, 20 bp, Homo sapiens
tgcaatccttacaaatgatt

SEQ ID NO: 6500201 - DNA, 22 bp, Homo sapiens
tgcaatcgtaatgtacagatgg

SEQ ID NO: 6500202 - DNA, 15 bp, Homo sapiens
tgcaatctaatctga

SEQ ID NO: 6500203 - DNA, 12 bp, Homo sapiens
tgcaatctactg

SEQ ID NO: 6500204 - DNA, 17 bp, Homo sapiens
tgcaatctactggaaat

SEQ ID NO: 6500205 - DNA, 14 bp, Homo sapiens
tgcaatctccaggg

SEQ ID NO: 6500206 - DNA, 17 bp, Homo sapiens
tgcaatctgtccagaca

SEQ ID NO: 6500207 - DNA, 18 bp, Homo sapiens
tgcaatctgtccagacaa

SEQ ID NO: 6500208 - DNA, 13 bp, Homo sapiens
tgcaatcttggct

SEQ ID NO: 6500209 - DNA, 18 bp, Homo sapiens
tgcaatcttggctcactg

SEQ ID NO: 6500210 - DNA, 23 bp, Homo sapiens
tgcaatcttggctcactgcaacc

SEQ ID NO: 6500211 - DNA, 16 bp, Homo sapiens
tgcaatgaaaagaaaa

SEQ ID NO: 6500212 - DNA, 13 bp, Homo sapiens
tgcaatgaaacag

SEQ ID NO: 6500213 - DNA, 13 bp, Homo sapiens
tgcaatgaagaag

SEQ ID NO: 6500214 - DNA, 18 bp, Homo sapiens
tgcaatgaagtctctgaa

SEQ ID NO: 6500215 - DNA, 22 bp, Homo sapiens
tgcaatgacctttcaataggaa

SEQ ID NO: 6500216 - DNA, 16 bp, Homo sapiens
tgcaatgactcaggac

SEQ ID NO: 6500217 - DNA, 16 bp, Homo sapiens
tgcaatgatcagactt

SEQ ID NO: 6500218 - DNA, 16 bp, Homo sapiens
tgcaatgcaattcaat

SEQ ID NO: 6500219 - DNA, 17 bp, Homo sapiens
tgcaatgcaattcaatg

SEQ ID NO: 6500220 - DNA, 21 bp, Homo sapiens
tgcaatgccagtcctgcagga

SEQ ID NO: 6500221 - DNA, 14 bp, Homo sapiens
tgcaatgccccctc

SEQ ID NO: 6500222 - DNA, 18 bp, Homo sapiens
tgcaatgccccctcccct

SEQ ID NO: 6500223 - DNA, 19 bp, Homo sapiens
tgcaatgccccctcccctc

SEQ ID NO: 6500224 - DNA, 21 bp, Homo sapiens
tgcaatgccccctcccctcct

SEQ ID NO: 6500225 - DNA, 15 bp, Homo sapiens
tgcaatgcctagact

SEQ ID NO: 6500226 - DNA, 15 bp, Homo sapiens
tgcaatgcttctgta

SEQ ID NO: 6500227 - DNA, 19 bp, Homo sapiens
tgcaatggatcagccaagg

SEQ ID NO: 6500228 - DNA, 13 bp, Homo sapiens
tgcaatggatttt

SEQ ID NO: 6500229 - DNA, 22 bp, Homo sapiens
tgcaatggcacgatctcagctc

SEQ ID NO: 6500230 - DNA, 21 bp, Homo sapiens
tgcaatggcagcattcccacc

SEQ ID NO: 6500231 - DNA, 20 bp, Homo sapiens
tgcaatggcgtgatctcggc

SEQ ID NO: 6500232 - DNA, 15 bp, Homo sapiens
tgtagcatctaatga

SEQ ID NO: 6500233 - DNA, 19 bp, Homo sapiens
tgtagcatcttcctctgca

SEQ ID NO: 6500234 - DNA, 22 bp, Homo sapiens
tgtagcatgtgaagaatgtctg

SEQ ID NO: 6500235 - DNA, 17 bp, Homo sapiens
tgtagcattaaatataa

SEQ ID NO: 6500236 - DNA, 20 bp, Homo sapiens
tgtagcattaaatataaaat

SEQ ID NO: 6500237 - DNA, 21 bp, Homo sapiens
tgtagcattaaatataaaata

SEQ ID NO: 6500238 - DNA, 17 bp, Homo sapiens
tgtagcatttcttgatg

SEQ ID NO: 6500239 - DNA, 14 bp, Homo sapiens
tgtagcattttcct

SEQ ID NO: 6500240 - DNA, 16 bp, Homo sapiens
tgtagccaaagaaatt

SEQ ID NO: 6500241 - DNA, 10 bp, Homo sapiens
tgtagccaag

SEQ ID NO: 6500242 - DNA, 16 bp, Homo sapiens
tgtagccacaccagga

SEQ ID NO: 6500243 - DNA, 18 bp, Homo sapiens
tgtagccacaccaggata

SEQ ID NO: 6500244 - DNA, 23 bp, Homo sapiens
tgtagccacagctgctgttctca

SEQ ID NO: 6500245 - DNA, 17 bp, Homo sapiens
tgtagccacctccttgg

SEQ ID NO: 6500246 - DNA, 16 bp, Homo sapiens
tgtagccactggcata

SEQ ID NO: 6500247 - DNA, 21 bp, Homo sapiens
tgtagccagaattctggacaa

SEQ ID NO: 6500248 - DNA, 19 bp, Homo sapiens
tgtagccagccaggtgcat

SEQ ID NO: 6500249 - DNA, 13 bp, Homo sapiens
tgtagccagccca

SEQ ID NO: 6500250 - DNA, 14 bp, Homo sapiens
tgtagccagccggg

SEQ ID NO: 6500251 - DNA, 18 bp, Homo sapiens
tgtagccagctgtgcact

SEQ ID NO: 6500252 - DNA, 14 bp, Homo sapiens
tgtagccaggaagc

SEQ ID NO: 6500253 - DNA, 17 bp, Homo sapiens
tgtagccaggtatggct

SEQ ID NO: 6500254 - DNA, 16 bp, Homo sapiens
tgtagccatctgcaca

SEQ ID NO: 6500255 - DNA, 11 bp, Homo sapiens
tgtagccatgg

SEQ ID NO: 6500256 - DNA, 14 bp, Homo sapiens
tgtagccatggctc

SEQ ID NO: 6500257 - DNA, 16 bp, Homo sapiens
tgtagccatggctcag

SEQ ID NO: 6500258 - DNA, 16 bp, Homo sapiens
tgtagcccacacttga

SEQ ID NO: 6500259 - DNA, 18 bp, Homo sapiens
tgtagccccagtcagaag

SEQ ID NO: 6500260 - DNA, 16 bp, Homo sapiens
tgtagccccagtgaca

SEQ ID NO: 6500261 - DNA, 21 bp, Homo sapiens
tgtagccccagtgacagctag

SEQ ID NO: 6500262 - DNA, 12 bp, Homo sapiens
tgtagccccggg

SEQ ID NO: 6500263 - DNA, 14 bp, Homo sapiens
tgtagccccgggct

SEQ ID NO: 6500264 - DNA, 18 bp, Homo sapiens
tgtagcccctctcctgga

SEQ ID NO: 6500265 - DNA, 17 bp, Homo sapiens
tgtagcccggccagggc

SEQ ID NO: 6500266 - DNA, 23 bp, Homo sapiens
tgtagcccggccagggcctggtg

SEQ ID NO: 6500267 - DNA, 21 bp, Homo sapiens
tgtagccctcccactttgctg

SEQ ID NO: 6500268 - DNA, 22 bp, Homo sapiens
tgtagccctctccaaatcaagg

SEQ ID NO: 6500269 - DNA, 12 bp, Homo sapiens
tgtagccctgga

SEQ ID NO: 6500270 - DNA, 22 bp, Homo sapiens
tgtagccctggatggcctctgg

SEQ ID NO: 6500271 - DNA, 12 bp, Homo sapiens
tgtagccctggc

SEQ ID NO: 6500272 - DNA, 13 bp, Homo sapiens
tgtagccctggcc

SEQ ID NO: 6500273 - DNA, 14 bp, Homo sapiens
tgtagccgccctga

SEQ ID NO: 6500274 - DNA, 22 bp, Homo sapiens
tgtagcctaaagggcagggccc

SEQ ID NO: 6500275 - DNA, 18 bp, Homo sapiens
tgtagcctaatattcatg

SEQ ID NO: 6500276 - DNA, 21 bp, Homo sapiens
tgtagcctaatattcatgctg

SEQ ID NO: 6500277 - DNA, 16 bp, Homo sapiens
tgtagcctatgtcttg

SEQ ID NO: 6500278 - DNA, 19 bp, Homo sapiens
tgtagcctatgtcttgtat

SEQ ID NO: 6500279 - DNA, 16 bp, Homo sapiens
tgtagcctcctttgta

SEQ ID NO: 6500280 - DNA, 16 bp, Homo sapiens
tgtagcctggtctgtg

SEQ ID NO: 6500281 - DNA, 22 bp, Homo sapiens
tgtagcctgtgcatgtatgtct

SEQ ID NO: 6500282 - DNA, 14 bp, Homo sapiens
tgtagccttctccc

SEQ ID NO: 6500283 - DNA, 16 bp, Homo sapiens
tgtagccttgcccgga

SEQ ID NO: 6500284 - DNA, 12 bp, Homo sapiens
tgtagccttttt

SEQ ID NO: 6500285 - DNA, 14 bp, Homo sapiens
tgtagcgacagcat

SEQ ID NO: 6500286 - DNA, 17 bp, Homo sapiens
tgtagcgaccccagact

SEQ ID NO: 6500287 - DNA, 16 bp, Homo sapiens
tgtagcgtcctgagga

SEQ ID NO: 6500288 - DNA, 17 bp, Homo sapiens
tgtagcgtcctgaggaa

SEQ ID NO: 6500289 - DNA, 18 bp, Homo sapiens
tgtagcgtcctgaggaat

SEQ ID NO: 6500290 - DNA, 21 bp, Homo sapiens
tgtagcgtgtttacatgtgta

SEQ ID NO: 6500291 - DNA, 16 bp, Homo sapiens
tgtagctaacagtgaa

SEQ ID NO: 6500292 - DNA, 17 bp, Homo sapiens
tgtagctaacagtgaag

SEQ ID NO: 6500293 - DNA, 20 bp, Homo sapiens
tgtagctaattaggaagctt

SEQ ID NO: 6500294 - DNA, 14 bp, Homo sapiens
tgtagctacagaga

SEQ ID NO: 6500295 - DNA, 24 bp, Homo sapiens
tgtagctacattttcagaagttaa

SEQ ID NO: 6500296 - DNA, 11 bp, Homo sapiens
tgtagctatta

SEQ ID NO: 6500297 - DNA, 21 bp, Homo sapiens
tgtagctattagcggctcctc

SEQ ID NO: 6500298 - DNA, 23 bp, Homo sapiens
tgtagctattagcggctcctcgc

SEQ ID NO: 6500299 - DNA, 14 bp, Homo sapiens
tgtagctattcttt

SEQ ID NO: 6500300 - DNA, 16 bp, Homo sapiens
tgtagctattctttga

SEQ ID NO: 6500301 - DNA, 22 bp, Homo sapiens
tgtagctcagtcatcaaagcag

SEQ ID NO: 6500302 - DNA, 18 bp, Homo sapiens
tgtagctccctcctccca

SEQ ID NO: 6500303 - DNA, 17 bp, Homo sapiens
tgtagctcctcccctgg

SEQ ID NO: 6500304 - DNA, 18 bp, Homo sapiens
tgtagctcctcccctgga

SEQ ID NO: 6500305 - DNA, 19 bp, Homo sapiens
tgtagctctgaatgctatt

SEQ ID NO: 6500306 - DNA, 14 bp, Homo sapiens
tgtagctctgcctc

SEQ ID NO: 6500307 - DNA, 19 bp, Homo sapiens
tgtagctgaaaataaaatg

SEQ ID NO: 6500308 - DNA, 14 bp, Homo sapiens
tgtagctgcgtcat

SEQ ID NO: 6500309 - DNA, 12 bp, Homo sapiens
tgtagctgtaaa

SEQ ID NO: 6500310 - DNA, 17 bp, Homo sapiens
tgtagctgtaaaacgct

SEQ ID NO: 6500311 - DNA, 18 bp, Homo sapiens
tgtagctgtaaaacgctg

SEQ ID NO: 6500312 - DNA, 15 bp, Homo sapiens
tgtagctgtaagggc

SEQ ID NO: 6500313 - DNA, 18 bp, Homo sapiens
tgtagctgtaagggcagt

SEQ ID NO: 6500314 - DNA, 20 bp, Homo sapiens
tgtagctgtaagggcagtgc

SEQ ID NO: 6500315 - DNA, 22 bp, Homo sapiens
tgtagctgtcatggtgcaattt

SEQ ID NO: 6500316 - DNA, 13 bp, Homo sapiens
tgtagctgtcctc

SEQ ID NO: 6500317 - DNA, 11 bp, Homo sapiens
tgtagctgtga

SEQ ID NO: 6500318 - DNA, 12 bp, Homo sapiens
tgtagctgtgaa

SEQ ID NO: 6500319 - DNA, 13 bp, Homo sapiens
tgtagctgtgacc

SEQ ID NO: 6500320 - DNA, 17 bp, Homo sapiens
tgtagctgtgacctgct

SEQ ID NO: 6500321 - DNA, 18 bp, Homo sapiens
tgtagctgtgacctgctg

SEQ ID NO: 6500322 - DNA, 21 bp, Homo sapiens
tgtagctgtgacctgctgagc

SEQ ID NO: 6500323 - DNA, 20 bp, Homo sapiens
tgtagcttaaaaaaaggaaa

SEQ ID NO: 6500324 - DNA, 16 bp, Homo sapiens
tgtagcttatctgccc

SEQ ID NO: 6500325 - DNA, 17 bp, Homo sapiens
tgtagcttatctgcccc

SEQ ID NO: 6500326 - DNA, 16 bp, Homo sapiens
tgtagcttcagtcatt

SEQ ID NO: 6500327 - DNA, 19 bp, Homo sapiens
tgtagcttccaaatttgaa

SEQ ID NO: 6500328 - DNA, 19 bp, Homo sapiens
tgtagcttccacctcatgg

SEQ ID NO: 6500329 - DNA, 20 bp, Homo sapiens
tgtagcttccacctcatgga

SEQ ID NO: 6500330 - DNA, 13 bp, Homo sapiens
tgtagcttctctt

SEQ ID NO: 6500331 - DNA, 22 bp, Homo sapiens
tgtagcttctgaaaggtgcttt

SEQ ID NO: 6500332 - DNA, 21 bp, Homo sapiens
tgtagcttcttctgaaagaat

SEQ ID NO: 6500333 - DNA, 15 bp, Homo sapiens
tgtagctttatcaaa

SEQ ID NO: 6500334 - DNA, 16 bp, Homo sapiens
tgtagctttcctggaa

SEQ ID NO: 6500335 - DNA, 14 bp, Homo sapiens
tgtagctttctgga

SEQ ID NO: 6500336 - DNA, 15 bp, Homo sapiens
tgtagctttctggaa

SEQ ID NO: 6500337 - DNA, 16 bp, Homo sapiens
tgtagcttttatgtga

SEQ ID NO: 6500338 - DNA, 19 bp, Homo sapiens
tgtagcttttatgtgatat

SEQ ID NO: 6500339 - DNA, 22 bp, Homo sapiens
tgtagcttttggggagggaggg

SEQ ID NO: 6500340 - DNA, 16 bp, Homo sapiens
tgtaggaaacagaaaa

SEQ ID NO: 6500341 - DNA, 16 bp, Homo sapiens
tgtaggaagcattttt

SEQ ID NO: 6500342 - DNA, 16 bp, Homo sapiens
tgtaggaaggtactgt

SEQ ID NO: 6500343 - DNA, 18 bp, Homo sapiens
tgtaggaaggtactgtat

SEQ ID NO: 6500344 - DNA, 23 bp, Homo sapiens
tgtaggaatgaccacgggcctca

SEQ ID NO: 6500345 - DNA, 20 bp, Homo sapiens
tgtaggaattcttttgggga

SEQ ID NO: 6500346 - DNA, 23 bp, Homo sapiens
tgtaggaattcttttggggaagt

SEQ ID NO: 6500347 - DNA, 20 bp, Homo sapiens
tgtaggacttttaaacaaaa

SEQ ID NO: 6500348 - DNA, 13 bp, Homo sapiens
tgtaggagaaact

SEQ ID NO: 6500349 - DNA, 18 bp, Homo sapiens
tgtaggagacttgccaga

SEQ ID NO: 6500350 - DNA, 22 bp, Homo sapiens
tgtaggagacttgccagagccg

SEQ ID NO: 6500351 - DNA, 10 bp, Homo sapiens
tgtaggagag

SEQ ID NO: 6500352 - DNA, 13 bp, Homo sapiens
tgtaggagagact

SEQ ID NO: 6500353 - DNA, 18 bp, Homo sapiens
tgtaggagagactggcca

SEQ ID NO: 6500354 - DNA, 16 bp, Homo sapiens
tgtaggagctgcagtt

SEQ ID NO: 6500355 - DNA, 15 bp, Homo sapiens
tgtaggagctgcctt

SEQ ID NO: 6500356 - DNA, 19 bp, Homo sapiens
tgtaggaggggttaataag

SEQ ID NO: 6500357 - DNA, 18 bp, Homo sapiens
tgtaggagtaaagataaa

SEQ ID NO: 6500358 - DNA, 12 bp, Homo sapiens
tgtaggagtgag

SEQ ID NO: 6500359 - DNA, 14 bp, Homo sapiens
tgtaggatctactt

SEQ ID NO: 6500360 - DNA, 17 bp, Homo sapiens
tgtaggcacaaaaccag

SEQ ID NO: 6500361 - DNA, 17 bp, Homo sapiens
tgtaggcacttttattt

SEQ ID NO: 6500362 - DNA, 21 bp, Homo sapiens
tgtaggcacttttattttcat

SEQ ID NO: 6500363 - DNA, 15 bp, Homo sapiens
tgtaggcagacacag

SEQ ID NO: 6500364 - DNA, 20 bp, Homo sapiens
tgtaggcataaagtcagggg

SEQ ID NO: 6500365 - DNA, 17 bp, Homo sapiens
tgtaggcatcatgcatg

SEQ ID NO: 6500366 - DNA, 18 bp, Homo sapiens
tgtaggcatcatgcatgt

SEQ ID NO: 6500367 - DNA, 23 bp, Homo sapiens
tgtaggccttaactatttcacat

SEQ ID NO: 6500368 - DNA, 17 bp, Homo sapiens
tgtaggcgcccctgggg

SEQ ID NO: 6500369 - DNA, 23 bp, Homo sapiens
tgtaggctaaaaggcttccaggc

SEQ ID NO: 6500370 - DNA, 14 bp, Homo sapiens
tgtaggctccacct

SEQ ID NO: 6500371 - DNA, 19 bp, Homo sapiens
tgtaggctgttccctttgc

SEQ ID NO: 6500372 - DNA, 20 bp, Homo sapiens
tgtaggctgttccctttgcc

SEQ ID NO: 6500373 - DNA, 12 bp, Homo sapiens
tgtagggaactc

SEQ ID NO: 6500374 - DNA, 15 bp, Homo sapiens
tgtagggaactttct

SEQ ID NO: 6500375 - DNA, 11 bp, Homo sapiens
tgtagggacca

SEQ ID NO: 6500376 - DNA, 22 bp, Homo sapiens
tgtagggagggcggcaggggcc

SEQ ID NO: 6500377 - DNA, 16 bp, Homo sapiens
tgtagggcaagaggat

SEQ ID NO: 6500378 - DNA, 23 bp, Homo sapiens
tgtagggcaagaggatgaaggaa

SEQ ID NO: 6500379 - DNA, 24 bp, Homo sapiens
tgtagggcacccaaaactcaagca

SEQ ID NO: 6500380 - DNA, 15 bp, Homo sapiens
tgtagggctggacct

SEQ ID NO: 6500381 - DNA, 18 bp, Homo sapiens
tgtaggggaaatcaaggt

SEQ ID NO: 6500382 - DNA, 23 bp, Homo sapiens
tgtaggggagccacatttacata

SEQ ID NO: 6500383 - DNA, 22 bp, Homo sapiens
tgtaggggccacctcctccccc

SEQ ID NO: 6500384 - DNA, 20 bp, Homo sapiens
tgtaggggcttacaaagcct

SEQ ID NO: 6500385 - DNA, 15 bp, Homo sapiens
tgtagggggccttgc

SEQ ID NO: 6500386 - DNA, 22 bp, Homo sapiens
tgtagggggccttgcggaagcc

SEQ ID NO: 6500387 - DNA, 22 bp, Homo sapiens
tgtaggggttaacttggtcaga

SEQ ID NO: 6500388 - DNA, 16 bp, Homo sapiens
tgtagggttacagaga

SEQ ID NO: 6500389 - DNA, 17 bp, Homo sapiens
tgtagggttataataat

SEQ ID NO: 6500390 - DNA, 22 bp, Homo sapiens
tgtagggttttttcttctttct

SEQ ID NO: 6500391 - DNA, 23 bp, Homo sapiens
tgtagggttttttcttctttctt

SEQ ID NO: 6500392 - DNA, 13 bp, Homo sapiens
tgtaggtaaaatg

SEQ ID NO: 6500393 - DNA, 16 bp, Homo sapiens
tgtaggtatactatgt

SEQ ID NO: 6500394 - DNA, 15 bp, Homo sapiens
tgtaggtatcatttt

SEQ ID NO: 6500395 - DNA, 18 bp, Homo sapiens
tgtaggtatgtctgtgcc

SEQ ID NO: 6500396 - DNA, 20 bp, Homo sapiens
tgtaggtatgtctgtgccat

SEQ ID NO: 6500397 - DNA, 15 bp, Homo sapiens
tgtaggtcaatgaaa

SEQ ID NO: 6500398 - DNA, 18 bp, Homo sapiens
tgtaggtcaatgaaatat

SEQ ID NO: 6500399 - DNA, 22 bp, Homo sapiens
tgtaggtgaaaggcatctttct

SEQ ID NO: 6500400 - DNA, 14 bp, Homo sapiens
tgtaggtgaaatga

SEQ ID NO: 6500401 - DNA, 15 bp, Homo sapiens
tgtaggtgagcctgg

SEQ ID NO: 6500402 - DNA, 16 bp, Homo sapiens
tgtaggtgagcctggg

SEQ ID NO: 6500403 - DNA, 18 bp, Homo sapiens
tgtaggtgtctgccttca

SEQ ID NO: 6500404 - DNA, 21 bp, Homo sapiens
tgtaggtgttatgtattccta

SEQ ID NO: 6500405 - DNA, 18 bp, Homo sapiens
tgtaggttatctttttaa

SEQ ID NO: 6500406 - DNA, 14 bp, Homo sapiens
tgtaggttatttta

SEQ ID NO: 6500407 - DNA, 15 bp, Homo sapiens
tgtaggttgcacact

SEQ ID NO: 6500408 - DNA, 18 bp, Homo sapiens
tgtaggttgcacactttg

SEQ ID NO: 6500409 - DNA, 20 bp, Homo sapiens
tgtaggttgcacactttggt

SEQ ID NO: 6500410 - DNA, 17 bp, Homo sapiens
tgtaggttgtctaaaaa

SEQ ID NO: 6500411 - DNA, 12 bp, Homo sapiens
tgcaatgggtaa

SEQ ID NO: 6500412 - DNA, 15 bp, Homo sapiens
tgcaatggtgactga

SEQ ID NO: 6500413 - DNA, 21 bp, Homo sapiens
tgcaatggtgactgatttcaa

SEQ ID NO: 6500414 - DNA, 14 bp, Homo sapiens
tgcaatgtcctgca

SEQ ID NO: 6500415 - DNA, 22 bp, Homo sapiens
tgcaatgtctgtccctaaacat

SEQ ID NO: 6500416 - DNA, 20 bp, Homo sapiens
tgcaatgtcttaaataaaac

SEQ ID NO: 6500417 - DNA, 15 bp, Homo sapiens
tgcaatgtgaaaaat

SEQ ID NO: 6500418 - DNA, 12 bp, Homo sapiens
tgcaatgtggaa

SEQ ID NO: 6500419 - DNA, 13 bp, Homo sapiens
tgcaatgtggaaa

SEQ ID NO: 6500420 - DNA, 21 bp, Homo sapiens
tgcaatgtggtgacacctccc

SEQ ID NO: 6500421 - DNA, 23 bp, Homo sapiens
tgcaatgtggtgacacctccccc

SEQ ID NO: 6500422 - DNA, 15 bp, Homo sapiens
tgcaatgtgtataaa

SEQ ID NO: 6500423 - DNA, 16 bp, Homo sapiens
tgcaatgtgtataaac

SEQ ID NO: 6500424 - DNA, 20 bp, Homo sapiens
tgcaatgtgtataaacaaga

SEQ ID NO: 6500425 - DNA, 21 bp, Homo sapiens
tgcaatgtgtataaacaagaa

SEQ ID NO: 6500426 - DNA, 20 bp, Homo sapiens
tgcaatgttattattggctt

SEQ ID NO: 6500427 - DNA, 17 bp, Homo sapiens
tgcaatgtttttgtgta

SEQ ID NO: 6500428 - DNA, 14 bp, Homo sapiens
tgcaattaaaaggt

SEQ ID NO: 6500429 - DNA, 19 bp, Homo sapiens
tgcaattaaacttccaaag

SEQ ID NO: 6500430 - DNA, 22 bp, Homo sapiens
tgcaattaaacttccaaagaaa

SEQ ID NO: 6500431 - DNA, 23 bp, Homo sapiens
tgcaattaaacttccaaagaaag

SEQ ID NO: 6500432 - DNA, 24 bp, Homo sapiens
tgcaattaaacttccaaagaaagt

SEQ ID NO: 6500433 - DNA, 16 bp, Homo sapiens
tgcaattaaagtgata

SEQ ID NO: 6500434 - DNA, 18 bp, Homo sapiens
tgcaattacagcaaaaag

SEQ ID NO: 6500435 - DNA, 16 bp, Homo sapiens
tgcaattagatagaaa

SEQ ID NO: 6500436 - DNA, 19 bp, Homo sapiens
tgcaattagcctcatagtt

SEQ ID NO: 6500437 - DNA, 17 bp, Homo sapiens
tgcaattaggattttga

SEQ ID NO: 6500438 - DNA, 14 bp, Homo sapiens
tgcaattcaaaagt

SEQ ID NO: 6500439 - DNA, 16 bp, Homo sapiens
tgcaattcaaaagttc

SEQ ID NO: 6500440 - DNA, 21 bp, Homo sapiens
tgcaattcaatgcaatgaaaa

SEQ ID NO: 6500441 - DNA, 19 bp, Homo sapiens
tgcaattcagtctgctctc

SEQ ID NO: 6500442 - DNA, 14 bp, Homo sapiens
tgcaattcagtgtt

SEQ ID NO: 6500443 - DNA, 21 bp, Homo sapiens
tgcaattcatgtaacagttgt

SEQ ID NO: 6500444 - DNA, 17 bp, Homo sapiens
tgcaattccaagaaaat

SEQ ID NO: 6500445 - DNA, 22 bp, Homo sapiens
tgcaattccattttgtgtctgt

SEQ ID NO: 6500446 - DNA, 18 bp, Homo sapiens
tgcaattcccctctgctg

SEQ ID NO: 6500447 - DNA, 14 bp, Homo sapiens
tgcaattctttttg

SEQ ID NO: 6500448 - DNA, 13 bp, Homo sapiens
tgcaattgctctt

SEQ ID NO: 6500449 - DNA, 21 bp, Homo sapiens
tgcaattgctcttctccacgt

SEQ ID NO: 6500450 - DNA, 14 bp, Homo sapiens
tgcaattgtacaaa

SEQ ID NO: 6500451 - DNA, 19 bp, Homo sapiens
tgcaattgtacaaaaaagt

SEQ ID NO: 6500452 - DNA, 20 bp, Homo sapiens
tgcaattgttaatcaaagat

SEQ ID NO: 6500453 - DNA, 18 bp, Homo sapiens
tgcaattgttgaaagctt

SEQ ID NO: 6500454 - DNA, 16 bp, Homo sapiens
tgcaattgtttaagaa

SEQ ID NO: 6500455 - DNA, 20 bp, Homo sapiens
tgcaattgtttaagaatcat

SEQ ID NO: 6500456 - DNA, 23 bp, Homo sapiens
tgcaattgtttaagaatcatgga

SEQ ID NO: 6500457 - DNA, 23 bp, Homo sapiens
tgcaatttaatggatatttctca

SEQ ID NO: 6500458 - DNA, 14 bp, Homo sapiens
tgcaatttattaaa

SEQ ID NO: 6500459 - DNA, 12 bp, Homo sapiens
tgcaatttcaag

SEQ ID NO: 6500460 - DNA, 19 bp, Homo sapiens
tgcaatttcaaggttctaa

SEQ ID NO: 6500461 - DNA, 14 bp, Homo sapiens
tgcaatttcatatg

SEQ ID NO: 6500462 - DNA, 19 bp, Homo sapiens
tgcaatttcccctctgtgt

SEQ ID NO: 6500463 - DNA, 17 bp, Homo sapiens
tgcaatttctgtacatt

SEQ ID NO: 6500464 - DNA, 20 bp, Homo sapiens
tgcaatttgtttaaagaata

SEQ ID NO: 6500465 - DNA, 17 bp, Homo sapiens
tgcaatttgtttgtgct

SEQ ID NO: 6500466 - DNA, 20 bp, Homo sapiens
tgcaatttgtttgtgcttct

SEQ ID NO: 6500467 - DNA, 14 bp, Homo sapiens
tgcaattttactgt

SEQ ID NO: 6500468 - DNA, 16 bp, Homo sapiens
tgcaattttactgtga

SEQ ID NO: 6500469 - DNA, 14 bp, Homo sapiens
tgcaatttttaaac

SEQ ID NO: 6500470 - DNA, 16 bp, Homo sapiens
tgcaatttttaaacta

SEQ ID NO: 6500471 - DNA, 18 bp, Homo sapiens
tgcaatttttaaactagt

SEQ ID NO: 6500472 - DNA, 19 bp, Homo sapiens
tgcaatttttaaactagta

SEQ ID NO: 6500473 - DNA, 21 bp, Homo sapiens
tgcaatttttaaactagtaat

SEQ ID NO: 6500474 - DNA, 20 bp, Homo sapiens
tgcacaaaatagcacatcca

SEQ ID NO: 6500475 - DNA, 21 bp, Homo sapiens
tgcacaaaattcgacctgatt

SEQ ID NO: 6500476 - DNA, 15 bp, Homo sapiens
tgcacaaacagaggc

SEQ ID NO: 6500477 - DNA, 17 bp, Homo sapiens
tgcacaaacagaggccg

SEQ ID NO: 6500478 - DNA, 19 bp, Homo sapiens
tgcacaaacatagacagat

SEQ ID NO: 6500479 - DNA, 22 bp, Homo sapiens
tgcacaaacatagacagatgtg

SEQ ID NO: 6500480 - DNA, 15 bp, Homo sapiens
tgcacaaactcacca

SEQ ID NO: 6500481 - DNA, 20 bp, Homo sapiens
tgcacaaacttgtgagcatc

SEQ ID NO: 6500482 - DNA, 17 bp, Homo sapiens
tgcacaaagcccttcca

SEQ ID NO: 6500483 - DNA, 15 bp, Homo sapiens
tgcacaaagtggcat

SEQ ID NO: 6500484 - DNA, 18 bp, Homo sapiens
tgcacaacagagtaacta

SEQ ID NO: 6500485 - DNA, 15 bp, Homo sapiens
tgcacaacagccctg

SEQ ID NO: 6500486 - DNA, 16 bp, Homo sapiens
tgcacaacagccctgc

SEQ ID NO: 6500487 - DNA, 20 bp, Homo sapiens
tgcacaacagccctgcctga

SEQ ID NO: 6500488 - DNA, 17 bp, Homo sapiens
tgcacaacatcctcaga

SEQ ID NO: 6500489 - DNA, 18 bp, Homo sapiens
tgcacaacatcctcagaa

SEQ ID NO: 6500490 - DNA, 14 bp, Homo sapiens
tgcacaacattaca

SEQ ID NO: 6500491 - DNA, 22 bp, Homo sapiens
tgcacaactagttaaaagcctt

SEQ ID NO: 6500492 - DNA, 15 bp, Homo sapiens
tgcacaactctccaa

SEQ ID NO: 6500493 - DNA, 13 bp, Homo sapiens
tgcacaagccagg

SEQ ID NO: 6500494 - DNA, 13 bp, Homo sapiens
tgcacaagctcag

SEQ ID NO: 6500495 - DNA, 23 bp, Homo sapiens
tgcacaagctccaagctcccagg

SEQ ID NO: 6500496 - DNA, 14 bp, Homo sapiens
tgcacaagctgcac

SEQ ID NO: 6500497 - DNA, 18 bp, Homo sapiens
tgcacaagcttgtatata

SEQ ID NO: 6500498 - DNA, 20 bp, Homo sapiens
tgcacaagcttgtatataca

SEQ ID NO: 6500499 - DNA, 22 bp, Homo sapiens
tgcacaaggaaagttattttca

SEQ ID NO: 6500500 - DNA, 14 bp, Homo sapiens
tgcacaagtaacac

SEQ ID NO: 6500501 - DNA, 16 bp, Homo sapiens
tgcacaagtctttcca

SEQ ID NO: 6500502 - DNA, 17 bp, Homo sapiens
tgcacaagttccctgga

SEQ ID NO: 6500503 - DNA, 18 bp, Homo sapiens
tgcacaagttccctggag

SEQ ID NO: 6500504 - DNA, 15 bp, Homo sapiens
tgcacaataaaaatg

SEQ ID NO: 6500505 - DNA, 20 bp, Homo sapiens
tgcacaataaaaatgtttaa

SEQ ID NO: 6500506 - DNA, 19 bp, Homo sapiens
tgcacaatattgaactttt

SEQ ID NO: 6500507 - DNA, 19 bp, Homo sapiens
tgcacaatatttcttttgt

SEQ ID NO: 6500508 - DNA, 18 bp, Homo sapiens
tgcacaatgaccagcagg

SEQ ID NO: 6500509 - DNA, 13 bp, Homo sapiens
tgcacaattccat

SEQ ID NO: 6500510 - DNA, 11 bp, Homo sapiens
tgcacaatttg

SEQ ID NO: 6500511 - DNA, 18 bp, Homo sapiens
tgcacaatttgagcaatt

SEQ ID NO: 6500512 - DNA, 19 bp, Homo sapiens
tgcacaatttgagcaattc

SEQ ID NO: 6500513 - DNA, 22 bp, Homo sapiens
tgcacaatttgagcaattcatt

SEQ ID NO: 6500514 - DNA, 22 bp, Homo sapiens
tgcacacacacacacatgcaca

SEQ ID NO: 6500515 - DNA, 20 bp, Homo sapiens
tgcacacacacggatgcaca

SEQ ID NO: 6500516 - DNA, 19 bp, Homo sapiens
tgcacacacagatgcacac

SEQ ID NO: 6500517 - DNA, 16 bp, Homo sapiens
tgcacacacagctcct

SEQ ID NO: 6500518 - DNA, 17 bp, Homo sapiens
tgcacacacagctcctc

SEQ ID NO: 6500519 - DNA, 18 bp, Homo sapiens
tgcacacacatatattat

SEQ ID NO: 6500520 - DNA, 15 bp, Homo sapiens
tgcacacacatgcat

SEQ ID NO: 6500521 - DNA, 21 bp, Homo sapiens
tgcacacacatggatgagcac

SEQ ID NO: 6500522 - DNA, 10 bp, Homo sapiens
tgcacacacc

SEQ ID NO: 6500523 - DNA, 15 bp, Homo sapiens
tgcacacaccagagc

SEQ ID NO: 6500524 - DNA, 17 bp, Homo sapiens
tgcacacaccagagccc

SEQ ID NO: 6500525 - DNA, 18 bp, Homo sapiens
tgcacacaccagagccca

SEQ ID NO: 6500526 - DNA, 18 bp, Homo sapiens
tgcacacacctcatgcta

SEQ ID NO: 6500527 - DNA, 13 bp, Homo sapiens
tgcacacacctgc

SEQ ID NO: 6500528 - DNA, 14 bp, Homo sapiens
tgcacacacctgca

SEQ ID NO: 6500529 - DNA, 16 bp, Homo sapiens
tgcacacacctgcaca

SEQ ID NO: 6500530 - DNA, 15 bp, Homo sapiens
tgcacacacctgcct

SEQ ID NO: 6500531 - DNA, 16 bp, Homo sapiens
tgcacacagaaatata

SEQ ID NO: 6500532 - DNA, 23 bp, Homo sapiens
tgcacacagaaatatatatacat

SEQ ID NO: 6500533 - DNA, 19 bp, Homo sapiens
tgcacacagaatgctcagg

SEQ ID NO: 6500534 - DNA, 13 bp, Homo sapiens
tgcacacagacgg

SEQ ID NO: 6500535 - DNA, 17 bp, Homo sapiens
tgcacacagacggccta

SEQ ID NO: 6500536 - DNA, 24 bp, Homo sapiens
tgcacacagcacgggggccaagga

SEQ ID NO: 6500537 - DNA, 14 bp, Homo sapiens
tgcacacaggacag

SEQ ID NO: 6500538 - DNA, 23 bp, Homo sapiens
tgcacacaggatggcaggaggca

SEQ ID NO: 6500539 - DNA, 15 bp, Homo sapiens
tgcacacagggcagt

SEQ ID NO: 6500540 - DNA, 14 bp, Homo sapiens
tgcacacagtgctt

SEQ ID NO: 6500541 - DNA, 13 bp, Homo sapiens
tgcacacataaca

SEQ ID NO: 6500542 - DNA, 17 bp, Homo sapiens
tgcacacataacacaca

SEQ ID NO: 6500543 - DNA, 13 bp, Homo sapiens
tgcacacatatat

SEQ ID NO: 6500544 - DNA, 19 bp, Homo sapiens
tgcacacattaggcattga

SEQ ID NO: 6500545 - DNA, 19 bp, Homo sapiens
tgcacacattggccgcttc

SEQ ID NO: 6500546 - DNA, 20 bp, Homo sapiens
tgcacacattggccgcttca

SEQ ID NO: 6500547 - DNA, 15 bp, Homo sapiens
tgcacacatttttta

SEQ ID NO: 6500548 - DNA, 20 bp, Homo sapiens
tgcacacattttttaaatgc

SEQ ID NO: 6500549 - DNA, 21 bp, Homo sapiens
tgcacaccaaattgctgagat

SEQ ID NO: 6500550 - DNA, 19 bp, Homo sapiens
tgcacaccaaggccctgca

SEQ ID NO: 6500551 - DNA, 20 bp, Homo sapiens
tgcacaccaaggccctgcat

SEQ ID NO: 6500552 - DNA, 16 bp, Homo sapiens
tgcacaccaccctccc

SEQ ID NO: 6500553 - DNA, 17 bp, Homo sapiens
tgcacaccaccctcccg

SEQ ID NO: 6500554 - DNA, 16 bp, Homo sapiens
tgcacaccagagacaa

SEQ ID NO: 6500555 - DNA, 23 bp, Homo sapiens
tgcacaccagagacaagcagagt

SEQ ID NO: 6500556 - DNA, 17 bp, Homo sapiens
tgcacaccagttactgt

SEQ ID NO: 6500557 - DNA, 23 bp, Homo sapiens
tgcacaccagttactgttcatgg

SEQ ID NO: 6500558 - DNA, 16 bp, Homo sapiens
tgcacaccattttgta

SEQ ID NO: 6500559 - DNA, 18 bp, Homo sapiens
tgcacaccattttgtaaa

SEQ ID NO: 6500560 - DNA, 23 bp, Homo sapiens
tgcacaccattttgtaaatgaaa

SEQ ID NO: 6500561 - DNA, 18 bp, Homo sapiens
tgcacacccactgccccg

SEQ ID NO: 6500562 - DNA, 20 bp, Homo sapiens
tgcacacccatgcacactca

SEQ ID NO: 6500563 - DNA, 18 bp, Homo sapiens
tgcacaccccactcccac

SEQ ID NO: 6500564 - DNA, 13 bp, Homo sapiens
tgcacaccctggg

SEQ ID NO: 6500565 - DNA, 20 bp, Homo sapiens
tgcacacctactagtcacca

SEQ ID NO: 6500566 - DNA, 17 bp, Homo sapiens
tgcacaccttttcccca

SEQ ID NO: 6500567 - DNA, 18 bp, Homo sapiens
tgcacaccttttccccag

SEQ ID NO: 6500568 - DNA, 16 bp, Homo sapiens
tgcacacggcacagag

SEQ ID NO: 6500569 - DNA, 23 bp, Homo sapiens
tgcacacggctggtcactctgcc

SEQ ID NO: 6500570 - DNA, 18 bp, Homo sapiens
tgcacacgggaaagcctt

SEQ ID NO: 6500571 - DNA, 21 bp, Homo sapiens
tgcacacgggcgagctttctc

SEQ ID NO: 6500572 - DNA, 22 bp, Homo sapiens
tgcacactagtttatgctacct

SEQ ID NO: 6500573 - DNA, 18 bp, Homo sapiens
tgcacactcactggcatc

SEQ ID NO: 6500574 - DNA, 16 bp, Homo sapiens
tgcacactcagttctg

SEQ ID NO: 6500575 - DNA, 15 bp, Homo sapiens
tgcacactccaggcc

SEQ ID NO: 6500576 - DNA, 19 bp, Homo sapiens
tgcacactccatctcctgc

SEQ ID NO: 6500577 - DNA, 20 bp, Homo sapiens
tgcacactgacataatgtag

SEQ ID NO: 6500578 - DNA, 13 bp, Homo sapiens
tgcacactgagaa

SEQ ID NO: 6500579 - DNA, 15 bp, Homo sapiens
tgcacactgagaatg

SEQ ID NO: 6500580 - DNA, 18 bp, Homo sapiens
tgcacactgagaatgcta

SEQ ID NO: 6500581 - DNA, 15 bp, Homo sapiens
tgcacactgcacatt

SEQ ID NO: 6500582 - DNA, 13 bp, Homo sapiens
tgcacactgttgg

SEQ ID NO: 6500583 - DNA, 21 bp, Homo sapiens
tgcacacttcaaatcagagca

SEQ ID NO: 6500584 - DNA, 12 bp, Homo sapiens
tgcacacttccc

SEQ ID NO: 6500585 - DNA, 14 bp, Homo sapiens
tgcacacttgtata

SEQ ID NO: 6500586 - DNA, 19 bp, Homo sapiens
tgcacacttgtatattgaa

SEQ ID NO: 6500587 - DNA, 22 bp, Homo sapiens
tgcacactttgccatattttca

SEQ ID NO: 6500588 - DNA, 13 bp, Homo sapiens
tgcacactttggc

SEQ ID NO: 6500589 - DNA, 19 bp, Homo sapiens
tgtaggtttctctcttccc

SEQ ID NO: 6500590 - DNA, 20 bp, Homo sapiens
tgtagtaaaatgttttcatt

SEQ ID NO: 6500591 - DNA, 15 bp, Homo sapiens
tgtagtaaagaaatt

SEQ ID NO: 6500592 - DNA, 17 bp, Homo sapiens
tgtagtaacactaatat

SEQ ID NO: 6500593 - DNA, 14 bp, Homo sapiens
tgtagtaagatttg

SEQ ID NO: 6500594 - DNA, 23 bp, Homo sapiens
tgtagtaataaaaagtaacacac

SEQ ID NO: 6500595 - DNA, 15 bp, Homo sapiens
tgtagtaattgacat

SEQ ID NO: 6500596 - DNA, 22 bp, Homo sapiens
tgtagtagcgttttttaaatgt

SEQ ID NO: 6500597 - DNA, 14 bp, Homo sapiens
tgtagtagtctcat

SEQ ID NO: 6500598 - DNA, 19 bp, Homo sapiens
tgtagtataatttcaagga

SEQ ID NO: 6500599 - DNA, 18 bp, Homo sapiens
tgtagtatcaaatattag

SEQ ID NO: 6500600 - DNA, 21 bp, Homo sapiens
tgtagtatcaaatattagatg

SEQ ID NO: 6500601 - DNA, 14 bp, Homo sapiens
tgtagtatctcata

SEQ ID NO: 6500602 - DNA, 22 bp, Homo sapiens
tgtagtatggcctgacagctct

SEQ ID NO: 6500603 - DNA, 23 bp, Homo sapiens
tgtagtatggcctgacagctctg

SEQ ID NO: 6500604 - DNA, 14 bp, Homo sapiens
tgtagtatggtata

SEQ ID NO: 6500605 - DNA, 21 bp, Homo sapiens
tgtagtatttagtatatgaaa

SEQ ID NO: 6500606 - DNA, 21 bp, Homo sapiens
tgtagtatttatatttaaatt

SEQ ID NO: 6500607 - DNA, 18 bp, Homo sapiens
tgtagtattttttgtata

SEQ ID NO: 6500608 - DNA, 18 bp, Homo sapiens
tgtagtcaaaaaaggaaa

SEQ ID NO: 6500609 - DNA, 13 bp, Homo sapiens
tgtagtcaagagg

SEQ ID NO: 6500610 - DNA, 14 bp, Homo sapiens
tgtagtcaggtgct

SEQ ID NO: 6500611 - DNA, 15 bp, Homo sapiens
tgtagtcataataaa

SEQ ID NO: 6500612 - DNA, 17 bp, Homo sapiens
tgtagtcccagcacttt

SEQ ID NO: 6500613 - DNA, 14 bp, Homo sapiens
tgtagtcccagcta

SEQ ID NO: 6500614 - DNA, 17 bp, Homo sapiens
tgtagtcccggaggcct

SEQ ID NO: 6500615 - DNA, 20 bp, Homo sapiens
tgtagtcccggaggccttcc

SEQ ID NO: 6500616 - DNA, 22 bp, Homo sapiens
tgtagtcccggaggccttccct

SEQ ID NO: 6500617 - DNA, 21 bp, Homo sapiens
tgtagtcgtacttaccaagct

SEQ ID NO: 6500618 - DNA, 15 bp, Homo sapiens
tgtagtctaagacct

SEQ ID NO: 6500619 - DNA, 15 bp, Homo sapiens
tgtagtcttatgaat

SEQ ID NO: 6500620 - DNA, 15 bp, Homo sapiens
tgtagtcttgtctta

SEQ ID NO: 6500621 - DNA, 18 bp, Homo sapiens
tgtagtctttttataggt

SEQ ID NO: 6500622 - DNA, 18 bp, Homo sapiens
tgtagtgaatcctctgtt

SEQ ID NO: 6500623 - DNA, 17 bp, Homo sapiens
tgtagtgagatagcatt

SEQ ID NO: 6500624 - DNA, 16 bp, Homo sapiens
tgtagtgattcattgt

SEQ ID NO: 6500625 - DNA, 20 bp, Homo sapiens
tgtagtgcatttttaaactt

SEQ ID NO: 6500626 - DNA, 17 bp, Homo sapiens
tgtagtgccgctcttgg

SEQ ID NO: 6500627 - DNA, 20 bp, Homo sapiens
tgtagtgctcgagtcacatt

SEQ ID NO: 6500628 - DNA, 19 bp, Homo sapiens
tgtagtggaagagcagcct

SEQ ID NO: 6500629 - DNA, 18 bp, Homo sapiens
tgtagtggcaaaaaagaa

SEQ ID NO: 6500630 - DNA, 21 bp, Homo sapiens
tgtagtggcaaaaaagaacag

SEQ ID NO: 6500631 - DNA, 22 bp, Homo sapiens
tgtagtggcacaatctcagctc

SEQ ID NO: 6500632 - DNA, 17 bp, Homo sapiens
tgtagtgtagtcaggtg

SEQ ID NO: 6500633 - DNA, 19 bp, Homo sapiens
tgtagtgtctttatttgct

SEQ ID NO: 6500634 - DNA, 15 bp, Homo sapiens
tgtagtgtgtcagag

SEQ ID NO: 6500635 - DNA, 23 bp, Homo sapiens
tgtagtgtgtgcttacagtaact

SEQ ID NO: 6500636 - DNA, 16 bp, Homo sapiens
tgtagtgttcagaaaa

SEQ ID NO: 6500637 - DNA, 18 bp, Homo sapiens
tgtagtgttcagaaaaaa

SEQ ID NO: 6500638 - DNA, 15 bp, Homo sapiens
tgtagtgttggagaa

SEQ ID NO: 6500639 - DNA, 17 bp, Homo sapiens
tgtagtgttggagaaga

SEQ ID NO: 6500640 - DNA, 21 bp, Homo sapiens
tgtagtgttggagaagaactg

SEQ ID NO: 6500641 - DNA, 14 bp, Homo sapiens
tgtagtgtttcttt

SEQ ID NO: 6500642 - DNA, 13 bp, Homo sapiens
tgtagttaatgat

SEQ ID NO: 6500643 - DNA, 14 bp, Homo sapiens
tgtagttaatttat

SEQ ID NO: 6500644 - DNA, 14 bp, Homo sapiens
tgtagttactcaag

SEQ ID NO: 6500645 - DNA, 16 bp, Homo sapiens
tgtagttactcaagca

SEQ ID NO: 6500646 - DNA, 12 bp, Homo sapiens
tgtagttaggaa

SEQ ID NO: 6500647 - DNA, 13 bp, Homo sapiens
tgtagttaggaaa

SEQ ID NO: 6500648 - DNA, 15 bp, Homo sapiens
tgtagttaggaaata

SEQ ID NO: 6500649 - DNA, 13 bp, Homo sapiens
tgtagttataaac

SEQ ID NO: 6500650 - DNA, 13 bp, Homo sapiens
tgtagttcatgta

SEQ ID NO: 6500651 - DNA, 20 bp, Homo sapiens
tgtagttcatgtaaataata

SEQ ID NO: 6500652 - DNA, 22 bp, Homo sapiens
tgtagttccacttatagcctct

SEQ ID NO: 6500653 - DNA, 16 bp, Homo sapiens
tgtagttccctctgcc

SEQ ID NO: 6500654 - DNA, 17 bp, Homo sapiens
tgtagttccctctgcct

SEQ ID NO: 6500655 - DNA, 13 bp, Homo sapiens
tgtagttctaaga

SEQ ID NO: 6500656 - DNA, 15 bp, Homo sapiens
tgtagttctgccagg

SEQ ID NO: 6500657 - DNA, 16 bp, Homo sapiens
tgtagttctgccaggc

SEQ ID NO: 6500658 - DNA, 18 bp, Homo sapiens
tgtagttctgccaggcaa

SEQ ID NO: 6500659 - DNA, 17 bp, Homo sapiens
tgtagttctgtgtactt

SEQ ID NO: 6500660 - DNA, 19 bp, Homo sapiens
tgtagttcttgtctgattg

SEQ ID NO: 6500661 - DNA, 15 bp, Homo sapiens
tgtagttctttaaac

SEQ ID NO: 6500662 - DNA, 16 bp, Homo sapiens
tgtagttgaataaaaa

SEQ ID NO: 6500663 - DNA, 21 bp, Homo sapiens
tgtagttgttcgttggttata

SEQ ID NO: 6500664 - DNA, 14 bp, Homo sapiens
tgtagtttaataca

SEQ ID NO: 6500665 - DNA, 19 bp, Homo sapiens
tgtagtttacctctttaaa

SEQ ID NO: 6500666 - DNA, 13 bp, Homo sapiens
tgtagtttcctct

SEQ ID NO: 6500667 - DNA, 16 bp, Homo sapiens
tgtagttttaaataaa

SEQ ID NO: 6500668 - DNA, 19 bp, Homo sapiens
tgtagttttatttgtatta

SEQ ID NO: 6500669 - DNA, 15 bp, Homo sapiens
tgtagttttcctttt

SEQ ID NO: 6500670 - DNA, 20 bp, Homo sapiens
tgtagttttgtgatgcattt

SEQ ID NO: 6500671 - DNA, 22 bp, Homo sapiens
tgtagtttttaattaaaaactt

SEQ ID NO: 6500672 - DNA, 19 bp, Homo sapiens
tgtagtttttatatgttgt

SEQ ID NO: 6500673 - DNA, 20 bp, Homo sapiens
tgtagtttttatatgttgta

SEQ ID NO: 6500674 - DNA, 17 bp, Homo sapiens
tgtagtttttgaaaatt

SEQ ID NO: 6500675 - DNA, 18 bp, Homo sapiens
tgtagtttttgctgaagg

SEQ ID NO: 6500676 - DNA, 21 bp, Homo sapiens
tgtagtttttgttcaccttct

SEQ ID NO: 6500677 - DNA, 17 bp, Homo sapiens
tgtataaaaaaaatagt

SEQ ID NO: 6500678 - DNA, 15 bp, Homo sapiens
tgtataaaaaagaaa

SEQ ID NO: 6500679 - DNA, 14 bp, Homo sapiens
tgtataaaaaccat

SEQ ID NO: 6500680 - DNA, 17 bp, Homo sapiens
tgtataaaaaggaaatt

SEQ ID NO: 6500681 - DNA, 22 bp, Homo sapiens
tgtataaaaatgtaaattagtt

SEQ ID NO: 6500682 - DNA, 18 bp, Homo sapiens
tgtataaaaattatcaaa

SEQ ID NO: 6500683 - DNA, 15 bp, Homo sapiens
tgtataaaacagtgt

SEQ ID NO: 6500684 - DNA, 17 bp, Homo sapiens
tgtataaaacagtgttt

SEQ ID NO: 6500685 - DNA, 20 bp, Homo sapiens
tgtataaaacagtgtttcca

SEQ ID NO: 6500686 - DNA, 18 bp, Homo sapiens
tgtataaaagtgtgaaat

SEQ ID NO: 6500687 - DNA, 10 bp, Homo sapiens
tgtataaaat

SEQ ID NO: 6500688 - DNA, 14 bp, Homo sapiens
tgtataaaatacat

SEQ ID NO: 6500689 - DNA, 22 bp, Homo sapiens
tgtataaaatacatagtgaaaa

SEQ ID NO: 6500690 - DNA, 13 bp, Homo sapiens
tgtataaaatctg

SEQ ID NO: 6500691 - DNA, 19 bp, Homo sapiens
tgtataaaatctgaatttt

SEQ ID NO: 6500692 - DNA, 13 bp, Homo sapiens
tgtataaaatgta

SEQ ID NO: 6500693 - DNA, 18 bp, Homo sapiens
tgtataaacaaattagca

SEQ ID NO: 6500694 - DNA, 15 bp, Homo sapiens
tgtataaacaagcct

SEQ ID NO: 6500695 - DNA, 20 bp, Homo sapiens
tgtataaactgtattttgaa

SEQ ID NO: 6500696 - DNA, 15 bp, Homo sapiens
tgtataaagaaactg

SEQ ID NO: 6500697 - DNA, 12 bp, Homo sapiens
tgtataaagatt

SEQ ID NO: 6500698 - DNA, 17 bp, Homo sapiens
tgtataaagattgtact

SEQ ID NO: 6500699 - DNA, 19 bp, Homo sapiens
tgtataaagattgtactta

SEQ ID NO: 6500700 - DNA, 16 bp, Homo sapiens
tgtataaagtgattga

SEQ ID NO: 6500701 - DNA, 18 bp, Homo sapiens
tgtataaagtgattgact

SEQ ID NO: 6500702 - DNA, 12 bp, Homo sapiens
tgtataaataag

SEQ ID NO: 6500703 - DNA, 15 bp, Homo sapiens
tgtataaataagagc

SEQ ID NO: 6500704 - DNA, 17 bp, Homo sapiens
tgtataaataagagcat

SEQ ID NO: 6500705 - DNA, 13 bp, Homo sapiens
tgtataaataata

SEQ ID NO: 6500706 - DNA, 12 bp, Homo sapiens
tgtataaatata

SEQ ID NO: 6500707 - DNA, 18 bp, Homo sapiens
tgtataaatgtacatttc

SEQ ID NO: 6500708 - DNA, 22 bp, Homo sapiens
tgtataaatgtctattattatg

SEQ ID NO: 6500709 - DNA, 21 bp, Homo sapiens
tgtataaattaaataaactgt

SEQ ID NO: 6500710 - DNA, 19 bp, Homo sapiens
tgtataaattaatacagag

SEQ ID NO: 6500711 - DNA, 14 bp, Homo sapiens
tgtataaatttatt

SEQ ID NO: 6500712 - DNA, 21 bp, Homo sapiens
tgtataaatttttaagtgtca

SEQ ID NO: 6500713 - DNA, 19 bp, Homo sapiens
tgtataacagccttttcct

SEQ ID NO: 6500714 - DNA, 17 bp, Homo sapiens
tgtataacaggttattt

SEQ ID NO: 6500715 - DNA, 14 bp, Homo sapiens
tgtataacatcact

SEQ ID NO: 6500716 - DNA, 17 bp, Homo sapiens
tgtataacatcactgtc

SEQ ID NO: 6500717 - DNA, 15 bp, Homo sapiens
tgtataaccaagtgt

SEQ ID NO: 6500718 - DNA, 16 bp, Homo sapiens
tgtataaccaagtgtg

SEQ ID NO: 6500719 - DNA, 21 bp, Homo sapiens
tgtataactaaactaacaaga

SEQ ID NO: 6500720 - DNA, 13 bp, Homo sapiens
tgtataacttaaa

SEQ ID NO: 6500721 - DNA, 21 bp, Homo sapiens
tgtataagaagatacactgca

SEQ ID NO: 6500722 - DNA, 16 bp, Homo sapiens
tgtataagcactgaaa

SEQ ID NO: 6500723 - DNA, 19 bp, Homo sapiens
tgtataagtactagatgca

SEQ ID NO: 6500724 - DNA, 16 bp, Homo sapiens
tgtataagtcaagcac

SEQ ID NO: 6500725 - DNA, 21 bp, Homo sapiens
tgtataagtcaagcacatgta

SEQ ID NO: 6500726 - DNA, 18 bp, Homo sapiens
tgtataagtgcacacaga

SEQ ID NO: 6500727 - DNA, 20 bp, Homo sapiens
tgtataagtgcacacagaaa

SEQ ID NO: 6500728 - DNA, 23 bp, Homo sapiens
tgtataagtgcacacagaaatat

SEQ ID NO: 6500729 - DNA, 18 bp, Homo sapiens
tgtataagtgtaaatata

SEQ ID NO: 6500730 - DNA, 19 bp, Homo sapiens
tgtataagtgtaaatataa

SEQ ID NO: 6500731 - DNA, 13 bp, Homo sapiens
tgtataagttatt

SEQ ID NO: 6500732 - DNA, 23 bp, Homo sapiens
tgtataagttatttttgtacatg

SEQ ID NO: 6500733 - DNA, 19 bp, Homo sapiens
tgtataagttgaggcattt

SEQ ID NO: 6500734 - DNA, 13 bp, Homo sapiens
tgtataatataaa

SEQ ID NO: 6500735 - DNA, 16 bp, Homo sapiens
tgtataatataaaaaa

SEQ ID NO: 6500736 - DNA, 14 bp, Homo sapiens
tgtataatatatat

SEQ ID NO: 6500737 - DNA, 14 bp, Homo sapiens
tgtataatattgaa

SEQ ID NO: 6500738 - DNA, 22 bp, Homo sapiens
tgtataatcacagttgtgttcc

SEQ ID NO: 6500739 - DNA, 11 bp, Homo sapiens
tgtataatggg

SEQ ID NO: 6500740 - DNA, 13 bp, Homo sapiens
tgtataatgtgat

SEQ ID NO: 6500741 - DNA, 14 bp, Homo sapiens
tgtataatgtgatt

SEQ ID NO: 6500742 - DNA, 22 bp, Homo sapiens
tgtataatgtgcagaaaatatt

SEQ ID NO: 6500743 - DNA, 16 bp, Homo sapiens
tgtataatgtgcttta

SEQ ID NO: 6500744 - DNA, 18 bp, Homo sapiens
tgtataatgttggtgtgg

SEQ ID NO: 6500745 - DNA, 14 bp, Homo sapiens
tgtataattaactt

SEQ ID NO: 6500746 - DNA, 20 bp, Homo sapiens
tgtataattcaaagcaccaa

SEQ ID NO: 6500747 - DNA, 22 bp, Homo sapiens
tgtataatttaacagtgccctt

SEQ ID NO: 6500748 - DNA, 12 bp, Homo sapiens
tgtataatttcg

SEQ ID NO: 6500749 - DNA, 20 bp, Homo sapiens
tgtataatttttttcttgta

SEQ ID NO: 6500750 - DNA, 17 bp, Homo sapiens
tgtatacaaacaggtgc

SEQ ID NO: 6500751 - DNA, 12 bp, Homo sapiens
tgtatacaaata

SEQ ID NO: 6500752 - DNA, 15 bp, Homo sapiens
tgtatacaaatatat

SEQ ID NO: 6500753 - DNA, 16 bp, Homo sapiens
tgtatacaaccctggc

SEQ ID NO: 6500754 - DNA, 19 bp, Homo sapiens
tgtatacaagtactggtaa

SEQ ID NO: 6500755 - DNA, 18 bp, Homo sapiens
tgtatacacaaatatata

SEQ ID NO: 6500756 - DNA, 23 bp, Homo sapiens
tgtatacacacatatacatatat

SEQ ID NO: 6500757 - DNA, 17 bp, Homo sapiens
tgtatacacttaaactt

SEQ ID NO: 6500758 - DNA, 19 bp, Homo sapiens
tgtatacacttaaacttgc

SEQ ID NO: 6500759 - DNA, 15 bp, Homo sapiens
tgtatacatacatgt

SEQ ID NO: 6500760 - DNA, 15 bp, Homo sapiens
tgtatacatatgtat

SEQ ID NO: 6500761 - DNA, 19 bp, Homo sapiens
tgtatacatatgtatgtgt

SEQ ID NO: 6500762 - DNA, 17 bp, Homo sapiens
tgtatacatcctgggta

SEQ ID NO: 6500763 - DNA, 22 bp, Homo sapiens
tgtatacatcttatagatgcaa

SEQ ID NO: 6500764 - DNA, 17 bp, Homo sapiens
tgtatacatgtgtgggt

SEQ ID NO: 6500765 - DNA, 18 bp, Homo sapiens
tgtatacatgtgtgggtg

SEQ ID NO: 6500766 - DNA, 19 bp, Homo sapiens
tgtatacatgtgtgggtgc

SEQ ID NO: 6500767 - DNA, 16 bp, Homo sapiens
tgtatacattttgtta

SEQ ID NO: 6500768 - DNA, 17 bp, Homo sapiens
tgtatacattttgttat

SEQ ID NO: 6500769 - DNA, 16 bp, Homo sapiens
tgcacactttggccca

SEQ ID NO: 6500770 - DNA, 13 bp, Homo sapiens
tgcacagaaaacc

SEQ ID NO: 6500771 - DNA, 14 bp, Homo sapiens
tgcacagaagcaca

SEQ ID NO: 6500772 - DNA, 17 bp, Homo sapiens
tgcacagaagctgtttt

SEQ ID NO: 6500773 - DNA, 16 bp, Homo sapiens
tgcacagaagggctct

SEQ ID NO: 6500774 - DNA, 22 bp, Homo sapiens
tgcacagaagggctctttctct

SEQ ID NO: 6500775 - DNA, 16 bp, Homo sapiens
tgcacagaagtcctgt

SEQ ID NO: 6500776 - DNA, 21 bp, Homo sapiens
tgcacagaagtcctgtatgtc

SEQ ID NO: 6500777 - DNA, 13 bp, Homo sapiens
tgcacagacaagc

SEQ ID NO: 6500778 - DNA, 17 bp, Homo sapiens
tgcacagacaagcagcc

SEQ ID NO: 6500779 - DNA, 15 bp, Homo sapiens
tgcacagacatctcc

SEQ ID NO: 6500780 - DNA, 17 bp, Homo sapiens
tgcacagacctcagaga

SEQ ID NO: 6500781 - DNA, 19 bp, Homo sapiens
tgcacagacgtccctccac

SEQ ID NO: 6500782 - DNA, 18 bp, Homo sapiens
tgcacagagatatgcaca

SEQ ID NO: 6500783 - DNA, 18 bp, Homo sapiens
tgcacagagctctccagc

SEQ ID NO: 6500784 - DNA, 19 bp, Homo sapiens
tgcacagagctctccagct

SEQ ID NO: 6500785 - DNA, 20 bp, Homo sapiens
tgcacagagctctccagctc

SEQ ID NO: 6500786 - DNA, 10 bp, Homo sapiens
tgcacagagg

SEQ ID NO: 6500787 - DNA, 12 bp, Homo sapiens
tgcacagagggc

SEQ ID NO: 6500788 - DNA, 18 bp, Homo sapiens
tgcacagagggcgctcct

SEQ ID NO: 6500789 - DNA, 19 bp, Homo sapiens
tgcacagagggcgctcctg

SEQ ID NO: 6500790 - DNA, 19 bp, Homo sapiens
tgcacagagggtcccattg

SEQ ID NO: 6500791 - DNA, 19 bp, Homo sapiens
tgcacagagttgttacatt

SEQ ID NO: 6500792 - DNA, 10 bp, Homo sapiens
tgcacagata

SEQ ID NO: 6500793 - DNA, 17 bp, Homo sapiens
tgcacagatacctcatc

SEQ ID NO: 6500794 - DNA, 18 bp, Homo sapiens
tgcacagatacctcatca

SEQ ID NO: 6500795 - DNA, 17 bp, Homo sapiens
tgcacagatatttccat

SEQ ID NO: 6500796 - DNA, 23 bp, Homo sapiens
tgcacagatggatttgcctgtgc

SEQ ID NO: 6500797 - DNA, 20 bp, Homo sapiens
tgcacagattaaacttcacc

SEQ ID NO: 6500798 - DNA, 15 bp, Homo sapiens
tgcacagattcccag

SEQ ID NO: 6500799 - DNA, 16 bp, Homo sapiens
tgcacagattcccagg

SEQ ID NO: 6500800 - DNA, 18 bp, Homo sapiens
tgcacagattcccaggcc

SEQ ID NO: 6500801 - DNA, 24 bp, Homo sapiens
tgcacagattcccaggccagggct

SEQ ID NO: 6500802 - DNA, 14 bp, Homo sapiens
tgcacagattgctg

SEQ ID NO: 6500803 - DNA, 20 bp, Homo sapiens
tgcacagattgctgaaactg

SEQ ID NO: 6500804 - DNA, 18 bp, Homo sapiens
tgcacagcacaaattagt

SEQ ID NO: 6500805 - DNA, 23 bp, Homo sapiens
tgcacagcacaaattagttatat

SEQ ID NO: 6500806 - DNA, 12 bp, Homo sapiens
tgcacagcagga

SEQ ID NO: 6500807 - DNA, 14 bp, Homo sapiens
tgcacagcaggacc

SEQ ID NO: 6500808 - DNA, 20 bp, Homo sapiens
tgcacagcatttgctttcct

SEQ ID NO: 6500809 - DNA, 22 bp, Homo sapiens
tgcacagccaacgagacacatt

SEQ ID NO: 6500810 - DNA, 20 bp, Homo sapiens
tgcacagcccaaccaggagg

SEQ ID NO: 6500811 - DNA, 21 bp, Homo sapiens
tgcacagcccaaccaggaggg

SEQ ID NO: 6500812 - DNA, 16 bp, Homo sapiens
tgcacagcggcccctg

SEQ ID NO: 6500813 - DNA, 18 bp, Homo sapiens
tgcacagctaacatggaa

SEQ ID NO: 6500814 - DNA, 20 bp, Homo sapiens
tgcacagctaacatggaagt

SEQ ID NO: 6500815 - DNA, 10 bp, Homo sapiens
tgcacagctg

SEQ ID NO: 6500816 - DNA, 19 bp, Homo sapiens
tgcacagctgcttgtcctg

SEQ ID NO: 6500817 - DNA, 15 bp, Homo sapiens
tgcacagctggagaa

SEQ ID NO: 6500818 - DNA, 19 bp, Homo sapiens
tgcacagctggagaaatgg

SEQ ID NO: 6500819 - DNA, 19 bp, Homo sapiens
tgcacagctgtagtacccc

SEQ ID NO: 6500820 - DNA, 15 bp, Homo sapiens
tgcacagcttcctga

SEQ ID NO: 6500821 - DNA, 19 bp, Homo sapiens
tgcacagcttttccaaaat

SEQ ID NO: 6500822 - DNA, 17 bp, Homo sapiens
tgcacaggaaataagcc

SEQ ID NO: 6500823 - DNA, 12 bp, Homo sapiens
tgcacaggaggg

SEQ ID NO: 6500824 - DNA, 13 bp, Homo sapiens
tgcacaggagggg

SEQ ID NO: 6500825 - DNA, 15 bp, Homo sapiens
tgcacaggagggggt

SEQ ID NO: 6500826 - DNA, 19 bp, Homo sapiens
tgcacaggcacacagggcc

SEQ ID NO: 6500827 - DNA, 23 bp, Homo sapiens
tgcacaggcagagcccagaccct

SEQ ID NO: 6500828 - DNA, 16 bp, Homo sapiens
tgcacaggcagcaagg

SEQ ID NO: 6500829 - DNA, 16 bp, Homo sapiens
tgcacaggccacttgc

SEQ ID NO: 6500830 - DNA, 19 bp, Homo sapiens
tgcacaggccacttgctca

SEQ ID NO: 6500831 - DNA, 20 bp, Homo sapiens
tgcacaggccacttgctcag

SEQ ID NO: 6500832 - DNA, 16 bp, Homo sapiens
tgcacaggccctgggg

SEQ ID NO: 6500833 - DNA, 12 bp, Homo sapiens
tgcacaggcctc

SEQ ID NO: 6500834 - DNA, 19 bp, Homo sapiens
tgcacaggcctctgcctgc

SEQ ID NO: 6500835 - DNA, 20 bp, Homo sapiens
tgcacaggcctctgcctgct

SEQ ID NO: 6500836 - DNA, 18 bp, Homo sapiens
tgcacaggctggaggagg

SEQ ID NO: 6500837 - DNA, 13 bp, Homo sapiens
tgcacaggcttgc

SEQ ID NO: 6500838 - DNA, 15 bp, Homo sapiens
tgcacagggcagctg

SEQ ID NO: 6500839 - DNA, 20 bp, Homo sapiens
tgcacagggcagctgggccc

SEQ ID NO: 6500840 - DNA, 17 bp, Homo sapiens
tgcacaggggaaggaaa

SEQ ID NO: 6500841 - DNA, 16 bp, Homo sapiens
tgcacaggtctctgtt

SEQ ID NO: 6500842 - DNA, 18 bp, Homo sapiens
tgcacaggtctctgttta

SEQ ID NO: 6500843 - DNA, 22 bp, Homo sapiens
tgcacaggtggctgtttcttgt

SEQ ID NO: 6500844 - DNA, 21 bp, Homo sapiens
tgcacagtagtgttgggtgga

SEQ ID NO: 6500845 - DNA, 13 bp, Homo sapiens
tgcacagtatctg

SEQ ID NO: 6500846 - DNA, 20 bp, Homo sapiens
tgcacagtatctgctgttct

SEQ ID NO: 6500847 - DNA, 16 bp, Homo sapiens
tgcacagtatttgtaa

SEQ ID NO: 6500848 - DNA, 19 bp, Homo sapiens
tgcacagtatttgtaatta

SEQ ID NO: 6500849 - DNA, 23 bp, Homo sapiens
tgcacagtatttgtaattaaaag

SEQ ID NO: 6500850 - DNA, 12 bp, Homo sapiens
tgcacagtcaga

SEQ ID NO: 6500851 - DNA, 20 bp, Homo sapiens
tgcacagtcagaaggacggc

SEQ ID NO: 6500852 - DNA, 17 bp, Homo sapiens
tgcacagtccctcctgt

SEQ ID NO: 6500853 - DNA, 20 bp, Homo sapiens
tgcacagtgacttctgagat

SEQ ID NO: 6500854 - DNA, 12 bp, Homo sapiens
tgcacagtgata

SEQ ID NO: 6500855 - DNA, 21 bp, Homo sapiens
tgcacagtgcctgatgggagt

SEQ ID NO: 6500856 - DNA, 15 bp, Homo sapiens
tgcacagtgctgttg

SEQ ID NO: 6500857 - DNA, 17 bp, Homo sapiens
tgcacagtggcttcttt

SEQ ID NO: 6500858 - DNA, 18 bp, Homo sapiens
tgcacagtggtccagggt

SEQ ID NO: 6500859 - DNA, 17 bp, Homo sapiens
tgcacagttctatttgc

SEQ ID NO: 6500860 - DNA, 18 bp, Homo sapiens
tgcacagttgccacattt

SEQ ID NO: 6500861 - DNA, 19 bp, Homo sapiens
tgcacagttggcccgggtg

SEQ ID NO: 6500862 - DNA, 24 bp, Homo sapiens
tgcacagttttctggctggagcct

SEQ ID NO: 6500863 - DNA, 21 bp, Homo sapiens
tgcacataagcttccatttta

SEQ ID NO: 6500864 - DNA, 13 bp, Homo sapiens
tgcacataatttg

SEQ ID NO: 6500865 - DNA, 15 bp, Homo sapiens
tgcacataatttgca

SEQ ID NO: 6500866 - DNA, 17 bp, Homo sapiens
tgcacataatttgcata

SEQ ID NO: 6500867 - DNA, 21 bp, Homo sapiens
tgcacatacgcaccacatctc

SEQ ID NO: 6500868 - DNA, 15 bp, Homo sapiens
tgcacatagcagact

SEQ ID NO: 6500869 - DNA, 19 bp, Homo sapiens
tgcacatagcagactagaa

SEQ ID NO: 6500870 - DNA, 20 bp, Homo sapiens
tgcacatagcagactagaat

SEQ ID NO: 6500871 - DNA, 14 bp, Homo sapiens
tgcacataggcagt

SEQ ID NO: 6500872 - DNA, 23 bp, Homo sapiens
tgcacatagttctgcccaaatta

SEQ ID NO: 6500873 - DNA, 19 bp, Homo sapiens
tgcacatatcaagaagtca

SEQ ID NO: 6500874 - DNA, 14 bp, Homo sapiens
tgcacatatggact

SEQ ID NO: 6500875 - DNA, 17 bp, Homo sapiens
tgcacatatggactctg

SEQ ID NO: 6500876 - DNA, 16 bp, Homo sapiens
tgcacatatgggtgct

SEQ ID NO: 6500877 - DNA, 18 bp, Homo sapiens
tgcacatattgagaacct

SEQ ID NO: 6500878 - DNA, 15 bp, Homo sapiens
tgcacatatttgaat

SEQ ID NO: 6500879 - DNA, 15 bp, Homo sapiens
tgcacatcaaaatat

SEQ ID NO: 6500880 - DNA, 21 bp, Homo sapiens
tgcacatcattcattcactgt

SEQ ID NO: 6500881 - DNA, 16 bp, Homo sapiens
tgcacatccattccca

SEQ ID NO: 6500882 - DNA, 11 bp, Homo sapiens
tgcacatcctc

SEQ ID NO: 6500883 - DNA, 13 bp, Homo sapiens
tgcacatctgttt

SEQ ID NO: 6500884 - DNA, 15 bp, Homo sapiens
tgcacatgaaagttt

SEQ ID NO: 6500885 - DNA, 21 bp, Homo sapiens
tgcacatgaacatatgtccat

SEQ ID NO: 6500886 - DNA, 16 bp, Homo sapiens
tgcacatgaagaaata

SEQ ID NO: 6500887 - DNA, 23 bp, Homo sapiens
tgcacatgaagaaatactgcact

SEQ ID NO: 6500888 - DNA, 16 bp, Homo sapiens
tgcacatgaatgcagt

SEQ ID NO: 6500889 - DNA, 23 bp, Homo sapiens
tgcacatgacatttgtcctgcag

SEQ ID NO: 6500890 - DNA, 21 bp, Homo sapiens
tgcacatgactcgggggtggg

SEQ ID NO: 6500891 - DNA, 17 bp, Homo sapiens
tgcacatgattgtataa

SEQ ID NO: 6500892 - DNA, 19 bp, Homo sapiens
tgcacatgattgtataagc

SEQ ID NO: 6500893 - DNA, 14 bp, Homo sapiens
tgcacatgatttca

SEQ ID NO: 6500894 - DNA, 16 bp, Homo sapiens
tgcacatgatttcaca

SEQ ID NO: 6500895 - DNA, 23 bp, Homo sapiens
tgcacatgatttcacaaatatta

SEQ ID NO: 6500896 - DNA, 18 bp, Homo sapiens
tgcacatgcctctgtaga

SEQ ID NO: 6500897 - DNA, 23 bp, Homo sapiens
tgcacatgctgtctggccctggg

SEQ ID NO: 6500898 - DNA, 23 bp, Homo sapiens
tgcacatggcctgagcatccaga

SEQ ID NO: 6500899 - DNA, 23 bp, Homo sapiens
tgcacatgtaacatagatttatg

SEQ ID NO: 6500900 - DNA, 21 bp, Homo sapiens
tgcacatgtacatatggaaat

SEQ ID NO: 6500901 - DNA, 14 bp, Homo sapiens
tgcacatgtcttaa

SEQ ID NO: 6500902 - DNA, 23 bp, Homo sapiens
tgcacatgtcttgtacatgtgta

SEQ ID NO: 6500903 - DNA, 15 bp, Homo sapiens
tgcacatgtgtctgt

SEQ ID NO: 6500904 - DNA, 14 bp, Homo sapiens
tgcacatgtttcct

SEQ ID NO: 6500905 - DNA, 16 bp, Homo sapiens
tgcacatgtttcctct

SEQ ID NO: 6500906 - DNA, 15 bp, Homo sapiens
tgcacattaaatgac

SEQ ID NO: 6500907 - DNA, 18 bp, Homo sapiens
tgcacattaaatgactct

SEQ ID NO: 6500908 - DNA, 15 bp, Homo sapiens
tgcacattcacttag

SEQ ID NO: 6500909 - DNA, 23 bp, Homo sapiens
tgcacattcacttagcagaacct

SEQ ID NO: 6500910 - DNA, 15 bp, Homo sapiens
tgcacattcatcctc

SEQ ID NO: 6500911 - DNA, 22 bp, Homo sapiens
tgcacattcatcctcacatgtg

SEQ ID NO: 6500912 - DNA, 23 bp, Homo sapiens
tgcacattcatcctcacatgtgg

SEQ ID NO: 6500913 - DNA, 14 bp, Homo sapiens
tgcacattccaaaa

SEQ ID NO: 6500914 - DNA, 16 bp, Homo sapiens
tgcacattctcccttg

SEQ ID NO: 6500915 - DNA, 12 bp, Homo sapiens
tgcacattgcct

SEQ ID NO: 6500916 - DNA, 12 bp, Homo sapiens
tgcacattgttc

SEQ ID NO: 6500917 - DNA, 20 bp, Homo sapiens
tgcacatttatatatatatg

SEQ ID NO: 6500918 - DNA, 13 bp, Homo sapiens
tgcacatttattt

SEQ ID NO: 6500919 - DNA, 22 bp, Homo sapiens
tgcacatttatttcctccctct

SEQ ID NO: 6500920 - DNA, 12 bp, Homo sapiens
tgcacatttctg

SEQ ID NO: 6500921 - DNA, 17 bp, Homo sapiens
tgcacatttctttgcat

SEQ ID NO: 6500922 - DNA, 16 bp, Homo sapiens
tgcacatttggaattg

SEQ ID NO: 6500923 - DNA, 14 bp, Homo sapiens
tgcacattttgatt

SEQ ID NO: 6500924 - DNA, 15 bp, Homo sapiens
tgcacattttgtggc

SEQ ID NO: 6500925 - DNA, 21 bp, Homo sapiens
tgcacattttgtggctgttga

SEQ ID NO: 6500926 - DNA, 15 bp, Homo sapiens
tgcacatttttttct

SEQ ID NO: 6500927 - DNA, 21 bp, Homo sapiens
tgcacatttttttctatgcat

SEQ ID NO: 6500928 - DNA, 11 bp, Homo sapiens
tgcaccaaaga

SEQ ID NO: 6500929 - DNA, 14 bp, Homo sapiens
tgcaccaaagacat

SEQ ID NO: 6500930 - DNA, 13 bp, Homo sapiens
tgcaccaaatagg

SEQ ID NO: 6500931 - DNA, 19 bp, Homo sapiens
tgcaccaaataggatcata

SEQ ID NO: 6500932 - DNA, 15 bp, Homo sapiens
tgcaccaacccagcc

SEQ ID NO: 6500933 - DNA, 20 bp, Homo sapiens
tgcaccaacccagccgctgc

SEQ ID NO: 6500934 - DNA, 17 bp, Homo sapiens
tgcaccaacctcactgc

SEQ ID NO: 6500935 - DNA, 19 bp, Homo sapiens
tgcaccaacctcactgccc

SEQ ID NO: 6500936 - DNA, 21 bp, Homo sapiens
tgcaccaacctcactgccctc

SEQ ID NO: 6500937 - DNA, 17 bp, Homo sapiens
tgcaccaactcacctgg

SEQ ID NO: 6500938 - DNA, 14 bp, Homo sapiens
tgcaccaagcagga

SEQ ID NO: 6500939 - DNA, 20 bp, Homo sapiens
tgcaccacacctggcatggt

SEQ ID NO: 6500940 - DNA, 12 bp, Homo sapiens
tgcaccaccaag

SEQ ID NO: 6500941 - DNA, 15 bp, Homo sapiens
tgcaccaccatgccc

SEQ ID NO: 6500942 - DNA, 16 bp, Homo sapiens
tgcaccaccatgccca

SEQ ID NO: 6500943 - DNA, 14 bp, Homo sapiens
tgcaccactctctt

SEQ ID NO: 6500944 - DNA, 14 bp, Homo sapiens
tgcaccactgcact

SEQ ID NO: 6500945 - DNA, 20 bp, Homo sapiens
tgcaccactgcactccagcc

SEQ ID NO: 6500946 - DNA, 21 bp, Homo sapiens
tgcaccagagtgaaagggcta

SEQ ID NO: 6500947 - DNA, 23 bp, Homo sapiens
tgcaccagagtgaaagggctatg

SEQ ID NO: 6500948 - DNA, 19 bp, Homo sapiens
tgtatacattttgttatag

SEQ ID NO: 6500949 - DNA, 19 bp, Homo sapiens
tgtataccacctgtacata

SEQ ID NO: 6500950 - DNA, 20 bp, Homo sapiens
tgtataccagcctactgtac

SEQ ID NO: 6500951 - DNA, 21 bp, Homo sapiens
tgtataccagcctactgtact

SEQ ID NO: 6500952 - DNA, 19 bp, Homo sapiens
tgtataccctgaagaactc

SEQ ID NO: 6500953 - DNA, 13 bp, Homo sapiens
tgtatacctgtaa

SEQ ID NO: 6500954 - DNA, 16 bp, Homo sapiens
tgtatacgcacgcacc

SEQ ID NO: 6500955 - DNA, 12 bp, Homo sapiens
tgtatactctgt

SEQ ID NO: 6500956 - DNA, 13 bp, Homo sapiens
tgtatactgtaat

SEQ ID NO: 6500957 - DNA, 13 bp, Homo sapiens
tgtatactttaaa

SEQ ID NO: 6500958 - DNA, 14 bp, Homo sapiens
tgtatactttaaat

SEQ ID NO: 6500959 - DNA, 19 bp, Homo sapiens
tgtatagaaaattcttgag

SEQ ID NO: 6500960 - DNA, 23 bp, Homo sapiens
tgtatagaaaattcttgagaagt

SEQ ID NO: 6500961 - DNA, 16 bp, Homo sapiens
tgtatagaacctcttt

SEQ ID NO: 6500962 - DNA, 22 bp, Homo sapiens
tgtatagacagtttgtaaatgt

SEQ ID NO: 6500963 - DNA, 23 bp, Homo sapiens
tgtatagaccaaagcaaagaaaa

SEQ ID NO: 6500964 - DNA, 17 bp, Homo sapiens
tgtatagagaatttaag

SEQ ID NO: 6500965 - DNA, 15 bp, Homo sapiens
tgtatagattagaat

SEQ ID NO: 6500966 - DNA, 22 bp, Homo sapiens
tgtatagattagattatattga

SEQ ID NO: 6500967 - DNA, 22 bp, Homo sapiens
tgtatagcatgtgtattaatgt

SEQ ID NO: 6500968 - DNA, 14 bp, Homo sapiens
tgtataggccatct

SEQ ID NO: 6500969 - DNA, 15 bp, Homo sapiens
tgtataggccatctg

SEQ ID NO: 6500970 - DNA, 18 bp, Homo sapiens
tgtataggccatctgtaa

SEQ ID NO: 6500971 - DNA, 20 bp, Homo sapiens
tgtataggccatctgtaaat

SEQ ID NO: 6500972 - DNA, 19 bp, Homo sapiens
tgtatagggaattttcatt

SEQ ID NO: 6500973 - DNA, 20 bp, Homo sapiens
tgtatagggaattttcattt

SEQ ID NO: 6500974 - DNA, 23 bp, Homo sapiens
tgtatagggaattttcattttca

SEQ ID NO: 6500975 - DNA, 21 bp, Homo sapiens
tgtataggtatgatctgtgta

SEQ ID NO: 6500976 - DNA, 23 bp, Homo sapiens
tgtatagtaaagtgataatttct

SEQ ID NO: 6500977 - DNA, 14 bp, Homo sapiens
tgtatagtatctgt

SEQ ID NO: 6500978 - DNA, 17 bp, Homo sapiens
tgtatagtatctgtata

SEQ ID NO: 6500979 - DNA, 17 bp, Homo sapiens
tgtatagtattggaaaa

SEQ ID NO: 6500980 - DNA, 15 bp, Homo sapiens
tgtatagtatttgaa

SEQ ID NO: 6500981 - DNA, 21 bp, Homo sapiens
tgtatagtatttgaaaacaga

SEQ ID NO: 6500982 - DNA, 15 bp, Homo sapiens
tgtatagtgccacca

SEQ ID NO: 6500983 - DNA, 19 bp, Homo sapiens
tgtatagtgttcacaaact

SEQ ID NO: 6500984 - DNA, 16 bp, Homo sapiens
tgtatagttatgtaaa

SEQ ID NO: 6500985 - DNA, 17 bp, Homo sapiens
tgtatagttatgtaaat

SEQ ID NO: 6500986 - DNA, 19 bp, Homo sapiens
tgtatagttatgtaaataa

SEQ ID NO: 6500987 - DNA, 14 bp, Homo sapiens
tgtatagttcacgt

SEQ ID NO: 6500988 - DNA, 22 bp, Homo sapiens
tgtatagttgcttgcctgatat

SEQ ID NO: 6500989 - DNA, 15 bp, Homo sapiens
tgtatagttgctttt

SEQ ID NO: 6500990 - DNA, 20 bp, Homo sapiens
tgtatagttttacactctag

SEQ ID NO: 6500991 - DNA, 21 bp, Homo sapiens
tgtatagttttataaaactca

SEQ ID NO: 6500992 - DNA, 14 bp, Homo sapiens
tgtatataaaaatg

SEQ ID NO: 6500993 - DNA, 16 bp, Homo sapiens
tgtatataaaaatggc

SEQ ID NO: 6500994 - DNA, 16 bp, Homo sapiens
tgtatataaacatatt

SEQ ID NO: 6500995 - DNA, 18 bp, Homo sapiens
tgtatataaactgggatg

SEQ ID NO: 6500996 - DNA, 20 bp, Homo sapiens
tgtatataaatatattttct

SEQ ID NO: 6500997 - DNA, 17 bp, Homo sapiens
tgtatataagttgctgt

SEQ ID NO: 6500998 - DNA, 18 bp, Homo sapiens
tgtatataatactaaagt

SEQ ID NO: 6500999 - DNA, 21 bp, Homo sapiens
tgtatataatggtgatgtcat

SEQ ID NO: 6501000 - DNA, 16 bp, Homo sapiens
tgtatatacaataaca

SEQ ID NO: 6501001 - DNA, 14 bp, Homo sapiens
tgtatatacacata

SEQ ID NO: 6501002 - DNA, 17 bp, Homo sapiens
tgtatatacacatatac

SEQ ID NO: 6501003 - DNA, 20 bp, Homo sapiens
tgtatatacacatataccta

SEQ ID NO: 6501004 - DNA, 15 bp, Homo sapiens
tgtatatacagttat

SEQ ID NO: 6501005 - DNA, 16 bp, Homo sapiens
tgtatatacagttatt

SEQ ID NO: 6501006 - DNA, 13 bp, Homo sapiens
tgtatatacatat

SEQ ID NO: 6501007 - DNA, 19 bp, Homo sapiens
tgtatatacatattataaa

SEQ ID NO: 6501008 - DNA, 14 bp, Homo sapiens
tgtatatacatttc

SEQ ID NO: 6501009 - DNA, 21 bp, Homo sapiens
tgtatatacgcatctataaat

SEQ ID NO: 6501010 - DNA, 12 bp, Homo sapiens
tgtatatacttt

SEQ ID NO: 6501011 - DNA, 21 bp, Homo sapiens
tgtatatagagattgtacatt

SEQ ID NO: 6501012 - DNA, 22 bp, Homo sapiens
tgtatatagagattgtacattt

SEQ ID NO: 6501013 - DNA, 12 bp, Homo sapiens
tgtatatagatg

SEQ ID NO: 6501014 - DNA, 15 bp, Homo sapiens
tgtatatagatgtgc

SEQ ID NO: 6501015 - DNA, 11 bp, Homo sapiens
tgtatatatac

SEQ ID NO: 6501016 - DNA, 17 bp, Homo sapiens
tgtatatatacataaca

SEQ ID NO: 6501017 - DNA, 17 bp, Homo sapiens
tgtatatatacatacac

SEQ ID NO: 6501018 - DNA, 19 bp, Homo sapiens
tgtatatatacatacactt

SEQ ID NO: 6501019 - DNA, 14 bp, Homo sapiens
tgtatatatacatg

SEQ ID NO: 6501020 - DNA, 17 bp, Homo sapiens
tgtatatatatgtatgt

SEQ ID NO: 6501021 - DNA, 15 bp, Homo sapiens
tgtatatatatgtga

SEQ ID NO: 6501022 - DNA, 20 bp, Homo sapiens
tgtatatatattcatataca

SEQ ID NO: 6501023 - DNA, 20 bp, Homo sapiens
tgtatatatatttatatata

SEQ ID NO: 6501024 - DNA, 17 bp, Homo sapiens
tgtatatatctgcttca

SEQ ID NO: 6501025 - DNA, 15 bp, Homo sapiens
tgtatatatcttata

SEQ ID NO: 6501026 - DNA, 22 bp, Homo sapiens
tgtatatatcttataactgttt

SEQ ID NO: 6501027 - DNA, 15 bp, Homo sapiens
tgtatatatgtcaaa

SEQ ID NO: 6501028 - DNA, 14 bp, Homo sapiens
tgtatatatgtgta

SEQ ID NO: 6501029 - DNA, 21 bp, Homo sapiens
tgtatatatgtgtatatatac

SEQ ID NO: 6501030 - DNA, 22 bp, Homo sapiens
tgtatatatgtgtatatataca

SEQ ID NO: 6501031 - DNA, 18 bp, Homo sapiens
tgtatatattatatatac

SEQ ID NO: 6501032 - DNA, 19 bp, Homo sapiens
tgtatatattatatataca

SEQ ID NO: 6501033 - DNA, 16 bp, Homo sapiens
tgtatatatttagtgc

SEQ ID NO: 6501034 - DNA, 18 bp, Homo sapiens
tgtatatatttagtgctg

SEQ ID NO: 6501035 - DNA, 22 bp, Homo sapiens
tgtatatatttattattttcat

SEQ ID NO: 6501036 - DNA, 22 bp, Homo sapiens
tgtatatattttatatgttcat

SEQ ID NO: 6501037 - DNA, 15 bp, Homo sapiens
tgtatatatttttct

SEQ ID NO: 6501038 - DNA, 19 bp, Homo sapiens
tgtatatcactaaaagcat

SEQ ID NO: 6501039 - DNA, 14 bp, Homo sapiens
tgtatatcagctct

SEQ ID NO: 6501040 - DNA, 20 bp, Homo sapiens
tgtatatccttccaaaaaat

SEQ ID NO: 6501041 - DNA, 22 bp, Homo sapiens
tgtatatccttccaaaaaatta

SEQ ID NO: 6501042 - DNA, 13 bp, Homo sapiens
tgtatatcgttat

SEQ ID NO: 6501043 - DNA, 19 bp, Homo sapiens
tgtatatcgttatcactgt

SEQ ID NO: 6501044 - DNA, 19 bp, Homo sapiens
tgtatatctatatctctaa

SEQ ID NO: 6501045 - DNA, 15 bp, Homo sapiens
tgtatatctctgtaa

SEQ ID NO: 6501046 - DNA, 14 bp, Homo sapiens
tgtatatctgtgta

SEQ ID NO: 6501047 - DNA, 21 bp, Homo sapiens
tgtatatctgtgtaagacacg

SEQ ID NO: 6501048 - DNA, 14 bp, Homo sapiens
tgtatatctttgca

SEQ ID NO: 6501049 - DNA, 16 bp, Homo sapiens
tgtatatctttgcact

SEQ ID NO: 6501050 - DNA, 13 bp, Homo sapiens
tgtatatgaaaac

SEQ ID NO: 6501051 - DNA, 14 bp, Homo sapiens
tgtatatgaaaaca

SEQ ID NO: 6501052 - DNA, 19 bp, Homo sapiens
tgtatatgaggatgtatgt

SEQ ID NO: 6501053 - DNA, 21 bp, Homo sapiens
tgtatatggtatatatacata

SEQ ID NO: 6501054 - DNA, 16 bp, Homo sapiens
tgtatatgtagatgta

SEQ ID NO: 6501055 - DNA, 13 bp, Homo sapiens
tgtatatgtataa

SEQ ID NO: 6501056 - DNA, 14 bp, Homo sapiens
tgtatatgtataaa

SEQ ID NO: 6501057 - DNA, 18 bp, Homo sapiens
tgtatatgtataaattaa

SEQ ID NO: 6501058 - DNA, 14 bp, Homo sapiens
tgtatatgtatata

SEQ ID NO: 6501059 - DNA, 12 bp, Homo sapiens
tgtatatgtatt

SEQ ID NO: 6501060 - DNA, 23 bp, Homo sapiens
tgtatatgtattcccttgtattt

SEQ ID NO: 6501061 - DNA, 14 bp, Homo sapiens
tgtatatgtattta

SEQ ID NO: 6501062 - DNA, 19 bp, Homo sapiens
tgtatatgtctagataaaa

SEQ ID NO: 6501063 - DNA, 18 bp, Homo sapiens
tgtatatgtgattttcaa

SEQ ID NO: 6501064 - DNA, 19 bp, Homo sapiens
tgtatatgtgattttcaaa

SEQ ID NO: 6501065 - DNA, 13 bp, Homo sapiens
tgtatatgtgctt

SEQ ID NO: 6501066 - DNA, 14 bp, Homo sapiens
tgtatatgttgtaa

SEQ ID NO: 6501067 - DNA, 16 bp, Homo sapiens
tgtatatgttgtaata

SEQ ID NO: 6501068 - DNA, 13 bp, Homo sapiens
tgtatatgtttat

SEQ ID NO: 6501069 - DNA, 19 bp, Homo sapiens
tgtatatgtttatacacac

SEQ ID NO: 6501070 - DNA, 19 bp, Homo sapiens
tgtatatgtttatatactg

SEQ ID NO: 6501071 - DNA, 13 bp, Homo sapiens
tgtatattaaaat

SEQ ID NO: 6501072 - DNA, 21 bp, Homo sapiens
tgtatattaagaagcaataac

SEQ ID NO: 6501073 - DNA, 13 bp, Homo sapiens
tgtatattacacc

SEQ ID NO: 6501074 - DNA, 19 bp, Homo sapiens
tgtatattacccaatggaa

SEQ ID NO: 6501075 - DNA, 20 bp, Homo sapiens
tgtatattacccaatggaaa

SEQ ID NO: 6501076 - DNA, 20 bp, Homo sapiens
tgtatattatcttctggtgc

SEQ ID NO: 6501077 - DNA, 23 bp, Homo sapiens
tgtatattatggaagattttaaa

SEQ ID NO: 6501078 - DNA, 21 bp, Homo sapiens
tgtatattatttctaggaaga

SEQ ID NO: 6501079 - DNA, 22 bp, Homo sapiens
tgtatattatttggcagtttgg

SEQ ID NO: 6501080 - DNA, 15 bp, Homo sapiens
tgtatattccaccat

SEQ ID NO: 6501081 - DNA, 22 bp, Homo sapiens
tgtatattccaccattcacatt

SEQ ID NO: 6501082 - DNA, 21 bp, Homo sapiens
tgtatattccttttaaagaag

SEQ ID NO: 6501083 - DNA, 16 bp, Homo sapiens
tgtatattctggaaaa

SEQ ID NO: 6501084 - DNA, 13 bp, Homo sapiens
tgtatattggttt

SEQ ID NO: 6501085 - DNA, 17 bp, Homo sapiens
tgtatattgtaatttaa

SEQ ID NO: 6501086 - DNA, 21 bp, Homo sapiens
tgtatattgtggatgtgttca

SEQ ID NO: 6501087 - DNA, 13 bp, Homo sapiens
tgtatatttaagg

SEQ ID NO: 6501088 - DNA, 19 bp, Homo sapiens
tgtatatttaattaaagca

SEQ ID NO: 6501089 - DNA, 15 bp, Homo sapiens
tgtatatttaggaaa

SEQ ID NO: 6501090 - DNA, 20 bp, Homo sapiens
tgtatatttatgaccagagc

SEQ ID NO: 6501091 - DNA, 13 bp, Homo sapiens
tgtatatttattc

SEQ ID NO: 6501092 - DNA, 16 bp, Homo sapiens
tgtatatttattcata

SEQ ID NO: 6501093 - DNA, 12 bp, Homo sapiens
tgtatatttgat

SEQ ID NO: 6501094 - DNA, 13 bp, Homo sapiens
tgtatatttgcaa

SEQ ID NO: 6501095 - DNA, 18 bp, Homo sapiens
tgtatatttgctgcaaag

SEQ ID NO: 6501096 - DNA, 15 bp, Homo sapiens
tgtatatttgtacaa

SEQ ID NO: 6501097 - DNA, 13 bp, Homo sapiens
tgtatatttgtat

SEQ ID NO: 6501098 - DNA, 15 bp, Homo sapiens
tgtatatttgtcatg

SEQ ID NO: 6501099 - DNA, 17 bp, Homo sapiens
tgtatatttgtcatgac

SEQ ID NO: 6501100 - DNA, 22 bp, Homo sapiens
tgtatattttaagaaataacag

SEQ ID NO: 6501101 - DNA, 17 bp, Homo sapiens
tgtatattttaatgaat

SEQ ID NO: 6501102 - DNA, 18 bp, Homo sapiens
tgtatattttaatgtttt

SEQ ID NO: 6501103 - DNA, 12 bp, Homo sapiens
tgtatattttat

SEQ ID NO: 6501104 - DNA, 15 bp, Homo sapiens
tgtatattttatata

SEQ ID NO: 6501105 - DNA, 19 bp, Homo sapiens
tgtatattttcagtgggtt

SEQ ID NO: 6501106 - DNA, 21 bp, Homo sapiens
tgtatatttttaaagaatgtt

SEQ ID NO: 6501107 - DNA, 14 bp, Homo sapiens
tgtatcaaaatgct

SEQ ID NO: 6501108 - DNA, 21 bp, Homo sapiens
tgtatcaaatctgtatatgtt

SEQ ID NO: 6501109 - DNA, 14 bp, Homo sapiens
tgtatcaaatgtta

SEQ ID NO: 6501110 - DNA, 15 bp, Homo sapiens
tgtatcaataaaatt

SEQ ID NO: 6501111 - DNA, 20 bp, Homo sapiens
tgtatcaataaaattctgta

SEQ ID NO: 6501112 - DNA, 24 bp, Homo sapiens
tgtatcaataaaattctgtaattt

SEQ ID NO: 6501113 - DNA, 14 bp, Homo sapiens
tgtatcaatttcta

SEQ ID NO: 6501114 - DNA, 17 bp, Homo sapiens
tgtatcaatttctaatg

SEQ ID NO: 6501115 - DNA, 14 bp, Homo sapiens
tgtatcagatgtga

SEQ ID NO: 6501116 - DNA, 19 bp, Homo sapiens
tgtatcaggtcagggactt

SEQ ID NO: 6501117 - DNA, 21 bp, Homo sapiens
tgtatcaggtgcccatccctg

SEQ ID NO: 6501118 - DNA, 13 bp, Homo sapiens
tgtatcagtgttt

SEQ ID NO: 6501119 - DNA, 18 bp, Homo sapiens
tgtatcagtgtttatgtg

SEQ ID NO: 6501120 - DNA, 16 bp, Homo sapiens
tgtatcatagaaatgt

SEQ ID NO: 6501121 - DNA, 20 bp, Homo sapiens
tgtatcattaaaatatatgt

SEQ ID NO: 6501122 - DNA, 19 bp, Homo sapiens
tgtatcatttttgtgcaca

SEQ ID NO: 6501123 - DNA, 22 bp, Homo sapiens
tgtatccaattttaatgataaa

SEQ ID NO: 6501124 - DNA, 15 bp, Homo sapiens
tgtatccaggcctgg

SEQ ID NO: 6501125 - DNA, 14 bp, Homo sapiens
tgtatccagtgatg

SEQ ID NO: 6501126 - DNA, 18 bp, Homo sapiens
tgtatccagtgatgtgct

SEQ ID NO: 6501127 - DNA, 13 bp, Homo sapiens
tgcaccagccctt

SEQ ID NO: 6501128 - DNA, 17 bp, Homo sapiens
tgcaccagcccttccct

SEQ ID NO: 6501129 - DNA, 18 bp, Homo sapiens
tgcaccagcgcccccaga

SEQ ID NO: 6501130 - DNA, 14 bp, Homo sapiens
tgcaccaggagaca

SEQ ID NO: 6501131 - DNA, 20 bp, Homo sapiens
tgcaccaggggtgcacaata

SEQ ID NO: 6501132 - DNA, 16 bp, Homo sapiens
tgcaccagtgccgcct

SEQ ID NO: 6501133 - DNA, 17 bp, Homo sapiens
tgcaccagtgccgcctg

SEQ ID NO: 6501134 - DNA, 19 bp, Homo sapiens
tgcaccagtgccgcctgtg

SEQ ID NO: 6501135 - DNA, 22 bp, Homo sapiens
tgcaccagtgccgcctgtgccc

SEQ ID NO: 6501136 - DNA, 19 bp, Homo sapiens
tgcaccagttttatccata

SEQ ID NO: 6501137 - DNA, 21 bp, Homo sapiens
tgcaccagttttatccataat

SEQ ID NO: 6501138 - DNA, 22 bp, Homo sapiens
tgcaccatgctgctggggaaga

SEQ ID NO: 6501139 - DNA, 23 bp, Homo sapiens
tgcaccattgcgctctagcctgg

SEQ ID NO: 6501140 - DNA, 17 bp, Homo sapiens
tgcacccacccaggagt

SEQ ID NO: 6501141 - DNA, 14 bp, Homo sapiens
tgcacccacccctg

SEQ ID NO: 6501142 - DNA, 19 bp, Homo sapiens
tgcacccacccctgcccag

SEQ ID NO: 6501143 - DNA, 16 bp, Homo sapiens
tgcacccacctgtttt

SEQ ID NO: 6501144 - DNA, 15 bp, Homo sapiens
tgcacccactcacca

SEQ ID NO: 6501145 - DNA, 20 bp, Homo sapiens
tgcacccactcaccagggtc

SEQ ID NO: 6501146 - DNA, 22 bp, Homo sapiens
tgcacccagccccaaggggtgg

SEQ ID NO: 6501147 - DNA, 13 bp, Homo sapiens
tgcacccagccct

SEQ ID NO: 6501148 - DNA, 15 bp, Homo sapiens
tgcacccagccctgg

SEQ ID NO: 6501149 - DNA, 17 bp, Homo sapiens
tgcacccagctccaggg

SEQ ID NO: 6501150 - DNA, 18 bp, Homo sapiens
tgcacccagctccagggg

SEQ ID NO: 6501151 - DNA, 16 bp, Homo sapiens
tgcacccatgccatag

SEQ ID NO: 6501152 - DNA, 18 bp, Homo sapiens
tgcaccccaaagctttcc

SEQ ID NO: 6501153 - DNA, 19 bp, Homo sapiens
tgcaccccaaagctttcct

SEQ ID NO: 6501154 - DNA, 12 bp, Homo sapiens
tgcaccccagca

SEQ ID NO: 6501155 - DNA, 19 bp, Homo sapiens
tgcaccccagcattccagc

SEQ ID NO: 6501156 - DNA, 20 bp, Homo sapiens
tgcaccccagcgtcaggcct

SEQ ID NO: 6501157 - DNA, 16 bp, Homo sapiens
tgcacccccctgtgcc

SEQ ID NO: 6501158 - DNA, 15 bp, Homo sapiens
tgcaccccctcctgc

SEQ ID NO: 6501159 - DNA, 18 bp, Homo sapiens
tgcaccccctcctgctgc

SEQ ID NO: 6501160 - DNA, 21 bp, Homo sapiens
tgcaccccgccggaggaaggt

SEQ ID NO: 6501161 - DNA, 12 bp, Homo sapiens
tgcacccctccc

SEQ ID NO: 6501162 - DNA, 15 bp, Homo sapiens
tgcacccctcccatt

SEQ ID NO: 6501163 - DNA, 18 bp, Homo sapiens
tgcacccctccggccccg

SEQ ID NO: 6501164 - DNA, 22 bp, Homo sapiens
tgcacccctgagttgggcagcc

SEQ ID NO: 6501165 - DNA, 18 bp, Homo sapiens
tgcacccctgcccccagg

SEQ ID NO: 6501166 - DNA, 14 bp, Homo sapiens
tgcacccctggaac

SEQ ID NO: 6501167 - DNA, 15 bp, Homo sapiens
tgcaccccttcctcc

SEQ ID NO: 6501168 - DNA, 17 bp, Homo sapiens
tgcaccccttcctgggc

SEQ ID NO: 6501169 - DNA, 19 bp, Homo sapiens
tgcaccccttctctcctcc

SEQ ID NO: 6501170 - DNA, 21 bp, Homo sapiens
tgcacccctttcctccccata

SEQ ID NO: 6501171 - DNA, 17 bp, Homo sapiens
tgcacccgcatgtacaa

SEQ ID NO: 6501172 - DNA, 20 bp, Homo sapiens
tgcacccggcctggatgcca

SEQ ID NO: 6501173 - DNA, 13 bp, Homo sapiens
tgcacccgtaccc

SEQ ID NO: 6501174 - DNA, 22 bp, Homo sapiens
tgcacccgtacccccgtggtct

SEQ ID NO: 6501175 - DNA, 19 bp, Homo sapiens
tgcaccctcaacctcctgg

SEQ ID NO: 6501176 - DNA, 15 bp, Homo sapiens
tgcaccctccacagg

SEQ ID NO: 6501177 - DNA, 14 bp, Homo sapiens
tgcaccctccaccc

SEQ ID NO: 6501178 - DNA, 17 bp, Homo sapiens
tgcaccctccaccctgt

SEQ ID NO: 6501179 - DNA, 21 bp, Homo sapiens
tgcaccctccctcctgccgct

SEQ ID NO: 6501180 - DNA, 20 bp, Homo sapiens
tgcaccctcttctcctctgg

SEQ ID NO: 6501181 - DNA, 21 bp, Homo sapiens
tgcaccctcttctcctctggc

SEQ ID NO: 6501182 - DNA, 12 bp, Homo sapiens
tgcaccctggaa

SEQ ID NO: 6501183 - DNA, 21 bp, Homo sapiens
tgcaccctgtagatgttctag

SEQ ID NO: 6501184 - DNA, 13 bp, Homo sapiens
tgcacccttccct

SEQ ID NO: 6501185 - DNA, 17 bp, Homo sapiens
tgcacccttccctcttc

SEQ ID NO: 6501186 - DNA, 15 bp, Homo sapiens
tgcacccttcctcct

SEQ ID NO: 6501187 - DNA, 13 bp, Homo sapiens
tgcacccttcttt

SEQ ID NO: 6501188 - DNA, 23 bp, Homo sapiens
tgcacccttcttttctcatgtgt

SEQ ID NO: 6501189 - DNA, 17 bp, Homo sapiens
tgcaccgacccgaggcc

SEQ ID NO: 6501190 - DNA, 21 bp, Homo sapiens
tgcaccgacccgaggcccaga

SEQ ID NO: 6501191 - DNA, 18 bp, Homo sapiens
tgcaccgagtgatttcca

SEQ ID NO: 6501192 - DNA, 16 bp, Homo sapiens
tgcaccgccgcagaag

SEQ ID NO: 6501193 - DNA, 14 bp, Homo sapiens
tgcaccgcctgccc

SEQ ID NO: 6501194 - DNA, 18 bp, Homo sapiens
tgcaccgcctgccctccc

SEQ ID NO: 6501195 - DNA, 13 bp, Homo sapiens
tgcaccggacagt

SEQ ID NO: 6501196 - DNA, 14 bp, Homo sapiens
tgcaccggctggcc

SEQ ID NO: 6501197 - DNA, 21 bp, Homo sapiens
tgcaccggctggcctggcccc

SEQ ID NO: 6501198 - DNA, 15 bp, Homo sapiens
tgcaccgggccacag

SEQ ID NO: 6501199 - DNA, 22 bp, Homo sapiens
tgcaccgggccacagagaaagt

SEQ ID NO: 6501200 - DNA, 15 bp, Homo sapiens
tgcaccgttgggacc

SEQ ID NO: 6501201 - DNA, 14 bp, Homo sapiens
tgcacctaaagaaa

SEQ ID NO: 6501202 - DNA, 19 bp, Homo sapiens
tgcacctaccccttggaaa

SEQ ID NO: 6501203 - DNA, 17 bp, Homo sapiens
tgcacctagagcttttt

SEQ ID NO: 6501204 - DNA, 22 bp, Homo sapiens
tgcacctagagcttttttataa

SEQ ID NO: 6501205 - DNA, 19 bp, Homo sapiens
tgcacctagctgtgcaaga

SEQ ID NO: 6501206 - DNA, 21 bp, Homo sapiens
tgcacctatggcccagccact

SEQ ID NO: 6501207 - DNA, 23 bp, Homo sapiens
tgcacctattctgtagttgcagc

SEQ ID NO: 6501208 - DNA, 20 bp, Homo sapiens
tgcacctcaaatcttctaat

SEQ ID NO: 6501209 - DNA, 13 bp, Homo sapiens
tgcacctccccaa

SEQ ID NO: 6501210 - DNA, 22 bp, Homo sapiens
tgcacctccctccccagctccg

SEQ ID NO: 6501211 - DNA, 18 bp, Homo sapiens
tgcacctcccttccctcc

SEQ ID NO: 6501212 - DNA, 23 bp, Homo sapiens
tgcacctccgcgggctgactggg

SEQ ID NO: 6501213 - DNA, 21 bp, Homo sapiens
tgcacctcctaccctcccacc

SEQ ID NO: 6501214 - DNA, 16 bp, Homo sapiens
tgcacctctcatcagc

SEQ ID NO: 6501215 - DNA, 13 bp, Homo sapiens
tgcacctctggct

SEQ ID NO: 6501216 - DNA, 21 bp, Homo sapiens
tgcacctctggctagagccga

SEQ ID NO: 6501217 - DNA, 13 bp, Homo sapiens
tgcacctgagacc

SEQ ID NO: 6501218 - DNA, 18 bp, Homo sapiens
tgcacctgagcctgttcc

SEQ ID NO: 6501219 - DNA, 13 bp, Homo sapiens
tgcacctgcagcc

SEQ ID NO: 6501220 - DNA, 13 bp, Homo sapiens
tgcacctgcaggc

SEQ ID NO: 6501221 - DNA, 19 bp, Homo sapiens
tgcacctgcagggagcagc

SEQ ID NO: 6501222 - DNA, 15 bp, Homo sapiens
tgcacctgccagcct

SEQ ID NO: 6501223 - DNA, 17 bp, Homo sapiens
tgcacctgccagcctgg

SEQ ID NO: 6501224 - DNA, 18 bp, Homo sapiens
tgcacctgccagcctggc

SEQ ID NO: 6501225 - DNA, 19 bp, Homo sapiens
tgcacctgccagcctggct

SEQ ID NO: 6501226 - DNA, 16 bp, Homo sapiens
tgcacctgcccagctc

SEQ ID NO: 6501227 - DNA, 14 bp, Homo sapiens
tgcacctgcctcca

SEQ ID NO: 6501228 - DNA, 16 bp, Homo sapiens
tgcacctgcctccacc

SEQ ID NO: 6501229 - DNA, 20 bp, Homo sapiens
tgcacctgcctccaccagca

SEQ ID NO: 6501230 - DNA, 21 bp, Homo sapiens
tgcacctgcgcctggctctgt

SEQ ID NO: 6501231 - DNA, 20 bp, Homo sapiens
  misc_feature (10)..(10): n is a, c, g or t
tgcacctgcnttgtccctgg

SEQ ID NO: 6501232 - DNA, 12 bp, Homo sapiens
tgcacctgctgc

SEQ ID NO: 6501233 - DNA, 16 bp, Homo sapiens
tgcacctgctgcgtcc

SEQ ID NO: 6501234 - DNA, 23 bp, Homo sapiens
tgcacctgctgcgtccccactcc

SEQ ID NO: 6501235 - DNA, 24 bp, Homo sapiens
tgcacctgctgcgtccccactccc

SEQ ID NO: 6501236 - DNA, 14 bp, Homo sapiens
tgcacctgcttctc

SEQ ID NO: 6501237 - DNA, 15 bp, Homo sapiens
tgcacctgcttctca

SEQ ID NO: 6501238 - DNA, 20 bp, Homo sapiens
tgcacctggaatatataacc

SEQ ID NO: 6501239 - DNA, 22 bp, Homo sapiens
tgcacctggaatatataaccag

SEQ ID NO: 6501240 - DNA, 12 bp, Homo sapiens
tgcacctggcct

SEQ ID NO: 6501241 - DNA, 13 bp, Homo sapiens
tgcacctgggaca

SEQ ID NO: 6501242 - DNA, 19 bp, Homo sapiens
tgcacctgggcagctcctc

SEQ ID NO: 6501243 - DNA, 16 bp, Homo sapiens
tgcacctgtactcagg

SEQ ID NO: 6501244 - DNA, 17 bp, Homo sapiens
tgcacctgtccccaccc

SEQ ID NO: 6501245 - DNA, 16 bp, Homo sapiens
tgcaccttacattcct

SEQ ID NO: 6501246 - DNA, 17 bp, Homo sapiens
tgcaccttacattccta

SEQ ID NO: 6501247 - DNA, 18 bp, Homo sapiens
tgcaccttaccaactttc

SEQ ID NO: 6501248 - DNA, 21 bp, Homo sapiens
tgcaccttaccaactttctgt

SEQ ID NO: 6501249 - DNA, 21 bp, Homo sapiens
tgcaccttcactctccagggt

SEQ ID NO: 6501250 - DNA, 12 bp, Homo sapiens
tgcaccttcagc

SEQ ID NO: 6501251 - DNA, 14 bp, Homo sapiens
tgcaccttctgacg

SEQ ID NO: 6501252 - DNA, 12 bp, Homo sapiens
tgcaccttgtga

SEQ ID NO: 6501253 - DNA, 14 bp, Homo sapiens
tgcaccttgtgtct

SEQ ID NO: 6501254 - DNA, 16 bp, Homo sapiens
tgcaccttgtgtctgt

SEQ ID NO: 6501255 - DNA, 18 bp, Homo sapiens
tgcacctttctagttgaa

SEQ ID NO: 6501256 - DNA, 20 bp, Homo sapiens
tgcaccttttcatgtacagc

SEQ ID NO: 6501257 - DNA, 20 bp, Homo sapiens
tgcacgaactggactgtgtg

SEQ ID NO: 6501258 - DNA, 16 bp, Homo sapiens
tgcacgcacactgtct

SEQ ID NO: 6501259 - DNA, 22 bp, Homo sapiens
tgcacgcccatgtgtgagtgtg

SEQ ID NO: 6501260 - DNA, 17 bp, Homo sapiens
tgcacgcggactccggg

SEQ ID NO: 6501261 - DNA, 15 bp, Homo sapiens
tgcacgctcaatgcc

SEQ ID NO: 6501262 - DNA, 20 bp, Homo sapiens
tgcacgctcccctccatccc

SEQ ID NO: 6501263 - DNA, 22 bp, Homo sapiens
tgcacgctcccctccatcccca

SEQ ID NO: 6501264 - DNA, 14 bp, Homo sapiens
tgcacgctggggaa

SEQ ID NO: 6501265 - DNA, 18 bp, Homo sapiens
tgcacggctgctcggctt

SEQ ID NO: 6501266 - DNA, 15 bp, Homo sapiens
tgcacggctgctgag

SEQ ID NO: 6501267 - DNA, 15 bp, Homo sapiens
tgcacggggccagca

SEQ ID NO: 6501268 - DNA, 20 bp, Homo sapiens
tgcacgggggaactgtgtgt

SEQ ID NO: 6501269 - DNA, 18 bp, Homo sapiens
tgcacggtgaatggcttt

SEQ ID NO: 6501270 - DNA, 23 bp, Homo sapiens
tgcacggtttcgaagtcattaaa

SEQ ID NO: 6501271 - DNA, 21 bp, Homo sapiens
tgcacgtaaagtacttgtagt

SEQ ID NO: 6501272 - DNA, 11 bp, Homo sapiens
tgcacgtgcaa

SEQ ID NO: 6501273 - DNA, 23 bp, Homo sapiens
tgcacgtgcacacacctgcacac

SEQ ID NO: 6501274 - DNA, 20 bp, Homo sapiens
tgcacgtgctcttctgttct

SEQ ID NO: 6501275 - DNA, 23 bp, Homo sapiens
tgcacgtgctcttctgttctcaa

SEQ ID NO: 6501276 - DNA, 15 bp, Homo sapiens
tgcacgtggcctctt

SEQ ID NO: 6501277 - DNA, 19 bp, Homo sapiens
tgcacgtggcctcttgagc

SEQ ID NO: 6501278 - DNA, 16 bp, Homo sapiens
tgcacgtggcttctga

SEQ ID NO: 6501279 - DNA, 14 bp, Homo sapiens
tgcacgtgtctggg

SEQ ID NO: 6501280 - DNA, 17 bp, Homo sapiens
tgcacgtgtctgggtat

SEQ ID NO: 6501281 - DNA, 14 bp, Homo sapiens
tgcacgtgtgtgca

SEQ ID NO: 6501282 - DNA, 15 bp, Homo sapiens
tgcacgtgtgtgcac

SEQ ID NO: 6501283 - DNA, 15 bp, Homo sapiens
tgcacgtgtgttttt

SEQ ID NO: 6501284 - DNA, 19 bp, Homo sapiens
tgcacgtgtgtttttctat

SEQ ID NO: 6501285 - DNA, 22 bp, Homo sapiens
tgcacgtgtgtttttctattaa

SEQ ID NO: 6501286 - DNA, 20 bp, Homo sapiens
tgcacgttatggtgtttctc

SEQ ID NO: 6501287 - DNA, 14 bp, Homo sapiens
tgcacgtttgtaat

SEQ ID NO: 6501288 - DNA, 18 bp, Homo sapiens
tgcactaaagccagcctg

SEQ ID NO: 6501289 - DNA, 22 bp, Homo sapiens
tgcactaaagccagcctgacct

SEQ ID NO: 6501290 - DNA, 16 bp, Homo sapiens
tgcactaaatgaatct

SEQ ID NO: 6501291 - DNA, 19 bp, Homo sapiens
tgcactaaccccagctgcc

SEQ ID NO: 6501292 - DNA, 23 bp, Homo sapiens
tgcactaagagaaaattgcacta

SEQ ID NO: 6501293 - DNA, 15 bp, Homo sapiens
tgcactaaggggccc

SEQ ID NO: 6501294 - DNA, 17 bp, Homo sapiens
tgcactaaggggcccgg

SEQ ID NO: 6501295 - DNA, 23 bp, Homo sapiens
tgcactaaggggcccggccagcc

SEQ ID NO: 6501296 - DNA, 22 bp, Homo sapiens
tgcactaatgtgttatgagaaa

SEQ ID NO: 6501297 - DNA, 18 bp, Homo sapiens
tgcactacattatggaat

SEQ ID NO: 6501298 - DNA, 15 bp, Homo sapiens
tgcactactcctctg

SEQ ID NO: 6501299 - DNA, 23 bp, Homo sapiens
tgcactactcctctgcagtgcct

SEQ ID NO: 6501300 - DNA, 14 bp, Homo sapiens
tgcactactgacat

SEQ ID NO: 6501301 - DNA, 15 bp, Homo sapiens
tgcactactgacatg

SEQ ID NO: 6501302 - DNA, 18 bp, Homo sapiens
tgcactactgacatgtgg

SEQ ID NO: 6501303 - DNA, 18 bp, Homo sapiens
tgcactagagaaaataaa

SEQ ID NO: 6501304 - DNA, 15 bp, Homo sapiens
tgcactaggaattct

SEQ ID NO: 6501305 - DNA, 14 bp, Homo sapiens
tgtatccatgtaat

SEQ ID NO: 6501306 - DNA, 18 bp, Homo sapiens
tgtatccattaacctggg

SEQ ID NO: 6501307 - DNA, 18 bp, Homo sapiens
tgtatccattatcatgtg

SEQ ID NO: 6501308 - DNA, 22 bp, Homo sapiens
tgtatccattatcatgtgtaat

SEQ ID NO: 6501309 - DNA, 14 bp, Homo sapiens
tgtatccattctac

SEQ ID NO: 6501310 - DNA, 16 bp, Homo sapiens
tgtatcccatgagcct

SEQ ID NO: 6501311 - DNA, 21 bp, Homo sapiens
tgtatcccccccctgtatagt

SEQ ID NO: 6501312 - DNA, 18 bp, Homo sapiens
tgtatcccgggaaggacc

SEQ ID NO: 6501313 - DNA, 20 bp, Homo sapiens
tgtatcccttctcacagcac

SEQ ID NO: 6501314 - DNA, 15 bp, Homo sapiens
tgtatccgactctaa

SEQ ID NO: 6501315 - DNA, 18 bp, Homo sapiens
tgtatccgactctaagct

SEQ ID NO: 6501316 - DNA, 21 bp, Homo sapiens
tgtatccgactctaagctgtg

SEQ ID NO: 6501317 - DNA, 22 bp, Homo sapiens
tgtatccgactctaagctgtgt

SEQ ID NO: 6501318 - DNA, 20 bp, Homo sapiens
tgtatccgtgaattgcttta

SEQ ID NO: 6501319 - DNA, 21 bp, Homo sapiens
tgtatcctggcaaataatact

SEQ ID NO: 6501320 - DNA, 13 bp, Homo sapiens
tgtatcctggggc

SEQ ID NO: 6501321 - DNA, 14 bp, Homo sapiens
tgtatcctggggct

SEQ ID NO: 6501322 - DNA, 15 bp, Homo sapiens
tgtatcctggggctc

SEQ ID NO: 6501323 - DNA, 19 bp, Homo sapiens
tgtatcctggggctccctt

SEQ ID NO: 6501324 - DNA, 22 bp, Homo sapiens
tgtatcgcatattagttaatct

SEQ ID NO: 6501325 - DNA, 15 bp, Homo sapiens
tgtatcggagacagt

SEQ ID NO: 6501326 - DNA, 20 bp, Homo sapiens
tgtatcggagggaaacagaa

SEQ ID NO: 6501327 - DNA, 19 bp, Homo sapiens
tgtatcgtatagctgtatt

SEQ ID NO: 6501328 - DNA, 22 bp, Homo sapiens
tgtatcgtatagctgtattgaa

SEQ ID NO: 6501329 - DNA, 17 bp, Homo sapiens
tgtatcgtggagaaaca

SEQ ID NO: 6501330 - DNA, 18 bp, Homo sapiens
tgtatctaaaaaataact

SEQ ID NO: 6501331 - DNA, 12 bp, Homo sapiens
tgtatctaagaa

SEQ ID NO: 6501332 - DNA, 12 bp, Homo sapiens
tgtatctaattc

SEQ ID NO: 6501333 - DNA, 15 bp, Homo sapiens
tgtatctacaataca

SEQ ID NO: 6501334 - DNA, 23 bp, Homo sapiens
tgtatctacaatacatatatcta

SEQ ID NO: 6501335 - DNA, 20 bp, Homo sapiens
tgtatctacattaaaatgac

SEQ ID NO: 6501336 - DNA, 14 bp, Homo sapiens
tgtatctagctcta

SEQ ID NO: 6501337 - DNA, 19 bp, Homo sapiens
tgtatctagcttcttcaga

SEQ ID NO: 6501338 - DNA, 16 bp, Homo sapiens
tgtatctatttgtaca

SEQ ID NO: 6501339 - DNA, 14 bp, Homo sapiens
tgtatctcaataaa

SEQ ID NO: 6501340 - DNA, 15 bp, Homo sapiens
tgtatctcaataaag

SEQ ID NO: 6501341 - DNA, 16 bp, Homo sapiens
tgtatctcaataaagc

SEQ ID NO: 6501342 - DNA, 17 bp, Homo sapiens
tgtatctcatactgtct

SEQ ID NO: 6501343 - DNA, 18 bp, Homo sapiens
tgtatctctgaagcatgt

SEQ ID NO: 6501344 - DNA, 21 bp, Homo sapiens
tgtatctctgaagcatgtttc

SEQ ID NO: 6501345 - DNA, 13 bp, Homo sapiens
tgtatctcttaaa

SEQ ID NO: 6501346 - DNA, 22 bp, Homo sapiens
tgtatctgaaggagattttcct

SEQ ID NO: 6501347 - DNA, 15 bp, Homo sapiens
tgtatctgacatatt

SEQ ID NO: 6501348 - DNA, 21 bp, Homo sapiens
tgtatctgacccactttgtaa

SEQ ID NO: 6501349 - DNA, 13 bp, Homo sapiens
tgtatctgagcag

SEQ ID NO: 6501350 - DNA, 15 bp, Homo sapiens
tgtatctgagttgcc

SEQ ID NO: 6501351 - DNA, 19 bp, Homo sapiens
tgtatctgagttgccaaga

SEQ ID NO: 6501352 - DNA, 17 bp, Homo sapiens
tgtatctgcaggcagac

SEQ ID NO: 6501353 - DNA, 21 bp, Homo sapiens
tgtatctgcaggcagacacgg

SEQ ID NO: 6501354 - DNA, 14 bp, Homo sapiens
tgtatctgtctact

SEQ ID NO: 6501355 - DNA, 12 bp, Homo sapiens
tgtatctgtctt

SEQ ID NO: 6501356 - DNA, 15 bp, Homo sapiens
tgtatctgtctttcc

SEQ ID NO: 6501357 - DNA, 20 bp, Homo sapiens
tgtatctgtctttccactct

SEQ ID NO: 6501358 - DNA, 22 bp, Homo sapiens
tgtatctgtctttccactctgg

SEQ ID NO: 6501359 - DNA, 22 bp, Homo sapiens
tgtatctgtgcttctaatatta

SEQ ID NO: 6501360 - DNA, 12 bp, Homo sapiens
tgtatcttaaat

SEQ ID NO: 6501361 - DNA, 18 bp, Homo sapiens
tgtatcttaaatctgtga

SEQ ID NO: 6501362 - DNA, 19 bp, Homo sapiens
tgtatcttaaatctgtgaa

SEQ ID NO: 6501363 - DNA, 22 bp, Homo sapiens
tgtatcttacctagtgtttact

SEQ ID NO: 6501364 - DNA, 13 bp, Homo sapiens
tgtatcttattta

SEQ ID NO: 6501365 - DNA, 14 bp, Homo sapiens
tgtatcttccagaa

SEQ ID NO: 6501366 - DNA, 18 bp, Homo sapiens
tgtatcttccatatttgg

SEQ ID NO: 6501367 - DNA, 19 bp, Homo sapiens
tgtatcttcctttcttgtc

SEQ ID NO: 6501368 - DNA, 20 bp, Homo sapiens
tgtatcttgattaatgtact

SEQ ID NO: 6501369 - DNA, 23 bp, Homo sapiens
tgtatctttaaaaaaaaatcttg

SEQ ID NO: 6501370 - DNA, 14 bp, Homo sapiens
tgtatctttatgct

SEQ ID NO: 6501371 - DNA, 17 bp, Homo sapiens
tgtatctttatgctgta

SEQ ID NO: 6501372 - DNA, 21 bp, Homo sapiens
tgtatctttatgctgtatttt

SEQ ID NO: 6501373 - DNA, 15 bp, Homo sapiens
tgtatctttattaaa

SEQ ID NO: 6501374 - DNA, 18 bp, Homo sapiens
tgtatctttctttctcta

SEQ ID NO: 6501375 - DNA, 16 bp, Homo sapiens
tgtatcttttttataa

SEQ ID NO: 6501376 - DNA, 21 bp, Homo sapiens
tgtatgaaaaattggggagga

SEQ ID NO: 6501377 - DNA, 19 bp, Homo sapiens
tgtatgaaaacatggaaca

SEQ ID NO: 6501378 - DNA, 11 bp, Homo sapiens
tgtatgaaaat

SEQ ID NO: 6501379 - DNA, 21 bp, Homo sapiens
tgtatgaaaatccttttaacc

SEQ ID NO: 6501380 - DNA, 16 bp, Homo sapiens
tgtatgaactctttaa

SEQ ID NO: 6501381 - DNA, 20 bp, Homo sapiens
tgtatgaactttatctaaag

SEQ ID NO: 6501382 - DNA, 14 bp, Homo sapiens
tgtatgaagtactt

SEQ ID NO: 6501383 - DNA, 23 bp, Homo sapiens
tgtatgaataatgaaaataaaac

SEQ ID NO: 6501384 - DNA, 15 bp, Homo sapiens
tgtatgaatatttta

SEQ ID NO: 6501385 - DNA, 19 bp, Homo sapiens
tgtatgaatattttatatt

SEQ ID NO: 6501386 - DNA, 19 bp, Homo sapiens
tgtatgaattttgtaagta

SEQ ID NO: 6501387 - DNA, 13 bp, Homo sapiens
tgtatgacagtga

SEQ ID NO: 6501388 - DNA, 22 bp, Homo sapiens
tgtatgacagtgaagcagcact

SEQ ID NO: 6501389 - DNA, 19 bp, Homo sapiens
tgtatgacccctggccaca

SEQ ID NO: 6501390 - DNA, 20 bp, Homo sapiens
tgtatgacccctggccacag

SEQ ID NO: 6501391 - DNA, 23 bp, Homo sapiens
tgtatgacccctggccacagcct

SEQ ID NO: 6501392 - DNA, 17 bp, Homo sapiens
tgtatgagaagtacttt

SEQ ID NO: 6501393 - DNA, 13 bp, Homo sapiens
tgtatgaggagag

SEQ ID NO: 6501394 - DNA, 23 bp, Homo sapiens
tgtatgaggcttttcccaccagc

SEQ ID NO: 6501395 - DNA, 16 bp, Homo sapiens
tgtatgagtagccagg

SEQ ID NO: 6501396 - DNA, 17 bp, Homo sapiens
tgtatgagtgtatgtgt

SEQ ID NO: 6501397 - DNA, 22 bp, Homo sapiens
tgtatgatattccatagtatat

SEQ ID NO: 6501398 - DNA, 15 bp, Homo sapiens
tgtatgatcaaatgt

SEQ ID NO: 6501399 - DNA, 16 bp, Homo sapiens
tgtatgatcaaatgtt

SEQ ID NO: 6501400 - DNA, 16 bp, Homo sapiens
tgtatgatctgtgcct

SEQ ID NO: 6501401 - DNA, 19 bp, Homo sapiens
tgtatgatgctaatcttgt

SEQ ID NO: 6501402 - DNA, 18 bp, Homo sapiens
tgtatgatgtgttgtgat

SEQ ID NO: 6501403 - DNA, 13 bp, Homo sapiens
tgtatgattactg

SEQ ID NO: 6501404 - DNA, 18 bp, Homo sapiens
tgtatgatttaggcttct

SEQ ID NO: 6501405 - DNA, 13 bp, Homo sapiens
tgtatgatttgtt

SEQ ID NO: 6501406 - DNA, 20 bp, Homo sapiens
tgtatgattttgatgcacaa

SEQ ID NO: 6501407 - DNA, 22 bp, Homo sapiens
tgtatgcaaatgagttcaggac

SEQ ID NO: 6501408 - DNA, 17 bp, Homo sapiens
tgtatgcacacacatat

SEQ ID NO: 6501409 - DNA, 19 bp, Homo sapiens
tgtatgcacacacatatat

SEQ ID NO: 6501410 - DNA, 21 bp, Homo sapiens
tgtatgcacatgaacttagat

SEQ ID NO: 6501411 - DNA, 18 bp, Homo sapiens
tgtatgcagctatctggt

SEQ ID NO: 6501412 - DNA, 22 bp, Homo sapiens
tgtatgcagtattcttgcactg

SEQ ID NO: 6501413 - DNA, 12 bp, Homo sapiens
tgtatgcatcag

SEQ ID NO: 6501414 - DNA, 18 bp, Homo sapiens
tgtatgcatcagataaca

SEQ ID NO: 6501415 - DNA, 19 bp, Homo sapiens
tgtatgcatcagataacaa

SEQ ID NO: 6501416 - DNA, 15 bp, Homo sapiens
tgtatgcatgttgtc

SEQ ID NO: 6501417 - DNA, 18 bp, Homo sapiens
tgtatgccaagtgagaag

SEQ ID NO: 6501418 - DNA, 14 bp, Homo sapiens
tgtatgccattaaa

SEQ ID NO: 6501419 - DNA, 19 bp, Homo sapiens
tgtatgccttcgggaaaat

SEQ ID NO: 6501420 - DNA, 11 bp, Homo sapiens
tgtatgccttt

SEQ ID NO: 6501421 - DNA, 12 bp, Homo sapiens
tgtatgccttta

SEQ ID NO: 6501422 - DNA, 21 bp, Homo sapiens
tgtatgcctttaaatctgtga

SEQ ID NO: 6501423 - DNA, 23 bp, Homo sapiens
tgtatgcctttaaatctgtgatg

SEQ ID NO: 6501424 - DNA, 12 bp, Homo sapiens
tgtatgcctttt

SEQ ID NO: 6501425 - DNA, 22 bp, Homo sapiens
tgtatgcgtgtccgtctgtctg

SEQ ID NO: 6501426 - DNA, 22 bp, Homo sapiens
tgtatgctaattgaacatgcaa

SEQ ID NO: 6501427 - DNA, 14 bp, Homo sapiens
tgtatgctgatcat

SEQ ID NO: 6501428 - DNA, 20 bp, Homo sapiens
tgtatgctgatgatcaaaac

SEQ ID NO: 6501429 - DNA, 12 bp, Homo sapiens
tgtatgctggac

SEQ ID NO: 6501430 - DNA, 17 bp, Homo sapiens
tgtatgctgtttgtaca

SEQ ID NO: 6501431 - DNA, 18 bp, Homo sapiens
tgtatgctgtttgtacaa

SEQ ID NO: 6501432 - DNA, 13 bp, Homo sapiens
tgtatgcttccag

SEQ ID NO: 6501433 - DNA, 15 bp, Homo sapiens
tgtatgctttgaatg

SEQ ID NO: 6501434 - DNA, 16 bp, Homo sapiens
tgtatggaaacactga

SEQ ID NO: 6501435 - DNA, 18 bp, Homo sapiens
tgtatggaagacaaatac

SEQ ID NO: 6501436 - DNA, 22 bp, Homo sapiens
tgtatggaagacaaatacacat

SEQ ID NO: 6501437 - DNA, 23 bp, Homo sapiens
tgtatggaagacaaatacacata

SEQ ID NO: 6501438 - DNA, 18 bp, Homo sapiens
tgtatggaatacagtgtt

SEQ ID NO: 6501439 - DNA, 17 bp, Homo sapiens
tgtatggagagaaaaca

SEQ ID NO: 6501440 - DNA, 18 bp, Homo sapiens
tgtatggagttaaataaa

SEQ ID NO: 6501441 - DNA, 21 bp, Homo sapiens
tgtatggatagtaaaattcta

SEQ ID NO: 6501442 - DNA, 17 bp, Homo sapiens
tgtatggatatatttga

SEQ ID NO: 6501443 - DNA, 19 bp, Homo sapiens
tgtatggatatatttgaaa

SEQ ID NO: 6501444 - DNA, 18 bp, Homo sapiens
tgtatggatttccagttt

SEQ ID NO: 6501445 - DNA, 18 bp, Homo sapiens
tgtatggctctcaagtga

SEQ ID NO: 6501446 - DNA, 21 bp, Homo sapiens
tgtatggctctcaagtgaaag

SEQ ID NO: 6501447 - DNA, 15 bp, Homo sapiens
tgtatggcttttctc

SEQ ID NO: 6501448 - DNA, 15 bp, Homo sapiens
tgtatggggcagctt

SEQ ID NO: 6501449 - DNA, 12 bp, Homo sapiens
tgtatgtaaaaa

SEQ ID NO: 6501450 - DNA, 15 bp, Homo sapiens
tgtatgtaaaatatt

SEQ ID NO: 6501451 - DNA, 17 bp, Homo sapiens
tgtatgtaaataccaag

SEQ ID NO: 6501452 - DNA, 23 bp, Homo sapiens
tgtatgtaagtaattgcatttct

SEQ ID NO: 6501453 - DNA, 22 bp, Homo sapiens
tgtatgtaatacatatagcagc

SEQ ID NO: 6501454 - DNA, 15 bp, Homo sapiens
tgtatgtacaataca

SEQ ID NO: 6501455 - DNA, 14 bp, Homo sapiens
tgtatgtacttaca

SEQ ID NO: 6501456 - DNA, 19 bp, Homo sapiens
tgtatgtacttacatgggt

SEQ ID NO: 6501457 - DNA, 21 bp, Homo sapiens
tgtatgtacttagctgtacta

SEQ ID NO: 6501458 - DNA, 12 bp, Homo sapiens
tgtatgtagcct

SEQ ID NO: 6501459 - DNA, 23 bp, Homo sapiens
tgtatgtaggagctgcagttctt

SEQ ID NO: 6501460 - DNA, 14 bp, Homo sapiens
tgtatgtataaatt

SEQ ID NO: 6501461 - DNA, 12 bp, Homo sapiens
tgtatgtataat

SEQ ID NO: 6501462 - DNA, 11 bp, Homo sapiens
tgtatgtatac

SEQ ID NO: 6501463 - DNA, 14 bp, Homo sapiens
tgtatgtatacaca

SEQ ID NO: 6501464 - DNA, 15 bp, Homo sapiens
tgtatgtatacacac

SEQ ID NO: 6501465 - DNA, 17 bp, Homo sapiens
tgtatgtatacacacac

SEQ ID NO: 6501466 - DNA, 17 bp, Homo sapiens
tgtatgtatgtgtagtg

SEQ ID NO: 6501467 - DNA, 14 bp, Homo sapiens
tgtatgtatgtgtg

SEQ ID NO: 6501468 - DNA, 22 bp, Homo sapiens
tgtatgtattaaacttttcatt

SEQ ID NO: 6501469 - DNA, 13 bp, Homo sapiens
tgtatgtattatt

SEQ ID NO: 6501470 - DNA, 17 bp, Homo sapiens
tgtatgtcaaagctttg

SEQ ID NO: 6501471 - DNA, 16 bp, Homo sapiens
tgtatgtcagaagtgc

SEQ ID NO: 6501472 - DNA, 24 bp, Homo sapiens
tgtatgtcagtggtttctacttcc

SEQ ID NO: 6501473 - DNA, 13 bp, Homo sapiens
tgtatgtcattaa

SEQ ID NO: 6501474 - DNA, 21 bp, Homo sapiens
tgtatgtcattaaagtgcact

SEQ ID NO: 6501475 - DNA, 22 bp, Homo sapiens
tgtatgtcattaaagtgcactg

SEQ ID NO: 6501476 - DNA, 14 bp, Homo sapiens
tgtatgtctatgtg

SEQ ID NO: 6501477 - DNA, 18 bp, Homo sapiens
tgtatgtctatgtgtata

SEQ ID NO: 6501478 - DNA, 11 bp, Homo sapiens
tgtatgtctgt

SEQ ID NO: 6501479 - DNA, 15 bp, Homo sapiens
tgtatgtctgtgtat

SEQ ID NO: 6501480 - DNA, 20 bp, Homo sapiens
tgtatgtctgtgtatgtata

SEQ ID NO: 6501481 - DNA, 13 bp, Homo sapiens
tgtatgtcttata

SEQ ID NO: 6501482 - DNA, 14 bp, Homo sapiens
tgtatgtcttataa

SEQ ID NO: 6501483 - DNA, 14 bp, Homo sapiens
tgtatgtcttggac

SEQ ID NO: 6501484 - DNA, 16 bp, Homo sapiens
tgcactaggaattctt

SEQ ID NO: 6501485 - DNA, 21 bp, Homo sapiens
tgcactaggaattctttgcat

SEQ ID NO: 6501486 - DNA, 14 bp, Homo sapiens
tgcactagtgcaat

SEQ ID NO: 6501487 - DNA, 14 bp, Homo sapiens
tgcactatatgcaa

SEQ ID NO: 6501488 - DNA, 16 bp, Homo sapiens
tgcactatctttcagc

SEQ ID NO: 6501489 - DNA, 15 bp, Homo sapiens
tgcactcaaatctta

SEQ ID NO: 6501490 - DNA, 16 bp, Homo sapiens
tgcactcaaatcttaa

SEQ ID NO: 6501491 - DNA, 19 bp, Homo sapiens
tgcactcaaatcttaagaa

SEQ ID NO: 6501492 - DNA, 14 bp, Homo sapiens
tgcactcaacctta

SEQ ID NO: 6501493 - DNA, 16 bp, Homo sapiens
tgcactcaagttgttt

SEQ ID NO: 6501494 - DNA, 18 bp, Homo sapiens
tgcactcaagttgtttaa

SEQ ID NO: 6501495 - DNA, 22 bp, Homo sapiens
tgcactcacccctagccctggt

SEQ ID NO: 6501496 - DNA, 14 bp, Homo sapiens
tgcactcagactgt

SEQ ID NO: 6501497 - DNA, 12 bp, Homo sapiens
tgcactcagatt

SEQ ID NO: 6501498 - DNA, 15 bp, Homo sapiens
tgcactcagcttttt

SEQ ID NO: 6501499 - DNA, 17 bp, Homo sapiens
tgcactcatagggtgct

SEQ ID NO: 6501500 - DNA, 14 bp, Homo sapiens
tgcactcatcatat

SEQ ID NO: 6501501 - DNA, 20 bp, Homo sapiens
tgcactccaagaaacgtgga

SEQ ID NO: 6501502 - DNA, 13 bp, Homo sapiens
tgcactccacaca

SEQ ID NO: 6501503 - DNA, 14 bp, Homo sapiens
tgcactccacacat

SEQ ID NO: 6501504 - DNA, 12 bp, Homo sapiens
tgcactccagaa

SEQ ID NO: 6501505 - DNA, 12 bp, Homo sapiens
tgcactccagac

SEQ ID NO: 6501506 - DNA, 18 bp, Homo sapiens
tgcactccagactctggg

SEQ ID NO: 6501507 - DNA, 14 bp, Homo sapiens
tgcactccagcctg

SEQ ID NO: 6501508 - DNA, 17 bp, Homo sapiens
tgcactccagcctgagc

SEQ ID NO: 6501509 - DNA, 15 bp, Homo sapiens
tgcactccagcctgg

SEQ ID NO: 6501510 - DNA, 17 bp, Homo sapiens
tgcactccagcctgggc

SEQ ID NO: 6501511 - DNA, 18 bp, Homo sapiens
tgcactccagcctgggcg

SEQ ID NO: 6501512 - DNA, 19 bp, Homo sapiens
tgcactccagcctgggcga

SEQ ID NO: 6501513 - DNA, 17 bp, Homo sapiens
tgcactccagcctgggt

SEQ ID NO: 6501514 - DNA, 19 bp, Homo sapiens
tgcactccagcctgggtga

SEQ ID NO: 6501515 - DNA, 23 bp, Homo sapiens
tgcactccagcttgggtgataaa

SEQ ID NO: 6501516 - DNA, 17 bp, Homo sapiens
tgcactccatggccacc

SEQ ID NO: 6501517 - DNA, 14 bp, Homo sapiens
tgcactcccacctg

SEQ ID NO: 6501518 - DNA, 19 bp, Homo sapiens
tgcactcccacctgacaca

SEQ ID NO: 6501519 - DNA, 22 bp, Homo sapiens
tgcactcccccagttcccgggc

SEQ ID NO: 6501520 - DNA, 16 bp, Homo sapiens
tgcactcccctgctgg

SEQ ID NO: 6501521 - DNA, 17 bp, Homo sapiens
tgcactcccctgctggg

SEQ ID NO: 6501522 - DNA, 14 bp, Homo sapiens
tgcactcccgacct

SEQ ID NO: 6501523 - DNA, 15 bp, Homo sapiens
tgcactccctggcct

SEQ ID NO: 6501524 - DNA, 16 bp, Homo sapiens
tgcactcctactgagt

SEQ ID NO: 6501525 - DNA, 19 bp, Homo sapiens
tgcactcctcacacagaat

SEQ ID NO: 6501526 - DNA, 12 bp, Homo sapiens
tgcactcctcag

SEQ ID NO: 6501527 - DNA, 20 bp, Homo sapiens
tgcactcctgtctcttggga

SEQ ID NO: 6501528 - DNA, 19 bp, Homo sapiens
tgcactcctttatctgtaa

SEQ ID NO: 6501529 - DNA, 17 bp, Homo sapiens
tgcactcgcactgcaaa

SEQ ID NO: 6501530 - DNA, 12 bp, Homo sapiens
tgcactcgccat

SEQ ID NO: 6501531 - DNA, 17 bp, Homo sapiens
tgcactctaaactgcaa

SEQ ID NO: 6501532 - DNA, 18 bp, Homo sapiens
tgcactctaaactgcaaa

SEQ ID NO: 6501533 - DNA, 15 bp, Homo sapiens
tgcactctagccgga

SEQ ID NO: 6501534 - DNA, 16 bp, Homo sapiens
tgcactctagcctggg

SEQ ID NO: 6501535 - DNA, 20 bp, Homo sapiens
tgcactctctctctgttaaa

SEQ ID NO: 6501536 - DNA, 19 bp, Homo sapiens
tgcactctgggtctggcca

SEQ ID NO: 6501537 - DNA, 12 bp, Homo sapiens
tgcactctgtgc

SEQ ID NO: 6501538 - DNA, 13 bp, Homo sapiens
tgcactctgtgcc

SEQ ID NO: 6501539 - DNA, 15 bp, Homo sapiens
tgcactcttaaacag

SEQ ID NO: 6501540 - DNA, 17 bp, Homo sapiens
tgcactcttaaacagca

SEQ ID NO: 6501541 - DNA, 12 bp, Homo sapiens
tgcactcttcta

SEQ ID NO: 6501542 - DNA, 13 bp, Homo sapiens
tgcactgaaaacc

SEQ ID NO: 6501543 - DNA, 20 bp, Homo sapiens
tgcactgaaaacttagccag

SEQ ID NO: 6501544 - DNA, 14 bp, Homo sapiens
tgcactgaaacctg

SEQ ID NO: 6501545 - DNA, 20 bp, Homo sapiens
tgcactgaacaggttctctt

SEQ ID NO: 6501546 - DNA, 16 bp, Homo sapiens
tgcactgaagagctct

SEQ ID NO: 6501547 - DNA, 22 bp, Homo sapiens
tgcactgaagccggacagctgc

SEQ ID NO: 6501548 - DNA, 16 bp, Homo sapiens
tgcactgaagttgtct

SEQ ID NO: 6501549 - DNA, 13 bp, Homo sapiens
tgcactgaagttt

SEQ ID NO: 6501550 - DNA, 16 bp, Homo sapiens
tgcactgaagtttgat

SEQ ID NO: 6501551 - DNA, 22 bp, Homo sapiens
tgcactgaataaagcacgtgca

SEQ ID NO: 6501552 - DNA, 14 bp, Homo sapiens
tgcactgaatatat

SEQ ID NO: 6501553 - DNA, 20 bp, Homo sapiens
tgcactgaatatataaacac

SEQ ID NO: 6501554 - DNA, 23 bp, Homo sapiens
tgcactgaatggctgacctgacc

SEQ ID NO: 6501555 - DNA, 18 bp, Homo sapiens
tgcactgacattgttggc

SEQ ID NO: 6501556 - DNA, 22 bp, Homo sapiens
tgcactgacccacagcctctgc

SEQ ID NO: 6501557 - DNA, 13 bp, Homo sapiens
tgcactgactctg

SEQ ID NO: 6501558 - DNA, 15 bp, Homo sapiens
tgcactgactctgga

SEQ ID NO: 6501559 - DNA, 16 bp, Homo sapiens
tgcactgactctggaa

SEQ ID NO: 6501560 - DNA, 12 bp, Homo sapiens
tgcactgactgt

SEQ ID NO: 6501561 - DNA, 15 bp, Homo sapiens
tgcactgagcagagt

SEQ ID NO: 6501562 - DNA, 17 bp, Homo sapiens
tgcactgagcagagtct

SEQ ID NO: 6501563 - DNA, 15 bp, Homo sapiens
tgcactgatcaccca

SEQ ID NO: 6501564 - DNA, 14 bp, Homo sapiens
tgcactgatgctgc

SEQ ID NO: 6501565 - DNA, 17 bp, Homo sapiens
tgcactgatgctgcccc

SEQ ID NO: 6501566 - DNA, 21 bp, Homo sapiens
tgcactgatgctgcccctcat

SEQ ID NO: 6501567 - DNA, 15 bp, Homo sapiens
tgcactgatgttgtg

SEQ ID NO: 6501568 - DNA, 14 bp, Homo sapiens
tgcactgccccctg

SEQ ID NO: 6501569 - DNA, 15 bp, Homo sapiens
tgcactgccccctgc

SEQ ID NO: 6501570 - DNA, 12 bp, Homo sapiens
tgcactgccctg

SEQ ID NO: 6501571 - DNA, 15 bp, Homo sapiens
tgcactgcctgcatg

SEQ ID NO: 6501572 - DNA, 21 bp, Homo sapiens
tgcactgcctgccatgtagtt

SEQ ID NO: 6501573 - DNA, 15 bp, Homo sapiens
tgcactgctcacgga

SEQ ID NO: 6501574 - DNA, 12 bp, Homo sapiens
tgcactgcttta

SEQ ID NO: 6501575 - DNA, 17 bp, Homo sapiens
tgcactggagccacagg

SEQ ID NO: 6501576 - DNA, 18 bp, Homo sapiens
tgcactggagtccagtct

SEQ ID NO: 6501577 - DNA, 21 bp, Homo sapiens
tgcactggagtccagtctctt

SEQ ID NO: 6501578 - DNA, 19 bp, Homo sapiens
tgcactggcaggatcacag

SEQ ID NO: 6501579 - DNA, 17 bp, Homo sapiens
tgcactggccttctgat

SEQ ID NO: 6501580 - DNA, 17 bp, Homo sapiens
tgcactgggaaggaaac

SEQ ID NO: 6501581 - DNA, 17 bp, Homo sapiens
tgcactgggaggctccc

SEQ ID NO: 6501582 - DNA, 13 bp, Homo sapiens
tgcactgggcagg

SEQ ID NO: 6501583 - DNA, 14 bp, Homo sapiens
tgcactgggcaggt

SEQ ID NO: 6501584 - DNA, 22 bp, Homo sapiens
tgcactgggcaggttcctgggg

SEQ ID NO: 6501585 - DNA, 16 bp, Homo sapiens
tgcactggggagcccg

SEQ ID NO: 6501586 - DNA, 16 bp, Homo sapiens
tgcactgggggaacag

SEQ ID NO: 6501587 - DNA, 20 bp, Homo sapiens
tgcactggggtaccacatgg

SEQ ID NO: 6501588 - DNA, 19 bp, Homo sapiens
tgcactggtcccaagtagt

SEQ ID NO: 6501589 - DNA, 13 bp, Homo sapiens
tgcactgtaaata

SEQ ID NO: 6501590 - DNA, 11 bp, Homo sapiens
tgcactgtaat

SEQ ID NO: 6501591 - DNA, 16 bp, Homo sapiens
tgcactgtatccaagt

SEQ ID NO: 6501592 - DNA, 15 bp, Homo sapiens
tgcactgtatgctgg

SEQ ID NO: 6501593 - DNA, 17 bp, Homo sapiens
tgcactgtattgctcct

SEQ ID NO: 6501594 - DNA, 20 bp, Homo sapiens
tgcactgtattgctcctccc

SEQ ID NO: 6501595 - DNA, 15 bp, Homo sapiens
tgcactgtcactttg

SEQ ID NO: 6501596 - DNA, 22 bp, Homo sapiens
tgcactgtcactttgctctggg

SEQ ID NO: 6501597 - DNA, 22 bp, Homo sapiens
tgcactgtcccggagctcaggc

SEQ ID NO: 6501598 - DNA, 18 bp, Homo sapiens
tgcactgtcctgctccac

SEQ ID NO: 6501599 - DNA, 22 bp, Homo sapiens
tgcactgtcctgctccacagtg

SEQ ID NO: 6501600 - DNA, 12 bp, Homo sapiens
tgcactgtgaac

SEQ ID NO: 6501601 - DNA, 18 bp, Homo sapiens
tgcactgtgaatcctggc

SEQ ID NO: 6501602 - DNA, 19 bp, Homo sapiens
tgcactgtgccccgcgggc

SEQ ID NO: 6501603 - DNA, 14 bp, Homo sapiens
tgcactgttccccc

SEQ ID NO: 6501604 - DNA, 20 bp, Homo sapiens
tgcactgttccccctgtgca

SEQ ID NO: 6501605 - DNA, 14 bp, Homo sapiens
tgcactgtttgcat

SEQ ID NO: 6501606 - DNA, 13 bp, Homo sapiens
tgcactgttttta

SEQ ID NO: 6501607 - DNA, 13 bp, Homo sapiens
tgcacttaaagaa

SEQ ID NO: 6501608 - DNA, 16 bp, Homo sapiens
tgcacttaaatatcaa

SEQ ID NO: 6501609 - DNA, 20 bp, Homo sapiens
tgcacttaagttagcctcca

SEQ ID NO: 6501610 - DNA, 18 bp, Homo sapiens
tgcacttacttgcttatt

SEQ ID NO: 6501611 - DNA, 24 bp, Homo sapiens
tgcacttagccatgatggcaacag

SEQ ID NO: 6501612 - DNA, 17 bp, Homo sapiens
tgcacttatgtacttga

SEQ ID NO: 6501613 - DNA, 22 bp, Homo sapiens
tgcacttatttatgaacctgcc

SEQ ID NO: 6501614 - DNA, 15 bp, Homo sapiens
tgcacttatttttta

SEQ ID NO: 6501615 - DNA, 15 bp, Homo sapiens
tgcacttcaaattca

SEQ ID NO: 6501616 - DNA, 15 bp, Homo sapiens
tgcacttcagacacc

SEQ ID NO: 6501617 - DNA, 15 bp, Homo sapiens
tgcacttcatatcta

SEQ ID NO: 6501618 - DNA, 21 bp, Homo sapiens
tgcacttcggataattttcat

SEQ ID NO: 6501619 - DNA, 18 bp, Homo sapiens
tgcacttctgttatcagg

SEQ ID NO: 6501620 - DNA, 16 bp, Homo sapiens
tgcacttctgttccag

SEQ ID NO: 6501621 - DNA, 22 bp, Homo sapiens
tgcacttgacctcatctcccga

SEQ ID NO: 6501622 - DNA, 16 bp, Homo sapiens
tgcacttgcagactct

SEQ ID NO: 6501623 - DNA, 17 bp, Homo sapiens
tgcacttgcctatgata

SEQ ID NO: 6501624 - DNA, 22 bp, Homo sapiens
tgcacttgcggttccggcatgg

SEQ ID NO: 6501625 - DNA, 14 bp, Homo sapiens
tgcacttggcctca

SEQ ID NO: 6501626 - DNA, 18 bp, Homo sapiens
tgcacttggcctcagctg

SEQ ID NO: 6501627 - DNA, 17 bp, Homo sapiens
tgcacttggcctctgga

SEQ ID NO: 6501628 - DNA, 21 bp, Homo sapiens
tgcacttgggggctcagcaag

SEQ ID NO: 6501629 - DNA, 17 bp, Homo sapiens
tgcacttgtgattattt

SEQ ID NO: 6501630 - DNA, 20 bp, Homo sapiens
tgcacttgtgattatttatt

SEQ ID NO: 6501631 - DNA, 16 bp, Homo sapiens
tgcactttaaatggaa

SEQ ID NO: 6501632 - DNA, 15 bp, Homo sapiens
tgcactttaattgaa

SEQ ID NO: 6501633 - DNA, 17 bp, Homo sapiens
tgcactttaattgaaga

SEQ ID NO: 6501634 - DNA, 20 bp, Homo sapiens
tgcactttaattgaagaact

SEQ ID NO: 6501635 - DNA, 16 bp, Homo sapiens
tgcactttataaacac

SEQ ID NO: 6501636 - DNA, 17 bp, Homo sapiens
tgcactttataaacact

SEQ ID NO: 6501637 - DNA, 17 bp, Homo sapiens
tgcactttatcttggga

SEQ ID NO: 6501638 - DNA, 19 bp, Homo sapiens
tgcactttccaatgccaca

SEQ ID NO: 6501639 - DNA, 19 bp, Homo sapiens
tgcactttctaatgtttct

SEQ ID NO: 6501640 - DNA, 17 bp, Homo sapiens
tgcactttgatgtcatg

SEQ ID NO: 6501641 - DNA, 21 bp, Homo sapiens
tgcactttgctttaatataaa

SEQ ID NO: 6501642 - DNA, 22 bp, Homo sapiens
tgcactttgctttaatataaat

SEQ ID NO: 6501643 - DNA, 19 bp, Homo sapiens
tgcactttgggtttttaac

SEQ ID NO: 6501644 - DNA, 12 bp, Homo sapiens
tgcactttgtag

SEQ ID NO: 6501645 - DNA, 19 bp, Homo sapiens
tgcactttgttctggctct

SEQ ID NO: 6501646 - DNA, 15 bp, Homo sapiens
tgcactttgtttaga

SEQ ID NO: 6501647 - DNA, 16 bp, Homo sapiens
tgcactttgtttagaa

SEQ ID NO: 6501648 - DNA, 21 bp, Homo sapiens
tgcacttttagaaatgcatat

SEQ ID NO: 6501649 - DNA, 14 bp, Homo sapiens
tgcacttttgaaat

SEQ ID NO: 6501650 - DNA, 19 bp, Homo sapiens
tgcacttttgaatgtccaa

SEQ ID NO: 6501651 - DNA, 20 bp, Homo sapiens
tgcacttttgaatgtccaaa

SEQ ID NO: 6501652 - DNA, 20 bp, Homo sapiens
tgcactttttccttactgtg

SEQ ID NO: 6501653 - DNA, 21 bp, Homo sapiens
tgcactttttccttactgtgc

SEQ ID NO: 6501654 - DNA, 22 bp, Homo sapiens
tgcactttttccttactgtgca

SEQ ID NO: 6501655 - DNA, 15 bp, Homo sapiens
tgcacttttttatga

SEQ ID NO: 6501656 - DNA, 21 bp, Homo sapiens
tgcacttttttatgaagaaaa

SEQ ID NO: 6501657 - DNA, 22 bp, Homo sapiens
tgcactttttttataagcaaaa

SEQ ID NO: 6501658 - DNA, 19 bp, Homo sapiens
tgcagaaaaaaaaaaagaa

SEQ ID NO: 6501659 - DNA, 17 bp, Homo sapiens
tgcagaaaaaaaagaaa

SEQ ID NO: 6501660 - DNA, 13 bp, Homo sapiens
tgcagaaaaagaa

SEQ ID NO: 6501661 - DNA, 14 bp, Homo sapiens
tgcagaaaaagaaa

SEQ ID NO: 6501662 - DNA, 15 bp, Homo sapiens
tgcagaaaacattgt

SEQ ID NO: 6501663 - DNA, 16 bp, Homo sapiens
tgcagaaaacattgtt

SEQ ID NO: 6501664 - DNA, 21 bp, Homo sapiens
tgcagaaaagcacctgccgac

SEQ ID NO: 6501665 - DNA, 12 bp, Homo sapiens
tgtatgtgaaag

SEQ ID NO: 6501666 - DNA, 18 bp, Homo sapiens
tgtatgtgagagattctg

SEQ ID NO: 6501667 - DNA, 23 bp, Homo sapiens
tgtatgtgcacatgtgtctgtgt

SEQ ID NO: 6501668 - DNA, 16 bp, Homo sapiens
tgtatgtgcactgtca

SEQ ID NO: 6501669 - DNA, 14 bp, Homo sapiens
tgtatgtggaagca

SEQ ID NO: 6501670 - DNA, 19 bp, Homo sapiens
tgtatgtggatacagtcat

SEQ ID NO: 6501671 - DNA, 20 bp, Homo sapiens
tgtatgtgggggtctgtgtg

SEQ ID NO: 6501672 - DNA, 22 bp, Homo sapiens
tgtatgtgggggtctgtgtgtt

SEQ ID NO: 6501673 - DNA, 16 bp, Homo sapiens
tgtatgtggtgtgggg

SEQ ID NO: 6501674 - DNA, 14 bp, Homo sapiens
tgtatgtgtaagta

SEQ ID NO: 6501675 - DNA, 16 bp, Homo sapiens
tgtatgtgtaataaat

SEQ ID NO: 6501676 - DNA, 12 bp, Homo sapiens
tgtatgtgtata

SEQ ID NO: 6501677 - DNA, 14 bp, Homo sapiens
tgtatgtgtatatg

SEQ ID NO: 6501678 - DNA, 20 bp, Homo sapiens
tgtatgtgtatgtgtgtgag

SEQ ID NO: 6501679 - DNA, 12 bp, Homo sapiens
tgtatgtgtatt

SEQ ID NO: 6501680 - DNA, 18 bp, Homo sapiens
tgtatgtgtgaaacaatg

SEQ ID NO: 6501681 - DNA, 19 bp, Homo sapiens
tgtatgtgtgaaacaatgt

SEQ ID NO: 6501682 - DNA, 22 bp, Homo sapiens
tgtatgtgtgagtgtatgtata

SEQ ID NO: 6501683 - DNA, 16 bp, Homo sapiens
tgtatgtgtgcttgag

SEQ ID NO: 6501684 - DNA, 14 bp, Homo sapiens
tgtatgtgtgtatg

SEQ ID NO: 6501685 - DNA, 18 bp, Homo sapiens
tgtatgtgtgtctatttt

SEQ ID NO: 6501686 - DNA, 22 bp, Homo sapiens
tgtatgtgtgtctattttgtaa

SEQ ID NO: 6501687 - DNA, 14 bp, Homo sapiens
tgtatgtgtgtgag

SEQ ID NO: 6501688 - DNA, 15 bp, Homo sapiens
tgtatgtgtgtgagt

SEQ ID NO: 6501689 - DNA, 13 bp, Homo sapiens
tgtatgtgtgtgt

SEQ ID NO: 6501690 - DNA, 20 bp, Homo sapiens
tgtatgtgtgtttctgtcct

SEQ ID NO: 6501691 - DNA, 15 bp, Homo sapiens
tgtatgtgtgttttt

SEQ ID NO: 6501692 - DNA, 11 bp, Homo sapiens
tgtatgtgttt

SEQ ID NO: 6501693 - DNA, 16 bp, Homo sapiens
tgtatgtgtttagaat

SEQ ID NO: 6501694 - DNA, 20 bp, Homo sapiens
tgtatgtgtttataattgtt

SEQ ID NO: 6501695 - DNA, 20 bp, Homo sapiens
tgtatgtgtttatgtaactt

SEQ ID NO: 6501696 - DNA, 11 bp, Homo sapiens
tgtatgttatt

SEQ ID NO: 6501697 - DNA, 19 bp, Homo sapiens
tgtatgttcagaagaaatt

SEQ ID NO: 6501698 - DNA, 14 bp, Homo sapiens
tgtatgttcttgtt

SEQ ID NO: 6501699 - DNA, 19 bp, Homo sapiens
tgtatgttgtgaagatgtt

SEQ ID NO: 6501700 - DNA, 23 bp, Homo sapiens
tgtatgttgtgaagatgtttgca

SEQ ID NO: 6501701 - DNA, 14 bp, Homo sapiens
tgtatgtttacact

SEQ ID NO: 6501702 - DNA, 18 bp, Homo sapiens
tgtatgtttacactgtca

SEQ ID NO: 6501703 - DNA, 20 bp, Homo sapiens
tgtatgtttacactgtcaaa

SEQ ID NO: 6501704 - DNA, 13 bp, Homo sapiens
tgtatgtttacat

SEQ ID NO: 6501705 - DNA, 22 bp, Homo sapiens
tgtatgtttatcaaagagcact

SEQ ID NO: 6501706 - DNA, 18 bp, Homo sapiens
tgtatgtttctgcatagc

SEQ ID NO: 6501707 - DNA, 15 bp, Homo sapiens
tgtatgtttcttctt

SEQ ID NO: 6501708 - DNA, 16 bp, Homo sapiens
tgtatgtttgcacact

SEQ ID NO: 6501709 - DNA, 12 bp, Homo sapiens
tgtatgtttgct

SEQ ID NO: 6501710 - DNA, 16 bp, Homo sapiens
tgtatgtttttactga

SEQ ID NO: 6501711 - DNA, 15 bp, Homo sapiens
tgtatgtttttcagt

SEQ ID NO: 6501712 - DNA, 18 bp, Homo sapiens
tgtatgtttttcagttca

SEQ ID NO: 6501713 - DNA, 20 bp, Homo sapiens
tgtatgtttttcagttcaaa

SEQ ID NO: 6501714 - DNA, 22 bp, Homo sapiens
tgtatgtttttcagttcaaagt

SEQ ID NO: 6501715 - DNA, 20 bp, Homo sapiens
tgtatgttttttactgtttg

SEQ ID NO: 6501716 - DNA, 22 bp, Homo sapiens
tgtattaaaaaaaacaaaaaga

SEQ ID NO: 6501717 - DNA, 13 bp, Homo sapiens
tgtattaaagaaa

SEQ ID NO: 6501718 - DNA, 18 bp, Homo sapiens
tgtattaaagatgcaggt

SEQ ID NO: 6501719 - DNA, 20 bp, Homo sapiens
tgtattaaatcttaaacaat

SEQ ID NO: 6501720 - DNA, 22 bp, Homo sapiens
tgtattaaatcttaaacaatgt

SEQ ID NO: 6501721 - DNA, 18 bp, Homo sapiens
tgtattaaattacatttg

SEQ ID NO: 6501722 - DNA, 19 bp, Homo sapiens
tgtattaaattacatttgt

SEQ ID NO: 6501723 - DNA, 13 bp, Homo sapiens
tgtattaacaaaa

SEQ ID NO: 6501724 - DNA, 22 bp, Homo sapiens
tgtattaacaaagttactggct

SEQ ID NO: 6501725 - DNA, 24 bp, Homo sapiens
tgtattaacaaagttactggctct

SEQ ID NO: 6501726 - DNA, 18 bp, Homo sapiens
tgtattaacatgcaataa

SEQ ID NO: 6501727 - DNA, 18 bp, Homo sapiens
tgtattaacctacctgtg

SEQ ID NO: 6501728 - DNA, 14 bp, Homo sapiens
tgtattaacgcaaa

SEQ ID NO: 6501729 - DNA, 12 bp, Homo sapiens
tgtattaactgg

SEQ ID NO: 6501730 - DNA, 17 bp, Homo sapiens
tgtattaacttgtagat

SEQ ID NO: 6501731 - DNA, 16 bp, Homo sapiens
tgtattaagaatgaaa

SEQ ID NO: 6501732 - DNA, 12 bp, Homo sapiens
tgtattaagagt

SEQ ID NO: 6501733 - DNA, 17 bp, Homo sapiens
tgtattaagagtgaaaa

SEQ ID NO: 6501734 - DNA, 13 bp, Homo sapiens
tgtattaagctcc

SEQ ID NO: 6501735 - DNA, 19 bp, Homo sapiens
tgtattaagggatttagta

SEQ ID NO: 6501736 - DNA, 22 bp, Homo sapiens
tgtattaagtgcagcttgacat

SEQ ID NO: 6501737 - DNA, 23 bp, Homo sapiens
tgtattaagtgcagcttgacatt

SEQ ID NO: 6501738 - DNA, 11 bp, Homo sapiens
tgtattaataa

SEQ ID NO: 6501739 - DNA, 13 bp, Homo sapiens
tgtattaataaag

SEQ ID NO: 6501740 - DNA, 14 bp, Homo sapiens
tgtattaataaagc

SEQ ID NO: 6501741 - DNA, 17 bp, Homo sapiens
tgtattaataaagcatt

SEQ ID NO: 6501742 - DNA, 19 bp, Homo sapiens
tgtattaataaagcattct

SEQ ID NO: 6501743 - DNA, 20 bp, Homo sapiens
tgtattaataaatagagcaa

SEQ ID NO: 6501744 - DNA, 21 bp, Homo sapiens
tgtattaatattcattgtata

SEQ ID NO: 6501745 - DNA, 20 bp, Homo sapiens
tgtattaatctgtttgtgca

SEQ ID NO: 6501746 - DNA, 16 bp, Homo sapiens
tgtattaattatttaa

SEQ ID NO: 6501747 - DNA, 19 bp, Homo sapiens
tgtattaatttctgataaa

SEQ ID NO: 6501748 - DNA, 18 bp, Homo sapiens
tgtattacataaataaat

SEQ ID NO: 6501749 - DNA, 16 bp, Homo sapiens
tgtattactagaagat

SEQ ID NO: 6501750 - DNA, 16 bp, Homo sapiens
tgtattactttctctg

SEQ ID NO: 6501751 - DNA, 18 bp, Homo sapiens
tgtattactttctctgta

SEQ ID NO: 6501752 - DNA, 20 bp, Homo sapiens
tgtattagaagattttagaa

SEQ ID NO: 6501753 - DNA, 13 bp, Homo sapiens
tgtattagatatc

SEQ ID NO: 6501754 - DNA, 18 bp, Homo sapiens
tgtattagatatcaatgt

SEQ ID NO: 6501755 - DNA, 16 bp, Homo sapiens
tgtattagatgttctc

SEQ ID NO: 6501756 - DNA, 18 bp, Homo sapiens
tgtattagatgttctcta

SEQ ID NO: 6501757 - DNA, 17 bp, Homo sapiens
tgtattagccagtcatt

SEQ ID NO: 6501758 - DNA, 14 bp, Homo sapiens
tgtattaggaaaat

SEQ ID NO: 6501759 - DNA, 18 bp, Homo sapiens
tgtattaggactggcttt

SEQ ID NO: 6501760 - DNA, 23 bp, Homo sapiens
tgtattaggactggctttgtccc

SEQ ID NO: 6501761 - DNA, 22 bp, Homo sapiens
tgtattagtaataaaacattag

SEQ ID NO: 6501762 - DNA, 12 bp, Homo sapiens
tgtattagtatg

SEQ ID NO: 6501763 - DNA, 15 bp, Homo sapiens
tgtattagtcacaga

SEQ ID NO: 6501764 - DNA, 16 bp, Homo sapiens
tgtattagtcataaaa

SEQ ID NO: 6501765 - DNA, 18 bp, Homo sapiens
tgtattagtcataaaaca

SEQ ID NO: 6501766 - DNA, 14 bp, Homo sapiens
tgtattataaaagc

SEQ ID NO: 6501767 - DNA, 15 bp, Homo sapiens
tgtattataacagtg

SEQ ID NO: 6501768 - DNA, 23 bp, Homo sapiens
tgtattataataagcaaaaagat

SEQ ID NO: 6501769 - DNA, 14 bp, Homo sapiens
tgtattataattgt

SEQ ID NO: 6501770 - DNA, 15 bp, Homo sapiens
tgtattataattgtt

SEQ ID NO: 6501771 - DNA, 19 bp, Homo sapiens
tgtattatacttagtcaaa

SEQ ID NO: 6501772 - DNA, 17 bp, Homo sapiens
tgtattatatgtaacta

SEQ ID NO: 6501773 - DNA, 18 bp, Homo sapiens
tgtattatcaatgaaaat

SEQ ID NO: 6501774 - DNA, 16 bp, Homo sapiens
tgtattatcacatcaa

SEQ ID NO: 6501775 - DNA, 17 bp, Homo sapiens
tgtattatcatatatgc

SEQ ID NO: 6501776 - DNA, 19 bp, Homo sapiens
tgtattatcatatatgctt

SEQ ID NO: 6501777 - DNA, 18 bp, Homo sapiens
tgtattatcttaaaccca

SEQ ID NO: 6501778 - DNA, 14 bp, Homo sapiens
tgtattatgagcca

SEQ ID NO: 6501779 - DNA, 15 bp, Homo sapiens
tgtattatgcaaagt

SEQ ID NO: 6501780 - DNA, 20 bp, Homo sapiens
tgtattatgtcctgtgagat

SEQ ID NO: 6501781 - DNA, 14 bp, Homo sapiens
tgtattattacaaa

SEQ ID NO: 6501782 - DNA, 20 bp, Homo sapiens
tgtattattattaaagaaaa

SEQ ID NO: 6501783 - DNA, 12 bp, Homo sapiens
tgtattattgct

SEQ ID NO: 6501784 - DNA, 18 bp, Homo sapiens
tgtattattgctgttgct

SEQ ID NO: 6501785 - DNA, 16 bp, Homo sapiens
tgtattattgttctca

SEQ ID NO: 6501786 - DNA, 14 bp, Homo sapiens
tgtattatttataa

SEQ ID NO: 6501787 - DNA, 15 bp, Homo sapiens
tgtattatttataat

SEQ ID NO: 6501788 - DNA, 13 bp, Homo sapiens
tgtattatttcat

SEQ ID NO: 6501789 - DNA, 14 bp, Homo sapiens
tgtattcaagtaat

SEQ ID NO: 6501790 - DNA, 14 bp, Homo sapiens
tgtattcaattaaa

SEQ ID NO: 6501791 - DNA, 21 bp, Homo sapiens
tgtattcacccgtccagacct

SEQ ID NO: 6501792 - DNA, 16 bp, Homo sapiens
tgtattcactaaaata

SEQ ID NO: 6501793 - DNA, 14 bp, Homo sapiens
tgtattcagagcca

SEQ ID NO: 6501794 - DNA, 19 bp, Homo sapiens
tgtattcagatcgtattaa

SEQ ID NO: 6501795 - DNA, 22 bp, Homo sapiens
tgtattcagatcgtattaatta

SEQ ID NO: 6501796 - DNA, 18 bp, Homo sapiens
tgtattcatattaccaga

SEQ ID NO: 6501797 - DNA, 20 bp, Homo sapiens
tgtattcatgaacttggctg

SEQ ID NO: 6501798 - DNA, 17 bp, Homo sapiens
tgtattcatgttcatgt

SEQ ID NO: 6501799 - DNA, 22 bp, Homo sapiens
tgtattcatgttcatgtgatta

SEQ ID NO: 6501800 - DNA, 13 bp, Homo sapiens
tgtattccaagac

SEQ ID NO: 6501801 - DNA, 15 bp, Homo sapiens
tgtattccaagacat

SEQ ID NO: 6501802 - DNA, 13 bp, Homo sapiens
tgtattcctatga

SEQ ID NO: 6501803 - DNA, 19 bp, Homo sapiens
tgtattccttttagcagta

SEQ ID NO: 6501804 - DNA, 19 bp, Homo sapiens
tgtattctctcctgtacct

SEQ ID NO: 6501805 - DNA, 16 bp, Homo sapiens
tgtattctctgcaatt

SEQ ID NO: 6501806 - DNA, 19 bp, Homo sapiens
tgtattctctgcaatttta

SEQ ID NO: 6501807 - DNA, 15 bp, Homo sapiens
tgtattctctgtaag

SEQ ID NO: 6501808 - DNA, 23 bp, Homo sapiens
tgtattctctttaccttctaaaa

SEQ ID NO: 6501809 - DNA, 13 bp, Homo sapiens
tgtattctgtaaa

SEQ ID NO: 6501810 - DNA, 17 bp, Homo sapiens
tgtattctgtatccgtg

SEQ ID NO: 6501811 - DNA, 16 bp, Homo sapiens
tgtattctgtcttcat

SEQ ID NO: 6501812 - DNA, 19 bp, Homo sapiens
tgtattctgtggattctat

SEQ ID NO: 6501813 - DNA, 21 bp, Homo sapiens
tgtattcttaaattcatttta

SEQ ID NO: 6501814 - DNA, 12 bp, Homo sapiens
tgtattcttcat

SEQ ID NO: 6501815 - DNA, 13 bp, Homo sapiens
tgtattcttcatg

SEQ ID NO: 6501816 - DNA, 16 bp, Homo sapiens
tgtattcttcatgaaa

SEQ ID NO: 6501817 - DNA, 21 bp, Homo sapiens
tgtattcttcatgaaatgtgt

SEQ ID NO: 6501818 - DNA, 17 bp, Homo sapiens
tgtattctttactaaag

SEQ ID NO: 6501819 - DNA, 16 bp, Homo sapiens
tgtattctttctgcct

SEQ ID NO: 6501820 - DNA, 16 bp, Homo sapiens
tgtattctttgatgtt

SEQ ID NO: 6501821 - DNA, 17 bp, Homo sapiens
tgtattctttgatgtta

SEQ ID NO: 6501822 - DNA, 19 bp, Homo sapiens
tgtattctttgatgttaac

SEQ ID NO: 6501823 - DNA, 23 bp, Homo sapiens
tgtattctttgatgttaacacat

SEQ ID NO: 6501824 - DNA, 19 bp, Homo sapiens
tgtattcttttccaagctc

SEQ ID NO: 6501825 - DNA, 22 bp, Homo sapiens
tgtattcttttccaagctcctt

SEQ ID NO: 6501826 - DNA, 15 bp, Homo sapiens
tgtattgagatttct

SEQ ID NO: 6501827 - DNA, 20 bp, Homo sapiens
tgtattgagatttcttaaat

SEQ ID NO: 6501828 - DNA, 19 bp, Homo sapiens
tgtattgatcaatgcatgt

SEQ ID NO: 6501829 - DNA, 19 bp, Homo sapiens
tgtattgattatataagca

SEQ ID NO: 6501830 - DNA, 19 bp, Homo sapiens
tgtattgatttttaagaaa

SEQ ID NO: 6501831 - DNA, 19 bp, Homo sapiens
tgtattgcacattgtaaaa

SEQ ID NO: 6501832 - DNA, 22 bp, Homo sapiens
tgtattgccatcgggtgccaaa

SEQ ID NO: 6501833 - DNA, 15 bp, Homo sapiens
tgtattgctcctccc

SEQ ID NO: 6501834 - DNA, 18 bp, Homo sapiens
tgtattgctgctgtgcgt

SEQ ID NO: 6501835 - DNA, 12 bp, Homo sapiens
tgtattgctgtc

SEQ ID NO: 6501836 - DNA, 13 bp, Homo sapiens
tgtattgcttatt

SEQ ID NO: 6501837 - DNA, 14 bp, Homo sapiens
tgtattgcttcctg

SEQ ID NO: 6501838 - DNA, 13 bp, Homo sapiens
tgtattgctttct

SEQ ID NO: 6501839 - DNA, 17 bp, Homo sapiens
tgtattgctttctttca

SEQ ID NO: 6501840 - DNA, 18 bp, Homo sapiens
tgtattggaagtatagat

SEQ ID NO: 6501841 - DNA, 22 bp, Homo sapiens
tgtattggcacagtgcttacat

SEQ ID NO: 6501842 - DNA, 14 bp, Homo sapiens
tgtattggcagcac

SEQ ID NO: 6501843 - DNA, 16 bp, Homo sapiens
tgtattggcagcacag

SEQ ID NO: 6501844 - DNA, 14 bp, Homo sapiens
tgtattggcctgga

SEQ ID NO: 6501845 - DNA, 12 bp, Homo sapiens
tgcagaaaatga

SEQ ID NO: 6501846 - DNA, 14 bp, Homo sapiens
tgcagaaacagatt

SEQ ID NO: 6501847 - DNA, 17 bp, Homo sapiens
tgcagaaacttggatgt

SEQ ID NO: 6501848 - DNA, 19 bp, Homo sapiens
tgcagaaagctttatatgt

SEQ ID NO: 6501849 - DNA, 14 bp, Homo sapiens
tgcagaaatgaaat

SEQ ID NO: 6501850 - DNA, 19 bp, Homo sapiens
tgcagaaatgagtgataaa

SEQ ID NO: 6501851 - DNA, 20 bp, Homo sapiens
tgcagaaatgagtgataaat

SEQ ID NO: 6501852 - DNA, 15 bp, Homo sapiens
tgcagaacaaatgaa

SEQ ID NO: 6501853 - DNA, 18 bp, Homo sapiens
tgcagaacaaatgaagac

SEQ ID NO: 6501854 - DNA, 14 bp, Homo sapiens
tgcagaacacctgg

SEQ ID NO: 6501855 - DNA, 15 bp, Homo sapiens
tgcagaacacctggc

SEQ ID NO: 6501856 - DNA, 17 bp, Homo sapiens
tgcagaacacctggccg

SEQ ID NO: 6501857 - DNA, 19 bp, Homo sapiens
tgcagaacacctggccggg

SEQ ID NO: 6501858 - DNA, 18 bp, Homo sapiens
tgcagaacaggcagaaat

SEQ ID NO: 6501859 - DNA, 14 bp, Homo sapiens
tgcagaaccagtcc

SEQ ID NO: 6501860 - DNA, 21 bp, Homo sapiens
tgcagaaccggagagccagct

SEQ ID NO: 6501861 - DNA, 17 bp, Homo sapiens
tgcagaactcctccaaa

SEQ ID NO: 6501862 - DNA, 15 bp, Homo sapiens
tgcagaactgtagct

SEQ ID NO: 6501863 - DNA, 22 bp, Homo sapiens
tgcagaacttccctccatccac

SEQ ID NO: 6501864 - DNA, 13 bp, Homo sapiens
tgcagaagaagct

SEQ ID NO: 6501865 - DNA, 14 bp, Homo sapiens
tgcagaagacagta

SEQ ID NO: 6501866 - DNA, 20 bp, Homo sapiens
tgcagaagagggtgtgtttg

SEQ ID NO: 6501867 - DNA, 21 bp, Homo sapiens
tgcagaagcaataataaagta

SEQ ID NO: 6501868 - DNA, 15 bp, Homo sapiens
tgcagaagcagagat

SEQ ID NO: 6501869 - DNA, 17 bp, Homo sapiens
tgcagaagccaagggaa

SEQ ID NO: 6501870 - DNA, 17 bp, Homo sapiens
tgcagaagccagaaggt

SEQ ID NO: 6501871 - DNA, 21 bp, Homo sapiens
tgcagaagccagaaggtgcag

SEQ ID NO: 6501872 - DNA, 23 bp, Homo sapiens
tgcagaagctatgtttttaaagt

SEQ ID NO: 6501873 - DNA, 12 bp, Homo sapiens
tgcagaaggaaa

SEQ ID NO: 6501874 - DNA, 16 bp, Homo sapiens
tgcagaaggaaaaatg

SEQ ID NO: 6501875 - DNA, 23 bp, Homo sapiens
tgcagaaggaagggcatccttct

SEQ ID NO: 6501876 - DNA, 20 bp, Homo sapiens
tgcagaaggcaaggccctgc

SEQ ID NO: 6501877 - DNA, 13 bp, Homo sapiens
tgcagaagtaagc

SEQ ID NO: 6501878 - DNA, 22 bp, Homo sapiens
tgcagaagtattcttttcaatt

SEQ ID NO: 6501879 - DNA, 15 bp, Homo sapiens
tgcagaagtgcatga

SEQ ID NO: 6501880 - DNA, 20 bp, Homo sapiens
tgcagaagttcttagtgttg

SEQ ID NO: 6501881 - DNA, 17 bp, Homo sapiens
tgcagaataatggaaac

SEQ ID NO: 6501882 - DNA, 21 bp, Homo sapiens
tgcagaataatggaaacatta

SEQ ID NO: 6501883 - DNA, 21 bp, Homo sapiens
tgcagaatacttgactcattt

SEQ ID NO: 6501884 - DNA, 23 bp, Homo sapiens
tgcagaatccctttgcacctgag

SEQ ID NO: 6501885 - DNA, 13 bp, Homo sapiens
tgcagaatctctg

SEQ ID NO: 6501886 - DNA, 18 bp, Homo sapiens
tgcagaatggcatttgca

SEQ ID NO: 6501887 - DNA, 11 bp, Homo sapiens
tgcagaatgta

SEQ ID NO: 6501888 - DNA, 21 bp, Homo sapiens
tgcagaatgtaagtgggccca

SEQ ID NO: 6501889 - DNA, 23 bp, Homo sapiens
tgcagaattaactataacaatca

SEQ ID NO: 6501890 - DNA, 14 bp, Homo sapiens
tgcagaattgttta

SEQ ID NO: 6501891 - DNA, 18 bp, Homo sapiens
tgcagacaaagccctgtc

SEQ ID NO: 6501892 - DNA, 19 bp, Homo sapiens
tgcagacaaagccctgtcc

SEQ ID NO: 6501893 - DNA, 23 bp, Homo sapiens
tgcagacaaagccctgtccttca

SEQ ID NO: 6501894 - DNA, 22 bp, Homo sapiens
tgcagacaacaccttcctcctg

SEQ ID NO: 6501895 - DNA, 22 bp, Homo sapiens
tgcagacaagtcttgctgtgct

SEQ ID NO: 6501896 - DNA, 12 bp, Homo sapiens
tgcagacaattc

SEQ ID NO: 6501897 - DNA, 10 bp, Homo sapiens
tgcagacaca

SEQ ID NO: 6501898 - DNA, 13 bp, Homo sapiens
tgcagacacacaa

SEQ ID NO: 6501899 - DNA, 21 bp, Homo sapiens
tgcagacacgccttcccctca

SEQ ID NO: 6501900 - DNA, 13 bp, Homo sapiens
tgcagacactgtg

SEQ ID NO: 6501901 - DNA, 19 bp, Homo sapiens
tgcagacagaagtctcctc

SEQ ID NO: 6501902 - DNA, 21 bp, Homo sapiens
tgcagacagaagtctcctcaa

SEQ ID NO: 6501903 - DNA, 13 bp, Homo sapiens
tgcagacagccat

SEQ ID NO: 6501904 - DNA, 13 bp, Homo sapiens
tgcagacaggaat

SEQ ID NO: 6501905 - DNA, 15 bp, Homo sapiens
tgcagacaggaatct

SEQ ID NO: 6501906 - DNA, 18 bp, Homo sapiens
tgcagacaggaatcttaa

SEQ ID NO: 6501907 - DNA, 12 bp, Homo sapiens
tgcagacaggca

SEQ ID NO: 6501908 - DNA, 13 bp, Homo sapiens
tgcagacaggcaa

SEQ ID NO: 6501909 - DNA, 23 bp, Homo sapiens
tgcagacaggccatgtgagccac

SEQ ID NO: 6501910 - DNA, 15 bp, Homo sapiens
tgcagacaggctctg

SEQ ID NO: 6501911 - DNA, 22 bp, Homo sapiens
tgcagacagggggccagaacac

SEQ ID NO: 6501912 - DNA, 17 bp, Homo sapiens
tgcagacatctctggag

SEQ ID NO: 6501913 - DNA, 19 bp, Homo sapiens
tgcagacatctctggagcc

SEQ ID NO: 6501914 - DNA, 21 bp, Homo sapiens
tgcagacatctctggagccag

SEQ ID NO: 6501915 - DNA, 22 bp, Homo sapiens
tgcagacatctctggagccaga

SEQ ID NO: 6501916 - DNA, 17 bp, Homo sapiens
tgcagacattctcaaag

SEQ ID NO: 6501917 - DNA, 22 bp, Homo sapiens
tgcagacattctcaaagcctct

SEQ ID NO: 6501918 - DNA, 17 bp, Homo sapiens
tgcagacatttacatgt

SEQ ID NO: 6501919 - DNA, 14 bp, Homo sapiens
tgcagaccctcaga

SEQ ID NO: 6501920 - DNA, 15 bp, Homo sapiens
tgcagaccctgccag

SEQ ID NO: 6501921 - DNA, 16 bp, Homo sapiens
tgcagaccctgccagg

SEQ ID NO: 6501922 - DNA, 17 bp, Homo sapiens
tgcagacctcaagccat

SEQ ID NO: 6501923 - DNA, 18 bp, Homo sapiens
tgcagacctcaagccatc

SEQ ID NO: 6501924 - DNA, 15 bp, Homo sapiens
tgcagacctcactgt

SEQ ID NO: 6501925 - DNA, 16 bp, Homo sapiens
tgcagacctcactgtc

SEQ ID NO: 6501926 - DNA, 15 bp, Homo sapiens
tgcagacctcatgcc

SEQ ID NO: 6501927 - DNA, 18 bp, Homo sapiens
tgcagacctcatgcccag

SEQ ID NO: 6501928 - DNA, 22 bp, Homo sapiens
tgcagacctggctgggcctggg

SEQ ID NO: 6501929 - DNA, 23 bp, Homo sapiens
tgcagacctgtcaccctgcagga

SEQ ID NO: 6501930 - DNA, 14 bp, Homo sapiens
tgcagacctgtcct

SEQ ID NO: 6501931 - DNA, 21 bp, Homo sapiens
tgcagacctgtcctcctggtg

SEQ ID NO: 6501932 - DNA, 23 bp, Homo sapiens
tgcagacctgtcctcctggtggg

SEQ ID NO: 6501933 - DNA, 14 bp, Homo sapiens
tgcagaccttactc

SEQ ID NO: 6501934 - DNA, 18 bp, Homo sapiens
tgcagaccttactcaggg

SEQ ID NO: 6501935 - DNA, 21 bp, Homo sapiens
tgcagacggatgcccattcct

SEQ ID NO: 6501936 - DNA, 23 bp, Homo sapiens
tgcagacgggaatgcctaggtcc

SEQ ID NO: 6501937 - DNA, 21 bp, Homo sapiens
tgcagacgggcaagaagctgc

SEQ ID NO: 6501938 - DNA, 16 bp, Homo sapiens
tgcagactcaataaaa

SEQ ID NO: 6501939 - DNA, 19 bp, Homo sapiens
tgcagactcaataaaatca

SEQ ID NO: 6501940 - DNA, 14 bp, Homo sapiens
tgcagactcagttt

SEQ ID NO: 6501941 - DNA, 15 bp, Homo sapiens
tgcagactcagtttg

SEQ ID NO: 6501942 - DNA, 14 bp, Homo sapiens
tgcagactcctcag

SEQ ID NO: 6501943 - DNA, 16 bp, Homo sapiens
tgcagactctacagag

SEQ ID NO: 6501944 - DNA, 17 bp, Homo sapiens
tgcagactctacagagg

SEQ ID NO: 6501945 - DNA, 20 bp, Homo sapiens
tgcagactctacagaggcca

SEQ ID NO: 6501946 - DNA, 22 bp, Homo sapiens
tgcagactctacagaggccatg

SEQ ID NO: 6501947 - DNA, 17 bp, Homo sapiens
tgcagactggaggggac

SEQ ID NO: 6501948 - DNA, 12 bp, Homo sapiens
tgcagactgtgg

SEQ ID NO: 6501949 - DNA, 22 bp, Homo sapiens
tgcagactgttagcttttacct

SEQ ID NO: 6501950 - DNA, 22 bp, Homo sapiens
tgcagacttcttaaaaggagct

SEQ ID NO: 6501951 - DNA, 19 bp, Homo sapiens
tgcagagaaacgcgctcct

SEQ ID NO: 6501952 - DNA, 21 bp, Homo sapiens
tgcagagaagcatcctccaca

SEQ ID NO: 6501953 - DNA, 23 bp, Homo sapiens
tgcagagaagcatcctccacatc

SEQ ID NO: 6501954 - DNA, 16 bp, Homo sapiens
tgcagagaagctggac

SEQ ID NO: 6501955 - DNA, 20 bp, Homo sapiens
tgcagagaataaaaggacca

SEQ ID NO: 6501956 - DNA, 24 bp, Homo sapiens
tgcagagacagagaggacgtgggc

SEQ ID NO: 6501957 - DNA, 20 bp, Homo sapiens
tgcagagacaggacctgact

SEQ ID NO: 6501958 - DNA, 13 bp, Homo sapiens
tgcagagaccttg

SEQ ID NO: 6501959 - DNA, 22 bp, Homo sapiens
tgcagagacgcaagggagaaga

SEQ ID NO: 6501960 - DNA, 13 bp, Homo sapiens
tgcagagactcat

SEQ ID NO: 6501961 - DNA, 11 bp, Homo sapiens
tgcagagactt

SEQ ID NO: 6501962 - DNA, 14 bp, Homo sapiens
tgcagagagaagcc

SEQ ID NO: 6501963 - DNA, 20 bp, Homo sapiens
tgcagagagcacctggtggg

SEQ ID NO: 6501964 - DNA, 21 bp, Homo sapiens
tgcagagagccattttgtgaa

SEQ ID NO: 6501965 - DNA, 20 bp, Homo sapiens
tgcagagatgtgcccccacc

SEQ ID NO: 6501966 - DNA, 13 bp, Homo sapiens
tgcagagatttcc

SEQ ID NO: 6501967 - DNA, 21 bp, Homo sapiens
tgcagagatttcctccatggt

SEQ ID NO: 6501968 - DNA, 15 bp, Homo sapiens
tgcagagatttctca

SEQ ID NO: 6501969 - DNA, 14 bp, Homo sapiens
tgcagagcaataac

SEQ ID NO: 6501970 - DNA, 16 bp, Homo sapiens
tgcagagcaataacac

SEQ ID NO: 6501971 - DNA, 17 bp, Homo sapiens
tgcagagcaataacact

SEQ ID NO: 6501972 - DNA, 18 bp, Homo sapiens
tgcagagcaataacacta

SEQ ID NO: 6501973 - DNA, 13 bp, Homo sapiens
tgcagagcagaca

SEQ ID NO: 6501974 - DNA, 15 bp, Homo sapiens
tgcagagcagacagg

SEQ ID NO: 6501975 - DNA, 19 bp, Homo sapiens
tgcagagcagacaggctac

SEQ ID NO: 6501976 - DNA, 22 bp, Homo sapiens
tgcagagcagtgggcctggcca

SEQ ID NO: 6501977 - DNA, 17 bp, Homo sapiens
tgcagagcccggcccca

SEQ ID NO: 6501978 - DNA, 18 bp, Homo sapiens
tgcagagcccggccccac

SEQ ID NO: 6501979 - DNA, 15 bp, Homo sapiens
tgcagagccttctca

SEQ ID NO: 6501980 - DNA, 20 bp, Homo sapiens
tgcagagccttctcagaagc

SEQ ID NO: 6501981 - DNA, 22 bp, Homo sapiens
tgcagagccttctcagaagcac

SEQ ID NO: 6501982 - DNA, 13 bp, Homo sapiens
tgcagagcttgtg

SEQ ID NO: 6501983 - DNA, 17 bp, Homo sapiens
tgcagaggagcccagtg

SEQ ID NO: 6501984 - DNA, 22 bp, Homo sapiens
tgcagaggagcccagtgggctg

SEQ ID NO: 6501985 - DNA, 16 bp, Homo sapiens
tgcagaggaggagaaa

SEQ ID NO: 6501986 - DNA, 19 bp, Homo sapiens
tgcagaggattgaggctta

SEQ ID NO: 6501987 - DNA, 13 bp, Homo sapiens
tgcagaggattta

SEQ ID NO: 6501988 - DNA, 15 bp, Homo sapiens
tgcagaggcagcagg

SEQ ID NO: 6501989 - DNA, 15 bp, Homo sapiens
tgcagaggccagagg

SEQ ID NO: 6501990 - DNA, 16 bp, Homo sapiens
tgcagaggcccagcca

SEQ ID NO: 6501991 - DNA, 14 bp, Homo sapiens
tgcagaggcctgca

SEQ ID NO: 6501992 - DNA, 22 bp, Homo sapiens
tgcagaggcggctctggttcct

SEQ ID NO: 6501993 - DNA, 10 bp, Homo sapiens
tgcagaggct

SEQ ID NO: 6501994 - DNA, 11 bp, Homo sapiens
tgcagaggctg

SEQ ID NO: 6501995 - DNA, 17 bp, Homo sapiens
tgcagaggctgagcagg

SEQ ID NO: 6501996 - DNA, 13 bp, Homo sapiens
tgcagagggagac

SEQ ID NO: 6501997 - DNA, 23 bp, Homo sapiens
tgcagagggctccagagtggaga

SEQ ID NO: 6501998 - DNA, 15 bp, Homo sapiens
tgcagaggggaaaga

SEQ ID NO: 6501999 - DNA, 13 bp, Homo sapiens
tgcagaggggcag

SEQ ID NO: 6502000 - DNA, 22 bp, Homo sapiens
tgcagaggggctttctggagag

SEQ ID NO: 6502001 - DNA, 19 bp, Homo sapiens
tgcagagggtactttaaga

SEQ ID NO: 6502002 - DNA, 20 bp, Homo sapiens
tgcagaggtaaaagtgtgag

SEQ ID NO: 6502003 - DNA, 17 bp, Homo sapiens
tgcagaggtaccctggg

SEQ ID NO: 6502004 - DNA, 19 bp, Homo sapiens
tgcagaggtaccctgggtg

SEQ ID NO: 6502005 - DNA, 19 bp, Homo sapiens
tgcagaggtccacaacaca

SEQ ID NO: 6502006 - DNA, 15 bp, Homo sapiens
tgcagaggtctccaa

SEQ ID NO: 6502007 - DNA, 15 bp, Homo sapiens
tgcagaggtgagcag

SEQ ID NO: 6502008 - DNA, 18 bp, Homo sapiens
tgcagagtaaattgctct

SEQ ID NO: 6502009 - DNA, 20 bp, Homo sapiens
tgcagagtaaattgctctgt

SEQ ID NO: 6502010 - DNA, 22 bp, Homo sapiens
tgcagagtaggggtctgtcttt

SEQ ID NO: 6502011 - DNA, 20 bp, Homo sapiens
tgcagagtatttttgtattc

SEQ ID NO: 6502012 - DNA, 13 bp, Homo sapiens
tgcagagtcagca

SEQ ID NO: 6502013 - DNA, 16 bp, Homo sapiens
tgcagagttcagactt

SEQ ID NO: 6502014 - DNA, 17 bp, Homo sapiens
tgcagataattctggac

SEQ ID NO: 6502015 - DNA, 20 bp, Homo sapiens
tgcagataattctggaccag

SEQ ID NO: 6502016 - DNA, 22 bp, Homo sapiens
tgcagataattctggaccagag

SEQ ID NO: 6502017 - DNA, 23 bp, Homo sapiens
tgcagatactactgaccagacaa

SEQ ID NO: 6502018 - DNA, 19 bp, Homo sapiens
tgcagatactttgaagtgc

SEQ ID NO: 6502019 - DNA, 22 bp, Homo sapiens
tgcagatactttgaagtgcagc

SEQ ID NO: 6502020 - DNA, 21 bp, Homo sapiens
tgcagatagaatttggcccag

SEQ ID NO: 6502021 - DNA, 20 bp, Homo sapiens
tgcagatagccagacacatg

SEQ ID NO: 6502022 - DNA, 23 bp, Homo sapiens
tgcagatagccagacacatggct

SEQ ID NO: 6502023 - DNA, 21 bp, Homo sapiens
tgtattgggcagcagactgtg

SEQ ID NO: 6502024 - DNA, 18 bp, Homo sapiens
tgtattgtaaaaaattca

SEQ ID NO: 6502025 - DNA, 18 bp, Homo sapiens
tgtattgtatattacaat

SEQ ID NO: 6502026 - DNA, 18 bp, Homo sapiens
tgtattgtgtcttttgca

SEQ ID NO: 6502027 - DNA, 21 bp, Homo sapiens
tgtattgtgtcttttgcatga

SEQ ID NO: 6502028 - DNA, 16 bp, Homo sapiens
tgtattgttagatgtt

SEQ ID NO: 6502029 - DNA, 12 bp, Homo sapiens
tgtattgttccc

SEQ ID NO: 6502030 - DNA, 14 bp, Homo sapiens
tgtattgttcccag

SEQ ID NO: 6502031 - DNA, 19 bp, Homo sapiens
tgtatttaaaaaaaagaaa

SEQ ID NO: 6502032 - DNA, 23 bp, Homo sapiens
tgtatttaaaaaaaagaaacttt

SEQ ID NO: 6502033 - DNA, 16 bp, Homo sapiens
tgtatttaaaaaaatc

SEQ ID NO: 6502034 - DNA, 21 bp, Homo sapiens
tgtatttaaaacatttcatgt

SEQ ID NO: 6502035 - DNA, 21 bp, Homo sapiens
tgtatttaaagaaaataaaca

SEQ ID NO: 6502036 - DNA, 21 bp, Homo sapiens
tgtatttaaaggtacaatcaa

SEQ ID NO: 6502037 - DNA, 13 bp, Homo sapiens
tgtatttaaatat

SEQ ID NO: 6502038 - DNA, 14 bp, Homo sapiens
tgtatttaacagaa

SEQ ID NO: 6502039 - DNA, 21 bp, Homo sapiens
tgtatttaacagaaattgtat

SEQ ID NO: 6502040 - DNA, 20 bp, Homo sapiens
tgtatttaactcagatgaat

SEQ ID NO: 6502041 - DNA, 23 bp, Homo sapiens
tgtatttaactctgtaagaaact

SEQ ID NO: 6502042 - DNA, 22 bp, Homo sapiens
tgtatttaagaaagggaaagct

SEQ ID NO: 6502043 - DNA, 19 bp, Homo sapiens
tgtatttaagacataaaca

SEQ ID NO: 6502044 - DNA, 20 bp, Homo sapiens
tgtatttaagacataaacaa

SEQ ID NO: 6502045 - DNA, 18 bp, Homo sapiens
tgtatttaagatgtacat

SEQ ID NO: 6502046 - DNA, 21 bp, Homo sapiens
tgtatttaagatgtacattta

SEQ ID NO: 6502047 - DNA, 13 bp, Homo sapiens
tgtatttaagcaa

SEQ ID NO: 6502048 - DNA, 14 bp, Homo sapiens
tgtatttaagcaaa

SEQ ID NO: 6502049 - DNA, 16 bp, Homo sapiens
tgtatttaatgtttgt

SEQ ID NO: 6502050 - DNA, 23 bp, Homo sapiens
tgtatttacgctttgattcatag

SEQ ID NO: 6502051 - DNA, 13 bp, Homo sapiens
tgtatttactgta

SEQ ID NO: 6502052 - DNA, 20 bp, Homo sapiens
tgtatttagtaaaaataaat

SEQ ID NO: 6502053 - DNA, 22 bp, Homo sapiens
tgtatttatacccccaggaaac

SEQ ID NO: 6502054 - DNA, 18 bp, Homo sapiens
tgtatttatataagtctg

SEQ ID NO: 6502055 - DNA, 17 bp, Homo sapiens
tgtatttatatgttaat

SEQ ID NO: 6502056 - DNA, 15 bp, Homo sapiens
tgtatttatattaga

SEQ ID NO: 6502057 - DNA, 13 bp, Homo sapiens
tgtatttatgtaa

SEQ ID NO: 6502058 - DNA, 17 bp, Homo sapiens
tgtatttatgtgtgagg

SEQ ID NO: 6502059 - DNA, 13 bp, Homo sapiens
tgtatttattcaa

SEQ ID NO: 6502060 - DNA, 17 bp, Homo sapiens
tgtatttattcaataaa

SEQ ID NO: 6502061 - DNA, 22 bp, Homo sapiens
tgtatttattcaataaagtatt

SEQ ID NO: 6502062 - DNA, 23 bp, Homo sapiens
tgtatttattgaagaaacagata

SEQ ID NO: 6502063 - DNA, 13 bp, Homo sapiens
tgtatttattgtc

SEQ ID NO: 6502064 - DNA, 14 bp, Homo sapiens
tgtatttattgtca

SEQ ID NO: 6502065 - DNA, 19 bp, Homo sapiens
tgtatttattgtcattact

SEQ ID NO: 6502066 - DNA, 18 bp, Homo sapiens
tgtatttatttaaaagat

SEQ ID NO: 6502067 - DNA, 17 bp, Homo sapiens
tgtatttatttccagac

SEQ ID NO: 6502068 - DNA, 19 bp, Homo sapiens
tgtatttattttcctcccc

SEQ ID NO: 6502069 - DNA, 20 bp, Homo sapiens
tgtatttattttcctcccca

SEQ ID NO: 6502070 - DNA, 15 bp, Homo sapiens
tgtatttcaaatatc

SEQ ID NO: 6502071 - DNA, 17 bp, Homo sapiens
tgtatttcagggacctc

SEQ ID NO: 6502072 - DNA, 15 bp, Homo sapiens
tgtatttcagtattt

SEQ ID NO: 6502073 - DNA, 13 bp, Homo sapiens
tgtatttcattat

SEQ ID NO: 6502074 - DNA, 22 bp, Homo sapiens
tgtatttccaaacctggttcat

SEQ ID NO: 6502075 - DNA, 21 bp, Homo sapiens
tgtatttcctgaaataaatgt

SEQ ID NO: 6502076 - DNA, 22 bp, Homo sapiens
tgtatttcctgaaataaatgtt

SEQ ID NO: 6502077 - DNA, 11 bp, Homo sapiens
tgtatttctaa

SEQ ID NO: 6502078 - DNA, 12 bp, Homo sapiens
tgtatttctata

SEQ ID NO: 6502079 - DNA, 15 bp, Homo sapiens
tgtatttctatacag

SEQ ID NO: 6502080 - DNA, 14 bp, Homo sapiens
tgtatttctatata

SEQ ID NO: 6502081 - DNA, 22 bp, Homo sapiens
tgtatttctctattttcataat

SEQ ID NO: 6502082 - DNA, 13 bp, Homo sapiens
tgtatttctctgt

SEQ ID NO: 6502083 - DNA, 10 bp, Homo sapiens
tgtatttctt

SEQ ID NO: 6502084 - DNA, 17 bp, Homo sapiens
tgtatttcttttatata

SEQ ID NO: 6502085 - DNA, 22 bp, Homo sapiens
tgtatttcttttatatataaaa

SEQ ID NO: 6502086 - DNA, 14 bp, Homo sapiens
tgtatttgaaaatt

SEQ ID NO: 6502087 - DNA, 23 bp, Homo sapiens
tgtatttgaagactgattttaaa

SEQ ID NO: 6502088 - DNA, 16 bp, Homo sapiens
tgtatttgagagactg

SEQ ID NO: 6502089 - DNA, 15 bp, Homo sapiens
tgtatttgagcatat

SEQ ID NO: 6502090 - DNA, 16 bp, Homo sapiens
tgtatttgagttggct

SEQ ID NO: 6502091 - DNA, 14 bp, Homo sapiens
tgtatttgatttat

SEQ ID NO: 6502092 - DNA, 17 bp, Homo sapiens
tgtatttgctaattttt

SEQ ID NO: 6502093 - DNA, 15 bp, Homo sapiens
tgtatttgctgttga

SEQ ID NO: 6502094 - DNA, 14 bp, Homo sapiens
tgtatttgcttttt

SEQ ID NO: 6502095 - DNA, 17 bp, Homo sapiens
tgtatttgtagtgttat

SEQ ID NO: 6502096 - DNA, 14 bp, Homo sapiens
tgtatttgtattaa

SEQ ID NO: 6502097 - DNA, 12 bp, Homo sapiens
tgtatttgtgac

SEQ ID NO: 6502098 - DNA, 20 bp, Homo sapiens
tgtatttgtgactaattgta

SEQ ID NO: 6502099 - DNA, 17 bp, Homo sapiens
tgtatttgtgactttta

SEQ ID NO: 6502100 - DNA, 19 bp, Homo sapiens
tgtatttgttatatataat

SEQ ID NO: 6502101 - DNA, 17 bp, Homo sapiens
tgtatttgttcatgttt

SEQ ID NO: 6502102 - DNA, 19 bp, Homo sapiens
tgtattttaaaagaatgat

SEQ ID NO: 6502103 - DNA, 15 bp, Homo sapiens
tgtattttaaaatag

SEQ ID NO: 6502104 - DNA, 21 bp, Homo sapiens
tgtattttaaagggacagttt

SEQ ID NO: 6502105 - DNA, 24 bp, Homo sapiens
tgtattttaaagggacagtttgta

SEQ ID NO: 6502106 - DNA, 20 bp, Homo sapiens
tgtattttaaattctcagtc

SEQ ID NO: 6502107 - DNA, 19 bp, Homo sapiens
tgtattttaacactttgta

SEQ ID NO: 6502108 - DNA, 13 bp, Homo sapiens
tgtattttaaggt

SEQ ID NO: 6502109 - DNA, 13 bp, Homo sapiens
tgtattttacata

SEQ ID NO: 6502110 - DNA, 19 bp, Homo sapiens
tgtattttactaataaaat

SEQ ID NO: 6502111 - DNA, 19 bp, Homo sapiens
tgtattttataaaattaaa

SEQ ID NO: 6502112 - DNA, 22 bp, Homo sapiens
tgtattttataaaattaaagaa

SEQ ID NO: 6502113 - DNA, 23 bp, Homo sapiens
tgtattttatcttattttctcaa

SEQ ID NO: 6502114 - DNA, 16 bp, Homo sapiens
tgtattttatgctcat

SEQ ID NO: 6502115 - DNA, 12 bp, Homo sapiens
tgtattttatgt

SEQ ID NO: 6502116 - DNA, 13 bp, Homo sapiens
tgtattttatgta

SEQ ID NO: 6502117 - DNA, 13 bp, Homo sapiens
tgtattttattgt

SEQ ID NO: 6502118 - DNA, 21 bp, Homo sapiens
tgtattttattgtaacagaca

SEQ ID NO: 6502119 - DNA, 18 bp, Homo sapiens
tgtattttatttagacaa

SEQ ID NO: 6502120 - DNA, 14 bp, Homo sapiens
tgtattttcagagc

SEQ ID NO: 6502121 - DNA, 15 bp, Homo sapiens
tgtattttcaggaag

SEQ ID NO: 6502122 - DNA, 12 bp, Homo sapiens
tgtattttcata

SEQ ID NO: 6502123 - DNA, 18 bp, Homo sapiens
tgtattttccaagtgtgc

SEQ ID NO: 6502124 - DNA, 20 bp, Homo sapiens
tgtattttcgggattctttg

SEQ ID NO: 6502125 - DNA, 17 bp, Homo sapiens
tgtattttctgtcactg

SEQ ID NO: 6502126 - DNA, 20 bp, Homo sapiens
tgtattttcttcccatttgt

SEQ ID NO: 6502127 - DNA, 21 bp, Homo sapiens
tgtattttcttcccatttgta

SEQ ID NO: 6502128 - DNA, 17 bp, Homo sapiens
tgtattttctttcactt

SEQ ID NO: 6502129 - DNA, 19 bp, Homo sapiens
tgtattttcttttatatct

SEQ ID NO: 6502130 - DNA, 20 bp, Homo sapiens
tgtattttcttttatatctg

SEQ ID NO: 6502131 - DNA, 13 bp, Homo sapiens
tgtattttgaaaa

SEQ ID NO: 6502132 - DNA, 14 bp, Homo sapiens
tgtattttgaaaaa

SEQ ID NO: 6502133 - DNA, 18 bp, Homo sapiens
tgtattttgaaaaagaga

SEQ ID NO: 6502134 - DNA, 14 bp, Homo sapiens
tgtattttgaagaa

SEQ ID NO: 6502135 - DNA, 15 bp, Homo sapiens
tgtattttgaagaat

SEQ ID NO: 6502136 - DNA, 15 bp, Homo sapiens
tgtattttgacaaaa

SEQ ID NO: 6502137 - DNA, 14 bp, Homo sapiens
tgtattttgattat

SEQ ID NO: 6502138 - DNA, 17 bp, Homo sapiens
tgtattttggaagacat

SEQ ID NO: 6502139 - DNA, 19 bp, Homo sapiens
tgtattttgtaaataataa

SEQ ID NO: 6502140 - DNA, 14 bp, Homo sapiens
tgtattttgtattg

SEQ ID NO: 6502141 - DNA, 18 bp, Homo sapiens
tgtattttgtcacttttt

SEQ ID NO: 6502142 - DNA, 23 bp, Homo sapiens
tgtattttgtgatgaatctacat

SEQ ID NO: 6502143 - DNA, 12 bp, Homo sapiens
tgtattttgtta

SEQ ID NO: 6502144 - DNA, 14 bp, Homo sapiens
tgtattttgttaaa

SEQ ID NO: 6502145 - DNA, 18 bp, Homo sapiens
tgtattttgttaaagctg

SEQ ID NO: 6502146 - DNA, 17 bp, Homo sapiens
tgtatttttaaagcatg

SEQ ID NO: 6502147 - DNA, 18 bp, Homo sapiens
tgtatttttaaattctgc

SEQ ID NO: 6502148 - DNA, 22 bp, Homo sapiens
tgtatttttaaattctgctcct

SEQ ID NO: 6502149 - DNA, 22 bp, Homo sapiens
tgtatttttacagctactttaa

SEQ ID NO: 6502150 - DNA, 17 bp, Homo sapiens
tgtatttttagtagaga

SEQ ID NO: 6502151 - DNA, 23 bp, Homo sapiens
tgtatttttatataatatctaaa

SEQ ID NO: 6502152 - DNA, 17 bp, Homo sapiens
tgtatttttattttcct

SEQ ID NO: 6502153 - DNA, 18 bp, Homo sapiens
tgtatttttatttttgca

SEQ ID NO: 6502154 - DNA, 20 bp, Homo sapiens
tgtatttttatttttgcaca

SEQ ID NO: 6502155 - DNA, 19 bp, Homo sapiens
tgtatttttcaataaagca

SEQ ID NO: 6502156 - DNA, 14 bp, Homo sapiens
tgtatttttctaca

SEQ ID NO: 6502157 - DNA, 22 bp, Homo sapiens
tgtatttttcttgctgttcagt

SEQ ID NO: 6502158 - DNA, 18 bp, Homo sapiens
tgtatttttgtaaaaaat

SEQ ID NO: 6502159 - DNA, 20 bp, Homo sapiens
tgtatttttgtaattcctct

SEQ ID NO: 6502160 - DNA, 12 bp, Homo sapiens
tgtatttttgtc

SEQ ID NO: 6502161 - DNA, 14 bp, Homo sapiens
tgtatttttgtcaa

SEQ ID NO: 6502162 - DNA, 20 bp, Homo sapiens
tgtatttttgtcaattacca

SEQ ID NO: 6502163 - DNA, 21 bp, Homo sapiens
tgtatttttgtgaagtattca

SEQ ID NO: 6502164 - DNA, 13 bp, Homo sapiens
tgtatttttgtta

SEQ ID NO: 6502165 - DNA, 22 bp, Homo sapiens
tgtatttttgttagtttacaat

SEQ ID NO: 6502166 - DNA, 18 bp, Homo sapiens
tgtattttttaaaacact

SEQ ID NO: 6502167 - DNA, 14 bp, Homo sapiens
tgtattttttaaag

SEQ ID NO: 6502168 - DNA, 17 bp, Homo sapiens
tgtattttttaatgcta

SEQ ID NO: 6502169 - DNA, 19 bp, Homo sapiens
tgtattttttaatgctaat

SEQ ID NO: 6502170 - DNA, 19 bp, Homo sapiens
tgtattttttatttacatt

SEQ ID NO: 6502171 - DNA, 16 bp, Homo sapiens
tgtattttttccttaa

SEQ ID NO: 6502172 - DNA, 18 bp, Homo sapiens
tgtattttttcttgcatt

SEQ ID NO: 6502173 - DNA, 19 bp, Homo sapiens
tgtattttttcttgcattg

SEQ ID NO: 6502174 - DNA, 21 bp, Homo sapiens
tgtattttttgttgaaagtaa

SEQ ID NO: 6502175 - DNA, 21 bp, Homo sapiens
tgtattttttgtttgtattgt

SEQ ID NO: 6502176 - DNA, 17 bp, Homo sapiens
tgtatttttttgcaagt

SEQ ID NO: 6502177 - DNA, 20 bp, Homo sapiens
tgtatttttttgcaagtgaa

SEQ ID NO: 6502178 - DNA, 14 bp, Homo sapiens
tgtcaaaaaccaga

SEQ ID NO: 6502179 - DNA, 15 bp, Homo sapiens
tgtcaaaaaccagaa

SEQ ID NO: 6502180 - DNA, 13 bp, Homo sapiens
tgtcaaaaatatt

SEQ ID NO: 6502181 - DNA, 14 bp, Homo sapiens
tgtcaaaaatattt

SEQ ID NO: 6502182 - DNA, 18 bp, Homo sapiens
tgtcaaaaattttgaatg

SEQ ID NO: 6502183 - DNA, 18 bp, Homo sapiens
tgtcaaaacactgtggaa

SEQ ID NO: 6502184 - DNA, 17 bp, Homo sapiens
tgtcaaaagtagaactt

SEQ ID NO: 6502185 - DNA, 21 bp, Homo sapiens
tgtcaaaagtagaactttgta

SEQ ID NO: 6502186 - DNA, 22 bp, Homo sapiens
tgtcaaaagtagaactttgtat

SEQ ID NO: 6502187 - DNA, 12 bp, Homo sapiens
tgtcaaaataaa

SEQ ID NO: 6502188 - DNA, 23 bp, Homo sapiens
tgtcaaaataaagattctcacat

SEQ ID NO: 6502189 - DNA, 13 bp, Homo sapiens
tgtcaaaatcatg

SEQ ID NO: 6502190 - DNA, 23 bp, Homo sapiens
tgtcaaaatcatgaatatttcaa

SEQ ID NO: 6502191 - DNA, 13 bp, Homo sapiens
tgtcaaaattaat

SEQ ID NO: 6502192 - DNA, 21 bp, Homo sapiens
tgtcaaacaaatagtctatca

SEQ ID NO: 6502193 - DNA, 20 bp, Homo sapiens
tgtcaaacattagtacttta

SEQ ID NO: 6502194 - DNA, 15 bp, Homo sapiens
tgtcaaactttgtca

SEQ ID NO: 6502195 - DNA, 16 bp, Homo sapiens
tgtcaaagatatgtta

SEQ ID NO: 6502196 - DNA, 18 bp, Homo sapiens
tgtcaaagattttacctg

SEQ ID NO: 6502197 - DNA, 14 bp, Homo sapiens
tgtcaaagcttgcc

SEQ ID NO: 6502198 - DNA, 15 bp, Homo sapiens
tgtcaaagcttgccg

SEQ ID NO: 6502199 - DNA, 13 bp, Homo sapiens
tgtcaaagctttg

SEQ ID NO: 6502200 - DNA, 19 bp, Homo sapiens
tgtcaaagtgaaagacatt

SEQ ID NO: 6502201 - DNA, 16 bp, Homo sapiens
tgtcaaagtggtgaga

SEQ ID NO: 6502202 - DNA, 16 bp, Homo sapiens
tgcagatagcccagga

SEQ ID NO: 6502203 - DNA, 17 bp, Homo sapiens
tgcagatagcccaggag

SEQ ID NO: 6502204 - DNA, 18 bp, Homo sapiens
tgcagatagcccaggagc

SEQ ID NO: 6502205 - DNA, 23 bp, Homo sapiens
tgcagatagcccaggagcaacag

SEQ ID NO: 6502206 - DNA, 20 bp, Homo sapiens
tgcagatatccaaacaagac

SEQ ID NO: 6502207 - DNA, 16 bp, Homo sapiens
tgcagatatctgcatg

SEQ ID NO: 6502208 - DNA, 17 bp, Homo sapiens
tgcagatatctgcatgt

SEQ ID NO: 6502209 - DNA, 19 bp, Homo sapiens
tgcagatatctgcatgtgt

SEQ ID NO: 6502210 - DNA, 23 bp, Homo sapiens
tgcagatcccagcccaccctgcc

SEQ ID NO: 6502211 - DNA, 21 bp, Homo sapiens
tgcagatcttccgtggtcaga

SEQ ID NO: 6502212 - DNA, 21 bp, Homo sapiens
tgcagatctttttgtgaaatt

SEQ ID NO: 6502213 - DNA, 24 bp, Homo sapiens
tgcagatgaaaaaaactaaggtga

SEQ ID NO: 6502214 - DNA, 15 bp, Homo sapiens
tgcagatgaaatgtt

SEQ ID NO: 6502215 - DNA, 17 bp, Homo sapiens
tgcagatgaaatgttct

SEQ ID NO: 6502216 - DNA, 14 bp, Homo sapiens
tgcagatgacaaaa

SEQ ID NO: 6502217 - DNA, 15 bp, Homo sapiens
tgcagatgacaaaaa

SEQ ID NO: 6502218 - DNA, 18 bp, Homo sapiens
tgcagatgagcagtcaca

SEQ ID NO: 6502219 - DNA, 17 bp, Homo sapiens
tgcagatgcaattgttt

SEQ ID NO: 6502220 - DNA, 11 bp, Homo sapiens
tgcagatgcca

SEQ ID NO: 6502221 - DNA, 20 bp, Homo sapiens
tgcagatgccaccctagcca

SEQ ID NO: 6502222 - DNA, 15 bp, Homo sapiens
tgcagatgccagagc

SEQ ID NO: 6502223 - DNA, 18 bp, Homo sapiens
tgcagatgctgctgaaga

SEQ ID NO: 6502224 - DNA, 18 bp, Homo sapiens
tgcagatgctttgcccag

SEQ ID NO: 6502225 - DNA, 20 bp, Homo sapiens
tgcagatgctttgcccaggc

SEQ ID NO: 6502226 - DNA, 21 bp, Homo sapiens
tgcagatgggtgctatcagag

SEQ ID NO: 6502227 - DNA, 18 bp, Homo sapiens
tgcagatggtactgctga

SEQ ID NO: 6502228 - DNA, 17 bp, Homo sapiens
tgcagatgtgtgtccca

SEQ ID NO: 6502229 - DNA, 17 bp, Homo sapiens
tgcagatgttagatatt

SEQ ID NO: 6502230 - DNA, 16 bp, Homo sapiens
tgcagattacactgat

SEQ ID NO: 6502231 - DNA, 17 bp, Homo sapiens
tgcagattacactgatc

SEQ ID NO: 6502232 - DNA, 23 bp, Homo sapiens
tgcagattattttagtctgtcat

SEQ ID NO: 6502233 - DNA, 13 bp, Homo sapiens
tgcagattcattt

SEQ ID NO: 6502234 - DNA, 19 bp, Homo sapiens
tgcagattcctcagattca

SEQ ID NO: 6502235 - DNA, 20 bp, Homo sapiens
tgcagattcctgggcctgtc

SEQ ID NO: 6502236 - DNA, 13 bp, Homo sapiens
tgcagattccttt

SEQ ID NO: 6502237 - DNA, 15 bp, Homo sapiens
tgcagattcctttgg

SEQ ID NO: 6502238 - DNA, 14 bp, Homo sapiens
tgcagattctgatt

SEQ ID NO: 6502239 - DNA, 15 bp, Homo sapiens
tgcagattctgattt

SEQ ID NO: 6502240 - DNA, 22 bp, Homo sapiens
tgcagattgagacctacaggct

SEQ ID NO: 6502241 - DNA, 23 bp, Homo sapiens
tgcagattgagacctacaggctg

SEQ ID NO: 6502242 - DNA, 20 bp, Homo sapiens
tgcagatttctgccttgaaa

SEQ ID NO: 6502243 - DNA, 14 bp, Homo sapiens
tgcagatttgatat

SEQ ID NO: 6502244 - DNA, 16 bp, Homo sapiens
tgcagatttgatattt

SEQ ID NO: 6502245 - DNA, 20 bp, Homo sapiens
tgcagatttgatatttgcat

SEQ ID NO: 6502246 - DNA, 16 bp, Homo sapiens
tgcagatttgggctgg

SEQ ID NO: 6502247 - DNA, 14 bp, Homo sapiens
tgcagattttctta

SEQ ID NO: 6502248 - DNA, 15 bp, Homo sapiens
tgcagcaacacccaa

SEQ ID NO: 6502249 - DNA, 16 bp, Homo sapiens
tgcagcaacacccaag

SEQ ID NO: 6502250 - DNA, 22 bp, Homo sapiens
tgcagcaacacccaagtccacc

SEQ ID NO: 6502251 - DNA, 14 bp, Homo sapiens
tgcagcaaccagag

SEQ ID NO: 6502252 - DNA, 18 bp, Homo sapiens
tgcagcaaccagagcact

SEQ ID NO: 6502253 - DNA, 20 bp, Homo sapiens
tgcagcaaccagagcactgt

SEQ ID NO: 6502254 - DNA, 12 bp, Homo sapiens
tgcagcaactcc

SEQ ID NO: 6502255 - DNA, 17 bp, Homo sapiens
tgcagcaactcccacga

SEQ ID NO: 6502256 - DNA, 18 bp, Homo sapiens
tgcagcaaggccctgctg

SEQ ID NO: 6502257 - DNA, 15 bp, Homo sapiens
tgcagcaataaagca

SEQ ID NO: 6502258 - DNA, 14 bp, Homo sapiens
tgcagcaatattct

SEQ ID NO: 6502259 - DNA, 16 bp, Homo sapiens
tgcagcaatcccactt

SEQ ID NO: 6502260 - DNA, 16 bp, Homo sapiens
tgcagcaatctttgaa

SEQ ID NO: 6502261 - DNA, 17 bp, Homo sapiens
tgcagcaatctttgaaa

SEQ ID NO: 6502262 - DNA, 21 bp, Homo sapiens
tgcagcacatgcgggctcgcc

SEQ ID NO: 6502263 - DNA, 17 bp, Homo sapiens
tgcagcaccgaggggcc

SEQ ID NO: 6502264 - DNA, 21 bp, Homo sapiens
tgcagcaccgaggggcctttg

SEQ ID NO: 6502265 - DNA, 14 bp, Homo sapiens
tgcagcacctccag

SEQ ID NO: 6502266 - DNA, 20 bp, Homo sapiens
tgcagcacctccaggcctgt

SEQ ID NO: 6502267 - DNA, 13 bp, Homo sapiens
tgcagcacctgcc

SEQ ID NO: 6502268 - DNA, 12 bp, Homo sapiens
tgcagcacctgt

SEQ ID NO: 6502269 - DNA, 15 bp, Homo sapiens
tgcagcacgcggcct

SEQ ID NO: 6502270 - DNA, 14 bp, Homo sapiens
tgcagcactgctgc

SEQ ID NO: 6502271 - DNA, 16 bp, Homo sapiens
tgcagcactgctgcct

SEQ ID NO: 6502272 - DNA, 23 bp, Homo sapiens
tgcagcactttttccttctgaaa

SEQ ID NO: 6502273 - DNA, 20 bp, Homo sapiens
tgcagcagaaaggctctgaa

SEQ ID NO: 6502274 - DNA, 10 bp, Homo sapiens
tgcagcagag

SEQ ID NO: 6502275 - DNA, 15 bp, Homo sapiens
tgcagcagaggacag

SEQ ID NO: 6502276 - DNA, 14 bp, Homo sapiens
tgcagcagaggcac

SEQ ID NO: 6502277 - DNA, 16 bp, Homo sapiens
tgcagcagattggaag

SEQ ID NO: 6502278 - DNA, 17 bp, Homo sapiens
tgcagcagcaagtacaa

SEQ ID NO: 6502279 - DNA, 14 bp, Homo sapiens
tgcagcagcccagc

SEQ ID NO: 6502280 - DNA, 16 bp, Homo sapiens
tgcagcagcttgctgc

SEQ ID NO: 6502281 - DNA, 22 bp, Homo sapiens
tgcagcaggaaggaacaaagac

SEQ ID NO: 6502282 - DNA, 23 bp, Homo sapiens
tgcagcaggaatatatgtgtgcc

SEQ ID NO: 6502283 - DNA, 10 bp, Homo sapiens
tgcagcaggc

SEQ ID NO: 6502284 - DNA, 17 bp, Homo sapiens
tgcagcaggcagaggag

SEQ ID NO: 6502285 - DNA, 18 bp, Homo sapiens
tgcagcaggcagaggaga

SEQ ID NO: 6502286 - DNA, 16 bp, Homo sapiens
tgcagcagggatgccc

SEQ ID NO: 6502287 - DNA, 17 bp, Homo sapiens
tgcagcagggatgccct

SEQ ID NO: 6502288 - DNA, 22 bp, Homo sapiens
tgcagcagggatgccctggagg

SEQ ID NO: 6502289 - DNA, 20 bp, Homo sapiens
tgcagcagggcaggaagggg

SEQ ID NO: 6502290 - DNA, 14 bp, Homo sapiens
tgcagcagggcagt

SEQ ID NO: 6502291 - DNA, 17 bp, Homo sapiens
tgcagcaggtgctgggc

SEQ ID NO: 6502292 - DNA, 19 bp, Homo sapiens
tgcagcatatcgtttaatt

SEQ ID NO: 6502293 - DNA, 20 bp, Homo sapiens
tgcagcatatgaggatgcag

SEQ ID NO: 6502294 - DNA, 23 bp, Homo sapiens
tgcagcatgacctgtgaccagca

SEQ ID NO: 6502295 - DNA, 14 bp, Homo sapiens
tgcagcatgagact

SEQ ID NO: 6502296 - DNA, 16 bp, Homo sapiens
tgcagcatgagacttt

SEQ ID NO: 6502297 - DNA, 19 bp, Homo sapiens
tgcagcatggggtttttat

SEQ ID NO: 6502298 - DNA, 18 bp, Homo sapiens
tgcagcatgttgctgagg

SEQ ID NO: 6502299 - DNA, 20 bp, Homo sapiens
tgcagcatttactatgcaca

SEQ ID NO: 6502300 - DNA, 15 bp, Homo sapiens
tgcagcatttcactt

SEQ ID NO: 6502301 - DNA, 18 bp, Homo sapiens
tgcagcatttgataatga

SEQ ID NO: 6502302 - DNA, 22 bp, Homo sapiens
tgcagcatttgataatgataaa

SEQ ID NO: 6502303 - DNA, 17 bp, Homo sapiens
tgcagccaaacagagcc

SEQ ID NO: 6502304 - DNA, 17 bp, Homo sapiens
tgcagccaaaggggagc

SEQ ID NO: 6502305 - DNA, 18 bp, Homo sapiens
tgcagccaaaggggagcc

SEQ ID NO: 6502306 - DNA, 20 bp, Homo sapiens
tgcagccacatggccccatc

SEQ ID NO: 6502307 - DNA, 22 bp, Homo sapiens
tgcagccacgaacacgcatgcc

SEQ ID NO: 6502308 - DNA, 19 bp, Homo sapiens
tgcagccacgattggagaa

SEQ ID NO: 6502309 - DNA, 15 bp, Homo sapiens
tgcagccactgattc

SEQ ID NO: 6502310 - DNA, 17 bp, Homo sapiens
tgcagccacttaggaca

SEQ ID NO: 6502311 - DNA, 21 bp, Homo sapiens
tgcagccagacctattcctcc

SEQ ID NO: 6502312 - DNA, 13 bp, Homo sapiens
tgcagccagaggc

SEQ ID NO: 6502313 - DNA, 23 bp, Homo sapiens
tgcagccagcagttgtaaaattg

SEQ ID NO: 6502314 - DNA, 16 bp, Homo sapiens
tgcagccagcccagcc

SEQ ID NO: 6502315 - DNA, 11 bp, Homo sapiens
tgcagccagct

SEQ ID NO: 6502316 - DNA, 13 bp, Homo sapiens
tgcagccaggcct

SEQ ID NO: 6502317 - DNA, 19 bp, Homo sapiens
tgcagccaggcctcgcctg

SEQ ID NO: 6502318 - DNA, 23 bp, Homo sapiens
tgcagccagggctggggttgcca

SEQ ID NO: 6502319 - DNA, 20 bp, Homo sapiens
tgcagccatcccgcttagcc

SEQ ID NO: 6502320 - DNA, 13 bp, Homo sapiens
tgcagcccaccag

SEQ ID NO: 6502321 - DNA, 15 bp, Homo sapiens
tgcagcccaccagga

SEQ ID NO: 6502322 - DNA, 19 bp, Homo sapiens
tgcagcccagaacgggcct

SEQ ID NO: 6502323 - DNA, 22 bp, Homo sapiens
tgcagcccagaacgggcctccc

SEQ ID NO: 6502324 - DNA, 12 bp, Homo sapiens
tgcagcccagcc

SEQ ID NO: 6502325 - DNA, 16 bp, Homo sapiens
tgcagcccaggccagt

SEQ ID NO: 6502326 - DNA, 12 bp, Homo sapiens
tgcagcccatgc

SEQ ID NO: 6502327 - DNA, 13 bp, Homo sapiens
tgcagcccatgcc

SEQ ID NO: 6502328 - DNA, 18 bp, Homo sapiens
tgcagcccatgcccacct

SEQ ID NO: 6502329 - DNA, 23 bp, Homo sapiens
tgcagcccatgcccacctgccca

SEQ ID NO: 6502330 - DNA, 19 bp, Homo sapiens
tgcagcccattcccaaggg

SEQ ID NO: 6502331 - DNA, 19 bp, Homo sapiens
tgcagcccatttctccaga

SEQ ID NO: 6502332 - DNA, 21 bp, Homo sapiens
tgcagcccatttctccagaac

SEQ ID NO: 6502333 - DNA, 22 bp, Homo sapiens
tgcagcccatttctccagaacc

SEQ ID NO: 6502334 - DNA, 11 bp, Homo sapiens
tgcagccccag

SEQ ID NO: 6502335 - DNA, 17 bp, Homo sapiens
tgcagccccagaagaaa

SEQ ID NO: 6502336 - DNA, 14 bp, Homo sapiens
tgcagccccaggac

SEQ ID NO: 6502337 - DNA, 17 bp, Homo sapiens
tgcagccccaggaccaa

SEQ ID NO: 6502338 - DNA, 18 bp, Homo sapiens
tgcagccccaggaccaag

SEQ ID NO: 6502339 - DNA, 14 bp, Homo sapiens
tgcagccccaggcc

SEQ ID NO: 6502340 - DNA, 16 bp, Homo sapiens
tgcagccccaggcctc

SEQ ID NO: 6502341 - DNA, 15 bp, Homo sapiens
tgcagccccctcctg

SEQ ID NO: 6502342 - DNA, 16 bp, Homo sapiens
tgcagccccctcctga

SEQ ID NO: 6502343 - DNA, 16 bp, Homo sapiens
tgcagcccctgggccc

SEQ ID NO: 6502344 - DNA, 20 bp, Homo sapiens
tgcagcccggcgccaccatc

SEQ ID NO: 6502345 - DNA, 20 bp, Homo sapiens
tgcagcccgtgtccaggagc

SEQ ID NO: 6502346 - DNA, 19 bp, Homo sapiens
tgcagcccgtgtggcccct

SEQ ID NO: 6502347 - DNA, 23 bp, Homo sapiens
tgcagccctctccaccctccggc

SEQ ID NO: 6502348 - DNA, 12 bp, Homo sapiens
tgcagccctctt

SEQ ID NO: 6502349 - DNA, 15 bp, Homo sapiens
tgcagccctcttgcc

SEQ ID NO: 6502350 - DNA, 13 bp, Homo sapiens
tgcagcccttcct

SEQ ID NO: 6502351 - DNA, 15 bp, Homo sapiens
tgcagcccttgggca

SEQ ID NO: 6502352 - DNA, 17 bp, Homo sapiens
tgcagcccttgggcagt

SEQ ID NO: 6502353 - DNA, 18 bp, Homo sapiens
tgcagcccttgggcagtt

SEQ ID NO: 6502354 - DNA, 19 bp, Homo sapiens
tgcagcccttgggcagttc

SEQ ID NO: 6502355 - DNA, 18 bp, Homo sapiens
tgcagccgcagagaaatg

SEQ ID NO: 6502356 - DNA, 15 bp, Homo sapiens
tgcagccgccttcct

SEQ ID NO: 6502357 - DNA, 15 bp, Homo sapiens
tgcagccggaggagg

SEQ ID NO: 6502358 - DNA, 17 bp, Homo sapiens
tgcagccggcacagggt

SEQ ID NO: 6502359 - DNA, 19 bp, Homo sapiens
tgcagccggggagctgagg

SEQ ID NO: 6502360 - DNA, 22 bp, Homo sapiens
tgcagcctaaagtacagcctgg

SEQ ID NO: 6502361 - DNA, 23 bp, Homo sapiens
tgcagcctaaagtacagcctgga

SEQ ID NO: 6502362 - DNA, 15 bp, Homo sapiens
tgcagcctaagaaga

SEQ ID NO: 6502363 - DNA, 16 bp, Homo sapiens
tgcagcctaagaagaa

SEQ ID NO: 6502364 - DNA, 17 bp, Homo sapiens
tgcagcctaagaagaag

SEQ ID NO: 6502365 - DNA, 21 bp, Homo sapiens
tgcagcctaagaagaaggcca

SEQ ID NO: 6502366 - DNA, 18 bp, Homo sapiens
tgcagcctcaacctcctg

SEQ ID NO: 6502367 - DNA, 22 bp, Homo sapiens
tgcagcctcaacctcctgggct

SEQ ID NO: 6502368 - DNA, 13 bp, Homo sapiens
tgcagcctcacag

SEQ ID NO: 6502369 - DNA, 17 bp, Homo sapiens
tgcagcctcacagtcct

SEQ ID NO: 6502370 - DNA, 18 bp, Homo sapiens
tgcagcctcacagtcctt

SEQ ID NO: 6502371 - DNA, 12 bp, Homo sapiens
tgcagcctcaga

SEQ ID NO: 6502372 - DNA, 19 bp, Homo sapiens
tgcagcctcaggactggga

SEQ ID NO: 6502373 - DNA, 20 bp, Homo sapiens
tgcagcctcaggactgggag

SEQ ID NO: 6502374 - DNA, 21 bp, Homo sapiens
tgcagcctcatactcctgggc

SEQ ID NO: 6502375 - DNA, 15 bp, Homo sapiens
tgcagcctccacttc

SEQ ID NO: 6502376 - DNA, 14 bp, Homo sapiens
tgcagcctccccca

SEQ ID NO: 6502377 - DNA, 22 bp, Homo sapiens
tgcagcctcccccacaaataat

SEQ ID NO: 6502378 - DNA, 12 bp, Homo sapiens
tgcagcctccct

SEQ ID NO: 6502379 - DNA, 13 bp, Homo sapiens
tgcagcctccggg

SEQ ID NO: 6502380 - DNA, 19 bp, Homo sapiens
tgcagcctcctcctgacca

SEQ ID NO: 6502381 - DNA, 15 bp, Homo sapiens
tgtcaaataaacact

SEQ ID NO: 6502382 - DNA, 16 bp, Homo sapiens
tgtcaaataaagcaaa

SEQ ID NO: 6502383 - DNA, 16 bp, Homo sapiens
tgtcaaatatctcaga

SEQ ID NO: 6502384 - DNA, 13 bp, Homo sapiens
tgtcaaatgaact

SEQ ID NO: 6502385 - DNA, 17 bp, Homo sapiens
tgtcaaatgaactttta

SEQ ID NO: 6502386 - DNA, 21 bp, Homo sapiens
tgtcaaatgaacttttacaga

SEQ ID NO: 6502387 - DNA, 20 bp, Homo sapiens
tgtcaaatgcccactctcca

SEQ ID NO: 6502388 - DNA, 23 bp, Homo sapiens
tgtcaaatggtattttttgtgaa

SEQ ID NO: 6502389 - DNA, 23 bp, Homo sapiens
tgtcaaatgtcattatgtagaaa

SEQ ID NO: 6502390 - DNA, 18 bp, Homo sapiens
tgtcaaatgtttccttaa

SEQ ID NO: 6502391 - DNA, 22 bp, Homo sapiens
tgtcaaatgtttccttaaacat

SEQ ID NO: 6502392 - DNA, 12 bp, Homo sapiens
tgtcaacaaaaa

SEQ ID NO: 6502393 - DNA, 15 bp, Homo sapiens
tgtcaacaaaaagac

SEQ ID NO: 6502394 - DNA, 18 bp, Homo sapiens
tgtcaacaaaaagacatg

SEQ ID NO: 6502395 - DNA, 20 bp, Homo sapiens
tgtcaacacaaagacatgga

SEQ ID NO: 6502396 - DNA, 16 bp, Homo sapiens
tgtcaacaccagaaag

SEQ ID NO: 6502397 - DNA, 22 bp, Homo sapiens
tgtcaacacccctgtgtggatg

SEQ ID NO: 6502398 - DNA, 20 bp, Homo sapiens
tgtcaaccccaagttagttc

SEQ ID NO: 6502399 - DNA, 15 bp, Homo sapiens
tgtcaacccctctca

SEQ ID NO: 6502400 - DNA, 19 bp, Homo sapiens
tgtcaacctttgtaagaaa

SEQ ID NO: 6502401 - DNA, 15 bp, Homo sapiens
tgtcaactatgatat

SEQ ID NO: 6502402 - DNA, 17 bp, Homo sapiens
tgtcaactgagagtcat

SEQ ID NO: 6502403 - DNA, 18 bp, Homo sapiens
tgtcaactgagagtcata

SEQ ID NO: 6502404 - DNA, 18 bp, Homo sapiens
tgtcaacttctggctcct

SEQ ID NO: 6502405 - DNA, 14 bp, Homo sapiens
tgtcaagaaagagc

SEQ ID NO: 6502406 - DNA, 14 bp, Homo sapiens
tgtcaagaaattct

SEQ ID NO: 6502407 - DNA, 14 bp, Homo sapiens
tgtcaagaacagga

SEQ ID NO: 6502408 - DNA, 15 bp, Homo sapiens
tgtcaagaatgagaa

SEQ ID NO: 6502409 - DNA, 19 bp, Homo sapiens
tgtcaagagggtctgagga

SEQ ID NO: 6502410 - DNA, 17 bp, Homo sapiens
tgtcaagagtcgctgtg

SEQ ID NO: 6502411 - DNA, 22 bp, Homo sapiens
tgtcaagcaatggggaatacaa

SEQ ID NO: 6502412 - DNA, 23 bp, Homo sapiens
tgtcaagccatttttacatctaa

SEQ ID NO: 6502413 - DNA, 17 bp, Homo sapiens
tgtcaagcctgtgcaaa

SEQ ID NO: 6502414 - DNA, 19 bp, Homo sapiens
tgtcaagctgaccttgctg

SEQ ID NO: 6502415 - DNA, 18 bp, Homo sapiens
tgtcaagctggccgtgga

SEQ ID NO: 6502416 - DNA, 18 bp, Homo sapiens
tgtcaagcttactacagt

SEQ ID NO: 6502417 - DNA, 18 bp, Homo sapiens
tgtcaagcttcattatta

SEQ ID NO: 6502418 - DNA, 14 bp, Homo sapiens
tgtcaagcttctct

SEQ ID NO: 6502419 - DNA, 18 bp, Homo sapiens
tgtcaaggaaaggatgca

SEQ ID NO: 6502420 - DNA, 14 bp, Homo sapiens
tgtcaaggaagaag

SEQ ID NO: 6502421 - DNA, 23 bp, Homo sapiens
tgtcaaggaagacttttggtaga

SEQ ID NO: 6502422 - DNA, 22 bp, Homo sapiens
tgtcaaggccgagggccaggca

SEQ ID NO: 6502423 - DNA, 23 bp, Homo sapiens
tgtcaaggccgagggccaggcag

SEQ ID NO: 6502424 - DNA, 18 bp, Homo sapiens
tgtcaaggggccctagga

SEQ ID NO: 6502425 - DNA, 19 bp, Homo sapiens
tgtcaaggtgaagcacata

SEQ ID NO: 6502426 - DNA, 13 bp, Homo sapiens
tgtcaaggtgctg

SEQ ID NO: 6502427 - DNA, 13 bp, Homo sapiens
tgtcaagtcctga

SEQ ID NO: 6502428 - DNA, 21 bp, Homo sapiens
tgtcaagtcctgactgggctg

SEQ ID NO: 6502429 - DNA, 18 bp, Homo sapiens
tgtcaagtctctgctggc

SEQ ID NO: 6502430 - DNA, 19 bp, Homo sapiens
tgtcaagtctctgctggcc

SEQ ID NO: 6502431 - DNA, 19 bp, Homo sapiens
tgtcaagtgggatctgtca

SEQ ID NO: 6502432 - DNA, 21 bp, Homo sapiens
tgtcaagttaacaaggaatgc

SEQ ID NO: 6502433 - DNA, 15 bp, Homo sapiens
tgtcaagttgtacat

SEQ ID NO: 6502434 - DNA, 17 bp, Homo sapiens
tgtcaagttgtgcttgt

SEQ ID NO: 6502435 - DNA, 23 bp, Homo sapiens
tgtcaagttttgggggtgggctg

SEQ ID NO: 6502436 - DNA, 22 bp, Homo sapiens
tgtcaagtttttatacctgtac

SEQ ID NO: 6502437 - DNA, 10 bp, Homo sapiens
tgtcaataaa

SEQ ID NO: 6502438 - DNA, 16 bp, Homo sapiens
tgtcaataaacagctt

SEQ ID NO: 6502439 - DNA, 23 bp, Homo sapiens
tgtcaataaacagcttcatgcct

SEQ ID NO: 6502440 - DNA, 23 bp, Homo sapiens
tgtcaataaagctgtgcttgggg

SEQ ID NO: 6502441 - DNA, 13 bp, Homo sapiens
tgtcaataaatga

SEQ ID NO: 6502442 - DNA, 14 bp, Homo sapiens
tgtcaataaatgac

SEQ ID NO: 6502443 - DNA, 18 bp, Homo sapiens
tgtcaataaatgacaccc

SEQ ID NO: 6502444 - DNA, 17 bp, Homo sapiens
tgtcaataaatgttgaa

SEQ ID NO: 6502445 - DNA, 19 bp, Homo sapiens
tgtcaataaatgttgaaaa

SEQ ID NO: 6502446 - DNA, 12 bp, Homo sapiens
tgtcaataaatt

SEQ ID NO: 6502447 - DNA, 15 bp, Homo sapiens
tgtcaataaggagca

SEQ ID NO: 6502448 - DNA, 17 bp, Homo sapiens
tgtcaatactgagccat

SEQ ID NO: 6502449 - DNA, 18 bp, Homo sapiens
tgtcaatagtattaacta

SEQ ID NO: 6502450 - DNA, 22 bp, Homo sapiens
tgtcaatatcgtacctgtccct

SEQ ID NO: 6502451 - DNA, 17 bp, Homo sapiens
tgtcaatattaaataca

SEQ ID NO: 6502452 - DNA, 21 bp, Homo sapiens
tgtcaatattaaatacagaca

SEQ ID NO: 6502453 - DNA, 23 bp, Homo sapiens
tgtcaatattaaatacagacact

SEQ ID NO: 6502454 - DNA, 20 bp, Homo sapiens
tgtcaatcagcctagttgat

SEQ ID NO: 6502455 - DNA, 22 bp, Homo sapiens
tgtcaatcttaagaggatggat

SEQ ID NO: 6502456 - DNA, 17 bp, Homo sapiens
tgtcaatgagagcataa

SEQ ID NO: 6502457 - DNA, 20 bp, Homo sapiens
tgtcaatgcagttgtctctg

SEQ ID NO: 6502458 - DNA, 17 bp, Homo sapiens
tgtcaatggaagaaacc

SEQ ID NO: 6502459 - DNA, 13 bp, Homo sapiens
tgtcaatgtaaag

SEQ ID NO: 6502460 - DNA, 14 bp, Homo sapiens
tgtcaattacagga

SEQ ID NO: 6502461 - DNA, 17 bp, Homo sapiens
tgtcaattacaggaagt

SEQ ID NO: 6502462 - DNA, 16 bp, Homo sapiens
tgtcaattaccagaaa

SEQ ID NO: 6502463 - DNA, 18 bp, Homo sapiens
tgtcaattgatatttctg

SEQ ID NO: 6502464 - DNA, 19 bp, Homo sapiens
tgtcaatttataatgatta

SEQ ID NO: 6502465 - DNA, 19 bp, Homo sapiens
tgtcaatttccctcaggtt

SEQ ID NO: 6502466 - DNA, 19 bp, Homo sapiens
tgtcaatttccctgactcc

SEQ ID NO: 6502467 - DNA, 22 bp, Homo sapiens
tgtcaatttggtttagaatgct

SEQ ID NO: 6502468 - DNA, 17 bp, Homo sapiens
tgtcaatttgtatatca

SEQ ID NO: 6502469 - DNA, 18 bp, Homo sapiens
tgtcaatttgtatatcat

SEQ ID NO: 6502470 - DNA, 22 bp, Homo sapiens
tgtcaatttgttggagatgcag

SEQ ID NO: 6502471 - DNA, 12 bp, Homo sapiens
tgtcacaaagaa

SEQ ID NO: 6502472 - DNA, 19 bp, Homo sapiens
tgtcacaaagctaaataca

SEQ ID NO: 6502473 - DNA, 17 bp, Homo sapiens
tgtcacaaagtgagaaa

SEQ ID NO: 6502474 - DNA, 19 bp, Homo sapiens
tgtcacaaagtgagaaatt

SEQ ID NO: 6502475 - DNA, 21 bp, Homo sapiens
tgtcacaacaattaaatatac

SEQ ID NO: 6502476 - DNA, 17 bp, Homo sapiens
tgtcacaacctctctga

SEQ ID NO: 6502477 - DNA, 22 bp, Homo sapiens
tgtcacaagtggtgtttattgc

SEQ ID NO: 6502478 - DNA, 16 bp, Homo sapiens
tgtcacaataaatggc

SEQ ID NO: 6502479 - DNA, 19 bp, Homo sapiens
tgtcacaattatgtgcaaa

SEQ ID NO: 6502480 - DNA, 12 bp, Homo sapiens
tgtcacacactg

SEQ ID NO: 6502481 - DNA, 13 bp, Homo sapiens
tgtcacacacttt

SEQ ID NO: 6502482 - DNA, 13 bp, Homo sapiens
tgtcacaccagcc

SEQ ID NO: 6502483 - DNA, 15 bp, Homo sapiens
tgtcacacccatggc

SEQ ID NO: 6502484 - DNA, 15 bp, Homo sapiens
tgtcacactaaaatt

SEQ ID NO: 6502485 - DNA, 16 bp, Homo sapiens
tgtcacacttgtttct

SEQ ID NO: 6502486 - DNA, 14 bp, Homo sapiens
tgtcacagaaatca

SEQ ID NO: 6502487 - DNA, 14 bp, Homo sapiens
tgtcacagaaatta

SEQ ID NO: 6502488 - DNA, 20 bp, Homo sapiens
tgtcacagaaattatgatcc

SEQ ID NO: 6502489 - DNA, 20 bp, Homo sapiens
tgtcacagaggcagtggcag

SEQ ID NO: 6502490 - DNA, 13 bp, Homo sapiens
tgtcacagctctg

SEQ ID NO: 6502491 - DNA, 18 bp, Homo sapiens
tgtcacagctctgtagaa

SEQ ID NO: 6502492 - DNA, 21 bp, Homo sapiens
tgtcacaggaaggctgtctca

SEQ ID NO: 6502493 - DNA, 12 bp, Homo sapiens
tgtcacaggcag

SEQ ID NO: 6502494 - DNA, 13 bp, Homo sapiens
tgtcacaggcagg

SEQ ID NO: 6502495 - DNA, 14 bp, Homo sapiens
tgtcacaggcaggt

SEQ ID NO: 6502496 - DNA, 13 bp, Homo sapiens
tgtcacaggctgg

SEQ ID NO: 6502497 - DNA, 16 bp, Homo sapiens
tgtcacaggctgggtc

SEQ ID NO: 6502498 - DNA, 13 bp, Homo sapiens
tgtcacagggcca

SEQ ID NO: 6502499 - DNA, 18 bp, Homo sapiens
tgtcacagtaaaaataaa

SEQ ID NO: 6502500 - DNA, 23 bp, Homo sapiens
tgtcacagtaaaaataaaatact

SEQ ID NO: 6502501 - DNA, 18 bp, Homo sapiens
tgtcacagtcttgtgaac

SEQ ID NO: 6502502 - DNA, 18 bp, Homo sapiens
tgtcacagtttcaggctt

SEQ ID NO: 6502503 - DNA, 17 bp, Homo sapiens
tgtcacagtttgttcag

SEQ ID NO: 6502504 - DNA, 19 bp, Homo sapiens
tgtcacatagtttttcctg

SEQ ID NO: 6502505 - DNA, 16 bp, Homo sapiens
tgtcacatcaagcatc

SEQ ID NO: 6502506 - DNA, 21 bp, Homo sapiens
tgtcacatcagcaatttcaga

SEQ ID NO: 6502507 - DNA, 20 bp, Homo sapiens
tgtcacatgaaacatttgca

SEQ ID NO: 6502508 - DNA, 18 bp, Homo sapiens
tgtcacatgacatccaca

SEQ ID NO: 6502509 - DNA, 19 bp, Homo sapiens
tgtcacatgacatccacat

SEQ ID NO: 6502510 - DNA, 20 bp, Homo sapiens
tgtcacatgacatccacatg

SEQ ID NO: 6502511 - DNA, 17 bp, Homo sapiens
tgtcacatggtgcccct

SEQ ID NO: 6502512 - DNA, 20 bp, Homo sapiens
tgtcacatttagctgtgctc

SEQ ID NO: 6502513 - DNA, 18 bp, Homo sapiens
tgtcacatttgaattctt

SEQ ID NO: 6502514 - DNA, 23 bp, Homo sapiens
tgtcaccaccttcccagctctcc

SEQ ID NO: 6502515 - DNA, 15 bp, Homo sapiens
tgtcaccagatctga

SEQ ID NO: 6502516 - DNA, 19 bp, Homo sapiens
tgtcaccagcaacatctcg

SEQ ID NO: 6502517 - DNA, 18 bp, Homo sapiens
tgtcaccagctgccaaaa

SEQ ID NO: 6502518 - DNA, 20 bp, Homo sapiens
tgtcaccaggcaaccaggaa

SEQ ID NO: 6502519 - DNA, 13 bp, Homo sapiens
tgtcaccatcatt

SEQ ID NO: 6502520 - DNA, 15 bp, Homo sapiens
tgtcaccatcatttc

SEQ ID NO: 6502521 - DNA, 17 bp, Homo sapiens
tgtcacccagcaaggca

SEQ ID NO: 6502522 - DNA, 23 bp, Homo sapiens
tgtcacccagcaaggcacaggct

SEQ ID NO: 6502523 - DNA, 23 bp, Homo sapiens
tgtcacccaggctggagtgcagt

SEQ ID NO: 6502524 - DNA, 16 bp, Homo sapiens
tgtcaccccagagcca

SEQ ID NO: 6502525 - DNA, 18 bp, Homo sapiens
tgtcaccccagagccaca

SEQ ID NO: 6502526 - DNA, 22 bp, Homo sapiens
tgtcaccccagagccacacatg

SEQ ID NO: 6502527 - DNA, 17 bp, Homo sapiens
tgtcaccccagtcacct

SEQ ID NO: 6502528 - DNA, 13 bp, Homo sapiens
tgtcacccccact

SEQ ID NO: 6502529 - DNA, 20 bp, Homo sapiens
tgtcacccccactcccgcct

SEQ ID NO: 6502530 - DNA, 20 bp, Homo sapiens
tgtcacccgatcgccagcaa

SEQ ID NO: 6502531 - DNA, 16 bp, Homo sapiens
tgtcaccctgtgggtg

SEQ ID NO: 6502532 - DNA, 18 bp, Homo sapiens
tgtcaccgtggaccttcc

SEQ ID NO: 6502533 - DNA, 20 bp, Homo sapiens
tgtcaccgtggaccttcctg

SEQ ID NO: 6502534 - DNA, 21 bp, Homo sapiens
tgtcacctagcagatatgtat

SEQ ID NO: 6502535 - DNA, 13 bp, Homo sapiens
tgtcacctcagct

SEQ ID NO: 6502536 - DNA, 13 bp, Homo sapiens
tgtcacctccttc

SEQ ID NO: 6502537 - DNA, 17 bp, Homo sapiens
tgtcacctcgctgggct

SEQ ID NO: 6502538 - DNA, 19 bp, Homo sapiens
tgtcacctcgctgggctct

SEQ ID NO: 6502539 - DNA, 17 bp, Homo sapiens
tgtcacctctcagctgc

SEQ ID NO: 6502540 - DNA, 19 bp, Homo sapiens
tgtcacctctctcagagca

SEQ ID NO: 6502541 - DNA, 13 bp, Homo sapiens
tgtcacctggcct

SEQ ID NO: 6502542 - DNA, 14 bp, Homo sapiens
tgtcacctggctgc

SEQ ID NO: 6502543 - DNA, 22 bp, Homo sapiens
tgtcacctgggagggtgggacc

SEQ ID NO: 6502544 - DNA, 14 bp, Homo sapiens
tgtcaccttcacct

SEQ ID NO: 6502545 - DNA, 12 bp, Homo sapiens
tgtcacctttct

SEQ ID NO: 6502546 - DNA, 22 bp, Homo sapiens
tgtcacctttcttcttgtgtct

SEQ ID NO: 6502547 - DNA, 13 bp, Homo sapiens
tgtcaccttttct

SEQ ID NO: 6502548 - DNA, 20 bp, Homo sapiens
tgtcaccttttcttgcctga

SEQ ID NO: 6502549 - DNA, 18 bp, Homo sapiens
tgtcacgaatatggacat

SEQ ID NO: 6502550 - DNA, 19 bp, Homo sapiens
tgtcacgatcacaggcctt

SEQ ID NO: 6502551 - DNA, 16 bp, Homo sapiens
tgtcacgattgtcatc

SEQ ID NO: 6502552 - DNA, 13 bp, Homo sapiens
tgtcacgcaggct

SEQ ID NO: 6502553 - DNA, 21 bp, Homo sapiens
tgtcacgctcatgtcctgtcc

SEQ ID NO: 6502554 - DNA, 16 bp, Homo sapiens
tgtcacggaaagcatc

SEQ ID NO: 6502555 - DNA, 17 bp, Homo sapiens
tgtcacggaacagatct

SEQ ID NO: 6502556 - DNA, 16 bp, Homo sapiens
tgtcacggccaggcag

SEQ ID NO: 6502557 - DNA, 13 bp, Homo sapiens
tgtcacgtactgt

SEQ ID NO: 6502558 - DNA, 15 bp, Homo sapiens
tgtcacgtactgtct

SEQ ID NO: 6502559 - DNA, 14 bp, Homo sapiens
tgcagcctctgcct

SEQ ID NO: 6502560 - DNA, 15 bp, Homo sapiens
tgcagcctctgcctc

SEQ ID NO: 6502561 - DNA, 12 bp, Homo sapiens
tgcagcctgagc

SEQ ID NO: 6502562 - DNA, 16 bp, Homo sapiens
tgcagcctgagctcca

SEQ ID NO: 6502563 - DNA, 14 bp, Homo sapiens
tgcagcctgcgcca

SEQ ID NO: 6502564 - DNA, 22 bp, Homo sapiens
tgcagcctgctctagtgggaca

SEQ ID NO: 6502565 - DNA, 14 bp, Homo sapiens
tgcagcctgctggg

SEQ ID NO: 6502566 - DNA, 12 bp, Homo sapiens
tgcagcctggct

SEQ ID NO: 6502567 - DNA, 13 bp, Homo sapiens
tgcagcctggctg

SEQ ID NO: 6502568 - DNA, 18 bp, Homo sapiens
tgcagcctggctggtcct

SEQ ID NO: 6502569 - DNA, 20 bp, Homo sapiens
tgcagcctggctggtcctcc

SEQ ID NO: 6502570 - DNA, 23 bp, Homo sapiens
tgcagcctggctggtcctcccat

SEQ ID NO: 6502571 - DNA, 12 bp, Homo sapiens
tgcagcctgggc

SEQ ID NO: 6502572 - DNA, 12 bp, Homo sapiens
tgcagcctgggt

SEQ ID NO: 6502573 - DNA, 14 bp, Homo sapiens
tgcagcctgggtct

SEQ ID NO: 6502574 - DNA, 15 bp, Homo sapiens
tgcagcctggtagaa

SEQ ID NO: 6502575 - DNA, 16 bp, Homo sapiens
tgcagcctggttggca

SEQ ID NO: 6502576 - DNA, 17 bp, Homo sapiens
tgcagcctgtggcttgg

SEQ ID NO: 6502577 - DNA, 22 bp, Homo sapiens
tgcagcctgtggcttggagtgg

SEQ ID NO: 6502578 - DNA, 15 bp, Homo sapiens
tgcagccttaaacag

SEQ ID NO: 6502579 - DNA, 22 bp, Homo sapiens
tgcagccttaaacagtgtccag

SEQ ID NO: 6502580 - DNA, 20 bp, Homo sapiens
tgcagccttcatcagaactc

SEQ ID NO: 6502581 - DNA, 17 bp, Homo sapiens
tgcagccttcccctccc

SEQ ID NO: 6502582 - DNA, 15 bp, Homo sapiens
tgcagccttggggca

SEQ ID NO: 6502583 - DNA, 15 bp, Homo sapiens
tgcagcgacccttgg

SEQ ID NO: 6502584 - DNA, 22 bp, Homo sapiens
tgcagcgacccttggtgtttcc

SEQ ID NO: 6502585 - DNA, 15 bp, Homo sapiens
tgcagcgagctgaga

SEQ ID NO: 6502586 - DNA, 14 bp, Homo sapiens
tgcagcgccacctg

SEQ ID NO: 6502587 - DNA, 20 bp, Homo sapiens
tgcagcggaagggactctgg

SEQ ID NO: 6502588 - DNA, 16 bp, Homo sapiens
tgcagcggcagagcaa

SEQ ID NO: 6502589 - DNA, 15 bp, Homo sapiens
tgcagcggctgccct

SEQ ID NO: 6502590 - DNA, 16 bp, Homo sapiens
tgcagcgggccaggca

SEQ ID NO: 6502591 - DNA, 20 bp, Homo sapiens
tgcagcggtggaaggagcct

SEQ ID NO: 6502592 - DNA, 14 bp, Homo sapiens
tgcagctaacatga

SEQ ID NO: 6502593 - DNA, 22 bp, Homo sapiens
tgcagctaagctcaaatgtata

SEQ ID NO: 6502594 - DNA, 18 bp, Homo sapiens
tgcagctaatttgtgaaa

SEQ ID NO: 6502595 - DNA, 15 bp, Homo sapiens
tgcagctactggaat

SEQ ID NO: 6502596 - DNA, 16 bp, Homo sapiens
tgcagctactggaatg

SEQ ID NO: 6502597 - DNA, 14 bp, Homo sapiens
tgcagctatctggt

SEQ ID NO: 6502598 - DNA, 20 bp, Homo sapiens
tgcagctatgcgcaatgtgg

SEQ ID NO: 6502599 - DNA, 18 bp, Homo sapiens
tgcagctatggacaattt

SEQ ID NO: 6502600 - DNA, 18 bp, Homo sapiens
tgcagctattcacacaca

SEQ ID NO: 6502601 - DNA, 19 bp, Homo sapiens
tgcagctattcacacacac

SEQ ID NO: 6502602 - DNA, 17 bp, Homo sapiens
tgcagctcaagggctgg

SEQ ID NO: 6502603 - DNA, 19 bp, Homo sapiens
tgcagctcaagggctggca

SEQ ID NO: 6502604 - DNA, 18 bp, Homo sapiens
tgcagctcagaaccacag

SEQ ID NO: 6502605 - DNA, 19 bp, Homo sapiens
tgcagctcagaaccacagc

SEQ ID NO: 6502606 - DNA, 20 bp, Homo sapiens
tgcagctcagaaccacagca

SEQ ID NO: 6502607 - DNA, 18 bp, Homo sapiens
tgcagctccctcctcagg

SEQ ID NO: 6502608 - DNA, 14 bp, Homo sapiens
tgcagctccctggc

SEQ ID NO: 6502609 - DNA, 13 bp, Homo sapiens
tgcagctctgcag

SEQ ID NO: 6502610 - DNA, 20 bp, Homo sapiens
tgcagctctgcagcaatatt

SEQ ID NO: 6502611 - DNA, 18 bp, Homo sapiens
tgcagctcttcctggaca

SEQ ID NO: 6502612 - DNA, 21 bp, Homo sapiens
tgcagctctttcttctttgaa

SEQ ID NO: 6502613 - DNA, 15 bp, Homo sapiens
tgcagctgaaattga

SEQ ID NO: 6502614 - DNA, 19 bp, Homo sapiens
tgcagctgaaattgaaaag

SEQ ID NO: 6502615 - DNA, 15 bp, Homo sapiens
tgcagctgacctctg

SEQ ID NO: 6502616 - DNA, 16 bp, Homo sapiens
tgcagctgagcctgag

SEQ ID NO: 6502617 - DNA, 18 bp, Homo sapiens
tgcagctgattttaacaa

SEQ ID NO: 6502618 - DNA, 22 bp, Homo sapiens
tgcagctgattttaacaataac

SEQ ID NO: 6502619 - DNA, 19 bp, Homo sapiens
tgcagctgcaccatcacac

SEQ ID NO: 6502620 - DNA, 20 bp, Homo sapiens
tgcagctgcccagcccctcc

SEQ ID NO: 6502621 - DNA, 19 bp, Homo sapiens
tgcagctgcctggggccca

SEQ ID NO: 6502622 - DNA, 19 bp, Homo sapiens
tgcagctgcttgttgtcaa

SEQ ID NO: 6502623 - DNA, 22 bp, Homo sapiens
tgcagctgcttttgcagaaatc

SEQ ID NO: 6502624 - DNA, 18 bp, Homo sapiens
tgcagctggaatgtgcca

SEQ ID NO: 6502625 - DNA, 20 bp, Homo sapiens
tgcagctggaatgtgccaca

SEQ ID NO: 6502626 - DNA, 14 bp, Homo sapiens
tgcagctggcccac

SEQ ID NO: 6502627 - DNA, 23 bp, Homo sapiens
tgcagctggcccactgctggctg

SEQ ID NO: 6502628 - DNA, 13 bp, Homo sapiens
tgcagctgggccc

SEQ ID NO: 6502629 - DNA, 18 bp, Homo sapiens
tgcagctgggccccatgc

SEQ ID NO: 6502630 - DNA, 22 bp, Homo sapiens
tgcagctgggccccatgctctg

SEQ ID NO: 6502631 - DNA, 20 bp, Homo sapiens
tgcagctgggcttggcctgg

SEQ ID NO: 6502632 - DNA, 21 bp, Homo sapiens
tgcagctgggcttggcctgga

SEQ ID NO: 6502633 - DNA, 15 bp, Homo sapiens
tgcagctgggtgggg

SEQ ID NO: 6502634 - DNA, 13 bp, Homo sapiens
tgcagctggtgtg

SEQ ID NO: 6502635 - DNA, 16 bp, Homo sapiens
tgcagctgtcaccact

SEQ ID NO: 6502636 - DNA, 12 bp, Homo sapiens
tgcagctgtgag

SEQ ID NO: 6502637 - DNA, 22 bp, Homo sapiens
tgcagctgtggcagagttacag

SEQ ID NO: 6502638 - DNA, 14 bp, Homo sapiens
tgcagctgtttcaa

SEQ ID NO: 6502639 - DNA, 19 bp, Homo sapiens
tgcagctgtttcaaagttg

SEQ ID NO: 6502640 - DNA, 19 bp, Homo sapiens
tgcagctgttttcaaagcc

SEQ ID NO: 6502641 - DNA, 15 bp, Homo sapiens
tgcagctgttttgtt

SEQ ID NO: 6502642 - DNA, 21 bp, Homo sapiens
tgcagctgttttgttgacatt

SEQ ID NO: 6502643 - DNA, 20 bp, Homo sapiens
tgcagcttcaggtgagccaa

SEQ ID NO: 6502644 - DNA, 11 bp, Homo sapiens
tgcagcttcct

SEQ ID NO: 6502645 - DNA, 13 bp, Homo sapiens
tgcagcttcctgt

SEQ ID NO: 6502646 - DNA, 16 bp, Homo sapiens
tgcagcttcgaggaca

SEQ ID NO: 6502647 - DNA, 22 bp, Homo sapiens
tgcagcttggagacaggattct

SEQ ID NO: 6502648 - DNA, 20 bp, Homo sapiens
tgcagcttggcattcttctt

SEQ ID NO: 6502649 - DNA, 18 bp, Homo sapiens
tgcagcttgggagagccc

SEQ ID NO: 6502650 - DNA, 16 bp, Homo sapiens
tgcagcttgtagccag

SEQ ID NO: 6502651 - DNA, 19 bp, Homo sapiens
tgcagcttgtgctgagcct

SEQ ID NO: 6502652 - DNA, 13 bp, Homo sapiens
tgcagctttatgt

SEQ ID NO: 6502653 - DNA, 16 bp, Homo sapiens
tgcagcttttggttaa

SEQ ID NO: 6502654 - DNA, 20 bp, Homo sapiens
tgcagcttttggttaatatg

SEQ ID NO: 6502655 - DNA, 24 bp, Homo sapiens
tgcagcttttggttaatatgtctt

SEQ ID NO: 6502656 - DNA, 23 bp, Homo sapiens
tgcaggaaaaggctaagaaaaag

SEQ ID NO: 6502657 - DNA, 19 bp, Homo sapiens
tgcaggaaatcagagctgg

SEQ ID NO: 6502658 - DNA, 17 bp, Homo sapiens
tgcaggaaatggctgtg

SEQ ID NO: 6502659 - DNA, 15 bp, Homo sapiens
tgcaggaacatgacc

SEQ ID NO: 6502660 - DNA, 19 bp, Homo sapiens
tgcaggaagagatgctcta

SEQ ID NO: 6502661 - DNA, 18 bp, Homo sapiens
tgcaggaagaggcccact

SEQ ID NO: 6502662 - DNA, 13 bp, Homo sapiens
tgcaggaaggaaa

SEQ ID NO: 6502663 - DNA, 15 bp, Homo sapiens
tgcaggaaggagctg

SEQ ID NO: 6502664 - DNA, 20 bp, Homo sapiens
tgcaggaaggagctgcctgg

SEQ ID NO: 6502665 - DNA, 22 bp, Homo sapiens
tgcaggaaggagctgcctggac

SEQ ID NO: 6502666 - DNA, 15 bp, Homo sapiens
tgcaggaatcaaaaa

SEQ ID NO: 6502667 - DNA, 19 bp, Homo sapiens
tgcaggaatcaaaaattga

SEQ ID NO: 6502668 - DNA, 21 bp, Homo sapiens
tgcaggaatcacccctctgcc

SEQ ID NO: 6502669 - DNA, 22 bp, Homo sapiens
tgcaggaatcacccctctgccc

SEQ ID NO: 6502670 - DNA, 22 bp, Homo sapiens
tgcaggacagagggaagccagt

SEQ ID NO: 6502671 - DNA, 14 bp, Homo sapiens
tgcaggacagctct

SEQ ID NO: 6502672 - DNA, 20 bp, Homo sapiens
tgcaggaccctgtcctgcag

SEQ ID NO: 6502673 - DNA, 15 bp, Homo sapiens
tgcaggacctcaggt

SEQ ID NO: 6502674 - DNA, 16 bp, Homo sapiens
tgcaggacctgcctgt

SEQ ID NO: 6502675 - DNA, 23 bp, Homo sapiens
tgcaggactctagctcatgagtg

SEQ ID NO: 6502676 - DNA, 23 bp, Homo sapiens
tgcaggactctatccctggcttc

SEQ ID NO: 6502677 - DNA, 22 bp, Homo sapiens
tgcaggagcaaggctgccctgt

SEQ ID NO: 6502678 - DNA, 13 bp, Homo sapiens
tgcaggagcctcc

SEQ ID NO: 6502679 - DNA, 22 bp, Homo sapiens
tgcaggagcctccctgcacggc

SEQ ID NO: 6502680 - DNA, 12 bp, Homo sapiens
tgcaggaggcca

SEQ ID NO: 6502681 - DNA, 22 bp, Homo sapiens
tgcaggaggccaaactgtccct

SEQ ID NO: 6502682 - DNA, 15 bp, Homo sapiens
tgcaggaggcctggg

SEQ ID NO: 6502683 - DNA, 19 bp, Homo sapiens
tgcaggaggcctgggaggg

SEQ ID NO: 6502684 - DNA, 18 bp, Homo sapiens
tgcaggagtttgtggtaa

SEQ ID NO: 6502685 - DNA, 19 bp, Homo sapiens
tgcaggagtttgtggtaac

SEQ ID NO: 6502686 - DNA, 20 bp, Homo sapiens
tgcaggatctcaccaggcag

SEQ ID NO: 6502687 - DNA, 18 bp, Homo sapiens
tgcaggatggtgtctctt

SEQ ID NO: 6502688 - DNA, 15 bp, Homo sapiens
tgcaggattcccttc

SEQ ID NO: 6502689 - DNA, 19 bp, Homo sapiens
tgcaggattcccttctggg

SEQ ID NO: 6502690 - DNA, 17 bp, Homo sapiens
tgcaggattctcaccag

SEQ ID NO: 6502691 - DNA, 19 bp, Homo sapiens
tgcaggatttgttctctgt

SEQ ID NO: 6502692 - DNA, 16 bp, Homo sapiens
tgcaggcaagacacct

SEQ ID NO: 6502693 - DNA, 20 bp, Homo sapiens
tgcaggcaagacaccttccc

SEQ ID NO: 6502694 - DNA, 22 bp, Homo sapiens
tgcaggcacacacgccttcatg

SEQ ID NO: 6502695 - DNA, 23 bp, Homo sapiens
tgcaggcacacacgccttcatgc

SEQ ID NO: 6502696 - DNA, 18 bp, Homo sapiens
tgcaggcacagaggaggt

SEQ ID NO: 6502697 - DNA, 19 bp, Homo sapiens
tgcaggcaccttagtggct

SEQ ID NO: 6502698 - DNA, 20 bp, Homo sapiens
tgcaggcacttattgtaaat

SEQ ID NO: 6502699 - DNA, 13 bp, Homo sapiens
tgcaggcagacac

SEQ ID NO: 6502700 - DNA, 15 bp, Homo sapiens
tgcaggcagccaggc

SEQ ID NO: 6502701 - DNA, 16 bp, Homo sapiens
tgcaggcagccaggcc

SEQ ID NO: 6502702 - DNA, 17 bp, Homo sapiens
tgcaggcagccaggcca

SEQ ID NO: 6502703 - DNA, 18 bp, Homo sapiens
tgcaggcagccaggccac

SEQ ID NO: 6502704 - DNA, 19 bp, Homo sapiens
tgcaggcagccaggccaca

SEQ ID NO: 6502705 - DNA, 17 bp, Homo sapiens
tgcaggcagcctgcaga

SEQ ID NO: 6502706 - DNA, 14 bp, Homo sapiens
tgcaggcagccttg

SEQ ID NO: 6502707 - DNA, 19 bp, Homo sapiens
tgcaggcaggaacaaacag

SEQ ID NO: 6502708 - DNA, 16 bp, Homo sapiens
tgcaggcaggcagacc

SEQ ID NO: 6502709 - DNA, 19 bp, Homo sapiens
tgcaggcaggcggctcctc

SEQ ID NO: 6502710 - DNA, 14 bp, Homo sapiens
tgcaggcagtgtct

SEQ ID NO: 6502711 - DNA, 21 bp, Homo sapiens
tgcaggcatgcatgtgcttgt

SEQ ID NO: 6502712 - DNA, 15 bp, Homo sapiens
tgcaggcatgcttct

SEQ ID NO: 6502713 - DNA, 13 bp, Homo sapiens
tgcaggccaggcc

SEQ ID NO: 6502714 - DNA, 14 bp, Homo sapiens
tgcaggccaggcca

SEQ ID NO: 6502715 - DNA, 20 bp, Homo sapiens
tgcaggccaggccagcttcc

SEQ ID NO: 6502716 - DNA, 22 bp, Homo sapiens
tgcaggccaggttatgcctcat

SEQ ID NO: 6502717 - DNA, 23 bp, Homo sapiens
tgcaggccagtggacagagggag

SEQ ID NO: 6502718 - DNA, 13 bp, Homo sapiens
tgcaggcccaccc

SEQ ID NO: 6502719 - DNA, 14 bp, Homo sapiens
tgcaggcccaccct

SEQ ID NO: 6502720 - DNA, 10 bp, Homo sapiens
tgcaggcccc

SEQ ID NO: 6502721 - DNA, 17 bp, Homo sapiens
tgcaggccccagccaag

SEQ ID NO: 6502722 - DNA, 11 bp, Homo sapiens
tgcaggccccg

SEQ ID NO: 6502723 - DNA, 15 bp, Homo sapiens
tgcaggccctccctc

SEQ ID NO: 6502724 - DNA, 16 bp, Homo sapiens
tgcaggccctccctct

SEQ ID NO: 6502725 - DNA, 15 bp, Homo sapiens
tgcaggccctggcct

SEQ ID NO: 6502726 - DNA, 11 bp, Homo sapiens
tgcaggccctt

SEQ ID NO: 6502727 - DNA, 17 bp, Homo sapiens
tgcaggcctaggtgcag

SEQ ID NO: 6502728 - DNA, 13 bp, Homo sapiens
tgcaggcggccct

SEQ ID NO: 6502729 - DNA, 16 bp, Homo sapiens
tgcaggcggccctcag

SEQ ID NO: 6502730 - DNA, 18 bp, Homo sapiens
tgcaggcggccctcagtg

SEQ ID NO: 6502731 - DNA, 22 bp, Homo sapiens
tgcaggcggtatccagaggtga

SEQ ID NO: 6502732 - DNA, 23 bp, Homo sapiens
tgcaggcggtatccagaggtgag

SEQ ID NO: 6502733 - DNA, 20 bp, Homo sapiens
tgcaggctaaagtgattcct

SEQ ID NO: 6502734 - DNA, 16 bp, Homo sapiens
tgcaggctccatgcac

SEQ ID NO: 6502735 - DNA, 15 bp, Homo sapiens
tgcaggctcccctga

SEQ ID NO: 6502736 - DNA, 16 bp, Homo sapiens
tgcaggctctgggctc

SEQ ID NO: 6502737 - DNA, 18 bp, Homo sapiens
tgcaggctctgggctcag

SEQ ID NO: 6502738 - DNA, 14 bp, Homo sapiens
tgtcacgtgaccct

SEQ ID NO: 6502739 - DNA, 18 bp, Homo sapiens
tgtcacgtgaccctgtgc

SEQ ID NO: 6502740 - DNA, 19 bp, Homo sapiens
tgtcacgtgaccctgtgcc

SEQ ID NO: 6502741 - DNA, 21 bp, Homo sapiens
tgtcacgtgaccctgtgcccc

SEQ ID NO: 6502742 - DNA, 23 bp, Homo sapiens
tgtcacgtgaccctgtgccccgc

SEQ ID NO: 6502743 - DNA, 17 bp, Homo sapiens
tgtcactaagaatataa

SEQ ID NO: 6502744 - DNA, 23 bp, Homo sapiens
tgtcactaccctcctgtaaaata

SEQ ID NO: 6502745 - DNA, 16 bp, Homo sapiens
tgtcactactcacagt

SEQ ID NO: 6502746 - DNA, 15 bp, Homo sapiens
tgtcactagaatgga

SEQ ID NO: 6502747 - DNA, 20 bp, Homo sapiens
tgtcactagaatggataaaa

SEQ ID NO: 6502748 - DNA, 18 bp, Homo sapiens
tgtcactagcagctgcag

SEQ ID NO: 6502749 - DNA, 18 bp, Homo sapiens
tgtcactcactgaggcca

SEQ ID NO: 6502750 - DNA, 16 bp, Homo sapiens
tgtcactcagcccctt

SEQ ID NO: 6502751 - DNA, 19 bp, Homo sapiens
tgtcactcagccccttccc

SEQ ID NO: 6502752 - DNA, 12 bp, Homo sapiens
tgtcactcaggc

SEQ ID NO: 6502753 - DNA, 15 bp, Homo sapiens
tgtcactcattgctg

SEQ ID NO: 6502754 - DNA, 16 bp, Homo sapiens
tgtcactccataaaaa

SEQ ID NO: 6502755 - DNA, 17 bp, Homo sapiens
tgtcactccataaaaag

SEQ ID NO: 6502756 - DNA, 17 bp, Homo sapiens
tgtcactctaggaagaa

SEQ ID NO: 6502757 - DNA, 22 bp, Homo sapiens
tgtcactctaggaagaagacaa

SEQ ID NO: 6502758 - DNA, 12 bp, Homo sapiens
tgtcactctgcc

SEQ ID NO: 6502759 - DNA, 13 bp, Homo sapiens
tgtcactctgcct

SEQ ID NO: 6502760 - DNA, 19 bp, Homo sapiens
tgtcactgaagtgattgaa

SEQ ID NO: 6502761 - DNA, 21 bp, Homo sapiens
tgtcactgaagtgattgaaag

SEQ ID NO: 6502762 - DNA, 19 bp, Homo sapiens
tgtcactgacacaaaggaa

SEQ ID NO: 6502763 - DNA, 13 bp, Homo sapiens
tgtcactgagact

SEQ ID NO: 6502764 - DNA, 14 bp, Homo sapiens
tgtcactgatggaa

SEQ ID NO: 6502765 - DNA, 11 bp, Homo sapiens
tgtcactgcca

SEQ ID NO: 6502766 - DNA, 16 bp, Homo sapiens
tgtcactgcctgacat

SEQ ID NO: 6502767 - DNA, 14 bp, Homo sapiens
tgtcactgctgtaa

SEQ ID NO: 6502768 - DNA, 19 bp, Homo sapiens
tgtcactgctgtaaagcaa

SEQ ID NO: 6502769 - DNA, 19 bp, Homo sapiens
tgtcactggaacctccctg

SEQ ID NO: 6502770 - DNA, 15 bp, Homo sapiens
tgtcactggcagagc

SEQ ID NO: 6502771 - DNA, 22 bp, Homo sapiens
tgtcactggcagagcacagccc

SEQ ID NO: 6502772 - DNA, 16 bp, Homo sapiens
tgtcactggctgcctc

SEQ ID NO: 6502773 - DNA, 18 bp, Homo sapiens
tgtcactggctgcctcca

SEQ ID NO: 6502774 - DNA, 19 bp, Homo sapiens
tgtcactggctggctccta

SEQ ID NO: 6502775 - DNA, 20 bp, Homo sapiens
tgtcactggctggctcctag

SEQ ID NO: 6502776 - DNA, 16 bp, Homo sapiens
tgtcactgtacagttt

SEQ ID NO: 6502777 - DNA, 17 bp, Homo sapiens
tgtcactgtacagtttt

SEQ ID NO: 6502778 - DNA, 18 bp, Homo sapiens
tgtcactgtacagttttg

SEQ ID NO: 6502779 - DNA, 17 bp, Homo sapiens
tgtcactgtagttttga

SEQ ID NO: 6502780 - DNA, 19 bp, Homo sapiens
tgtcactgtccagagtctc

SEQ ID NO: 6502781 - DNA, 19 bp, Homo sapiens
tgtcactgtccctcctggt

SEQ ID NO: 6502782 - DNA, 14 bp, Homo sapiens
tgtcactgttataa

SEQ ID NO: 6502783 - DNA, 17 bp, Homo sapiens
tgtcactgttataaatt

SEQ ID NO: 6502784 - DNA, 21 bp, Homo sapiens
tgtcactgttataaattttgt

SEQ ID NO: 6502785 - DNA, 22 bp, Homo sapiens
tgtcacttcgcgtgccctcgct

SEQ ID NO: 6502786 - DNA, 14 bp, Homo sapiens
tgtcacttcttcac

SEQ ID NO: 6502787 - DNA, 19 bp, Homo sapiens
tgtcacttgactcttgaat

SEQ ID NO: 6502788 - DNA, 14 bp, Homo sapiens
tgtcacttgcatgt

SEQ ID NO: 6502789 - DNA, 14 bp, Homo sapiens
tgtcacttgccaca

SEQ ID NO: 6502790 - DNA, 19 bp, Homo sapiens
tgtcacttgccacatggtg

SEQ ID NO: 6502791 - DNA, 16 bp, Homo sapiens
tgtcacttgctgcttt

SEQ ID NO: 6502792 - DNA, 20 bp, Homo sapiens
tgtcacttgtaggtttctct

SEQ ID NO: 6502793 - DNA, 14 bp, Homo sapiens
tgtcacttgtgctt

SEQ ID NO: 6502794 - DNA, 18 bp, Homo sapiens
tgtcacttgtgctttgct

SEQ ID NO: 6502795 - DNA, 18 bp, Homo sapiens
tgtcactttgctctgggt

SEQ ID NO: 6502796 - DNA, 16 bp, Homo sapiens
tgtcactttttatgct

SEQ ID NO: 6502797 - DNA, 16 bp, Homo sapiens
tgtcactttttctgat

SEQ ID NO: 6502798 - DNA, 12 bp, Homo sapiens
tgtcactttttg

SEQ ID NO: 6502799 - DNA, 18 bp, Homo sapiens
tgtcactttttgaggcaa

SEQ ID NO: 6502800 - DNA, 23 bp, Homo sapiens
tgtcacttttttataaaagttta

SEQ ID NO: 6502801 - DNA, 20 bp, Homo sapiens
tgtcacttttttcctgtcaa

SEQ ID NO: 6502802 - DNA, 21 bp, Homo sapiens
tgtcacttttttcctgtcaat

SEQ ID NO: 6502803 - DNA, 16 bp, Homo sapiens
tgtcagaaaagagcca

SEQ ID NO: 6502804 - DNA, 21 bp, Homo sapiens
tgtcagaaaccagttatgtga

SEQ ID NO: 6502805 - DNA, 19 bp, Homo sapiens
tgtcagaaaccctggtctc

SEQ ID NO: 6502806 - DNA, 22 bp, Homo sapiens
tgtcagaaaccctggtctccgt

SEQ ID NO: 6502807 - DNA, 14 bp, Homo sapiens
tgtcagaagacact

SEQ ID NO: 6502808 - DNA, 16 bp, Homo sapiens
tgtcagaagacactaa

SEQ ID NO: 6502809 - DNA, 19 bp, Homo sapiens
tgtcagaagacactaattc

SEQ ID NO: 6502810 - DNA, 11 bp, Homo sapiens
tgtcagaagct

SEQ ID NO: 6502811 - DNA, 22 bp, Homo sapiens
tgtcagaagcttggcatgacct

SEQ ID NO: 6502812 - DNA, 21 bp, Homo sapiens
tgtcagaaggagacagaatga

SEQ ID NO: 6502813 - DNA, 16 bp, Homo sapiens
tgtcagaataggaaaa

SEQ ID NO: 6502814 - DNA, 22 bp, Homo sapiens
tgtcagaatcagaatcatggag

SEQ ID NO: 6502815 - DNA, 21 bp, Homo sapiens
tgtcagaatggaatccatctg

SEQ ID NO: 6502816 - DNA, 14 bp, Homo sapiens
tgtcagaatgttgt

SEQ ID NO: 6502817 - DNA, 17 bp, Homo sapiens
tgtcagaatttctttgt

SEQ ID NO: 6502818 - DNA, 12 bp, Homo sapiens
tgtcagacacag

SEQ ID NO: 6502819 - DNA, 23 bp, Homo sapiens
tgtcagacagaacttgaatgtgt

SEQ ID NO: 6502820 - DNA, 17 bp, Homo sapiens
tgtcagacataaagcca

SEQ ID NO: 6502821 - DNA, 20 bp, Homo sapiens
tgtcagacataaagccatgt

SEQ ID NO: 6502822 - DNA, 23 bp, Homo sapiens
tgtcagacatccatgtttgtaaa

SEQ ID NO: 6502823 - DNA, 18 bp, Homo sapiens
tgtcagacatgaaaacta

SEQ ID NO: 6502824 - DNA, 17 bp, Homo sapiens
tgtcagaccctggaggc

SEQ ID NO: 6502825 - DNA, 21 bp, Homo sapiens
tgtcagactatccattttaca

SEQ ID NO: 6502826 - DNA, 16 bp, Homo sapiens
tgtcagacttccaaat

SEQ ID NO: 6502827 - DNA, 21 bp, Homo sapiens
tgtcagacttccaaatcctgg

SEQ ID NO: 6502828 - DNA, 22 bp, Homo sapiens
tgtcagagaagaaaaacgtgag

SEQ ID NO: 6502829 - DNA, 12 bp, Homo sapiens
tgtcagagatgt

SEQ ID NO: 6502830 - DNA, 17 bp, Homo sapiens
tgtcagagcccagccca

SEQ ID NO: 6502831 - DNA, 19 bp, Homo sapiens
tgtcagagcccaggggaga

SEQ ID NO: 6502832 - DNA, 13 bp, Homo sapiens
tgtcagagccgcc

SEQ ID NO: 6502833 - DNA, 11 bp, Homo sapiens
tgtcagagcta

SEQ ID NO: 6502834 - DNA, 13 bp, Homo sapiens
tgtcagagctggg

SEQ ID NO: 6502835 - DNA, 15 bp, Homo sapiens
tgtcagagctgggag

SEQ ID NO: 6502836 - DNA, 18 bp, Homo sapiens
tgtcagagctgttggcct

SEQ ID NO: 6502837 - DNA, 16 bp, Homo sapiens
tgtcagatacaatgta

SEQ ID NO: 6502838 - DNA, 16 bp, Homo sapiens
tgtcagatattcatat

SEQ ID NO: 6502839 - DNA, 16 bp, Homo sapiens
tgtcagatcgttcatt

SEQ ID NO: 6502840 - DNA, 14 bp, Homo sapiens
tgtcagatctggat

SEQ ID NO: 6502841 - DNA, 23 bp, Homo sapiens
tgtcagatgagaacaaagctgtt

SEQ ID NO: 6502842 - DNA, 21 bp, Homo sapiens
tgtcagatgcgtgcccagctc

SEQ ID NO: 6502843 - DNA, 11 bp, Homo sapiens
tgtcagattcc

SEQ ID NO: 6502844 - DNA, 14 bp, Homo sapiens
tgtcagattccttt

SEQ ID NO: 6502845 - DNA, 13 bp, Homo sapiens
tgtcagcaaaaag

SEQ ID NO: 6502846 - DNA, 15 bp, Homo sapiens
tgtcagcaaatgtaa

SEQ ID NO: 6502847 - DNA, 17 bp, Homo sapiens
tgtcagcagctctgaga

SEQ ID NO: 6502848 - DNA, 13 bp, Homo sapiens
tgtcagcaggaag

SEQ ID NO: 6502849 - DNA, 16 bp, Homo sapiens
tgtcagcatctgacca

SEQ ID NO: 6502850 - DNA, 17 bp, Homo sapiens
tgtcagcatctgaccat

SEQ ID NO: 6502851 - DNA, 22 bp, Homo sapiens
tgtcagcatctgaccatctgtg

SEQ ID NO: 6502852 - DNA, 18 bp, Homo sapiens
tgtcagcatctttgccct

SEQ ID NO: 6502853 - DNA, 21 bp, Homo sapiens
tgtcagcattggcctctgtgt

SEQ ID NO: 6502854 - DNA, 15 bp, Homo sapiens
tgtcagccacctccc

SEQ ID NO: 6502855 - DNA, 11 bp, Homo sapiens
tgtcagccagc

SEQ ID NO: 6502856 - DNA, 15 bp, Homo sapiens
tgtcagccagccgcc

SEQ ID NO: 6502857 - DNA, 18 bp, Homo sapiens
tgtcagccagccgccctg

SEQ ID NO: 6502858 - DNA, 16 bp, Homo sapiens
tgtcagcccacagcag

SEQ ID NO: 6502859 - DNA, 19 bp, Homo sapiens
tgtcagcccctcttccctt

SEQ ID NO: 6502860 - DNA, 22 bp, Homo sapiens
tgtcagccctgctgtcagacct

SEQ ID NO: 6502861 - DNA, 14 bp, Homo sapiens
tgtcagcctcccac

SEQ ID NO: 6502862 - DNA, 11 bp, Homo sapiens
tgtcagcctga

SEQ ID NO: 6502863 - DNA, 23 bp, Homo sapiens
tgtcagcctgaagatcagagctg

SEQ ID NO: 6502864 - DNA, 11 bp, Homo sapiens
tgtcagccttg

SEQ ID NO: 6502865 - DNA, 12 bp, Homo sapiens
tgtcagccttgc

SEQ ID NO: 6502866 - DNA, 21 bp, Homo sapiens
tgtcagcgcctggcctaccca

SEQ ID NO: 6502867 - DNA, 15 bp, Homo sapiens
tgtcagcggtgcagc

SEQ ID NO: 6502868 - DNA, 20 bp, Homo sapiens
tgtcagcgttctaccaggca

SEQ ID NO: 6502869 - DNA, 23 bp, Homo sapiens
tgtcagctactgcggaaaaggaa

SEQ ID NO: 6502870 - DNA, 23 bp, Homo sapiens
tgtcagctcccctcggagaagag

SEQ ID NO: 6502871 - DNA, 19 bp, Homo sapiens
tgtcagctgaacctgggta

SEQ ID NO: 6502872 - DNA, 20 bp, Homo sapiens
tgtcagctgagcttgagctc

SEQ ID NO: 6502873 - DNA, 24 bp, Homo sapiens
tgtcagctgaggctgggggagagc

SEQ ID NO: 6502874 - DNA, 17 bp, Homo sapiens
tgtcagctgttgtcaca

SEQ ID NO: 6502875 - DNA, 14 bp, Homo sapiens
tgtcagcttcccag

SEQ ID NO: 6502876 - DNA, 16 bp, Homo sapiens
tgtcaggaacagaagg

SEQ ID NO: 6502877 - DNA, 20 bp, Homo sapiens
tgtcaggacccaggccgcct

SEQ ID NO: 6502878 - DNA, 11 bp, Homo sapiens
tgtcaggaggc

SEQ ID NO: 6502879 - DNA, 19 bp, Homo sapiens
tgtcaggattgcgagagat

SEQ ID NO: 6502880 - DNA, 22 bp, Homo sapiens
tgtcaggattgcgagagatgtg

SEQ ID NO: 6502881 - DNA, 12 bp, Homo sapiens
tgtcaggcaggt

SEQ ID NO: 6502882 - DNA, 14 bp, Homo sapiens
tgtcaggcatggct

SEQ ID NO: 6502883 - DNA, 13 bp, Homo sapiens
tgtcaggccccca

SEQ ID NO: 6502884 - DNA, 14 bp, Homo sapiens
tgtcaggcccccag

SEQ ID NO: 6502885 - DNA, 19 bp, Homo sapiens
tgtcaggcccgtcggagct

SEQ ID NO: 6502886 - DNA, 17 bp, Homo sapiens
tgtcaggccctctgcct

SEQ ID NO: 6502887 - DNA, 20 bp, Homo sapiens
tgtcaggccctctgcctgca

SEQ ID NO: 6502888 - DNA, 23 bp, Homo sapiens
tgtcaggccctctgcctgcactc

SEQ ID NO: 6502889 - DNA, 18 bp, Homo sapiens
tgtcaggcctctgagccc

SEQ ID NO: 6502890 - DNA, 21 bp, Homo sapiens
tgtcaggcctctgagcccaag

SEQ ID NO: 6502891 - DNA, 21 bp, Homo sapiens
tgtcaggcctgacggggagga

SEQ ID NO: 6502892 - DNA, 11 bp, Homo sapiens
tgtcaggcctt

SEQ ID NO: 6502893 - DNA, 19 bp, Homo sapiens
tgtcaggctctgaatctct

SEQ ID NO: 6502894 - DNA, 23 bp, Homo sapiens
tgtcaggctctgaatctctcaaa

SEQ ID NO: 6502895 - DNA, 22 bp, Homo sapiens
tgtcaggctctggcccttgcct

SEQ ID NO: 6502896 - DNA, 17 bp, Homo sapiens
tgtcaggctgaaaacaa

SEQ ID NO: 6502897 - DNA, 18 bp, Homo sapiens
tgtcaggctgaaaacaat

SEQ ID NO: 6502898 - DNA, 16 bp, Homo sapiens
tgtcaggctgctggcg

SEQ ID NO: 6502899 - DNA, 22 bp, Homo sapiens
tgtcaggctgctggcgcctctg

SEQ ID NO: 6502900 - DNA, 22 bp, Homo sapiens
tgtcagggaacatatttaagga

SEQ ID NO: 6502901 - DNA, 14 bp, Homo sapiens
tgtcagggagggcc

SEQ ID NO: 6502902 - DNA, 23 bp, Homo sapiens
tgtcagggagtgttccctatcca

SEQ ID NO: 6502903 - DNA, 21 bp, Homo sapiens
tgtcagggatgagttgaggtg

SEQ ID NO: 6502904 - DNA, 19 bp, Homo sapiens
tgtcagggcagtacaatgt

SEQ ID NO: 6502905 - DNA, 24 bp, Homo sapiens
tgtcagggtccaggagagcctggg

SEQ ID NO: 6502906 - DNA, 20 bp, Homo sapiens
tgtcaggtcccagcgagcca

SEQ ID NO: 6502907 - DNA, 21 bp, Homo sapiens
tgtcaggtggaccctgtaaat

SEQ ID NO: 6502908 - DNA, 17 bp, Homo sapiens
tgtcaggtggggcagct

SEQ ID NO: 6502909 - DNA, 15 bp, Homo sapiens
tgtcagtactttctt

SEQ ID NO: 6502910 - DNA, 10 bp, Homo sapiens
tgtcagtagt

SEQ ID NO: 6502911 - DNA, 13 bp, Homo sapiens
tgtcagtagtgcc

SEQ ID NO: 6502912 - DNA, 17 bp, Homo sapiens
tgtcagtagtgcctgtg

SEQ ID NO: 6502913 - DNA, 15 bp, Homo sapiens
tgtcagtagtgctaa

SEQ ID NO: 6502914 - DNA, 16 bp, Homo sapiens
tgtcagtatttcaact

SEQ ID NO: 6502915 - DNA, 20 bp, Homo sapiens
tgtcagtatttcaactgctg

SEQ ID NO: 6502916 - DNA, 19 bp, Homo sapiens
tgcaggctctgggctcagg

SEQ ID NO: 6502917 - DNA, 13 bp, Homo sapiens
tgcaggctgcacc

SEQ ID NO: 6502918 - DNA, 19 bp, Homo sapiens
tgcaggctgcacctctggc

SEQ ID NO: 6502919 - DNA, 16 bp, Homo sapiens
tgcaggctgcaggagg

SEQ ID NO: 6502920 - DNA, 17 bp, Homo sapiens
tgcaggctgcaggaggg

SEQ ID NO: 6502921 - DNA, 18 bp, Homo sapiens
tgcaggctggagactgga

SEQ ID NO: 6502922 - DNA, 21 bp, Homo sapiens
tgcaggctggcaccgccttct

SEQ ID NO: 6502923 - DNA, 22 bp, Homo sapiens
tgcaggctggcaccgccttctc

SEQ ID NO: 6502924 - DNA, 17 bp, Homo sapiens
tgcaggctggccagccg

SEQ ID NO: 6502925 - DNA, 22 bp, Homo sapiens
tgcaggctggccagccgctctc

SEQ ID NO: 6502926 - DNA, 12 bp, Homo sapiens
tgcaggctgggg

SEQ ID NO: 6502927 - DNA, 13 bp, Homo sapiens
tgcaggctgggga

SEQ ID NO: 6502928 - DNA, 15 bp, Homo sapiens
tgcaggctggggagg

SEQ ID NO: 6502929 - DNA, 16 bp, Homo sapiens
tgcaggctggggaggt

SEQ ID NO: 6502930 - DNA, 23 bp, Homo sapiens
tgcaggctggggaggtgctgggg

SEQ ID NO: 6502931 - DNA, 17 bp, Homo sapiens
tgcaggctgtctcattt

SEQ ID NO: 6502932 - DNA, 19 bp, Homo sapiens
tgcaggctgtctcatttat

SEQ ID NO: 6502933 - DNA, 20 bp, Homo sapiens
tgcagggaaaattatttgca

SEQ ID NO: 6502934 - DNA, 22 bp, Homo sapiens
tgcagggaaagggatggtcagg

SEQ ID NO: 6502935 - DNA, 18 bp, Homo sapiens
tgcagggaagagggcagt

SEQ ID NO: 6502936 - DNA, 17 bp, Homo sapiens
tgcagggaattgggggg

SEQ ID NO: 6502937 - DNA, 20 bp, Homo sapiens
tgcagggacagcctgcacag

SEQ ID NO: 6502938 - DNA, 23 bp, Homo sapiens
tgcagggacagttgggtgtgaga

SEQ ID NO: 6502939 - DNA, 14 bp, Homo sapiens
tgcagggagaccag

SEQ ID NO: 6502940 - DNA, 19 bp, Homo sapiens
tgcagggagcaccacggcc

SEQ ID NO: 6502941 - DNA, 20 bp, Homo sapiens
tgcagggagcaccacggcca

SEQ ID NO: 6502942 - DNA, 14 bp, Homo sapiens
tgcagggagcactg

SEQ ID NO: 6502943 - DNA, 23 bp, Homo sapiens
tgcagggagcatggctgtgagga

SEQ ID NO: 6502944 - DNA, 23 bp, Homo sapiens
tgcagggagctgggcttccagaa

SEQ ID NO: 6502945 - DNA, 13 bp, Homo sapiens
tgcagggaggagt

SEQ ID NO: 6502946 - DNA, 12 bp, Homo sapiens
tgcagggaggcc

SEQ ID NO: 6502947 - DNA, 13 bp, Homo sapiens
tgcagggagtccg

SEQ ID NO: 6502948 - DNA, 24 bp, Homo sapiens
tgcagggataggaagtgccccagg

SEQ ID NO: 6502949 - DNA, 22 bp, Homo sapiens
tgcagggcacagaaggctgggg

SEQ ID NO: 6502950 - DNA, 16 bp, Homo sapiens
tgcagggcacagatga

SEQ ID NO: 6502951 - DNA, 14 bp, Homo sapiens
tgcagggcacgggg

SEQ ID NO: 6502952 - DNA, 17 bp, Homo sapiens
tgcagggcacggggacc

SEQ ID NO: 6502953 - DNA, 18 bp, Homo sapiens
tgcagggcacggggacct

SEQ ID NO: 6502954 - DNA, 23 bp, Homo sapiens
tgcagggcacggggacctggata

SEQ ID NO: 6502955 - DNA, 13 bp, Homo sapiens
tgcagggcagccc

SEQ ID NO: 6502956 - DNA, 13 bp, Homo sapiens
tgcagggcagcct

SEQ ID NO: 6502957 - DNA, 15 bp, Homo sapiens
tgcagggcagcctgt

SEQ ID NO: 6502958 - DNA, 18 bp, Homo sapiens
tgcagggcagcctgtggg

SEQ ID NO: 6502959 - DNA, 22 bp, Homo sapiens
tgcagggcagcctgtgggagaa

SEQ ID NO: 6502960 - DNA, 13 bp, Homo sapiens
tgcagggccagga

SEQ ID NO: 6502961 - DNA, 15 bp, Homo sapiens
tgcagggccatggct

SEQ ID NO: 6502962 - DNA, 20 bp, Homo sapiens
tgcagggccctctggggctc

SEQ ID NO: 6502963 - DNA, 23 bp, Homo sapiens
tgcagggccgcgagaggccgagc

SEQ ID NO: 6502964 - DNA, 14 bp, Homo sapiens
tgcagggcctctgt

SEQ ID NO: 6502965 - DNA, 13 bp, Homo sapiens
tgcagggcctggc

SEQ ID NO: 6502966 - DNA, 22 bp, Homo sapiens
tgcagggcctggcatagagtag

SEQ ID NO: 6502967 - DNA, 13 bp, Homo sapiens
tgcagggctgctg

SEQ ID NO: 6502968 - DNA, 14 bp, Homo sapiens
tgcagggctgctgt

SEQ ID NO: 6502969 - DNA, 17 bp, Homo sapiens
tgcagggctgctgtggc

SEQ ID NO: 6502970 - DNA, 17 bp, Homo sapiens
tgcagggctttaaaatt

SEQ ID NO: 6502971 - DNA, 15 bp, Homo sapiens
tgcaggggactgggc

SEQ ID NO: 6502972 - DNA, 17 bp, Homo sapiens
tgcaggggactgggcca

SEQ ID NO: 6502973 - DNA, 20 bp, Homo sapiens
tgcaggggactgggccatgg

SEQ ID NO: 6502974 - DNA, 20 bp, Homo sapiens
tgcaggggccaggggtggga

SEQ ID NO: 6502975 - DNA, 19 bp, Homo sapiens
tgcaggggcctctgttcct

SEQ ID NO: 6502976 - DNA, 24 bp, Homo sapiens
tgcaggggctacgttagcagccca

SEQ ID NO: 6502977 - DNA, 13 bp, Homo sapiens
tgcaggggctctg

SEQ ID NO: 6502978 - DNA, 19 bp, Homo sapiens
tgcaggggctctggagaga

SEQ ID NO: 6502979 - DNA, 21 bp, Homo sapiens
tgcaggggctctggagagaaa

SEQ ID NO: 6502980 - DNA, 18 bp, Homo sapiens
tgcagggggaggaggact

SEQ ID NO: 6502981 - DNA, 20 bp, Homo sapiens
tgcagggggaggaggacttg

SEQ ID NO: 6502982 - DNA, 22 bp, Homo sapiens
tgcagggggaggaggacttgga

SEQ ID NO: 6502983 - DNA, 16 bp, Homo sapiens
tgcagggggctcctgg

SEQ ID NO: 6502984 - DNA, 19 bp, Homo sapiens
tgcagggggtgtgtctgct

SEQ ID NO: 6502985 - DNA, 23 bp, Homo sapiens
tgcaggggtcagtgcagcagagg

SEQ ID NO: 6502986 - DNA, 18 bp, Homo sapiens
tgcaggggtcccccctca

SEQ ID NO: 6502987 - DNA, 16 bp, Homo sapiens
tgcaggggtccctgct

SEQ ID NO: 6502988 - DNA, 17 bp, Homo sapiens
tgcaggggtccctgcta

SEQ ID NO: 6502989 - DNA, 16 bp, Homo sapiens
tgcaggggtctgggag

SEQ ID NO: 6502990 - DNA, 22 bp, Homo sapiens
tgcagggtagggggcctgagtt

SEQ ID NO: 6502991 - DNA, 19 bp, Homo sapiens
tgcagggtcctcttctggg

SEQ ID NO: 6502992 - DNA, 22 bp, Homo sapiens
tgcagggtcctcttctgggcct

SEQ ID NO: 6502993 - DNA, 20 bp, Homo sapiens
tgcagggtctttttctaggg

SEQ ID NO: 6502994 - DNA, 16 bp, Homo sapiens
tgcagggtgacctgct

SEQ ID NO: 6502995 - DNA, 20 bp, Homo sapiens
tgcagggtgggtgagctctc

SEQ ID NO: 6502996 - DNA, 21 bp, Homo sapiens
tgcagggtgggtgagctctca

SEQ ID NO: 6502997 - DNA, 19 bp, Homo sapiens
tgcagggtggtgctgggac

SEQ ID NO: 6502998 - DNA, 23 bp, Homo sapiens
tgcagggttcaagccttccaggg

SEQ ID NO: 6502999 - DNA, 23 bp, Homo sapiens
tgcagggttctccctcccacctt

SEQ ID NO: 6503000 - DNA, 20 bp, Homo sapiens
tgcaggtacttcctcctgat

SEQ ID NO: 6503001 - DNA, 23 bp, Homo sapiens
tgcaggtacttcctcctgatggc

SEQ ID NO: 6503002 - DNA, 18 bp, Homo sapiens
tgcaggtagacctgtctc

SEQ ID NO: 6503003 - DNA, 20 bp, Homo sapiens
tgcaggtatttcagaaggag

SEQ ID NO: 6503004 - DNA, 21 bp, Homo sapiens
tgcaggtatttcagaaggaga

SEQ ID NO: 6503005 - DNA, 21 bp, Homo sapiens
tgcaggtcaagttgtcaggtt

SEQ ID NO: 6503006 - DNA, 21 bp, Homo sapiens
tgcaggtcagcccatggaggc

SEQ ID NO: 6503007 - DNA, 14 bp, Homo sapiens
tgcaggtcagcctc

SEQ ID NO: 6503008 - DNA, 18 bp, Homo sapiens
tgcaggtccctaataaag

SEQ ID NO: 6503009 - DNA, 19 bp, Homo sapiens
tgcaggtccctaataaagc

SEQ ID NO: 6503010 - DNA, 20 bp, Homo sapiens
tgcaggtccggggaggaggt

SEQ ID NO: 6503011 - DNA, 15 bp, Homo sapiens
tgcaggtctttaaat

SEQ ID NO: 6503012 - DNA, 17 bp, Homo sapiens
tgcaggtgagcaggcag

SEQ ID NO: 6503013 - DNA, 17 bp, Homo sapiens
tgcaggtgccagggccc

SEQ ID NO: 6503014 - DNA, 23 bp, Homo sapiens
tgcaggtgccagggcccacccca

SEQ ID NO: 6503015 - DNA, 17 bp, Homo sapiens
tgcaggtgcctggcttg

SEQ ID NO: 6503016 - DNA, 17 bp, Homo sapiens
tgcaggtgctgctgatg

SEQ ID NO: 6503017 - DNA, 17 bp, Homo sapiens
tgcaggtggatctcctt

SEQ ID NO: 6503018 - DNA, 21 bp, Homo sapiens
tgcaggtggatctccttgaga

SEQ ID NO: 6503019 - DNA, 15 bp, Homo sapiens
tgcaggtgggatgag

SEQ ID NO: 6503020 - DNA, 15 bp, Homo sapiens
tgcaggtgggcactg

SEQ ID NO: 6503021 - DNA, 19 bp, Homo sapiens
tgcaggtggtgggacactg

SEQ ID NO: 6503022 - DNA, 19 bp, Homo sapiens
tgcaggtggtgtcgggccc

SEQ ID NO: 6503023 - DNA, 12 bp, Homo sapiens
tgcaggttccca

SEQ ID NO: 6503024 - DNA, 20 bp, Homo sapiens
tgcaggttcttcttcctgaa

SEQ ID NO: 6503025 - DNA, 14 bp, Homo sapiens
tgcaggttgcagag

SEQ ID NO: 6503026 - DNA, 23 bp, Homo sapiens
tgcaggttggaaggggccttgct

SEQ ID NO: 6503027 - DNA, 16 bp, Homo sapiens
tgcaggttggacccca

SEQ ID NO: 6503028 - DNA, 23 bp, Homo sapiens
tgcaggttgggccatactggcct

SEQ ID NO: 6503029 - DNA, 22 bp, Homo sapiens
tgcaggtttatattgggaagct

SEQ ID NO: 6503030 - DNA, 14 bp, Homo sapiens
tgcaggtttctcct

SEQ ID NO: 6503031 - DNA, 22 bp, Homo sapiens
tgcaggtttctccttgaagcaa

SEQ ID NO: 6503032 - DNA, 18 bp, Homo sapiens
tgcaggtttgacacgcag

SEQ ID NO: 6503033 - DNA, 15 bp, Homo sapiens
tgcaggtttgttaca

SEQ ID NO: 6503034 - DNA, 16 bp, Homo sapiens
tgcaggtttgttacat

SEQ ID NO: 6503035 - DNA, 15 bp, Homo sapiens
tgcagtaaaacacat

SEQ ID NO: 6503036 - DNA, 13 bp, Homo sapiens
tgcagtaaatatt

SEQ ID NO: 6503037 - DNA, 13 bp, Homo sapiens
tgcagtaaatctt

SEQ ID NO: 6503038 - DNA, 18 bp, Homo sapiens
tgcagtaaatcttttaca

SEQ ID NO: 6503039 - DNA, 18 bp, Homo sapiens
tgcagtaacactggcctt

SEQ ID NO: 6503040 - DNA, 17 bp, Homo sapiens
tgcagtaacattctact

SEQ ID NO: 6503041 - DNA, 16 bp, Homo sapiens
tgcagtaactgttttt

SEQ ID NO: 6503042 - DNA, 15 bp, Homo sapiens
tgcagtaacttggga

SEQ ID NO: 6503043 - DNA, 19 bp, Homo sapiens
tgcagtaatctccagggcc

SEQ ID NO: 6503044 - DNA, 16 bp, Homo sapiens
tgcagtacagtgtgtg

SEQ ID NO: 6503045 - DNA, 17 bp, Homo sapiens
tgcagtacatacgtctg

SEQ ID NO: 6503046 - DNA, 20 bp, Homo sapiens
tgcagtacatgggtgactat

SEQ ID NO: 6503047 - DNA, 15 bp, Homo sapiens
tgcagtactaaaatt

SEQ ID NO: 6503048 - DNA, 21 bp, Homo sapiens
tgcagtacttttgttgtatgg

SEQ ID NO: 6503049 - DNA, 17 bp, Homo sapiens
tgcagtagagagccttt

SEQ ID NO: 6503050 - DNA, 14 bp, Homo sapiens
tgcagtagattttc

SEQ ID NO: 6503051 - DNA, 16 bp, Homo sapiens
tgcagtagattttctt

SEQ ID NO: 6503052 - DNA, 19 bp, Homo sapiens
tgcagtagattttctttaa

SEQ ID NO: 6503053 - DNA, 13 bp, Homo sapiens
tgcagtatagaat

SEQ ID NO: 6503054 - DNA, 14 bp, Homo sapiens
tgcagtatagaata

SEQ ID NO: 6503055 - DNA, 16 bp, Homo sapiens
tgcagtatcagagggt

SEQ ID NO: 6503056 - DNA, 20 bp, Homo sapiens
tgcagtatcggcactgtaca

SEQ ID NO: 6503057 - DNA, 20 bp, Homo sapiens
tgcagtatgatggcaggaga

SEQ ID NO: 6503058 - DNA, 19 bp, Homo sapiens
tgcagtatggccagacgtg

SEQ ID NO: 6503059 - DNA, 15 bp, Homo sapiens
tgcagtattcttgca

SEQ ID NO: 6503060 - DNA, 13 bp, Homo sapiens
tgcagtattgagt

SEQ ID NO: 6503061 - DNA, 15 bp, Homo sapiens
tgcagtattgccaca

SEQ ID NO: 6503062 - DNA, 16 bp, Homo sapiens
tgcagtattgccacaa

SEQ ID NO: 6503063 - DNA, 18 bp, Homo sapiens
tgcagtcacatcacaata

SEQ ID NO: 6503064 - DNA, 13 bp, Homo sapiens
tgcagtcacctct

SEQ ID NO: 6503065 - DNA, 15 bp, Homo sapiens
tgcagtcacctcttc

SEQ ID NO: 6503066 - DNA, 21 bp, Homo sapiens
tgcagtcacgtgaggcccctg

SEQ ID NO: 6503067 - DNA, 22 bp, Homo sapiens
tgcagtcacgtgaggcccctgt

SEQ ID NO: 6503068 - DNA, 23 bp, Homo sapiens
tgcagtcacgtgaggcccctgtg

SEQ ID NO: 6503069 - DNA, 13 bp, Homo sapiens
tgcagtcactgca

SEQ ID NO: 6503070 - DNA, 15 bp, Homo sapiens
tgcagtcactggagg

SEQ ID NO: 6503071 - DNA, 17 bp, Homo sapiens
tgcagtcactggaggtt

SEQ ID NO: 6503072 - DNA, 14 bp, Homo sapiens
tgcagtcagaagat

SEQ ID NO: 6503073 - DNA, 14 bp, Homo sapiens
tgcagtcagactga

SEQ ID NO: 6503074 - DNA, 17 bp, Homo sapiens
tgcagtcagcacagaga

SEQ ID NO: 6503075 - DNA, 14 bp, Homo sapiens
tgcagtcagcagat

SEQ ID NO: 6503076 - DNA, 23 bp, Homo sapiens
tgcagtcagcagatgctgttgtg

SEQ ID NO: 6503077 - DNA, 16 bp, Homo sapiens
tgcagtcagtgtttct

SEQ ID NO: 6503078 - DNA, 18 bp, Homo sapiens
tgcagtcatcaacaaaag

SEQ ID NO: 6503079 - DNA, 22 bp, Homo sapiens
tgcagtcatcaacaatgattaa

SEQ ID NO: 6503080 - DNA, 16 bp, Homo sapiens
tgcagtcatcagaagt

SEQ ID NO: 6503081 - DNA, 13 bp, Homo sapiens
tgcagtcatttgt

SEQ ID NO: 6503082 - DNA, 15 bp, Homo sapiens
tgcagtccagaataa

SEQ ID NO: 6503083 - DNA, 20 bp, Homo sapiens
tgcagtccagaataagtgct

SEQ ID NO: 6503084 - DNA, 21 bp, Homo sapiens
tgcagtccagaataagtgctg

SEQ ID NO: 6503085 - DNA, 20 bp, Homo sapiens
tgcagtcccaagcggtgtct

SEQ ID NO: 6503086 - DNA, 22 bp, Homo sapiens
tgcagtcccaagcggtgtctct

SEQ ID NO: 6503087 - DNA, 17 bp, Homo sapiens
tgcagtcccgtggaggg

SEQ ID NO: 6503088 - DNA, 16 bp, Homo sapiens
tgcagtcctcaggaag

SEQ ID NO: 6503089 - DNA, 20 bp, Homo sapiens
tgcagtcctcggcagctccg

SEQ ID NO: 6503090 - DNA, 16 bp, Homo sapiens
tgcagtcctgaggaga

SEQ ID NO: 6503091 - DNA, 19 bp, Homo sapiens
tgcagtcctgatcagagcc

SEQ ID NO: 6503092 - DNA, 22 bp, Homo sapiens
tgcagtcctgatcagagccgtg

SEQ ID NO: 6503093 - DNA, 14 bp, Homo sapiens
tgtcagtcactaaa

SEQ ID NO: 6503094 - DNA, 18 bp, Homo sapiens
tgtcagtcccactgcacc

SEQ ID NO: 6503095 - DNA, 17 bp, Homo sapiens
tgtcagtcgtgttgctt

SEQ ID NO: 6503096 - DNA, 19 bp, Homo sapiens
tgtcagtctgcttagaaat

SEQ ID NO: 6503097 - DNA, 16 bp, Homo sapiens
tgtcagtctggtttat

SEQ ID NO: 6503098 - DNA, 14 bp, Homo sapiens
tgtcagtctgtcca

SEQ ID NO: 6503099 - DNA, 13 bp, Homo sapiens
tgtcagtgccgcc

SEQ ID NO: 6503100 - DNA, 16 bp, Homo sapiens
tgtcagtgccgccgcc

SEQ ID NO: 6503101 - DNA, 18 bp, Homo sapiens
tgtcagtggtttctactt

SEQ ID NO: 6503102 - DNA, 22 bp, Homo sapiens
tgtcagtggtttctacttcccc

SEQ ID NO: 6503103 - DNA, 18 bp, Homo sapiens
tgtcagtgtagacacagg

SEQ ID NO: 6503104 - DNA, 11 bp, Homo sapiens
tgtcagtgtca

SEQ ID NO: 6503105 - DNA, 15 bp, Homo sapiens
tgtcagtgtcctcag

SEQ ID NO: 6503106 - DNA, 13 bp, Homo sapiens
tgtcagtgtgaaa

SEQ ID NO: 6503107 - DNA, 14 bp, Homo sapiens
tgtcagtgtgactg

SEQ ID NO: 6503108 - DNA, 19 bp, Homo sapiens
tgtcagtgtgactgatctc

SEQ ID NO: 6503109 - DNA, 15 bp, Homo sapiens
tgtcagtgtgtcagt

SEQ ID NO: 6503110 - DNA, 23 bp, Homo sapiens
tgtcagtgttgcctcttgcaatg

SEQ ID NO: 6503111 - DNA, 14 bp, Homo sapiens
tgtcagtgtttgta

SEQ ID NO: 6503112 - DNA, 12 bp, Homo sapiens
tgtcagtgtttt

SEQ ID NO: 6503113 - DNA, 15 bp, Homo sapiens
tgtcagttacttttt

SEQ ID NO: 6503114 - DNA, 18 bp, Homo sapiens
tgtcagttcaactttcag

SEQ ID NO: 6503115 - DNA, 23 bp, Homo sapiens
tgtcagttcagaaaaaatgtgaa

SEQ ID NO: 6503116 - DNA, 15 bp, Homo sapiens
tgtcagttcataata

SEQ ID NO: 6503117 - DNA, 20 bp, Homo sapiens
tgtcagttctctgggaagtg

SEQ ID NO: 6503118 - DNA, 15 bp, Homo sapiens
tgtcagttgtacttc

SEQ ID NO: 6503119 - DNA, 19 bp, Homo sapiens
tgtcagttgtacttctgct

SEQ ID NO: 6503120 - DNA, 21 bp, Homo sapiens
tgtcagttgtgaagaggggcc

SEQ ID NO: 6503121 - DNA, 17 bp, Homo sapiens
tgtcagtttatcttaag

SEQ ID NO: 6503122 - DNA, 14 bp, Homo sapiens
tgtcagtttcccct

SEQ ID NO: 6503123 - DNA, 14 bp, Homo sapiens
tgtcagttttcata

SEQ ID NO: 6503124 - DNA, 13 bp, Homo sapiens
tgtcagtttttcc

SEQ ID NO: 6503125 - DNA, 18 bp, Homo sapiens
tgtcataaacagatgaat

SEQ ID NO: 6503126 - DNA, 13 bp, Homo sapiens
tgtcataaagatt

SEQ ID NO: 6503127 - DNA, 16 bp, Homo sapiens
tgtcataaagattata

SEQ ID NO: 6503128 - DNA, 18 bp, Homo sapiens
tgtcataaagtgagaaaa

SEQ ID NO: 6503129 - DNA, 20 bp, Homo sapiens
tgtcataaagtgagaaaact

SEQ ID NO: 6503130 - DNA, 10 bp, Homo sapiens
tgtcataaat

SEQ ID NO: 6503131 - DNA, 19 bp, Homo sapiens
tgtcataaatgtcacaata

SEQ ID NO: 6503132 - DNA, 21 bp, Homo sapiens
tgtcataaatgtcacaataaa

SEQ ID NO: 6503133 - DNA, 16 bp, Homo sapiens
tgtcataacatttaaa

SEQ ID NO: 6503134 - DNA, 23 bp, Homo sapiens
tgtcataacatttaaagagattt

SEQ ID NO: 6503135 - DNA, 15 bp, Homo sapiens
tgtcataaggcggcg

SEQ ID NO: 6503136 - DNA, 14 bp, Homo sapiens
tgtcataataaagt

SEQ ID NO: 6503137 - DNA, 20 bp, Homo sapiens
tgtcataatatttgaacaaa

SEQ ID NO: 6503138 - DNA, 15 bp, Homo sapiens
tgtcatacagagaag

SEQ ID NO: 6503139 - DNA, 16 bp, Homo sapiens
tgtcatacagagaagt

SEQ ID NO: 6503140 - DNA, 18 bp, Homo sapiens
tgtcatacagagaagtca

SEQ ID NO: 6503141 - DNA, 23 bp, Homo sapiens
tgtcataccaggccgccccagcc

SEQ ID NO: 6503142 - DNA, 20 bp, Homo sapiens
tgtcatactcgagtctgagg

SEQ ID NO: 6503143 - DNA, 13 bp, Homo sapiens
tgtcatactctgt

SEQ ID NO: 6503144 - DNA, 16 bp, Homo sapiens
tgtcatactctgtgta

SEQ ID NO: 6503145 - DNA, 21 bp, Homo sapiens
tgtcatagaatagcatgttgt

SEQ ID NO: 6503146 - DNA, 23 bp, Homo sapiens
tgtcatagccaaagccaggcctg

SEQ ID NO: 6503147 - DNA, 18 bp, Homo sapiens
tgtcatagggattgtccc

SEQ ID NO: 6503148 - DNA, 15 bp, Homo sapiens
tgtcatataatgcaa

SEQ ID NO: 6503149 - DNA, 18 bp, Homo sapiens
tgtcatatattactagca

SEQ ID NO: 6503150 - DNA, 16 bp, Homo sapiens
tgtcatatattcatgt

SEQ ID NO: 6503151 - DNA, 18 bp, Homo sapiens
tgtcatatattcatgtaa

SEQ ID NO: 6503152 - DNA, 20 bp, Homo sapiens
tgtcatatattcatgtaata

SEQ ID NO: 6503153 - DNA, 23 bp, Homo sapiens
tgtcatatcagcacatattttct

SEQ ID NO: 6503154 - DNA, 17 bp, Homo sapiens
tgtcatatcttctttgt

SEQ ID NO: 6503155 - DNA, 16 bp, Homo sapiens
tgtcatatgactgatt

SEQ ID NO: 6503156 - DNA, 12 bp, Homo sapiens
tgtcatattaaa

SEQ ID NO: 6503157 - DNA, 22 bp, Homo sapiens
tgtcatattttcctttatgtga

SEQ ID NO: 6503158 - DNA, 14 bp, Homo sapiens
tgtcatcaaatatt

SEQ ID NO: 6503159 - DNA, 19 bp, Homo sapiens
tgtcatcaaatattaccaa

SEQ ID NO: 6503160 - DNA, 22 bp, Homo sapiens
tgtcatcaacattcttgtgtct

SEQ ID NO: 6503161 - DNA, 15 bp, Homo sapiens
tgtcatcaagtagta

SEQ ID NO: 6503162 - DNA, 15 bp, Homo sapiens
tgtcatcaattaaag

SEQ ID NO: 6503163 - DNA, 17 bp, Homo sapiens
tgtcatcaatttgtaat

SEQ ID NO: 6503164 - DNA, 13 bp, Homo sapiens
tgtcatcactcta

SEQ ID NO: 6503165 - DNA, 15 bp, Homo sapiens
tgtcatcagaagata

SEQ ID NO: 6503166 - DNA, 21 bp, Homo sapiens
tgtcatcagccaccatcctat

SEQ ID NO: 6503167 - DNA, 16 bp, Homo sapiens
tgtcatcagtaagtat

SEQ ID NO: 6503168 - DNA, 17 bp, Homo sapiens
tgtcatcatcatggcca

SEQ ID NO: 6503169 - DNA, 16 bp, Homo sapiens
tgtcatccaccagtgt

SEQ ID NO: 6503170 - DNA, 17 bp, Homo sapiens
tgtcatccatgcgtgca

SEQ ID NO: 6503171 - DNA, 18 bp, Homo sapiens
tgtcatccccttgtgtca

SEQ ID NO: 6503172 - DNA, 19 bp, Homo sapiens
tgtcatcccgctcctgctg

SEQ ID NO: 6503173 - DNA, 20 bp, Homo sapiens
tgtcatcccgctcctgctga

SEQ ID NO: 6503174 - DNA, 19 bp, Homo sapiens
tgtcatcctcaaagaaagt

SEQ ID NO: 6503175 - DNA, 23 bp, Homo sapiens
tgtcatcctcccttgccccaggc

SEQ ID NO: 6503176 - DNA, 20 bp, Homo sapiens
tgtcatccttggtctttgta

SEQ ID NO: 6503177 - DNA, 18 bp, Homo sapiens
tgtcatcgttccccaccc

SEQ ID NO: 6503178 - DNA, 12 bp, Homo sapiens
tgtcatctaaag

SEQ ID NO: 6503179 - DNA, 20 bp, Homo sapiens
tgtcatctaccttttctctt

SEQ ID NO: 6503180 - DNA, 16 bp, Homo sapiens
tgtcatctagcccctt

SEQ ID NO: 6503181 - DNA, 15 bp, Homo sapiens
tgtcatctcagtgct

SEQ ID NO: 6503182 - DNA, 16 bp, Homo sapiens
tgtcatctctctgggg

SEQ ID NO: 6503183 - DNA, 22 bp, Homo sapiens
tgtcatctctctggggccctgg

SEQ ID NO: 6503184 - DNA, 13 bp, Homo sapiens
tgtcatctgagaa

SEQ ID NO: 6503185 - DNA, 15 bp, Homo sapiens
tgtcatctgaggagt

SEQ ID NO: 6503186 - DNA, 15 bp, Homo sapiens
tgtcatctgctcctt

SEQ ID NO: 6503187 - DNA, 20 bp, Homo sapiens
tgtcatctgctccttcctgt

SEQ ID NO: 6503188 - DNA, 14 bp, Homo sapiens
tgtcatctgggcca

SEQ ID NO: 6503189 - DNA, 22 bp, Homo sapiens
tgtcatcttttagagtaaacta

SEQ ID NO: 6503190 - DNA, 16 bp, Homo sapiens
tgtcatctttttctag

SEQ ID NO: 6503191 - DNA, 17 bp, Homo sapiens
tgtcatgaaagcacctg

SEQ ID NO: 6503192 - DNA, 20 bp, Homo sapiens
tgtcatgaagtgcacaggag

SEQ ID NO: 6503193 - DNA, 21 bp, Homo sapiens
tgtcatgaagtgcacaggagc

SEQ ID NO: 6503194 - DNA, 21 bp, Homo sapiens
tgtcatgaattcttatgctta

SEQ ID NO: 6503195 - DNA, 22 bp, Homo sapiens
tgtcatgacagtgcttgcatcc

SEQ ID NO: 6503196 - DNA, 16 bp, Homo sapiens
tgtcatgactttcaga

SEQ ID NO: 6503197 - DNA, 22 bp, Homo sapiens
tgtcatgatacgcttaaggtgg

SEQ ID NO: 6503198 - DNA, 19 bp, Homo sapiens
tgtcatgatttcaatgatt

SEQ ID NO: 6503199 - DNA, 22 bp, Homo sapiens
tgtcatgcccagcttggagtgc

SEQ ID NO: 6503200 - DNA, 17 bp, Homo sapiens
tgtcatgcccccctcaa

SEQ ID NO: 6503201 - DNA, 18 bp, Homo sapiens
tgtcatgctcacttttgt

SEQ ID NO: 6503202 - DNA, 19 bp, Homo sapiens
tgtcatggaaaatgtcctg

SEQ ID NO: 6503203 - DNA, 19 bp, Homo sapiens
tgtcatggctctgaactgc

SEQ ID NO: 6503204 - DNA, 15 bp, Homo sapiens
tgtcatggctgaagt

SEQ ID NO: 6503205 - DNA, 12 bp, Homo sapiens
tgtcatggtcct

SEQ ID NO: 6503206 - DNA, 21 bp, Homo sapiens
tgtcatggtcctttctggaag

SEQ ID NO: 6503207 - DNA, 12 bp, Homo sapiens
tgtcatggtgat

SEQ ID NO: 6503208 - DNA, 16 bp, Homo sapiens
tgtcatggtgatgcaa

SEQ ID NO: 6503209 - DNA, 18 bp, Homo sapiens
tgtcatggtgcaatttgt

SEQ ID NO: 6503210 - DNA, 20 bp, Homo sapiens
tgtcatggtgcaatttgtct

SEQ ID NO: 6503211 - DNA, 14 bp, Homo sapiens
tgtcatgtaatact

SEQ ID NO: 6503212 - DNA, 19 bp, Homo sapiens
tgtcatgtaggttgtctaa

SEQ ID NO: 6503213 - DNA, 18 bp, Homo sapiens
tgtcatgtggaaactatt

SEQ ID NO: 6503214 - DNA, 11 bp, Homo sapiens
tgtcatgtgta

SEQ ID NO: 6503215 - DNA, 13 bp, Homo sapiens
tgtcatgtgtata

SEQ ID NO: 6503216 - DNA, 15 bp, Homo sapiens
tgtcatgtgtataaa

SEQ ID NO: 6503217 - DNA, 18 bp, Homo sapiens
tgtcatgtgttccctttg

SEQ ID NO: 6503218 - DNA, 19 bp, Homo sapiens
tgtcatgtgttccctttgt

SEQ ID NO: 6503219 - DNA, 17 bp, Homo sapiens
tgtcatgttatgcagtg

SEQ ID NO: 6503220 - DNA, 15 bp, Homo sapiens
tgtcatgttgcttgt

SEQ ID NO: 6503221 - DNA, 16 bp, Homo sapiens
tgtcatgtttattcta

SEQ ID NO: 6503222 - DNA, 23 bp, Homo sapiens
tgtcattaaatggggctcacaaa

SEQ ID NO: 6503223 - DNA, 15 bp, Homo sapiens
tgtcattaacacatt

SEQ ID NO: 6503224 - DNA, 19 bp, Homo sapiens
tgtcattaccagacggttc

SEQ ID NO: 6503225 - DNA, 20 bp, Homo sapiens
tgtcattactgcctttggaa

SEQ ID NO: 6503226 - DNA, 22 bp, Homo sapiens
tgtcattactgcctttggaaga

SEQ ID NO: 6503227 - DNA, 14 bp, Homo sapiens
tgtcattagcctga

SEQ ID NO: 6503228 - DNA, 22 bp, Homo sapiens
tgtcattagtgagacatattta

SEQ ID NO: 6503229 - DNA, 20 bp, Homo sapiens
tgtcattatattctaattaa

SEQ ID NO: 6503230 - DNA, 13 bp, Homo sapiens
tgtcattatgaca

SEQ ID NO: 6503231 - DNA, 13 bp, Homo sapiens
tgtcattatgatt

SEQ ID NO: 6503232 - DNA, 16 bp, Homo sapiens
tgtcattatgtagaaa

SEQ ID NO: 6503233 - DNA, 17 bp, Homo sapiens
tgtcattatttattgtt

SEQ ID NO: 6503234 - DNA, 21 bp, Homo sapiens
tgtcattatttgataacattt

SEQ ID NO: 6503235 - DNA, 23 bp, Homo sapiens
tgtcattatttttgttagcaaag

SEQ ID NO: 6503236 - DNA, 19 bp, Homo sapiens
tgtcattcccctttgcact

SEQ ID NO: 6503237 - DNA, 22 bp, Homo sapiens
tgtcattcccctttgcactgta

SEQ ID NO: 6503238 - DNA, 23 bp, Homo sapiens
tgtcattcccctttgcactgtaa

SEQ ID NO: 6503239 - DNA, 12 bp, Homo sapiens
tgtcattctcat

SEQ ID NO: 6503240 - DNA, 22 bp, Homo sapiens
tgtcattctcatccaaaagtga

SEQ ID NO: 6503241 - DNA, 23 bp, Homo sapiens
tgtcattctcatccaaaagtgac

SEQ ID NO: 6503242 - DNA, 14 bp, Homo sapiens
tgtcattctgcctg

SEQ ID NO: 6503243 - DNA, 15 bp, Homo sapiens
tgtcattctgcctgc

SEQ ID NO: 6503244 - DNA, 16 bp, Homo sapiens
tgtcattctgcctgct

SEQ ID NO: 6503245 - DNA, 22 bp, Homo sapiens
tgtcattctgcctgctccatcg

SEQ ID NO: 6503246 - DNA, 22 bp, Homo sapiens
tgtcattgcccacttctgtgta

SEQ ID NO: 6503247 - DNA, 13 bp, Homo sapiens
tgtcattgcttct

SEQ ID NO: 6503248 - DNA, 13 bp, Homo sapiens
tgtcattggaagc

SEQ ID NO: 6503249 - DNA, 14 bp, Homo sapiens
tgtcattgtaaaca

SEQ ID NO: 6503250 - DNA, 18 bp, Homo sapiens
tgtcattgtaaacaaact

SEQ ID NO: 6503251 - DNA, 13 bp, Homo sapiens
tgtcattgtattc

SEQ ID NO: 6503252 - DNA, 17 bp, Homo sapiens
tgtcattgtccagctgg

SEQ ID NO: 6503253 - DNA, 13 bp, Homo sapiens
tgtcattgtctac

SEQ ID NO: 6503254 - DNA, 21 bp, Homo sapiens
tgtcattgtctactcctagaa

SEQ ID NO: 6503255 - DNA, 12 bp, Homo sapiens
tgtcattgttat

SEQ ID NO: 6503256 - DNA, 20 bp, Homo sapiens
tgtcatttaccctggtggag

SEQ ID NO: 6503257 - DNA, 16 bp, Homo sapiens
tgtcatttcagaagtt

SEQ ID NO: 6503258 - DNA, 16 bp, Homo sapiens
tgtcatttcatacaaa

SEQ ID NO: 6503259 - DNA, 18 bp, Homo sapiens
tgtcatttcatgtcctgt

SEQ ID NO: 6503260 - DNA, 14 bp, Homo sapiens
tgtcatttcatttc

SEQ ID NO: 6503261 - DNA, 14 bp, Homo sapiens
tgtcatttccaaat

SEQ ID NO: 6503262 - DNA, 11 bp, Homo sapiens
tgtcatttcta

SEQ ID NO: 6503263 - DNA, 13 bp, Homo sapiens
tgtcatttcttca

SEQ ID NO: 6503264 - DNA, 14 bp, Homo sapiens
tgtcatttctttta

SEQ ID NO: 6503265 - DNA, 12 bp, Homo sapiens
tgtcatttgcac

SEQ ID NO: 6503266 - DNA, 13 bp, Homo sapiens
tgtcatttgcaca

SEQ ID NO: 6503267 - DNA, 16 bp, Homo sapiens
tgtcatttgttaaaat

SEQ ID NO: 6503268 - DNA, 23 bp, Homo sapiens
tgtcattttaaaatctgatttaa

SEQ ID NO: 6503269 - DNA, 22 bp, Homo sapiens
tgtcattttattttttccctcc

SEQ ID NO: 6503270 - DNA, 22 bp, Homo sapiens
tgtcattttcagatccttccaa

SEQ ID NO: 6503271 - DNA, 13 bp, Homo sapiens
tgtcattttcatt

SEQ ID NO: 6503272 - DNA, 19 bp, Homo sapiens
tgtcattttcattagcaaa

SEQ ID NO: 6503273 - DNA, 17 bp, Homo sapiens
tgcagtcctgggtcctc

SEQ ID NO: 6503274 - DNA, 13 bp, Homo sapiens
tgcagtcctggtg

SEQ ID NO: 6503275 - DNA, 20 bp, Homo sapiens
tgcagtcgcttgccaaagca

SEQ ID NO: 6503276 - DNA, 20 bp, Homo sapiens
tgcagtcggcatgccaggac

SEQ ID NO: 6503277 - DNA, 22 bp, Homo sapiens
tgcagtcggcatgccaggaccc

SEQ ID NO: 6503278 - DNA, 13 bp, Homo sapiens
tgcagtctcagaa

SEQ ID NO: 6503279 - DNA, 16 bp, Homo sapiens
tgcagtctcatttctc

SEQ ID NO: 6503280 - DNA, 13 bp, Homo sapiens
tgcagtctcctct

SEQ ID NO: 6503281 - DNA, 18 bp, Homo sapiens
tgcagtctctataccaat

SEQ ID NO: 6503282 - DNA, 22 bp, Homo sapiens
tgcagtctctataccaataaag

SEQ ID NO: 6503283 - DNA, 17 bp, Homo sapiens
tgcagtctctttatttt

SEQ ID NO: 6503284 - DNA, 19 bp, Homo sapiens
tgcagtctgcttctgcacc

SEQ ID NO: 6503285 - DNA, 19 bp, Homo sapiens
tgcagtctggctgagccct

SEQ ID NO: 6503286 - DNA, 20 bp, Homo sapiens
tgcagtctggctgagccctg

SEQ ID NO: 6503287 - DNA, 19 bp, Homo sapiens
tgcagtctgtccaggctcg

SEQ ID NO: 6503288 - DNA, 21 bp, Homo sapiens
tgcagtcttaccaatgacttt

SEQ ID NO: 6503289 - DNA, 20 bp, Homo sapiens
tgcagtcttctctctggctc

SEQ ID NO: 6503290 - DNA, 21 bp, Homo sapiens
tgcagtcttctctctggctca

SEQ ID NO: 6503291 - DNA, 23 bp, Homo sapiens
tgcagtcttctctctggctcagg

SEQ ID NO: 6503292 - DNA, 18 bp, Homo sapiens
tgcagtcttgtactgtga

SEQ ID NO: 6503293 - DNA, 20 bp, Homo sapiens
tgcagtctttatttttttcc

SEQ ID NO: 6503294 - DNA, 21 bp, Homo sapiens
tgcagtctttatttttttccc

SEQ ID NO: 6503295 - DNA, 22 bp, Homo sapiens
tgcagtctttatttttttccca

SEQ ID NO: 6503296 - DNA, 15 bp, Homo sapiens
tgcagtctttccccc

SEQ ID NO: 6503297 - DNA, 17 bp, Homo sapiens
tgcagtctttcccccag

SEQ ID NO: 6503298 - DNA, 21 bp, Homo sapiens
tgcagtctttcccccaggaaa

SEQ ID NO: 6503299 - DNA, 15 bp, Homo sapiens
tgcagtgaactattt

SEQ ID NO: 6503300 - DNA, 19 bp, Homo sapiens
tgcagtgaacttccagaca

SEQ ID NO: 6503301 - DNA, 18 bp, Homo sapiens
tgcagtgaatttgaataa

SEQ ID NO: 6503302 - DNA, 23 bp, Homo sapiens
tgcagtgacctgccctacatatc

SEQ ID NO: 6503303 - DNA, 19 bp, Homo sapiens
tgcagtgacgtgcacctgt

SEQ ID NO: 6503304 - DNA, 12 bp, Homo sapiens
tgcagtgagcag

SEQ ID NO: 6503305 - DNA, 17 bp, Homo sapiens
tgcagtgagcagggtgg

SEQ ID NO: 6503306 - DNA, 13 bp, Homo sapiens
tgcagtgagctga

SEQ ID NO: 6503307 - DNA, 20 bp, Homo sapiens
tgcagtgaggggccctccat

SEQ ID NO: 6503308 - DNA, 21 bp, Homo sapiens
tgcagtgatatggcagaagac

SEQ ID NO: 6503309 - DNA, 18 bp, Homo sapiens
tgcagtgatgtatacatc

SEQ ID NO: 6503310 - DNA, 11 bp, Homo sapiens
tgcagtgatta

SEQ ID NO: 6503311 - DNA, 15 bp, Homo sapiens
tgcagtgattcagca

SEQ ID NO: 6503312 - DNA, 16 bp, Homo sapiens
tgcagtgcccctagct

SEQ ID NO: 6503313 - DNA, 12 bp, Homo sapiens
tgcagtgccttg

SEQ ID NO: 6503314 - DNA, 20 bp, Homo sapiens
tgcagtgcctttccccattc

SEQ ID NO: 6503315 - DNA, 19 bp, Homo sapiens
tgcagtgctcgctgttgct

SEQ ID NO: 6503316 - DNA, 12 bp, Homo sapiens
tgcagtgctctt

SEQ ID NO: 6503317 - DNA, 20 bp, Homo sapiens
tgcagtgctctttgtagcta

SEQ ID NO: 6503318 - DNA, 16 bp, Homo sapiens
tgcagtggacggagag

SEQ ID NO: 6503319 - DNA, 15 bp, Homo sapiens
tgcagtggagctggc

SEQ ID NO: 6503320 - DNA, 22 bp, Homo sapiens
tgcagtggcatgatctcagctc

SEQ ID NO: 6503321 - DNA, 13 bp, Homo sapiens
tgcagtggcctga

SEQ ID NO: 6503322 - DNA, 14 bp, Homo sapiens
tgcagtggcctggc

SEQ ID NO: 6503323 - DNA, 23 bp, Homo sapiens
tgcagtggcgcaatctcggctca

SEQ ID NO: 6503324 - DNA, 22 bp, Homo sapiens
tgcagtggcgccatctcggctc

SEQ ID NO: 6503325 - DNA, 16 bp, Homo sapiens
tgcagtggcttttcat

SEQ ID NO: 6503326 - DNA, 13 bp, Homo sapiens
tgcagtgggcagt

SEQ ID NO: 6503327 - DNA, 13 bp, Homo sapiens
tgcagtggggttt

SEQ ID NO: 6503328 - DNA, 22 bp, Homo sapiens
tgcagtggtatgatcacggctc

SEQ ID NO: 6503329 - DNA, 20 bp, Homo sapiens
tgcagtggtgcgatctgggt

SEQ ID NO: 6503330 - DNA, 14 bp, Homo sapiens
tgcagtgtagattt

SEQ ID NO: 6503331 - DNA, 17 bp, Homo sapiens
tgcagtgtatttaatgt

SEQ ID NO: 6503332 - DNA, 23 bp, Homo sapiens
tgcagtgtccattatctgctgtt

SEQ ID NO: 6503333 - DNA, 12 bp, Homo sapiens
tgcagtgtctta

SEQ ID NO: 6503334 - DNA, 20 bp, Homo sapiens
tgcagtgtgaatgctgggcc

SEQ ID NO: 6503335 - DNA, 18 bp, Homo sapiens
tgcagtgtgcctgtcact

SEQ ID NO: 6503336 - DNA, 15 bp, Homo sapiens
tgcagtgttagtatt

SEQ ID NO: 6503337 - DNA, 17 bp, Homo sapiens
tgcagtgttcgcttggc

SEQ ID NO: 6503338 - DNA, 13 bp, Homo sapiens
tgcagtgttctgt

SEQ ID NO: 6503339 - DNA, 16 bp, Homo sapiens
tgcagtgttctgtgaa

SEQ ID NO: 6503340 - DNA, 18 bp, Homo sapiens
tgcagttacaaattataa

SEQ ID NO: 6503341 - DNA, 23 bp, Homo sapiens
tgcagttacaaattataatgtat

SEQ ID NO: 6503342 - DNA, 18 bp, Homo sapiens
tgcagttagcacagagga

SEQ ID NO: 6503343 - DNA, 23 bp, Homo sapiens
tgcagttagccccagaaaatgaa

SEQ ID NO: 6503344 - DNA, 16 bp, Homo sapiens
tgcagttcagaatggc

SEQ ID NO: 6503345 - DNA, 19 bp, Homo sapiens
tgcagttcagcaccaccct

SEQ ID NO: 6503346 - DNA, 15 bp, Homo sapiens
tgcagttcattattt

SEQ ID NO: 6503347 - DNA, 21 bp, Homo sapiens
tgcagttcccccaacctcaga

SEQ ID NO: 6503348 - DNA, 13 bp, Homo sapiens
tgcagttcctggc

SEQ ID NO: 6503349 - DNA, 17 bp, Homo sapiens
tgcagttctagtttgca

SEQ ID NO: 6503350 - DNA, 12 bp, Homo sapiens
tgcagttctgaa

SEQ ID NO: 6503351 - DNA, 15 bp, Homo sapiens
tgcagttctgaagaa

SEQ ID NO: 6503352 - DNA, 17 bp, Homo sapiens
tgcagttctgaagaaga

SEQ ID NO: 6503353 - DNA, 19 bp, Homo sapiens
tgcagttctgaagaagatg

SEQ ID NO: 6503354 - DNA, 14 bp, Homo sapiens
tgcagttctgcagc

SEQ ID NO: 6503355 - DNA, 17 bp, Homo sapiens
tgcagttcttgagttgc

SEQ ID NO: 6503356 - DNA, 18 bp, Homo sapiens
tgcagttcttgtggaaga

SEQ ID NO: 6503357 - DNA, 19 bp, Homo sapiens
tgcagttcttgtggaagac

SEQ ID NO: 6503358 - DNA, 22 bp, Homo sapiens
tgcagttcttgtggaagacact

SEQ ID NO: 6503359 - DNA, 21 bp, Homo sapiens
tgcagttctttggctgaaagg

SEQ ID NO: 6503360 - DNA, 16 bp, Homo sapiens
tgcagttgaagagcct

SEQ ID NO: 6503361 - DNA, 17 bp, Homo sapiens
tgcagttgactttctcc

SEQ ID NO: 6503362 - DNA, 14 bp, Homo sapiens
tgcagttgagaggg

SEQ ID NO: 6503363 - DNA, 14 bp, Homo sapiens
tgcagttgataaga

SEQ ID NO: 6503364 - DNA, 19 bp, Homo sapiens
tgcagttgctcattgtaga

SEQ ID NO: 6503365 - DNA, 15 bp, Homo sapiens
tgcagttggcctcag

SEQ ID NO: 6503366 - DNA, 16 bp, Homo sapiens
tgcagttggcctcagc

SEQ ID NO: 6503367 - DNA, 17 bp, Homo sapiens
tgcagttggcctcagca

SEQ ID NO: 6503368 - DNA, 14 bp, Homo sapiens
tgcagttgtatagt

SEQ ID NO: 6503369 - DNA, 16 bp, Homo sapiens
tgcagttgtgaaagca

SEQ ID NO: 6503370 - DNA, 17 bp, Homo sapiens
tgcagttgtgaaagcac

SEQ ID NO: 6503371 - DNA, 20 bp, Homo sapiens
tgcagttgtgatataaagga

SEQ ID NO: 6503372 - DNA, 15 bp, Homo sapiens
tgcagttgtgatttc

SEQ ID NO: 6503373 - DNA, 12 bp, Homo sapiens
tgcagtttaaga

SEQ ID NO: 6503374 - DNA, 19 bp, Homo sapiens
tgcagtttaagatgacact

SEQ ID NO: 6503375 - DNA, 18 bp, Homo sapiens
tgcagtttacagtatttc

SEQ ID NO: 6503376 - DNA, 10 bp, Homo sapiens
tgcagtttat

SEQ ID NO: 6503377 - DNA, 19 bp, Homo sapiens
tgcagtttatcattcaagt

SEQ ID NO: 6503378 - DNA, 15 bp, Homo sapiens
tgcagtttcatgtat

SEQ ID NO: 6503379 - DNA, 17 bp, Homo sapiens
tgcagtttcatgtatgt

SEQ ID NO: 6503380 - DNA, 19 bp, Homo sapiens
tgcagtttcatgtatgtat

SEQ ID NO: 6503381 - DNA, 15 bp, Homo sapiens
tgcagtttcattcaa

SEQ ID NO: 6503382 - DNA, 22 bp, Homo sapiens
tgcagtttcttgtgtagatttg

SEQ ID NO: 6503383 - DNA, 11 bp, Homo sapiens
tgcagtttgaa

SEQ ID NO: 6503384 - DNA, 22 bp, Homo sapiens
tgcagtttgaaattctgaattt

SEQ ID NO: 6503385 - DNA, 16 bp, Homo sapiens
tgcagtttggccctgg

SEQ ID NO: 6503386 - DNA, 17 bp, Homo sapiens
tgcagtttgggagacat

SEQ ID NO: 6503387 - DNA, 18 bp, Homo sapiens
tgcagtttgggagacatg

SEQ ID NO: 6503388 - DNA, 16 bp, Homo sapiens
tgcagttttaagaatt

SEQ ID NO: 6503389 - DNA, 12 bp, Homo sapiens
tgcagttttcct

SEQ ID NO: 6503390 - DNA, 15 bp, Homo sapiens
tgcagttttgacatt

SEQ ID NO: 6503391 - DNA, 18 bp, Homo sapiens
tgcagttttggtgtgtaa

SEQ ID NO: 6503392 - DNA, 23 bp, Homo sapiens
tgcagttttgtaaataagtgaaa

SEQ ID NO: 6503393 - DNA, 12 bp, Homo sapiens
tgcagtttttaa

SEQ ID NO: 6503394 - DNA, 15 bp, Homo sapiens
tgcagtttttcattt

SEQ ID NO: 6503395 - DNA, 16 bp, Homo sapiens
tgcagtttttcccaag

SEQ ID NO: 6503396 - DNA, 22 bp, Homo sapiens
tgcataaaagggtcaaacctgt

SEQ ID NO: 6503397 - DNA, 23 bp, Homo sapiens
tgcataaaagggtcaaacctgta

SEQ ID NO: 6503398 - DNA, 14 bp, Homo sapiens
tgcataaacttcat

SEQ ID NO: 6503399 - DNA, 15 bp, Homo sapiens
tgcataaacttcatc

SEQ ID NO: 6503400 - DNA, 16 bp, Homo sapiens
tgcataaacttcatct

SEQ ID NO: 6503401 - DNA, 17 bp, Homo sapiens
tgcataaagtcagtgcc

SEQ ID NO: 6503402 - DNA, 13 bp, Homo sapiens
tgcataaataaat

SEQ ID NO: 6503403 - DNA, 13 bp, Homo sapiens
tgcataaatatgc

SEQ ID NO: 6503404 - DNA, 14 bp, Homo sapiens
tgcataaatatgca

SEQ ID NO: 6503405 - DNA, 15 bp, Homo sapiens
tgcataaatatgcag

SEQ ID NO: 6503406 - DNA, 19 bp, Homo sapiens
tgcataaatatgcagtgat

SEQ ID NO: 6503407 - DNA, 13 bp, Homo sapiens
tgcataaatcaat

SEQ ID NO: 6503408 - DNA, 17 bp, Homo sapiens
tgcataaatcaatggtt

SEQ ID NO: 6503409 - DNA, 16 bp, Homo sapiens
tgcataaatgcataat

SEQ ID NO: 6503410 - DNA, 15 bp, Homo sapiens
tgcataaatgttata

SEQ ID NO: 6503411 - DNA, 16 bp, Homo sapiens
tgcataaatttgtaat

SEQ ID NO: 6503412 - DNA, 21 bp, Homo sapiens
tgcataaatttgtaatatatc

SEQ ID NO: 6503413 - DNA, 23 bp, Homo sapiens
tgcataacgtataaaagcctgtt

SEQ ID NO: 6503414 - DNA, 22 bp, Homo sapiens
tgcataactgacaaatcaagtt

SEQ ID NO: 6503415 - DNA, 23 bp, Homo sapiens
tgcataactgacaaatcaagttt

SEQ ID NO: 6503416 - DNA, 22 bp, Homo sapiens
tgcataagaaatgtagctgaag

SEQ ID NO: 6503417 - DNA, 12 bp, Homo sapiens
tgcataagatta

SEQ ID NO: 6503418 - DNA, 22 bp, Homo sapiens
tgcataagattaaaggaaggaa

SEQ ID NO: 6503419 - DNA, 20 bp, Homo sapiens
tgcataagattatatacaaa

SEQ ID NO: 6503420 - DNA, 20 bp, Homo sapiens
tgcataagcctcaggcctgg

SEQ ID NO: 6503421 - DNA, 18 bp, Homo sapiens
tgcataaggtttttatgc

SEQ ID NO: 6503422 - DNA, 23 bp, Homo sapiens
tgcataagtaattaaaatatact

SEQ ID NO: 6503423 - DNA, 14 bp, Homo sapiens
tgcataagtgaaaa

SEQ ID NO: 6503424 - DNA, 18 bp, Homo sapiens
tgcataagtgaaaatctt

SEQ ID NO: 6503425 - DNA, 18 bp, Homo sapiens
tgcataagttcttaatgt

SEQ ID NO: 6503426 - DNA, 11 bp, Homo sapiens
tgcataataaa

SEQ ID NO: 6503427 - DNA, 21 bp, Homo sapiens
tgcataataagcaggttgtta

SEQ ID NO: 6503428 - DNA, 12 bp, Homo sapiens
tgcataatacta

SEQ ID NO: 6503429 - DNA, 19 bp, Homo sapiens
tgcataatactaatttatt

SEQ ID NO: 6503430 - DNA, 20 bp, Homo sapiens
tgcataatactaatttattg

SEQ ID NO: 6503431 - DNA, 15 bp, Homo sapiens
tgcataatatgcata

SEQ ID NO: 6503432 - DNA, 20 bp, Homo sapiens
tgcataatatgcatatatat

SEQ ID NO: 6503433 - DNA, 22 bp, Homo sapiens
tgcataatatgcatatatatgt

SEQ ID NO: 6503434 - DNA, 23 bp, Homo sapiens
tgcataatcagcgccctggagtc

SEQ ID NO: 6503435 - DNA, 22 bp, Homo sapiens
tgcataatgaaccgtttacagt

SEQ ID NO: 6503436 - DNA, 17 bp, Homo sapiens
tgcataatgcaatcaaa

SEQ ID NO: 6503437 - DNA, 17 bp, Homo sapiens
tgcataatgctttggaa

SEQ ID NO: 6503438 - DNA, 19 bp, Homo sapiens
tgcataatgctttggaaaa

SEQ ID NO: 6503439 - DNA, 15 bp, Homo sapiens
tgcataatgtcttta

SEQ ID NO: 6503440 - DNA, 16 bp, Homo sapiens
tgcataatgtctttaa

SEQ ID NO: 6503441 - DNA, 20 bp, Homo sapiens
tgcatacaactgtgcattac

SEQ ID NO: 6503442 - DNA, 14 bp, Homo sapiens
tgcatacaataaaa

SEQ ID NO: 6503443 - DNA, 15 bp, Homo sapiens
tgcatacaataaaag

SEQ ID NO: 6503444 - DNA, 16 bp, Homo sapiens
tgcatacaataaaaga

SEQ ID NO: 6503445 - DNA, 18 bp, Homo sapiens
tgcatacaataaaagagc

SEQ ID NO: 6503446 - DNA, 22 bp, Homo sapiens
tgcatacaataaaagagcttta

SEQ ID NO: 6503447 - DNA, 9 bp, Homo sapiens
tgcatacac

SEQ ID NO: 6503448 - DNA, 15 bp, Homo sapiens
tgcatacacacacac

SEQ ID NO: 6503449 - DNA, 16 bp, Homo sapiens
tgcatacacatgcact

SEQ ID NO: 6503450 - DNA, 15 bp, Homo sapiens
tgcatacagaaatat

SEQ ID NO: 6503451 - DNA, 16 bp, Homo sapiens
tgcatacatacacata

SEQ ID NO: 6503452 - DNA, 14 bp, Homo sapiens
tgtcattttctcca

SEQ ID NO: 6503453 - DNA, 15 bp, Homo sapiens
tgtcattttctccat

SEQ ID NO: 6503454 - DNA, 14 bp, Homo sapiens
tgtcattttctctt

SEQ ID NO: 6503455 - DNA, 21 bp, Homo sapiens
tgtcattttctgttatacaca

SEQ ID NO: 6503456 - DNA, 22 bp, Homo sapiens
tgtcattttctgttatacacag

SEQ ID NO: 6503457 - DNA, 21 bp, Homo sapiens
tgtcattttcttgatgtcact

SEQ ID NO: 6503458 - DNA, 15 bp, Homo sapiens
tgtcattttgaagct

SEQ ID NO: 6503459 - DNA, 18 bp, Homo sapiens
tgtcattttgaagctaat

SEQ ID NO: 6503460 - DNA, 15 bp, Homo sapiens
tgtcattttgcactg

SEQ ID NO: 6503461 - DNA, 16 bp, Homo sapiens
tgtcatttttaatgta

SEQ ID NO: 6503462 - DNA, 14 bp, Homo sapiens
tgtcatttttgaat

SEQ ID NO: 6503463 - DNA, 15 bp, Homo sapiens
tgtcattttttttct

SEQ ID NO: 6503464 - DNA, 18 bp, Homo sapiens
tgtccaaaaccgccagct

SEQ ID NO: 6503465 - DNA, 20 bp, Homo sapiens
tgtccaaaaccgccagctct

SEQ ID NO: 6503466 - DNA, 22 bp, Homo sapiens
tgtccaaaaccgccagctctgt

SEQ ID NO: 6503467 - DNA, 22 bp, Homo sapiens
tgtccaaaactgtattgaaaaa

SEQ ID NO: 6503468 - DNA, 18 bp, Homo sapiens
tgtccaaaagcgccctca

SEQ ID NO: 6503469 - DNA, 19 bp, Homo sapiens
tgtccaaaagcgccctcac

SEQ ID NO: 6503470 - DNA, 18 bp, Homo sapiens
tgtccaaaatttatattt

SEQ ID NO: 6503471 - DNA, 15 bp, Homo sapiens
tgtccaaactgccta

SEQ ID NO: 6503472 - DNA, 22 bp, Homo sapiens
tgtccaaactgcctaagccctc

SEQ ID NO: 6503473 - DNA, 18 bp, Homo sapiens
tgtccaaacttaacagat

SEQ ID NO: 6503474 - DNA, 20 bp, Homo sapiens
tgtccaaagaggctgcccct

SEQ ID NO: 6503475 - DNA, 12 bp, Homo sapiens
tgtccaaagcag

SEQ ID NO: 6503476 - DNA, 17 bp, Homo sapiens
tgtccaaagctgaaaat

SEQ ID NO: 6503477 - DNA, 22 bp, Homo sapiens
tgtccaaagctgaaaatgtgta

SEQ ID NO: 6503478 - DNA, 13 bp, Homo sapiens
tgtccaaatttaa

SEQ ID NO: 6503479 - DNA, 14 bp, Homo sapiens
tgtccaaatttaaa

SEQ ID NO: 6503480 - DNA, 17 bp, Homo sapiens
tgtccaaatttaaaatg

SEQ ID NO: 6503481 - DNA, 15 bp, Homo sapiens
tgtccaacccctccc

SEQ ID NO: 6503482 - DNA, 22 bp, Homo sapiens
tgtccaacccctcccccacgtc

SEQ ID NO: 6503483 - DNA, 18 bp, Homo sapiens
tgtccaacccgaggcccg

SEQ ID NO: 6503484 - DNA, 15 bp, Homo sapiens
tgtccaacctaaccc

SEQ ID NO: 6503485 - DNA, 21 bp, Homo sapiens
tgtccaacctaacccctttcc

SEQ ID NO: 6503486 - DNA, 23 bp, Homo sapiens
tgtccaactccagtactggagct

SEQ ID NO: 6503487 - DNA, 19 bp, Homo sapiens
tgtccaactggccctattt

SEQ ID NO: 6503488 - DNA, 20 bp, Homo sapiens
tgtccaagaactctaaccag

SEQ ID NO: 6503489 - DNA, 16 bp, Homo sapiens
tgtccaagaagcccag

SEQ ID NO: 6503490 - DNA, 22 bp, Homo sapiens
tgtccaagacacatgctgaggt

SEQ ID NO: 6503491 - DNA, 17 bp, Homo sapiens
tgtccaagtgtgtgtgc

SEQ ID NO: 6503492 - DNA, 18 bp, Homo sapiens
tgtccaagtgtgtgtgcg

SEQ ID NO: 6503493 - DNA, 17 bp, Homo sapiens
tgtccaagttcttcacc

SEQ ID NO: 6503494 - DNA, 18 bp, Homo sapiens
tgtccaagttcttcacct

SEQ ID NO: 6503495 - DNA, 19 bp, Homo sapiens
tgtccaagttcttcacctc

SEQ ID NO: 6503496 - DNA, 23 bp, Homo sapiens
tgtccaagttcttcacctctatc

SEQ ID NO: 6503497 - DNA, 16 bp, Homo sapiens
tgtccaatataaattg

SEQ ID NO: 6503498 - DNA, 14 bp, Homo sapiens
tgtccaatatgaaa

SEQ ID NO: 6503499 - DNA, 14 bp, Homo sapiens
tgtccaatctgcaa

SEQ ID NO: 6503500 - DNA, 20 bp, Homo sapiens
tgtccaatggctgtaaacta

SEQ ID NO: 6503501 - DNA, 15 bp, Homo sapiens
tgtccaattatgcac

SEQ ID NO: 6503502 - DNA, 19 bp, Homo sapiens
tgtccaattatgcactggc

SEQ ID NO: 6503503 - DNA, 15 bp, Homo sapiens
tgtccaattccagag

SEQ ID NO: 6503504 - DNA, 23 bp, Homo sapiens
tgtccaattgttgacagttctga

SEQ ID NO: 6503505 - DNA, 17 bp, Homo sapiens
tgtccaatttgtaagta

SEQ ID NO: 6503506 - DNA, 20 bp, Homo sapiens
tgtccacaaatgtcctcaga

SEQ ID NO: 6503507 - DNA, 20 bp, Homo sapiens
tgtccacacaagacagcaga

SEQ ID NO: 6503508 - DNA, 22 bp, Homo sapiens
tgtccacacaagacagcagagc

SEQ ID NO: 6503509 - DNA, 16 bp, Homo sapiens
tgtccacaggcttctg

SEQ ID NO: 6503510 - DNA, 15 bp, Homo sapiens
tgtccacagtctccc

SEQ ID NO: 6503511 - DNA, 21 bp, Homo sapiens
tgtccacagtgattagcctcg

SEQ ID NO: 6503512 - DNA, 17 bp, Homo sapiens
tgtccacatccccagag

SEQ ID NO: 6503513 - DNA, 17 bp, Homo sapiens
tgtccacatgacctcca

SEQ ID NO: 6503514 - DNA, 22 bp, Homo sapiens
tgtccaccacttcaggggatgg

SEQ ID NO: 6503515 - DNA, 16 bp, Homo sapiens
tgtccaccagacccac

SEQ ID NO: 6503516 - DNA, 22 bp, Homo sapiens
tgtccaccagtttatacagaac

SEQ ID NO: 6503517 - DNA, 19 bp, Homo sapiens
tgtccaccatccccagctg

SEQ ID NO: 6503518 - DNA, 14 bp, Homo sapiens
tgtccaccatgctc

SEQ ID NO: 6503519 - DNA, 17 bp, Homo sapiens
tgtccaccatgctctct

SEQ ID NO: 6503520 - DNA, 20 bp, Homo sapiens
tgtccacccacttagtccac

SEQ ID NO: 6503521 - DNA, 12 bp, Homo sapiens
tgtccaccccca

SEQ ID NO: 6503522 - DNA, 13 bp, Homo sapiens
tgtccacccccat

SEQ ID NO: 6503523 - DNA, 17 bp, Homo sapiens
tgtccacctcaccaggg

SEQ ID NO: 6503524 - DNA, 15 bp, Homo sapiens
tgtccacctggcccc

SEQ ID NO: 6503525 - DNA, 22 bp, Homo sapiens
tgtccacctgtgagaaaggaaa

SEQ ID NO: 6503526 - DNA, 15 bp, Homo sapiens
tgtccacctgtgggt

SEQ ID NO: 6503527 - DNA, 21 bp, Homo sapiens
tgtccaccttctgccaaggcc

SEQ ID NO: 6503528 - DNA, 17 bp, Homo sapiens
tgtccaccttttaagtt

SEQ ID NO: 6503529 - DNA, 18 bp, Homo sapiens
tgtccaccttttaagtta

SEQ ID NO: 6503530 - DNA, 18 bp, Homo sapiens
tgtccacgactgtctcca

SEQ ID NO: 6503531 - DNA, 23 bp, Homo sapiens
tgtccacgcgtgccgtggcacca

SEQ ID NO: 6503532 - DNA, 19 bp, Homo sapiens
tgtccacgtacttaattta

SEQ ID NO: 6503533 - DNA, 14 bp, Homo sapiens
tgtccacgtggaga

SEQ ID NO: 6503534 - DNA, 23 bp, Homo sapiens
tgtccactaaaccccatacctgg

SEQ ID NO: 6503535 - DNA, 21 bp, Homo sapiens
tgtccactctcggggcccttg

SEQ ID NO: 6503536 - DNA, 23 bp, Homo sapiens
tgtccactgagactttcccctct

SEQ ID NO: 6503537 - DNA, 18 bp, Homo sapiens
tgtccacttgtgggtcct

SEQ ID NO: 6503538 - DNA, 22 bp, Homo sapiens
tgtccagaaattgtgtgtgcaa

SEQ ID NO: 6503539 - DNA, 23 bp, Homo sapiens
tgtccagaagcggcctgtgcgtt

SEQ ID NO: 6503540 - DNA, 16 bp, Homo sapiens
tgtccagacaagccct

SEQ ID NO: 6503541 - DNA, 19 bp, Homo sapiens
tgtccagacaagccctgct

SEQ ID NO: 6503542 - DNA, 21 bp, Homo sapiens
tgtccagacagagccctgtga

SEQ ID NO: 6503543 - DNA, 22 bp, Homo sapiens
tgtccagacagagccctgtgag

SEQ ID NO: 6503544 - DNA, 15 bp, Homo sapiens
tgtccagacagcctg

SEQ ID NO: 6503545 - DNA, 17 bp, Homo sapiens
tgtccagacagcctgta

SEQ ID NO: 6503546 - DNA, 20 bp, Homo sapiens
tgtccagaccattgtcttcc

SEQ ID NO: 6503547 - DNA, 13 bp, Homo sapiens
tgtccagagacaa

SEQ ID NO: 6503548 - DNA, 20 bp, Homo sapiens
tgtccagagacatgggcctc

SEQ ID NO: 6503549 - DNA, 21 bp, Homo sapiens
tgtccagagagcaactctgag

SEQ ID NO: 6503550 - DNA, 21 bp, Homo sapiens
tgtccagagataaaaatcata

SEQ ID NO: 6503551 - DNA, 22 bp, Homo sapiens
tgtccagagataaaaatcatat

SEQ ID NO: 6503552 - DNA, 20 bp, Homo sapiens
tgtccagagctgcttccccg

SEQ ID NO: 6503553 - DNA, 17 bp, Homo sapiens
tgtccagagggactgga

SEQ ID NO: 6503554 - DNA, 21 bp, Homo sapiens
tgtccagagggactggacagc

SEQ ID NO: 6503555 - DNA, 24 bp, Homo sapiens
tgtccagagggactggacagccag

SEQ ID NO: 6503556 - DNA, 17 bp, Homo sapiens
tgtccagagtgagcaag

SEQ ID NO: 6503557 - DNA, 21 bp, Homo sapiens
tgtccagattattggctgctt

SEQ ID NO: 6503558 - DNA, 23 bp, Homo sapiens
tgtccagattattggctgctttg

SEQ ID NO: 6503559 - DNA, 21 bp, Homo sapiens
tgtccagattgggagaagtgg

SEQ ID NO: 6503560 - DNA, 12 bp, Homo sapiens
tgtccagcacct

SEQ ID NO: 6503561 - DNA, 19 bp, Homo sapiens
tgtccagcaccttgtgcct

SEQ ID NO: 6503562 - DNA, 13 bp, Homo sapiens
tgtccagcagctg

SEQ ID NO: 6503563 - DNA, 22 bp, Homo sapiens
tgtccagcagctgcgggtctga

SEQ ID NO: 6503564 - DNA, 15 bp, Homo sapiens
tgtccagcagtcact

SEQ ID NO: 6503565 - DNA, 20 bp, Homo sapiens
tgtccagcatggatgaaacc

SEQ ID NO: 6503566 - DNA, 17 bp, Homo sapiens
tgtccagcattgctgga

SEQ ID NO: 6503567 - DNA, 22 bp, Homo sapiens
tgtccagccacccccaggcatc

SEQ ID NO: 6503568 - DNA, 17 bp, Homo sapiens
tgtccagcccccagtgc

SEQ ID NO: 6503569 - DNA, 20 bp, Homo sapiens
tgtccagccgtgtgtgcatg

SEQ ID NO: 6503570 - DNA, 21 bp, Homo sapiens
tgtccagccgtgtgtgcatgt

SEQ ID NO: 6503571 - DNA, 22 bp, Homo sapiens
tgtccagcctgggcagccaggc

SEQ ID NO: 6503572 - DNA, 12 bp, Homo sapiens
tgtccagcctta

SEQ ID NO: 6503573 - DNA, 23 bp, Homo sapiens
tgtccagctccaacctgcaaaga

SEQ ID NO: 6503574 - DNA, 15 bp, Homo sapiens
tgtccagctggttgt

SEQ ID NO: 6503575 - DNA, 16 bp, Homo sapiens
tgtccagcttccaaag

SEQ ID NO: 6503576 - DNA, 16 bp, Homo sapiens
tgtccaggaaagaaac

SEQ ID NO: 6503577 - DNA, 18 bp, Homo sapiens
tgtccaggaactgcctgg

SEQ ID NO: 6503578 - DNA, 14 bp, Homo sapiens
tgtccaggatggag

SEQ ID NO: 6503579 - DNA, 18 bp, Homo sapiens
tgtccaggatggagggtc

SEQ ID NO: 6503580 - DNA, 21 bp, Homo sapiens
tgtccaggcactgctgcccag

SEQ ID NO: 6503581 - DNA, 20 bp, Homo sapiens
tgtccaggcagtagatcatt

SEQ ID NO: 6503582 - DNA, 16 bp, Homo sapiens
tgtccaggccactgtg

SEQ ID NO: 6503583 - DNA, 19 bp, Homo sapiens
tgtccaggccactgtggcc

SEQ ID NO: 6503584 - DNA, 20 bp, Homo sapiens
tgtccaggccactgtggcca

SEQ ID NO: 6503585 - DNA, 14 bp, Homo sapiens
tgtccaggctctgg

SEQ ID NO: 6503586 - DNA, 15 bp, Homo sapiens
tgtccaggctctggg

SEQ ID NO: 6503587 - DNA, 20 bp, Homo sapiens
tgtccaggctctgggcacag

SEQ ID NO: 6503588 - DNA, 22 bp, Homo sapiens
tgtccaggctctgggcacagtg

SEQ ID NO: 6503589 - DNA, 20 bp, Homo sapiens
tgtccaggctggtctgaaac

SEQ ID NO: 6503590 - DNA, 13 bp, Homo sapiens
tgtccagggccct

SEQ ID NO: 6503591 - DNA, 22 bp, Homo sapiens
tgtccaggtagaaaagaaatgg

SEQ ID NO: 6503592 - DNA, 23 bp, Homo sapiens
tgtccaggtctagaaggccaggc

SEQ ID NO: 6503593 - DNA, 20 bp, Homo sapiens
tgtccaggtctcactgcttt

SEQ ID NO: 6503594 - DNA, 19 bp, Homo sapiens
tgtccagtaagatcactgt

SEQ ID NO: 6503595 - DNA, 20 bp, Homo sapiens
tgtccagtaagatcactgtt

SEQ ID NO: 6503596 - DNA, 13 bp, Homo sapiens
tgtccagtgccca

SEQ ID NO: 6503597 - DNA, 18 bp, Homo sapiens
tgtccagtgcccattcct

SEQ ID NO: 6503598 - DNA, 19 bp, Homo sapiens
tgtccagtggagggctcat

SEQ ID NO: 6503599 - DNA, 13 bp, Homo sapiens
tgtccagttataa

SEQ ID NO: 6503600 - DNA, 13 bp, Homo sapiens
tgtccagtttcca

SEQ ID NO: 6503601 - DNA, 14 bp, Homo sapiens
tgtccagtttccaa

SEQ ID NO: 6503602 - DNA, 20 bp, Homo sapiens
tgtccagttttggaggctga

SEQ ID NO: 6503603 - DNA, 13 bp, Homo sapiens
tgtccataaagta

SEQ ID NO: 6503604 - DNA, 23 bp, Homo sapiens
tgtccataaagtaattttgtgaa

SEQ ID NO: 6503605 - DNA, 16 bp, Homo sapiens
tgtccataagagaaat

SEQ ID NO: 6503606 - DNA, 13 bp, Homo sapiens
tgtccatacactt

SEQ ID NO: 6503607 - DNA, 13 bp, Homo sapiens
tgtccatccccag

SEQ ID NO: 6503608 - DNA, 14 bp, Homo sapiens
tgtccatccccagt

SEQ ID NO: 6503609 - DNA, 20 bp, Homo sapiens
tgtccatcccttttcctgtc

SEQ ID NO: 6503610 - DNA, 17 bp, Homo sapiens
tgtccatccgtctctgt

SEQ ID NO: 6503611 - DNA, 19 bp, Homo sapiens
tgtccatccgtctctgtcc

SEQ ID NO: 6503612 - DNA, 14 bp, Homo sapiens
tgtccatcctcctc

SEQ ID NO: 6503613 - DNA, 20 bp, Homo sapiens
tgtccatcctcctctccatg

SEQ ID NO: 6503614 - DNA, 22 bp, Homo sapiens
tgtccatcctcctctccatgca

SEQ ID NO: 6503615 - DNA, 17 bp, Homo sapiens
tgtccatcctgacctgc

SEQ ID NO: 6503616 - DNA, 13 bp, Homo sapiens
tgtccatctgacc

SEQ ID NO: 6503617 - DNA, 23 bp, Homo sapiens
tgtccatctgcccgcctgcccac

SEQ ID NO: 6503618 - DNA, 19 bp, Homo sapiens
tgtccatctgtctgtccta

SEQ ID NO: 6503619 - DNA, 13 bp, Homo sapiens
tgtccatcttgtt

SEQ ID NO: 6503620 - DNA, 20 bp, Homo sapiens
tgtccatcttgtttcatttg

SEQ ID NO: 6503621 - DNA, 21 bp, Homo sapiens
tgtccatgcctacagataatt

SEQ ID NO: 6503622 - DNA, 15 bp, Homo sapiens
tgtccatgcttctca

SEQ ID NO: 6503623 - DNA, 20 bp, Homo sapiens
tgtccatgtggttcttcaaa

SEQ ID NO: 6503624 - DNA, 16 bp, Homo sapiens
tgtccatgtgtgtgca

SEQ ID NO: 6503625 - DNA, 18 bp, Homo sapiens
tgtccattatctgctgtt

SEQ ID NO: 6503626 - DNA, 21 bp, Homo sapiens
tgtccattatctgctgttcct

SEQ ID NO: 6503627 - DNA, 20 bp, Homo sapiens
tgcatacattcttcaagatc

SEQ ID NO: 6503628 - DNA, 12 bp, Homo sapiens
tgcataccaacc

SEQ ID NO: 6503629 - DNA, 14 bp, Homo sapiens
tgcataccactttt

SEQ ID NO: 6503630 - DNA, 20 bp, Homo sapiens
tgcataccacttttgttctt

SEQ ID NO: 6503631 - DNA, 21 bp, Homo sapiens
tgcataccacttttgttcttg

SEQ ID NO: 6503632 - DNA, 20 bp, Homo sapiens
tgcatacgcattaagggcct

SEQ ID NO: 6503633 - DNA, 18 bp, Homo sapiens
tgcatacgtaaaaatgga

SEQ ID NO: 6503634 - DNA, 16 bp, Homo sapiens
tgcatacgtacattcc

SEQ ID NO: 6503635 - DNA, 15 bp, Homo sapiens
tgcatactattaaac

SEQ ID NO: 6503636 - DNA, 18 bp, Homo sapiens
tgcatactattaaacatg

SEQ ID NO: 6503637 - DNA, 14 bp, Homo sapiens
tgcatactggactc

SEQ ID NO: 6503638 - DNA, 19 bp, Homo sapiens
tgcatactgttgatacaaa

SEQ ID NO: 6503639 - DNA, 14 bp, Homo sapiens
tgcatacttcaaaa

SEQ ID NO: 6503640 - DNA, 17 bp, Homo sapiens
tgcatacttcaaaagta

SEQ ID NO: 6503641 - DNA, 18 bp, Homo sapiens
tgcatacttcaaaagtat

SEQ ID NO: 6503642 - DNA, 19 bp, Homo sapiens
tgcatacttcaaaagtatt

SEQ ID NO: 6503643 - DNA, 13 bp, Homo sapiens
tgcatactttatt

SEQ ID NO: 6503644 - DNA, 21 bp, Homo sapiens
tgcatactttgacaaggaaaa

SEQ ID NO: 6503645 - DNA, 22 bp, Homo sapiens
tgcatactttgtattttgatta

SEQ ID NO: 6503646 - DNA, 18 bp, Homo sapiens
tgcatactttttaaatgt

SEQ ID NO: 6503647 - DNA, 13 bp, Homo sapiens
tgcatagaataat

SEQ ID NO: 6503648 - DNA, 13 bp, Homo sapiens
tgcatagaattct

SEQ ID NO: 6503649 - DNA, 19 bp, Homo sapiens
tgcatagaattctagcttt

SEQ ID NO: 6503650 - DNA, 14 bp, Homo sapiens
tgcatagacaaagg

SEQ ID NO: 6503651 - DNA, 19 bp, Homo sapiens
tgcatagacaaaggcctta

SEQ ID NO: 6503652 - DNA, 13 bp, Homo sapiens
tgcatagacaagt

SEQ ID NO: 6503653 - DNA, 17 bp, Homo sapiens
tgcatagacaagtgttt

SEQ ID NO: 6503654 - DNA, 17 bp, Homo sapiens
tgcatagagccacgtat

SEQ ID NO: 6503655 - DNA, 19 bp, Homo sapiens
tgcatagagccctggccag

SEQ ID NO: 6503656 - DNA, 20 bp, Homo sapiens
tgcatagagccctggccagc

SEQ ID NO: 6503657 - DNA, 20 bp, Homo sapiens
tgcatagattccctgagcag

SEQ ID NO: 6503658 - DNA, 16 bp, Homo sapiens
tgcatagcagctgcta

SEQ ID NO: 6503659 - DNA, 21 bp, Homo sapiens
tgcatagcagctgctactagc

SEQ ID NO: 6503660 - DNA, 17 bp, Homo sapiens
tgcatagcgaaataaaa

SEQ ID NO: 6503661 - DNA, 19 bp, Homo sapiens
tgcatagcgtcctgccctg

SEQ ID NO: 6503662 - DNA, 21 bp, Homo sapiens
tgcatagcgtcctgccctgcc

SEQ ID NO: 6503663 - DNA, 17 bp, Homo sapiens
tgcatagctctccttcc

SEQ ID NO: 6503664 - DNA, 14 bp, Homo sapiens
tgcataggattcca

SEQ ID NO: 6503665 - DNA, 18 bp, Homo sapiens
tgcataggcaaagaagga

SEQ ID NO: 6503666 - DNA, 13 bp, Homo sapiens
tgcataggctcct

SEQ ID NO: 6503667 - DNA, 16 bp, Homo sapiens
tgcataggtctggaag

SEQ ID NO: 6503668 - DNA, 21 bp, Homo sapiens
tgcatagtaccaatcatttta

SEQ ID NO: 6503669 - DNA, 21 bp, Homo sapiens
tgcatagtattccattgtgtg

SEQ ID NO: 6503670 - DNA, 13 bp, Homo sapiens
tgcatagtgctgg

SEQ ID NO: 6503671 - DNA, 13 bp, Homo sapiens
tgcatagtttctt

SEQ ID NO: 6503672 - DNA, 18 bp, Homo sapiens
tgcatataaaggttatga

SEQ ID NO: 6503673 - DNA, 20 bp, Homo sapiens
tgcatataaaggttatgaaa

SEQ ID NO: 6503674 - DNA, 15 bp, Homo sapiens
tgcatataaatatat

SEQ ID NO: 6503675 - DNA, 19 bp, Homo sapiens
tgcatataaatatatttaa

SEQ ID NO: 6503676 - DNA, 14 bp, Homo sapiens
tgcatataacttat

SEQ ID NO: 6503677 - DNA, 16 bp, Homo sapiens
tgcatataacttatat

SEQ ID NO: 6503678 - DNA, 21 bp, Homo sapiens
tgcatataagggaagtagtta

SEQ ID NO: 6503679 - DNA, 22 bp, Homo sapiens
tgcatataagggaagtagttat

SEQ ID NO: 6503680 - DNA, 16 bp, Homo sapiens
tgcatatagaaaacaa

SEQ ID NO: 6503681 - DNA, 14 bp, Homo sapiens
tgcatatagacaca

SEQ ID NO: 6503682 - DNA, 18 bp, Homo sapiens
tgcatatagacacacata

SEQ ID NO: 6503683 - DNA, 19 bp, Homo sapiens
tgcatatagacacacatac

SEQ ID NO: 6503684 - DNA, 17 bp, Homo sapiens
tgcatatagatttagtt

SEQ ID NO: 6503685 - DNA, 14 bp, Homo sapiens
tgcatatagttaaa

SEQ ID NO: 6503686 - DNA, 15 bp, Homo sapiens
tgcatatagttaaac

SEQ ID NO: 6503687 - DNA, 13 bp, Homo sapiens
tgcatatatatat

SEQ ID NO: 6503688 - DNA, 16 bp, Homo sapiens
tgcatatatgttcttc

SEQ ID NO: 6503689 - DNA, 20 bp, Homo sapiens
tgcatatatgttcttcataa

SEQ ID NO: 6503690 - DNA, 15 bp, Homo sapiens
tgcatatcacccttc

SEQ ID NO: 6503691 - DNA, 18 bp, Homo sapiens
tgcatatcagtcatgact

SEQ ID NO: 6503692 - DNA, 18 bp, Homo sapiens
tgcatatcctgagccatc

SEQ ID NO: 6503693 - DNA, 20 bp, Homo sapiens
tgcatatctctagtccctgt

SEQ ID NO: 6503694 - DNA, 22 bp, Homo sapiens
tgcatatctctagtccctgtgt

SEQ ID NO: 6503695 - DNA, 13 bp, Homo sapiens
tgcatatctgcct

SEQ ID NO: 6503696 - DNA, 17 bp, Homo sapiens
tgcatatctgcctcccc

SEQ ID NO: 6503697 - DNA, 14 bp, Homo sapiens
tgcatatcttcatc

SEQ ID NO: 6503698 - DNA, 15 bp, Homo sapiens
tgcatatgacagaat

SEQ ID NO: 6503699 - DNA, 14 bp, Homo sapiens
tgcatatgagcctg

SEQ ID NO: 6503700 - DNA, 17 bp, Homo sapiens
tgcatatgctacacata

SEQ ID NO: 6503701 - DNA, 23 bp, Homo sapiens
tgcatatgctacacatatgtgct

SEQ ID NO: 6503702 - DNA, 13 bp, Homo sapiens
tgcatatgcttct

SEQ ID NO: 6503703 - DNA, 22 bp, Homo sapiens
tgcatatggcaacgttcatgtt

SEQ ID NO: 6503704 - DNA, 16 bp, Homo sapiens
tgcatatgtagataca

SEQ ID NO: 6503705 - DNA, 15 bp, Homo sapiens
tgcatatgtatgact

SEQ ID NO: 6503706 - DNA, 21 bp, Homo sapiens
tgcatatgtcactagaatgga

SEQ ID NO: 6503707 - DNA, 14 bp, Homo sapiens
tgcatatgtgtgtg

SEQ ID NO: 6503708 - DNA, 17 bp, Homo sapiens
tgcatatgttaaagctt

SEQ ID NO: 6503709 - DNA, 16 bp, Homo sapiens
tgcatatgttacaatt

SEQ ID NO: 6503710 - DNA, 17 bp, Homo sapiens
tgcatatgttgaatact

SEQ ID NO: 6503711 - DNA, 21 bp, Homo sapiens
tgcatatgttttccacataaa

SEQ ID NO: 6503712 - DNA, 20 bp, Homo sapiens
tgcatattataaaggataaa

SEQ ID NO: 6503713 - DNA, 22 bp, Homo sapiens
tgcatattcctttctatcattt

SEQ ID NO: 6503714 - DNA, 22 bp, Homo sapiens
tgcatattctattgtattattt

SEQ ID NO: 6503715 - DNA, 23 bp, Homo sapiens
tgcatattcttatgtatgtgaaa

SEQ ID NO: 6503716 - DNA, 15 bp, Homo sapiens
tgcatattgcatact

SEQ ID NO: 6503717 - DNA, 23 bp, Homo sapiens
tgcatattgcatactattaaaca

SEQ ID NO: 6503718 - DNA, 19 bp, Homo sapiens
tgcatattgtacacttttt

SEQ ID NO: 6503719 - DNA, 16 bp, Homo sapiens
tgcatatttataagag

SEQ ID NO: 6503720 - DNA, 17 bp, Homo sapiens
tgcatatttataagaga

SEQ ID NO: 6503721 - DNA, 18 bp, Homo sapiens
tgcatatttataagagaa

SEQ ID NO: 6503722 - DNA, 22 bp, Homo sapiens
tgcatatttatccaaaatgtgt

SEQ ID NO: 6503723 - DNA, 22 bp, Homo sapiens
tgcatatttattgcattgctgg

SEQ ID NO: 6503724 - DNA, 13 bp, Homo sapiens
tgcatatttgcca

SEQ ID NO: 6503725 - DNA, 16 bp, Homo sapiens
tgcatatttgttactt

SEQ ID NO: 6503726 - DNA, 19 bp, Homo sapiens
tgcatattttgagaaactg

SEQ ID NO: 6503727 - DNA, 18 bp, Homo sapiens
tgcatcaagaactattgt

SEQ ID NO: 6503728 - DNA, 22 bp, Homo sapiens
tgcatcaagacttcaatcctga

SEQ ID NO: 6503729 - DNA, 14 bp, Homo sapiens
tgcatcaatcctgt

SEQ ID NO: 6503730 - DNA, 20 bp, Homo sapiens
tgcatcaatcctgtgtggtt

SEQ ID NO: 6503731 - DNA, 22 bp, Homo sapiens
tgcatcaatttttcttatttca

SEQ ID NO: 6503732 - DNA, 13 bp, Homo sapiens
tgcatcacactca

SEQ ID NO: 6503733 - DNA, 18 bp, Homo sapiens
tgcatcacactcaaggac

SEQ ID NO: 6503734 - DNA, 22 bp, Homo sapiens
tgcatcacactcaaggacagga

SEQ ID NO: 6503735 - DNA, 15 bp, Homo sapiens
tgcatcacatctgca

SEQ ID NO: 6503736 - DNA, 17 bp, Homo sapiens
tgcatcacatctgcaca

SEQ ID NO: 6503737 - DNA, 18 bp, Homo sapiens
tgcatcacatctgcacac

SEQ ID NO: 6503738 - DNA, 20 bp, Homo sapiens
tgcatcacatgatgaaaaat

SEQ ID NO: 6503739 - DNA, 13 bp, Homo sapiens
tgcatcacccagg

SEQ ID NO: 6503740 - DNA, 21 bp, Homo sapiens
tgcatcacccgcccctggact

SEQ ID NO: 6503741 - DNA, 14 bp, Homo sapiens
tgcatcactgggtg

SEQ ID NO: 6503742 - DNA, 20 bp, Homo sapiens
tgcatcactggtatacacac

SEQ ID NO: 6503743 - DNA, 21 bp, Homo sapiens
tgcatcactgtatcattttct

SEQ ID NO: 6503744 - DNA, 22 bp, Homo sapiens
tgcatcacttggggtcaccacc

SEQ ID NO: 6503745 - DNA, 17 bp, Homo sapiens
tgcatcagaaagggagg

SEQ ID NO: 6503746 - DNA, 20 bp, Homo sapiens
tgcatcagaaagggagggct

SEQ ID NO: 6503747 - DNA, 23 bp, Homo sapiens
tgcatcagaaatgtctggagaat

SEQ ID NO: 6503748 - DNA, 16 bp, Homo sapiens
tgcatcagcctctggc

SEQ ID NO: 6503749 - DNA, 19 bp, Homo sapiens
tgcatcagctgctgaaaca

SEQ ID NO: 6503750 - DNA, 14 bp, Homo sapiens
tgcatcaggaaaca

SEQ ID NO: 6503751 - DNA, 20 bp, Homo sapiens
tgcatcagtattaatactaa

SEQ ID NO: 6503752 - DNA, 13 bp, Homo sapiens
tgcatcagtgact

SEQ ID NO: 6503753 - DNA, 12 bp, Homo sapiens
tgcatcagttca

SEQ ID NO: 6503754 - DNA, 17 bp, Homo sapiens
tgcatcagttcactgct

SEQ ID NO: 6503755 - DNA, 21 bp, Homo sapiens
tgcatcatagaacagaaatat

SEQ ID NO: 6503756 - DNA, 17 bp, Homo sapiens
tgcatcatagtttgctt

SEQ ID NO: 6503757 - DNA, 20 bp, Homo sapiens
tgcatcatatatttaacaat

SEQ ID NO: 6503758 - DNA, 17 bp, Homo sapiens
tgcatcatctcttcctc

SEQ ID NO: 6503759 - DNA, 19 bp, Homo sapiens
tgcatcatcttgaacatta

SEQ ID NO: 6503760 - DNA, 17 bp, Homo sapiens
tgcatcatgtctctttg

SEQ ID NO: 6503761 - DNA, 19 bp, Homo sapiens
tgcatcattactgttccag

SEQ ID NO: 6503762 - DNA, 18 bp, Homo sapiens
tgcatccaaaggtgctca

SEQ ID NO: 6503763 - DNA, 16 bp, Homo sapiens
tgcatccaactccagg

SEQ ID NO: 6503764 - DNA, 19 bp, Homo sapiens
tgcatccaggcctgaggct

SEQ ID NO: 6503765 - DNA, 14 bp, Homo sapiens
tgcatccattcctc

SEQ ID NO: 6503766 - DNA, 19 bp, Homo sapiens
tgcatccattctcctgagg

SEQ ID NO: 6503767 - DNA, 20 bp, Homo sapiens
tgcatccattgttgtgtctg

SEQ ID NO: 6503768 - DNA, 19 bp, Homo sapiens
tgcatccatttactgacac

SEQ ID NO: 6503769 - DNA, 20 bp, Homo sapiens
tgcatccatttactgacact

SEQ ID NO: 6503770 - DNA, 23 bp, Homo sapiens
tgcatcccaaaccacgcctcttg

SEQ ID NO: 6503771 - DNA, 19 bp, Homo sapiens
tgcatcccaccagcctgag

SEQ ID NO: 6503772 - DNA, 18 bp, Homo sapiens
tgcatcccccagcactga

SEQ ID NO: 6503773 - DNA, 15 bp, Homo sapiens
tgcatcccccccacc

SEQ ID NO: 6503774 - DNA, 16 bp, Homo sapiens
tgcatccccttccagc

SEQ ID NO: 6503775 - DNA, 24 bp, Homo sapiens
tgcatcccgtacctcttcccatga

SEQ ID NO: 6503776 - DNA, 14 bp, Homo sapiens
tgcatccctggctg

SEQ ID NO: 6503777 - DNA, 17 bp, Homo sapiens
tgcatccctgtgtccac

SEQ ID NO: 6503778 - DNA, 17 bp, Homo sapiens
tgcatcccttggcccct

SEQ ID NO: 6503779 - DNA, 18 bp, Homo sapiens
tgcatcccttggcccctc

SEQ ID NO: 6503780 - DNA, 19 bp, Homo sapiens
tgcatccgggggcagctct

SEQ ID NO: 6503781 - DNA, 23 bp, Homo sapiens
tgcatccgtgagcagtgtgtctc

SEQ ID NO: 6503782 - DNA, 13 bp, Homo sapiens
tgcatcctcagcc

SEQ ID NO: 6503783 - DNA, 15 bp, Homo sapiens
tgcatcctcagcccc

SEQ ID NO: 6503784 - DNA, 19 bp, Homo sapiens
tgcatcctcagccccaggg

SEQ ID NO: 6503785 - DNA, 20 bp, Homo sapiens
tgcatcctcagccccagggc

SEQ ID NO: 6503786 - DNA, 22 bp, Homo sapiens
tgcatcctccaagaatctatct

SEQ ID NO: 6503787 - DNA, 18 bp, Homo sapiens
tgcatcctccgcctcccg

SEQ ID NO: 6503788 - DNA, 12 bp, Homo sapiens
tgcatcctcctc

SEQ ID NO: 6503789 - DNA, 17 bp, Homo sapiens
tgcatcctcctcagccc

SEQ ID NO: 6503790 - DNA, 18 bp, Homo sapiens
tgcatcctctcccccaca

SEQ ID NO: 6503791 - DNA, 14 bp, Homo sapiens
tgcatcctgaggcc

SEQ ID NO: 6503792 - DNA, 22 bp, Homo sapiens
tgcatcctgaggccagtggccc

SEQ ID NO: 6503793 - DNA, 12 bp, Homo sapiens
tgcatcctgtga

SEQ ID NO: 6503794 - DNA, 20 bp, Homo sapiens
tgcatccttaacctttatta

SEQ ID NO: 6503795 - DNA, 16 bp, Homo sapiens
tgcatccttcctgggg

SEQ ID NO: 6503796 - DNA, 15 bp, Homo sapiens
tgcatccttgtaata

SEQ ID NO: 6503797 - DNA, 19 bp, Homo sapiens
tgcatccttgtaatacctg

SEQ ID NO: 6503798 - DNA, 14 bp, Homo sapiens
tgcatcgctgttct

SEQ ID NO: 6503799 - DNA, 15 bp, Homo sapiens
tgcatcgggaaagaa

SEQ ID NO: 6503800 - DNA, 18 bp, Homo sapiens
tgcatcgggaaagaagaa

SEQ ID NO: 6503801 - DNA, 18 bp, Homo sapiens
tgcatcgtcccctccccc

SEQ ID NO: 6503802 - DNA, 18 bp, Homo sapiens
tgcatcgttttctttgct

SEQ ID NO: 6503803 - DNA, 12 bp, Homo sapiens
tgcatctaagcc

SEQ ID NO: 6503804 - DNA, 16 bp, Homo sapiens
tgcatctaagcccatg

SEQ ID NO: 6503805 - DNA, 17 bp, Homo sapiens
tgtccattcatctcatg

SEQ ID NO: 6503806 - DNA, 21 bp, Homo sapiens
tgtccattcatctcatgctct

SEQ ID NO: 6503807 - DNA, 16 bp, Homo sapiens
tgtccattccaataca

SEQ ID NO: 6503808 - DNA, 22 bp, Homo sapiens
tgtccattgacatgtacagaga

SEQ ID NO: 6503809 - DNA, 23 bp, Homo sapiens
tgtccattgcgttattttctttt

SEQ ID NO: 6503810 - DNA, 14 bp, Homo sapiens
tgtccattgtaaat

SEQ ID NO: 6503811 - DNA, 20 bp, Homo sapiens
tgtccattgtaaatctgaag

SEQ ID NO: 6503812 - DNA, 21 bp, Homo sapiens
tgtccattgtaaatctgaaga

SEQ ID NO: 6503813 - DNA, 22 bp, Homo sapiens
tgtccattgtaaatctgaagaa

SEQ ID NO: 6503814 - DNA, 19 bp, Homo sapiens
tgtccatttacctggaaac

SEQ ID NO: 6503815 - DNA, 20 bp, Homo sapiens
tgtccatttatccacaggaa

SEQ ID NO: 6503816 - DNA, 13 bp, Homo sapiens
tgtccattttgca

SEQ ID NO: 6503817 - DNA, 20 bp, Homo sapiens
tgtccattttgcaaacccaa

SEQ ID NO: 6503818 - DNA, 18 bp, Homo sapiens
tgtccattttgtgaagcc

SEQ ID NO: 6503819 - DNA, 22 bp, Homo sapiens
tgtcccaaaacaaaataggtga

SEQ ID NO: 6503820 - DNA, 21 bp, Homo sapiens
tgtcccaaaatcccctcagcc

SEQ ID NO: 6503821 - DNA, 22 bp, Homo sapiens
tgtcccaaaatcccctcagcct

SEQ ID NO: 6503822 - DNA, 20 bp, Homo sapiens
tgtcccaagagccataaggg

SEQ ID NO: 6503823 - DNA, 23 bp, Homo sapiens
tgtcccaagctcccaagagcttc

SEQ ID NO: 6503824 - DNA, 20 bp, Homo sapiens
tgtcccaagtctgacagcca

SEQ ID NO: 6503825 - DNA, 15 bp, Homo sapiens
tgtcccaagtgccaa

SEQ ID NO: 6503826 - DNA, 23 bp, Homo sapiens
tgtcccaatcttaccagatgcta

SEQ ID NO: 6503827 - DNA, 19 bp, Homo sapiens
tgtcccaattctgcccgct

SEQ ID NO: 6503828 - DNA, 20 bp, Homo sapiens
tgtcccacaatattacctta

SEQ ID NO: 6503829 - DNA, 20 bp, Homo sapiens
tgtcccacagcttggggcca

SEQ ID NO: 6503830 - DNA, 13 bp, Homo sapiens
tgtcccacaggga

SEQ ID NO: 6503831 - DNA, 16 bp, Homo sapiens
tgtcccacagggacca

SEQ ID NO: 6503832 - DNA, 17 bp, Homo sapiens
tgtcccacagggaccac

SEQ ID NO: 6503833 - DNA, 22 bp, Homo sapiens
tgtcccacagggaccacatcca

SEQ ID NO: 6503834 - DNA, 17 bp, Homo sapiens
tgtcccacatggccatc

SEQ ID NO: 6503835 - DNA, 12 bp, Homo sapiens
tgtcccacccac

SEQ ID NO: 6503836 - DNA, 18 bp, Homo sapiens
tgtcccacccacacagct

SEQ ID NO: 6503837 - DNA, 17 bp, Homo sapiens
tgtcccacccccacccc

SEQ ID NO: 6503838 - DNA, 22 bp, Homo sapiens
tgtcccacccccacccccagct

SEQ ID NO: 6503839 - DNA, 19 bp, Homo sapiens
tgtcccacccccagcagct

SEQ ID NO: 6503840 - DNA, 16 bp, Homo sapiens
tgtcccacccctagcc

SEQ ID NO: 6503841 - DNA, 22 bp, Homo sapiens
tgtcccacccctagccaccagt

SEQ ID NO: 6503842 - DNA, 16 bp, Homo sapiens
tgtcccaccgggagcc

SEQ ID NO: 6503843 - DNA, 12 bp, Homo sapiens
tgtcccacctct

SEQ ID NO: 6503844 - DNA, 13 bp, Homo sapiens
tgtcccacctctt

SEQ ID NO: 6503845 - DNA, 21 bp, Homo sapiens
tgtcccacctcttctcttcct

SEQ ID NO: 6503846 - DNA, 17 bp, Homo sapiens
tgtcccacctggctccc

SEQ ID NO: 6503847 - DNA, 16 bp, Homo sapiens
tgtcccaccttgacca

SEQ ID NO: 6503848 - DNA, 18 bp, Homo sapiens
tgtcccactacatctggg

SEQ ID NO: 6503849 - DNA, 16 bp, Homo sapiens
tgtcccactggctcct

SEQ ID NO: 6503850 - DNA, 19 bp, Homo sapiens
tgtcccacttctcatctta

SEQ ID NO: 6503851 - DNA, 16 bp, Homo sapiens
tgtcccagaagatgac

SEQ ID NO: 6503852 - DNA, 23 bp, Homo sapiens
tgtcccagagcttattggccact

SEQ ID NO: 6503853 - DNA, 18 bp, Homo sapiens
tgtcccagatcgtctcca

SEQ ID NO: 6503854 - DNA, 21 bp, Homo sapiens
tgtcccagatgggccacggct

SEQ ID NO: 6503855 - DNA, 18 bp, Homo sapiens
tgtcccagcacctggcac

SEQ ID NO: 6503856 - DNA, 19 bp, Homo sapiens
tgtcccagcagaagaggga

SEQ ID NO: 6503857 - DNA, 21 bp, Homo sapiens
tgtcccagccacgcagggcca

SEQ ID NO: 6503858 - DNA, 13 bp, Homo sapiens
tgtcccagcccct

SEQ ID NO: 6503859 - DNA, 14 bp, Homo sapiens
tgtcccagcccctg

SEQ ID NO: 6503860 - DNA, 16 bp, Homo sapiens
tgtcccagcctggcct

SEQ ID NO: 6503861 - DNA, 21 bp, Homo sapiens
tgtcccagctaccaagtcaga

SEQ ID NO: 6503862 - DNA, 11 bp, Homo sapiens
tgtcccaggca

SEQ ID NO: 6503863 - DNA, 12 bp, Homo sapiens
tgtcccaggcag

SEQ ID NO: 6503864 - DNA, 22 bp, Homo sapiens
tgtcccaggcatgcagctgcct

SEQ ID NO: 6503865 - DNA, 17 bp, Homo sapiens
tgtcccaggccggccca

SEQ ID NO: 6503866 - DNA, 13 bp, Homo sapiens
tgtcccagggccc

SEQ ID NO: 6503867 - DNA, 19 bp, Homo sapiens
tgtcccagggccctcccag

SEQ ID NO: 6503868 - DNA, 23 bp, Homo sapiens
tgtcccagtagccaaggcccggg

SEQ ID NO: 6503869 - DNA, 17 bp, Homo sapiens
tgtcccagtcagaaata

SEQ ID NO: 6503870 - DNA, 11 bp, Homo sapiens
tgtcccagtcc

SEQ ID NO: 6503871 - DNA, 16 bp, Homo sapiens
tgtcccagtcccagcc

SEQ ID NO: 6503872 - DNA, 23 bp, Homo sapiens
tgtcccagtcccagcctctgggg

SEQ ID NO: 6503873 - DNA, 13 bp, Homo sapiens
tgtcccagtgaac

SEQ ID NO: 6503874 - DNA, 11 bp, Homo sapiens
tgtcccagtgt

SEQ ID NO: 6503875 - DNA, 12 bp, Homo sapiens
tgtcccagtgtc

SEQ ID NO: 6503876 - DNA, 18 bp, Homo sapiens
tgtcccatagtccctgcc

SEQ ID NO: 6503877 - DNA, 14 bp, Homo sapiens
tgtcccatgaccca

SEQ ID NO: 6503878 - DNA, 17 bp, Homo sapiens
tgtcccatgacccaccc

SEQ ID NO: 6503879 - DNA, 23 bp, Homo sapiens
tgtcccatgaccttgacgtgtgt

SEQ ID NO: 6503880 - DNA, 17 bp, Homo sapiens
tgtcccatgatccctgt

SEQ ID NO: 6503881 - DNA, 20 bp, Homo sapiens
tgtcccatgtgagctgctgc

SEQ ID NO: 6503882 - DNA, 16 bp, Homo sapiens
tgtcccattctagatc

SEQ ID NO: 6503883 - DNA, 16 bp, Homo sapiens
tgtcccatttattatt

SEQ ID NO: 6503884 - DNA, 19 bp, Homo sapiens
tgtcccatttattatttta

SEQ ID NO: 6503885 - DNA, 20 bp, Homo sapiens
tgtcccatttattattttaa

SEQ ID NO: 6503886 - DNA, 13 bp, Homo sapiens
tgtcccatttcct

SEQ ID NO: 6503887 - DNA, 20 bp, Homo sapiens
tgtcccattttccccttcct

SEQ ID NO: 6503888 - DNA, 18 bp, Homo sapiens
tgtccccaaacaggacag

SEQ ID NO: 6503889 - DNA, 21 bp, Homo sapiens
tgtccccaaagtaccacactg

SEQ ID NO: 6503890 - DNA, 14 bp, Homo sapiens
tgtccccaaatccg

SEQ ID NO: 6503891 - DNA, 13 bp, Homo sapiens
tgtccccaacagc

SEQ ID NO: 6503892 - DNA, 20 bp, Homo sapiens
tgtccccaacagcgcccaaa

SEQ ID NO: 6503893 - DNA, 14 bp, Homo sapiens
tgtccccacacagc

SEQ ID NO: 6503894 - DNA, 17 bp, Homo sapiens
tgtccccacacagcctc

SEQ ID NO: 6503895 - DNA, 17 bp, Homo sapiens
tgtccccaccatctgct

SEQ ID NO: 6503896 - DNA, 17 bp, Homo sapiens
tgtccccacccatgcgc

SEQ ID NO: 6503897 - DNA, 19 bp, Homo sapiens
tgtccccacccatgcgcct

SEQ ID NO: 6503898 - DNA, 20 bp, Homo sapiens
tgtccccacccatgcgcctt

SEQ ID NO: 6503899 - DNA, 19 bp, Homo sapiens
tgtccccaccctccactca

SEQ ID NO: 6503900 - DNA, 12 bp, Homo sapiens
tgtccccactcc

SEQ ID NO: 6503901 - DNA, 13 bp, Homo sapiens
tgtccccactccc

SEQ ID NO: 6503902 - DNA, 14 bp, Homo sapiens
tgtccccactcccg

SEQ ID NO: 6503903 - DNA, 12 bp, Homo sapiens
tgtccccagacc

SEQ ID NO: 6503904 - DNA, 19 bp, Homo sapiens
tgtccccagaccaaccctg

SEQ ID NO: 6503905 - DNA, 22 bp, Homo sapiens
tgtccccagaccaaccctggga

SEQ ID NO: 6503906 - DNA, 13 bp, Homo sapiens
tgtccccagccca

SEQ ID NO: 6503907 - DNA, 18 bp, Homo sapiens
tgtccccagcctacctct

SEQ ID NO: 6503908 - DNA, 15 bp, Homo sapiens
tgtccccaggcccag

SEQ ID NO: 6503909 - DNA, 18 bp, Homo sapiens
tgtccccaggcccagccc

SEQ ID NO: 6503910 - DNA, 19 bp, Homo sapiens
tgtccccaggcccagccct

SEQ ID NO: 6503911 - DNA, 12 bp, Homo sapiens
tgtccccagggc

SEQ ID NO: 6503912 - DNA, 13 bp, Homo sapiens
tgtccccagggcc

SEQ ID NO: 6503913 - DNA, 17 bp, Homo sapiens
tgtccccagggcccctc

SEQ ID NO: 6503914 - DNA, 22 bp, Homo sapiens
tgtccccagttaatgtgccaaa

SEQ ID NO: 6503915 - DNA, 19 bp, Homo sapiens
tgtccccagtttgcagaaa

SEQ ID NO: 6503916 - DNA, 13 bp, Homo sapiens
tgtccccatctgt

SEQ ID NO: 6503917 - DNA, 15 bp, Homo sapiens
tgtccccattctata

SEQ ID NO: 6503918 - DNA, 9 bp, Homo sapiens
tgtccccca

SEQ ID NO: 6503919 - DNA, 15 bp, Homo sapiens
tgtcccccaacttca

SEQ ID NO: 6503920 - DNA, 13 bp, Homo sapiens
tgtcccccaaggt

SEQ ID NO: 6503921 - DNA, 13 bp, Homo sapiens
tgtcccccacacc

SEQ ID NO: 6503922 - DNA, 13 bp, Homo sapiens
tgtcccccacctc

SEQ ID NO: 6503923 - DNA, 14 bp, Homo sapiens
tgtcccccactgct

SEQ ID NO: 6503924 - DNA, 12 bp, Homo sapiens
tgtcccccagca

SEQ ID NO: 6503925 - DNA, 23 bp, Homo sapiens
tgtcccccagcatcgggggcctg

SEQ ID NO: 6503926 - DNA, 13 bp, Homo sapiens
tgtcccccaggct

SEQ ID NO: 6503927 - DNA, 15 bp, Homo sapiens
tgtcccccaggctgg

SEQ ID NO: 6503928 - DNA, 14 bp, Homo sapiens
tgtccccccactcc

SEQ ID NO: 6503929 - DNA, 21 bp, Homo sapiens
tgtccccccaggtgctggagg

SEQ ID NO: 6503930 - DNA, 20 bp, Homo sapiens
tgtccccccctaactttctt

SEQ ID NO: 6503931 - DNA, 22 bp, Homo sapiens
tgtcccccctgtggtctgtgtg

SEQ ID NO: 6503932 - DNA, 13 bp, Homo sapiens
tgtccccccttga

SEQ ID NO: 6503933 - DNA, 17 bp, Homo sapiens
tgtccccccttgaagca

SEQ ID NO: 6503934 - DNA, 20 bp, Homo sapiens
tgtccccctaatattaggga

SEQ ID NO: 6503935 - DNA, 13 bp, Homo sapiens
tgtccccctcacc

SEQ ID NO: 6503936 - DNA, 18 bp, Homo sapiens
tgtccccctcccctccca

SEQ ID NO: 6503937 - DNA, 19 bp, Homo sapiens
tgtccccctcccctcccag

SEQ ID NO: 6503938 - DNA, 18 bp, Homo sapiens
tgtccccctctgtccagg

SEQ ID NO: 6503939 - DNA, 21 bp, Homo sapiens
tgtccccctgagatcagagtc

SEQ ID NO: 6503940 - DNA, 23 bp, Homo sapiens
tgtccccctgagatcagagtcct

SEQ ID NO: 6503941 - DNA, 22 bp, Homo sapiens
tgtccccctttagatctctgaa

SEQ ID NO: 6503942 - DNA, 16 bp, Homo sapiens
tgtccccgacccttgc

SEQ ID NO: 6503943 - DNA, 17 bp, Homo sapiens
tgtccccgcactgggct

SEQ ID NO: 6503944 - DNA, 19 bp, Homo sapiens
tgtccccgcactgggcttg

SEQ ID NO: 6503945 - DNA, 16 bp, Homo sapiens
tgtccccgcagccctg

SEQ ID NO: 6503946 - DNA, 16 bp, Homo sapiens
tgtccccgccttccct

SEQ ID NO: 6503947 - DNA, 22 bp, Homo sapiens
tgtccccgccttccctcactct

SEQ ID NO: 6503948 - DNA, 23 bp, Homo sapiens
tgtccccgccttccctcactctt

SEQ ID NO: 6503949 - DNA, 18 bp, Homo sapiens
tgtccccgctgctgtgca

SEQ ID NO: 6503950 - DNA, 16 bp, Homo sapiens
tgtccccgctggctca

SEQ ID NO: 6503951 - DNA, 16 bp, Homo sapiens
tgtccccggcctcagc

SEQ ID NO: 6503952 - DNA, 16 bp, Homo sapiens
tgtccccggggcccag

SEQ ID NO: 6503953 - DNA, 17 bp, Homo sapiens
tgtcccctatcctcccc

SEQ ID NO: 6503954 - DNA, 21 bp, Homo sapiens
tgtcccctatgccactaagcc

SEQ ID NO: 6503955 - DNA, 14 bp, Homo sapiens
tgtcccctcacaga

SEQ ID NO: 6503956 - DNA, 23 bp, Homo sapiens
tgtcccctcactctgtcagccag

SEQ ID NO: 6503957 - DNA, 13 bp, Homo sapiens
tgtcccctcagcg

SEQ ID NO: 6503958 - DNA, 13 bp, Homo sapiens
tgtcccctcagct

SEQ ID NO: 6503959 - DNA, 18 bp, Homo sapiens
tgtcccctccactgtcac

SEQ ID NO: 6503960 - DNA, 13 bp, Homo sapiens
tgtcccctcccag

SEQ ID NO: 6503961 - DNA, 13 bp, Homo sapiens
tgtcccctctccc

SEQ ID NO: 6503962 - DNA, 15 bp, Homo sapiens
tgtcccctgacaggg

SEQ ID NO: 6503963 - DNA, 13 bp, Homo sapiens
tgtcccctgagtt

SEQ ID NO: 6503964 - DNA, 15 bp, Homo sapiens
tgtcccctgccccag

SEQ ID NO: 6503965 - DNA, 12 bp, Homo sapiens
tgtcccctgctt

SEQ ID NO: 6503966 - DNA, 13 bp, Homo sapiens
tgtcccctggggc

SEQ ID NO: 6503967 - DNA, 20 bp, Homo sapiens
tgtcccctggggctggtgga

SEQ ID NO: 6503968 - DNA, 16 bp, Homo sapiens
tgtccccttcccctgc

SEQ ID NO: 6503969 - DNA, 18 bp, Homo sapiens
tgtccccttcccctgctg

SEQ ID NO: 6503970 - DNA, 16 bp, Homo sapiens
tgtccccttctctcat

SEQ ID NO: 6503971 - DNA, 21 bp, Homo sapiens
tgtccccttggcaggtcctgg

SEQ ID NO: 6503972 - DNA, 15 bp, Homo sapiens
tgtcccgcggtgctg

SEQ ID NO: 6503973 - DNA, 20 bp, Homo sapiens
tgtcccggggtcctgtggca

SEQ ID NO: 6503974 - DNA, 21 bp, Homo sapiens
tgtcccggggtcctgtggcag

SEQ ID NO: 6503975 - DNA, 22 bp, Homo sapiens
tgtccctaatttaacccagctc

SEQ ID NO: 6503976 - DNA, 19 bp, Homo sapiens
tgtccctacacccctcccc

SEQ ID NO: 6503977 - DNA, 16 bp, Homo sapiens
tgtccctagctcacac

SEQ ID NO: 6503978 - DNA, 18 bp, Homo sapiens
tgtccctagggctctcca

SEQ ID NO: 6503979 - DNA, 16 bp, Homo sapiens
tgtccctatacactag

SEQ ID NO: 6503980 - DNA, 22 bp, Homo sapiens
tgtccctatacactagacaaaa

SEQ ID NO: 6503981 - DNA, 21 bp, Homo sapiens
tgtccctatctattaaagtga

SEQ ID NO: 6503982 - DNA, 16 bp, Homo sapiens
tgtccctattctgcca

SEQ ID NO: 6503983 - DNA, 21 bp, Homo sapiens
tgtccctattctgccatggga

SEQ ID NO: 6503984 - DNA, 16 bp, Homo sapiens
tgcatctaatgaaaaa

SEQ ID NO: 6503985 - DNA, 15 bp, Homo sapiens
tgcatctagaaagct

SEQ ID NO: 6503986 - DNA, 21 bp, Homo sapiens
tgcatctagaggcttccttca

SEQ ID NO: 6503987 - DNA, 14 bp, Homo sapiens
tgcatctcaaaatt

SEQ ID NO: 6503988 - DNA, 14 bp, Homo sapiens
tgcatctcagatgc

SEQ ID NO: 6503989 - DNA, 15 bp, Homo sapiens
tgcatctcagatgcc

SEQ ID NO: 6503990 - DNA, 13 bp, Homo sapiens
tgcatctccacct

SEQ ID NO: 6503991 - DNA, 23 bp, Homo sapiens
tgcatctccacttggcattagct

SEQ ID NO: 6503992 - DNA, 19 bp, Homo sapiens
tgcatctcctcccgccctt

SEQ ID NO: 6503993 - DNA, 15 bp, Homo sapiens
tgcatctgaccagca

SEQ ID NO: 6503994 - DNA, 17 bp, Homo sapiens
tgcatctgaccagcagc

SEQ ID NO: 6503995 - DNA, 18 bp, Homo sapiens
tgcatctgaccagcagcg

SEQ ID NO: 6503996 - DNA, 22 bp, Homo sapiens
tgcatctgaccagcagcgcctt

SEQ ID NO: 6503997 - DNA, 13 bp, Homo sapiens
tgcatctgcacat

SEQ ID NO: 6503998 - DNA, 17 bp, Homo sapiens
tgcatctggagagaaca

SEQ ID NO: 6503999 - DNA, 12 bp, Homo sapiens
tgcatctggcac

SEQ ID NO: 6504000 - DNA, 15 bp, Homo sapiens
tgcatctggcctatg

SEQ ID NO: 6504001 - DNA, 23 bp, Homo sapiens
tgcatctgggattcccaccaagg

SEQ ID NO: 6504002 - DNA, 13 bp, Homo sapiens
tgcatctggggcc

SEQ ID NO: 6504003 - DNA, 13 bp, Homo sapiens
tgcatctggtgta

SEQ ID NO: 6504004 - DNA, 20 bp, Homo sapiens
tgcatctggtgtaggaagtt

SEQ ID NO: 6504005 - DNA, 11 bp, Homo sapiens
tgcatctgtat

SEQ ID NO: 6504006 - DNA, 13 bp, Homo sapiens
tgcatctgtcctc

SEQ ID NO: 6504007 - DNA, 18 bp, Homo sapiens
tgcatctgtggcctgggg

SEQ ID NO: 6504008 - DNA, 19 bp, Homo sapiens
tgcatctgtggcctggggc

SEQ ID NO: 6504009 - DNA, 12 bp, Homo sapiens
tgcatcttaaaa

SEQ ID NO: 6504010 - DNA, 15 bp, Homo sapiens
tgcatcttcttgcat

SEQ ID NO: 6504011 - DNA, 18 bp, Homo sapiens
tgcatcttcttgcatcta

SEQ ID NO: 6504012 - DNA, 23 bp, Homo sapiens
tgcatctttcatagttctgttaa

SEQ ID NO: 6504013 - DNA, 12 bp, Homo sapiens
tgcatctttccc

SEQ ID NO: 6504014 - DNA, 14 bp, Homo sapiens
tgcatctttccctg

SEQ ID NO: 6504015 - DNA, 13 bp, Homo sapiens
tgcatctttctct

SEQ ID NO: 6504016 - DNA, 17 bp, Homo sapiens
tgcatctttgatgtgtt

SEQ ID NO: 6504017 - DNA, 23 bp, Homo sapiens
tgcatctttttgaccctcattct

SEQ ID NO: 6504018 - DNA, 18 bp, Homo sapiens
tgcatgaaaagtgcatgg

SEQ ID NO: 6504019 - DNA, 20 bp, Homo sapiens
tgcatgaaaatagctatttt

SEQ ID NO: 6504020 - DNA, 21 bp, Homo sapiens
tgcatgaaactaggcttctgt

SEQ ID NO: 6504021 - DNA, 10 bp, Homo sapiens
tgcatgaaat

SEQ ID NO: 6504022 - DNA, 18 bp, Homo sapiens
tgcatgaaatgaatgtct

SEQ ID NO: 6504023 - DNA, 21 bp, Homo sapiens
tgcatgaagagaagcaatttt

SEQ ID NO: 6504024 - DNA, 22 bp, Homo sapiens
tgcatgaagagaagcaattttg

SEQ ID NO: 6504025 - DNA, 23 bp, Homo sapiens
tgcatgaagagaagcaattttgg

SEQ ID NO: 6504026 - DNA, 14 bp, Homo sapiens
tgcatgaagcaacg

SEQ ID NO: 6504027 - DNA, 22 bp, Homo sapiens
tgcatgaagcaacgataaaatt

SEQ ID NO: 6504028 - DNA, 18 bp, Homo sapiens
tgcatgaaggtctacctg

SEQ ID NO: 6504029 - DNA, 19 bp, Homo sapiens
tgcatgaaggtttctgaaa

SEQ ID NO: 6504030 - DNA, 21 bp, Homo sapiens
tgcatgaaggtttctgaaaat

SEQ ID NO: 6504031 - DNA, 20 bp, Homo sapiens
tgcatgaagtaatatgcaca

SEQ ID NO: 6504032 - DNA, 18 bp, Homo sapiens
tgcatgaatcagatgtgt

SEQ ID NO: 6504033 - DNA, 18 bp, Homo sapiens
tgcatgacacttccaaag

SEQ ID NO: 6504034 - DNA, 15 bp, Homo sapiens
tgcatgacagcctct

SEQ ID NO: 6504035 - DNA, 20 bp, Homo sapiens
tgcatgacctaccaggacag

SEQ ID NO: 6504036 - DNA, 13 bp, Homo sapiens
tgcatgacctatc

SEQ ID NO: 6504037 - DNA, 17 bp, Homo sapiens
tgcatgacgtttaaggc

SEQ ID NO: 6504038 - DNA, 14 bp, Homo sapiens
tgcatgacttccct

SEQ ID NO: 6504039 - DNA, 13 bp, Homo sapiens
tgcatgagcacct

SEQ ID NO: 6504040 - DNA, 22 bp, Homo sapiens
tgcatgagctacgcctgcctcc

SEQ ID NO: 6504041 - DNA, 14 bp, Homo sapiens
tgcatgagctccct

SEQ ID NO: 6504042 - DNA, 12 bp, Homo sapiens
tgcatgagctga

SEQ ID NO: 6504043 - DNA, 22 bp, Homo sapiens
tgcatgagctggcaaccagcca

SEQ ID NO: 6504044 - DNA, 24 bp, Homo sapiens
tgcatgagctggcaaccagccagc

SEQ ID NO: 6504045 - DNA, 15 bp, Homo sapiens
tgcatgagcttttat

SEQ ID NO: 6504046 - DNA, 15 bp, Homo sapiens
tgcatgataaacatt

SEQ ID NO: 6504047 - DNA, 15 bp, Homo sapiens
tgcatgatattgtat

SEQ ID NO: 6504048 - DNA, 23 bp, Homo sapiens
tgcatgatcttacacgaagaaat

SEQ ID NO: 6504049 - DNA, 21 bp, Homo sapiens
tgcatgatgccctcccctcag

SEQ ID NO: 6504050 - DNA, 22 bp, Homo sapiens
tgcatgatgccctcccctcagc

SEQ ID NO: 6504051 - DNA, 12 bp, Homo sapiens
tgcatgatgggt

SEQ ID NO: 6504052 - DNA, 17 bp, Homo sapiens
tgcatgatgtttgccca

SEQ ID NO: 6504053 - DNA, 21 bp, Homo sapiens
tgcatgattcttctcttgtga

SEQ ID NO: 6504054 - DNA, 18 bp, Homo sapiens
tgcatgattttatacata

SEQ ID NO: 6504055 - DNA, 19 bp, Homo sapiens
tgcatgatttttgccctgc

SEQ ID NO: 6504056 - DNA, 18 bp, Homo sapiens
tgcatgcaaaccaggagc

SEQ ID NO: 6504057 - DNA, 15 bp, Homo sapiens
tgcatgcaaatgagc

SEQ ID NO: 6504058 - DNA, 23 bp, Homo sapiens
tgcatgcaactaattcaataaaa

SEQ ID NO: 6504059 - DNA, 20 bp, Homo sapiens
tgcatgcagcaacacccaag

SEQ ID NO: 6504060 - DNA, 22 bp, Homo sapiens
tgcatgcagccactgtgctgaa

SEQ ID NO: 6504061 - DNA, 23 bp, Homo sapiens
tgcatgcagggcccccacaggag

SEQ ID NO: 6504062 - DNA, 15 bp, Homo sapiens
tgcatgcaggtctcc

SEQ ID NO: 6504063 - DNA, 15 bp, Homo sapiens
tgcatgcataatgaa

SEQ ID NO: 6504064 - DNA, 16 bp, Homo sapiens
tgcatgcattgagctg

SEQ ID NO: 6504065 - DNA, 19 bp, Homo sapiens
tgcatgcattgagctgcct

SEQ ID NO: 6504066 - DNA, 23 bp, Homo sapiens
tgcatgcccagagacccagcgga

SEQ ID NO: 6504067 - DNA, 15 bp, Homo sapiens
tgcatgccctctcag

SEQ ID NO: 6504068 - DNA, 14 bp, Homo sapiens
tgcatgccctctct

SEQ ID NO: 6504069 - DNA, 20 bp, Homo sapiens
tgcatgccctctctgagtct

SEQ ID NO: 6504070 - DNA, 19 bp, Homo sapiens
tgcatgcctgggcccaggc

SEQ ID NO: 6504071 - DNA, 21 bp, Homo sapiens
tgcatgcggcccagcccggct

SEQ ID NO: 6504072 - DNA, 19 bp, Homo sapiens
tgcatgctaaattattatt

SEQ ID NO: 6504073 - DNA, 23 bp, Homo sapiens
tgcatgctaaattattatttagc

SEQ ID NO: 6504074 - DNA, 15 bp, Homo sapiens
tgcatgctagtgttg

SEQ ID NO: 6504075 - DNA, 20 bp, Homo sapiens
tgcatgctagtgttgtattt

SEQ ID NO: 6504076 - DNA, 16 bp, Homo sapiens
tgcatgctcaaatgaa

SEQ ID NO: 6504077 - DNA, 18 bp, Homo sapiens
tgcatgctcctctgcctg

SEQ ID NO: 6504078 - DNA, 22 bp, Homo sapiens
tgcatgctcctctgcctgtgcc

SEQ ID NO: 6504079 - DNA, 16 bp, Homo sapiens
tgcatgctctctgcag

SEQ ID NO: 6504080 - DNA, 17 bp, Homo sapiens
tgcatgctctggaagcc

SEQ ID NO: 6504081 - DNA, 13 bp, Homo sapiens
tgcatgctgaaac

SEQ ID NO: 6504082 - DNA, 15 bp, Homo sapiens
tgcatgctgaaacaa

SEQ ID NO: 6504083 - DNA, 18 bp, Homo sapiens
tgcatgctgataatcatt

SEQ ID NO: 6504084 - DNA, 19 bp, Homo sapiens
tgcatgctgataatcattt

SEQ ID NO: 6504085 - DNA, 17 bp, Homo sapiens
tgcatgctgctggacag

SEQ ID NO: 6504086 - DNA, 15 bp, Homo sapiens
tgcatgctgtagctg

SEQ ID NO: 6504087 - DNA, 16 bp, Homo sapiens
tgcatgcttagagcat

SEQ ID NO: 6504088 - DNA, 18 bp, Homo sapiens
tgcatgctttccatattt

SEQ ID NO: 6504089 - DNA, 15 bp, Homo sapiens
tgcatggaaacctga

SEQ ID NO: 6504090 - DNA, 19 bp, Homo sapiens
tgcatggaaacctgaaaaa

SEQ ID NO: 6504091 - DNA, 12 bp, Homo sapiens
tgcatggaaatc

SEQ ID NO: 6504092 - DNA, 19 bp, Homo sapiens
tgcatggaaattcccttca

SEQ ID NO: 6504093 - DNA, 16 bp, Homo sapiens
tgcatggaagttgggg

SEQ ID NO: 6504094 - DNA, 19 bp, Homo sapiens
tgcatggaagttggggcac

SEQ ID NO: 6504095 - DNA, 19 bp, Homo sapiens
tgcatggaatttgtaagtt

SEQ ID NO: 6504096 - DNA, 23 bp, Homo sapiens
tgcatggacaccccttatccagg

SEQ ID NO: 6504097 - DNA, 15 bp, Homo sapiens
tgcatggacctaaca

SEQ ID NO: 6504098 - DNA, 18 bp, Homo sapiens
tgcatggacgcctggctc

SEQ ID NO: 6504099 - DNA, 15 bp, Homo sapiens
tgcatggagaatggg

SEQ ID NO: 6504100 - DNA, 12 bp, Homo sapiens
tgcatggagcct

SEQ ID NO: 6504101 - DNA, 13 bp, Homo sapiens
tgcatggagcctg

SEQ ID NO: 6504102 - DNA, 15 bp, Homo sapiens
tgcatggagcctgga

SEQ ID NO: 6504103 - DNA, 18 bp, Homo sapiens
tgcatggaggactctcct

SEQ ID NO: 6504104 - DNA, 13 bp, Homo sapiens
tgcatggaggccc

SEQ ID NO: 6504105 - DNA, 16 bp, Homo sapiens
tgcatggagtgtttga

SEQ ID NO: 6504106 - DNA, 13 bp, Homo sapiens
tgcatggcactga

SEQ ID NO: 6504107 - DNA, 16 bp, Homo sapiens
tgcatggcactgaccg

SEQ ID NO: 6504108 - DNA, 20 bp, Homo sapiens
tgcatggcagggcctcatct

SEQ ID NO: 6504109 - DNA, 23 bp, Homo sapiens
tgcatggcagggggctgctgctg

SEQ ID NO: 6504110 - DNA, 18 bp, Homo sapiens
tgcatggcatcctccagc

SEQ ID NO: 6504111 - DNA, 14 bp, Homo sapiens
tgcatggcctccca

SEQ ID NO: 6504112 - DNA, 18 bp, Homo sapiens
tgcatggcctcccagcca

SEQ ID NO: 6504113 - DNA, 19 bp, Homo sapiens
tgcatggcctcccagccac

SEQ ID NO: 6504114 - DNA, 20 bp, Homo sapiens
tgcatggcctcccagccacc

SEQ ID NO: 6504115 - DNA, 21 bp, Homo sapiens
tgcatggcctcccagccaccc

SEQ ID NO: 6504116 - DNA, 19 bp, Homo sapiens
tgcatggctccagaaatgt

SEQ ID NO: 6504117 - DNA, 15 bp, Homo sapiens
tgcatggctcctgtc

SEQ ID NO: 6504118 - DNA, 16 bp, Homo sapiens
tgcatggctcctgtct

SEQ ID NO: 6504119 - DNA, 18 bp, Homo sapiens
tgcatggcttggggagca

SEQ ID NO: 6504120 - DNA, 22 bp, Homo sapiens
tgcatggcttggggagcagagt

SEQ ID NO: 6504121 - DNA, 14 bp, Homo sapiens
tgcatgggaggggg

SEQ ID NO: 6504122 - DNA, 11 bp, Homo sapiens
tgcatgggctc

SEQ ID NO: 6504123 - DNA, 13 bp, Homo sapiens
tgcatgggctcgc

SEQ ID NO: 6504124 - DNA, 16 bp, Homo sapiens
tgcatggggaggcagc

SEQ ID NO: 6504125 - DNA, 23 bp, Homo sapiens
tgcatgggggaccctgtgcatct

SEQ ID NO: 6504126 - DNA, 23 bp, Homo sapiens
tgcatggggtggggtagggctga

SEQ ID NO: 6504127 - DNA, 17 bp, Homo sapiens
tgcatgggtgaagggag

SEQ ID NO: 6504128 - DNA, 18 bp, Homo sapiens
tgcatgggttttgtaggt

SEQ ID NO: 6504129 - DNA, 19 bp, Homo sapiens
tgcatgggttttgtaggta

SEQ ID NO: 6504130 - DNA, 18 bp, Homo sapiens
tgcatggtaatttatagt

SEQ ID NO: 6504131 - DNA, 20 bp, Homo sapiens
tgcatggtgccccaggacca

SEQ ID NO: 6504132 - DNA, 22 bp, Homo sapiens
tgcatggtgccccaggaccagc

SEQ ID NO: 6504133 - DNA, 16 bp, Homo sapiens
tgcatggtggcaccag

SEQ ID NO: 6504134 - DNA, 13 bp, Homo sapiens
tgcatggtggcca

SEQ ID NO: 6504135 - DNA, 19 bp, Homo sapiens
tgcatgtaaaatcttcagc

SEQ ID NO: 6504136 - DNA, 20 bp, Homo sapiens
tgcatgtaaaatcttcagct

SEQ ID NO: 6504137 - DNA, 21 bp, Homo sapiens
tgcatgtaaaatcttcagctg

SEQ ID NO: 6504138 - DNA, 22 bp, Homo sapiens
tgcatgtaaaatcttcagctgg

SEQ ID NO: 6504139 - DNA, 17 bp, Homo sapiens
tgcatgtaaaatgcagt

SEQ ID NO: 6504140 - DNA, 13 bp, Homo sapiens
tgcatgtaatcaa

SEQ ID NO: 6504141 - DNA, 22 bp, Homo sapiens
tgcatgtactagtcctctagaa

SEQ ID NO: 6504142 - DNA, 17 bp, Homo sapiens
tgcatgtactgtatatt

SEQ ID NO: 6504143 - DNA, 21 bp, Homo sapiens
tgcatgtacttgaaggatgga

SEQ ID NO: 6504144 - DNA, 18 bp, Homo sapiens
tgcatgtagaggcttgtt

SEQ ID NO: 6504145 - DNA, 21 bp, Homo sapiens
tgcatgtagaggcttgtttac

SEQ ID NO: 6504146 - DNA, 18 bp, Homo sapiens
tgcatgtagcatataaat

SEQ ID NO: 6504147 - DNA, 20 bp, Homo sapiens
tgcatgtagcatataaatgt

SEQ ID NO: 6504148 - DNA, 17 bp, Homo sapiens
tgcatgtagtaacacta

SEQ ID NO: 6504149 - DNA, 17 bp, Homo sapiens
tgcatgtataaatgaag

SEQ ID NO: 6504150 - DNA, 16 bp, Homo sapiens
tgcatgtatgtataca

SEQ ID NO: 6504151 - DNA, 16 bp, Homo sapiens
tgcatgtatgtcttgg

SEQ ID NO: 6504152 - DNA, 20 bp, Homo sapiens
tgcatgtatgtgcacatgtg

SEQ ID NO: 6504153 - DNA, 15 bp, Homo sapiens
tgcatgtatgtgtgt

SEQ ID NO: 6504154 - DNA, 16 bp, Homo sapiens
tgcatgtattcactaa

SEQ ID NO: 6504155 - DNA, 20 bp, Homo sapiens
tgcatgtcaaacatgagatg

SEQ ID NO: 6504156 - DNA, 15 bp, Homo sapiens
tgcatgtcacatgac

SEQ ID NO: 6504157 - DNA, 15 bp, Homo sapiens
tgcatgtcagagcac

SEQ ID NO: 6504158 - DNA, 16 bp, Homo sapiens
tgcatgtcagagcact

SEQ ID NO: 6504159 - DNA, 23 bp, Homo sapiens
tgcatgtcctttgcgcctgtgac

SEQ ID NO: 6504160 - DNA, 15 bp, Homo sapiens
tgcatgtcgcacaat

SEQ ID NO: 6504161 - DNA, 14 bp, Homo sapiens
tgcatgtctgcatg

SEQ ID NO: 6504162 - DNA, 15 bp, Homo sapiens
tgtccctcaattaca

SEQ ID NO: 6504163 - DNA, 16 bp, Homo sapiens
tgtccctcaattacag

SEQ ID NO: 6504164 - DNA, 16 bp, Homo sapiens
tgtccctccaacacag

SEQ ID NO: 6504165 - DNA, 13 bp, Homo sapiens
tgtccctccaggc

SEQ ID NO: 6504166 - DNA, 21 bp, Homo sapiens
tgtccctccaggcccatctca

SEQ ID NO: 6504167 - DNA, 14 bp, Homo sapiens
tgtccctcccacct

SEQ ID NO: 6504168 - DNA, 18 bp, Homo sapiens
tgtccctcccacctctgt

SEQ ID NO: 6504169 - DNA, 15 bp, Homo sapiens
tgtccctcccactcc

SEQ ID NO: 6504170 - DNA, 14 bp, Homo sapiens
tgtccctccccctt

SEQ ID NO: 6504171 - DNA, 22 bp, Homo sapiens
tgtccctcctcttcctgtagtg

SEQ ID NO: 6504172 - DNA, 13 bp, Homo sapiens
tgtccctcctgag

SEQ ID NO: 6504173 - DNA, 24 bp, Homo sapiens
tgtccctctcagtgccttctctca

SEQ ID NO: 6504174 - DNA, 22 bp, Homo sapiens
tgtccctctcctatgtggcagc

SEQ ID NO: 6504175 - DNA, 20 bp, Homo sapiens
tgtccctctccttgccccca

SEQ ID NO: 6504176 - DNA, 22 bp, Homo sapiens
tgtccctctcgccctggccagg

SEQ ID NO: 6504177 - DNA, 16 bp, Homo sapiens
tgtccctctcttggct

SEQ ID NO: 6504178 - DNA, 14 bp, Homo sapiens
tgtccctctgcccc

SEQ ID NO: 6504179 - DNA, 15 bp, Homo sapiens
tgtccctctgcccca

SEQ ID NO: 6504180 - DNA, 16 bp, Homo sapiens
tgtccctctgcctttt

SEQ ID NO: 6504181 - DNA, 15 bp, Homo sapiens
tgtccctctttgcct

SEQ ID NO: 6504182 - DNA, 21 bp, Homo sapiens
tgtccctctttgcctgtgtga

SEQ ID NO: 6504183 - DNA, 15 bp, Homo sapiens
tgtccctgaaaccta

SEQ ID NO: 6504184 - DNA, 20 bp, Homo sapiens
tgtccctgaagtcttgcatt

SEQ ID NO: 6504185 - DNA, 18 bp, Homo sapiens
tgtccctgcactgtgccc

SEQ ID NO: 6504186 - DNA, 14 bp, Homo sapiens
tgtccctgcagggc

SEQ ID NO: 6504187 - DNA, 20 bp, Homo sapiens
tgtccctgccccgcccccca

SEQ ID NO: 6504188 - DNA, 13 bp, Homo sapiens
tgtccctgcctgg

SEQ ID NO: 6504189 - DNA, 13 bp, Homo sapiens
tgtccctgccttc

SEQ ID NO: 6504190 - DNA, 12 bp, Homo sapiens
tgtccctgctcc

SEQ ID NO: 6504191 - DNA, 12 bp, Homo sapiens
tgtccctggaca

SEQ ID NO: 6504192 - DNA, 13 bp, Homo sapiens
tgtccctggacac

SEQ ID NO: 6504193 - DNA, 14 bp, Homo sapiens
tgtccctggacaca

SEQ ID NO: 6504194 - DNA, 16 bp, Homo sapiens
tgtccctggacacagc

SEQ ID NO: 6504195 - DNA, 16 bp, Homo sapiens
tgtccctggccatctc

SEQ ID NO: 6504196 - DNA, 16 bp, Homo sapiens
tgtccctggcttcctt

SEQ ID NO: 6504197 - DNA, 12 bp, Homo sapiens
tgtccctggggc

SEQ ID NO: 6504198 - DNA, 13 bp, Homo sapiens
tgtccctggggca

SEQ ID NO: 6504199 - DNA, 14 bp, Homo sapiens
tgtccctggggcac

SEQ ID NO: 6504200 - DNA, 15 bp, Homo sapiens
tgtccctggggcact

SEQ ID NO: 6504201 - DNA, 23 bp, Homo sapiens
tgtccctggggcactcccccagg

SEQ ID NO: 6504202 - DNA, 23 bp, Homo sapiens
tgtccctgggggagtaattctgt

SEQ ID NO: 6504203 - DNA, 13 bp, Homo sapiens
tgtccctgtagct

SEQ ID NO: 6504204 - DNA, 17 bp, Homo sapiens
tgtccctgtagctcagt

SEQ ID NO: 6504205 - DNA, 16 bp, Homo sapiens
tgtccctgtcaccaag

SEQ ID NO: 6504206 - DNA, 13 bp, Homo sapiens
tgtccctgtccct

SEQ ID NO: 6504207 - DNA, 17 bp, Homo sapiens
tgtccctgtccctgccc

SEQ ID NO: 6504208 - DNA, 22 bp, Homo sapiens
tgtccctgtccttccctgttct

SEQ ID NO: 6504209 - DNA, 18 bp, Homo sapiens
tgtccctgtccttctaca

SEQ ID NO: 6504210 - DNA, 14 bp, Homo sapiens
tgtccctgtgccta

SEQ ID NO: 6504211 - DNA, 15 bp, Homo sapiens
tgtccctgtgggctc

SEQ ID NO: 6504212 - DNA, 12 bp, Homo sapiens
tgtccctgtggt

SEQ ID NO: 6504213 - DNA, 20 bp, Homo sapiens
tgtccctgtggtaccctggc

SEQ ID NO: 6504214 - DNA, 12 bp, Homo sapiens
tgtccctgtgtt

SEQ ID NO: 6504215 - DNA, 18 bp, Homo sapiens
tgtccctgtgttgtccca

SEQ ID NO: 6504216 - DNA, 23 bp, Homo sapiens
tgtccctgtgttgtcccatctgc

SEQ ID NO: 6504217 - DNA, 13 bp, Homo sapiens
tgtccctgttaga

SEQ ID NO: 6504218 - DNA, 18 bp, Homo sapiens
tgtcccttcacatagttt

SEQ ID NO: 6504219 - DNA, 23 bp, Homo sapiens
tgtcccttccccttcaccgctcc

SEQ ID NO: 6504220 - DNA, 21 bp, Homo sapiens
tgtcccttcgagtccaggaca

SEQ ID NO: 6504221 - DNA, 18 bp, Homo sapiens
tgtcccttgatgcacaga

SEQ ID NO: 6504222 - DNA, 19 bp, Homo sapiens
tgtcccttgatgcacagag

SEQ ID NO: 6504223 - DNA, 15 bp, Homo sapiens
tgtcccttgcctctg

SEQ ID NO: 6504224 - DNA, 14 bp, Homo sapiens
tgtcccttgctgta

SEQ ID NO: 6504225 - DNA, 16 bp, Homo sapiens
tgtcccttgctgtttt

SEQ ID NO: 6504226 - DNA, 23 bp, Homo sapiens
tgtccctttcccctagatccaga

SEQ ID NO: 6504227 - DNA, 14 bp, Homo sapiens
tgtccctttcccta

SEQ ID NO: 6504228 - DNA, 15 bp, Homo sapiens
tgtccctttccctac

SEQ ID NO: 6504229 - DNA, 17 bp, Homo sapiens
tgtccctttccctacct

SEQ ID NO: 6504230 - DNA, 14 bp, Homo sapiens
tgtccctttcttct

SEQ ID NO: 6504231 - DNA, 16 bp, Homo sapiens
tgtccctttcttggcc

SEQ ID NO: 6504232 - DNA, 18 bp, Homo sapiens
tgtccctttgctcccggc

SEQ ID NO: 6504233 - DNA, 16 bp, Homo sapiens
tgtcccttttccctta

SEQ ID NO: 6504234 - DNA, 17 bp, Homo sapiens
tgtcccttttccttttt

SEQ ID NO: 6504235 - DNA, 13 bp, Homo sapiens
tgtcccttttctt

SEQ ID NO: 6504236 - DNA, 13 bp, Homo sapiens
tgtccgagaacta

SEQ ID NO: 6504237 - DNA, 22 bp, Homo sapiens
tgtccgagaactaaagccaagg

SEQ ID NO: 6504238 - DNA, 13 bp, Homo sapiens
tgtccgagctttg

SEQ ID NO: 6504239 - DNA, 14 bp, Homo sapiens
tgtccgatgctgga

SEQ ID NO: 6504240 - DNA, 15 bp, Homo sapiens
tgtccgatttttcca

SEQ ID NO: 6504241 - DNA, 17 bp, Homo sapiens
tgtccgccctcttcccc

SEQ ID NO: 6504242 - DNA, 21 bp, Homo sapiens
tgtccgcgtcctttcctctcc

SEQ ID NO: 6504243 - DNA, 18 bp, Homo sapiens
tgtccgctctctcatgtg

SEQ ID NO: 6504244 - DNA, 21 bp, Homo sapiens
tgtccgctgctgctttccttc

SEQ ID NO: 6504245 - DNA, 15 bp, Homo sapiens
tgtccgctgggtggt

SEQ ID NO: 6504246 - DNA, 20 bp, Homo sapiens
tgtccgctgggtggtaccct

SEQ ID NO: 6504247 - DNA, 12 bp, Homo sapiens
tgtccgctgtct

SEQ ID NO: 6504248 - DNA, 19 bp, Homo sapiens
tgtccgctgtctccctcct

SEQ ID NO: 6504249 - DNA, 18 bp, Homo sapiens
tgtccggcccagtgccac

SEQ ID NO: 6504250 - DNA, 23 bp, Homo sapiens
tgtccggccgctttgtgattcca

SEQ ID NO: 6504251 - DNA, 13 bp, Homo sapiens
tgtccgtccaccc

SEQ ID NO: 6504252 - DNA, 13 bp, Homo sapiens
tgtccgtcctgct

SEQ ID NO: 6504253 - DNA, 14 bp, Homo sapiens
tgtccgtcctgctc

SEQ ID NO: 6504254 - DNA, 17 bp, Homo sapiens
tgtccgtctgtcctgcg

SEQ ID NO: 6504255 - DNA, 13 bp, Homo sapiens
tgtccgtgcccct

SEQ ID NO: 6504256 - DNA, 13 bp, Homo sapiens
tgtccgtgtgcct

SEQ ID NO: 6504257 - DNA, 16 bp, Homo sapiens
tgtccgtgtgcctcct

SEQ ID NO: 6504258 - DNA, 18 bp, Homo sapiens
tgtccgtgtgcctcctgt

SEQ ID NO: 6504259 - DNA, 19 bp, Homo sapiens
tgtcctaaaaatggctaac

SEQ ID NO: 6504260 - DNA, 16 bp, Homo sapiens
tgtcctaagagattta

SEQ ID NO: 6504261 - DNA, 20 bp, Homo sapiens
tgtcctaagagatttatctt

SEQ ID NO: 6504262 - DNA, 18 bp, Homo sapiens
tgtcctaaggacacacta

SEQ ID NO: 6504263 - DNA, 21 bp, Homo sapiens
tgtcctaagtgtcaagtcctg

SEQ ID NO: 6504264 - DNA, 15 bp, Homo sapiens
tgtcctaatggtgat

SEQ ID NO: 6504265 - DNA, 18 bp, Homo sapiens
tgtcctaatggtgatgca

SEQ ID NO: 6504266 - DNA, 14 bp, Homo sapiens
tgtcctacacttga

SEQ ID NO: 6504267 - DNA, 18 bp, Homo sapiens
tgtcctacagaaaaacct

SEQ ID NO: 6504268 - DNA, 22 bp, Homo sapiens
tgtcctacagtgactccctggg

SEQ ID NO: 6504269 - DNA, 18 bp, Homo sapiens
tgtcctaccatcagctct

SEQ ID NO: 6504270 - DNA, 24 bp, Homo sapiens
tgtcctaccatcagctctgccttg

SEQ ID NO: 6504271 - DNA, 16 bp, Homo sapiens
tgtcctacccaccctc

SEQ ID NO: 6504272 - DNA, 16 bp, Homo sapiens
tgtcctacccgcccgc

SEQ ID NO: 6504273 - DNA, 21 bp, Homo sapiens
tgtcctacccgcccgcgtcca

SEQ ID NO: 6504274 - DNA, 22 bp, Homo sapiens
tgtcctacccgcccgcgtccaa

SEQ ID NO: 6504275 - DNA, 16 bp, Homo sapiens
tgtcctacgtccaagg

SEQ ID NO: 6504276 - DNA, 12 bp, Homo sapiens
tgtcctactctg

SEQ ID NO: 6504277 - DNA, 21 bp, Homo sapiens
tgtcctacttctgactttact

SEQ ID NO: 6504278 - DNA, 23 bp, Homo sapiens
tgtcctacttctgactttacttg

SEQ ID NO: 6504279 - DNA, 14 bp, Homo sapiens
tgtcctagcacaga

SEQ ID NO: 6504280 - DNA, 18 bp, Homo sapiens
tgtcctagcacagatggc

SEQ ID NO: 6504281 - DNA, 22 bp, Homo sapiens
tgtcctagcacagatggccagc

SEQ ID NO: 6504282 - DNA, 14 bp, Homo sapiens
tgtcctagccaggt

SEQ ID NO: 6504283 - DNA, 14 bp, Homo sapiens
tgtcctaggctctg

SEQ ID NO: 6504284 - DNA, 16 bp, Homo sapiens
tgtcctaggctctggg

SEQ ID NO: 6504285 - DNA, 23 bp, Homo sapiens
tgtcctaggggccgagggaaatg

SEQ ID NO: 6504286 - DNA, 15 bp, Homo sapiens
tgtcctagtctcctt

SEQ ID NO: 6504287 - DNA, 12 bp, Homo sapiens
tgtcctataatt

SEQ ID NO: 6504288 - DNA, 16 bp, Homo sapiens
tgtcctatccccggac

SEQ ID NO: 6504289 - DNA, 12 bp, Homo sapiens
tgtcctatgcct

SEQ ID NO: 6504290 - DNA, 13 bp, Homo sapiens
tgtcctatgtgtg

SEQ ID NO: 6504291 - DNA, 22 bp, Homo sapiens
tgtcctatgtgtgactctaaat

SEQ ID NO: 6504292 - DNA, 23 bp, Homo sapiens
tgtcctcaagaagaaagtgttca

SEQ ID NO: 6504293 - DNA, 13 bp, Homo sapiens
tgtcctcaccatg

SEQ ID NO: 6504294 - DNA, 12 bp, Homo sapiens
tgtcctcaccct

SEQ ID NO: 6504295 - DNA, 13 bp, Homo sapiens
tgtcctcaccctg

SEQ ID NO: 6504296 - DNA, 20 bp, Homo sapiens
tgtcctcaccctgtgggacc

SEQ ID NO: 6504297 - DNA, 14 bp, Homo sapiens
tgtcctcacgcccc

SEQ ID NO: 6504298 - DNA, 22 bp, Homo sapiens
tgtcctcacggtgccttttttc

SEQ ID NO: 6504299 - DNA, 15 bp, Homo sapiens
tgtcctcactgctcc

SEQ ID NO: 6504300 - DNA, 19 bp, Homo sapiens
tgtcctcactgctccctga

SEQ ID NO: 6504301 - DNA, 14 bp, Homo sapiens
tgtcctcagagcag

SEQ ID NO: 6504302 - DNA, 18 bp, Homo sapiens
tgtcctcagagcaggggc

SEQ ID NO: 6504303 - DNA, 22 bp, Homo sapiens
tgtcctcagagggtccctaggt

SEQ ID NO: 6504304 - DNA, 13 bp, Homo sapiens
tgtcctcagcccc

SEQ ID NO: 6504305 - DNA, 16 bp, Homo sapiens
tgtcctcagccttgcc

SEQ ID NO: 6504306 - DNA, 14 bp, Homo sapiens
tgtcctcagcttct

SEQ ID NO: 6504307 - DNA, 14 bp, Homo sapiens
tgtcctcagggagc

SEQ ID NO: 6504308 - DNA, 23 bp, Homo sapiens
tgtcctcagggagcagggaaggc

SEQ ID NO: 6504309 - DNA, 18 bp, Homo sapiens
tgtcctcaggtggccatg

SEQ ID NO: 6504310 - DNA, 13 bp, Homo sapiens
tgtcctcatcctt

SEQ ID NO: 6504311 - DNA, 17 bp, Homo sapiens
tgtcctccaagccagcg

SEQ ID NO: 6504312 - DNA, 16 bp, Homo sapiens
tgtcctccaagtgccc

SEQ ID NO: 6504313 - DNA, 19 bp, Homo sapiens
tgtcctccaagtgccccct

SEQ ID NO: 6504314 - DNA, 23 bp, Homo sapiens
tgtcctccaagtgccccctcacc

SEQ ID NO: 6504315 - DNA, 19 bp, Homo sapiens
tgtcctccagaagcctctg

SEQ ID NO: 6504316 - DNA, 20 bp, Homo sapiens
tgtcctccagaagcctctgg

SEQ ID NO: 6504317 - DNA, 15 bp, Homo sapiens
tgtcctccagcttcc

SEQ ID NO: 6504318 - DNA, 24 bp, Homo sapiens
tgtcctccagcttcccctcgctgt

SEQ ID NO: 6504319 - DNA, 19 bp, Homo sapiens
tgtcctcccaggaaccaaa

SEQ ID NO: 6504320 - DNA, 14 bp, Homo sapiens
tgtcctccccaccc

SEQ ID NO: 6504321 - DNA, 21 bp, Homo sapiens
tgtcctcccgagctcctcttc

SEQ ID NO: 6504322 - DNA, 21 bp, Homo sapiens
tgtcctccctccctcccttcc

SEQ ID NO: 6504323 - DNA, 10 bp, Homo sapiens
tgtcctcctc

SEQ ID NO: 6504324 - DNA, 11 bp, Homo sapiens
tgtcctcctcg

SEQ ID NO: 6504325 - DNA, 15 bp, Homo sapiens
tgtcctcctctgagg

SEQ ID NO: 6504326 - DNA, 18 bp, Homo sapiens
tgtcctcctctgtgaaac

SEQ ID NO: 6504327 - DNA, 11 bp, Homo sapiens
tgtcctcctgc

SEQ ID NO: 6504328 - DNA, 12 bp, Homo sapiens
tgtcctcctgct

SEQ ID NO: 6504329 - DNA, 18 bp, Homo sapiens
tgtcctcctgctctgctt

SEQ ID NO: 6504330 - DNA, 22 bp, Homo sapiens
tgtcctcctgctctgcttcctc

SEQ ID NO: 6504331 - DNA, 17 bp, Homo sapiens
tgtcctcctgctgccag

SEQ ID NO: 6504332 - DNA, 18 bp, Homo sapiens
tgtcctcctgctgccagt

SEQ ID NO: 6504333 - DNA, 13 bp, Homo sapiens
tgtcctcctggaa

SEQ ID NO: 6504334 - DNA, 21 bp, Homo sapiens
tgtcctcctggtgggtccagg

SEQ ID NO: 6504335 - DNA, 14 bp, Homo sapiens
tgtcctcctgttca

SEQ ID NO: 6504336 - DNA, 15 bp, Homo sapiens
tgtcctccttcctgg

SEQ ID NO: 6504337 - DNA, 16 bp, Homo sapiens
tgtcctccttttcact

SEQ ID NO: 6504338 - DNA, 21 bp, Homo sapiens
tgtcctcgcactgcccaggga

SEQ ID NO: 6504339 - DNA, 12 bp, Homo sapiens
tgtcctctacat

SEQ ID NO: 6504340 - DNA, 18 bp, Homo sapiens
tgtcctctcagaactcct

SEQ ID NO: 6504341 - DNA, 20 bp, Homo sapiens
tgtcctctcagaactcctgt

SEQ ID NO: 6504342 - DNA, 14 bp, Homo sapiens
tgtcctctcagagc

SEQ ID NO: 6504343 - DNA, 12 bp, Homo sapiens
tgcatgtctgcc

SEQ ID NO: 6504344 - DNA, 21 bp, Homo sapiens
tgcatgtctgccaaaatgcaa

SEQ ID NO: 6504345 - DNA, 23 bp, Homo sapiens
tgcatgtctgcctatgcactgaa

SEQ ID NO: 6504346 - DNA, 13 bp, Homo sapiens
tgcatgtcttaaa

SEQ ID NO: 6504347 - DNA, 19 bp, Homo sapiens
tgcatgtcttaaatgctca

SEQ ID NO: 6504348 - DNA, 21 bp, Homo sapiens
tgcatgtcttaaatgctcata

SEQ ID NO: 6504349 - DNA, 14 bp, Homo sapiens
tgcatgtcttttaa

SEQ ID NO: 6504350 - DNA, 12 bp, Homo sapiens
tgcatgtgaaga

SEQ ID NO: 6504351 - DNA, 19 bp, Homo sapiens
tgcatgtgaagcatgcttt

SEQ ID NO: 6504352 - DNA, 15 bp, Homo sapiens
tgcatgtgactctga

SEQ ID NO: 6504353 - DNA, 16 bp, Homo sapiens
tgcatgtgactctgaa

SEQ ID NO: 6504354 - DNA, 17 bp, Homo sapiens
tgcatgtgactctgaag

SEQ ID NO: 6504355 - DNA, 23 bp, Homo sapiens
tgcatgtgacttctcccctgccc

SEQ ID NO: 6504356 - DNA, 14 bp, Homo sapiens
tgcatgtgcatgca

SEQ ID NO: 6504357 - DNA, 15 bp, Homo sapiens
tgcatgtgcatgcat

SEQ ID NO: 6504358 - DNA, 18 bp, Homo sapiens
tgcatgtgcatgcatacc

SEQ ID NO: 6504359 - DNA, 23 bp, Homo sapiens
tgcatgtgcgtggaagtgttcct

SEQ ID NO: 6504360 - DNA, 14 bp, Homo sapiens
tgcatgtgctgtct

SEQ ID NO: 6504361 - DNA, 15 bp, Homo sapiens
tgcatgtggcttttt

SEQ ID NO: 6504362 - DNA, 22 bp, Homo sapiens
tgcatgtggtttggttcctctc

SEQ ID NO: 6504363 - DNA, 24 bp, Homo sapiens
tgcatgtggtttggttcctctctg

SEQ ID NO: 6504364 - DNA, 19 bp, Homo sapiens
tgcatgtgtaaatctgaaa

SEQ ID NO: 6504365 - DNA, 22 bp, Homo sapiens
tgcatgtgtaaatctgaaaaac

SEQ ID NO: 6504366 - DNA, 12 bp, Homo sapiens
tgcatgtgtata

SEQ ID NO: 6504367 - DNA, 21 bp, Homo sapiens
tgcatgtgtatatatgtcaaa

SEQ ID NO: 6504368 - DNA, 22 bp, Homo sapiens
tgcatgtgtgcgtgtctccatg

SEQ ID NO: 6504369 - DNA, 14 bp, Homo sapiens
tgcatgtgtgtata

SEQ ID NO: 6504370 - DNA, 20 bp, Homo sapiens
tgcatgtgtgtgtctgtctt

SEQ ID NO: 6504371 - DNA, 21 bp, Homo sapiens
tgcatgtgtgtgtctgtcttt

SEQ ID NO: 6504372 - DNA, 17 bp, Homo sapiens
tgcatgttccactaacc

SEQ ID NO: 6504373 - DNA, 18 bp, Homo sapiens
tgcatgttccactaaccc

SEQ ID NO: 6504374 - DNA, 11 bp, Homo sapiens
tgcatgttctt

SEQ ID NO: 6504375 - DNA, 17 bp, Homo sapiens
tgcatgtttactttatt

SEQ ID NO: 6504376 - DNA, 20 bp, Homo sapiens
tgcatgtttactttattaga

SEQ ID NO: 6504377 - DNA, 16 bp, Homo sapiens
tgcatgtttgctgttc

SEQ ID NO: 6504378 - DNA, 21 bp, Homo sapiens
tgcatgttttccagctcctca

SEQ ID NO: 6504379 - DNA, 15 bp, Homo sapiens
tgcattaaaagaaaa

SEQ ID NO: 6504380 - DNA, 16 bp, Homo sapiens
tgcattaaaattaaat

SEQ ID NO: 6504381 - DNA, 19 bp, Homo sapiens
tgcattaaaatttcttatt

SEQ ID NO: 6504382 - DNA, 21 bp, Homo sapiens
tgcattaaacctgtctccact

SEQ ID NO: 6504383 - DNA, 21 bp, Homo sapiens
tgcattaaaggagatcttccc

SEQ ID NO: 6504384 - DNA, 17 bp, Homo sapiens
tgcattaaattcacaaa

SEQ ID NO: 6504385 - DNA, 20 bp, Homo sapiens
tgcattaaattcacaaactt

SEQ ID NO: 6504386 - DNA, 22 bp, Homo sapiens
tgcattaaccactctacagact

SEQ ID NO: 6504387 - DNA, 14 bp, Homo sapiens
tgcattaacttaaa

SEQ ID NO: 6504388 - DNA, 18 bp, Homo sapiens
tgcattaatctaagaaaa

SEQ ID NO: 6504389 - DNA, 13 bp, Homo sapiens
tgcattacaaagt

SEQ ID NO: 6504390 - DNA, 18 bp, Homo sapiens
tgcattacagagaggaga

SEQ ID NO: 6504391 - DNA, 14 bp, Homo sapiens
tgcattacattcct

SEQ ID NO: 6504392 - DNA, 22 bp, Homo sapiens
tgcattaccagcttaaaacact

SEQ ID NO: 6504393 - DNA, 23 bp, Homo sapiens
tgcattaccgcgttgtaaaatat

SEQ ID NO: 6504394 - DNA, 17 bp, Homo sapiens
tgcattactgcatgcac

SEQ ID NO: 6504395 - DNA, 17 bp, Homo sapiens
tgcattagaaaccatga

SEQ ID NO: 6504396 - DNA, 20 bp, Homo sapiens
tgcattagaaatagacagta

SEQ ID NO: 6504397 - DNA, 14 bp, Homo sapiens
tgcattagaaatta

SEQ ID NO: 6504398 - DNA, 18 bp, Homo sapiens
tgcattagcacagatttt

SEQ ID NO: 6504399 - DNA, 22 bp, Homo sapiens
tgcattagcctggatcctcagt

SEQ ID NO: 6504400 - DNA, 19 bp, Homo sapiens
tgcattagggatgcctcct

SEQ ID NO: 6504401 - DNA, 18 bp, Homo sapiens
tgcattatctagatactg

SEQ ID NO: 6504402 - DNA, 21 bp, Homo sapiens
tgcattatctagatactgtat

SEQ ID NO: 6504403 - DNA, 17 bp, Homo sapiens
tgcattattaaattgta

SEQ ID NO: 6504404 - DNA, 18 bp, Homo sapiens
tgcattattaaattgtaa

SEQ ID NO: 6504405 - DNA, 23 bp, Homo sapiens
tgcattattcatttagtgagtta

SEQ ID NO: 6504406 - DNA, 13 bp, Homo sapiens
tgcattatttgtt

SEQ ID NO: 6504407 - DNA, 22 bp, Homo sapiens
tgcattatttgttgactagatg

SEQ ID NO: 6504408 - DNA, 14 bp, Homo sapiens
tgcattattttatt

SEQ ID NO: 6504409 - DNA, 20 bp, Homo sapiens
tgcattattttattgagcaa

SEQ ID NO: 6504410 - DNA, 17 bp, Homo sapiens
tgcattattttgtcata

SEQ ID NO: 6504411 - DNA, 13 bp, Homo sapiens
tgcattcaaaatc

SEQ ID NO: 6504412 - DNA, 14 bp, Homo sapiens
tgcattcaacctta

SEQ ID NO: 6504413 - DNA, 19 bp, Homo sapiens
tgcattcaaccttaccaaa

SEQ ID NO: 6504414 - DNA, 15 bp, Homo sapiens
tgcattcaagagagg

SEQ ID NO: 6504415 - DNA, 20 bp, Homo sapiens
tgcattcacaaggtcaaagt

SEQ ID NO: 6504416 - DNA, 21 bp, Homo sapiens
tgcattcacagcgcctcctgg

SEQ ID NO: 6504417 - DNA, 22 bp, Homo sapiens
tgcattcacagcgcctcctgga

SEQ ID NO: 6504418 - DNA, 23 bp, Homo sapiens
tgcattcacatttagaaaagtga

SEQ ID NO: 6504419 - DNA, 14 bp, Homo sapiens
tgcattcacccaga

SEQ ID NO: 6504420 - DNA, 16 bp, Homo sapiens
tgcattcactcagcat

SEQ ID NO: 6504421 - DNA, 12 bp, Homo sapiens
tgcattcagatc

SEQ ID NO: 6504422 - DNA, 13 bp, Homo sapiens
tgcattcagatct

SEQ ID NO: 6504423 - DNA, 19 bp, Homo sapiens
tgcattcagatctgaagta

SEQ ID NO: 6504424 - DNA, 21 bp, Homo sapiens
tgcattcatgcaagagtttct

SEQ ID NO: 6504425 - DNA, 22 bp, Homo sapiens
tgcattcatgttttaaaagttt

SEQ ID NO: 6504426 - DNA, 18 bp, Homo sapiens
tgcattcattcatcctct

SEQ ID NO: 6504427 - DNA, 20 bp, Homo sapiens
tgcattcattcatcctctta

SEQ ID NO: 6504428 - DNA, 16 bp, Homo sapiens
tgcattcattctgagc

SEQ ID NO: 6504429 - DNA, 17 bp, Homo sapiens
tgcattcattctgagcc

SEQ ID NO: 6504430 - DNA, 12 bp, Homo sapiens
tgcattccagaa

SEQ ID NO: 6504431 - DNA, 18 bp, Homo sapiens
tgcattccagaacaaatt

SEQ ID NO: 6504432 - DNA, 20 bp, Homo sapiens
tgcattccagcgtctgctgt

SEQ ID NO: 6504433 - DNA, 15 bp, Homo sapiens
tgcattccatgattt

SEQ ID NO: 6504434 - DNA, 18 bp, Homo sapiens
tgcattccccgctgccca

SEQ ID NO: 6504435 - DNA, 12 bp, Homo sapiens
tgcattcctgaa

SEQ ID NO: 6504436 - DNA, 19 bp, Homo sapiens
tgcattccttacttgcact

SEQ ID NO: 6504437 - DNA, 15 bp, Homo sapiens
tgcattcctttgtct

SEQ ID NO: 6504438 - DNA, 16 bp, Homo sapiens
tgcattcctttgtctt

SEQ ID NO: 6504439 - DNA, 18 bp, Homo sapiens
tgcattcctttgtcttca

SEQ ID NO: 6504440 - DNA, 16 bp, Homo sapiens
tgcattctagtgcaga

SEQ ID NO: 6504441 - DNA, 22 bp, Homo sapiens
tgcattctatcgttattataaa

SEQ ID NO: 6504442 - DNA, 15 bp, Homo sapiens
tgcattctattgcct

SEQ ID NO: 6504443 - DNA, 19 bp, Homo sapiens
tgcattctattgccttctt

SEQ ID NO: 6504444 - DNA, 21 bp, Homo sapiens
tgcattctccctccttccctt

SEQ ID NO: 6504445 - DNA, 21 bp, Homo sapiens
tgcattctgccgtgtgccctc

SEQ ID NO: 6504446 - DNA, 19 bp, Homo sapiens
tgcattctgtttcctcttg

SEQ ID NO: 6504447 - DNA, 22 bp, Homo sapiens
tgcattcttaatctccactgtt

SEQ ID NO: 6504448 - DNA, 17 bp, Homo sapiens
tgcattcttccgcaccc

SEQ ID NO: 6504449 - DNA, 15 bp, Homo sapiens
tgcattcttctgatc

SEQ ID NO: 6504450 - DNA, 16 bp, Homo sapiens
tgcattctttctgtat

SEQ ID NO: 6504451 - DNA, 13 bp, Homo sapiens
tgcattctttggt

SEQ ID NO: 6504452 - DNA, 20 bp, Homo sapiens
tgcattctttggtaattttt

SEQ ID NO: 6504453 - DNA, 17 bp, Homo sapiens
tgcattgaaaagagctg

SEQ ID NO: 6504454 - DNA, 19 bp, Homo sapiens
tgcattgaacacaaactgt

SEQ ID NO: 6504455 - DNA, 12 bp, Homo sapiens
tgcattgaagat

SEQ ID NO: 6504456 - DNA, 15 bp, Homo sapiens
tgcattgaatatatt

SEQ ID NO: 6504457 - DNA, 19 bp, Homo sapiens
tgcattgaatttagtcatt

SEQ ID NO: 6504458 - DNA, 18 bp, Homo sapiens
tgcattgactttccccac

SEQ ID NO: 6504459 - DNA, 15 bp, Homo sapiens
tgcattgagctgcct

SEQ ID NO: 6504460 - DNA, 16 bp, Homo sapiens
tgcattgagctgcctc

SEQ ID NO: 6504461 - DNA, 22 bp, Homo sapiens
tgcattgagtccagctttcctt

SEQ ID NO: 6504462 - DNA, 22 bp, Homo sapiens
tgcattgatattgtgaacattt

SEQ ID NO: 6504463 - DNA, 17 bp, Homo sapiens
tgcattgattcagtatt

SEQ ID NO: 6504464 - DNA, 18 bp, Homo sapiens
tgcattgccgctgtataa

SEQ ID NO: 6504465 - DNA, 14 bp, Homo sapiens
tgcattgcctgtaa

SEQ ID NO: 6504466 - DNA, 16 bp, Homo sapiens
tgcattgctggtagag

SEQ ID NO: 6504467 - DNA, 21 bp, Homo sapiens
tgcattggaactggaggcagg

SEQ ID NO: 6504468 - DNA, 18 bp, Homo sapiens
tgcattggaagaccccac

SEQ ID NO: 6504469 - DNA, 19 bp, Homo sapiens
tgcattggaagaccccacc

SEQ ID NO: 6504470 - DNA, 18 bp, Homo sapiens
tgcattggataacaccac

SEQ ID NO: 6504471 - DNA, 16 bp, Homo sapiens
tgcattggcctctgta

SEQ ID NO: 6504472 - DNA, 13 bp, Homo sapiens
tgcattggcctgg

SEQ ID NO: 6504473 - DNA, 17 bp, Homo sapiens
tgcattggcctggcctc

SEQ ID NO: 6504474 - DNA, 19 bp, Homo sapiens
tgcattggcctggcctcca

SEQ ID NO: 6504475 - DNA, 18 bp, Homo sapiens
tgcattgggattttagaa

SEQ ID NO: 6504476 - DNA, 20 bp, Homo sapiens
tgcattggggttcctctgta

SEQ ID NO: 6504477 - DNA, 21 bp, Homo sapiens
tgcattggtggcatcacagac

SEQ ID NO: 6504478 - DNA, 20 bp, Homo sapiens
tgcattggtttgagaaaggc

SEQ ID NO: 6504479 - DNA, 15 bp, Homo sapiens
tgcattggttttcca

SEQ ID NO: 6504480 - DNA, 12 bp, Homo sapiens
tgcattgtaaat

SEQ ID NO: 6504481 - DNA, 13 bp, Homo sapiens
tgcattgtccttt

SEQ ID NO: 6504482 - DNA, 18 bp, Homo sapiens
tgcattgtctaatgacag

SEQ ID NO: 6504483 - DNA, 22 bp, Homo sapiens
tgcattgtctccttccacaatg

SEQ ID NO: 6504484 - DNA, 12 bp, Homo sapiens
tgcattgtctgt

SEQ ID NO: 6504485 - DNA, 18 bp, Homo sapiens
tgcattgtgaattgcctg

SEQ ID NO: 6504486 - DNA, 24 bp, Homo sapiens
tgcattgtgaattgcctgccatgg

SEQ ID NO: 6504487 - DNA, 12 bp, Homo sapiens
tgcattgtgctt

SEQ ID NO: 6504488 - DNA, 14 bp, Homo sapiens
tgcattgtggctgt

SEQ ID NO: 6504489 - DNA, 16 bp, Homo sapiens
tgcattgtggctgtca

SEQ ID NO: 6504490 - DNA, 13 bp, Homo sapiens
tgcattgttattt

SEQ ID NO: 6504491 - DNA, 15 bp, Homo sapiens
tgcattgttggctat

SEQ ID NO: 6504492 - DNA, 19 bp, Homo sapiens
tgcattgttggctatttga

SEQ ID NO: 6504493 - DNA, 15 bp, Homo sapiens
tgcattgttgtaaag

SEQ ID NO: 6504494 - DNA, 20 bp, Homo sapiens
tgcatttaaaagatacagtt

SEQ ID NO: 6504495 - DNA, 15 bp, Homo sapiens
tgcatttaaactctg

SEQ ID NO: 6504496 - DNA, 15 bp, Homo sapiens
tgcatttaaagtatt

SEQ ID NO: 6504497 - DNA, 14 bp, Homo sapiens
tgcatttaaatcaa

SEQ ID NO: 6504498 - DNA, 16 bp, Homo sapiens
tgcatttaaatcaagt

SEQ ID NO: 6504499 - DNA, 21 bp, Homo sapiens
tgcatttaagaacagaacagc

SEQ ID NO: 6504500 - DNA, 13 bp, Homo sapiens
tgcatttaaggag

SEQ ID NO: 6504501 - DNA, 15 bp, Homo sapiens
tgcatttaaggagat

SEQ ID NO: 6504502 - DNA, 18 bp, Homo sapiens
tgcatttaagttgtaaac

SEQ ID NO: 6504503 - DNA, 13 bp, Homo sapiens
tgcatttaataaa

SEQ ID NO: 6504504 - DNA, 23 bp, Homo sapiens
tgcatttaataaagatgagttgg

SEQ ID NO: 6504505 - DNA, 19 bp, Homo sapiens
tgcatttacgcctgtaaat

SEQ ID NO: 6504506 - DNA, 22 bp, Homo sapiens
tgcatttacgcctgtaaatgta

SEQ ID NO: 6504507 - DNA, 15 bp, Homo sapiens
tgcatttagaaatca

SEQ ID NO: 6504508 - DNA, 21 bp, Homo sapiens
tgcatttagaactttctgctt

SEQ ID NO: 6504509 - DNA, 19 bp, Homo sapiens
tgcatttagcatgagttct

SEQ ID NO: 6504510 - DNA, 14 bp, Homo sapiens
tgcatttagctgta

SEQ ID NO: 6504511 - DNA, 17 bp, Homo sapiens
tgcatttagctgtattc

SEQ ID NO: 6504512 - DNA, 21 bp, Homo sapiens
tgcatttagctgtattcatat

SEQ ID NO: 6504513 - DNA, 15 bp, Homo sapiens
tgcatttagcttctt

SEQ ID NO: 6504514 - DNA, 16 bp, Homo sapiens
tgcatttagcttcttt

SEQ ID NO: 6504515 - DNA, 21 bp, Homo sapiens
tgcatttagggagtattctaa

SEQ ID NO: 6504516 - DNA, 18 bp, Homo sapiens
tgcatttataaagaccgt

SEQ ID NO: 6504517 - DNA, 17 bp, Homo sapiens
tgcatttataaatgtgt

SEQ ID NO: 6504518 - DNA, 20 bp, Homo sapiens
tgcatttataaatgtgtggt

SEQ ID NO: 6504519 - DNA, 21 bp, Homo sapiens
tgcatttatagatcatttcta

SEQ ID NO: 6504520 - DNA, 13 bp, Homo sapiens
tgcatttatatgt

SEQ ID NO: 6504521 - DNA, 16 bp, Homo sapiens
tgtcctctcccccttc

SEQ ID NO: 6504522 - DNA, 22 bp, Homo sapiens
tgtcctctcccccttcagctcc

SEQ ID NO: 6504523 - DNA, 20 bp, Homo sapiens
tgtcctctcccctccagcct

SEQ ID NO: 6504524 - DNA, 21 bp, Homo sapiens
tgtcctctcccctctgccctg

SEQ ID NO: 6504525 - DNA, 22 bp, Homo sapiens
tgtcctctcccctctgccctgt

SEQ ID NO: 6504526 - DNA, 23 bp, Homo sapiens
tgtcctctcccgcgggcctggac

SEQ ID NO: 6504527 - DNA, 14 bp, Homo sapiens
tgtcctctccctgc

SEQ ID NO: 6504528 - DNA, 18 bp, Homo sapiens
tgtcctctccctgccaag

SEQ ID NO: 6504529 - DNA, 15 bp, Homo sapiens
tgtcctctgctttgc

SEQ ID NO: 6504530 - DNA, 13 bp, Homo sapiens
tgtcctctgtagt

SEQ ID NO: 6504531 - DNA, 16 bp, Homo sapiens
tgtcctctgtgcccac

SEQ ID NO: 6504532 - DNA, 23 bp, Homo sapiens
tgtcctcttctgcatcttgggga

SEQ ID NO: 6504533 - DNA, 14 bp, Homo sapiens
tgtcctcttctgct

SEQ ID NO: 6504534 - DNA, 16 bp, Homo sapiens
tgtcctcttgccagct

SEQ ID NO: 6504535 - DNA, 14 bp, Homo sapiens
tgtcctcttggcca

SEQ ID NO: 6504536 - DNA, 17 bp, Homo sapiens
tgtcctctttcagaaaa

SEQ ID NO: 6504537 - DNA, 21 bp, Homo sapiens
tgtcctctttcagaaaacaga

SEQ ID NO: 6504538 - DNA, 15 bp, Homo sapiens
tgtcctctttcagct

SEQ ID NO: 6504539 - DNA, 18 bp, Homo sapiens
tgtcctctttcagctcct

SEQ ID NO: 6504540 - DNA, 23 bp, Homo sapiens
tgtcctgaaaattgtttcaagaa

SEQ ID NO: 6504541 - DNA, 22 bp, Homo sapiens
tgtcctgaaacgctcctttgtg

SEQ ID NO: 6504542 - DNA, 17 bp, Homo sapiens
tgtcctgaaagcggctg

SEQ ID NO: 6504543 - DNA, 20 bp, Homo sapiens
tgtcctgaaccgactgaccc

SEQ ID NO: 6504544 - DNA, 13 bp, Homo sapiens
tgtcctgaagctg

SEQ ID NO: 6504545 - DNA, 15 bp, Homo sapiens
tgtcctgaatccagc

SEQ ID NO: 6504546 - DNA, 22 bp, Homo sapiens
tgtcctgaatggctttgtcttg

SEQ ID NO: 6504547 - DNA, 17 bp, Homo sapiens
tgtcctgacagcactcc

SEQ ID NO: 6504548 - DNA, 22 bp, Homo sapiens
tgtcctgacagcactcctcggc

SEQ ID NO: 6504549 - DNA, 23 bp, Homo sapiens
tgtcctgaccaccctcccctctc

SEQ ID NO: 6504550 - DNA, 11 bp, Homo sapiens
tgtcctgactg

SEQ ID NO: 6504551 - DNA, 16 bp, Homo sapiens
tgtcctgactgtccta

SEQ ID NO: 6504552 - DNA, 14 bp, Homo sapiens
tgtcctgagcacca

SEQ ID NO: 6504553 - DNA, 14 bp, Homo sapiens
tgtcctgagcccca

SEQ ID NO: 6504554 - DNA, 17 bp, Homo sapiens
tgtcctgagctaacact

SEQ ID NO: 6504555 - DNA, 14 bp, Homo sapiens
tgtcctgagctcag

SEQ ID NO: 6504556 - DNA, 15 bp, Homo sapiens
tgtcctgagctcagc

SEQ ID NO: 6504557 - DNA, 16 bp, Homo sapiens
tgtcctgagctcagcg

SEQ ID NO: 6504558 - DNA, 18 bp, Homo sapiens
tgtcctgatgcttttgtc

SEQ ID NO: 6504559 - DNA, 15 bp, Homo sapiens
tgtcctgatttctac

SEQ ID NO: 6504560 - DNA, 20 bp, Homo sapiens
tgtcctgatttctacaactg

SEQ ID NO: 6504561 - DNA, 14 bp, Homo sapiens
tgtcctgatttctt

SEQ ID NO: 6504562 - DNA, 10 bp, Homo sapiens
tgtcctgcat

SEQ ID NO: 6504563 - DNA, 14 bp, Homo sapiens
tgtcctgcatgcat

SEQ ID NO: 6504564 - DNA, 16 bp, Homo sapiens
tgtcctgcatgcataa

SEQ ID NO: 6504565 - DNA, 20 bp, Homo sapiens
tgtcctgcatgtatgccatg

SEQ ID NO: 6504566 - DNA, 22 bp, Homo sapiens
tgtcctgccacccagccccagc

SEQ ID NO: 6504567 - DNA, 12 bp, Homo sapiens
tgtcctgccagc

SEQ ID NO: 6504568 - DNA, 13 bp, Homo sapiens
tgtcctgccagct

SEQ ID NO: 6504569 - DNA, 22 bp, Homo sapiens
tgtcctgccagctgccttcctc

SEQ ID NO: 6504570 - DNA, 19 bp, Homo sapiens
tgtcctgcccccaaggagg

SEQ ID NO: 6504571 - DNA, 22 bp, Homo sapiens
tgtcctgcctaaggctgaactt

SEQ ID NO: 6504572 - DNA, 13 bp, Homo sapiens
tgtcctgcctctc

SEQ ID NO: 6504573 - DNA, 19 bp, Homo sapiens
tgtcctgcctgtctgaagc

SEQ ID NO: 6504574 - DNA, 16 bp, Homo sapiens
tgtcctgctagctgtc

SEQ ID NO: 6504575 - DNA, 17 bp, Homo sapiens
tgtcctgctcacctgtg

SEQ ID NO: 6504576 - DNA, 15 bp, Homo sapiens
tgtcctgctgccctc

SEQ ID NO: 6504577 - DNA, 19 bp, Homo sapiens
tgtcctgctgccctcccac

SEQ ID NO: 6504578 - DNA, 19 bp, Homo sapiens
tgtcctgcttatacttttc

SEQ ID NO: 6504579 - DNA, 15 bp, Homo sapiens
tgtcctggcccttca

SEQ ID NO: 6504580 - DNA, 17 bp, Homo sapiens
tgtcctggcccttcagt

SEQ ID NO: 6504581 - DNA, 21 bp, Homo sapiens
tgtcctggctcccagggtcct

SEQ ID NO: 6504582 - DNA, 20 bp, Homo sapiens
tgtcctgggagtgagctggt

SEQ ID NO: 6504583 - DNA, 21 bp, Homo sapiens
tgtcctgggcctgcccctgtg

SEQ ID NO: 6504584 - DNA, 16 bp, Homo sapiens
tgtcctgggcgccctg

SEQ ID NO: 6504585 - DNA, 17 bp, Homo sapiens
tgtcctgggcgccctgg

SEQ ID NO: 6504586 - DNA, 13 bp, Homo sapiens
tgtcctgggctgg

SEQ ID NO: 6504587 - DNA, 11 bp, Homo sapiens
tgtcctggggg

SEQ ID NO: 6504588 - DNA, 22 bp, Homo sapiens
tgtcctgggggatgcaaataaa

SEQ ID NO: 6504589 - DNA, 16 bp, Homo sapiens
tgtcctggtgctctct

SEQ ID NO: 6504590 - DNA, 18 bp, Homo sapiens
tgtcctggtggctgggcc

SEQ ID NO: 6504591 - DNA, 13 bp, Homo sapiens
tgtcctggtgtca

SEQ ID NO: 6504592 - DNA, 21 bp, Homo sapiens
tgtcctggttccttcctatgc

SEQ ID NO: 6504593 - DNA, 15 bp, Homo sapiens
tgtcctgtaaacact

SEQ ID NO: 6504594 - DNA, 20 bp, Homo sapiens
tgtcctgtaaacactcagct

SEQ ID NO: 6504595 - DNA, 22 bp, Homo sapiens
tgtcctgtaaacactcagctgt

SEQ ID NO: 6504596 - DNA, 20 bp, Homo sapiens
tgtcctgtaactgttacagt

SEQ ID NO: 6504597 - DNA, 23 bp, Homo sapiens
tgtcctgtatagcaacctatttg

SEQ ID NO: 6504598 - DNA, 11 bp, Homo sapiens
tgtcctgtcct

SEQ ID NO: 6504599 - DNA, 13 bp, Homo sapiens
tgtcctgtcctgc

SEQ ID NO: 6504600 - DNA, 12 bp, Homo sapiens
tgtcctgtctgc

SEQ ID NO: 6504601 - DNA, 20 bp, Homo sapiens
tgtcctgtgaggtttcccaa

SEQ ID NO: 6504602 - DNA, 22 bp, Homo sapiens
tgtcctgtgatctgtgtacaat

SEQ ID NO: 6504603 - DNA, 13 bp, Homo sapiens
tgtcctgtgatgt

SEQ ID NO: 6504604 - DNA, 17 bp, Homo sapiens
tgtcctgtgtcagttta

SEQ ID NO: 6504605 - DNA, 21 bp, Homo sapiens
tgtcctgttaggccaactgcc

SEQ ID NO: 6504606 - DNA, 22 bp, Homo sapiens
tgtcctgttaggccaactgcct

SEQ ID NO: 6504607 - DNA, 23 bp, Homo sapiens
tgtcctgttattttttatttcca

SEQ ID NO: 6504608 - DNA, 15 bp, Homo sapiens
tgtcctgttgattaa

SEQ ID NO: 6504609 - DNA, 13 bp, Homo sapiens
tgtcctgtttctt

SEQ ID NO: 6504610 - DNA, 15 bp, Homo sapiens
tgtccttaaaatgtg

SEQ ID NO: 6504611 - DNA, 21 bp, Homo sapiens
tgtccttaacccacctctcct

SEQ ID NO: 6504612 - DNA, 16 bp, Homo sapiens
tgtccttactcagagc

SEQ ID NO: 6504613 - DNA, 20 bp, Homo sapiens
tgtccttactcagagctgcg

SEQ ID NO: 6504614 - DNA, 18 bp, Homo sapiens
tgtccttagaacatttta

SEQ ID NO: 6504615 - DNA, 11 bp, Homo sapiens
tgtccttagca

SEQ ID NO: 6504616 - DNA, 14 bp, Homo sapiens
tgtccttagcctgg

SEQ ID NO: 6504617 - DNA, 23 bp, Homo sapiens
tgtccttagcctggacctctgac

SEQ ID NO: 6504618 - DNA, 20 bp, Homo sapiens
tgtccttagtgtataaaaac

SEQ ID NO: 6504619 - DNA, 14 bp, Homo sapiens
tgtccttcagagct

SEQ ID NO: 6504620 - DNA, 18 bp, Homo sapiens
tgtccttcagagctcttc

SEQ ID NO: 6504621 - DNA, 22 bp, Homo sapiens
tgtccttcattccgttaggaat

SEQ ID NO: 6504622 - DNA, 19 bp, Homo sapiens
tgtccttccattttcattc

SEQ ID NO: 6504623 - DNA, 20 bp, Homo sapiens
tgtccttcccacggccactg

SEQ ID NO: 6504624 - DNA, 12 bp, Homo sapiens
tgtccttccctg

SEQ ID NO: 6504625 - DNA, 19 bp, Homo sapiens
tgtccttccctgttctccc

SEQ ID NO: 6504626 - DNA, 22 bp, Homo sapiens
tgtccttctacagaacctgagg

SEQ ID NO: 6504627 - DNA, 11 bp, Homo sapiens
tgtccttctcc

SEQ ID NO: 6504628 - DNA, 12 bp, Homo sapiens
tgtccttctcct

SEQ ID NO: 6504629 - DNA, 13 bp, Homo sapiens
tgtccttcttcct

SEQ ID NO: 6504630 - DNA, 14 bp, Homo sapiens
tgtccttcttcctc

SEQ ID NO: 6504631 - DNA, 23 bp, Homo sapiens
tgtccttgaacccaacagtccct

SEQ ID NO: 6504632 - DNA, 15 bp, Homo sapiens
tgtccttgaactgag

SEQ ID NO: 6504633 - DNA, 18 bp, Homo sapiens
tgtccttgaactgaggcc

SEQ ID NO: 6504634 - DNA, 17 bp, Homo sapiens
tgtccttgaagcttgta

SEQ ID NO: 6504635 - DNA, 20 bp, Homo sapiens
tgtccttgaaggactaatag

SEQ ID NO: 6504636 - DNA, 17 bp, Homo sapiens
tgtccttgaatgccata

SEQ ID NO: 6504637 - DNA, 16 bp, Homo sapiens
tgtccttgcacctgca

SEQ ID NO: 6504638 - DNA, 17 bp, Homo sapiens
tgtccttgccccactcc

SEQ ID NO: 6504639 - DNA, 18 bp, Homo sapiens
tgtccttggaagtttcat

SEQ ID NO: 6504640 - DNA, 21 bp, Homo sapiens
tgtccttggcaactttcttct

SEQ ID NO: 6504641 - DNA, 14 bp, Homo sapiens
tgtccttgtgcatg

SEQ ID NO: 6504642 - DNA, 22 bp, Homo sapiens
tgtccttgtgtatcctgacagc

SEQ ID NO: 6504643 - DNA, 15 bp, Homo sapiens
tgtccttgtgtgttt

SEQ ID NO: 6504644 - DNA, 16 bp, Homo sapiens
tgtcctttaaaaaaga

SEQ ID NO: 6504645 - DNA, 18 bp, Homo sapiens
tgtcctttaaaaaagaaa

SEQ ID NO: 6504646 - DNA, 16 bp, Homo sapiens
tgtcctttaatatttg

SEQ ID NO: 6504647 - DNA, 19 bp, Homo sapiens
tgtcctttaccaaagatga

SEQ ID NO: 6504648 - DNA, 21 bp, Homo sapiens
tgtcctttaccaaagatgaat

SEQ ID NO: 6504649 - DNA, 17 bp, Homo sapiens
tgtcctttccctccact

SEQ ID NO: 6504650 - DNA, 16 bp, Homo sapiens
tgtcctttccctggag

SEQ ID NO: 6504651 - DNA, 13 bp, Homo sapiens
tgtcctttccctt

SEQ ID NO: 6504652 - DNA, 14 bp, Homo sapiens
tgtcctttcccttc

SEQ ID NO: 6504653 - DNA, 14 bp, Homo sapiens
tgtcctttctagag

SEQ ID NO: 6504654 - DNA, 16 bp, Homo sapiens
tgtcctttctcagagg

SEQ ID NO: 6504655 - DNA, 13 bp, Homo sapiens
tgtcctttctcca

SEQ ID NO: 6504656 - DNA, 14 bp, Homo sapiens
tgtcctttctccag

SEQ ID NO: 6504657 - DNA, 18 bp, Homo sapiens
tgtcctttctccaggccc

SEQ ID NO: 6504658 - DNA, 18 bp, Homo sapiens
tgtcctttctctctaatt

SEQ ID NO: 6504659 - DNA, 19 bp, Homo sapiens
tgtcctttgagaaagaaat

SEQ ID NO: 6504660 - DNA, 20 bp, Homo sapiens
tgtcctttgagaaagaaata

SEQ ID NO: 6504661 - DNA, 21 bp, Homo sapiens
tgtcctttggtactatggtgt

SEQ ID NO: 6504662 - DNA, 15 bp, Homo sapiens
tgtccttttatttct

SEQ ID NO: 6504663 - DNA, 17 bp, Homo sapiens
tgtccttttatttctcc

SEQ ID NO: 6504664 - DNA, 21 bp, Homo sapiens
tgtccttttcccccagcacct

SEQ ID NO: 6504665 - DNA, 15 bp, Homo sapiens
tgtccttttgcaaag

SEQ ID NO: 6504666 - DNA, 16 bp, Homo sapiens
tgtccttttgctcttc

SEQ ID NO: 6504667 - DNA, 16 bp, Homo sapiens
tgtccttttgtcttct

SEQ ID NO: 6504668 - DNA, 18 bp, Homo sapiens
tgtcctttttcctctcca

SEQ ID NO: 6504669 - DNA, 19 bp, Homo sapiens
tgtcgaattcctactgaca

SEQ ID NO: 6504670 - DNA, 21 bp, Homo sapiens
tgtcgaatttttattatttgt

SEQ ID NO: 6504671 - DNA, 15 bp, Homo sapiens
tgtcgacatgttttt

SEQ ID NO: 6504672 - DNA, 15 bp, Homo sapiens
tgtcgagacacttgc

SEQ ID NO: 6504673 - DNA, 23 bp, Homo sapiens
tgtcgaggccacattgctggctg

SEQ ID NO: 6504674 - DNA, 17 bp, Homo sapiens
tgtcgatgagactgttt

SEQ ID NO: 6504675 - DNA, 18 bp, Homo sapiens
tgtcgatgagactgttta

SEQ ID NO: 6504676 - DNA, 14 bp, Homo sapiens
tgtcgatgcacagt

SEQ ID NO: 6504677 - DNA, 18 bp, Homo sapiens
tgtcgattagactggaca

SEQ ID NO: 6504678 - DNA, 20 bp, Homo sapiens
tgtcgattagactggacagc

SEQ ID NO: 6504679 - DNA, 14 bp, Homo sapiens
tgtcgattttcaat

SEQ ID NO: 6504680 - DNA, 12 bp, Homo sapiens
tgtcgcacaatg

SEQ ID NO: 6504681 - DNA, 18 bp, Homo sapiens
tgtcgcccacccagctgg

SEQ ID NO: 6504682 - DNA, 21 bp, Homo sapiens
tgtcgcccacccagctggtcc

SEQ ID NO: 6504683 - DNA, 15 bp, Homo sapiens
tgtcgcccagtctgg

SEQ ID NO: 6504684 - DNA, 19 bp, Homo sapiens
tgtcgccccaggccctccc

SEQ ID NO: 6504685 - DNA, 21 bp, Homo sapiens
tgtcgccccaggccctccctg

SEQ ID NO: 6504686 - DNA, 23 bp, Homo sapiens
tgtcgccccaggccctccctgac

SEQ ID NO: 6504687 - DNA, 22 bp, Homo sapiens
tgtcgcctctcactctggcagc

SEQ ID NO: 6504688 - DNA, 14 bp, Homo sapiens
tgtcgcctctgcat

SEQ ID NO: 6504689 - DNA, 14 bp, Homo sapiens
tgtcgcctgacagc

SEQ ID NO: 6504690 - DNA, 14 bp, Homo sapiens
tgtcgcgccttctc

SEQ ID NO: 6504691 - DNA, 16 bp, Homo sapiens
tgtcgctatgtgactt

SEQ ID NO: 6504692 - DNA, 22 bp, Homo sapiens
tgtcgctatgtgacttgcgctt

SEQ ID NO: 6504693 - DNA, 17 bp, Homo sapiens
tgtcgctcaggctggag

SEQ ID NO: 6504694 - DNA, 15 bp, Homo sapiens
tgtcgctcatgtgtg

SEQ ID NO: 6504695 - DNA, 17 bp, Homo sapiens
tgtcgctctgctggcct

SEQ ID NO: 6504696 - DNA, 18 bp, Homo sapiens
tgtcgctgcctccatggc

SEQ ID NO: 6504697 - DNA, 21 bp, Homo sapiens
tgtcgctgggtcctctgcagt

SEQ ID NO: 6504698 - DNA, 18 bp, Homo sapiens
tgtcgctttcccttggat

SEQ ID NO: 6504699 - DNA, 23 bp, Homo sapiens
tgtcggagcaagtttcatcagcc

SEQ ID NO: 6504700 - DNA, 13 bp, Homo sapiens
tgcatttcaaatg

SEQ ID NO: 6504701 - DNA, 16 bp, Homo sapiens
tgcatttcaaatgtta

SEQ ID NO: 6504702 - DNA, 23 bp, Homo sapiens
tgcatttcaagcagctgaagaaa

SEQ ID NO: 6504703 - DNA, 20 bp, Homo sapiens
tgcatttcaaggaacagcca

SEQ ID NO: 6504704 - DNA, 22 bp, Homo sapiens
tgcatttcagcttgaacctgct

SEQ ID NO: 6504705 - DNA, 21 bp, Homo sapiens
tgcatttcattcaaatcagtg

SEQ ID NO: 6504706 - DNA, 14 bp, Homo sapiens
tgcatttccagctg

SEQ ID NO: 6504707 - DNA, 14 bp, Homo sapiens
tgcatttcctgaca

SEQ ID NO: 6504708 - DNA, 19 bp, Homo sapiens
tgcatttctatgccatttt

SEQ ID NO: 6504709 - DNA, 21 bp, Homo sapiens
tgcatttctatgccattttta

SEQ ID NO: 6504710 - DNA, 21 bp, Homo sapiens
tgcatttctcttctcagctct

SEQ ID NO: 6504711 - DNA, 18 bp, Homo sapiens
tgcatttctgaatagaaa

SEQ ID NO: 6504712 - DNA, 19 bp, Homo sapiens
tgcatttctgaatagaaat

SEQ ID NO: 6504713 - DNA, 16 bp, Homo sapiens
tgcatttctgtatttt

SEQ ID NO: 6504714 - DNA, 12 bp, Homo sapiens
tgcatttcttgg

SEQ ID NO: 6504715 - DNA, 13 bp, Homo sapiens
tgcatttctttat

SEQ ID NO: 6504716 - DNA, 21 bp, Homo sapiens
tgcatttctttatttctgtct

SEQ ID NO: 6504717 - DNA, 21 bp, Homo sapiens
tgcatttgagagaagccacgc

SEQ ID NO: 6504718 - DNA, 23 bp, Homo sapiens
tgcatttgagagaagccacgctg

SEQ ID NO: 6504719 - DNA, 13 bp, Homo sapiens
tgcatttgaggtc

SEQ ID NO: 6504720 - DNA, 19 bp, Homo sapiens
tgcatttgaggtctgttct

SEQ ID NO: 6504721 - DNA, 18 bp, Homo sapiens
tgcatttgatagcaatgt

SEQ ID NO: 6504722 - DNA, 16 bp, Homo sapiens
tgcatttgcctgcttc

SEQ ID NO: 6504723 - DNA, 18 bp, Homo sapiens
tgcatttgcctgcttctt

SEQ ID NO: 6504724 - DNA, 16 bp, Homo sapiens
tgcatttgctgttgtt

SEQ ID NO: 6504725 - DNA, 14 bp, Homo sapiens
tgcatttgcttttg

SEQ ID NO: 6504726 - DNA, 21 bp, Homo sapiens
tgcatttggaatttttgcttg

SEQ ID NO: 6504727 - DNA, 23 bp, Homo sapiens
tgcatttggcaacccaaggaacc

SEQ ID NO: 6504728 - DNA, 21 bp, Homo sapiens
tgcatttggcaggaagatgta

SEQ ID NO: 6504729 - DNA, 17 bp, Homo sapiens
tgcatttggctggagcc

SEQ ID NO: 6504730 - DNA, 16 bp, Homo sapiens
tgcatttgggtccagg

SEQ ID NO: 6504731 - DNA, 21 bp, Homo sapiens
tgcatttggtaggaagcctga

SEQ ID NO: 6504732 - DNA, 23 bp, Homo sapiens
tgcatttggtggtttcagaaatg

SEQ ID NO: 6504733 - DNA, 16 bp, Homo sapiens
tgcatttgtaaaaatg

SEQ ID NO: 6504734 - DNA, 19 bp, Homo sapiens
tgcatttgtaaaaatgaga

SEQ ID NO: 6504735 - DNA, 18 bp, Homo sapiens
tgcatttgtaaatgctgt

SEQ ID NO: 6504736 - DNA, 15 bp, Homo sapiens
tgcatttgtctattc

SEQ ID NO: 6504737 - DNA, 22 bp, Homo sapiens
tgcatttgtgcgtatgcagtgt

SEQ ID NO: 6504738 - DNA, 23 bp, Homo sapiens
tgcatttgtggtaatctacacca

SEQ ID NO: 6504739 - DNA, 14 bp, Homo sapiens
tgcatttgtgtctg

SEQ ID NO: 6504740 - DNA, 19 bp, Homo sapiens
tgcatttgttccattaaaa

SEQ ID NO: 6504741 - DNA, 18 bp, Homo sapiens
tgcatttgtttatgtaat

SEQ ID NO: 6504742 - DNA, 19 bp, Homo sapiens
tgcatttgtttatgtaatt

SEQ ID NO: 6504743 - DNA, 22 bp, Homo sapiens
tgcatttgtttatgtaatttca

SEQ ID NO: 6504744 - DNA, 16 bp, Homo sapiens
tgcattttaaaaatga

SEQ ID NO: 6504745 - DNA, 19 bp, Homo sapiens
tgcattttaaccctatttt

SEQ ID NO: 6504746 - DNA, 17 bp, Homo sapiens
tgcattttaagcataat

SEQ ID NO: 6504747 - DNA, 21 bp, Homo sapiens
tgcattttaattttaaccaaa

SEQ ID NO: 6504748 - DNA, 16 bp, Homo sapiens
tgcattttacacattg

SEQ ID NO: 6504749 - DNA, 15 bp, Homo sapiens
tgcattttacagtat

SEQ ID NO: 6504750 - DNA, 22 bp, Homo sapiens
tgcattttacagtatcttcaaa

SEQ ID NO: 6504751 - DNA, 14 bp, Homo sapiens
tgcattttaccatc

SEQ ID NO: 6504752 - DNA, 16 bp, Homo sapiens
tgcattttcacaaatt

SEQ ID NO: 6504753 - DNA, 18 bp, Homo sapiens
tgcattttcacaacatat

SEQ ID NO: 6504754 - DNA, 15 bp, Homo sapiens
tgcattttcctcttg

SEQ ID NO: 6504755 - DNA, 20 bp, Homo sapiens
tgcattttctgaaactaatg

SEQ ID NO: 6504756 - DNA, 23 bp, Homo sapiens
tgcattttctgaaactaatgaaa

SEQ ID NO: 6504757 - DNA, 16 bp, Homo sapiens
tgcattttcttcacag

SEQ ID NO: 6504758 - DNA, 17 bp, Homo sapiens
tgcattttcttcacagt

SEQ ID NO: 6504759 - DNA, 19 bp, Homo sapiens
tgcattttcttcacagtgc

SEQ ID NO: 6504760 - DNA, 15 bp, Homo sapiens
tgcattttcttcaga

SEQ ID NO: 6504761 - DNA, 17 bp, Homo sapiens
tgcattttcttcagaat

SEQ ID NO: 6504762 - DNA, 20 bp, Homo sapiens
tgcattttcttcagaattat

SEQ ID NO: 6504763 - DNA, 19 bp, Homo sapiens
tgcattttgatattgctgt

SEQ ID NO: 6504764 - DNA, 19 bp, Homo sapiens
tgcattttgctagacagtt

SEQ ID NO: 6504765 - DNA, 13 bp, Homo sapiens
tgcattttgctat

SEQ ID NO: 6504766 - DNA, 17 bp, Homo sapiens
tgcattttgctattgta

SEQ ID NO: 6504767 - DNA, 23 bp, Homo sapiens
tgcattttggagagtttcctgaa

SEQ ID NO: 6504768 - DNA, 18 bp, Homo sapiens
tgcattttgtagcctctc

SEQ ID NO: 6504769 - DNA, 14 bp, Homo sapiens
tgcattttgtgtac

SEQ ID NO: 6504770 - DNA, 16 bp, Homo sapiens
tgcattttgtgtacag

SEQ ID NO: 6504771 - DNA, 14 bp, Homo sapiens
tgcattttgtttca

SEQ ID NO: 6504772 - DNA, 16 bp, Homo sapiens
tgcattttgtttcact

SEQ ID NO: 6504773 - DNA, 22 bp, Homo sapiens
tgcattttgtttcactctttcc

SEQ ID NO: 6504774 - DNA, 19 bp, Homo sapiens
tgcattttgtttctgtata

SEQ ID NO: 6504775 - DNA, 13 bp, Homo sapiens
tgcatttttaccc

SEQ ID NO: 6504776 - DNA, 14 bp, Homo sapiens
tgcatttttctgca

SEQ ID NO: 6504777 - DNA, 15 bp, Homo sapiens
tgcatttttctgcag

SEQ ID NO: 6504778 - DNA, 17 bp, Homo sapiens
tgcatttttctgcagaa

SEQ ID NO: 6504779 - DNA, 21 bp, Homo sapiens
tgcatttttcttatttatatc

SEQ ID NO: 6504780 - DNA, 11 bp, Homo sapiens
tgcatttttgt

SEQ ID NO: 6504781 - DNA, 15 bp, Homo sapiens
tgcatttttgtaaat

SEQ ID NO: 6504782 - DNA, 19 bp, Homo sapiens
tgcatttttgttttgaaag

SEQ ID NO: 6504783 - DNA, 19 bp, Homo sapiens
tgcattttttaaaacaaga

SEQ ID NO: 6504784 - DNA, 16 bp, Homo sapiens
tgcatttttttagttt

SEQ ID NO: 6504785 - DNA, 18 bp, Homo sapiens
tgcattttttttttcatt

SEQ ID NO: 6504786 - DNA, 16 bp, Homo sapiens
tgccaaaaaaaaaaga

SEQ ID NO: 6504787 - DNA, 20 bp, Homo sapiens
tgccaaaaaaagacagggct

SEQ ID NO: 6504788 - DNA, 17 bp, Homo sapiens
tgccaaaaactaaaatt

SEQ ID NO: 6504789 - DNA, 19 bp, Homo sapiens
tgccaaaaactaaaattca

SEQ ID NO: 6504790 - DNA, 21 bp, Homo sapiens
tgccaaaaaggatacataatg

SEQ ID NO: 6504791 - DNA, 19 bp, Homo sapiens
tgccaaaaagtgaaataat

SEQ ID NO: 6504792 - DNA, 21 bp, Homo sapiens
tgccaaaaagtgaaataatgt

SEQ ID NO: 6504793 - DNA, 22 bp, Homo sapiens
tgccaaaaagtgaaataatgtg

SEQ ID NO: 6504794 - DNA, 14 bp, Homo sapiens
tgccaaaaccaaat

SEQ ID NO: 6504795 - DNA, 14 bp, Homo sapiens
tgccaaaaccaaga

SEQ ID NO: 6504796 - DNA, 15 bp, Homo sapiens
tgccaaaaccacatg

SEQ ID NO: 6504797 - DNA, 19 bp, Homo sapiens
tgccaaaaccacatgggct

SEQ ID NO: 6504798 - DNA, 22 bp, Homo sapiens
tgccaaaaccacatgggctggg

SEQ ID NO: 6504799 - DNA, 18 bp, Homo sapiens
tgccaaaacccagctgca

SEQ ID NO: 6504800 - DNA, 22 bp, Homo sapiens
tgccaaaacccagctgcacccc

SEQ ID NO: 6504801 - DNA, 19 bp, Homo sapiens
tgccaaaagatctggggag

SEQ ID NO: 6504802 - DNA, 19 bp, Homo sapiens
tgccaaaaggccccttccc

SEQ ID NO: 6504803 - DNA, 20 bp, Homo sapiens
tgccaaaaggccccttccca

SEQ ID NO: 6504804 - DNA, 11 bp, Homo sapiens
tgccaaaataa

SEQ ID NO: 6504805 - DNA, 21 bp, Homo sapiens
tgccaaaataaagtctgtcat

SEQ ID NO: 6504806 - DNA, 23 bp, Homo sapiens
tgccaaaataaagtctgtcatgc

SEQ ID NO: 6504807 - DNA, 19 bp, Homo sapiens
tgccaaaataccagagcct

SEQ ID NO: 6504808 - DNA, 21 bp, Homo sapiens
tgccaaaataccagagccttc

SEQ ID NO: 6504809 - DNA, 15 bp, Homo sapiens
tgccaaaatattgct

SEQ ID NO: 6504810 - DNA, 19 bp, Homo sapiens
tgccaaaatcattttaatg

SEQ ID NO: 6504811 - DNA, 13 bp, Homo sapiens
tgccaaaatgcaa

SEQ ID NO: 6504812 - DNA, 14 bp, Homo sapiens
tgccaaaatgcaac

SEQ ID NO: 6504813 - DNA, 18 bp, Homo sapiens
tgccaaaatgctctagtg

SEQ ID NO: 6504814 - DNA, 18 bp, Homo sapiens
tgccaaaatgtcaatttt

SEQ ID NO: 6504815 - DNA, 19 bp, Homo sapiens
tgccaaaattcatttctaa

SEQ ID NO: 6504816 - DNA, 17 bp, Homo sapiens
tgccaaacaaaaaggtt

SEQ ID NO: 6504817 - DNA, 23 bp, Homo sapiens
tgccaaacaaaaaggttctcagg

SEQ ID NO: 6504818 - DNA, 20 bp, Homo sapiens
tgccaaacattaatgttgat

SEQ ID NO: 6504819 - DNA, 15 bp, Homo sapiens
tgccaaacccagccc

SEQ ID NO: 6504820 - DNA, 14 bp, Homo sapiens
tgccaaagatcact

SEQ ID NO: 6504821 - DNA, 16 bp, Homo sapiens
tgccaaagatgtttga

SEQ ID NO: 6504822 - DNA, 18 bp, Homo sapiens
tgccaaagatgtttgaaa

SEQ ID NO: 6504823 - DNA, 22 bp, Homo sapiens
tgccaaagcaaaagaagtaaaa

SEQ ID NO: 6504824 - DNA, 15 bp, Homo sapiens
tgccaaagcagacat

SEQ ID NO: 6504825 - DNA, 17 bp, Homo sapiens
tgccaaagcagctacaa

SEQ ID NO: 6504826 - DNA, 17 bp, Homo sapiens
tgccaaagctgctttct

SEQ ID NO: 6504827 - DNA, 18 bp, Homo sapiens
tgccaaagctgctttctt

SEQ ID NO: 6504828 - DNA, 20 bp, Homo sapiens
tgccaaagctgctttcttct

SEQ ID NO: 6504829 - DNA, 23 bp, Homo sapiens
tgccaaagctgctttcttctctg

SEQ ID NO: 6504830 - DNA, 16 bp, Homo sapiens
tgccaaagctttacta

SEQ ID NO: 6504831 - DNA, 21 bp, Homo sapiens
tgccaaagctttactactgtg

SEQ ID NO: 6504832 - DNA, 16 bp, Homo sapiens
tgccaaaggatgtgat

SEQ ID NO: 6504833 - DNA, 14 bp, Homo sapiens
tgccaaagggaaat

SEQ ID NO: 6504834 - DNA, 19 bp, Homo sapiens
tgccaaagtaaaacaatac

SEQ ID NO: 6504835 - DNA, 19 bp, Homo sapiens
tgccaaagtacagaatttg

SEQ ID NO: 6504836 - DNA, 22 bp, Homo sapiens
tgccaaagtccatttatcccaa

SEQ ID NO: 6504837 - DNA, 18 bp, Homo sapiens
tgccaaagtgcctgggaa

SEQ ID NO: 6504838 - DNA, 22 bp, Homo sapiens
tgccaaagtgcctgggaagccc

SEQ ID NO: 6504839 - DNA, 14 bp, Homo sapiens
tgccaaataaaatg

SEQ ID NO: 6504840 - DNA, 19 bp, Homo sapiens
tgccaaataaaatgtttac

SEQ ID NO: 6504841 - DNA, 20 bp, Homo sapiens
tgccaaataaagttaaaagt

SEQ ID NO: 6504842 - DNA, 13 bp, Homo sapiens
tgccaaataaatg

SEQ ID NO: 6504843 - DNA, 16 bp, Homo sapiens
tgccaaataataaaaa

SEQ ID NO: 6504844 - DNA, 19 bp, Homo sapiens
tgccaaatagccccagact

SEQ ID NO: 6504845 - DNA, 21 bp, Homo sapiens
tgccaaatagccccagactgg

SEQ ID NO: 6504846 - DNA, 18 bp, Homo sapiens
tgccaaatatgtcctggg

SEQ ID NO: 6504847 - DNA, 21 bp, Homo sapiens
tgccaaatattaagaagctca

SEQ ID NO: 6504848 - DNA, 15 bp, Homo sapiens
tgccaaatcctgggc

SEQ ID NO: 6504849 - DNA, 14 bp, Homo sapiens
tgccaaatctggct

SEQ ID NO: 6504850 - DNA, 15 bp, Homo sapiens
tgccaaatgctgggg

SEQ ID NO: 6504851 - DNA, 17 bp, Homo sapiens
tgccaaatgctggggca

SEQ ID NO: 6504852 - DNA, 18 bp, Homo sapiens
tgccaaattaaaaaagat

SEQ ID NO: 6504853 - DNA, 19 bp, Homo sapiens
tgccaaattaaaaaagata

SEQ ID NO: 6504854 - DNA, 22 bp, Homo sapiens
tgccaaattaaaaaagataaac

SEQ ID NO: 6504855 - DNA, 18 bp, Homo sapiens
tgccaaattgtagttctt

SEQ ID NO: 6504856 - DNA, 22 bp, Homo sapiens
tgccaacaaagcttacaacatt

SEQ ID NO: 6504857 - DNA, 18 bp, Homo sapiens
tgccaacaagaatgcatt

SEQ ID NO: 6504858 - DNA, 20 bp, Homo sapiens
tgccaacaatcctagtgctt

SEQ ID NO: 6504859 - DNA, 19 bp, Homo sapiens
tgccaacaccttcttggct

SEQ ID NO: 6504860 - DNA, 22 bp, Homo sapiens
tgccaacactcaagaagcaggc

SEQ ID NO: 6504861 - DNA, 20 bp, Homo sapiens
tgccaacacttaatcatttt

SEQ ID NO: 6504862 - DNA, 14 bp, Homo sapiens
tgccaacagtggct

SEQ ID NO: 6504863 - DNA, 20 bp, Homo sapiens
tgccaacagttgtatgtttg

SEQ ID NO: 6504864 - DNA, 22 bp, Homo sapiens
tgccaacagttgtatgtttgct

SEQ ID NO: 6504865 - DNA, 21 bp, Homo sapiens
tgccaacatgaggacagaagg

SEQ ID NO: 6504866 - DNA, 22 bp, Homo sapiens
tgccaacattgcctatttcagt

SEQ ID NO: 6504867 - DNA, 15 bp, Homo sapiens
tgccaaccacctctg

SEQ ID NO: 6504868 - DNA, 18 bp, Homo sapiens
tgccaaccccacccagct

SEQ ID NO: 6504869 - DNA, 19 bp, Homo sapiens
tgccaaccccacccagctc

SEQ ID NO: 6504870 - DNA, 23 bp, Homo sapiens
tgccaaccccacccagctccagg

SEQ ID NO: 6504871 - DNA, 16 bp, Homo sapiens
tgccaacctaaaactc

SEQ ID NO: 6504872 - DNA, 16 bp, Homo sapiens
tgccaacctctggagc

SEQ ID NO: 6504873 - DNA, 18 bp, Homo sapiens
tgccaacctgatgcccct

SEQ ID NO: 6504874 - DNA, 22 bp, Homo sapiens
tgccaacctgtaataaatatga

SEQ ID NO: 6504875 - DNA, 13 bp, Homo sapiens
tgccaactaagcc

SEQ ID NO: 6504876 - DNA, 14 bp, Homo sapiens
tgtcggaggaaaga

SEQ ID NO: 6504877 - DNA, 17 bp, Homo sapiens
tgtcggaggaaagacaa

SEQ ID NO: 6504878 - DNA, 14 bp, Homo sapiens
tgtcggcacattca

SEQ ID NO: 6504879 - DNA, 18 bp, Homo sapiens
tgtcggcacgtcccatgt

SEQ ID NO: 6504880 - DNA, 16 bp, Homo sapiens
tgtcggccacacccca

SEQ ID NO: 6504881 - DNA, 21 bp, Homo sapiens
tgtcggcctctaaccccaggc

SEQ ID NO: 6504882 - DNA, 23 bp, Homo sapiens
tgtcggcctctaaccccaggccc

SEQ ID NO: 6504883 - DNA, 12 bp, Homo sapiens
tgtcggctccag

SEQ ID NO: 6504884 - DNA, 23 bp, Homo sapiens
tgtcggctccagtccccagaact

SEQ ID NO: 6504885 - DNA, 13 bp, Homo sapiens
tgtcggctgtgag

SEQ ID NO: 6504886 - DNA, 15 bp, Homo sapiens
tgtcgggcatgacac

SEQ ID NO: 6504887 - DNA, 13 bp, Homo sapiens
tgtcggggcccct

SEQ ID NO: 6504888 - DNA, 16 bp, Homo sapiens
tgtcggggcccctgcg

SEQ ID NO: 6504889 - DNA, 20 bp, Homo sapiens
tgtcggggctgacctctcac

SEQ ID NO: 6504890 - DNA, 16 bp, Homo sapiens
tgtcggggttggggtg

SEQ ID NO: 6504891 - DNA, 19 bp, Homo sapiens
tgtcgtaacagcaggagca

SEQ ID NO: 6504892 - DNA, 23 bp, Homo sapiens
tgtcgtagccaaggtgggctgag

SEQ ID NO: 6504893 - DNA, 16 bp, Homo sapiens
tgtcgtccccagacca

SEQ ID NO: 6504894 - DNA, 18 bp, Homo sapiens
tgtcgtcctgcagtgtga

SEQ ID NO: 6504895 - DNA, 17 bp, Homo sapiens
tgtcgtctgactctggg

SEQ ID NO: 6504896 - DNA, 13 bp, Homo sapiens
tgtcgtctgtgaa

SEQ ID NO: 6504897 - DNA, 22 bp, Homo sapiens
tgtcgtcttgaacgagcagccc

SEQ ID NO: 6504898 - DNA, 24 bp, Homo sapiens
tgtcgtcttgaacgagcagcccag

SEQ ID NO: 6504899 - DNA, 20 bp, Homo sapiens
tgtcgtggacacacacagac

SEQ ID NO: 6504900 - DNA, 17 bp, Homo sapiens
tgtcgtggactccagct

SEQ ID NO: 6504901 - DNA, 13 bp, Homo sapiens
tgtcgtgggatgg

SEQ ID NO: 6504902 - DNA, 14 bp, Homo sapiens
tgtcgtggttctta

SEQ ID NO: 6504903 - DNA, 15 bp, Homo sapiens
tgtcgtggttcttaa

SEQ ID NO: 6504904 - DNA, 21 bp, Homo sapiens
tgtcgtggttcttaaatgttt

SEQ ID NO: 6504905 - DNA, 16 bp, Homo sapiens
tgtcgtgtctgctgtt

SEQ ID NO: 6504906 - DNA, 17 bp, Homo sapiens
tgtcgtgtctgctgttg

SEQ ID NO: 6504907 - DNA, 16 bp, Homo sapiens
tgtcgtgtttacaaaa

SEQ ID NO: 6504908 - DNA, 14 bp, Homo sapiens
tgtcgtgttttcaa

SEQ ID NO: 6504909 - DNA, 20 bp, Homo sapiens
tgtcgtgttttcaaggaaga

SEQ ID NO: 6504910 - DNA, 21 bp, Homo sapiens
tgtcgttaaaaagttgtttgt

SEQ ID NO: 6504911 - DNA, 14 bp, Homo sapiens
tgtcgttcccttgt

SEQ ID NO: 6504912 - DNA, 20 bp, Homo sapiens
tgtcgttcccttgtgtctgt

SEQ ID NO: 6504913 - DNA, 20 bp, Homo sapiens
tgtcgtttgtgaacgctgtg

SEQ ID NO: 6504914 - DNA, 14 bp, Homo sapiens
tgtctaaaaaacaa

SEQ ID NO: 6504915 - DNA, 14 bp, Homo sapiens
tgtctaaaaacatt

SEQ ID NO: 6504916 - DNA, 15 bp, Homo sapiens
tgtctaaaaaccaga

SEQ ID NO: 6504917 - DNA, 22 bp, Homo sapiens
tgtctaaaaataaaatgcattt

SEQ ID NO: 6504918 - DNA, 17 bp, Homo sapiens
tgtctaaaacaataaaa

SEQ ID NO: 6504919 - DNA, 20 bp, Homo sapiens
tgtctaaaatacttgagaaa

SEQ ID NO: 6504920 - DNA, 21 bp, Homo sapiens
tgtctaaaatacttgagaaat

SEQ ID NO: 6504921 - DNA, 17 bp, Homo sapiens
tgtctaaacaatgctga

SEQ ID NO: 6504922 - DNA, 22 bp, Homo sapiens
tgtctaaacaatgctgatttgg

SEQ ID NO: 6504923 - DNA, 11 bp, Homo sapiens
tgtctaaactg

SEQ ID NO: 6504924 - DNA, 13 bp, Homo sapiens
tgtctaaactgca

SEQ ID NO: 6504925 - DNA, 19 bp, Homo sapiens
tgtctaaagagctttagtc

SEQ ID NO: 6504926 - DNA, 13 bp, Homo sapiens
tgtctaaagcctt

SEQ ID NO: 6504927 - DNA, 23 bp, Homo sapiens
tgtctaaagccttaactaagact

SEQ ID NO: 6504928 - DNA, 16 bp, Homo sapiens
tgtctaaagtgggaaa

SEQ ID NO: 6504929 - DNA, 12 bp, Homo sapiens
tgtctaaagtgt

SEQ ID NO: 6504930 - DNA, 23 bp, Homo sapiens
tgtctaaagtgtattttcagagc

SEQ ID NO: 6504931 - DNA, 21 bp, Homo sapiens
tgtctaaccaattgtgagaat

SEQ ID NO: 6504932 - DNA, 21 bp, Homo sapiens
tgtctaaccccaggttttctg

SEQ ID NO: 6504933 - DNA, 15 bp, Homo sapiens
tgtctaacccccagc

SEQ ID NO: 6504934 - DNA, 16 bp, Homo sapiens
tgtctaacccccagct

SEQ ID NO: 6504935 - DNA, 21 bp, Homo sapiens
tgtctaacctacgaccccaga

SEQ ID NO: 6504936 - DNA, 16 bp, Homo sapiens
tgtctaagaaacattg

SEQ ID NO: 6504937 - DNA, 24 bp, Homo sapiens
tgtctaagcagttttgtaaatgta

SEQ ID NO: 6504938 - DNA, 22 bp, Homo sapiens
tgtctaaggtcacacagtatta

SEQ ID NO: 6504939 - DNA, 13 bp, Homo sapiens
tgtctaagttttg

SEQ ID NO: 6504940 - DNA, 14 bp, Homo sapiens
tgtctaatgaaacc

SEQ ID NO: 6504941 - DNA, 17 bp, Homo sapiens
tgtctaatgtattttat

SEQ ID NO: 6504942 - DNA, 13 bp, Homo sapiens
tgtctaattaaaa

SEQ ID NO: 6504943 - DNA, 19 bp, Homo sapiens
tgtctaattgcatctcaaa

SEQ ID NO: 6504944 - DNA, 13 bp, Homo sapiens
tgtctacaaatat

SEQ ID NO: 6504945 - DNA, 15 bp, Homo sapiens
tgtctacaaatataa

SEQ ID NO: 6504946 - DNA, 19 bp, Homo sapiens
tgtctacagagaacctgga

SEQ ID NO: 6504947 - DNA, 17 bp, Homo sapiens
tgtctacattaaatcac

SEQ ID NO: 6504948 - DNA, 13 bp, Homo sapiens
tgtctacatttct

SEQ ID NO: 6504949 - DNA, 14 bp, Homo sapiens
tgtctactcctcac

SEQ ID NO: 6504950 - DNA, 17 bp, Homo sapiens
tgtctactcctcacagc

SEQ ID NO: 6504951 - DNA, 22 bp, Homo sapiens
tgtctactctaggactgggccc

SEQ ID NO: 6504952 - DNA, 12 bp, Homo sapiens
tgtctactgctt

SEQ ID NO: 6504953 - DNA, 14 bp, Homo sapiens
tgtctacttgctcc

SEQ ID NO: 6504954 - DNA, 14 bp, Homo sapiens
tgtctactttctct

SEQ ID NO: 6504955 - DNA, 15 bp, Homo sapiens
tgtctactttctctt

SEQ ID NO: 6504956 - DNA, 16 bp, Homo sapiens
tgtctactttctcttg

SEQ ID NO: 6504957 - DNA, 21 bp, Homo sapiens
tgtctactttctcttgtttaa

SEQ ID NO: 6504958 - DNA, 13 bp, Homo sapiens
tgtctacttttta

SEQ ID NO: 6504959 - DNA, 14 bp, Homo sapiens
tgtctactttttaa

SEQ ID NO: 6504960 - DNA, 19 bp, Homo sapiens
tgtctagaaagtaagaaaa

SEQ ID NO: 6504961 - DNA, 21 bp, Homo sapiens
tgtctagaaagtaagaaaaca

SEQ ID NO: 6504962 - DNA, 17 bp, Homo sapiens
tgtctagaatcctgctt

SEQ ID NO: 6504963 - DNA, 18 bp, Homo sapiens
tgtctagaatcctgcttt

SEQ ID NO: 6504964 - DNA, 13 bp, Homo sapiens
tgtctagaatgtg

SEQ ID NO: 6504965 - DNA, 14 bp, Homo sapiens
tgtctagacatatt

SEQ ID NO: 6504966 - DNA, 15 bp, Homo sapiens
tgtctagactggcct

SEQ ID NO: 6504967 - DNA, 16 bp, Homo sapiens
tgtctagagcctcttg

SEQ ID NO: 6504968 - DNA, 23 bp, Homo sapiens
tgtctagaggcaacagtgttctg

SEQ ID NO: 6504969 - DNA, 22 bp, Homo sapiens
tgtctagaggtgagaccaaagg

SEQ ID NO: 6504970 - DNA, 14 bp, Homo sapiens
tgtctagataaaag

SEQ ID NO: 6504971 - DNA, 18 bp, Homo sapiens
tgtctagataacattcat

SEQ ID NO: 6504972 - DNA, 15 bp, Homo sapiens
tgtctagcacttcct

SEQ ID NO: 6504973 - DNA, 21 bp, Homo sapiens
tgtctagcacttccttgccag

SEQ ID NO: 6504974 - DNA, 17 bp, Homo sapiens
tgtctagcatgccaaca

SEQ ID NO: 6504975 - DNA, 21 bp, Homo sapiens
tgtctagcatgccaacaagaa

SEQ ID NO: 6504976 - DNA, 17 bp, Homo sapiens
tgtctagccactccctc

SEQ ID NO: 6504977 - DNA, 19 bp, Homo sapiens
tgtctagccactccctccc

SEQ ID NO: 6504978 - DNA, 17 bp, Homo sapiens
tgtctaggactgcagtg

SEQ ID NO: 6504979 - DNA, 15 bp, Homo sapiens
tgtctaggagacaga

SEQ ID NO: 6504980 - DNA, 18 bp, Homo sapiens
tgtctaggagacagagcc

SEQ ID NO: 6504981 - DNA, 19 bp, Homo sapiens
tgtctaggattttggatgt

SEQ ID NO: 6504982 - DNA, 13 bp, Homo sapiens
tgtctaggcactg

SEQ ID NO: 6504983 - DNA, 20 bp, Homo sapiens
tgtctaggctggaagagcca

SEQ ID NO: 6504984 - DNA, 21 bp, Homo sapiens
tgtctaggctggaagagccaa

SEQ ID NO: 6504985 - DNA, 23 bp, Homo sapiens
tgtctagggcagagtatgttctt

SEQ ID NO: 6504986 - DNA, 21 bp, Homo sapiens
tgtctaggtcagtacccacct

SEQ ID NO: 6504987 - DNA, 18 bp, Homo sapiens
tgtctaggttaaagctaa

SEQ ID NO: 6504988 - DNA, 18 bp, Homo sapiens
tgtctagtaattgggaaa

SEQ ID NO: 6504989 - DNA, 13 bp, Homo sapiens
tgtctagtgtatt

SEQ ID NO: 6504990 - DNA, 23 bp, Homo sapiens
tgtctagttgtttgattcagaca

SEQ ID NO: 6504991 - DNA, 14 bp, Homo sapiens
tgtctagtttccca

SEQ ID NO: 6504992 - DNA, 15 bp, Homo sapiens
tgtctagtttctagt

SEQ ID NO: 6504993 - DNA, 16 bp, Homo sapiens
tgtctagtttctagtg

SEQ ID NO: 6504994 - DNA, 15 bp, Homo sapiens
tgtctagtttgcata

SEQ ID NO: 6504995 - DNA, 16 bp, Homo sapiens
tgtctagttttctaga

SEQ ID NO: 6504996 - DNA, 17 bp, Homo sapiens
tgtctagttttctagac

SEQ ID NO: 6504997 - DNA, 16 bp, Homo sapiens
tgtctataaaagaaac

SEQ ID NO: 6504998 - DNA, 13 bp, Homo sapiens
tgtctataaagca

SEQ ID NO: 6504999 - DNA, 14 bp, Homo sapiens
tgtctataagtata

SEQ ID NO: 6505000 - DNA, 15 bp, Homo sapiens
tgtctataagtatat

SEQ ID NO: 6505001 - DNA, 13 bp, Homo sapiens
tgtctataggact

SEQ ID NO: 6505002 - DNA, 17 bp, Homo sapiens
tgtctatagttgtcagt

SEQ ID NO: 6505003 - DNA, 14 bp, Homo sapiens
tgtctatctgtgaa

SEQ ID NO: 6505004 - DNA, 21 bp, Homo sapiens
tgtctatgaactagagactct

SEQ ID NO: 6505005 - DNA, 19 bp, Homo sapiens
tgtctatgaagttgctgtt

SEQ ID NO: 6505006 - DNA, 20 bp, Homo sapiens
tgtctatgaagttgctgttt

SEQ ID NO: 6505007 - DNA, 21 bp, Homo sapiens
tgtctatgaagttgctgttta

SEQ ID NO: 6505008 - DNA, 18 bp, Homo sapiens
tgtctatgatgttgctgt

SEQ ID NO: 6505009 - DNA, 17 bp, Homo sapiens
tgtctatgattgtactt

SEQ ID NO: 6505010 - DNA, 20 bp, Homo sapiens
tgtctatgattgtactttga

SEQ ID NO: 6505011 - DNA, 21 bp, Homo sapiens
tgtctatgattgtactttgaa

SEQ ID NO: 6505012 - DNA, 15 bp, Homo sapiens
tgtctatgcagcctg

SEQ ID NO: 6505013 - DNA, 16 bp, Homo sapiens
tgtctatgctccctct

SEQ ID NO: 6505014 - DNA, 20 bp, Homo sapiens
tgtctatggatttgccttct

SEQ ID NO: 6505015 - DNA, 16 bp, Homo sapiens
tgtctatgggactcaa

SEQ ID NO: 6505016 - DNA, 16 bp, Homo sapiens
tgtctatgtgtatata

SEQ ID NO: 6505017 - DNA, 17 bp, Homo sapiens
tgtctatgtgtatatat

SEQ ID NO: 6505018 - DNA, 18 bp, Homo sapiens
tgtctatgtgtatatatt

SEQ ID NO: 6505019 - DNA, 19 bp, Homo sapiens
tgtctatgtgtatatatta

SEQ ID NO: 6505020 - DNA, 16 bp, Homo sapiens
tgtctattaaaattct

SEQ ID NO: 6505021 - DNA, 18 bp, Homo sapiens
tgtctattaaaattctga

SEQ ID NO: 6505022 - DNA, 20 bp, Homo sapiens
tgtctattatagtgaaacat

SEQ ID NO: 6505023 - DNA, 13 bp, Homo sapiens
tgtctattattat

SEQ ID NO: 6505024 - DNA, 18 bp, Homo sapiens
tgtctattccattccctt

SEQ ID NO: 6505025 - DNA, 14 bp, Homo sapiens
tgtctattctccag

SEQ ID NO: 6505026 - DNA, 16 bp, Homo sapiens
tgtctattctgagcct

SEQ ID NO: 6505027 - DNA, 17 bp, Homo sapiens
tgtctattctgagcctt

SEQ ID NO: 6505028 - DNA, 16 bp, Homo sapiens
tgtctatttaagtgca

SEQ ID NO: 6505029 - DNA, 15 bp, Homo sapiens
tgtctatttgtctct

SEQ ID NO: 6505030 - DNA, 17 bp, Homo sapiens
tgtctatttgtctctta

SEQ ID NO: 6505031 - DNA, 20 bp, Homo sapiens
tgtctcaaaaataatatact

SEQ ID NO: 6505032 - DNA, 21 bp, Homo sapiens
tgtctcaaaaataatatactt

SEQ ID NO: 6505033 - DNA, 22 bp, Homo sapiens
tgtctcaaaggagctttctcaa

SEQ ID NO: 6505034 - DNA, 20 bp, Homo sapiens
tgtctcaaccagatttattt

SEQ ID NO: 6505035 - DNA, 18 bp, Homo sapiens
tgtctcaacgcctccccc

SEQ ID NO: 6505036 - DNA, 20 bp, Homo sapiens
tgtctcaagagggcactggt

SEQ ID NO: 6505037 - DNA, 23 bp, Homo sapiens
tgtctcaagtgcaatgccccctc

SEQ ID NO: 6505038 - DNA, 22 bp, Homo sapiens
tgtctcaatagctccaagctgt

SEQ ID NO: 6505039 - DNA, 16 bp, Homo sapiens
tgtctcaatgctcata

SEQ ID NO: 6505040 - DNA, 22 bp, Homo sapiens
tgtctcaatgctcataacggat

SEQ ID NO: 6505041 - DNA, 16 bp, Homo sapiens
tgtctcacagaggcag

SEQ ID NO: 6505042 - DNA, 14 bp, Homo sapiens
tgtctcacatggga

SEQ ID NO: 6505043 - DNA, 19 bp, Homo sapiens
tgtctcacgattccagtgc

SEQ ID NO: 6505044 - DNA, 14 bp, Homo sapiens
tgtctcactgagca

SEQ ID NO: 6505045 - DNA, 21 bp, Homo sapiens
tgtctcactttactttcaagt

SEQ ID NO: 6505046 - DNA, 22 bp, Homo sapiens
tgtctcagacttttgtacatct

SEQ ID NO: 6505047 - DNA, 20 bp, Homo sapiens
tgtctcagatggtgtgtcca

SEQ ID NO: 6505048 - DNA, 15 bp, Homo sapiens
tgtctcagattggga

SEQ ID NO: 6505049 - DNA, 16 bp, Homo sapiens
tgtctcagattttatt

SEQ ID NO: 6505050 - DNA, 20 bp, Homo sapiens
tgtctcagattttattatgt

SEQ ID NO: 6505051 - DNA, 15 bp, Homo sapiens
tgtctcagcctccca

SEQ ID NO: 6505052 - DNA, 13 bp, Homo sapiens
tgtctcagcctct

SEQ ID NO: 6505053 - DNA, 15 bp, Homo sapiens
tgtctcagcctctgc

SEQ ID NO: 6505054 - DNA, 16 bp, Homo sapiens
tgtctcagccttccga

SEQ ID NO: 6505055 - DNA, 22 bp, Homo sapiens
tgccaactccatgaccaggcca

SEQ ID NO: 6505056 - DNA, 22 bp, Homo sapiens
tgccaactccatgtcagggaag

SEQ ID NO: 6505057 - DNA, 16 bp, Homo sapiens
tgccaactcgggagca

SEQ ID NO: 6505058 - DNA, 14 bp, Homo sapiens
tgccaactgaagcc

SEQ ID NO: 6505059 - DNA, 19 bp, Homo sapiens
tgccaactgaagccttctt

SEQ ID NO: 6505060 - DNA, 18 bp, Homo sapiens
tgccaactgatctgttat

SEQ ID NO: 6505061 - DNA, 18 bp, Homo sapiens
tgccaactgccaggctgc

SEQ ID NO: 6505062 - DNA, 14 bp, Homo sapiens
tgccaactggtcac

SEQ ID NO: 6505063 - DNA, 18 bp, Homo sapiens
tgccaactggtcactgtg

SEQ ID NO: 6505064 - DNA, 17 bp, Homo sapiens
tgccaactgtggctggt

SEQ ID NO: 6505065 - DNA, 21 bp, Homo sapiens
tgccaacttaagtatttacag

SEQ ID NO: 6505066 - DNA, 17 bp, Homo sapiens
tgccaacttcccacacg

SEQ ID NO: 6505067 - DNA, 16 bp, Homo sapiens
tgccaacttgccatgt

SEQ ID NO: 6505068 - DNA, 14 bp, Homo sapiens
tgccaactttccag

SEQ ID NO: 6505069 - DNA, 16 bp, Homo sapiens
tgccaactttccagac

SEQ ID NO: 6505070 - DNA, 16 bp, Homo sapiens
tgccaagaactctggg

SEQ ID NO: 6505071 - DNA, 18 bp, Homo sapiens
tgccaagaactctgggca

SEQ ID NO: 6505072 - DNA, 18 bp, Homo sapiens
tgccaagaactgaaaaca

SEQ ID NO: 6505073 - DNA, 20 bp, Homo sapiens
tgccaagaactgaaaacata

SEQ ID NO: 6505074 - DNA, 12 bp, Homo sapiens
tgccaagacaaa

SEQ ID NO: 6505075 - DNA, 16 bp, Homo sapiens
tgccaagacaaatcaa

SEQ ID NO: 6505076 - DNA, 18 bp, Homo sapiens
tgccaagactctatgctc

SEQ ID NO: 6505077 - DNA, 22 bp, Homo sapiens
tgccaagagtcaacaggtcact

SEQ ID NO: 6505078 - DNA, 22 bp, Homo sapiens
tgccaagattaccctcggtcat

SEQ ID NO: 6505079 - DNA, 23 bp, Homo sapiens
tgccaagatttaaaattaaattt

SEQ ID NO: 6505080 - DNA, 23 bp, Homo sapiens
tgccaagcaaggaaaacttattt

SEQ ID NO: 6505081 - DNA, 15 bp, Homo sapiens
tgccaagcactgtgc

SEQ ID NO: 6505082 - DNA, 22 bp, Homo sapiens
tgccaagcatttaatgtagcca

SEQ ID NO: 6505083 - DNA, 17 bp, Homo sapiens
tgccaagccctggcccc

SEQ ID NO: 6505084 - DNA, 14 bp, Homo sapiens
tgccaagccctttg

SEQ ID NO: 6505085 - DNA, 17 bp, Homo sapiens
tgccaagccctttgctg

SEQ ID NO: 6505086 - DNA, 21 bp, Homo sapiens
tgccaagccctttgctgttcg

SEQ ID NO: 6505087 - DNA, 13 bp, Homo sapiens
tgccaagccttct

SEQ ID NO: 6505088 - DNA, 22 bp, Homo sapiens
tgccaagcgagaatgcaggccc

SEQ ID NO: 6505089 - DNA, 18 bp, Homo sapiens
tgccaagctaatctgcct

SEQ ID NO: 6505090 - DNA, 14 bp, Homo sapiens
tgccaagctcacac

SEQ ID NO: 6505091 - DNA, 15 bp, Homo sapiens
tgccaagctccaagc

SEQ ID NO: 6505092 - DNA, 16 bp, Homo sapiens
tgccaagctccaagcc

SEQ ID NO: 6505093 - DNA, 23 bp, Homo sapiens
tgccaagctccaagccccatctt

SEQ ID NO: 6505094 - DNA, 15 bp, Homo sapiens
tgccaagctgaagct

SEQ ID NO: 6505095 - DNA, 16 bp, Homo sapiens
tgccaagctgaagcta

SEQ ID NO: 6505096 - DNA, 17 bp, Homo sapiens
tgccaagctgaagctac

SEQ ID NO: 6505097 - DNA, 14 bp, Homo sapiens
tgccaagcttcctg

SEQ ID NO: 6505098 - DNA, 16 bp, Homo sapiens
tgccaagcttcctgtg

SEQ ID NO: 6505099 - DNA, 20 bp, Homo sapiens
tgccaagcttcctgtgccct

SEQ ID NO: 6505100 - DNA, 22 bp, Homo sapiens
tgccaagcttgtgagagctggt

SEQ ID NO: 6505101 - DNA, 16 bp, Homo sapiens
tgccaagctttcttct

SEQ ID NO: 6505102 - DNA, 16 bp, Homo sapiens
tgccaaggcagaggcc

SEQ ID NO: 6505103 - DNA, 18 bp, Homo sapiens
tgccaaggcagaggcctg

SEQ ID NO: 6505104 - DNA, 22 bp, Homo sapiens
tgccaaggcagaggcctgggct

SEQ ID NO: 6505105 - DNA, 19 bp, Homo sapiens
tgccaaggcatccccagtg

SEQ ID NO: 6505106 - DNA, 12 bp, Homo sapiens
tgccaaggccaa

SEQ ID NO: 6505107 - DNA, 16 bp, Homo sapiens
tgccaaggccagagtg

SEQ ID NO: 6505108 - DNA, 21 bp, Homo sapiens
tgccaaggccagagtggcctg

SEQ ID NO: 6505109 - DNA, 13 bp, Homo sapiens
tgccaaggctctc

SEQ ID NO: 6505110 - DNA, 16 bp, Homo sapiens
tgccaagggccccagg

SEQ ID NO: 6505111 - DNA, 19 bp, Homo sapiens
tgccaaggtggagggaagg

SEQ ID NO: 6505112 - DNA, 15 bp, Homo sapiens
tgccaagtcctgcct

SEQ ID NO: 6505113 - DNA, 19 bp, Homo sapiens
tgccaagtggacttggagc

SEQ ID NO: 6505114 - DNA, 17 bp, Homo sapiens
tgccaagtggccctcag

SEQ ID NO: 6505115 - DNA, 20 bp, Homo sapiens
tgccaagttgctgtcactgt

SEQ ID NO: 6505116 - DNA, 17 bp, Homo sapiens
tgccaagtttttcagaa

SEQ ID NO: 6505117 - DNA, 21 bp, Homo sapiens
tgccaagtttttcagaaagtt

SEQ ID NO: 6505118 - DNA, 23 bp, Homo sapiens
tgccaataaaagttttctccaac

SEQ ID NO: 6505119 - DNA, 15 bp, Homo sapiens
tgccaataaagcttt

SEQ ID NO: 6505120 - DNA, 17 bp, Homo sapiens
tgccaataaagcttttg

SEQ ID NO: 6505121 - DNA, 21 bp, Homo sapiens
tgccaataaagcttttggaag

SEQ ID NO: 6505122 - DNA, 17 bp, Homo sapiens
tgccaataaagtgatct

SEQ ID NO: 6505123 - DNA, 20 bp, Homo sapiens
tgccaataaagtgatctgtg

SEQ ID NO: 6505124 - DNA, 13 bp, Homo sapiens
tgccaataaattc

SEQ ID NO: 6505125 - DNA, 17 bp, Homo sapiens
tgccaataaattctaaa

SEQ ID NO: 6505126 - DNA, 18 bp, Homo sapiens
tgccaataaattctaaat

SEQ ID NO: 6505127 - DNA, 13 bp, Homo sapiens
tgccaataaccaa

SEQ ID NO: 6505128 - DNA, 14 bp, Homo sapiens
tgccaataaccaag

SEQ ID NO: 6505129 - DNA, 20 bp, Homo sapiens
tgccaataaccaagtttatt

SEQ ID NO: 6505130 - DNA, 18 bp, Homo sapiens
tgccaatactagtcaccc

SEQ ID NO: 6505131 - DNA, 13 bp, Homo sapiens
tgccaatatgaca

SEQ ID NO: 6505132 - DNA, 20 bp, Homo sapiens
tgccaatatgccagcttgga

SEQ ID NO: 6505133 - DNA, 18 bp, Homo sapiens
tgccaatattaaatctgc

SEQ ID NO: 6505134 - DNA, 19 bp, Homo sapiens
tgccaatattaaatctgct

SEQ ID NO: 6505135 - DNA, 14 bp, Homo sapiens
tgccaatcaatagc

SEQ ID NO: 6505136 - DNA, 19 bp, Homo sapiens
tgccaatcggctacccctc

SEQ ID NO: 6505137 - DNA, 17 bp, Homo sapiens
tgccaatgacaggacat

SEQ ID NO: 6505138 - DNA, 18 bp, Homo sapiens
tgccaatgagtctgtaat

SEQ ID NO: 6505139 - DNA, 17 bp, Homo sapiens
tgccaatgccacagcca

SEQ ID NO: 6505140 - DNA, 22 bp, Homo sapiens
tgccaatgctacagtaataaat

SEQ ID NO: 6505141 - DNA, 17 bp, Homo sapiens
tgccaatgctgtacgta

SEQ ID NO: 6505142 - DNA, 18 bp, Homo sapiens
tgccaatggaacctcctt

SEQ ID NO: 6505143 - DNA, 19 bp, Homo sapiens
tgccaatggtgtagctgtc

SEQ ID NO: 6505144 - DNA, 17 bp, Homo sapiens
tgccaattacggtgtac

SEQ ID NO: 6505145 - DNA, 18 bp, Homo sapiens
tgccaattgctaccgaga

SEQ ID NO: 6505146 - DNA, 21 bp, Homo sapiens
tgccaatttgcacattaaatg

SEQ ID NO: 6505147 - DNA, 14 bp, Homo sapiens
tgccacaaaaatgt

SEQ ID NO: 6505148 - DNA, 16 bp, Homo sapiens
tgccacaaagctcaat

SEQ ID NO: 6505149 - DNA, 16 bp, Homo sapiens
tgccacaacagaataa

SEQ ID NO: 6505150 - DNA, 21 bp, Homo sapiens
tgccacaacagaataaagcag

SEQ ID NO: 6505151 - DNA, 23 bp, Homo sapiens
tgccacaacagaataaagcagcc

SEQ ID NO: 6505152 - DNA, 17 bp, Homo sapiens
tgccacaaccacggtca

SEQ ID NO: 6505153 - DNA, 17 bp, Homo sapiens
tgccacaaccagccagg

SEQ ID NO: 6505154 - DNA, 19 bp, Homo sapiens
tgccacaacgcctggctaa

SEQ ID NO: 6505155 - DNA, 14 bp, Homo sapiens
tgccacaagcacaa

SEQ ID NO: 6505156 - DNA, 22 bp, Homo sapiens
tgccacaaggaagaaattaact

SEQ ID NO: 6505157 - DNA, 23 bp, Homo sapiens
tgccacaaggaagaaattaactt

SEQ ID NO: 6505158 - DNA, 19 bp, Homo sapiens
tgccacaaggacttcctgt

SEQ ID NO: 6505159 - DNA, 23 bp, Homo sapiens
tgccacaatgcagttctgagcac

SEQ ID NO: 6505160 - DNA, 16 bp, Homo sapiens
tgccacaatgcctctc

SEQ ID NO: 6505161 - DNA, 14 bp, Homo sapiens
tgccacaatgtgat

SEQ ID NO: 6505162 - DNA, 23 bp, Homo sapiens
tgccacacagagtggtctttctg

SEQ ID NO: 6505163 - DNA, 23 bp, Homo sapiens
tgccacaccaagctgtgccaccc

SEQ ID NO: 6505164 - DNA, 21 bp, Homo sapiens
tgccacaccaatcagagagcc

SEQ ID NO: 6505165 - DNA, 22 bp, Homo sapiens
tgccacaccaatcagagagcct

SEQ ID NO: 6505166 - DNA, 23 bp, Homo sapiens
tgccacaccaatcagagagccta

SEQ ID NO: 6505167 - DNA, 12 bp, Homo sapiens
tgccacacccag

SEQ ID NO: 6505168 - DNA, 13 bp, Homo sapiens
tgccacaccccat

SEQ ID NO: 6505169 - DNA, 23 bp, Homo sapiens
tgccacaccccccacccctagga

SEQ ID NO: 6505170 - DNA, 17 bp, Homo sapiens
tgccacaccctccccat

SEQ ID NO: 6505171 - DNA, 18 bp, Homo sapiens
tgccacaccctccccatt

SEQ ID NO: 6505172 - DNA, 22 bp, Homo sapiens
tgccacaccctcccccgccact

SEQ ID NO: 6505173 - DNA, 19 bp, Homo sapiens
tgccacacgagaacctgaa

SEQ ID NO: 6505174 - DNA, 18 bp, Homo sapiens
tgccacacggaagcaagc

SEQ ID NO: 6505175 - DNA, 19 bp, Homo sapiens
tgccacacggaagcaagca

SEQ ID NO: 6505176 - DNA, 17 bp, Homo sapiens
tgccacactcagtcccc

SEQ ID NO: 6505177 - DNA, 21 bp, Homo sapiens
tgccacactcagtcccccacc

SEQ ID NO: 6505178 - DNA, 18 bp, Homo sapiens
tgccacactctccatcac

SEQ ID NO: 6505179 - DNA, 13 bp, Homo sapiens
tgccacactgatg

SEQ ID NO: 6505180 - DNA, 19 bp, Homo sapiens
tgccacactgatggctcaa

SEQ ID NO: 6505181 - DNA, 13 bp, Homo sapiens
tgccacacttcag

SEQ ID NO: 6505182 - DNA, 16 bp, Homo sapiens
tgccacacttcaggct

SEQ ID NO: 6505183 - DNA, 23 bp, Homo sapiens
tgccacacttcaggctcttctcc

SEQ ID NO: 6505184 - DNA, 19 bp, Homo sapiens
tgccacacttcgctcttga

SEQ ID NO: 6505185 - DNA, 21 bp, Homo sapiens
tgccacacttcgctcttgagg

SEQ ID NO: 6505186 - DNA, 21 bp, Homo sapiens
tgccacacttgtgtgccacag

SEQ ID NO: 6505187 - DNA, 17 bp, Homo sapiens
tgccacactttcactgg

SEQ ID NO: 6505188 - DNA, 11 bp, Homo sapiens
tgccacagaga

SEQ ID NO: 6505189 - DNA, 14 bp, Homo sapiens
tgccacagagaaga

SEQ ID NO: 6505190 - DNA, 15 bp, Homo sapiens
tgccacagagcgggg

SEQ ID NO: 6505191 - DNA, 12 bp, Homo sapiens
tgccacagaggc

SEQ ID NO: 6505192 - DNA, 21 bp, Homo sapiens
tgccacagaggccccacctga

SEQ ID NO: 6505193 - DNA, 19 bp, Homo sapiens
tgccacagcaaggctgtcg

SEQ ID NO: 6505194 - DNA, 14 bp, Homo sapiens
tgccacagccaagc

SEQ ID NO: 6505195 - DNA, 14 bp, Homo sapiens
tgccacagccagag

SEQ ID NO: 6505196 - DNA, 17 bp, Homo sapiens
tgccacagccagaggag

SEQ ID NO: 6505197 - DNA, 14 bp, Homo sapiens
tgccacagccccac

SEQ ID NO: 6505198 - DNA, 17 bp, Homo sapiens
tgccacagccccacagc

SEQ ID NO: 6505199 - DNA, 14 bp, Homo sapiens
tgccacagccctgt

SEQ ID NO: 6505200 - DNA, 21 bp, Homo sapiens
tgccacagccctgtcagcatg

SEQ ID NO: 6505201 - DNA, 21 bp, Homo sapiens
tgccacagcctcccctgccag

SEQ ID NO: 6505202 - DNA, 22 bp, Homo sapiens
tgccacagcctcccctgccagg

SEQ ID NO: 6505203 - DNA, 13 bp, Homo sapiens
tgccacagcctgc

SEQ ID NO: 6505204 - DNA, 16 bp, Homo sapiens
tgccacagcctgctgg

SEQ ID NO: 6505205 - DNA, 20 bp, Homo sapiens
tgccacagcctgctggcagg

SEQ ID NO: 6505206 - DNA, 21 bp, Homo sapiens
tgccacagcctgctggcaggg

SEQ ID NO: 6505207 - DNA, 13 bp, Homo sapiens
tgccacagctcaa

SEQ ID NO: 6505208 - DNA, 15 bp, Homo sapiens
tgccacagctcaact

SEQ ID NO: 6505209 - DNA, 12 bp, Homo sapiens
tgccacagctct

SEQ ID NO: 6505210 - DNA, 11 bp, Homo sapiens
tgccacagctt

SEQ ID NO: 6505211 - DNA, 13 bp, Homo sapiens
tgccacaggacac

SEQ ID NO: 6505212 - DNA, 11 bp, Homo sapiens
tgccacaggcc

SEQ ID NO: 6505213 - DNA, 12 bp, Homo sapiens
tgccacaggcct

SEQ ID NO: 6505214 - DNA, 21 bp, Homo sapiens
tgccacaggcttagggacagg

SEQ ID NO: 6505215 - DNA, 18 bp, Homo sapiens
tgccacagggtactaaaa

SEQ ID NO: 6505216 - DNA, 17 bp, Homo sapiens
tgccacagtagaactgt

SEQ ID NO: 6505217 - DNA, 17 bp, Homo sapiens
tgccacagtatattttt

SEQ ID NO: 6505218 - DNA, 17 bp, Homo sapiens
tgccacataattcatta

SEQ ID NO: 6505219 - DNA, 18 bp, Homo sapiens
tgccacataattcattaa

SEQ ID NO: 6505220 - DNA, 16 bp, Homo sapiens
tgccacatacaggtgc

SEQ ID NO: 6505221 - DNA, 21 bp, Homo sapiens
tgccacatacatagatcttca

SEQ ID NO: 6505222 - DNA, 22 bp, Homo sapiens
tgccacatcaaacctttgagta

SEQ ID NO: 6505223 - DNA, 21 bp, Homo sapiens
tgccacatctcagttatctaa

SEQ ID NO: 6505224 - DNA, 13 bp, Homo sapiens
tgccacatcttga

SEQ ID NO: 6505225 - DNA, 20 bp, Homo sapiens
tgccacatcttgaaaatgcc

SEQ ID NO: 6505226 - DNA, 15 bp, Homo sapiens
tgccacattagaact

SEQ ID NO: 6505227 - DNA, 14 bp, Homo sapiens
tgccacatttctga

SEQ ID NO: 6505228 - DNA, 15 bp, Homo sapiens
tgccacatttctgat

SEQ ID NO: 6505229 - DNA, 20 bp, Homo sapiens
tgccacatttctgatcagag

SEQ ID NO: 6505230 - DNA, 14 bp, Homo sapiens
tgccacattttctt

SEQ ID NO: 6505231 - DNA, 21 bp, Homo sapiens
tgccaccaaaagtgctcccca

SEQ ID NO: 6505232 - DNA, 18 bp, Homo sapiens
tgccaccaactggccctc

SEQ ID NO: 6505233 - DNA, 15 bp, Homo sapiens
tgtctcaggaaaaca

SEQ ID NO: 6505234 - DNA, 19 bp, Homo sapiens
tgtctcaggactctgaaaa

SEQ ID NO: 6505235 - DNA, 21 bp, Homo sapiens
tgtctcaggctcaagttttta

SEQ ID NO: 6505236 - DNA, 17 bp, Homo sapiens
tgtctcaggctgcctga

SEQ ID NO: 6505237 - DNA, 16 bp, Homo sapiens
tgtctcagtattttag

SEQ ID NO: 6505238 - DNA, 22 bp, Homo sapiens
tgtctcagtgaaggaagaacct

SEQ ID NO: 6505239 - DNA, 13 bp, Homo sapiens
tgtctcagtgatt

SEQ ID NO: 6505240 - DNA, 15 bp, Homo sapiens
tgtctcagttttcag

SEQ ID NO: 6505241 - DNA, 13 bp, Homo sapiens
tgtctcatatatt

SEQ ID NO: 6505242 - DNA, 21 bp, Homo sapiens
tgtctcatccatcatcatgtg

SEQ ID NO: 6505243 - DNA, 23 bp, Homo sapiens
tgtctcatccccaggggtcccag

SEQ ID NO: 6505244 - DNA, 22 bp, Homo sapiens
tgtctcatctagtacctttgga

SEQ ID NO: 6505245 - DNA, 18 bp, Homo sapiens
tgtctcatgccagcagca

SEQ ID NO: 6505246 - DNA, 13 bp, Homo sapiens
tgtctcatgtgtg

SEQ ID NO: 6505247 - DNA, 20 bp, Homo sapiens
tgtctcatgtgtgctcttct

SEQ ID NO: 6505248 - DNA, 21 bp, Homo sapiens
tgtctcattctcagagtaaaa

SEQ ID NO: 6505249 - DNA, 21 bp, Homo sapiens
tgtctcattgaccttcagatt

SEQ ID NO: 6505250 - DNA, 19 bp, Homo sapiens
tgtctcatttagaaacaat

SEQ ID NO: 6505251 - DNA, 15 bp, Homo sapiens
tgtctcattttggtc

SEQ ID NO: 6505252 - DNA, 19 bp, Homo sapiens
tgtctccaaccccccagca

SEQ ID NO: 6505253 - DNA, 21 bp, Homo sapiens
tgtctccaaccccccagcact

SEQ ID NO: 6505254 - DNA, 22 bp, Homo sapiens
tgtctccactaaatgagctcct

SEQ ID NO: 6505255 - DNA, 11 bp, Homo sapiens
tgtctccagac

SEQ ID NO: 6505256 - DNA, 17 bp, Homo sapiens
tgtctccagacccccac

SEQ ID NO: 6505257 - DNA, 19 bp, Homo sapiens
tgtctccagacccccaccc

SEQ ID NO: 6505258 - DNA, 20 bp, Homo sapiens
tgtctccagacccccacccc

SEQ ID NO: 6505259 - DNA, 18 bp, Homo sapiens
tgtctccagctgcctggg

SEQ ID NO: 6505260 - DNA, 21 bp, Homo sapiens
tgtctccagctgcctgggccc

SEQ ID NO: 6505261 - DNA, 20 bp, Homo sapiens
tgtctccatcgtctcatcct

SEQ ID NO: 6505262 - DNA, 23 bp, Homo sapiens
tgtctccatgaggtactggtccc

SEQ ID NO: 6505263 - DNA, 21 bp, Homo sapiens
tgtctccatgcacatgcacgc

SEQ ID NO: 6505264 - DNA, 13 bp, Homo sapiens
tgtctccatgctg

SEQ ID NO: 6505265 - DNA, 17 bp, Homo sapiens
tgtctccattgtgtgat

SEQ ID NO: 6505266 - DNA, 14 bp, Homo sapiens
tgtctccattttct

SEQ ID NO: 6505267 - DNA, 17 bp, Homo sapiens
tgtctcccaacatggga

SEQ ID NO: 6505268 - DNA, 20 bp, Homo sapiens
tgtctcccaacatgggaggg

SEQ ID NO: 6505269 - DNA, 11 bp, Homo sapiens
tgtctcccaca

SEQ ID NO: 6505270 - DNA, 15 bp, Homo sapiens
tgtctcccacaccca

SEQ ID NO: 6505271 - DNA, 23 bp, Homo sapiens
tgtctcccaccctttctgccagg

SEQ ID NO: 6505272 - DNA, 21 bp, Homo sapiens
tgtctcccagggccttaaaag

SEQ ID NO: 6505273 - DNA, 19 bp, Homo sapiens
tgtctcccctaccaggctg

SEQ ID NO: 6505274 - DNA, 23 bp, Homo sapiens
tgtctcccctgttcccctctccc

SEQ ID NO: 6505275 - DNA, 22 bp, Homo sapiens
tgtctccctcgggggctcttcc

SEQ ID NO: 6505276 - DNA, 14 bp, Homo sapiens
tgtctccctggggt

SEQ ID NO: 6505277 - DNA, 14 bp, Homo sapiens
tgtctcccttctct

SEQ ID NO: 6505278 - DNA, 16 bp, Homo sapiens
tgtctcccttctctct

SEQ ID NO: 6505279 - DNA, 18 bp, Homo sapiens
tgtctcccttctctctct

SEQ ID NO: 6505280 - DNA, 21 bp, Homo sapiens
tgtctcctaagcacctgtaat

SEQ ID NO: 6505281 - DNA, 20 bp, Homo sapiens
tgtctcctacctgctgctgc

SEQ ID NO: 6505282 - DNA, 16 bp, Homo sapiens
tgtctcctactgagga

SEQ ID NO: 6505283 - DNA, 22 bp, Homo sapiens
tgtctcctatatatttctatta

SEQ ID NO: 6505284 - DNA, 12 bp, Homo sapiens
tgtctcctatcc

SEQ ID NO: 6505285 - DNA, 13 bp, Homo sapiens
tgtctcctcaagc

SEQ ID NO: 6505286 - DNA, 17 bp, Homo sapiens
tgtctcctcaagcctgt

SEQ ID NO: 6505287 - DNA, 22 bp, Homo sapiens
tgtctcctcccaggtttcttct

SEQ ID NO: 6505288 - DNA, 23 bp, Homo sapiens
tgtctcctcccaggtttcttctc

SEQ ID NO: 6505289 - DNA, 15 bp, Homo sapiens
tgtctcctccctggg

SEQ ID NO: 6505290 - DNA, 14 bp, Homo sapiens
tgtctcctctcaga

SEQ ID NO: 6505291 - DNA, 14 bp, Homo sapiens
tgtctcctctgtca

SEQ ID NO: 6505292 - DNA, 17 bp, Homo sapiens
tgtctcctcttctttgt

SEQ ID NO: 6505293 - DNA, 14 bp, Homo sapiens
tgtctccttcccac

SEQ ID NO: 6505294 - DNA, 15 bp, Homo sapiens
tgtctccttcccact

SEQ ID NO: 6505295 - DNA, 18 bp, Homo sapiens
tgtctccttcccactgtc

SEQ ID NO: 6505296 - DNA, 19 bp, Homo sapiens
tgtctccttcccactgtcc

SEQ ID NO: 6505297 - DNA, 17 bp, Homo sapiens
tgtctccttggttatat

SEQ ID NO: 6505298 - DNA, 16 bp, Homo sapiens
tgtctcctttccactg

SEQ ID NO: 6505299 - DNA, 22 bp, Homo sapiens
tgtctcctttctgactgtccct

SEQ ID NO: 6505300 - DNA, 17 bp, Homo sapiens
tgtctcgagcgccctgc

SEQ ID NO: 6505301 - DNA, 18 bp, Homo sapiens
tgtctcgagcgccctgca

SEQ ID NO: 6505302 - DNA, 19 bp, Homo sapiens
tgtctcgcgcgactgagaa

SEQ ID NO: 6505303 - DNA, 23 bp, Homo sapiens
tgtctcgctgcatcacccaggct

SEQ ID NO: 6505304 - DNA, 19 bp, Homo sapiens
tgtctcggaacctgtgagc

SEQ ID NO: 6505305 - DNA, 15 bp, Homo sapiens
tgtctcggctctgca

SEQ ID NO: 6505306 - DNA, 14 bp, Homo sapiens
tgtctcgggctgac

SEQ ID NO: 6505307 - DNA, 14 bp, Homo sapiens
tgtctcgtttgtga

SEQ ID NO: 6505308 - DNA, 15 bp, Homo sapiens
tgtctctaaaaagaa

SEQ ID NO: 6505309 - DNA, 22 bp, Homo sapiens
tgtctctaaaaagaagccacag

SEQ ID NO: 6505310 - DNA, 15 bp, Homo sapiens
tgtctctaaccattc

SEQ ID NO: 6505311 - DNA, 19 bp, Homo sapiens
tgtctctacaaaaaataaa

SEQ ID NO: 6505312 - DNA, 22 bp, Homo sapiens
tgtctctacccactatgcacag

SEQ ID NO: 6505313 - DNA, 15 bp, Homo sapiens
tgtctctagccactt

SEQ ID NO: 6505314 - DNA, 16 bp, Homo sapiens
tgtctctagccacttt

SEQ ID NO: 6505315 - DNA, 19 bp, Homo sapiens
tgtctctagccactttggt

SEQ ID NO: 6505316 - DNA, 15 bp, Homo sapiens
tgtctctagccgggc

SEQ ID NO: 6505317 - DNA, 21 bp, Homo sapiens
tgtctctagtagtgtggcctg

SEQ ID NO: 6505318 - DNA, 18 bp, Homo sapiens
tgtctctagtttctttct

SEQ ID NO: 6505319 - DNA, 15 bp, Homo sapiens
tgtctctcccacccc

SEQ ID NO: 6505320 - DNA, 20 bp, Homo sapiens
tgtctctccccctctgtctt

SEQ ID NO: 6505321 - DNA, 16 bp, Homo sapiens
tgtctctccctaccct

SEQ ID NO: 6505322 - DNA, 13 bp, Homo sapiens
tgtctctcctgcc

SEQ ID NO: 6505323 - DNA, 22 bp, Homo sapiens
tgtctctctccatgttggcctg

SEQ ID NO: 6505324 - DNA, 12 bp, Homo sapiens
tgtctctctggg

SEQ ID NO: 6505325 - DNA, 19 bp, Homo sapiens
tgtctctcttcagactctc

SEQ ID NO: 6505326 - DNA, 18 bp, Homo sapiens
tgtctctcttctcagagt

SEQ ID NO: 6505327 - DNA, 18 bp, Homo sapiens
tgtctctcttttgctctc

SEQ ID NO: 6505328 - DNA, 16 bp, Homo sapiens
tgtctctgaagcgtga

SEQ ID NO: 6505329 - DNA, 15 bp, Homo sapiens
tgtctctgagatttt

SEQ ID NO: 6505330 - DNA, 16 bp, Homo sapiens
tgtctctgagccccct

SEQ ID NO: 6505331 - DNA, 13 bp, Homo sapiens
tgtctctgatgca

SEQ ID NO: 6505332 - DNA, 15 bp, Homo sapiens
tgtctctgcatctga

SEQ ID NO: 6505333 - DNA, 15 bp, Homo sapiens
tgtctctgccatgtg

SEQ ID NO: 6505334 - DNA, 13 bp, Homo sapiens
tgtctctgcctct

SEQ ID NO: 6505335 - DNA, 17 bp, Homo sapiens
tgtctctgcctggagca

SEQ ID NO: 6505336 - DNA, 20 bp, Homo sapiens
tgtctctgcctggagcaggg

SEQ ID NO: 6505337 - DNA, 13 bp, Homo sapiens
tgtctctgctcct

SEQ ID NO: 6505338 - DNA, 15 bp, Homo sapiens
tgtctctgcttggct

SEQ ID NO: 6505339 - DNA, 14 bp, Homo sapiens
tgtctctgctttcc

SEQ ID NO: 6505340 - DNA, 18 bp, Homo sapiens
tgtctctgctttcctttt

SEQ ID NO: 6505341 - DNA, 20 bp, Homo sapiens
tgtctctgctttccttttct

SEQ ID NO: 6505342 - DNA, 13 bp, Homo sapiens
tgtctctggcctg

SEQ ID NO: 6505343 - DNA, 14 bp, Homo sapiens
tgtctctggctact

SEQ ID NO: 6505344 - DNA, 21 bp, Homo sapiens
tgtctctggctactccctgga

SEQ ID NO: 6505345 - DNA, 22 bp, Homo sapiens
tgtctctggctactccctggac

SEQ ID NO: 6505346 - DNA, 21 bp, Homo sapiens
tgtctctgggcctgtgtgtgg

SEQ ID NO: 6505347 - DNA, 14 bp, Homo sapiens
tgtctctgggctga

SEQ ID NO: 6505348 - DNA, 17 bp, Homo sapiens
tgtctctgtggaaaagc

SEQ ID NO: 6505349 - DNA, 20 bp, Homo sapiens
tgtctctgttcagatgtgca

SEQ ID NO: 6505350 - DNA, 18 bp, Homo sapiens
tgtctcttacatctcctt

SEQ ID NO: 6505351 - DNA, 20 bp, Homo sapiens
tgtctcttatggatgtcccc

SEQ ID NO: 6505352 - DNA, 22 bp, Homo sapiens
tgtctcttatggatgtccccag

SEQ ID NO: 6505353 - DNA, 20 bp, Homo sapiens
tgtctcttcatctaatatga

SEQ ID NO: 6505354 - DNA, 21 bp, Homo sapiens
tgtctcttcctctgcaggaca

SEQ ID NO: 6505355 - DNA, 13 bp, Homo sapiens
tgtctcttctcct

SEQ ID NO: 6505356 - DNA, 14 bp, Homo sapiens
tgtctcttctcctt

SEQ ID NO: 6505357 - DNA, 16 bp, Homo sapiens
tgtctcttctgagcta

SEQ ID NO: 6505358 - DNA, 19 bp, Homo sapiens
tgtctcttcttaaccctga

SEQ ID NO: 6505359 - DNA, 13 bp, Homo sapiens
tgtctcttgaaaa

SEQ ID NO: 6505360 - DNA, 17 bp, Homo sapiens
tgtctcttgagcatcaa

SEQ ID NO: 6505361 - DNA, 17 bp, Homo sapiens
tgtctcttgcctgccac

SEQ ID NO: 6505362 - DNA, 21 bp, Homo sapiens
tgtctcttgcctgccactgtg

SEQ ID NO: 6505363 - DNA, 16 bp, Homo sapiens
tgtctcttgggaagca

SEQ ID NO: 6505364 - DNA, 18 bp, Homo sapiens
tgtctcttgggaagcagt

SEQ ID NO: 6505365 - DNA, 22 bp, Homo sapiens
tgtctcttggtcctgctgcagt

SEQ ID NO: 6505366 - DNA, 17 bp, Homo sapiens
tgtctctttaagggcat

SEQ ID NO: 6505367 - DNA, 21 bp, Homo sapiens
tgtctctttaatgtcacaggc

SEQ ID NO: 6505368 - DNA, 22 bp, Homo sapiens
tgtctctttaatgtcacaggca

SEQ ID NO: 6505369 - DNA, 18 bp, Homo sapiens
tgtctctttccactttgt

SEQ ID NO: 6505370 - DNA, 21 bp, Homo sapiens
tgtctcttttctcttttgctt

SEQ ID NO: 6505371 - DNA, 17 bp, Homo sapiens
tgtctcttttttaagtt

SEQ ID NO: 6505372 - DNA, 22 bp, Homo sapiens
tgtctgaaaaattcctttgtgt

SEQ ID NO: 6505373 - DNA, 13 bp, Homo sapiens
tgtctgaaacaga

SEQ ID NO: 6505374 - DNA, 19 bp, Homo sapiens
tgtctgaaacagagaacca

SEQ ID NO: 6505375 - DNA, 15 bp, Homo sapiens
tgtctgaaacataga

SEQ ID NO: 6505376 - DNA, 13 bp, Homo sapiens
tgtctgaaacatt

SEQ ID NO: 6505377 - DNA, 13 bp, Homo sapiens
tgtctgaaatttt

SEQ ID NO: 6505378 - DNA, 12 bp, Homo sapiens
tgtctgaacaaa

SEQ ID NO: 6505379 - DNA, 20 bp, Homo sapiens
tgtctgaacaatctccaaaa

SEQ ID NO: 6505380 - DNA, 19 bp, Homo sapiens
tgtctgaacccaggcagct

SEQ ID NO: 6505381 - DNA, 20 bp, Homo sapiens
tgtctgaacccaggcagctg

SEQ ID NO: 6505382 - DNA, 22 bp, Homo sapiens
tgtctgaagcccaaagcctgag

SEQ ID NO: 6505383 - DNA, 22 bp, Homo sapiens
tgtctgaaggacacttcctgcc

SEQ ID NO: 6505384 - DNA, 17 bp, Homo sapiens
tgtctgaagtacaaaca

SEQ ID NO: 6505385 - DNA, 19 bp, Homo sapiens
tgtctgaagtacaaacatg

SEQ ID NO: 6505386 - DNA, 17 bp, Homo sapiens
tgtctgaatcatgtctg

SEQ ID NO: 6505387 - DNA, 19 bp, Homo sapiens
tgtctgaatcatgtctgta

SEQ ID NO: 6505388 - DNA, 14 bp, Homo sapiens
tgtctgaattattc

SEQ ID NO: 6505389 - DNA, 14 bp, Homo sapiens
tgtctgaattgaga

SEQ ID NO: 6505390 - DNA, 19 bp, Homo sapiens
tgtctgaattgagaaaaga

SEQ ID NO: 6505391 - DNA, 14 bp, Homo sapiens
tgtctgacacatta

SEQ ID NO: 6505392 - DNA, 15 bp, Homo sapiens
tgtctgacagtcttt

SEQ ID NO: 6505393 - DNA, 14 bp, Homo sapiens
tgtctgacatgttt

SEQ ID NO: 6505394 - DNA, 15 bp, Homo sapiens
tgtctgaccagagaa

SEQ ID NO: 6505395 - DNA, 20 bp, Homo sapiens
tgtctgaccttccaaagact

SEQ ID NO: 6505396 - DNA, 20 bp, Homo sapiens
tgtctgacttctcaggaaga

SEQ ID NO: 6505397 - DNA, 16 bp, Homo sapiens
tgtctgacttttgtta

SEQ ID NO: 6505398 - DNA, 21 bp, Homo sapiens
tgtctgacttttgttaaattc

SEQ ID NO: 6505399 - DNA, 20 bp, Homo sapiens
tgtctgagagaccatctcct

SEQ ID NO: 6505400 - DNA, 15 bp, Homo sapiens
tgtctgagccctgcc

SEQ ID NO: 6505401 - DNA, 14 bp, Homo sapiens
tgtctgagctgctg

SEQ ID NO: 6505402 - DNA, 22 bp, Homo sapiens
tgtctgaggagtaagtgtacaa

SEQ ID NO: 6505403 - DNA, 13 bp, Homo sapiens
tgtctgaggcctc

SEQ ID NO: 6505404 - DNA, 14 bp, Homo sapiens
tgtctgaggcctca

SEQ ID NO: 6505405 - DNA, 18 bp, Homo sapiens
tgtctgaggtgacttaaa

SEQ ID NO: 6505406 - DNA, 20 bp, Homo sapiens
tgtctgagtagtggccactg

SEQ ID NO: 6505407 - DNA, 22 bp, Homo sapiens
tgtctgagtagtggccactggg

SEQ ID NO: 6505408 - DNA, 16 bp, Homo sapiens
tgtctgagtggcttca

SEQ ID NO: 6505409 - DNA, 15 bp, Homo sapiens
tgtctgagtttggta

SEQ ID NO: 6505410 - DNA, 12 bp, Homo sapiens
tgtctgatattg

SEQ ID NO: 6505411 - DNA, 20 bp, Homo sapiens
tgccaccaactggccctctt

SEQ ID NO: 6505412 - DNA, 15 bp, Homo sapiens
tgccaccaagctcac

SEQ ID NO: 6505413 - DNA, 20 bp, Homo sapiens
tgccaccaagctcacacctg

SEQ ID NO: 6505414 - DNA, 22 bp, Homo sapiens
tgccaccaagctcacacctgtc

SEQ ID NO: 6505415 - DNA, 11 bp, Homo sapiens
tgccaccaata

SEQ ID NO: 6505416 - DNA, 13 bp, Homo sapiens
tgccaccaataaa

SEQ ID NO: 6505417 - DNA, 21 bp, Homo sapiens
tgccaccaataaaaatcctac

SEQ ID NO: 6505418 - DNA, 20 bp, Homo sapiens
tgccaccaccagatgagaag

SEQ ID NO: 6505419 - DNA, 22 bp, Homo sapiens
tgccaccaccagatgagaagtt

SEQ ID NO: 6505420 - DNA, 16 bp, Homo sapiens
tgccaccacccacccc

SEQ ID NO: 6505421 - DNA, 22 bp, Homo sapiens
tgccaccacccctccctctgct

SEQ ID NO: 6505422 - DNA, 23 bp, Homo sapiens
tgccaccacccctccctctgctc

SEQ ID NO: 6505423 - DNA, 21 bp, Homo sapiens
tgccaccaccctgtcttcctc

SEQ ID NO: 6505424 - DNA, 22 bp, Homo sapiens
tgccaccaccctgtcttcctct

SEQ ID NO: 6505425 - DNA, 16 bp, Homo sapiens
tgccaccacctctgtg

SEQ ID NO: 6505426 - DNA, 18 bp, Homo sapiens
tgccaccacgtctgccag

SEQ ID NO: 6505427 - DNA, 20 bp, Homo sapiens
tgccaccacgtctgccaggc

SEQ ID NO: 6505428 - DNA, 21 bp, Homo sapiens
tgccaccacgtctgccaggcc

SEQ ID NO: 6505429 - DNA, 14 bp, Homo sapiens
tgccaccagagacc

SEQ ID NO: 6505430 - DNA, 20 bp, Homo sapiens
tgccaccagcaatgccctgc

SEQ ID NO: 6505431 - DNA, 22 bp, Homo sapiens
tgccaccagcaatgccctgcct

SEQ ID NO: 6505432 - DNA, 14 bp, Homo sapiens
tgccaccagcccct

SEQ ID NO: 6505433 - DNA, 17 bp, Homo sapiens
tgccaccaggagaacca

SEQ ID NO: 6505434 - DNA, 22 bp, Homo sapiens
tgccaccaggagaaccactaca

SEQ ID NO: 6505435 - DNA, 13 bp, Homo sapiens
tgccaccaggcca

SEQ ID NO: 6505436 - DNA, 12 bp, Homo sapiens
tgccaccaggga

SEQ ID NO: 6505437 - DNA, 19 bp, Homo sapiens
tgccaccatcctgctgctg

SEQ ID NO: 6505438 - DNA, 16 bp, Homo sapiens
tgccaccatgtattca

SEQ ID NO: 6505439 - DNA, 21 bp, Homo sapiens
tgccacccaccccaagctgct

SEQ ID NO: 6505440 - DNA, 16 bp, Homo sapiens
tgccacccacctccct

SEQ ID NO: 6505441 - DNA, 18 bp, Homo sapiens
tgccacccacctccctgc

SEQ ID NO: 6505442 - DNA, 19 bp, Homo sapiens
tgccacccactcaggattg

SEQ ID NO: 6505443 - DNA, 18 bp, Homo sapiens
tgccacccattcttcccg

SEQ ID NO: 6505444 - DNA, 14 bp, Homo sapiens
tgccaccccaaccc

SEQ ID NO: 6505445 - DNA, 17 bp, Homo sapiens
tgccaccccaccctccc

SEQ ID NO: 6505446 - DNA, 23 bp, Homo sapiens
tgccaccccaccctccctggagt

SEQ ID NO: 6505447 - DNA, 24 bp, Homo sapiens
tgccaccccaggtttttcatctga

SEQ ID NO: 6505448 - DNA, 16 bp, Homo sapiens
tgccaccccatgtgcc

SEQ ID NO: 6505449 - DNA, 13 bp, Homo sapiens
tgccacccccagc

SEQ ID NO: 6505450 - DNA, 14 bp, Homo sapiens
tgccacccccagcc

SEQ ID NO: 6505451 - DNA, 21 bp, Homo sapiens
tgccacccccagttcctatga

SEQ ID NO: 6505452 - DNA, 19 bp, Homo sapiens
tgccaccccccgccggcag

SEQ ID NO: 6505453 - DNA, 22 bp, Homo sapiens
tgccacccccttccctgggagg

SEQ ID NO: 6505454 - DNA, 21 bp, Homo sapiens
tgccacccctaaactccaggg

SEQ ID NO: 6505455 - DNA, 18 bp, Homo sapiens
tgccacccctgtccagat

SEQ ID NO: 6505456 - DNA, 14 bp, Homo sapiens
tgccaccccttcct

SEQ ID NO: 6505457 - DNA, 15 bp, Homo sapiens
tgccaccccttcctc

SEQ ID NO: 6505458 - DNA, 17 bp, Homo sapiens
tgccaccccttcctccc

SEQ ID NO: 6505459 - DNA, 18 bp, Homo sapiens
tgccaccccttggcactg

SEQ ID NO: 6505460 - DNA, 20 bp, Homo sapiens
tgccaccccttggcactgtg

SEQ ID NO: 6505461 - DNA, 17 bp, Homo sapiens
tgccacccgcccacccg

SEQ ID NO: 6505462 - DNA, 21 bp, Homo sapiens
tgccacccgtaggcagcctct

SEQ ID NO: 6505463 - DNA, 14 bp, Homo sapiens
tgccaccctacctg

SEQ ID NO: 6505464 - DNA, 17 bp, Homo sapiens
tgccaccctcatgctgt

SEQ ID NO: 6505465 - DNA, 20 bp, Homo sapiens
tgccaccctcctccctccaa

SEQ ID NO: 6505466 - DNA, 22 bp, Homo sapiens
tgccaccctctccatgcccaac

SEQ ID NO: 6505467 - DNA, 13 bp, Homo sapiens
tgccaccctctgc

SEQ ID NO: 6505468 - DNA, 16 bp, Homo sapiens
tgccaccctctgcagg

SEQ ID NO: 6505469 - DNA, 13 bp, Homo sapiens
tgccaccctctgg

SEQ ID NO: 6505470 - DNA, 14 bp, Homo sapiens
tgccaccctctggg

SEQ ID NO: 6505471 - DNA, 17 bp, Homo sapiens
tgccaccctctgggagt

SEQ ID NO: 6505472 - DNA, 15 bp, Homo sapiens
tgccaccctgctgag

SEQ ID NO: 6505473 - DNA, 17 bp, Homo sapiens
tgccaccctgggctctg

SEQ ID NO: 6505474 - DNA, 19 bp, Homo sapiens
tgccaccctgggctctgtg

SEQ ID NO: 6505475 - DNA, 21 bp, Homo sapiens
tgccaccctgggctctgtggg

SEQ ID NO: 6505476 - DNA, 17 bp, Homo sapiens
tgccaccgactgcccag

SEQ ID NO: 6505477 - DNA, 15 bp, Homo sapiens
tgccaccgccagagg

SEQ ID NO: 6505478 - DNA, 16 bp, Homo sapiens
tgccacctcccaagag

SEQ ID NO: 6505479 - DNA, 17 bp, Homo sapiens
tgccacctccccttgcc

SEQ ID NO: 6505480 - DNA, 21 bp, Homo sapiens
tgccacctccccttgccagct

SEQ ID NO: 6505481 - DNA, 18 bp, Homo sapiens
tgccacctctaacagcac

SEQ ID NO: 6505482 - DNA, 19 bp, Homo sapiens
tgccacctctaacagcacc

SEQ ID NO: 6505483 - DNA, 19 bp, Homo sapiens
tgccacctctcccagccct

SEQ ID NO: 6505484 - DNA, 19 bp, Homo sapiens
tgccacctggggcagtcac

SEQ ID NO: 6505485 - DNA, 10 bp, Homo sapiens
tgccacctgt

SEQ ID NO: 6505486 - DNA, 16 bp, Homo sapiens
tgccacctgtctgtct

SEQ ID NO: 6505487 - DNA, 21 bp, Homo sapiens
tgccacctgttaaaatgtaca

SEQ ID NO: 6505488 - DNA, 20 bp, Homo sapiens
tgccaccttgggtctgtgtc

SEQ ID NO: 6505489 - DNA, 22 bp, Homo sapiens
tgccaccttgggtctgtgtcac

SEQ ID NO: 6505490 - DNA, 16 bp, Homo sapiens
tgccaccttgtggccg

SEQ ID NO: 6505491 - DNA, 16 bp, Homo sapiens
tgccacgaatttctgt

SEQ ID NO: 6505492 - DNA, 18 bp, Homo sapiens
tgccacgcacttcctctc

SEQ ID NO: 6505493 - DNA, 20 bp, Homo sapiens
tgccacgccccgtgtctgga

SEQ ID NO: 6505494 - DNA, 15 bp, Homo sapiens
tgccacgcctggaag

SEQ ID NO: 6505495 - DNA, 15 bp, Homo sapiens
tgccacgcgctctgc

SEQ ID NO: 6505496 - DNA, 17 bp, Homo sapiens
tgccacgcgctctgcat

SEQ ID NO: 6505497 - DNA, 19 bp, Homo sapiens
tgccacgcgctctgcatgc

SEQ ID NO: 6505498 - DNA, 22 bp, Homo sapiens
tgccacgcggtacaaaggaaaa

SEQ ID NO: 6505499 - DNA, 16 bp, Homo sapiens
tgccacggcagccacc

SEQ ID NO: 6505500 - DNA, 21 bp, Homo sapiens
tgccacggcagccaccctgcc

SEQ ID NO: 6505501 - DNA, 20 bp, Homo sapiens
tgccacgggtgagagagcag

SEQ ID NO: 6505502 - DNA, 23 bp, Homo sapiens
tgccacgtgccattgtctttcct

SEQ ID NO: 6505503 - DNA, 18 bp, Homo sapiens
tgccacgtgccttaggaa

SEQ ID NO: 6505504 - DNA, 17 bp, Homo sapiens
tgccacgtggccgctgc

SEQ ID NO: 6505505 - DNA, 15 bp, Homo sapiens
tgccacgttccacag

SEQ ID NO: 6505506 - DNA, 16 bp, Homo sapiens
tgccacgttccacagt

SEQ ID NO: 6505507 - DNA, 16 bp, Homo sapiens
tgccactaacttctaa

SEQ ID NO: 6505508 - DNA, 17 bp, Homo sapiens
tgccactaacttctaaa

SEQ ID NO: 6505509 - DNA, 18 bp, Homo sapiens
tgccactaattttagtat

SEQ ID NO: 6505510 - DNA, 22 bp, Homo sapiens
tgccactacggaatagttggct

SEQ ID NO: 6505511 - DNA, 13 bp, Homo sapiens
tgccactaggccc

SEQ ID NO: 6505512 - DNA, 15 bp, Homo sapiens
tgccactaggccctg

SEQ ID NO: 6505513 - DNA, 20 bp, Homo sapiens
tgccactaggccctggtctg

SEQ ID NO: 6505514 - DNA, 16 bp, Homo sapiens
tgccactaggctgggt

SEQ ID NO: 6505515 - DNA, 22 bp, Homo sapiens
tgccactaggctgggtgcccac

SEQ ID NO: 6505516 - DNA, 15 bp, Homo sapiens
tgccactagggctct

SEQ ID NO: 6505517 - DNA, 16 bp, Homo sapiens
tgccactcacacagcc

SEQ ID NO: 6505518 - DNA, 18 bp, Homo sapiens
tgccactcacacagccag

SEQ ID NO: 6505519 - DNA, 21 bp, Homo sapiens
tgccactcacacagccaggtg

SEQ ID NO: 6505520 - DNA, 23 bp, Homo sapiens
tgccactcacacagccaggtgcc

SEQ ID NO: 6505521 - DNA, 21 bp, Homo sapiens
tgccactcacccttcctggcc

SEQ ID NO: 6505522 - DNA, 23 bp, Homo sapiens
tgccactcacccttcctggccca

SEQ ID NO: 6505523 - DNA, 14 bp, Homo sapiens
tgccactcactagg

SEQ ID NO: 6505524 - DNA, 15 bp, Homo sapiens
tgccactcactaggc

SEQ ID NO: 6505525 - DNA, 17 bp, Homo sapiens
tgccactcactaggccc

SEQ ID NO: 6505526 - DNA, 21 bp, Homo sapiens
tgccactcactaggcccccac

SEQ ID NO: 6505527 - DNA, 22 bp, Homo sapiens
tgccactcactaggcccccact

SEQ ID NO: 6505528 - DNA, 17 bp, Homo sapiens
tgccactcatactcaga

SEQ ID NO: 6505529 - DNA, 17 bp, Homo sapiens
tgccactcattcctgta

SEQ ID NO: 6505530 - DNA, 17 bp, Homo sapiens
tgccactccagtcctgc

SEQ ID NO: 6505531 - DNA, 19 bp, Homo sapiens
tgccactcccctaaactcc

SEQ ID NO: 6505532 - DNA, 14 bp, Homo sapiens
tgccactccctacc

SEQ ID NO: 6505533 - DNA, 16 bp, Homo sapiens
tgccactccctgagct

SEQ ID NO: 6505534 - DNA, 16 bp, Homo sapiens
tgccactcctcaaact

SEQ ID NO: 6505535 - DNA, 14 bp, Homo sapiens
tgccactcctccct

SEQ ID NO: 6505536 - DNA, 18 bp, Homo sapiens
tgccactcctgcttctct

SEQ ID NO: 6505537 - DNA, 14 bp, Homo sapiens
tgccactctcctga

SEQ ID NO: 6505538 - DNA, 18 bp, Homo sapiens
tgccactctcctgaggag

SEQ ID NO: 6505539 - DNA, 14 bp, Homo sapiens
tgccactctgctgc

SEQ ID NO: 6505540 - DNA, 15 bp, Homo sapiens
tgccactctgggcag

SEQ ID NO: 6505541 - DNA, 22 bp, Homo sapiens
tgccactgacaggaaagtggat

SEQ ID NO: 6505542 - DNA, 23 bp, Homo sapiens
tgccactgaccgggatccagttc

SEQ ID NO: 6505543 - DNA, 13 bp, Homo sapiens
tgccactgcaaac

SEQ ID NO: 6505544 - DNA, 20 bp, Homo sapiens
tgccactgcaaacaataaac

SEQ ID NO: 6505545 - DNA, 18 bp, Homo sapiens
tgccactgcacaccagcc

SEQ ID NO: 6505546 - DNA, 15 bp, Homo sapiens
tgccactgcactcca

SEQ ID NO: 6505547 - DNA, 16 bp, Homo sapiens
tgccactgcactccag

SEQ ID NO: 6505548 - DNA, 18 bp, Homo sapiens
tgccactgcactccagcc

SEQ ID NO: 6505549 - DNA, 15 bp, Homo sapiens
tgccactgccaggca

SEQ ID NO: 6505550 - DNA, 19 bp, Homo sapiens
tgccactgccaggcacctg

SEQ ID NO: 6505551 - DNA, 15 bp, Homo sapiens
tgccactgccataac

SEQ ID NO: 6505552 - DNA, 21 bp, Homo sapiens
tgccactgcccgagctggtgc

SEQ ID NO: 6505553 - DNA, 13 bp, Homo sapiens
tgccactgcctct

SEQ ID NO: 6505554 - DNA, 13 bp, Homo sapiens
tgccactgcctgc

SEQ ID NO: 6505555 - DNA, 16 bp, Homo sapiens
tgccactgcctgcacc

SEQ ID NO: 6505556 - DNA, 22 bp, Homo sapiens
tgccactgctgtatttttattt

SEQ ID NO: 6505557 - DNA, 20 bp, Homo sapiens
tgccactggcaaatgtaact

SEQ ID NO: 6505558 - DNA, 16 bp, Homo sapiens
tgccactgggacagct

SEQ ID NO: 6505559 - DNA, 19 bp, Homo sapiens
tgccactgggacagctggc

SEQ ID NO: 6505560 - DNA, 15 bp, Homo sapiens
tgccactgggctctg

SEQ ID NO: 6505561 - DNA, 17 bp, Homo sapiens
tgccactgggctctgga

SEQ ID NO: 6505562 - DNA, 18 bp, Homo sapiens
tgccactgggctctggac

SEQ ID NO: 6505563 - DNA, 12 bp, Homo sapiens
tgccactgtgtg

SEQ ID NO: 6505564 - DNA, 15 bp, Homo sapiens
tgccactgtgtttcc

SEQ ID NO: 6505565 - DNA, 14 bp, Homo sapiens
tgccacttaatgta

SEQ ID NO: 6505566 - DNA, 23 bp, Homo sapiens
tgccacttaatgtatgttaccaa

SEQ ID NO: 6505567 - DNA, 14 bp, Homo sapiens
tgccacttagaata

SEQ ID NO: 6505568 - DNA, 19 bp, Homo sapiens
tgccacttcaacccccagc

SEQ ID NO: 6505569 - DNA, 20 bp, Homo sapiens
tgccacttcactccagcctg

SEQ ID NO: 6505570 - DNA, 14 bp, Homo sapiens
tgccacttccagga

SEQ ID NO: 6505571 - DNA, 22 bp, Homo sapiens
tgccacttccaggagcccagag

SEQ ID NO: 6505572 - DNA, 15 bp, Homo sapiens
tgccacttcctttta

SEQ ID NO: 6505573 - DNA, 19 bp, Homo sapiens
tgccacttgacattccttg

SEQ ID NO: 6505574 - DNA, 18 bp, Homo sapiens
tgccacttggccaccagg

SEQ ID NO: 6505575 - DNA, 19 bp, Homo sapiens
tgccacttggccaccagga

SEQ ID NO: 6505576 - DNA, 21 bp, Homo sapiens
tgccacttggccaccaggact

SEQ ID NO: 6505577 - DNA, 23 bp, Homo sapiens
tgccacttgtcaaagaaggtgct

SEQ ID NO: 6505578 - DNA, 13 bp, Homo sapiens
tgccactttccac

SEQ ID NO: 6505579 - DNA, 18 bp, Homo sapiens
tgccactttccaccaact

SEQ ID NO: 6505580 - DNA, 16 bp, Homo sapiens
tgccactttgactcag

SEQ ID NO: 6505581 - DNA, 22 bp, Homo sapiens
tgccactttgactcagaggctg

SEQ ID NO: 6505582 - DNA, 12 bp, Homo sapiens
tgccactttgca

SEQ ID NO: 6505583 - DNA, 19 bp, Homo sapiens
tgccactttgcacattttg

SEQ ID NO: 6505584 - DNA, 20 bp, Homo sapiens
tgccactttgcacattttga

SEQ ID NO: 6505585 - DNA, 16 bp, Homo sapiens
tgccactttggcttct

SEQ ID NO: 6505586 - DNA, 13 bp, Homo sapiens
tgccactttttca

SEQ ID NO: 6505587 - DNA, 19 bp, Homo sapiens
tgccagaaaaaaataacta

SEQ ID NO: 6505588 - DNA, 20 bp, Homo sapiens
tgtctgatctgtgctttcca

SEQ ID NO: 6505589 - DNA, 23 bp, Homo sapiens
tgtctgatctgtgctttccagct

SEQ ID NO: 6505590 - DNA, 11 bp, Homo sapiens
tgtctgatgtg

SEQ ID NO: 6505591 - DNA, 20 bp, Homo sapiens
tgtctgatgtgtgcccagat

SEQ ID NO: 6505592 - DNA, 13 bp, Homo sapiens
tgtctgattctat

SEQ ID NO: 6505593 - DNA, 14 bp, Homo sapiens
tgtctgattctatg

SEQ ID NO: 6505594 - DNA, 15 bp, Homo sapiens
tgtctgattctatgc

SEQ ID NO: 6505595 - DNA, 16 bp, Homo sapiens
tgtctgattctatgcc

SEQ ID NO: 6505596 - DNA, 21 bp, Homo sapiens
tgtctgattggcttgtagaat

SEQ ID NO: 6505597 - DNA, 13 bp, Homo sapiens
tgtctgatttctt

SEQ ID NO: 6505598 - DNA, 13 bp, Homo sapiens
tgtctgcaacatg

SEQ ID NO: 6505599 - DNA, 14 bp, Homo sapiens
tgtctgcacagagg

SEQ ID NO: 6505600 - DNA, 14 bp, Homo sapiens
tgtctgcacccagg

SEQ ID NO: 6505601 - DNA, 15 bp, Homo sapiens
tgtctgcacccaggg

SEQ ID NO: 6505602 - DNA, 16 bp, Homo sapiens
tgtctgcacccagggg

SEQ ID NO: 6505603 - DNA, 12 bp, Homo sapiens
tgtctgcagcct

SEQ ID NO: 6505604 - DNA, 15 bp, Homo sapiens
tgtctgcagccttga

SEQ ID NO: 6505605 - DNA, 14 bp, Homo sapiens
tgtctgcagctcaa

SEQ ID NO: 6505606 - DNA, 13 bp, Homo sapiens
tgtctgcagctcc

SEQ ID NO: 6505607 - DNA, 14 bp, Homo sapiens
tgtctgcagctcct

SEQ ID NO: 6505608 - DNA, 11 bp, Homo sapiens
tgtctgcaggt

SEQ ID NO: 6505609 - DNA, 15 bp, Homo sapiens
tgtctgcagtcctgg

SEQ ID NO: 6505610 - DNA, 16 bp, Homo sapiens
tgtctgcagtgtgccc

SEQ ID NO: 6505611 - DNA, 15 bp, Homo sapiens
tgtctgccaacctaa

SEQ ID NO: 6505612 - DNA, 18 bp, Homo sapiens
tgtctgccacattaacta

SEQ ID NO: 6505613 - DNA, 13 bp, Homo sapiens
tgtctgccaggca

SEQ ID NO: 6505614 - DNA, 13 bp, Homo sapiens
tgtctgccagggc

SEQ ID NO: 6505615 - DNA, 16 bp, Homo sapiens
tgtctgccccaagttt

SEQ ID NO: 6505616 - DNA, 19 bp, Homo sapiens
tgtctgccccagcccagat

SEQ ID NO: 6505617 - DNA, 18 bp, Homo sapiens
tgtctgcccccgtcttct

SEQ ID NO: 6505618 - DNA, 21 bp, Homo sapiens
tgtctgccctctgggtccctc

SEQ ID NO: 6505619 - DNA, 16 bp, Homo sapiens
tgtctgcccttcaccc

SEQ ID NO: 6505620 - DNA, 16 bp, Homo sapiens
tgtctgccgtgagagc

SEQ ID NO: 6505621 - DNA, 23 bp, Homo sapiens
tgtctgcctatgcactgaagagc

SEQ ID NO: 6505622 - DNA, 21 bp, Homo sapiens
tgtctgcctcctgctttggga

SEQ ID NO: 6505623 - DNA, 22 bp, Homo sapiens
tgtctgcctggagtgctgtgct

SEQ ID NO: 6505624 - DNA, 15 bp, Homo sapiens
tgtctgcgaagtcct

SEQ ID NO: 6505625 - DNA, 14 bp, Homo sapiens
tgtctgcgccccgc

SEQ ID NO: 6505626 - DNA, 15 bp, Homo sapiens
tgtctgcgccgctgt

SEQ ID NO: 6505627 - DNA, 19 bp, Homo sapiens
tgtctgcgccgctgtgctg

SEQ ID NO: 6505628 - DNA, 21 bp, Homo sapiens
tgtctgcgccgctgtgctgtt

SEQ ID NO: 6505629 - DNA, 20 bp, Homo sapiens
tgtctgcggagccagcgcct

SEQ ID NO: 6505630 - DNA, 16 bp, Homo sapiens
tgtctgctaatgtaaa

SEQ ID NO: 6505631 - DNA, 17 bp, Homo sapiens
tgtctgctaccagggct

SEQ ID NO: 6505632 - DNA, 15 bp, Homo sapiens
tgtctgctctgcata

SEQ ID NO: 6505633 - DNA, 16 bp, Homo sapiens
tgtctgctgactgttt

SEQ ID NO: 6505634 - DNA, 18 bp, Homo sapiens
tgtctgctgagttggcct

SEQ ID NO: 6505635 - DNA, 13 bp, Homo sapiens
tgtctgctgcctc

SEQ ID NO: 6505636 - DNA, 14 bp, Homo sapiens
tgtctgctgcctcc

SEQ ID NO: 6505637 - DNA, 12 bp, Homo sapiens
tgtctgctggca

SEQ ID NO: 6505638 - DNA, 21 bp, Homo sapiens
tgtctgctggtcacttcttct

SEQ ID NO: 6505639 - DNA, 13 bp, Homo sapiens
tgtctgctgttgt

SEQ ID NO: 6505640 - DNA, 23 bp, Homo sapiens
tgtctgcttagtatctcatcaac

SEQ ID NO: 6505641 - DNA, 16 bp, Homo sapiens
tgtctgcttgcatctg

SEQ ID NO: 6505642 - DNA, 15 bp, Homo sapiens
tgtctgcttgtcaaa

SEQ ID NO: 6505643 - DNA, 21 bp, Homo sapiens
tgtctgctttaaagggcctgc

SEQ ID NO: 6505644 - DNA, 22 bp, Homo sapiens
tgtctgctttaaagggcctgcc

SEQ ID NO: 6505645 - DNA, 18 bp, Homo sapiens
tgtctggaagaagcagcg

SEQ ID NO: 6505646 - DNA, 15 bp, Homo sapiens
tgtctggaagatggg

SEQ ID NO: 6505647 - DNA, 16 bp, Homo sapiens
tgtctggaagctgagc

SEQ ID NO: 6505648 - DNA, 20 bp, Homo sapiens
tgtctggactagaaaatctg

SEQ ID NO: 6505649 - DNA, 14 bp, Homo sapiens
tgtctggagaataa

SEQ ID NO: 6505650 - DNA, 20 bp, Homo sapiens
tgtctggagaccaccagggc

SEQ ID NO: 6505651 - DNA, 13 bp, Homo sapiens
tgtctggagcggc

SEQ ID NO: 6505652 - DNA, 22 bp, Homo sapiens
tgtctggagtcccctcctccag

SEQ ID NO: 6505653 - DNA, 23 bp, Homo sapiens
tgtctggagtggtaacagctctc

SEQ ID NO: 6505654 - DNA, 15 bp, Homo sapiens
tgtctggatcagtaa

SEQ ID NO: 6505655 - DNA, 19 bp, Homo sapiens
tgtctggatccttcccaag

SEQ ID NO: 6505656 - DNA, 13 bp, Homo sapiens
tgtctggatgcac

SEQ ID NO: 6505657 - DNA, 18 bp, Homo sapiens
tgtctggcaaaagaaaaa

SEQ ID NO: 6505658 - DNA, 20 bp, Homo sapiens
tgtctggcaaggactttgta

SEQ ID NO: 6505659 - DNA, 16 bp, Homo sapiens
tgtctggcaatgccac

SEQ ID NO: 6505660 - DNA, 14 bp, Homo sapiens
tgtctggcagatga

SEQ ID NO: 6505661 - DNA, 15 bp, Homo sapiens
tgtctggcagatgag

SEQ ID NO: 6505662 - DNA, 15 bp, Homo sapiens
tgtctggccagggag

SEQ ID NO: 6505663 - DNA, 22 bp, Homo sapiens
tgtctggcccgcaatactgtag

SEQ ID NO: 6505664 - DNA, 14 bp, Homo sapiens
tgtctggcctgagg

SEQ ID NO: 6505665 - DNA, 18 bp, Homo sapiens
tgtctggcctgaggtcaa

SEQ ID NO: 6505666 - DNA, 19 bp, Homo sapiens
tgtctggcgttctcaagaa

SEQ ID NO: 6505667 - DNA, 17 bp, Homo sapiens
tgtctggcgttgtgggg

SEQ ID NO: 6505668 - DNA, 21 bp, Homo sapiens
tgtctggctcggacccacccc

SEQ ID NO: 6505669 - DNA, 22 bp, Homo sapiens
tgtctggctcggacccacccca

SEQ ID NO: 6505670 - DNA, 19 bp, Homo sapiens
tgtctggctgaggatttca

SEQ ID NO: 6505671 - DNA, 14 bp, Homo sapiens
tgtctggctgcaga

SEQ ID NO: 6505672 - DNA, 17 bp, Homo sapiens
tgtctggctgcagagca

SEQ ID NO: 6505673 - DNA, 20 bp, Homo sapiens
tgtctggctgtggcccctcc

SEQ ID NO: 6505674 - DNA, 15 bp, Homo sapiens
tgtctggctttcccg

SEQ ID NO: 6505675 - DNA, 17 bp, Homo sapiens
tgtctggctttggcact

SEQ ID NO: 6505676 - DNA, 18 bp, Homo sapiens
tgtctggctttggcactc

SEQ ID NO: 6505677 - DNA, 22 bp, Homo sapiens
tgtctggctttggcactctctg

SEQ ID NO: 6505678 - DNA, 15 bp, Homo sapiens
tgtctgggaagccct

SEQ ID NO: 6505679 - DNA, 12 bp, Homo sapiens
tgtctgggatcg

SEQ ID NO: 6505680 - DNA, 21 bp, Homo sapiens
tgtctgggattaagggcaaat

SEQ ID NO: 6505681 - DNA, 19 bp, Homo sapiens
tgtctgggctcaagctttc

SEQ ID NO: 6505682 - DNA, 15 bp, Homo sapiens
tgtctggggacaggc

SEQ ID NO: 6505683 - DNA, 23 bp, Homo sapiens
tgtctggggacgttgctgagcca

SEQ ID NO: 6505684 - DNA, 23 bp, Homo sapiens
tgtctggggctacagaatagggt

SEQ ID NO: 6505685 - DNA, 17 bp, Homo sapiens
tgtctggggtgagggag

SEQ ID NO: 6505686 - DNA, 19 bp, Homo sapiens
tgtctgggtcgtcttttga

SEQ ID NO: 6505687 - DNA, 12 bp, Homo sapiens
tgtctggtacta

SEQ ID NO: 6505688 - DNA, 15 bp, Homo sapiens
tgtctggtccacaca

SEQ ID NO: 6505689 - DNA, 16 bp, Homo sapiens
tgtctggtgaggtggc

SEQ ID NO: 6505690 - DNA, 20 bp, Homo sapiens
tgtctggtgaggtggcccag

SEQ ID NO: 6505691 - DNA, 21 bp, Homo sapiens
tgtctggtgcccctactggag

SEQ ID NO: 6505692 - DNA, 16 bp, Homo sapiens
tgtctggtggccccgt

SEQ ID NO: 6505693 - DNA, 16 bp, Homo sapiens
tgtctggtgtttgtca

SEQ ID NO: 6505694 - DNA, 18 bp, Homo sapiens
tgtctggtgtttgtcatg

SEQ ID NO: 6505695 - DNA, 16 bp, Homo sapiens
tgtctggttaaaaaat

SEQ ID NO: 6505696 - DNA, 23 bp, Homo sapiens
tgtctggttctcaattccaacag

SEQ ID NO: 6505697 - DNA, 15 bp, Homo sapiens
tgtctgtaaaaaatg

SEQ ID NO: 6505698 - DNA, 18 bp, Homo sapiens
tgtctgtaaaagagccta

SEQ ID NO: 6505699 - DNA, 12 bp, Homo sapiens
tgtctgtaaata

SEQ ID NO: 6505700 - DNA, 17 bp, Homo sapiens
tgtctgtaaatatgttt

SEQ ID NO: 6505701 - DNA, 13 bp, Homo sapiens
tgtctgtaatcat

SEQ ID NO: 6505702 - DNA, 20 bp, Homo sapiens
tgtctgtacacgtgtcctgt

SEQ ID NO: 6505703 - DNA, 12 bp, Homo sapiens
tgtctgtacata

SEQ ID NO: 6505704 - DNA, 19 bp, Homo sapiens
tgtctgtacatactggcct

SEQ ID NO: 6505705 - DNA, 22 bp, Homo sapiens
tgtctgtacatactggcctctg

SEQ ID NO: 6505706 - DNA, 14 bp, Homo sapiens
tgtctgtacctaaa

SEQ ID NO: 6505707 - DNA, 19 bp, Homo sapiens
tgtctgtacctaaagcaat

SEQ ID NO: 6505708 - DNA, 14 bp, Homo sapiens
tgtctgtagagaat

SEQ ID NO: 6505709 - DNA, 16 bp, Homo sapiens
tgtctgtagagggccc

SEQ ID NO: 6505710 - DNA, 14 bp, Homo sapiens
tgtctgtatttcat

SEQ ID NO: 6505711 - DNA, 17 bp, Homo sapiens
tgtctgtcaatcacagt

SEQ ID NO: 6505712 - DNA, 18 bp, Homo sapiens
tgtctgtcacaggctggg

SEQ ID NO: 6505713 - DNA, 19 bp, Homo sapiens
tgtctgtcacaggctgggt

SEQ ID NO: 6505714 - DNA, 14 bp, Homo sapiens
tgtctgtcagaaga

SEQ ID NO: 6505715 - DNA, 17 bp, Homo sapiens
tgtctgtcagaagacac

SEQ ID NO: 6505716 - DNA, 15 bp, Homo sapiens
tgtctgtcatttctc

SEQ ID NO: 6505717 - DNA, 20 bp, Homo sapiens
tgtctgtcatttctctttca

SEQ ID NO: 6505718 - DNA, 17 bp, Homo sapiens
tgtctgtccatctgtct

SEQ ID NO: 6505719 - DNA, 17 bp, Homo sapiens
tgtctgtccctaaacat

SEQ ID NO: 6505720 - DNA, 16 bp, Homo sapiens
tgtctgtcctcagagc

SEQ ID NO: 6505721 - DNA, 14 bp, Homo sapiens
tgtctgtctgtccc

SEQ ID NO: 6505722 - DNA, 15 bp, Homo sapiens
tgtctgtctgtctgt

SEQ ID NO: 6505723 - DNA, 15 bp, Homo sapiens
tgtctgtctttgcaa

SEQ ID NO: 6505724 - DNA, 11 bp, Homo sapiens
tgtctgtgcac

SEQ ID NO: 6505725 - DNA, 19 bp, Homo sapiens
tgtctgtgcacatgcctct

SEQ ID NO: 6505726 - DNA, 15 bp, Homo sapiens
tgtctgtgcagctgc

SEQ ID NO: 6505727 - DNA, 12 bp, Homo sapiens
tgtctgtgccat

SEQ ID NO: 6505728 - DNA, 16 bp, Homo sapiens
tgtctgtgccatggat

SEQ ID NO: 6505729 - DNA, 17 bp, Homo sapiens
tgtctgtgccatggccc

SEQ ID NO: 6505730 - DNA, 16 bp, Homo sapiens
tgtctgtgccatttct

SEQ ID NO: 6505731 - DNA, 20 bp, Homo sapiens
tgtctgtgccctccaaagag

SEQ ID NO: 6505732 - DNA, 20 bp, Homo sapiens
tgtctgtggatggtcattgc

SEQ ID NO: 6505733 - DNA, 21 bp, Homo sapiens
tgtctgtggatggtcattgca

SEQ ID NO: 6505734 - DNA, 15 bp, Homo sapiens
tgtctgtggattttt

SEQ ID NO: 6505735 - DNA, 19 bp, Homo sapiens
tgtctgtggcaaaagttta

SEQ ID NO: 6505736 - DNA, 13 bp, Homo sapiens
tgtctgtggggag

SEQ ID NO: 6505737 - DNA, 11 bp, Homo sapiens
tgtctgtggtc

SEQ ID NO: 6505738 - DNA, 15 bp, Homo sapiens
tgtctgtgtatacat

SEQ ID NO: 6505739 - DNA, 17 bp, Homo sapiens
tgtctgtgtgattttca

SEQ ID NO: 6505740 - DNA, 14 bp, Homo sapiens
tgtctgtgtgctac

SEQ ID NO: 6505741 - DNA, 22 bp, Homo sapiens
tgtctgtgtgctactaacagat

SEQ ID NO: 6505742 - DNA, 18 bp, Homo sapiens
tgtctgtgttgctgttta

SEQ ID NO: 6505743 - DNA, 19 bp, Homo sapiens
tgtctgtgttgctgtttag

SEQ ID NO: 6505744 - DNA, 14 bp, Homo sapiens
tgtctgtgttgctt

SEQ ID NO: 6505745 - DNA, 23 bp, Homo sapiens
tgtctgttaccatgtcactgtgg

SEQ ID NO: 6505746 - DNA, 20 bp, Homo sapiens
tgtctgttcccagcccctgc

SEQ ID NO: 6505747 - DNA, 19 bp, Homo sapiens
tgtctgttctaagtccact

SEQ ID NO: 6505748 - DNA, 13 bp, Homo sapiens
tgtctgttctaca

SEQ ID NO: 6505749 - DNA, 14 bp, Homo sapiens
tgtctgttcttcat

SEQ ID NO: 6505750 - DNA, 19 bp, Homo sapiens
tgtctgttggcaaatttgt

SEQ ID NO: 6505751 - DNA, 22 bp, Homo sapiens
tgtctgtttatatattgaaagt

SEQ ID NO: 6505752 - DNA, 20 bp, Homo sapiens
tgtctgtttattaactactg

SEQ ID NO: 6505753 - DNA, 15 bp, Homo sapiens
tgtctgtttccttct

SEQ ID NO: 6505754 - DNA, 16 bp, Homo sapiens
tgtctgtttgttctct

SEQ ID NO: 6505755 - DNA, 19 bp, Homo sapiens
tgtctgtttgtttcaagaa

SEQ ID NO: 6505756 - DNA, 23 bp, Homo sapiens
tgtctgtttgtttcaagaacctg

SEQ ID NO: 6505757 - DNA, 15 bp, Homo sapiens
tgtcttaaaaaatgt

SEQ ID NO: 6505758 - DNA, 20 bp, Homo sapiens
tgtcttaaactaaatgtgca

SEQ ID NO: 6505759 - DNA, 21 bp, Homo sapiens
tgtcttaaaggggcctgcgca

SEQ ID NO: 6505760 - DNA, 14 bp, Homo sapiens
tgtcttaaataaaa

SEQ ID NO: 6505761 - DNA, 19 bp, Homo sapiens
tgtcttaaatcagtttatt

SEQ ID NO: 6505762 - DNA, 13 bp, Homo sapiens
tgtcttaaatgct

SEQ ID NO: 6505763 - DNA, 18 bp, Homo sapiens
tgtcttaacctattccca

SEQ ID NO: 6505764 - DNA, 15 bp, Homo sapiens
tgtcttaactgtcac

SEQ ID NO: 6505765 - DNA, 15 bp, Homo sapiens
tgtcttaaggagact

SEQ ID NO: 6505766 - DNA, 13 bp, Homo sapiens
tgtcttaagtgtt

SEQ ID NO: 6505767 - DNA, 14 bp, Homo sapiens
tgtcttaagtgttt

SEQ ID NO: 6505768 - DNA, 22 bp, Homo sapiens
tgtcttaatgaagtttgaatgt

SEQ ID NO: 6505769 - DNA, 13 bp, Homo sapiens
tgccagaaacagt

SEQ ID NO: 6505770 - DNA, 20 bp, Homo sapiens
tgccagaaagagagaaccaa

SEQ ID NO: 6505771 - DNA, 13 bp, Homo sapiens
tgccagaaagtcc

SEQ ID NO: 6505772 - DNA, 21 bp, Homo sapiens
tgccagaaagtcccccctcgc

SEQ ID NO: 6505773 - DNA, 10 bp, Homo sapiens
tgccagaaga

SEQ ID NO: 6505774 - DNA, 19 bp, Homo sapiens
tgccagaagagaattcagt

SEQ ID NO: 6505775 - DNA, 14 bp, Homo sapiens
tgccagaaggaagg

SEQ ID NO: 6505776 - DNA, 20 bp, Homo sapiens
tgccagaatactgggttctt

SEQ ID NO: 6505777 - DNA, 18 bp, Homo sapiens
tgccagaatataatgtgc

SEQ ID NO: 6505778 - DNA, 22 bp, Homo sapiens
tgccagacaaataggagtgagt

SEQ ID NO: 6505779 - DNA, 14 bp, Homo sapiens
tgccagacactgag

SEQ ID NO: 6505780 - DNA, 20 bp, Homo sapiens
tgccagacactgagcttctg

SEQ ID NO: 6505781 - DNA, 15 bp, Homo sapiens
tgccagacatggacc

SEQ ID NO: 6505782 - DNA, 12 bp, Homo sapiens
tgccagacatgt

SEQ ID NO: 6505783 - DNA, 21 bp, Homo sapiens
tgccagacattgctctcagtg

SEQ ID NO: 6505784 - DNA, 17 bp, Homo sapiens
tgccagaccccctggag

SEQ ID NO: 6505785 - DNA, 13 bp, Homo sapiens
tgccagactctag

SEQ ID NO: 6505786 - DNA, 18 bp, Homo sapiens
tgccagactgaaccagag

SEQ ID NO: 6505787 - DNA, 14 bp, Homo sapiens
tgccagacttaaat

SEQ ID NO: 6505788 - DNA, 20 bp, Homo sapiens
tgccagacttctaaaataaa

SEQ ID NO: 6505789 - DNA, 11 bp, Homo sapiens
tgccagagagg

SEQ ID NO: 6505790 - DNA, 21 bp, Homo sapiens
tgccagagaggggctgctctc

SEQ ID NO: 6505791 - DNA, 17 bp, Homo sapiens
tgccagagataaactaa

SEQ ID NO: 6505792 - DNA, 19 bp, Homo sapiens
tgccagagcaaagggccag

SEQ ID NO: 6505793 - DNA, 11 bp, Homo sapiens
tgccagagcag

SEQ ID NO: 6505794 - DNA, 20 bp, Homo sapiens
tgccagagcaggagcccctg

SEQ ID NO: 6505795 - DNA, 13 bp, Homo sapiens
tgccagagcaggg

SEQ ID NO: 6505796 - DNA, 16 bp, Homo sapiens
tgccagagccaacctg

SEQ ID NO: 6505797 - DNA, 19 bp, Homo sapiens
tgccagagcccaagtgcca

SEQ ID NO: 6505798 - DNA, 20 bp, Homo sapiens
tgccagagcccaagtgccat

SEQ ID NO: 6505799 - DNA, 22 bp, Homo sapiens
tgccagagcccaagtgccatcc

SEQ ID NO: 6505800 - DNA, 12 bp, Homo sapiens
tgccagagccgg

SEQ ID NO: 6505801 - DNA, 11 bp, Homo sapiens
tgccagagcct

SEQ ID NO: 6505802 - DNA, 12 bp, Homo sapiens
tgccagagcctg

SEQ ID NO: 6505803 - DNA, 13 bp, Homo sapiens
tgccagagcctgg

SEQ ID NO: 6505804 - DNA, 23 bp, Homo sapiens
tgccagagcctggggcatcccag

SEQ ID NO: 6505805 - DNA, 20 bp, Homo sapiens
tgccagagcctggggctcta

SEQ ID NO: 6505806 - DNA, 21 bp, Homo sapiens
tgccagaggaatcctggcagc

SEQ ID NO: 6505807 - DNA, 19 bp, Homo sapiens
tgccagaggccctggaggg

SEQ ID NO: 6505808 - DNA, 12 bp, Homo sapiens
tgccagagggcc

SEQ ID NO: 6505809 - DNA, 14 bp, Homo sapiens
tgccagagggccag

SEQ ID NO: 6505810 - DNA, 17 bp, Homo sapiens
tgccagagggccagcag

SEQ ID NO: 6505811 - DNA, 19 bp, Homo sapiens
tgccagagggccagcaggc

SEQ ID NO: 6505812 - DNA, 20 bp, Homo sapiens
tgccagagggccagcaggct

SEQ ID NO: 6505813 - DNA, 14 bp, Homo sapiens
tgccagaggggaag

SEQ ID NO: 6505814 - DNA, 17 bp, Homo sapiens
tgccagaggtgggcagg

SEQ ID NO: 6505815 - DNA, 21 bp, Homo sapiens
tgccagaggtgggcaggtggt

SEQ ID NO: 6505816 - DNA, 16 bp, Homo sapiens
tgccagatataactgt

SEQ ID NO: 6505817 - DNA, 22 bp, Homo sapiens
tgccagatataactgtcttgtt

SEQ ID NO: 6505818 - DNA, 12 bp, Homo sapiens
tgccagatgctg

SEQ ID NO: 6505819 - DNA, 17 bp, Homo sapiens
tgccagatgctgatgtt

SEQ ID NO: 6505820 - DNA, 23 bp, Homo sapiens
tgccagatgtgggctcagatcct

SEQ ID NO: 6505821 - DNA, 15 bp, Homo sapiens
tgccagatgttgtct

SEQ ID NO: 6505822 - DNA, 22 bp, Homo sapiens
tgccagatgttgtctgaactaa

SEQ ID NO: 6505823 - DNA, 16 bp, Homo sapiens
tgccagattctgcctc

SEQ ID NO: 6505824 - DNA, 17 bp, Homo sapiens
tgccagattctgcctct

SEQ ID NO: 6505825 - DNA, 15 bp, Homo sapiens
tgccagattgcccca

SEQ ID NO: 6505826 - DNA, 16 bp, Homo sapiens
tgccagcaactgaata

SEQ ID NO: 6505827 - DNA, 22 bp, Homo sapiens
tgccagcaatgacatctcaggg

SEQ ID NO: 6505828 - DNA, 17 bp, Homo sapiens
tgccagcacaggggccc

SEQ ID NO: 6505829 - DNA, 20 bp, Homo sapiens
tgccagcacaggggccccag

SEQ ID NO: 6505830 - DNA, 19 bp, Homo sapiens
tgccagcaccacagccggt

SEQ ID NO: 6505831 - DNA, 14 bp, Homo sapiens
tgccagcagagcca

SEQ ID NO: 6505832 - DNA, 16 bp, Homo sapiens
tgccagcagagccagg

SEQ ID NO: 6505833 - DNA, 22 bp, Homo sapiens
tgccagcagagccagggcaggg

SEQ ID NO: 6505834 - DNA, 23 bp, Homo sapiens
tgccagcagagccagggcagggc

SEQ ID NO: 6505835 - DNA, 10 bp, Homo sapiens
tgccagcagc

SEQ ID NO: 6505836 - DNA, 12 bp, Homo sapiens
tgccagcagccc

SEQ ID NO: 6505837 - DNA, 14 bp, Homo sapiens
tgccagcagccccg

SEQ ID NO: 6505838 - DNA, 21 bp, Homo sapiens
tgccagcagctgtttctggaa

SEQ ID NO: 6505839 - DNA, 18 bp, Homo sapiens
tgccagcatggttgcaga

SEQ ID NO: 6505840 - DNA, 17 bp, Homo sapiens
tgccagcattccagact

SEQ ID NO: 6505841 - DNA, 18 bp, Homo sapiens
tgccagcattccagactt

SEQ ID NO: 6505842 - DNA, 20 bp, Homo sapiens
tgccagccaatccctggcca

SEQ ID NO: 6505843 - DNA, 11 bp, Homo sapiens
tgccagccaca

SEQ ID NO: 6505844 - DNA, 22 bp, Homo sapiens
tgccagccacccctcctctagc

SEQ ID NO: 6505845 - DNA, 15 bp, Homo sapiens
tgccagccactgtca

SEQ ID NO: 6505846 - DNA, 12 bp, Homo sapiens
tgccagccagaa

SEQ ID NO: 6505847 - DNA, 22 bp, Homo sapiens
tgccagccagaagcctctgcct

SEQ ID NO: 6505848 - DNA, 22 bp, Homo sapiens
tgccagccagcagccagctctc

SEQ ID NO: 6505849 - DNA, 23 bp, Homo sapiens
tgccagccagcagccagctctca

SEQ ID NO: 6505850 - DNA, 17 bp, Homo sapiens
tgccagcccaaagctgg

SEQ ID NO: 6505851 - DNA, 22 bp, Homo sapiens
tgccagcccaaagctggagcca

SEQ ID NO: 6505852 - DNA, 16 bp, Homo sapiens
tgccagcccaccccct

SEQ ID NO: 6505853 - DNA, 13 bp, Homo sapiens
tgccagcccagaa

SEQ ID NO: 6505854 - DNA, 15 bp, Homo sapiens
tgccagcccagaggc

SEQ ID NO: 6505855 - DNA, 13 bp, Homo sapiens
tgccagcccagct

SEQ ID NO: 6505856 - DNA, 14 bp, Homo sapiens
tgccagcccagctg

SEQ ID NO: 6505857 - DNA, 19 bp, Homo sapiens
tgccagccccctaaaagca

SEQ ID NO: 6505858 - DNA, 20 bp, Homo sapiens
tgccagccccgccacgcttg

SEQ ID NO: 6505859 - DNA, 12 bp, Homo sapiens
tgccagcccctg

SEQ ID NO: 6505860 - DNA, 14 bp, Homo sapiens
tgccagcccctgcc

SEQ ID NO: 6505861 - DNA, 16 bp, Homo sapiens
tgccagcccctgcctg

SEQ ID NO: 6505862 - DNA, 17 bp, Homo sapiens
tgccagcccctgctggc

SEQ ID NO: 6505863 - DNA, 15 bp, Homo sapiens
tgccagcccggaggg

SEQ ID NO: 6505864 - DNA, 22 bp, Homo sapiens
tgccagcccggctcggcccagc

SEQ ID NO: 6505865 - DNA, 11 bp, Homo sapiens
tgccagccctt

SEQ ID NO: 6505866 - DNA, 21 bp, Homo sapiens
tgccagcccttcaggaagcag

SEQ ID NO: 6505867 - DNA, 19 bp, Homo sapiens
tgccagccgaccctcctgg

SEQ ID NO: 6505868 - DNA, 21 bp, Homo sapiens
tgccagccgggtacctcagtt

SEQ ID NO: 6505869 - DNA, 14 bp, Homo sapiens
tgccagcctccttg

SEQ ID NO: 6505870 - DNA, 18 bp, Homo sapiens
tgccagcctgaggtgccc

SEQ ID NO: 6505871 - DNA, 15 bp, Homo sapiens
tgccagcctggcttc

SEQ ID NO: 6505872 - DNA, 16 bp, Homo sapiens
tgccagcctggcttct

SEQ ID NO: 6505873 - DNA, 18 bp, Homo sapiens
tgccagcctggcttctgg

SEQ ID NO: 6505874 - DNA, 19 bp, Homo sapiens
tgccagccttcccttcttt

SEQ ID NO: 6505875 - DNA, 18 bp, Homo sapiens
tgccagccttcctctgca

SEQ ID NO: 6505876 - DNA, 21 bp, Homo sapiens
tgccagccttcctctgcagct

SEQ ID NO: 6505877 - DNA, 16 bp, Homo sapiens
tgccagcgcatgtgtc

SEQ ID NO: 6505878 - DNA, 21 bp, Homo sapiens
tgccagcgccaaaacaagcca

SEQ ID NO: 6505879 - DNA, 19 bp, Homo sapiens
tgccagcggtttcctggtg

SEQ ID NO: 6505880 - DNA, 19 bp, Homo sapiens
tgccagctactcaggaggc

SEQ ID NO: 6505881 - DNA, 19 bp, Homo sapiens
tgccagctacttcctcctc

SEQ ID NO: 6505882 - DNA, 13 bp, Homo sapiens
tgccagctatttt

SEQ ID NO: 6505883 - DNA, 11 bp, Homo sapiens
tgccagctcca

SEQ ID NO: 6505884 - DNA, 19 bp, Homo sapiens
tgccagctccacagggtgg

SEQ ID NO: 6505885 - DNA, 23 bp, Homo sapiens
tgccagctctgtatcaggaccca

SEQ ID NO: 6505886 - DNA, 14 bp, Homo sapiens
tgccagctctgtca

SEQ ID NO: 6505887 - DNA, 15 bp, Homo sapiens
tgccagctgacatct

SEQ ID NO: 6505888 - DNA, 17 bp, Homo sapiens
tgccagctgcagcctgg

SEQ ID NO: 6505889 - DNA, 21 bp, Homo sapiens
tgccagctgcagcctggttgg

SEQ ID NO: 6505890 - DNA, 22 bp, Homo sapiens
tgccagctgccttcctcatccc

SEQ ID NO: 6505891 - DNA, 16 bp, Homo sapiens
tgccagctgctgagcc

SEQ ID NO: 6505892 - DNA, 17 bp, Homo sapiens
tgccagctgctgagccg

SEQ ID NO: 6505893 - DNA, 20 bp, Homo sapiens
tgccagctgctgagccgcag

SEQ ID NO: 6505894 - DNA, 16 bp, Homo sapiens
tgccagctgcttctgc

SEQ ID NO: 6505895 - DNA, 16 bp, Homo sapiens
tgccagctggcctttg

SEQ ID NO: 6505896 - DNA, 18 bp, Homo sapiens
tgccagctggcctttgta

SEQ ID NO: 6505897 - DNA, 17 bp, Homo sapiens
tgccagctgggcccagc

SEQ ID NO: 6505898 - DNA, 14 bp, Homo sapiens
tgccagctgtctcc

SEQ ID NO: 6505899 - DNA, 16 bp, Homo sapiens
tgccagctgtctccca

SEQ ID NO: 6505900 - DNA, 20 bp, Homo sapiens
tgccagctgtgtccttcggg

SEQ ID NO: 6505901 - DNA, 21 bp, Homo sapiens
tgccagcttcctgtgggccag

SEQ ID NO: 6505902 - DNA, 14 bp, Homo sapiens
tgccagcttctctc

SEQ ID NO: 6505903 - DNA, 20 bp, Homo sapiens
tgccagcttctctctccagg

SEQ ID NO: 6505904 - DNA, 19 bp, Homo sapiens
tgccagcttctttgcagct

SEQ ID NO: 6505905 - DNA, 21 bp, Homo sapiens
tgccagcttggacatcagtgt

SEQ ID NO: 6505906 - DNA, 18 bp, Homo sapiens
tgccaggaaacaagggaa

SEQ ID NO: 6505907 - DNA, 22 bp, Homo sapiens
tgccaggaaaggagagtacttt

SEQ ID NO: 6505908 - DNA, 12 bp, Homo sapiens
tgccaggaactc

SEQ ID NO: 6505909 - DNA, 16 bp, Homo sapiens
tgccaggaagccagca

SEQ ID NO: 6505910 - DNA, 18 bp, Homo sapiens
tgccaggaagccagcagg

SEQ ID NO: 6505911 - DNA, 22 bp, Homo sapiens
tgccaggaagccagcaggctct

SEQ ID NO: 6505912 - DNA, 17 bp, Homo sapiens
tgccaggaatgtttcag

SEQ ID NO: 6505913 - DNA, 12 bp, Homo sapiens
tgccaggacacc

SEQ ID NO: 6505914 - DNA, 13 bp, Homo sapiens
tgccaggacacct

SEQ ID NO: 6505915 - DNA, 14 bp, Homo sapiens
tgccaggacacctg

SEQ ID NO: 6505916 - DNA, 19 bp, Homo sapiens
tgccaggacacctgcccca

SEQ ID NO: 6505917 - DNA, 23 bp, Homo sapiens
tgccaggacacctgccccagcgc

SEQ ID NO: 6505918 - DNA, 13 bp, Homo sapiens
tgccaggacacgc

SEQ ID NO: 6505919 - DNA, 19 bp, Homo sapiens
tgccaggacagctgcaggt

SEQ ID NO: 6505920 - DNA, 18 bp, Homo sapiens
tgccaggacagctggctg

SEQ ID NO: 6505921 - DNA, 23 bp, Homo sapiens
tgccaggacagctggctgctgac

SEQ ID NO: 6505922 - DNA, 24 bp, Homo sapiens
tgccaggacagctggctgctgaca

SEQ ID NO: 6505923 - DNA, 12 bp, Homo sapiens
tgccaggaccag

SEQ ID NO: 6505924 - DNA, 23 bp, Homo sapiens
tgccaggaccccaggtcaggggc

SEQ ID NO: 6505925 - DNA, 16 bp, Homo sapiens
tgccaggacccgccag

SEQ ID NO: 6505926 - DNA, 21 bp, Homo sapiens
tgccaggactccccaggccag

SEQ ID NO: 6505927 - DNA, 14 bp, Homo sapiens
tgccaggactgtga

SEQ ID NO: 6505928 - DNA, 18 bp, Homo sapiens
tgccaggagatggcccca

SEQ ID NO: 6505929 - DNA, 17 bp, Homo sapiens
tgccaggagcaatggga

SEQ ID NO: 6505930 - DNA, 22 bp, Homo sapiens
tgccaggagcaatgggactgga

SEQ ID NO: 6505931 - DNA, 15 bp, Homo sapiens
tgccaggagcacggc

SEQ ID NO: 6505932 - DNA, 17 bp, Homo sapiens
tgccaggaggaacaaag

SEQ ID NO: 6505933 - DNA, 22 bp, Homo sapiens
tgccaggaggacccagggctct

SEQ ID NO: 6505934 - DNA, 22 bp, Homo sapiens
tgccaggaggctggcagtacag

SEQ ID NO: 6505935 - DNA, 21 bp, Homo sapiens
tgccaggagggacaaaggagc

SEQ ID NO: 6505936 - DNA, 22 bp, Homo sapiens
tgccaggagggacaaaggagcc

SEQ ID NO: 6505937 - DNA, 12 bp, Homo sapiens
tgccaggagtgg

SEQ ID NO: 6505938 - DNA, 13 bp, Homo sapiens
tgccaggagtggg

SEQ ID NO: 6505939 - DNA, 22 bp, Homo sapiens
tgccaggattggcacaagctcc

SEQ ID NO: 6505940 - DNA, 18 bp, Homo sapiens
tgccaggattgtcactcc

SEQ ID NO: 6505941 - DNA, 20 bp, Homo sapiens
tgccaggcaacttttaaagc

SEQ ID NO: 6505942 - DNA, 15 bp, Homo sapiens
tgccaggcacaggca

SEQ ID NO: 6505943 - DNA, 16 bp, Homo sapiens
tgccaggcacaggcag

SEQ ID NO: 6505944 - DNA, 19 bp, Homo sapiens
tgccaggcacaggcagggc

SEQ ID NO: 6505945 - DNA, 20 bp, Homo sapiens
tgccaggcacaggcagggca

SEQ ID NO: 6505946 - DNA, 13 bp, Homo sapiens
tgccaggcaccat

SEQ ID NO: 6505947 - DNA, 13 bp, Homo sapiens
tgccaggcacctg

SEQ ID NO: 6505948 - DNA, 18 bp, Homo sapiens
tgtcttaatggatgaaat

SEQ ID NO: 6505949 - DNA, 13 bp, Homo sapiens
tgtcttaattaag

SEQ ID NO: 6505950 - DNA, 18 bp, Homo sapiens
tgtcttaattaagtaaac

SEQ ID NO: 6505951 - DNA, 22 bp, Homo sapiens
tgtcttacaaggcaggcctttc

SEQ ID NO: 6505952 - DNA, 20 bp, Homo sapiens
tgtcttacgtttttctggtg

SEQ ID NO: 6505953 - DNA, 21 bp, Homo sapiens
tgtcttactaataggtctgga

SEQ ID NO: 6505954 - DNA, 18 bp, Homo sapiens
tgtcttagaagaaattaa

SEQ ID NO: 6505955 - DNA, 22 bp, Homo sapiens
tgtcttagagagagagagagcg

SEQ ID NO: 6505956 - DNA, 17 bp, Homo sapiens
tgtcttagatcaggaga

SEQ ID NO: 6505957 - DNA, 23 bp, Homo sapiens
tgtcttagtgcaaaaaacatact

SEQ ID NO: 6505958 - DNA, 19 bp, Homo sapiens
tgtcttataaacaaatgaa

SEQ ID NO: 6505959 - DNA, 21 bp, Homo sapiens
tgtcttataagaaaacatgta

SEQ ID NO: 6505960 - DNA, 22 bp, Homo sapiens
tgtcttataagaaaacatgtaa

SEQ ID NO: 6505961 - DNA, 16 bp, Homo sapiens
tgtcttatctggccct

SEQ ID NO: 6505962 - DNA, 16 bp, Homo sapiens
tgtcttatggtccaga

SEQ ID NO: 6505963 - DNA, 21 bp, Homo sapiens
tgtcttatgtgaaaaattaac

SEQ ID NO: 6505964 - DNA, 22 bp, Homo sapiens
tgtcttatgtgaaaaattaact

SEQ ID NO: 6505965 - DNA, 17 bp, Homo sapiens
tgtcttattcctaattc

SEQ ID NO: 6505966 - DNA, 15 bp, Homo sapiens
tgtcttatttttaga

SEQ ID NO: 6505967 - DNA, 16 bp, Homo sapiens
tgtcttatttttagat

SEQ ID NO: 6505968 - DNA, 17 bp, Homo sapiens
tgtcttcaacagctccc

SEQ ID NO: 6505969 - DNA, 19 bp, Homo sapiens
tgtcttcaaccctgccctg

SEQ ID NO: 6505970 - DNA, 15 bp, Homo sapiens
tgtcttcaatgatca

SEQ ID NO: 6505971 - DNA, 19 bp, Homo sapiens
tgtcttcaatgatcaaatt

SEQ ID NO: 6505972 - DNA, 17 bp, Homo sapiens
tgtcttcacctgccacc

SEQ ID NO: 6505973 - DNA, 18 bp, Homo sapiens
tgtcttcacctgccacca

SEQ ID NO: 6505974 - DNA, 13 bp, Homo sapiens
tgtcttcagatcc

SEQ ID NO: 6505975 - DNA, 18 bp, Homo sapiens
tgtcttcagatcctgctg

SEQ ID NO: 6505976 - DNA, 23 bp, Homo sapiens
tgtcttcagtctcacagagaagc

SEQ ID NO: 6505977 - DNA, 15 bp, Homo sapiens
tgtcttcataaagta

SEQ ID NO: 6505978 - DNA, 17 bp, Homo sapiens
tgtcttcataaagtact

SEQ ID NO: 6505979 - DNA, 23 bp, Homo sapiens
tgtcttcatcacttcttccactg

SEQ ID NO: 6505980 - DNA, 19 bp, Homo sapiens
tgtcttcatccttagcaac

SEQ ID NO: 6505981 - DNA, 15 bp, Homo sapiens
tgtcttcatgtacat

SEQ ID NO: 6505982 - DNA, 15 bp, Homo sapiens
tgtcttcatgttgat

SEQ ID NO: 6505983 - DNA, 19 bp, Homo sapiens
tgtcttcatttcattgtat

SEQ ID NO: 6505984 - DNA, 22 bp, Homo sapiens
tgtcttcattttcattaccagg

SEQ ID NO: 6505985 - DNA, 16 bp, Homo sapiens
tgtcttccaaccccag

SEQ ID NO: 6505986 - DNA, 12 bp, Homo sapiens
tgtcttccataa

SEQ ID NO: 6505987 - DNA, 13 bp, Homo sapiens
tgtcttccataat

SEQ ID NO: 6505988 - DNA, 16 bp, Homo sapiens
tgtcttccatgtatct

SEQ ID NO: 6505989 - DNA, 16 bp, Homo sapiens
tgtcttccattaagaa

SEQ ID NO: 6505990 - DNA, 14 bp, Homo sapiens
tgtcttcccagggt

SEQ ID NO: 6505991 - DNA, 16 bp, Homo sapiens
tgtcttcccagggtag

SEQ ID NO: 6505992 - DNA, 13 bp, Homo sapiens
tgtcttccccacc

SEQ ID NO: 6505993 - DNA, 15 bp, Homo sapiens
tgtcttccccaccgc

SEQ ID NO: 6505994 - DNA, 15 bp, Homo sapiens
tgtcttccccacctt

SEQ ID NO: 6505995 - DNA, 18 bp, Homo sapiens
tgtcttcccccctctcct

SEQ ID NO: 6505996 - DNA, 11 bp, Homo sapiens
tgtcttccctg

SEQ ID NO: 6505997 - DNA, 12 bp, Homo sapiens
tgtcttccctgc

SEQ ID NO: 6505998 - DNA, 14 bp, Homo sapiens
tgtcttccctgcct

SEQ ID NO: 6505999 - DNA, 16 bp, Homo sapiens
tgtcttccctgcctgt

SEQ ID NO: 6506000 - DNA, 17 bp, Homo sapiens
tgtcttcccttctttgc

SEQ ID NO: 6506001 - DNA, 18 bp, Homo sapiens
tgtcttccgatcaacatt

SEQ ID NO: 6506002 - DNA, 23 bp, Homo sapiens
tgtcttccgatcaacatttatga

SEQ ID NO: 6506003 - DNA, 22 bp, Homo sapiens
tgtcttcctagtatattagttt

SEQ ID NO: 6506004 - DNA, 20 bp, Homo sapiens
tgtcttcctatttcagaagt

SEQ ID NO: 6506005 - DNA, 16 bp, Homo sapiens
tgtcttcctcaaaata

SEQ ID NO: 6506006 - DNA, 16 bp, Homo sapiens
tgtcttcctcccaagt

SEQ ID NO: 6506007 - DNA, 14 bp, Homo sapiens
tgtcttcctctgca

SEQ ID NO: 6506008 - DNA, 16 bp, Homo sapiens
tgtcttcctctgcaag

SEQ ID NO: 6506009 - DNA, 13 bp, Homo sapiens
tgtcttcctgtgg

SEQ ID NO: 6506010 - DNA, 17 bp, Homo sapiens
tgtcttcctttgcttcc

SEQ ID NO: 6506011 - DNA, 22 bp, Homo sapiens
tgtcttcggccgagctggtttc

SEQ ID NO: 6506012 - DNA, 23 bp, Homo sapiens
tgtcttcggccgagctggtttcc

SEQ ID NO: 6506013 - DNA, 16 bp, Homo sapiens
tgtcttcgtacagttc

SEQ ID NO: 6506014 - DNA, 23 bp, Homo sapiens
tgtcttctaactttattctttgt

SEQ ID NO: 6506015 - DNA, 16 bp, Homo sapiens
tgtcttctcccagagc

SEQ ID NO: 6506016 - DNA, 13 bp, Homo sapiens
tgtcttctctcaa

SEQ ID NO: 6506017 - DNA, 21 bp, Homo sapiens
tgtcttctctcaaagggaagc

SEQ ID NO: 6506018 - DNA, 12 bp, Homo sapiens
tgtcttctctcc

SEQ ID NO: 6506019 - DNA, 21 bp, Homo sapiens
tgtcttctctccacttctggt

SEQ ID NO: 6506020 - DNA, 12 bp, Homo sapiens
tgtcttctgcct

SEQ ID NO: 6506021 - DNA, 13 bp, Homo sapiens
tgtcttctgcctg

SEQ ID NO: 6506022 - DNA, 14 bp, Homo sapiens
tgtcttctgctgtt

SEQ ID NO: 6506023 - DNA, 23 bp, Homo sapiens
tgtcttctgctttgttgtgtgcc

SEQ ID NO: 6506024 - DNA, 23 bp, Homo sapiens
tgtcttctggacaggctctgctt

SEQ ID NO: 6506025 - DNA, 13 bp, Homo sapiens
tgtcttctgggca

SEQ ID NO: 6506026 - DNA, 16 bp, Homo sapiens
tgtcttctgggcacag

SEQ ID NO: 6506027 - DNA, 13 bp, Homo sapiens
tgtcttctggtct

SEQ ID NO: 6506028 - DNA, 17 bp, Homo sapiens
tgtcttctggtctgtgt

SEQ ID NO: 6506029 - DNA, 13 bp, Homo sapiens
tgtcttctgtata

SEQ ID NO: 6506030 - DNA, 22 bp, Homo sapiens
tgtcttctgttcccaaggaagc

SEQ ID NO: 6506031 - DNA, 10 bp, Homo sapiens
tgtcttctta

SEQ ID NO: 6506032 - DNA, 15 bp, Homo sapiens
tgtcttcttaaaatc

SEQ ID NO: 6506033 - DNA, 22 bp, Homo sapiens
tgtcttcttaaaatcaaatgta

SEQ ID NO: 6506034 - DNA, 21 bp, Homo sapiens
tgtcttcttgggggcagacca

SEQ ID NO: 6506035 - DNA, 13 bp, Homo sapiens
tgtcttctttcca

SEQ ID NO: 6506036 - DNA, 12 bp, Homo sapiens
tgtcttctttct

SEQ ID NO: 6506037 - DNA, 14 bp, Homo sapiens
tgtcttctttctcc

SEQ ID NO: 6506038 - DNA, 19 bp, Homo sapiens
tgtcttctttctccatgga

SEQ ID NO: 6506039 - DNA, 16 bp, Homo sapiens
tgtcttcttttgtggt

SEQ ID NO: 6506040 - DNA, 21 bp, Homo sapiens
tgtcttgaaaaaaaatagatg

SEQ ID NO: 6506041 - DNA, 16 bp, Homo sapiens
tgtcttgaaaactgtg

SEQ ID NO: 6506042 - DNA, 22 bp, Homo sapiens
tgtcttgaaacatgttcatctg

SEQ ID NO: 6506043 - DNA, 19 bp, Homo sapiens
tgtcttgaaagattcaggt

SEQ ID NO: 6506044 - DNA, 24 bp, Homo sapiens
tgtcttgaagcagccttgatatgt

SEQ ID NO: 6506045 - DNA, 13 bp, Homo sapiens
tgtcttgaataag

SEQ ID NO: 6506046 - DNA, 15 bp, Homo sapiens
tgtcttgagagaaaa

SEQ ID NO: 6506047 - DNA, 16 bp, Homo sapiens
tgtcttgagagaaaag

SEQ ID NO: 6506048 - DNA, 20 bp, Homo sapiens
tgtcttgagagcgctggcct

SEQ ID NO: 6506049 - DNA, 20 bp, Homo sapiens
tgtcttgagagcttggcctt

SEQ ID NO: 6506050 - DNA, 19 bp, Homo sapiens
tgtcttgagaggagacttg

SEQ ID NO: 6506051 - DNA, 12 bp, Homo sapiens
tgtcttgatttt

SEQ ID NO: 6506052 - DNA, 20 bp, Homo sapiens
tgtcttgcaaagcctttaaa

SEQ ID NO: 6506053 - DNA, 19 bp, Homo sapiens
tgtcttgcactggccttct

SEQ ID NO: 6506054 - DNA, 13 bp, Homo sapiens
tgtcttgcatttt

SEQ ID NO: 6506055 - DNA, 14 bp, Homo sapiens
tgtcttgcattttt

SEQ ID NO: 6506056 - DNA, 18 bp, Homo sapiens
tgtcttgcatttttttcc

SEQ ID NO: 6506057 - DNA, 23 bp, Homo sapiens
tgtcttgcatttttttcctttat

SEQ ID NO: 6506058 - DNA, 14 bp, Homo sapiens
tgtcttgccccagt

SEQ ID NO: 6506059 - DNA, 15 bp, Homo sapiens
tgtcttgcctttttc

SEQ ID NO: 6506060 - DNA, 18 bp, Homo sapiens
tgtcttgcgggtctgtca

SEQ ID NO: 6506061 - DNA, 19 bp, Homo sapiens
tgtcttgcgggtctgtcag

SEQ ID NO: 6506062 - DNA, 23 bp, Homo sapiens
tgtcttgctagacaaggttgctg

SEQ ID NO: 6506063 - DNA, 19 bp, Homo sapiens
tgtcttggacactgtacaa

SEQ ID NO: 6506064 - DNA, 23 bp, Homo sapiens
tgtcttggacccacctgaaatgc

SEQ ID NO: 6506065 - DNA, 15 bp, Homo sapiens
tgtcttggcctccca

SEQ ID NO: 6506066 - DNA, 22 bp, Homo sapiens
tgtcttggcctcccaaagtgct

SEQ ID NO: 6506067 - DNA, 13 bp, Homo sapiens
tgtcttgggcaga

SEQ ID NO: 6506068 - DNA, 17 bp, Homo sapiens
tgtcttggtacttgctg

SEQ ID NO: 6506069 - DNA, 20 bp, Homo sapiens
tgtcttggtggatgggccct

SEQ ID NO: 6506070 - DNA, 22 bp, Homo sapiens
tgtcttggtggatgggccctgc

SEQ ID NO: 6506071 - DNA, 18 bp, Homo sapiens
tgtcttgtaatattttgt

SEQ ID NO: 6506072 - DNA, 22 bp, Homo sapiens
tgtcttgtacatgtgtagcctg

SEQ ID NO: 6506073 - DNA, 13 bp, Homo sapiens
tgtcttgtacttc

SEQ ID NO: 6506074 - DNA, 17 bp, Homo sapiens
tgtcttgtatggctctc

SEQ ID NO: 6506075 - DNA, 16 bp, Homo sapiens
tgtcttgtatttaaaa

SEQ ID NO: 6506076 - DNA, 19 bp, Homo sapiens
tgtcttgtatttaaaaaca

SEQ ID NO: 6506077 - DNA, 14 bp, Homo sapiens
tgtcttgtcatttt

SEQ ID NO: 6506078 - DNA, 15 bp, Homo sapiens
tgtcttgtccccacc

SEQ ID NO: 6506079 - DNA, 18 bp, Homo sapiens
tgtcttgtgtatttctct

SEQ ID NO: 6506080 - DNA, 21 bp, Homo sapiens
tgtcttgtgtatttctctgtg

SEQ ID NO: 6506081 - DNA, 22 bp, Homo sapiens
tgtcttgtgtatttctctgtga

SEQ ID NO: 6506082 - DNA, 15 bp, Homo sapiens
tgtcttgtgtttctt

SEQ ID NO: 6506083 - DNA, 15 bp, Homo sapiens
tgtcttgttaatatt

SEQ ID NO: 6506084 - DNA, 12 bp, Homo sapiens
tgtcttgttcat

SEQ ID NO: 6506085 - DNA, 16 bp, Homo sapiens
tgtcttgttcctgtgc

SEQ ID NO: 6506086 - DNA, 16 bp, Homo sapiens
tgtcttgttcttgaga

SEQ ID NO: 6506087 - DNA, 14 bp, Homo sapiens
tgtcttgtttcagt

SEQ ID NO: 6506088 - DNA, 22 bp, Homo sapiens
tgtctttaaaaactgttttaga

SEQ ID NO: 6506089 - DNA, 22 bp, Homo sapiens
tgtctttaaaaataaaagctat

SEQ ID NO: 6506090 - DNA, 16 bp, Homo sapiens
tgtctttaaaagagag

SEQ ID NO: 6506091 - DNA, 14 bp, Homo sapiens
tgtctttaaatctt

SEQ ID NO: 6506092 - DNA, 22 bp, Homo sapiens
tgtctttaaatcttcaatatga

SEQ ID NO: 6506093 - DNA, 17 bp, Homo sapiens
tgtctttaaatgctgct

SEQ ID NO: 6506094 - DNA, 14 bp, Homo sapiens
tgtctttaatgcaa

SEQ ID NO: 6506095 - DNA, 15 bp, Homo sapiens
tgtctttaatgcaat

SEQ ID NO: 6506096 - DNA, 20 bp, Homo sapiens
tgtctttactggacctgaaa

SEQ ID NO: 6506097 - DNA, 22 bp, Homo sapiens
tgtctttactggacctgaaatt

SEQ ID NO: 6506098 - DNA, 17 bp, Homo sapiens
tgtctttagatagccct

SEQ ID NO: 6506099 - DNA, 21 bp, Homo sapiens
tgtctttaggcagcagctttt

SEQ ID NO: 6506100 - DNA, 18 bp, Homo sapiens
tgtctttatagatgtaca

SEQ ID NO: 6506101 - DNA, 21 bp, Homo sapiens
tgtctttatgagctaaaaata

SEQ ID NO: 6506102 - DNA, 14 bp, Homo sapiens
tgtctttatgattt

SEQ ID NO: 6506103 - DNA, 20 bp, Homo sapiens
tgtctttatgtaagaagaaa

SEQ ID NO: 6506104 - DNA, 16 bp, Homo sapiens
tgtctttattgtccac

SEQ ID NO: 6506105 - DNA, 14 bp, Homo sapiens
tgtctttcaagtga

SEQ ID NO: 6506106 - DNA, 21 bp, Homo sapiens
tgtctttccactcctcctagc

SEQ ID NO: 6506107 - DNA, 12 bp, Homo sapiens
tgtctttcctcc

SEQ ID NO: 6506108 - DNA, 14 bp, Homo sapiens
tgtctttctagcca

SEQ ID NO: 6506109 - DNA, 21 bp, Homo sapiens
tgtctttctattcagcaaaag

SEQ ID NO: 6506110 - DNA, 17 bp, Homo sapiens
tgtctttctattcataa

SEQ ID NO: 6506111 - DNA, 23 bp, Homo sapiens
tgtctttctattcataataaact

SEQ ID NO: 6506112 - DNA, 12 bp, Homo sapiens
tgtctttctgag

SEQ ID NO: 6506113 - DNA, 13 bp, Homo sapiens
tgtctttctgggg

SEQ ID NO: 6506114 - DNA, 16 bp, Homo sapiens
tgtctttcttgtaagg

SEQ ID NO: 6506115 - DNA, 15 bp, Homo sapiens
tgtctttctttgctg

SEQ ID NO: 6506116 - DNA, 20 bp, Homo sapiens
tgtctttctttggtgccttt

SEQ ID NO: 6506117 - DNA, 22 bp, Homo sapiens
tgtctttctttggtgcctttcc

SEQ ID NO: 6506118 - DNA, 15 bp, Homo sapiens
tgtctttctttgtca

SEQ ID NO: 6506119 - DNA, 20 bp, Homo sapiens
tgtctttctttgtcattcag

SEQ ID NO: 6506120 - DNA, 18 bp, Homo sapiens
tgtctttgatcgcctctt

SEQ ID NO: 6506121 - DNA, 13 bp, Homo sapiens
tgtctttgcaaag

SEQ ID NO: 6506122 - DNA, 14 bp, Homo sapiens
tgtctttgcaaagg

SEQ ID NO: 6506123 - DNA, 17 bp, Homo sapiens
tgtctttgcaaaggact

SEQ ID NO: 6506124 - DNA, 19 bp, Homo sapiens
tgtctttgcagggcacaga

SEQ ID NO: 6506125 - DNA, 14 bp, Homo sapiens
tgtctttgcataca

SEQ ID NO: 6506126 - DNA, 18 bp, Homo sapiens
tgtctttgcggggcctgt

SEQ ID NO: 6506127 - DNA, 15 bp, Homo sapiens
tgccaggcacctggc

SEQ ID NO: 6506128 - DNA, 20 bp, Homo sapiens
tgccaggcacctggcctgct

SEQ ID NO: 6506129 - DNA, 23 bp, Homo sapiens
tgccaggcactctcatcacccca

SEQ ID NO: 6506130 - DNA, 22 bp, Homo sapiens
tgccaggcagaaaactggcagt

SEQ ID NO: 6506131 - DNA, 16 bp, Homo sapiens
tgccaggcagctgcag

SEQ ID NO: 6506132 - DNA, 12 bp, Homo sapiens
tgccaggcaggg

SEQ ID NO: 6506133 - DNA, 17 bp, Homo sapiens
tgccaggcaggggtggg

SEQ ID NO: 6506134 - DNA, 18 bp, Homo sapiens
tgccaggcaggggtgggg

SEQ ID NO: 6506135 - DNA, 14 bp, Homo sapiens
tgccaggcatggtg

SEQ ID NO: 6506136 - DNA, 14 bp, Homo sapiens
tgccaggccagcct

SEQ ID NO: 6506137 - DNA, 17 bp, Homo sapiens
tgccaggccagcctccg

SEQ ID NO: 6506138 - DNA, 22 bp, Homo sapiens
tgccaggcccatctcaggtgcc

SEQ ID NO: 6506139 - DNA, 23 bp, Homo sapiens
tgccaggcccatctcaggtgcca

SEQ ID NO: 6506140 - DNA, 14 bp, Homo sapiens
tgccaggcccgggg

SEQ ID NO: 6506141 - DNA, 14 bp, Homo sapiens
tgccaggcctccct

SEQ ID NO: 6506142 - DNA, 14 bp, Homo sapiens
tgccaggcgaggcc

SEQ ID NO: 6506143 - DNA, 20 bp, Homo sapiens
tgccaggcgttggtgccact

SEQ ID NO: 6506144 - DNA, 16 bp, Homo sapiens
tgccaggctaattttt

SEQ ID NO: 6506145 - DNA, 19 bp, Homo sapiens
tgccaggctccctttctct

SEQ ID NO: 6506146 - DNA, 14 bp, Homo sapiens
tgccaggctctctt

SEQ ID NO: 6506147 - DNA, 22 bp, Homo sapiens
tgccaggctgaattacagtgaa

SEQ ID NO: 6506148 - DNA, 19 bp, Homo sapiens
tgccaggctgcctcctgcc

SEQ ID NO: 6506149 - DNA, 20 bp, Homo sapiens
tgccaggctgcctcctgccc

SEQ ID NO: 6506150 - DNA, 20 bp, Homo sapiens
tgccaggctgcgtccctccg

SEQ ID NO: 6506151 - DNA, 24 bp, Homo sapiens
tgccaggctgcgtccctccgagct

SEQ ID NO: 6506152 - DNA, 19 bp, Homo sapiens
tgccaggctggagtgcagt

SEQ ID NO: 6506153 - DNA, 20 bp, Homo sapiens
tgccaggctggagtgcagtg

SEQ ID NO: 6506154 - DNA, 12 bp, Homo sapiens
tgccaggctggg

SEQ ID NO: 6506155 - DNA, 13 bp, Homo sapiens
tgccaggctggga

SEQ ID NO: 6506156 - DNA, 14 bp, Homo sapiens
tgccaggctgggca

SEQ ID NO: 6506157 - DNA, 16 bp, Homo sapiens
tgccaggctgtaagca

SEQ ID NO: 6506158 - DNA, 12 bp, Homo sapiens
tgccaggctgtt

SEQ ID NO: 6506159 - DNA, 16 bp, Homo sapiens
tgccaggcttgcctgg

SEQ ID NO: 6506160 - DNA, 21 bp, Homo sapiens
tgccagggaaaaagaccaaat

SEQ ID NO: 6506161 - DNA, 14 bp, Homo sapiens
tgccagggaagaca

SEQ ID NO: 6506162 - DNA, 19 bp, Homo sapiens
tgccagggaagacagagca

SEQ ID NO: 6506163 - DNA, 20 bp, Homo sapiens
tgccagggaagacagagcag

SEQ ID NO: 6506164 - DNA, 21 bp, Homo sapiens
tgccagggaagacagagcagg

SEQ ID NO: 6506165 - DNA, 11 bp, Homo sapiens
tgccagggaca

SEQ ID NO: 6506166 - DNA, 22 bp, Homo sapiens
tgccagggacattttcaagaca

SEQ ID NO: 6506167 - DNA, 15 bp, Homo sapiens
tgccagggagacaga

SEQ ID NO: 6506168 - DNA, 22 bp, Homo sapiens
tgccagggaggtggaaggaccc

SEQ ID NO: 6506169 - DNA, 12 bp, Homo sapiens
tgccagggcagg

SEQ ID NO: 6506170 - DNA, 15 bp, Homo sapiens
tgccagggcagggcc

SEQ ID NO: 6506171 - DNA, 16 bp, Homo sapiens
tgccagggcagggccc

SEQ ID NO: 6506172 - DNA, 16 bp, Homo sapiens
tgccagggcagggtct

SEQ ID NO: 6506173 - DNA, 17 bp, Homo sapiens
tgccagggcccacccca

SEQ ID NO: 6506174 - DNA, 21 bp, Homo sapiens
tgccagggcccaccccagcct

SEQ ID NO: 6506175 - DNA, 16 bp, Homo sapiens
tgccagggcccaggag

SEQ ID NO: 6506176 - DNA, 17 bp, Homo sapiens
tgccagggcccctctcc

SEQ ID NO: 6506177 - DNA, 11 bp, Homo sapiens
tgccagggctc

SEQ ID NO: 6506178 - DNA, 20 bp, Homo sapiens
tgccagggctcgggcgctgt

SEQ ID NO: 6506179 - DNA, 19 bp, Homo sapiens
tgccagggctctgggggca

SEQ ID NO: 6506180 - DNA, 22 bp, Homo sapiens
tgccagggctctgggggcagat

SEQ ID NO: 6506181 - DNA, 18 bp, Homo sapiens
tgccaggggcatccaagg

SEQ ID NO: 6506182 - DNA, 15 bp, Homo sapiens
tgccaggggctctgt

SEQ ID NO: 6506183 - DNA, 16 bp, Homo sapiens
tgccaggggcttgaga

SEQ ID NO: 6506184 - DNA, 18 bp, Homo sapiens
tgccaggtactatgcaga

SEQ ID NO: 6506185 - DNA, 21 bp, Homo sapiens
tgccaggtgatctcctgtggc

SEQ ID NO: 6506186 - DNA, 19 bp, Homo sapiens
tgccaggttctatttggaa

SEQ ID NO: 6506187 - DNA, 20 bp, Homo sapiens
tgccaggttctatttggaat

SEQ ID NO: 6506188 - DNA, 14 bp, Homo sapiens
tgccaggttttctg

SEQ ID NO: 6506189 - DNA, 18 bp, Homo sapiens
tgccaggtttttggtctg

SEQ ID NO: 6506190 - DNA, 22 bp, Homo sapiens
tgccaggtttttggtctgaccc

SEQ ID NO: 6506191 - DNA, 24 bp, Homo sapiens
tgccagtaacacaggccaccctgt

SEQ ID NO: 6506192 - DNA, 22 bp, Homo sapiens
tgccagtaacgcgtcttcctga

SEQ ID NO: 6506193 - DNA, 21 bp, Homo sapiens
tgccagtattttaaaatagcg

SEQ ID NO: 6506194 - DNA, 17 bp, Homo sapiens
tgccagtcaagaagaaa

SEQ ID NO: 6506195 - DNA, 14 bp, Homo sapiens
tgccagtcaccccg

SEQ ID NO: 6506196 - DNA, 15 bp, Homo sapiens
tgccagtcaccccgg

SEQ ID NO: 6506197 - DNA, 22 bp, Homo sapiens
tgccagtcaccccggccacctg

SEQ ID NO: 6506198 - DNA, 13 bp, Homo sapiens
tgccagtcagcaa

SEQ ID NO: 6506199 - DNA, 15 bp, Homo sapiens
tgccagtcctcctca

SEQ ID NO: 6506200 - DNA, 13 bp, Homo sapiens
tgccagtcctgca

SEQ ID NO: 6506201 - DNA, 14 bp, Homo sapiens
tgccagtcctgcaa

SEQ ID NO: 6506202 - DNA, 13 bp, Homo sapiens
tgccagtcctgtc

SEQ ID NO: 6506203 - DNA, 16 bp, Homo sapiens
tgccagtcgcgctgcc

SEQ ID NO: 6506204 - DNA, 17 bp, Homo sapiens
tgccagtcgcgctgcct

SEQ ID NO: 6506205 - DNA, 21 bp, Homo sapiens
tgccagtcgcgctgcctgtgt

SEQ ID NO: 6506206 - DNA, 17 bp, Homo sapiens
tgccagtctcattttca

SEQ ID NO: 6506207 - DNA, 15 bp, Homo sapiens
tgccagtgaagtcct

SEQ ID NO: 6506208 - DNA, 16 bp, Homo sapiens
tgccagtgaagtcctt

SEQ ID NO: 6506209 - DNA, 17 bp, Homo sapiens
tgccagtgataagagca

SEQ ID NO: 6506210 - DNA, 14 bp, Homo sapiens
tgccagtgcactcc

SEQ ID NO: 6506211 - DNA, 14 bp, Homo sapiens
tgccagtgcatgcc

SEQ ID NO: 6506212 - DNA, 18 bp, Homo sapiens
tgccagtgcatgccagga

SEQ ID NO: 6506213 - DNA, 13 bp, Homo sapiens
tgccagtgccagg

SEQ ID NO: 6506214 - DNA, 15 bp, Homo sapiens
tgccagtgccttacc

SEQ ID NO: 6506215 - DNA, 20 bp, Homo sapiens
tgccagtgccttacctcctg

SEQ ID NO: 6506216 - DNA, 22 bp, Homo sapiens
tgccagtgccttacctcctgcc

SEQ ID NO: 6506217 - DNA, 19 bp, Homo sapiens
tgccagtgctaaactactg

SEQ ID NO: 6506218 - DNA, 22 bp, Homo sapiens
tgccagtggagacggaatctgc

SEQ ID NO: 6506219 - DNA, 21 bp, Homo sapiens
tgccagtggatcccctgcggt

SEQ ID NO: 6506220 - DNA, 13 bp, Homo sapiens
tgccagtggtgga

SEQ ID NO: 6506221 - DNA, 20 bp, Homo sapiens
tgccagtgtctttctttggt

SEQ ID NO: 6506222 - DNA, 21 bp, Homo sapiens
tgccagtgtttagaagagcct

SEQ ID NO: 6506223 - DNA, 23 bp, Homo sapiens
tgccagtgtttagaagagcctga

SEQ ID NO: 6506224 - DNA, 17 bp, Homo sapiens
tgccagttacttgcttt

SEQ ID NO: 6506225 - DNA, 18 bp, Homo sapiens
tgccagttacttgggctt

SEQ ID NO: 6506226 - DNA, 17 bp, Homo sapiens
tgccagttatggctata

SEQ ID NO: 6506227 - DNA, 22 bp, Homo sapiens
tgccagttgaaaatggattttt

SEQ ID NO: 6506228 - DNA, 22 bp, Homo sapiens
tgccagttgtcctccttccggg

SEQ ID NO: 6506229 - DNA, 23 bp, Homo sapiens
tgccagtttaatcattgcctggt

SEQ ID NO: 6506230 - DNA, 19 bp, Homo sapiens
tgccagttttgtttccttt

SEQ ID NO: 6506231 - DNA, 14 bp, Homo sapiens
tgccataaaacatt

SEQ ID NO: 6506232 - DNA, 20 bp, Homo sapiens
tgccataaaacattaagaaa

SEQ ID NO: 6506233 - DNA, 23 bp, Homo sapiens
tgccataaaacattaagaaaatc

SEQ ID NO: 6506234 - DNA, 20 bp, Homo sapiens
tgccataacttgtttgtaaa

SEQ ID NO: 6506235 - DNA, 20 bp, Homo sapiens
tgccataactttatgaagtg

SEQ ID NO: 6506236 - DNA, 14 bp, Homo sapiens
tgccataatacaaa

SEQ ID NO: 6506237 - DNA, 16 bp, Homo sapiens
tgccataatacaaaag

SEQ ID NO: 6506238 - DNA, 16 bp, Homo sapiens
tgccataatatgatgc

SEQ ID NO: 6506239 - DNA, 23 bp, Homo sapiens
tgccatacatcagttattcattc

SEQ ID NO: 6506240 - DNA, 13 bp, Homo sapiens
tgccatacatgtt

SEQ ID NO: 6506241 - DNA, 16 bp, Homo sapiens
tgccataccttctccc

SEQ ID NO: 6506242 - DNA, 19 bp, Homo sapiens
tgccataccttctcccagg

SEQ ID NO: 6506243 - DNA, 23 bp, Homo sapiens
tgccataccttctcccaggcctc

SEQ ID NO: 6506244 - DNA, 15 bp, Homo sapiens
tgccataccttgaga

SEQ ID NO: 6506245 - DNA, 18 bp, Homo sapiens
tgccatactgtatgcagt

SEQ ID NO: 6506246 - DNA, 20 bp, Homo sapiens
tgccatacttgttctgtatt

SEQ ID NO: 6506247 - DNA, 17 bp, Homo sapiens
tgccatactttgtctga

SEQ ID NO: 6506248 - DNA, 18 bp, Homo sapiens
tgccatactttgtctgaa

SEQ ID NO: 6506249 - DNA, 13 bp, Homo sapiens
tgccatagagttt

SEQ ID NO: 6506250 - DNA, 14 bp, Homo sapiens
tgccatagccccat

SEQ ID NO: 6506251 - DNA, 11 bp, Homo sapiens
tgccataggag

SEQ ID NO: 6506252 - DNA, 18 bp, Homo sapiens
tgccatagtcaaagagag

SEQ ID NO: 6506253 - DNA, 19 bp, Homo sapiens
tgccatagtcacatggcct

SEQ ID NO: 6506254 - DNA, 20 bp, Homo sapiens
tgccatagtcttaactggtc

SEQ ID NO: 6506255 - DNA, 15 bp, Homo sapiens
tgccatagtttgtga

SEQ ID NO: 6506256 - DNA, 21 bp, Homo sapiens
tgccatattaaaatctgatgt

SEQ ID NO: 6506257 - DNA, 14 bp, Homo sapiens
tgccatattaaatt

SEQ ID NO: 6506258 - DNA, 17 bp, Homo sapiens
tgccatattctgttggc

SEQ ID NO: 6506259 - DNA, 16 bp, Homo sapiens
tgccatattgcacatg

SEQ ID NO: 6506260 - DNA, 17 bp, Homo sapiens
tgccatattttcaccat

SEQ ID NO: 6506261 - DNA, 15 bp, Homo sapiens
tgccatcaaactgta

SEQ ID NO: 6506262 - DNA, 17 bp, Homo sapiens
tgccatcaaactgtaaa

SEQ ID NO: 6506263 - DNA, 21 bp, Homo sapiens
tgccatcaactactattcaaa

SEQ ID NO: 6506264 - DNA, 22 bp, Homo sapiens
tgccatcaataaaaaattatga

SEQ ID NO: 6506265 - DNA, 21 bp, Homo sapiens
tgccatcagaaattttctaca

SEQ ID NO: 6506266 - DNA, 14 bp, Homo sapiens
tgccatcagcccct

SEQ ID NO: 6506267 - DNA, 18 bp, Homo sapiens
tgccatcagcccctggga

SEQ ID NO: 6506268 - DNA, 21 bp, Homo sapiens
tgccatcagcccctgggaaca

SEQ ID NO: 6506269 - DNA, 23 bp, Homo sapiens
tgccatcagcccctgggaacagg

SEQ ID NO: 6506270 - DNA, 13 bp, Homo sapiens
tgccatcatctcc

SEQ ID NO: 6506271 - DNA, 15 bp, Homo sapiens
tgccatcatctcctg

SEQ ID NO: 6506272 - DNA, 22 bp, Homo sapiens
tgccatcattgctgtctgcagc

SEQ ID NO: 6506273 - DNA, 13 bp, Homo sapiens
tgccatcccaagc

SEQ ID NO: 6506274 - DNA, 20 bp, Homo sapiens
tgccatccccctctcacgcc

SEQ ID NO: 6506275 - DNA, 15 bp, Homo sapiens
tgccatccctccctc

SEQ ID NO: 6506276 - DNA, 15 bp, Homo sapiens
tgccatcctccctgt

SEQ ID NO: 6506277 - DNA, 22 bp, Homo sapiens
tgccatcctgatggacctgccc

SEQ ID NO: 6506278 - DNA, 23 bp, Homo sapiens
tgccatccttgctgcagcttcta

SEQ ID NO: 6506279 - DNA, 14 bp, Homo sapiens
tgccatcggacagg

SEQ ID NO: 6506280 - DNA, 16 bp, Homo sapiens
tgccatcgggtgccaa

SEQ ID NO: 6506281 - DNA, 17 bp, Homo sapiens
tgccatcgggtgccaaa

SEQ ID NO: 6506282 - DNA, 18 bp, Homo sapiens
tgccatcgggtgccaaat

SEQ ID NO: 6506283 - DNA, 19 bp, Homo sapiens
tgccatctaatggcttcag

SEQ ID NO: 6506284 - DNA, 16 bp, Homo sapiens
tgccatctagccagcc

SEQ ID NO: 6506285 - DNA, 23 bp, Homo sapiens
tgccatctcaattgtgctttgta

SEQ ID NO: 6506286 - DNA, 20 bp, Homo sapiens
tgccatctcacctcctgctg

SEQ ID NO: 6506287 - DNA, 15 bp, Homo sapiens
tgccatctccaccct

SEQ ID NO: 6506288 - DNA, 15 bp, Homo sapiens
tgccatctctgctcc

SEQ ID NO: 6506289 - DNA, 21 bp, Homo sapiens
tgccatcttccatatccgggt

SEQ ID NO: 6506290 - DNA, 16 bp, Homo sapiens
tgccatcttcccagca

SEQ ID NO: 6506291 - DNA, 22 bp, Homo sapiens
tgccatcttctccccgaggctg

SEQ ID NO: 6506292 - DNA, 22 bp, Homo sapiens
tgccatgaacaaattctttagt

SEQ ID NO: 6506293 - DNA, 17 bp, Homo sapiens
tgccatgaaggcacctg

SEQ ID NO: 6506294 - DNA, 19 bp, Homo sapiens
tgccatgacatttcatctg

SEQ ID NO: 6506295 - DNA, 17 bp, Homo sapiens
tgccatgactgctcagg

SEQ ID NO: 6506296 - DNA, 20 bp, Homo sapiens
tgccatgactgctcaggcct

SEQ ID NO: 6506297 - DNA, 21 bp, Homo sapiens
tgccatgactgctcaggcctc

SEQ ID NO: 6506298 - DNA, 23 bp, Homo sapiens
tgccatgagccgcccaaggcctt

SEQ ID NO: 6506299 - DNA, 13 bp, Homo sapiens
tgccatgaggcct

SEQ ID NO: 6506300 - DNA, 22 bp, Homo sapiens
tgccatgaggcctttccccagt

SEQ ID NO: 6506301 - DNA, 23 bp, Homo sapiens
tgccatgagtattagcttaccca

SEQ ID NO: 6506302 - DNA, 22 bp, Homo sapiens
tgccatgagtccatgtcctatg

SEQ ID NO: 6506303 - DNA, 17 bp, Homo sapiens
tgccatgatctgtattt

SEQ ID NO: 6506304 - DNA, 13 bp, Homo sapiens
tgtctttggaaaa

SEQ ID NO: 6506305 - DNA, 17 bp, Homo sapiens
tgtctttggaaaattca

SEQ ID NO: 6506306 - DNA, 14 bp, Homo sapiens
tgtctttggaccct

SEQ ID NO: 6506307 - DNA, 16 bp, Homo sapiens
tgtctttggaccctga

SEQ ID NO: 6506308 - DNA, 18 bp, Homo sapiens
tgtctttggaccctgagg

SEQ ID NO: 6506309 - DNA, 10 bp, Homo sapiens
tgtctttggt

SEQ ID NO: 6506310 - DNA, 20 bp, Homo sapiens
tgtctttggtcctcttgcca

SEQ ID NO: 6506311 - DNA, 13 bp, Homo sapiens
tgtctttgtaagt

SEQ ID NO: 6506312 - DNA, 17 bp, Homo sapiens
tgtctttgtaagtcagt

SEQ ID NO: 6506313 - DNA, 20 bp, Homo sapiens
tgtctttgtggactgtgggt

SEQ ID NO: 6506314 - DNA, 13 bp, Homo sapiens
tgtctttgtggga

SEQ ID NO: 6506315 - DNA, 19 bp, Homo sapiens
tgtctttgttggaaaagaa

SEQ ID NO: 6506316 - DNA, 20 bp, Homo sapiens
tgtctttgttgtctccctct

SEQ ID NO: 6506317 - DNA, 15 bp, Homo sapiens
tgtctttgtttaaaa

SEQ ID NO: 6506318 - DNA, 19 bp, Homo sapiens
tgtcttttaaaaactcctg

SEQ ID NO: 6506319 - DNA, 15 bp, Homo sapiens
tgtcttttaaaatgc

SEQ ID NO: 6506320 - DNA, 14 bp, Homo sapiens
tgtcttttaaactc

SEQ ID NO: 6506321 - DNA, 20 bp, Homo sapiens
tgtcttttaatgcttcattc

SEQ ID NO: 6506322 - DNA, 22 bp, Homo sapiens
tgtcttttaggactctgatttt

SEQ ID NO: 6506323 - DNA, 17 bp, Homo sapiens
tgtcttttatgcagata

SEQ ID NO: 6506324 - DNA, 19 bp, Homo sapiens
tgtcttttatgcagataga

SEQ ID NO: 6506325 - DNA, 13 bp, Homo sapiens
tgtcttttcaagt

SEQ ID NO: 6506326 - DNA, 21 bp, Homo sapiens
tgtcttttcaagtaattttca

SEQ ID NO: 6506327 - DNA, 18 bp, Homo sapiens
tgtcttttcaatcttcta

SEQ ID NO: 6506328 - DNA, 22 bp, Homo sapiens
tgtcttttcagaagcaagccag

SEQ ID NO: 6506329 - DNA, 20 bp, Homo sapiens
tgtcttttcccatttatcta

SEQ ID NO: 6506330 - DNA, 14 bp, Homo sapiens
tgtcttttctcctc

SEQ ID NO: 6506331 - DNA, 19 bp, Homo sapiens
tgtcttttctcctccgcct

SEQ ID NO: 6506332 - DNA, 16 bp, Homo sapiens
tgtcttttcttgcatg

SEQ ID NO: 6506333 - DNA, 21 bp, Homo sapiens
tgtcttttcttgcatgaggct

SEQ ID NO: 6506334 - DNA, 15 bp, Homo sapiens
tgtcttttcttggca

SEQ ID NO: 6506335 - DNA, 22 bp, Homo sapiens
tgtcttttcttggcaaaagcct

SEQ ID NO: 6506336 - DNA, 23 bp, Homo sapiens
tgtcttttcttggcaaaagcctt

SEQ ID NO: 6506337 - DNA, 19 bp, Homo sapiens
tgtcttttctttgccatct

SEQ ID NO: 6506338 - DNA, 15 bp, Homo sapiens
tgtcttttgaagaag

SEQ ID NO: 6506339 - DNA, 13 bp, Homo sapiens
tgtcttttgaata

SEQ ID NO: 6506340 - DNA, 13 bp, Homo sapiens
tgtcttttgtcat

SEQ ID NO: 6506341 - DNA, 17 bp, Homo sapiens
tgtcttttgttctctga

SEQ ID NO: 6506342 - DNA, 21 bp, Homo sapiens
tgtctttttattaaaatattt

SEQ ID NO: 6506343 - DNA, 13 bp, Homo sapiens
tgtctttttccta

SEQ ID NO: 6506344 - DNA, 15 bp, Homo sapiens
tgtctttttcctact

SEQ ID NO: 6506345 - DNA, 19 bp, Homo sapiens
tgtctttttcctactccgt

SEQ ID NO: 6506346 - DNA, 13 bp, Homo sapiens
tgtctttttcctt

SEQ ID NO: 6506347 - DNA, 18 bp, Homo sapiens
tgtctttttctagacttg

SEQ ID NO: 6506348 - DNA, 17 bp, Homo sapiens
tgtctttttctggactg

SEQ ID NO: 6506349 - DNA, 18 bp, Homo sapiens
tgtctttttgaaataaag

SEQ ID NO: 6506350 - DNA, 20 bp, Homo sapiens
tgtctttttgtatctaaagt

SEQ ID NO: 6506351 - DNA, 14 bp, Homo sapiens
tgtctttttgttat

SEQ ID NO: 6506352 - DNA, 18 bp, Homo sapiens
tgtcttttttaaggctct

SEQ ID NO: 6506353 - DNA, 19 bp, Homo sapiens
tgtcttttttaaggctctg

SEQ ID NO: 6506354 - DNA, 14 bp, Homo sapiens
tgtcttttttctaa

SEQ ID NO: 6506355 - DNA, 14 bp, Homo sapiens
tgtcttttttctct

SEQ ID NO: 6506356 - DNA, 22 bp, Homo sapiens
tgtctttttttgtatagttaac

SEQ ID NO: 6506357 - DNA, 18 bp, Homo sapiens
tgtcttttttttaatgtg

SEQ ID NO: 6506358 - DNA, 15 bp, Homo sapiens
tgtctttttttttct

SEQ ID NO: 6506359 - DNA, 11 bp, Homo sapiens
tgtgaaaaaaa

SEQ ID NO: 6506360 - DNA, 12 bp, Homo sapiens
tgtgaaaaatca

SEQ ID NO: 6506361 - DNA, 13 bp, Homo sapiens
tgtgaaaaatctg

SEQ ID NO: 6506362 - DNA, 14 bp, Homo sapiens
tgtgaaaaatgagc

SEQ ID NO: 6506363 - DNA, 14 bp, Homo sapiens
tgtgaaaacaatat

SEQ ID NO: 6506364 - DNA, 13 bp, Homo sapiens
tgtgaaaagaaaa

SEQ ID NO: 6506365 - DNA, 17 bp, Homo sapiens
tgtgaaaagaaaaatga

SEQ ID NO: 6506366 - DNA, 18 bp, Homo sapiens
tgtgaaaataaagcagaa

SEQ ID NO: 6506367 - DNA, 18 bp, Homo sapiens
tgtgaaaatatacttgac

SEQ ID NO: 6506368 - DNA, 21 bp, Homo sapiens
tgtgaaaatatacttgactct

SEQ ID NO: 6506369 - DNA, 13 bp, Homo sapiens
tgtgaaaatgctt

SEQ ID NO: 6506370 - DNA, 19 bp, Homo sapiens
tgtgaaacacacaatgtgg

SEQ ID NO: 6506371 - DNA, 16 bp, Homo sapiens
tgtgaaacacagctgt

SEQ ID NO: 6506372 - DNA, 21 bp, Homo sapiens
tgtgaaacagttgctgtgaac

SEQ ID NO: 6506373 - DNA, 14 bp, Homo sapiens
tgtgaaaccacagg

SEQ ID NO: 6506374 - DNA, 20 bp, Homo sapiens
tgtgaaacgtcccacacttt

SEQ ID NO: 6506375 - DNA, 20 bp, Homo sapiens
tgtgaaactctattatggaa

SEQ ID NO: 6506376 - DNA, 22 bp, Homo sapiens
tgtgaaactgaaggtcaataaa

SEQ ID NO: 6506377 - DNA, 14 bp, Homo sapiens
tgtgaaactttcat

SEQ ID NO: 6506378 - DNA, 14 bp, Homo sapiens
tgtgaaagaaaata

SEQ ID NO: 6506379 - DNA, 22 bp, Homo sapiens
tgtgaaagaaagctgagaagaa

SEQ ID NO: 6506380 - DNA, 11 bp, Homo sapiens
tgtgaaagaag

SEQ ID NO: 6506381 - DNA, 17 bp, Homo sapiens
tgtgaaagaagagaaaa

SEQ ID NO: 6506382 - DNA, 23 bp, Homo sapiens
tgtgaaagaagtatttaaacttt

SEQ ID NO: 6506383 - DNA, 23 bp, Homo sapiens
tgtgaaagaatcagtaggaccag

SEQ ID NO: 6506384 - DNA, 13 bp, Homo sapiens
tgtgaaaggaaag

SEQ ID NO: 6506385 - DNA, 14 bp, Homo sapiens
tgtgaaaggaaaga

SEQ ID NO: 6506386 - DNA, 15 bp, Homo sapiens
tgtgaaaggaaagag

SEQ ID NO: 6506387 - DNA, 20 bp, Homo sapiens
tgtgaaaggtaggaaactta

SEQ ID NO: 6506388 - DNA, 21 bp, Homo sapiens
tgtgaaaggtgctgatggccc

SEQ ID NO: 6506389 - DNA, 15 bp, Homo sapiens
tgtgaaagtctcctg

SEQ ID NO: 6506390 - DNA, 23 bp, Homo sapiens
tgtgaaagtgccaaaataaagtc

SEQ ID NO: 6506391 - DNA, 20 bp, Homo sapiens
tgtgaaataaaactggcttt

SEQ ID NO: 6506392 - DNA, 23 bp, Homo sapiens
tgtgaaataccacaagcctgaga

SEQ ID NO: 6506393 - DNA, 21 bp, Homo sapiens
tgtgaaatagttcaaagccaa

SEQ ID NO: 6506394 - DNA, 12 bp, Homo sapiens
tgtgaaatataa

SEQ ID NO: 6506395 - DNA, 23 bp, Homo sapiens
tgtgaaatcagtatcagaatact

SEQ ID NO: 6506396 - DNA, 18 bp, Homo sapiens
tgtgaaatcatcaaaaag

SEQ ID NO: 6506397 - DNA, 19 bp, Homo sapiens
tgtgaaatcatcaaaaaga

SEQ ID NO: 6506398 - DNA, 21 bp, Homo sapiens
tgtgaaatcatcaaaaagaaa

SEQ ID NO: 6506399 - DNA, 18 bp, Homo sapiens
tgtgaaatctcagaattt

SEQ ID NO: 6506400 - DNA, 14 bp, Homo sapiens
tgtgaaatgaaaac

SEQ ID NO: 6506401 - DNA, 14 bp, Homo sapiens
tgtgaaatgctggc

SEQ ID NO: 6506402 - DNA, 17 bp, Homo sapiens
tgtgaaatgctttctgt

SEQ ID NO: 6506403 - DNA, 12 bp, Homo sapiens
tgtgaaatgtaa

SEQ ID NO: 6506404 - DNA, 14 bp, Homo sapiens
tgtgaaatgtgcaa

SEQ ID NO: 6506405 - DNA, 23 bp, Homo sapiens
tgtgaaattcaacctgtgtctta

SEQ ID NO: 6506406 - DNA, 15 bp, Homo sapiens
tgtgaaattctcaga

SEQ ID NO: 6506407 - DNA, 19 bp, Homo sapiens
tgtgaaattctcagagtgt

SEQ ID NO: 6506408 - DNA, 10 bp, Homo sapiens
tgtgaaattt

SEQ ID NO: 6506409 - DNA, 14 bp, Homo sapiens
tgtgaaatttacat

SEQ ID NO: 6506410 - DNA, 19 bp, Homo sapiens
tgtgaaatttcatgattgg

SEQ ID NO: 6506411 - DNA, 15 bp, Homo sapiens
tgtgaaatttttcat

SEQ ID NO: 6506412 - DNA, 17 bp, Homo sapiens
tgtgaaatttttcatat

SEQ ID NO: 6506413 - DNA, 19 bp, Homo sapiens
tgtgaaatttttcatattt

SEQ ID NO: 6506414 - DNA, 20 bp, Homo sapiens
tgtgaaatttttcatatttt

SEQ ID NO: 6506415 - DNA, 14 bp, Homo sapiens
tgtgaacagaagtc

SEQ ID NO: 6506416 - DNA, 13 bp, Homo sapiens
tgtgaacagcttg

SEQ ID NO: 6506417 - DNA, 19 bp, Homo sapiens
tgtgaacagctttgtatgt

SEQ ID NO: 6506418 - DNA, 20 bp, Homo sapiens
tgtgaacagttgtgtttgaa

SEQ ID NO: 6506419 - DNA, 20 bp, Homo sapiens
tgtgaacataggtgtgcttc

SEQ ID NO: 6506420 - DNA, 13 bp, Homo sapiens
tgtgaacattctg

SEQ ID NO: 6506421 - DNA, 21 bp, Homo sapiens
tgtgaaccaccacacccagcc

SEQ ID NO: 6506422 - DNA, 15 bp, Homo sapiens
tgtgaacccaggaca

SEQ ID NO: 6506423 - DNA, 20 bp, Homo sapiens
tgtgaaccctagctgtgtca

SEQ ID NO: 6506424 - DNA, 17 bp, Homo sapiens
tgtgaacctacctgcct

SEQ ID NO: 6506425 - DNA, 19 bp, Homo sapiens
tgtgaacctacctgccttg

SEQ ID NO: 6506426 - DNA, 16 bp, Homo sapiens
tgtgaacgctgtgatg

SEQ ID NO: 6506427 - DNA, 22 bp, Homo sapiens
tgtgaacgtccttccttgactg

SEQ ID NO: 6506428 - DNA, 22 bp, Homo sapiens
tgtgaactaagttattgctgca

SEQ ID NO: 6506429 - DNA, 14 bp, Homo sapiens
tgtgaactattttg

SEQ ID NO: 6506430 - DNA, 17 bp, Homo sapiens
tgtgaactccatcattc

SEQ ID NO: 6506431 - DNA, 18 bp, Homo sapiens
tgtgaactgctttcaagt

SEQ ID NO: 6506432 - DNA, 13 bp, Homo sapiens
tgtgaactggaag

SEQ ID NO: 6506433 - DNA, 16 bp, Homo sapiens
tgtgaactggaagaaa

SEQ ID NO: 6506434 - DNA, 19 bp, Homo sapiens
tgtgaactggaagaaagca

SEQ ID NO: 6506435 - DNA, 20 bp, Homo sapiens
tgtgaactggaagaaagcaa

SEQ ID NO: 6506436 - DNA, 19 bp, Homo sapiens
tgtgaactgggcacagatt

SEQ ID NO: 6506437 - DNA, 21 bp, Homo sapiens
tgtgaactgggcacagattga

SEQ ID NO: 6506438 - DNA, 15 bp, Homo sapiens
tgtgaactgggcatt

SEQ ID NO: 6506439 - DNA, 15 bp, Homo sapiens
tgtgaacttggaagc

SEQ ID NO: 6506440 - DNA, 18 bp, Homo sapiens
tgtgaacttggaagcaca

SEQ ID NO: 6506441 - DNA, 15 bp, Homo sapiens
tgtgaacttgtagct

SEQ ID NO: 6506442 - DNA, 19 bp, Homo sapiens
tgtgaactttctcagcata

SEQ ID NO: 6506443 - DNA, 13 bp, Homo sapiens
tgtgaagaaatgg

SEQ ID NO: 6506444 - DNA, 16 bp, Homo sapiens
tgtgaagacacctgca

SEQ ID NO: 6506445 - DNA, 15 bp, Homo sapiens
tgtgaagacactgtg

SEQ ID NO: 6506446 - DNA, 21 bp, Homo sapiens
tgtgaagacattttttgctat

SEQ ID NO: 6506447 - DNA, 20 bp, Homo sapiens
tgtgaagacccaaaacagct

SEQ ID NO: 6506448 - DNA, 18 bp, Homo sapiens
tgtgaagacccagcagga

SEQ ID NO: 6506449 - DNA, 21 bp, Homo sapiens
tgtgaagagaatgtattctgt

SEQ ID NO: 6506450 - DNA, 22 bp, Homo sapiens
tgtgaagagaatgtattctgta

SEQ ID NO: 6506451 - DNA, 23 bp, Homo sapiens
tgtgaagagggacataagataaa

SEQ ID NO: 6506452 - DNA, 14 bp, Homo sapiens
tgtgaagaggtctg

SEQ ID NO: 6506453 - DNA, 22 bp, Homo sapiens
tgtgaagaggtctgattggctg

SEQ ID NO: 6506454 - DNA, 18 bp, Homo sapiens
tgtgaagataatttgcat

SEQ ID NO: 6506455 - DNA, 19 bp, Homo sapiens
tgtgaagataatttgcata

SEQ ID NO: 6506456 - DNA, 20 bp, Homo sapiens
tgtgaagatgcattgtagtt

SEQ ID NO: 6506457 - DNA, 13 bp, Homo sapiens
tgtgaagcaccta

SEQ ID NO: 6506458 - DNA, 13 bp, Homo sapiens
tgtgaagcatgct

SEQ ID NO: 6506459 - DNA, 22 bp, Homo sapiens
tgtgaagcatgctttgctgcta

SEQ ID NO: 6506460 - DNA, 16 bp, Homo sapiens
tgtgaagccagatctc

SEQ ID NO: 6506461 - DNA, 17 bp, Homo sapiens
tgtgaagccctgttgtg

SEQ ID NO: 6506462 - DNA, 17 bp, Homo sapiens
tgtgaagccctttgcct

SEQ ID NO: 6506463 - DNA, 19 bp, Homo sapiens
tgtgaagccctttgcctgt

SEQ ID NO: 6506464 - DNA, 16 bp, Homo sapiens
tgtgaagcctttatct

SEQ ID NO: 6506465 - DNA, 15 bp, Homo sapiens
tgtgaagctaatgaa

SEQ ID NO: 6506466 - DNA, 15 bp, Homo sapiens
tgtgaaggcagagaa

SEQ ID NO: 6506467 - DNA, 19 bp, Homo sapiens
tgtgaaggcagagaaaggg

SEQ ID NO: 6506468 - DNA, 23 bp, Homo sapiens
tgtgaaggcaggggaatgtatgt

SEQ ID NO: 6506469 - DNA, 20 bp, Homo sapiens
tgtgaaggtaactaagaagt

SEQ ID NO: 6506470 - DNA, 16 bp, Homo sapiens
tgtgaaggtcttgcct

SEQ ID NO: 6506471 - DNA, 17 bp, Homo sapiens
tgtgaaggtgatttaag

SEQ ID NO: 6506472 - DNA, 23 bp, Homo sapiens
tgtgaagtaacccctcctggctg

SEQ ID NO: 6506473 - DNA, 19 bp, Homo sapiens
tgtgaagtccacttatgta

SEQ ID NO: 6506474 - DNA, 17 bp, Homo sapiens
tgtgaagtgttgtggag

SEQ ID NO: 6506475 - DNA, 21 bp, Homo sapiens
tgtgaagttacatgcataaaa

SEQ ID NO: 6506476 - DNA, 20 bp, Homo sapiens
tgtgaagtttacattgtaaa

SEQ ID NO: 6506477 - DNA, 16 bp, Homo sapiens
tgtgaagtttggagat

SEQ ID NO: 6506478 - DNA, 19 bp, Homo sapiens
tgtgaatacaattaaaggt

SEQ ID NO: 6506479 - DNA, 14 bp, Homo sapiens
tgtgaatactgctt

SEQ ID NO: 6506480 - DNA, 22 bp, Homo sapiens
tgtgaatagaactctgaaatga

SEQ ID NO: 6506481 - DNA, 16 bp, Homo sapiens
tgtgaatagattttag

SEQ ID NO: 6506482 - DNA, 15 bp, Homo sapiens
tgtgaatagcctggc

SEQ ID NO: 6506483 - DNA, 16 bp, Homo sapiens
tgccatgatgcctctg

SEQ ID NO: 6506484 - DNA, 14 bp, Homo sapiens
tgccatgatgttta

SEQ ID NO: 6506485 - DNA, 14 bp, Homo sapiens
tgccatgatttttg

SEQ ID NO: 6506486 - DNA, 13 bp, Homo sapiens
tgccatgcaggaa

SEQ ID NO: 6506487 - DNA, 14 bp, Homo sapiens
tgccatgcatacat

SEQ ID NO: 6506488 - DNA, 17 bp, Homo sapiens
tgccatgcatacatgct

SEQ ID NO: 6506489 - DNA, 22 bp, Homo sapiens
tgccatgccactgccaggcacc

SEQ ID NO: 6506490 - DNA, 15 bp, Homo sapiens
tgccatgcccaccat

SEQ ID NO: 6506491 - DNA, 13 bp, Homo sapiens
tgccatgcccagg

SEQ ID NO: 6506492 - DNA, 15 bp, Homo sapiens
tgccatgcctgctcc

SEQ ID NO: 6506493 - DNA, 16 bp, Homo sapiens
tgccatgcctgctccc

SEQ ID NO: 6506494 - DNA, 20 bp, Homo sapiens
tgccatgcctgctccctgtc

SEQ ID NO: 6506495 - DNA, 17 bp, Homo sapiens
tgccatgctgctatgaa

SEQ ID NO: 6506496 - DNA, 21 bp, Homo sapiens
tgccatgctgctatgaagact

SEQ ID NO: 6506497 - DNA, 15 bp, Homo sapiens
tgccatgctttgagt

SEQ ID NO: 6506498 - DNA, 13 bp, Homo sapiens
tgccatgcttttt

SEQ ID NO: 6506499 - DNA, 22 bp, Homo sapiens
tgccatggaagaggctacaggg

SEQ ID NO: 6506500 - DNA, 21 bp, Homo sapiens
tgccatggaatgactgaagac

SEQ ID NO: 6506501 - DNA, 17 bp, Homo sapiens
tgccatggaggcacaca

SEQ ID NO: 6506502 - DNA, 18 bp, Homo sapiens
tgccatggaggcacacag

SEQ ID NO: 6506503 - DNA, 23 bp, Homo sapiens
tgccatggaggcacacagctgca

SEQ ID NO: 6506504 - DNA, 17 bp, Homo sapiens
tgccatggatctgatct

SEQ ID NO: 6506505 - DNA, 20 bp, Homo sapiens
tgccatggatttccactgct

SEQ ID NO: 6506506 - DNA, 15 bp, Homo sapiens
tgccatggccaggag

SEQ ID NO: 6506507 - DNA, 15 bp, Homo sapiens
tgccatggcccccca

SEQ ID NO: 6506508 - DNA, 19 bp, Homo sapiens
tgccatggccccccactcc

SEQ ID NO: 6506509 - DNA, 19 bp, Homo sapiens
tgccatggcctgtgctggg

SEQ ID NO: 6506510 - DNA, 17 bp, Homo sapiens
tgccatggcgtgtccct

SEQ ID NO: 6506511 - DNA, 22 bp, Homo sapiens
tgccatggctaggtagaagtga

SEQ ID NO: 6506512 - DNA, 14 bp, Homo sapiens
tgccatggctgggg

SEQ ID NO: 6506513 - DNA, 15 bp, Homo sapiens
tgccatgggaaacaa

SEQ ID NO: 6506514 - DNA, 12 bp, Homo sapiens
tgccatgggaga

SEQ ID NO: 6506515 - DNA, 15 bp, Homo sapiens
tgccatgggccagcc

SEQ ID NO: 6506516 - DNA, 18 bp, Homo sapiens
tgccatgggccagcctag

SEQ ID NO: 6506517 - DNA, 16 bp, Homo sapiens
tgccatgggcctgctg

SEQ ID NO: 6506518 - DNA, 19 bp, Homo sapiens
tgccatgggtgcagaccct

SEQ ID NO: 6506519 - DNA, 18 bp, Homo sapiens
tgccatgtaaatccccac

SEQ ID NO: 6506520 - DNA, 14 bp, Homo sapiens
tgccatgtacctcc

SEQ ID NO: 6506521 - DNA, 17 bp, Homo sapiens
tgccatgtacctcccct

SEQ ID NO: 6506522 - DNA, 18 bp, Homo sapiens
tgccatgtacctcccctg

SEQ ID NO: 6506523 - DNA, 23 bp, Homo sapiens
tgccatgtacctcccctgccttg

SEQ ID NO: 6506524 - DNA, 16 bp, Homo sapiens
tgccatgtagcagaca

SEQ ID NO: 6506525 - DNA, 16 bp, Homo sapiens
tgccatgtaggctaag

SEQ ID NO: 6506526 - DNA, 17 bp, Homo sapiens
tgccatgtaggctaaga

SEQ ID NO: 6506527 - DNA, 22 bp, Homo sapiens
tgccatgtctgcagtgtgcccc

SEQ ID NO: 6506528 - DNA, 15 bp, Homo sapiens
tgccatgtgccaggt

SEQ ID NO: 6506529 - DNA, 16 bp, Homo sapiens
tgccatgtggagtgga

SEQ ID NO: 6506530 - DNA, 15 bp, Homo sapiens
tgccatgtgtaagtt

SEQ ID NO: 6506531 - DNA, 14 bp, Homo sapiens
tgccatgtgtgagt

SEQ ID NO: 6506532 - DNA, 18 bp, Homo sapiens
tgccatgtgtgagtcact

SEQ ID NO: 6506533 - DNA, 15 bp, Homo sapiens
tgccatgttgcccct

SEQ ID NO: 6506534 - DNA, 16 bp, Homo sapiens
tgccatgttggccagg

SEQ ID NO: 6506535 - DNA, 23 bp, Homo sapiens
tgccatgtttttcccctgctccc

SEQ ID NO: 6506536 - DNA, 18 bp, Homo sapiens
tgccattaaatagggaaa

SEQ ID NO: 6506537 - DNA, 18 bp, Homo sapiens
tgccattacactccagcc

SEQ ID NO: 6506538 - DNA, 20 bp, Homo sapiens
tgccattacactccagcctg

SEQ ID NO: 6506539 - DNA, 22 bp, Homo sapiens
tgccattacactccagcctggg

SEQ ID NO: 6506540 - DNA, 14 bp, Homo sapiens
tgccattacccagt

SEQ ID NO: 6506541 - DNA, 17 bp, Homo sapiens
tgccattacccagtgcc

SEQ ID NO: 6506542 - DNA, 18 bp, Homo sapiens
tgccattactactgtaca

SEQ ID NO: 6506543 - DNA, 16 bp, Homo sapiens
tgccattagccaagga

SEQ ID NO: 6506544 - DNA, 16 bp, Homo sapiens
tgccattatagcgcct

SEQ ID NO: 6506545 - DNA, 16 bp, Homo sapiens
tgccattatatttgca

SEQ ID NO: 6506546 - DNA, 18 bp, Homo sapiens
tgccattatatttgcatt

SEQ ID NO: 6506547 - DNA, 19 bp, Homo sapiens
tgccattatatttgcatta

SEQ ID NO: 6506548 - DNA, 21 bp, Homo sapiens
tgccattatgcaaatggagat

SEQ ID NO: 6506549 - DNA, 17 bp, Homo sapiens
tgccattattctatgta

SEQ ID NO: 6506550 - DNA, 20 bp, Homo sapiens
tgccattattttctgtcaga

SEQ ID NO: 6506551 - DNA, 21 bp, Homo sapiens
tgccattattttctgtcagat

SEQ ID NO: 6506552 - DNA, 19 bp, Homo sapiens
tgccattcaaggcttattt

SEQ ID NO: 6506553 - DNA, 16 bp, Homo sapiens
tgccattcacttcata

SEQ ID NO: 6506554 - DNA, 18 bp, Homo sapiens
tgccattccactccactc

SEQ ID NO: 6506555 - DNA, 14 bp, Homo sapiens
tgccattctccagt

SEQ ID NO: 6506556 - DNA, 20 bp, Homo sapiens
tgccattctgcatgagctga

SEQ ID NO: 6506557 - DNA, 14 bp, Homo sapiens
tgccattctgtgca

SEQ ID NO: 6506558 - DNA, 16 bp, Homo sapiens
tgccattcttctggtg

SEQ ID NO: 6506559 - DNA, 23 bp, Homo sapiens
tgccattgaaggcttaattgact

SEQ ID NO: 6506560 - DNA, 14 bp, Homo sapiens
tgccattggcctct

SEQ ID NO: 6506561 - DNA, 13 bp, Homo sapiens
tgccattgggacc

SEQ ID NO: 6506562 - DNA, 17 bp, Homo sapiens
tgccattgggaccctcc

SEQ ID NO: 6506563 - DNA, 18 bp, Homo sapiens
tgccattgtactccagcc

SEQ ID NO: 6506564 - DNA, 20 bp, Homo sapiens
tgccattgtagcgtctttct

SEQ ID NO: 6506565 - DNA, 16 bp, Homo sapiens
tgccattgtctttata

SEQ ID NO: 6506566 - DNA, 17 bp, Homo sapiens
tgccatttaaaaagttg

SEQ ID NO: 6506567 - DNA, 20 bp, Homo sapiens
tgccatttagaatctagaaa

SEQ ID NO: 6506568 - DNA, 19 bp, Homo sapiens
tgccatttagcaataaata

SEQ ID NO: 6506569 - DNA, 14 bp, Homo sapiens
tgccatttatttat

SEQ ID NO: 6506570 - DNA, 23 bp, Homo sapiens
tgccatttcctcctgggcaacag

SEQ ID NO: 6506571 - DNA, 16 bp, Homo sapiens
tgccatttcctgtctg

SEQ ID NO: 6506572 - DNA, 16 bp, Homo sapiens
tgccatttctctgctt

SEQ ID NO: 6506573 - DNA, 15 bp, Homo sapiens
tgccatttcttccca

SEQ ID NO: 6506574 - DNA, 17 bp, Homo sapiens
tgccatttcttcccaag

SEQ ID NO: 6506575 - DNA, 19 bp, Homo sapiens
tgccatttcttcccaaggc

SEQ ID NO: 6506576 - DNA, 15 bp, Homo sapiens
tgccatttcttctct

SEQ ID NO: 6506577 - DNA, 17 bp, Homo sapiens
tgccatttcttctctct

SEQ ID NO: 6506578 - DNA, 21 bp, Homo sapiens
tgccatttcttctctctgttc

SEQ ID NO: 6506579 - DNA, 22 bp, Homo sapiens
tgccatttggtgtggattttct

SEQ ID NO: 6506580 - DNA, 23 bp, Homo sapiens
tgccatttggtgtggattttcta

SEQ ID NO: 6506581 - DNA, 19 bp, Homo sapiens
tgccattttaaaaatagaa

SEQ ID NO: 6506582 - DNA, 17 bp, Homo sapiens
tgccattttctgtaaag

SEQ ID NO: 6506583 - DNA, 14 bp, Homo sapiens
tgccattttgcatt

SEQ ID NO: 6506584 - DNA, 18 bp, Homo sapiens
tgccatttttattagaaa

SEQ ID NO: 6506585 - DNA, 17 bp, Homo sapiens
tgccatttttctataaa

SEQ ID NO: 6506586 - DNA, 21 bp, Homo sapiens
tgccatttttctataaatcag

SEQ ID NO: 6506587 - DNA, 19 bp, Homo sapiens
tgccattttttgtctgtga

SEQ ID NO: 6506588 - DNA, 17 bp, Homo sapiens
tgcccaaaatgtgaagc

SEQ ID NO: 6506589 - DNA, 15 bp, Homo sapiens
tgcccaaactcccct

SEQ ID NO: 6506590 - DNA, 23 bp, Homo sapiens
tgcccaaactccccttccctggg

SEQ ID NO: 6506591 - DNA, 23 bp, Homo sapiens
tgcccaaagagcacaaacatttt

SEQ ID NO: 6506592 - DNA, 23 bp, Homo sapiens
tgcccaaagcagcacttataaat

SEQ ID NO: 6506593 - DNA, 21 bp, Homo sapiens
tgcccaaagtgcttccaaggc

SEQ ID NO: 6506594 - DNA, 17 bp, Homo sapiens
tgcccaaagtggggagg

SEQ ID NO: 6506595 - DNA, 18 bp, Homo sapiens
tgcccaaatataacatga

SEQ ID NO: 6506596 - DNA, 19 bp, Homo sapiens
tgcccaaatcccctccctg

SEQ ID NO: 6506597 - DNA, 23 bp, Homo sapiens
tgcccaaccaggttgcagtagca

SEQ ID NO: 6506598 - DNA, 20 bp, Homo sapiens
tgcccaacccttccctcacc

SEQ ID NO: 6506599 - DNA, 22 bp, Homo sapiens
tgcccaacccttccctcacctt

SEQ ID NO: 6506600 - DNA, 13 bp, Homo sapiens
tgcccaacctcag

SEQ ID NO: 6506601 - DNA, 15 bp, Homo sapiens
tgcccaacctcagca

SEQ ID NO: 6506602 - DNA, 22 bp, Homo sapiens
tgcccaacctgctctcctcttg

SEQ ID NO: 6506603 - DNA, 14 bp, Homo sapiens
tgcccaactcccag

SEQ ID NO: 6506604 - DNA, 17 bp, Homo sapiens
tgcccaactcccagcca

SEQ ID NO: 6506605 - DNA, 18 bp, Homo sapiens
tgcccaactgtgtagcat

SEQ ID NO: 6506606 - DNA, 14 bp, Homo sapiens
tgcccaactgttat

SEQ ID NO: 6506607 - DNA, 21 bp, Homo sapiens
tgcccaagaatagatgctgac

SEQ ID NO: 6506608 - DNA, 23 bp, Homo sapiens
tgcccaagataggagttctctga

SEQ ID NO: 6506609 - DNA, 18 bp, Homo sapiens
tgcccaagcagcctggag

SEQ ID NO: 6506610 - DNA, 20 bp, Homo sapiens
tgcccaagcagcctggagac

SEQ ID NO: 6506611 - DNA, 15 bp, Homo sapiens
tgcccaagccagagg

SEQ ID NO: 6506612 - DNA, 20 bp, Homo sapiens
tgcccaagccagaggctggg

SEQ ID NO: 6506613 - DNA, 14 bp, Homo sapiens
tgcccaagcccagg

SEQ ID NO: 6506614 - DNA, 18 bp, Homo sapiens
tgcccaagcccaggccac

SEQ ID NO: 6506615 - DNA, 15 bp, Homo sapiens
tgcccaaggatgcct

SEQ ID NO: 6506616 - DNA, 18 bp, Homo sapiens
tgcccaaggatgccttag

SEQ ID NO: 6506617 - DNA, 22 bp, Homo sapiens
tgcccaagggcctcccaccaga

SEQ ID NO: 6506618 - DNA, 19 bp, Homo sapiens
tgcccaaggttgcacagca

SEQ ID NO: 6506619 - DNA, 17 bp, Homo sapiens
tgcccaagtcacacagc

SEQ ID NO: 6506620 - DNA, 19 bp, Homo sapiens
tgcccaagtcacacagcta

SEQ ID NO: 6506621 - DNA, 15 bp, Homo sapiens
tgcccaagtgaccag

SEQ ID NO: 6506622 - DNA, 15 bp, Homo sapiens
tgcccaagtggctct

SEQ ID NO: 6506623 - DNA, 22 bp, Homo sapiens
tgcccaagtggctcttgggaca

SEQ ID NO: 6506624 - DNA, 14 bp, Homo sapiens
tgcccaagtgggca

SEQ ID NO: 6506625 - DNA, 16 bp, Homo sapiens
tgcccaagttgctctg

SEQ ID NO: 6506626 - DNA, 17 bp, Homo sapiens
tgcccaatccaggcccg

SEQ ID NO: 6506627 - DNA, 16 bp, Homo sapiens
tgcccaatcctccctg

SEQ ID NO: 6506628 - DNA, 17 bp, Homo sapiens
tgcccaatcctccctgg

SEQ ID NO: 6506629 - DNA, 20 bp, Homo sapiens
tgcccaatgagactctaggg

SEQ ID NO: 6506630 - DNA, 20 bp, Homo sapiens
tgcccaatgctttgggaggc

SEQ ID NO: 6506631 - DNA, 19 bp, Homo sapiens
tgcccaattccaggtgtgc

SEQ ID NO: 6506632 - DNA, 21 bp, Homo sapiens
tgcccaattggaggaaagcaa

SEQ ID NO: 6506633 - DNA, 14 bp, Homo sapiens
tgcccacaacgtcc

SEQ ID NO: 6506634 - DNA, 20 bp, Homo sapiens
tgcccacaacttgtcaccca

SEQ ID NO: 6506635 - DNA, 11 bp, Homo sapiens
tgcccacacac

SEQ ID NO: 6506636 - DNA, 15 bp, Homo sapiens
tgcccacacactttc

SEQ ID NO: 6506637 - DNA, 16 bp, Homo sapiens
tgcccacacactttcc

SEQ ID NO: 6506638 - DNA, 21 bp, Homo sapiens
tgcccacaccaccgccctcct

SEQ ID NO: 6506639 - DNA, 15 bp, Homo sapiens
tgcccacacctcctg

SEQ ID NO: 6506640 - DNA, 17 bp, Homo sapiens
tgcccacacctcctggg

SEQ ID NO: 6506641 - DNA, 12 bp, Homo sapiens
tgcccacagcag

SEQ ID NO: 6506642 - DNA, 12 bp, Homo sapiens
tgcccacagccc

SEQ ID NO: 6506643 - DNA, 16 bp, Homo sapiens
tgcccacaggatcagt

SEQ ID NO: 6506644 - DNA, 20 bp, Homo sapiens
tgcccacaggatcagtctga

SEQ ID NO: 6506645 - DNA, 21 bp, Homo sapiens
tgcccacaggccgccctgcgg

SEQ ID NO: 6506646 - DNA, 18 bp, Homo sapiens
tgcccacagggaccaaga

SEQ ID NO: 6506647 - DNA, 23 bp, Homo sapiens
tgcccacagtgtcaggcactggg

SEQ ID NO: 6506648 - DNA, 15 bp, Homo sapiens
tgcccacatactgtc

SEQ ID NO: 6506649 - DNA, 23 bp, Homo sapiens
tgcccacatcccaggcttcaccc

SEQ ID NO: 6506650 - DNA, 18 bp, Homo sapiens
tgcccacatgggacctgg

SEQ ID NO: 6506651 - DNA, 18 bp, Homo sapiens
tgcccacatttagtctct

SEQ ID NO: 6506652 - DNA, 13 bp, Homo sapiens
tgcccaccaaagg

SEQ ID NO: 6506653 - DNA, 17 bp, Homo sapiens
tgcccaccaacatccca

SEQ ID NO: 6506654 - DNA, 20 bp, Homo sapiens
tgcccaccacaactaacaat

SEQ ID NO: 6506655 - DNA, 22 bp, Homo sapiens
tgcccaccaccgtgtcatgaga

SEQ ID NO: 6506656 - DNA, 13 bp, Homo sapiens
tgcccaccagctg

SEQ ID NO: 6506657 - DNA, 17 bp, Homo sapiens
tgcccaccccagcatca

SEQ ID NO: 6506658 - DNA, 11 bp, Homo sapiens
tgcccaccccc

SEQ ID NO: 6506659 - DNA, 14 bp, Homo sapiens
tgcccacccccggg

SEQ ID NO: 6506660 - DNA, 22 bp, Homo sapiens
tgcccacccccgggatcctgcc

SEQ ID NO: 6506661 - DNA, 14 bp, Homo sapiens
tgtgaatagtctgt

SEQ ID NO: 6506662 - DNA, 15 bp, Homo sapiens
tgtgaatataaatgt

SEQ ID NO: 6506663 - DNA, 20 bp, Homo sapiens
tgtgaatataaatgtgtgta

SEQ ID NO: 6506664 - DNA, 14 bp, Homo sapiens
tgtgaatatgagaa

SEQ ID NO: 6506665 - DNA, 16 bp, Homo sapiens
tgtgaatatgagaaat

SEQ ID NO: 6506666 - DNA, 18 bp, Homo sapiens
tgtgaatattgtggctcc

SEQ ID NO: 6506667 - DNA, 16 bp, Homo sapiens
tgtgaatcaagggtca

SEQ ID NO: 6506668 - DNA, 21 bp, Homo sapiens
tgtgaatcaagggtcaggcct

SEQ ID NO: 6506669 - DNA, 22 bp, Homo sapiens
tgtgaatcaagggtcaggcctt

SEQ ID NO: 6506670 - DNA, 21 bp, Homo sapiens
tgtgaatccatgggtctggct

SEQ ID NO: 6506671 - DNA, 18 bp, Homo sapiens
tgtgaatcgcaaggcctg

SEQ ID NO: 6506672 - DNA, 14 bp, Homo sapiens
tgtgaatcgcagct

SEQ ID NO: 6506673 - DNA, 17 bp, Homo sapiens
tgtgaatcgcagctgtg

SEQ ID NO: 6506674 - DNA, 22 bp, Homo sapiens
tgtgaatctgcttttcctctgc

SEQ ID NO: 6506675 - DNA, 17 bp, Homo sapiens
tgtgaatctgggtggga

SEQ ID NO: 6506676 - DNA, 14 bp, Homo sapiens
tgtgaatctgttga

SEQ ID NO: 6506677 - DNA, 16 bp, Homo sapiens
tgtgaatcttgaataa

SEQ ID NO: 6506678 - DNA, 23 bp, Homo sapiens
tgtgaatgaacactcttttgctt

SEQ ID NO: 6506679 - DNA, 19 bp, Homo sapiens
tgtgaatgattcatgttat

SEQ ID NO: 6506680 - DNA, 20 bp, Homo sapiens
tgtgaatgattcatgttata

SEQ ID NO: 6506681 - DNA, 14 bp, Homo sapiens
tgtgaatgcaggtt

SEQ ID NO: 6506682 - DNA, 17 bp, Homo sapiens
tgtgaatgccactgcct

SEQ ID NO: 6506683 - DNA, 13 bp, Homo sapiens
tgtgaatgctaag

SEQ ID NO: 6506684 - DNA, 19 bp, Homo sapiens
tgtgaatgctgggcccctg

SEQ ID NO: 6506685 - DNA, 22 bp, Homo sapiens
tgtgaatgctgtacctttctga

SEQ ID NO: 6506686 - DNA, 14 bp, Homo sapiens
tgtgaatgcttctc

SEQ ID NO: 6506687 - DNA, 17 bp, Homo sapiens
tgtgaatgcttctcact

SEQ ID NO: 6506688 - DNA, 16 bp, Homo sapiens
tgtgaatggaggcaga

SEQ ID NO: 6506689 - DNA, 15 bp, Homo sapiens
tgtgaatggattgga

SEQ ID NO: 6506690 - DNA, 22 bp, Homo sapiens
tgtgaatggattggattattta

SEQ ID NO: 6506691 - DNA, 17 bp, Homo sapiens
tgtgaatggctgtgccc

SEQ ID NO: 6506692 - DNA, 17 bp, Homo sapiens
tgtgaatggttgcaaag

SEQ ID NO: 6506693 - DNA, 11 bp, Homo sapiens
tgtgaatgtag

SEQ ID NO: 6506694 - DNA, 12 bp, Homo sapiens
tgtgaatgtagc

SEQ ID NO: 6506695 - DNA, 23 bp, Homo sapiens
tgtgaatgttgtcctgtgtcatc

SEQ ID NO: 6506696 - DNA, 15 bp, Homo sapiens
tgtgaattactaact

SEQ ID NO: 6506697 - DNA, 19 bp, Homo sapiens
tgtgaattaggctgtaact

SEQ ID NO: 6506698 - DNA, 22 bp, Homo sapiens
tgtgaattaggctgtaactact

SEQ ID NO: 6506699 - DNA, 16 bp, Homo sapiens
tgtgaattattgacac

SEQ ID NO: 6506700 - DNA, 17 bp, Homo sapiens
tgtgaattattgacact

SEQ ID NO: 6506701 - DNA, 19 bp, Homo sapiens
tgtgaattattgacactga

SEQ ID NO: 6506702 - DNA, 18 bp, Homo sapiens
tgtgaattcccagactct

SEQ ID NO: 6506703 - DNA, 16 bp, Homo sapiens
tgtgaattctgtgaag

SEQ ID NO: 6506704 - DNA, 19 bp, Homo sapiens
tgtgaattgaaatgttcgt

SEQ ID NO: 6506705 - DNA, 20 bp, Homo sapiens
tgtgaattgaagtcatcata

SEQ ID NO: 6506706 - DNA, 15 bp, Homo sapiens
tgtgaattgactacc

SEQ ID NO: 6506707 - DNA, 17 bp, Homo sapiens
tgtgaattgataataaa

SEQ ID NO: 6506708 - DNA, 18 bp, Homo sapiens
tgtgaattgcctgcagag

SEQ ID NO: 6506709 - DNA, 17 bp, Homo sapiens
tgtgaattgcctgccat

SEQ ID NO: 6506710 - DNA, 19 bp, Homo sapiens
tgtgaattgcctgccatgg

SEQ ID NO: 6506711 - DNA, 23 bp, Homo sapiens
tgtgaattgcctgccatggctgt

SEQ ID NO: 6506712 - DNA, 19 bp, Homo sapiens
tgtgaattgtttttgtaca

SEQ ID NO: 6506713 - DNA, 16 bp, Homo sapiens
tgtgaatttcaaaaaa

SEQ ID NO: 6506714 - DNA, 23 bp, Homo sapiens
tgtgaatttcttcactgttgaaa

SEQ ID NO: 6506715 - DNA, 21 bp, Homo sapiens
tgtgaatttgccagaggacca

SEQ ID NO: 6506716 - DNA, 20 bp, Homo sapiens
tgtgaattttaaaatgcaaa

SEQ ID NO: 6506717 - DNA, 19 bp, Homo sapiens
tgtgaatttttaagctgca

SEQ ID NO: 6506718 - DNA, 22 bp, Homo sapiens
tgtgaatttttaagctgcaaat

SEQ ID NO: 6506719 - DNA, 15 bp, Homo sapiens
tgtgacaaaaaatta

SEQ ID NO: 6506720 - DNA, 16 bp, Homo sapiens
tgtgacaaaaaattaa

SEQ ID NO: 6506721 - DNA, 13 bp, Homo sapiens
tgtgacaaaggat

SEQ ID NO: 6506722 - DNA, 12 bp, Homo sapiens
tgtgacaacatt

SEQ ID NO: 6506723 - DNA, 23 bp, Homo sapiens
tgtgacaacatttttgtacatta

SEQ ID NO: 6506724 - DNA, 14 bp, Homo sapiens
tgtgacaaccctgg

SEQ ID NO: 6506725 - DNA, 15 bp, Homo sapiens
tgtgacaaccctggc

SEQ ID NO: 6506726 - DNA, 18 bp, Homo sapiens
tgtgacaaccctggcctc

SEQ ID NO: 6506727 - DNA, 22 bp, Homo sapiens
tgtgacaacctttgtgtaataa

SEQ ID NO: 6506728 - DNA, 22 bp, Homo sapiens
tgtgacaactaaacaaggcatt

SEQ ID NO: 6506729 - DNA, 19 bp, Homo sapiens
tgtgacaactgtctaactt

SEQ ID NO: 6506730 - DNA, 13 bp, Homo sapiens
tgtgacaagccaa

SEQ ID NO: 6506731 - DNA, 19 bp, Homo sapiens
tgtgacaataagtttgaac

SEQ ID NO: 6506732 - DNA, 14 bp, Homo sapiens
tgtgacaataataa

SEQ ID NO: 6506733 - DNA, 15 bp, Homo sapiens
tgtgacaatgactaa

SEQ ID NO: 6506734 - DNA, 21 bp, Homo sapiens
tgtgacaattctgtttttaat

SEQ ID NO: 6506735 - DNA, 15 bp, Homo sapiens
tgtgacacactacac

SEQ ID NO: 6506736 - DNA, 16 bp, Homo sapiens
tgtgacacactacacc

SEQ ID NO: 6506737 - DNA, 19 bp, Homo sapiens
tgtgacacactacaccaca

SEQ ID NO: 6506738 - DNA, 21 bp, Homo sapiens
tgtgacacactacaccacaca

SEQ ID NO: 6506739 - DNA, 18 bp, Homo sapiens
tgtgacaccagaataatg

SEQ ID NO: 6506740 - DNA, 16 bp, Homo sapiens
tgtgacacccacaatc

SEQ ID NO: 6506741 - DNA, 22 bp, Homo sapiens
tgtgacacccacaatcccacct

SEQ ID NO: 6506742 - DNA, 20 bp, Homo sapiens
tgtgacaccccccttctgaa

SEQ ID NO: 6506743 - DNA, 23 bp, Homo sapiens
tgtgacacctaactcttttctat

SEQ ID NO: 6506744 - DNA, 14 bp, Homo sapiens
tgtgacacctggtg

SEQ ID NO: 6506745 - DNA, 21 bp, Homo sapiens
tgtgacacctggtgcgggcct

SEQ ID NO: 6506746 - DNA, 23 bp, Homo sapiens
tgtgacacctggtgcgggcctgg

SEQ ID NO: 6506747 - DNA, 16 bp, Homo sapiens
tgtgacagaatcttgt

SEQ ID NO: 6506748 - DNA, 20 bp, Homo sapiens
tgtgacagaatcttgtattt

SEQ ID NO: 6506749 - DNA, 22 bp, Homo sapiens
tgtgacagaatcttgtatttgg

SEQ ID NO: 6506750 - DNA, 23 bp, Homo sapiens
tgtgacagctctttttgtgaagt

SEQ ID NO: 6506751 - DNA, 19 bp, Homo sapiens
tgtgacaggaaagccctcc

SEQ ID NO: 6506752 - DNA, 22 bp, Homo sapiens
tgtgacaggaagcccaaggcag

SEQ ID NO: 6506753 - DNA, 22 bp, Homo sapiens
tgtgacagggccagtggggcct

SEQ ID NO: 6506754 - DNA, 20 bp, Homo sapiens
tgtgacagtgcctcttccag

SEQ ID NO: 6506755 - DNA, 16 bp, Homo sapiens
tgtgacagtttccaaa

SEQ ID NO: 6506756 - DNA, 17 bp, Homo sapiens
tgtgacagtttccaaat

SEQ ID NO: 6506757 - DNA, 18 bp, Homo sapiens
tgtgacagtttccaaatt

SEQ ID NO: 6506758 - DNA, 16 bp, Homo sapiens
tgtgacataccccctc

SEQ ID NO: 6506759 - DNA, 21 bp, Homo sapiens
tgtgacataccccctccccca

SEQ ID NO: 6506760 - DNA, 19 bp, Homo sapiens
tgtgacatcacagggcctc

SEQ ID NO: 6506761 - DNA, 21 bp, Homo sapiens
tgtgacatcacagggcctcag

SEQ ID NO: 6506762 - DNA, 13 bp, Homo sapiens
tgtgacatgctaa

SEQ ID NO: 6506763 - DNA, 16 bp, Homo sapiens
tgtgacatggtgcctg

SEQ ID NO: 6506764 - DNA, 17 bp, Homo sapiens
tgtgacatggtgcctga

SEQ ID NO: 6506765 - DNA, 22 bp, Homo sapiens
tgtgacatggtgcctgagaggc

SEQ ID NO: 6506766 - DNA, 16 bp, Homo sapiens
tgtgacattcctgatt

SEQ ID NO: 6506767 - DNA, 13 bp, Homo sapiens
tgtgacattcctt

SEQ ID NO: 6506768 - DNA, 12 bp, Homo sapiens
tgtgacattgct

SEQ ID NO: 6506769 - DNA, 21 bp, Homo sapiens
tgtgacatttgtcattttcat

SEQ ID NO: 6506770 - DNA, 19 bp, Homo sapiens
tgtgaccaactgtgttgta

SEQ ID NO: 6506771 - DNA, 19 bp, Homo sapiens
tgtgaccaagtataaactt

SEQ ID NO: 6506772 - DNA, 17 bp, Homo sapiens
tgtgaccaatacatttg

SEQ ID NO: 6506773 - DNA, 18 bp, Homo sapiens
tgtgaccaatacatttgt

SEQ ID NO: 6506774 - DNA, 21 bp, Homo sapiens
tgtgaccaatacatttgtatt

SEQ ID NO: 6506775 - DNA, 15 bp, Homo sapiens
tgtgaccacaacatg

SEQ ID NO: 6506776 - DNA, 22 bp, Homo sapiens
tgtgaccacatacgtgttagga

SEQ ID NO: 6506777 - DNA, 22 bp, Homo sapiens
tgtgaccactgaattcactcca

SEQ ID NO: 6506778 - DNA, 16 bp, Homo sapiens
tgtgaccagaaagctt

SEQ ID NO: 6506779 - DNA, 14 bp, Homo sapiens
tgtgaccagcactg

SEQ ID NO: 6506780 - DNA, 19 bp, Homo sapiens
tgtgaccagtctgaccctt

SEQ ID NO: 6506781 - DNA, 14 bp, Homo sapiens
tgtgaccagttttg

SEQ ID NO: 6506782 - DNA, 14 bp, Homo sapiens
tgtgacccaccagt

SEQ ID NO: 6506783 - DNA, 15 bp, Homo sapiens
tgtgacccaccagtg

SEQ ID NO: 6506784 - DNA, 21 bp, Homo sapiens
tgtgacccacttctcatcaca

SEQ ID NO: 6506785 - DNA, 20 bp, Homo sapiens
tgtgacccagcactgcccaa

SEQ ID NO: 6506786 - DNA, 15 bp, Homo sapiens
tgtgaccccactgcc

SEQ ID NO: 6506787 - DNA, 16 bp, Homo sapiens
tgtgacccctcctggg

SEQ ID NO: 6506788 - DNA, 17 bp, Homo sapiens
tgtgacccctcctgggg

SEQ ID NO: 6506789 - DNA, 16 bp, Homo sapiens
tgtgacccctccttgt

SEQ ID NO: 6506790 - DNA, 14 bp, Homo sapiens
tgtgacccctttca

SEQ ID NO: 6506791 - DNA, 20 bp, Homo sapiens
tgtgacccgtgaatgtgcct

SEQ ID NO: 6506792 - DNA, 13 bp, Homo sapiens
tgtgaccctccaa

SEQ ID NO: 6506793 - DNA, 15 bp, Homo sapiens
tgtgaccctccaaat

SEQ ID NO: 6506794 - DNA, 13 bp, Homo sapiens
tgtgaccctctca

SEQ ID NO: 6506795 - DNA, 18 bp, Homo sapiens
tgtgaccctctttgctga

SEQ ID NO: 6506796 - DNA, 22 bp, Homo sapiens
tgtgaccctgggcaagtcactt

SEQ ID NO: 6506797 - DNA, 17 bp, Homo sapiens
tgtgacccttgtcatct

SEQ ID NO: 6506798 - DNA, 16 bp, Homo sapiens
tgtgaccggggtcctg

SEQ ID NO: 6506799 - DNA, 12 bp, Homo sapiens
tgtgacctagca

SEQ ID NO: 6506800 - DNA, 21 bp, Homo sapiens
tgtgacctataattttgcaaa

SEQ ID NO: 6506801 - DNA, 14 bp, Homo sapiens
tgtgacctcaggca

SEQ ID NO: 6506802 - DNA, 14 bp, Homo sapiens
tgtgacctgaagtt

SEQ ID NO: 6506803 - DNA, 15 bp, Homo sapiens
tgtgacctgaagttc

SEQ ID NO: 6506804 - DNA, 20 bp, Homo sapiens
tgtgacctgatttcagaaga

SEQ ID NO: 6506805 - DNA, 15 bp, Homo sapiens
tgtgacctgctcctg

SEQ ID NO: 6506806 - DNA, 14 bp, Homo sapiens
tgtgacctgctgag

SEQ ID NO: 6506807 - DNA, 15 bp, Homo sapiens
tgtgacctgctgagc

SEQ ID NO: 6506808 - DNA, 16 bp, Homo sapiens
tgtgacctgctgagct

SEQ ID NO: 6506809 - DNA, 22 bp, Homo sapiens
tgtgacctgctgagctctgaga

SEQ ID NO: 6506810 - DNA, 13 bp, Homo sapiens
tgtgacctggggc

SEQ ID NO: 6506811 - DNA, 15 bp, Homo sapiens
tgtgacctggtctgg

SEQ ID NO: 6506812 - DNA, 14 bp, Homo sapiens
tgtgaccttctcta

SEQ ID NO: 6506813 - DNA, 22 bp, Homo sapiens
tgtgaccttgacttgccatgaa

SEQ ID NO: 6506814 - DNA, 16 bp, Homo sapiens
tgtgacgactgcaaag

SEQ ID NO: 6506815 - DNA, 14 bp, Homo sapiens
tgtgacgattattt

SEQ ID NO: 6506816 - DNA, 21 bp, Homo sapiens
tgtgacgattatttatttctg

SEQ ID NO: 6506817 - DNA, 15 bp, Homo sapiens
tgtgacgtgcactgt

SEQ ID NO: 6506818 - DNA, 21 bp, Homo sapiens
tgtgacgtttttccagttcac

SEQ ID NO: 6506819 - DNA, 19 bp, Homo sapiens
tgtgactaagttgcaagat

SEQ ID NO: 6506820 - DNA, 19 bp, Homo sapiens
tgtgactagcgcctggcct

SEQ ID NO: 6506821 - DNA, 18 bp, Homo sapiens
tgtgactaggaaaaaatt

SEQ ID NO: 6506822 - DNA, 21 bp, Homo sapiens
tgtgactaggcatacactgta

SEQ ID NO: 6506823 - DNA, 22 bp, Homo sapiens
tgtgactatgaaacgaatataa

SEQ ID NO: 6506824 - DNA, 15 bp, Homo sapiens
tgtgactcagcagag

SEQ ID NO: 6506825 - DNA, 20 bp, Homo sapiens
tgtgactcagcagaggcagt

SEQ ID NO: 6506826 - DNA, 19 bp, Homo sapiens
tgtgactcagcatcaccca

SEQ ID NO: 6506827 - DNA, 15 bp, Homo sapiens
tgtgactcattccca

SEQ ID NO: 6506828 - DNA, 15 bp, Homo sapiens
tgtgactccatatcc

SEQ ID NO: 6506829 - DNA, 21 bp, Homo sapiens
tgtgactccttatctctttcc

SEQ ID NO: 6506830 - DNA, 22 bp, Homo sapiens
tgtgactccttatctctttcca

SEQ ID NO: 6506831 - DNA, 17 bp, Homo sapiens
tgtgactcgggagctgc

SEQ ID NO: 6506832 - DNA, 18 bp, Homo sapiens
tgtgactcgggagctgca

SEQ ID NO: 6506833 - DNA, 19 bp, Homo sapiens
tgtgactcgggagctgcac

SEQ ID NO: 6506834 - DNA, 20 bp, Homo sapiens
tgtgactcgggagctgcaca

SEQ ID NO: 6506835 - DNA, 21 bp, Homo sapiens
tgtgactctaagctcagtgct

SEQ ID NO: 6506836 - DNA, 12 bp, Homo sapiens
tgtgactctctt

SEQ ID NO: 6506837 - DNA, 13 bp, Homo sapiens
tgtgactctgggc

SEQ ID NO: 6506838 - DNA, 13 bp, Homo sapiens
tgcccaccccctc

SEQ ID NO: 6506839 - DNA, 14 bp, Homo sapiens
tgcccaccccctca

SEQ ID NO: 6506840 - DNA, 15 bp, Homo sapiens
tgcccaccccctcaa

SEQ ID NO: 6506841 - DNA, 16 bp, Homo sapiens
tgcccaccccctgccc

SEQ ID NO: 6506842 - DNA, 16 bp, Homo sapiens
tgcccaccccctgctg

SEQ ID NO: 6506843 - DNA, 20 bp, Homo sapiens
tgcccaccccctgctggtgc

SEQ ID NO: 6506844 - DNA, 21 bp, Homo sapiens
tgcccaccccctgctggtgcc

SEQ ID NO: 6506845 - DNA, 17 bp, Homo sapiens
tgcccacccctcactcc

SEQ ID NO: 6506846 - DNA, 13 bp, Homo sapiens
tgcccaccctacc

SEQ ID NO: 6506847 - DNA, 19 bp, Homo sapiens
tgcccaccctaccagctcc

SEQ ID NO: 6506848 - DNA, 20 bp, Homo sapiens
tgcccaccctaccagctcct

SEQ ID NO: 6506849 - DNA, 22 bp, Homo sapiens
tgcccaccctaccagctcctcc

SEQ ID NO: 6506850 - DNA, 18 bp, Homo sapiens
tgcccaccctgggagaca

SEQ ID NO: 6506851 - DNA, 14 bp, Homo sapiens
tgcccacccttcgc

SEQ ID NO: 6506852 - DNA, 22 bp, Homo sapiens
tgcccaccgaggagccccagcc

SEQ ID NO: 6506853 - DNA, 23 bp, Homo sapiens
tgcccaccgaggagccccagccc

SEQ ID NO: 6506854 - DNA, 16 bp, Homo sapiens
tgcccaccgccctcct

SEQ ID NO: 6506855 - DNA, 18 bp, Homo sapiens
tgcccaccgccctcctcc

SEQ ID NO: 6506856 - DNA, 15 bp, Homo sapiens
tgcccacctgctctt

SEQ ID NO: 6506857 - DNA, 14 bp, Homo sapiens
tgcccacctggcct

SEQ ID NO: 6506858 - DNA, 15 bp, Homo sapiens
tgcccacctggctgc

SEQ ID NO: 6506859 - DNA, 16 bp, Homo sapiens
tgcccacctggctgcc

SEQ ID NO: 6506860 - DNA, 14 bp, Homo sapiens
tgcccacctggggt

SEQ ID NO: 6506861 - DNA, 20 bp, Homo sapiens
tgcccacctggggtctctct

SEQ ID NO: 6506862 - DNA, 20 bp, Homo sapiens
tgcccacgagggtctcccct

SEQ ID NO: 6506863 - DNA, 19 bp, Homo sapiens
tgcccacgatcccctcccc

SEQ ID NO: 6506864 - DNA, 22 bp, Homo sapiens
tgcccacgatcccctcccccaa

SEQ ID NO: 6506865 - DNA, 16 bp, Homo sapiens
tgcccacgcagaggac

SEQ ID NO: 6506866 - DNA, 18 bp, Homo sapiens
tgcccacgcccctcccca

SEQ ID NO: 6506867 - DNA, 20 bp, Homo sapiens
tgcccacgcccctccccagc

SEQ ID NO: 6506868 - DNA, 18 bp, Homo sapiens
tgcccacgctggagtgca

SEQ ID NO: 6506869 - DNA, 19 bp, Homo sapiens
tgcccacggtctgagctag

SEQ ID NO: 6506870 - DNA, 16 bp, Homo sapiens
tgcccacgtcccgggc

SEQ ID NO: 6506871 - DNA, 24 bp, Homo sapiens
tgcccacgtgcagcacctgtcacc

SEQ ID NO: 6506872 - DNA, 16 bp, Homo sapiens
tgcccactaagaagtt

SEQ ID NO: 6506873 - DNA, 21 bp, Homo sapiens
tgcccactaggatcccactgg

SEQ ID NO: 6506874 - DNA, 15 bp, Homo sapiens
tgcccactcccatcc

SEQ ID NO: 6506875 - DNA, 19 bp, Homo sapiens
tgcccactcccatcccttc

SEQ ID NO: 6506876 - DNA, 14 bp, Homo sapiens
tgcccactccccca

SEQ ID NO: 6506877 - DNA, 23 bp, Homo sapiens
tgcccactcccccaggagcagct

SEQ ID NO: 6506878 - DNA, 15 bp, Homo sapiens
tgcccactccctgca

SEQ ID NO: 6506879 - DNA, 20 bp, Homo sapiens
tgcccactcctgctctgctc

SEQ ID NO: 6506880 - DNA, 13 bp, Homo sapiens
tgcccactctggg

SEQ ID NO: 6506881 - DNA, 22 bp, Homo sapiens
tgcccactgctgcagtagggga

SEQ ID NO: 6506882 - DNA, 15 bp, Homo sapiens
tgcccactgctggtg

SEQ ID NO: 6506883 - DNA, 16 bp, Homo sapiens
tgcccactgctggtgc

SEQ ID NO: 6506884 - DNA, 15 bp, Homo sapiens
tgcccactggccgct

SEQ ID NO: 6506885 - DNA, 22 bp, Homo sapiens
tgcccacttagccgtccatggc

SEQ ID NO: 6506886 - DNA, 17 bp, Homo sapiens
tgcccacttcagcccag

SEQ ID NO: 6506887 - DNA, 16 bp, Homo sapiens
tgcccagaacttccct

SEQ ID NO: 6506888 - DNA, 17 bp, Homo sapiens
tgcccagaagaactttg

SEQ ID NO: 6506889 - DNA, 21 bp, Homo sapiens
tgcccagaataagttattgca

SEQ ID NO: 6506890 - DNA, 14 bp, Homo sapiens
tgcccagaatactg

SEQ ID NO: 6506891 - DNA, 16 bp, Homo sapiens
tgcccagaatactgat

SEQ ID NO: 6506892 - DNA, 18 bp, Homo sapiens
tgcccagaatgaggctgc

SEQ ID NO: 6506893 - DNA, 17 bp, Homo sapiens
tgcccagacacagactg

SEQ ID NO: 6506894 - DNA, 20 bp, Homo sapiens
tgcccagacacagactggca

SEQ ID NO: 6506895 - DNA, 22 bp, Homo sapiens
tgcccagacacatgggcttgtg

SEQ ID NO: 6506896 - DNA, 21 bp, Homo sapiens
tgcccagacatttttttccct

SEQ ID NO: 6506897 - DNA, 18 bp, Homo sapiens
tgcccagacccctctggc

SEQ ID NO: 6506898 - DNA, 22 bp, Homo sapiens
tgcccagacccctctggccagg

SEQ ID NO: 6506899 - DNA, 13 bp, Homo sapiens
tgcccagactgat

SEQ ID NO: 6506900 - DNA, 16 bp, Homo sapiens
tgcccagagacccagc

SEQ ID NO: 6506901 - DNA, 18 bp, Homo sapiens
tgcccagagacccagcgg

SEQ ID NO: 6506902 - DNA, 23 bp, Homo sapiens
tgcccagagacccagcggacaca

SEQ ID NO: 6506903 - DNA, 17 bp, Homo sapiens
tgcccagagatgcctcc

SEQ ID NO: 6506904 - DNA, 15 bp, Homo sapiens
tgcccagagatggga

SEQ ID NO: 6506905 - DNA, 21 bp, Homo sapiens
tgcccagagccaagctggggc

SEQ ID NO: 6506906 - DNA, 15 bp, Homo sapiens
tgcccagagctgagt

SEQ ID NO: 6506907 - DNA, 21 bp, Homo sapiens
tgcccagaggactcccaaccc

SEQ ID NO: 6506908 - DNA, 15 bp, Homo sapiens
tgcccagagtagccc

SEQ ID NO: 6506909 - DNA, 18 bp, Homo sapiens
tgcccagagtagcccagg

SEQ ID NO: 6506910 - DNA, 20 bp, Homo sapiens
tgcccagatcagccagaagc

SEQ ID NO: 6506911 - DNA, 16 bp, Homo sapiens
tgcccagatcccagaa

SEQ ID NO: 6506912 - DNA, 17 bp, Homo sapiens
tgcccagatcgttctgc

SEQ ID NO: 6506913 - DNA, 16 bp, Homo sapiens
tgcccagattcccaga

SEQ ID NO: 6506914 - DNA, 17 bp, Homo sapiens
tgcccagattcccagac

SEQ ID NO: 6506915 - DNA, 17 bp, Homo sapiens
tgcccagcacctcctcc

SEQ ID NO: 6506916 - DNA, 21 bp, Homo sapiens
tgcccagcacctcctccgtgg

SEQ ID NO: 6506917 - DNA, 22 bp, Homo sapiens
tgcccagcacctcctccgtggg

SEQ ID NO: 6506918 - DNA, 16 bp, Homo sapiens
tgcccagcacctggag

SEQ ID NO: 6506919 - DNA, 18 bp, Homo sapiens
tgcccagcagctcaagaa

SEQ ID NO: 6506920 - DNA, 12 bp, Homo sapiens
tgcccagcaggc

SEQ ID NO: 6506921 - DNA, 14 bp, Homo sapiens
tgcccagcaggccc

SEQ ID NO: 6506922 - DNA, 19 bp, Homo sapiens
tgcccagccacccctcaga

SEQ ID NO: 6506923 - DNA, 15 bp, Homo sapiens
tgcccagccactcca

SEQ ID NO: 6506924 - DNA, 16 bp, Homo sapiens
tgcccagccactccaa

SEQ ID NO: 6506925 - DNA, 22 bp, Homo sapiens
tgcccagccactccaagccccc

SEQ ID NO: 6506926 - DNA, 18 bp, Homo sapiens
tgcccagccagccacccc

SEQ ID NO: 6506927 - DNA, 20 bp, Homo sapiens
tgcccagccagccacccctg

SEQ ID NO: 6506928 - DNA, 22 bp, Homo sapiens
tgcccagccagccatcggaaga

SEQ ID NO: 6506929 - DNA, 22 bp, Homo sapiens
tgcccagcccatttgggctctg

SEQ ID NO: 6506930 - DNA, 16 bp, Homo sapiens
tgcccagcccctcctc

SEQ ID NO: 6506931 - DNA, 19 bp, Homo sapiens
tgcccagcccctcctccct

SEQ ID NO: 6506932 - DNA, 17 bp, Homo sapiens
tgcccagccccttttct

SEQ ID NO: 6506933 - DNA, 20 bp, Homo sapiens
tgcccagcccggaccttggc

SEQ ID NO: 6506934 - DNA, 15 bp, Homo sapiens
tgcccagccctccca

SEQ ID NO: 6506935 - DNA, 16 bp, Homo sapiens
tgcccagccctcccag

SEQ ID NO: 6506936 - DNA, 18 bp, Homo sapiens
tgcccagccctctgtggc

SEQ ID NO: 6506937 - DNA, 13 bp, Homo sapiens
tgcccagccctgg

SEQ ID NO: 6506938 - DNA, 18 bp, Homo sapiens
tgcccagccctggcccag

SEQ ID NO: 6506939 - DNA, 19 bp, Homo sapiens
tgcccagccctggcccagg

SEQ ID NO: 6506940 - DNA, 22 bp, Homo sapiens
tgcccagccctggcccaggtgc

SEQ ID NO: 6506941 - DNA, 16 bp, Homo sapiens
tgcccagcctgcccca

SEQ ID NO: 6506942 - DNA, 13 bp, Homo sapiens
tgcccagcctgct

SEQ ID NO: 6506943 - DNA, 16 bp, Homo sapiens
tgcccagcctgctctc

SEQ ID NO: 6506944 - DNA, 15 bp, Homo sapiens
tgcccagcctggagc

SEQ ID NO: 6506945 - DNA, 20 bp, Homo sapiens
tgcccagcctggatgccatc

SEQ ID NO: 6506946 - DNA, 23 bp, Homo sapiens
tgcccagcctggggcaaacctag

SEQ ID NO: 6506947 - DNA, 19 bp, Homo sapiens
tgcccagcggacagtggca

SEQ ID NO: 6506948 - DNA, 24 bp, Homo sapiens
tgcccagcggctcttcctggacag

SEQ ID NO: 6506949 - DNA, 14 bp, Homo sapiens
tgcccagctagctg

SEQ ID NO: 6506950 - DNA, 17 bp, Homo sapiens
tgcccagctcagagggt

SEQ ID NO: 6506951 - DNA, 15 bp, Homo sapiens
tgcccagctcagtct

SEQ ID NO: 6506952 - DNA, 14 bp, Homo sapiens
tgcccagctcagtg

SEQ ID NO: 6506953 - DNA, 18 bp, Homo sapiens
tgcccagctcagtgccac

SEQ ID NO: 6506954 - DNA, 19 bp, Homo sapiens
tgcccagctcagtgccaca

SEQ ID NO: 6506955 - DNA, 12 bp, Homo sapiens
tgcccagctcct

SEQ ID NO: 6506956 - DNA, 13 bp, Homo sapiens
tgcccagctctct

SEQ ID NO: 6506957 - DNA, 15 bp, Homo sapiens
tgcccagctctgacc

SEQ ID NO: 6506958 - DNA, 15 bp, Homo sapiens
tgcccagctgccgcc

SEQ ID NO: 6506959 - DNA, 20 bp, Homo sapiens
tgcccagctgctcccctgcc

SEQ ID NO: 6506960 - DNA, 20 bp, Homo sapiens
tgcccagctgtgctgggagg

SEQ ID NO: 6506961 - DNA, 20 bp, Homo sapiens
tgcccagcttcgtcagctcc

SEQ ID NO: 6506962 - DNA, 22 bp, Homo sapiens
tgcccagcttggagtgccacgt

SEQ ID NO: 6506963 - DNA, 13 bp, Homo sapiens
tgcccagcttggg

SEQ ID NO: 6506964 - DNA, 23 bp, Homo sapiens
tgcccagcttttcattgctgtga

SEQ ID NO: 6506965 - DNA, 16 bp, Homo sapiens
tgcccaggaaaataac

SEQ ID NO: 6506966 - DNA, 18 bp, Homo sapiens
tgcccaggaagtaatttt

SEQ ID NO: 6506967 - DNA, 18 bp, Homo sapiens
tgcccaggacggtctgtg

SEQ ID NO: 6506968 - DNA, 19 bp, Homo sapiens
tgcccaggagacagaccac

SEQ ID NO: 6506969 - DNA, 17 bp, Homo sapiens
tgcccaggagagccagc

SEQ ID NO: 6506970 - DNA, 19 bp, Homo sapiens
tgcccaggagagccagccc

SEQ ID NO: 6506971 - DNA, 22 bp, Homo sapiens
tgcccaggagagccagccctcc

SEQ ID NO: 6506972 - DNA, 21 bp, Homo sapiens
tgcccaggagcaagtgaggcc

SEQ ID NO: 6506973 - DNA, 12 bp, Homo sapiens
tgcccaggcagg

SEQ ID NO: 6506974 - DNA, 13 bp, Homo sapiens
tgcccaggcaggt

SEQ ID NO: 6506975 - DNA, 17 bp, Homo sapiens
tgcccaggcaggtcttg

SEQ ID NO: 6506976 - DNA, 22 bp, Homo sapiens
tgcccaggcatgaaattcttcc

SEQ ID NO: 6506977 - DNA, 10 bp, Homo sapiens
tgcccaggcc

SEQ ID NO: 6506978 - DNA, 21 bp, Homo sapiens
tgcccaggccacagagaacct

SEQ ID NO: 6506979 - DNA, 11 bp, Homo sapiens
tgcccaggccc

SEQ ID NO: 6506980 - DNA, 12 bp, Homo sapiens
tgcccaggcccc

SEQ ID NO: 6506981 - DNA, 18 bp, Homo sapiens
tgcccaggcccctgccac

SEQ ID NO: 6506982 - DNA, 20 bp, Homo sapiens
tgcccaggcccctgccaccc

SEQ ID NO: 6506983 - DNA, 16 bp, Homo sapiens
tgcccaggcccttggc

SEQ ID NO: 6506984 - DNA, 19 bp, Homo sapiens
tgcccaggcccttggctgc

SEQ ID NO: 6506985 - DNA, 20 bp, Homo sapiens
tgcccaggcccttggctgca

SEQ ID NO: 6506986 - DNA, 21 bp, Homo sapiens
tgcccaggccggccagcctca

SEQ ID NO: 6506987 - DNA, 22 bp, Homo sapiens
tgcccaggccggccagcctcac

SEQ ID NO: 6506988 - DNA, 19 bp, Homo sapiens
tgcccaggcctatctggaa

SEQ ID NO: 6506989 - DNA, 14 bp, Homo sapiens
tgcccaggcctccc

SEQ ID NO: 6506990 - DNA, 15 bp, Homo sapiens
tgcccaggcctcccc

SEQ ID NO: 6506991 - DNA, 16 bp, Homo sapiens
tgcccaggcctcccca

SEQ ID NO: 6506992 - DNA, 14 bp, Homo sapiens
tgcccaggctccat

SEQ ID NO: 6506993 - DNA, 15 bp, Homo sapiens
tgcccaggctctgct

SEQ ID NO: 6506994 - DNA, 17 bp, Homo sapiens
tgcccaggctctgctga

SEQ ID NO: 6506995 - DNA, 19 bp, Homo sapiens
tgcccaggctgctcttgaa

SEQ ID NO: 6506996 - DNA, 20 bp, Homo sapiens
tgcccaggctgctcttgaat

SEQ ID NO: 6506997 - DNA, 15 bp, Homo sapiens
tgcccaggctggagt

SEQ ID NO: 6506998 - DNA, 18 bp, Homo sapiens
tgcccaggctggcgtgca

SEQ ID NO: 6506999 - DNA, 23 bp, Homo sapiens
tgcccaggctggcgtgcagtggt

SEQ ID NO: 6507000 - DNA, 17 bp, Homo sapiens
tgcccaggctggtctca

SEQ ID NO: 6507001 - DNA, 20 bp, Homo sapiens
tgcccaggctggtcttgaac

SEQ ID NO: 6507002 - DNA, 14 bp, Homo sapiens
tgcccaggctgtgc

SEQ ID NO: 6507003 - DNA, 17 bp, Homo sapiens
tgcccagggaagccctc

SEQ ID NO: 6507004 - DNA, 19 bp, Homo sapiens
tgcccagggccactctgcc

SEQ ID NO: 6507005 - DNA, 21 bp, Homo sapiens
tgcccagggccactctgcctc

SEQ ID NO: 6507006 - DNA, 11 bp, Homo sapiens
tgcccagggct

SEQ ID NO: 6507007 - DNA, 14 bp, Homo sapiens
tgcccagggctcag

SEQ ID NO: 6507008 - DNA, 21 bp, Homo sapiens
tgcccagggctcagcctggtg

SEQ ID NO: 6507009 - DNA, 20 bp, Homo sapiens
tgcccaggggacgtggcgct

SEQ ID NO: 6507010 - DNA, 20 bp, Homo sapiens
tgcccaggggcccacaggga

SEQ ID NO: 6507011 - DNA, 18 bp, Homo sapiens
tgcccaggggtgccccct

SEQ ID NO: 6507012 - DNA, 20 bp, Homo sapiens
tgcccagggtcagtgtatct

SEQ ID NO: 6507013 - DNA, 19 bp, Homo sapiens
tgcccagggtgcagtgtga

SEQ ID NO: 6507014 - DNA, 16 bp, Homo sapiens
tgcccagggtggctgc

SEQ ID NO: 6507015 - DNA, 21 bp, Homo sapiens
tgcccagggtggctgccagcc

SEQ ID NO: 6507016 - DNA, 17 bp, Homo sapiens
tgcccaggtaccaccct

SEQ ID NO: 6507017 - DNA, 18 bp, Homo sapiens
tgcccaggtaccaccctt

SEQ ID NO: 6507018 - DNA, 18 bp, Homo sapiens
tgcccaggtatcctgggg

SEQ ID NO: 6507019 - DNA, 21 bp, Homo sapiens
tgcccaggtatcctgggggaa

SEQ ID NO: 6507020 - DNA, 19 bp, Homo sapiens
tgcccaggtcaccaagcag

SEQ ID NO: 6507021 - DNA, 16 bp, Homo sapiens
tgcccaggtgagggaa

SEQ ID NO: 6507022 - DNA, 18 bp, Homo sapiens
tgcccaggtgagggaagg

SEQ ID NO: 6507023 - DNA, 20 bp, Homo sapiens
tgcccaggtgagggaaggag

SEQ ID NO: 6507024 - DNA, 18 bp, Homo sapiens
tgcccaggtggcctcctg

SEQ ID NO: 6507025 - DNA, 21 bp, Homo sapiens
tgcccaggtggcctcctggcc

SEQ ID NO: 6507026 - DNA, 17 bp, Homo sapiens
tgcccaggtggctgtgg

SEQ ID NO: 6507027 - DNA, 22 bp, Homo sapiens
tgcccaggtggggtttcctgca

SEQ ID NO: 6507028 - DNA, 20 bp, Homo sapiens
tgcccaggtttctggtctct

SEQ ID NO: 6507029 - DNA, 20 bp, Homo sapiens
tgcccagtaaaatttcagga

SEQ ID NO: 6507030 - DNA, 18 bp, Homo sapiens
tgcccagtcatgacattt

SEQ ID NO: 6507031 - DNA, 14 bp, Homo sapiens
tgcccagtccccca

SEQ ID NO: 6507032 - DNA, 13 bp, Homo sapiens
tgcccagtcctgg

SEQ ID NO: 6507033 - DNA, 14 bp, Homo sapiens
tgcccagtcctggg

SEQ ID NO: 6507034 - DNA, 16 bp, Homo sapiens
tgcccagtcctgggtt

SEQ ID NO: 6507035 - DNA, 21 bp, Homo sapiens
tgcccagtgagccctgctctt

SEQ ID NO: 6507036 - DNA, 22 bp, Homo sapiens
tgcccagtgatggcattactct

SEQ ID NO: 6507037 - DNA, 20 bp, Homo sapiens
tgcccagtgttgtttgtaaa

SEQ ID NO: 6507038 - DNA, 22 bp, Homo sapiens
tgcccagtgttgtttgtaaata

SEQ ID NO: 6507039 - DNA, 22 bp, Homo sapiens
tgcccagttaatcttgctttct

SEQ ID NO: 6507040 - DNA, 18 bp, Homo sapiens
tgcccagttcatcccaat

SEQ ID NO: 6507041 - DNA, 21 bp, Homo sapiens
tgcccagttggaggagactgg

SEQ ID NO: 6507042 - DNA, 18 bp, Homo sapiens
tgcccagtttctgcctct

SEQ ID NO: 6507043 - DNA, 20 bp, Homo sapiens
tgcccatacccctgcctggg

SEQ ID NO: 6507044 - DNA, 23 bp, Homo sapiens
tgcccatcatacgcatggtcctg

SEQ ID NO: 6507045 - DNA, 16 bp, Homo sapiens
tgcccatcatctctgc

SEQ ID NO: 6507046 - DNA, 20 bp, Homo sapiens
tgcccatcatctctgccttt

SEQ ID NO: 6507047 - DNA, 21 bp, Homo sapiens
tgcccatcccagtccctcgcc

SEQ ID NO: 6507048 - DNA, 19 bp, Homo sapiens
tgcccatcccagtgtccta

SEQ ID NO: 6507049 - DNA, 13 bp, Homo sapiens
tgcccatccctgg

SEQ ID NO: 6507050 - DNA, 13 bp, Homo sapiens
tgcccatcctgcc

SEQ ID NO: 6507051 - DNA, 20 bp, Homo sapiens
tgcccatcctgccatcctca

SEQ ID NO: 6507052 - DNA, 20 bp, Homo sapiens
tgcccatcgtgaagaagcct

SEQ ID NO: 6507053 - DNA, 23 bp, Homo sapiens
tgcccatcgtgaagaagcctgta

SEQ ID NO: 6507054 - DNA, 19 bp, Homo sapiens
tgcccatctgggaaaatac

SEQ ID NO: 6507055 - DNA, 22 bp, Homo sapiens
tgcccatgcctaaagcccattg

SEQ ID NO: 6507056 - DNA, 24 bp, Homo sapiens
tgcccatggacaggctggctccag

SEQ ID NO: 6507057 - DNA, 18 bp, Homo sapiens
tgcccatggcatgtcttt

SEQ ID NO: 6507058 - DNA, 17 bp, Homo sapiens
tgcccatggctgggaac

SEQ ID NO: 6507059 - DNA, 23 bp, Homo sapiens
tgcccatggcttctggtcatgaa

SEQ ID NO: 6507060 - DNA, 16 bp, Homo sapiens
tgcccatgggagctgg

SEQ ID NO: 6507061 - DNA, 18 bp, Homo sapiens
tgcccatgggatatgtgg

SEQ ID NO: 6507062 - DNA, 22 bp, Homo sapiens
tgcccatgggcactgctgggtg

SEQ ID NO: 6507063 - DNA, 23 bp, Homo sapiens
tgcccatgggcactgctgggtgg

SEQ ID NO: 6507064 - DNA, 23 bp, Homo sapiens
tgcccatgtccagagggactgga

SEQ ID NO: 6507065 - DNA, 14 bp, Homo sapiens
tgcccatgtgtaca

SEQ ID NO: 6507066 - DNA, 14 bp, Homo sapiens
tgcccatgtgtatg

SEQ ID NO: 6507067 - DNA, 19 bp, Homo sapiens
tgcccattcaccaaaatta

SEQ ID NO: 6507068 - DNA, 15 bp, Homo sapiens
tgcccattcctaata

SEQ ID NO: 6507069 - DNA, 14 bp, Homo sapiens
tgcccattcctgcc

SEQ ID NO: 6507070 - DNA, 15 bp, Homo sapiens
tgcccattcctgcct

SEQ ID NO: 6507071 - DNA, 16 bp, Homo sapiens
tgccccaaactttctc

SEQ ID NO: 6507072 - DNA, 22 bp, Homo sapiens
tgccccaaaggaagctttctct

SEQ ID NO: 6507073 - DNA, 14 bp, Homo sapiens
tgccccaaatcaca

SEQ ID NO: 6507074 - DNA, 23 bp, Homo sapiens
tgccccaaatggattcctgtttc

SEQ ID NO: 6507075 - DNA, 17 bp, Homo sapiens
tgccccaacccttcttc

SEQ ID NO: 6507076 - DNA, 20 bp, Homo sapiens
tgccccaacccttcttcatg

SEQ ID NO: 6507077 - DNA, 18 bp, Homo sapiens
tgccccaactccttccag

SEQ ID NO: 6507078 - DNA, 18 bp, Homo sapiens
tgccccaagagcaggagg

SEQ ID NO: 6507079 - DNA, 24 bp, Homo sapiens
tgccccaagagcaggaggtgcctg

SEQ ID NO: 6507080 - DNA, 19 bp, Homo sapiens
tgccccaagaggctagccc

SEQ ID NO: 6507081 - DNA, 22 bp, Homo sapiens
tgccccaagaggctagccccag

SEQ ID NO: 6507082 - DNA, 15 bp, Homo sapiens
tgccccaagcagcca

SEQ ID NO: 6507083 - DNA, 19 bp, Homo sapiens
tgccccaagcagccagcca

SEQ ID NO: 6507084 - DNA, 18 bp, Homo sapiens
tgccccaaggccccaggg

SEQ ID NO: 6507085 - DNA, 11 bp, Homo sapiens
tgccccaaggg

SEQ ID NO: 6507086 - DNA, 19 bp, Homo sapiens
tgccccaagggcccagacc

SEQ ID NO: 6507087 - DNA, 21 bp, Homo sapiens
tgccccaagggcccagaccct

SEQ ID NO: 6507088 - DNA, 14 bp, Homo sapiens
tgccccaagtcctc

SEQ ID NO: 6507089 - DNA, 15 bp, Homo sapiens
tgccccaagtcctca

SEQ ID NO: 6507090 - DNA, 22 bp, Homo sapiens
tgccccaagttttgtgaaattt

SEQ ID NO: 6507091 - DNA, 21 bp, Homo sapiens
tgccccaatcgggtccagaga

SEQ ID NO: 6507092 - DNA, 20 bp, Homo sapiens
tgccccacaaaacttcagtg

SEQ ID NO: 6507093 - DNA, 17 bp, Homo sapiens
tgccccacaaggcccag

SEQ ID NO: 6507094 - DNA, 20 bp, Homo sapiens
tgccccacacaggcctggcc

SEQ ID NO: 6507095 - DNA, 22 bp, Homo sapiens
tgccccacacaggcctggccca

SEQ ID NO: 6507096 - DNA, 16 bp, Homo sapiens
tgccccacacggactc

SEQ ID NO: 6507097 - DNA, 13 bp, Homo sapiens
tgccccacactcc

SEQ ID NO: 6507098 - DNA, 23 bp, Homo sapiens
tgccccacactccccgccttaga

SEQ ID NO: 6507099 - DNA, 12 bp, Homo sapiens
tgccccacagct

SEQ ID NO: 6507100 - DNA, 14 bp, Homo sapiens
tgccccacagtctc

SEQ ID NO: 6507101 - DNA, 12 bp, Homo sapiens
tgccccacagtt

SEQ ID NO: 6507102 - DNA, 20 bp, Homo sapiens
tgccccacatgcatgtctgc

SEQ ID NO: 6507103 - DNA, 17 bp, Homo sapiens
tgccccaccactcccca

SEQ ID NO: 6507104 - DNA, 19 bp, Homo sapiens
tgccccaccactccccaac

SEQ ID NO: 6507105 - DNA, 14 bp, Homo sapiens
tgccccaccagcca

SEQ ID NO: 6507106 - DNA, 17 bp, Homo sapiens
tgccccaccagccacct

SEQ ID NO: 6507107 - DNA, 19 bp, Homo sapiens
tgccccacccaactccaca

SEQ ID NO: 6507108 - DNA, 21 bp, Homo sapiens
tgccccacccaccccacagac

SEQ ID NO: 6507109 - DNA, 17 bp, Homo sapiens
tgccccacccacccctc

SEQ ID NO: 6507110 - DNA, 22 bp, Homo sapiens
tgccccacccacccctcctggg

SEQ ID NO: 6507111 - DNA, 21 bp, Homo sapiens
tgccccaccccacctcacagc

SEQ ID NO: 6507112 - DNA, 20 bp, Homo sapiens
tgccccaccccacctccact

SEQ ID NO: 6507113 - DNA, 13 bp, Homo sapiens
tgccccaccccat

SEQ ID NO: 6507114 - DNA, 16 bp, Homo sapiens
tgccccacccctccat

SEQ ID NO: 6507115 - DNA, 23 bp, Homo sapiens
tgccccacccctccatgattcca

SEQ ID NO: 6507116 - DNA, 19 bp, Homo sapiens
tgccccacctcccgccctc

SEQ ID NO: 6507117 - DNA, 12 bp, Homo sapiens
tgccccacctgc

SEQ ID NO: 6507118 - DNA, 13 bp, Homo sapiens
tgccccacctgcc

SEQ ID NO: 6507119 - DNA, 16 bp, Homo sapiens
tgccccacctgcctgg

SEQ ID NO: 6507120 - DNA, 19 bp, Homo sapiens
tgccccacctgcctggtgc

SEQ ID NO: 6507121 - DNA, 15 bp, Homo sapiens
tgccccacgcacgca

SEQ ID NO: 6507122 - DNA, 21 bp, Homo sapiens
tgccccacgctgtggccctgg

SEQ ID NO: 6507123 - DNA, 14 bp, Homo sapiens
tgccccactccagc

SEQ ID NO: 6507124 - DNA, 15 bp, Homo sapiens
tgccccactccagcc

SEQ ID NO: 6507125 - DNA, 16 bp, Homo sapiens
tgccccactccagcct

SEQ ID NO: 6507126 - DNA, 21 bp, Homo sapiens
tgccccactccagcctgggga

SEQ ID NO: 6507127 - DNA, 20 bp, Homo sapiens
tgccccactctgctgaggcc

SEQ ID NO: 6507128 - DNA, 15 bp, Homo sapiens
tgccccactgggaga

SEQ ID NO: 6507129 - DNA, 22 bp, Homo sapiens
tgccccactgggagagtcctta

SEQ ID NO: 6507130 - DNA, 23 bp, Homo sapiens
tgccccactgggagagtccttag

SEQ ID NO: 6507131 - DNA, 19 bp, Homo sapiens
tgccccacttgtccttagc

SEQ ID NO: 6507132 - DNA, 16 bp, Homo sapiens
tgccccagaaagggga

SEQ ID NO: 6507133 - DNA, 23 bp, Homo sapiens
tgccccagacagttcttttctac

SEQ ID NO: 6507134 - DNA, 17 bp, Homo sapiens
tgccccagactgagctc

SEQ ID NO: 6507135 - DNA, 18 bp, Homo sapiens
tgccccagactgagctct

SEQ ID NO: 6507136 - DNA, 13 bp, Homo sapiens
tgccccagagctg

SEQ ID NO: 6507137 - DNA, 15 bp, Homo sapiens
tgccccagagctgtt

SEQ ID NO: 6507138 - DNA, 13 bp, Homo sapiens
tgccccagaggcc

SEQ ID NO: 6507139 - DNA, 13 bp, Homo sapiens
tgccccagaggtc

SEQ ID NO: 6507140 - DNA, 19 bp, Homo sapiens
tgccccagaggtcgcagct

SEQ ID NO: 6507141 - DNA, 13 bp, Homo sapiens
tgccccagccaga

SEQ ID NO: 6507142 - DNA, 16 bp, Homo sapiens
tgccccagcccaagtc

SEQ ID NO: 6507143 - DNA, 17 bp, Homo sapiens
tgccccagcccaagtcc

SEQ ID NO: 6507144 - DNA, 13 bp, Homo sapiens
tgccccagccccg

SEQ ID NO: 6507145 - DNA, 13 bp, Homo sapiens
tgccccagcctgt

SEQ ID NO: 6507146 - DNA, 15 bp, Homo sapiens
tgccccagcgcggct

SEQ ID NO: 6507147 - DNA, 22 bp, Homo sapiens
tgccccagctctcttctggctt

SEQ ID NO: 6507148 - DNA, 15 bp, Homo sapiens
tgccccagctctgga

SEQ ID NO: 6507149 - DNA, 16 bp, Homo sapiens
tgccccagctctggat

SEQ ID NO: 6507150 - DNA, 18 bp, Homo sapiens
tgccccagctctggcttc

SEQ ID NO: 6507151 - DNA, 13 bp, Homo sapiens
tgccccagcttta

SEQ ID NO: 6507152 - DNA, 20 bp, Homo sapiens
tgccccagctttatctgtca

SEQ ID NO: 6507153 - DNA, 18 bp, Homo sapiens
tgccccaggaccagctca

SEQ ID NO: 6507154 - DNA, 18 bp, Homo sapiens
tgccccaggactctggca

SEQ ID NO: 6507155 - DNA, 19 bp, Homo sapiens
tgccccaggactctggcac

SEQ ID NO: 6507156 - DNA, 16 bp, Homo sapiens
tgccccaggccaggta

SEQ ID NO: 6507157 - DNA, 20 bp, Homo sapiens
tgccccaggccggagcccag

SEQ ID NO: 6507158 - DNA, 21 bp, Homo sapiens
tgccccagggagtccagggtt

SEQ ID NO: 6507159 - DNA, 14 bp, Homo sapiens
tgccccagggatgg

SEQ ID NO: 6507160 - DNA, 17 bp, Homo sapiens
tgccccaggtacacctc

SEQ ID NO: 6507161 - DNA, 24 bp, Homo sapiens
tgccccagtcggccccatctctca

SEQ ID NO: 6507162 - DNA, 18 bp, Homo sapiens
tgccccagtttggggtgc

SEQ ID NO: 6507163 - DNA, 18 bp, Homo sapiens
tgccccatcactgcgcca

SEQ ID NO: 6507164 - DNA, 19 bp, Homo sapiens
tgccccatcacttacagaa

SEQ ID NO: 6507165 - DNA, 19 bp, Homo sapiens
tgccccatcagcagcttga

SEQ ID NO: 6507166 - DNA, 16 bp, Homo sapiens
tgccccatcagtgctc

SEQ ID NO: 6507167 - DNA, 18 bp, Homo sapiens
tgccccatcagtgctccc

SEQ ID NO: 6507168 - DNA, 20 bp, Homo sapiens
tgccccatcagtgctccctc

SEQ ID NO: 6507169 - DNA, 20 bp, Homo sapiens
tgccccatccagacctggct

SEQ ID NO: 6507170 - DNA, 17 bp, Homo sapiens
tgccccatcctccagca

SEQ ID NO: 6507171 - DNA, 20 bp, Homo sapiens
tgccccatcctccagcaggg

SEQ ID NO: 6507172 - DNA, 13 bp, Homo sapiens
tgccccatcctgg

SEQ ID NO: 6507173 - DNA, 15 bp, Homo sapiens
tgccccatcctgggc

SEQ ID NO: 6507174 - DNA, 13 bp, Homo sapiens
tgccccatgagac

SEQ ID NO: 6507175 - DNA, 12 bp, Homo sapiens
tgccccatgcct

SEQ ID NO: 6507176 - DNA, 16 bp, Homo sapiens
tgccccattgagatct

SEQ ID NO: 6507177 - DNA, 22 bp, Homo sapiens
tgccccattgagatcttcctgc

SEQ ID NO: 6507178 - DNA, 16 bp, Homo sapiens
tgccccatttatccac

SEQ ID NO: 6507179 - DNA, 16 bp, Homo sapiens
tgcccccaacactcca

SEQ ID NO: 6507180 - DNA, 19 bp, Homo sapiens
tgcccccaacactccaggc

SEQ ID NO: 6507181 - DNA, 21 bp, Homo sapiens
tgcccccaacactccaggccc

SEQ ID NO: 6507182 - DNA, 16 bp, Homo sapiens
tgcccccaaccatttc

SEQ ID NO: 6507183 - DNA, 20 bp, Homo sapiens
tgcccccaaggaggcagcct

SEQ ID NO: 6507184 - DNA, 22 bp, Homo sapiens
tgcccccaatagtagtctctgt

SEQ ID NO: 6507185 - DNA, 13 bp, Homo sapiens
tgcccccacaccc

SEQ ID NO: 6507186 - DNA, 15 bp, Homo sapiens
tgcccccacacccac

SEQ ID NO: 6507187 - DNA, 17 bp, Homo sapiens
tgcccccacacccactc

SEQ ID NO: 6507188 - DNA, 13 bp, Homo sapiens
tgcccccacagat

SEQ ID NO: 6507189 - DNA, 16 bp, Homo sapiens
tgcccccacagatcca

SEQ ID NO: 6507190 - DNA, 20 bp, Homo sapiens
tgcccccacagatccatcct

SEQ ID NO: 6507191 - DNA, 13 bp, Homo sapiens
tgcccccacagct

SEQ ID NO: 6507192 - DNA, 12 bp, Homo sapiens
tgcccccacccc

SEQ ID NO: 6507193 - DNA, 17 bp, Homo sapiens
tgtgactctgggcaggg

SEQ ID NO: 6507194 - DNA, 12 bp, Homo sapiens
tgtgactcttct

SEQ ID NO: 6507195 - DNA, 14 bp, Homo sapiens
tgtgactcttctct

SEQ ID NO: 6507196 - DNA, 17 bp, Homo sapiens
tgtgactcttctctcaa

SEQ ID NO: 6507197 - DNA, 21 bp, Homo sapiens
tgtgactgaagaagatgagcc

SEQ ID NO: 6507198 - DNA, 15 bp, Homo sapiens
tgtgactgagggcct

SEQ ID NO: 6507199 - DNA, 16 bp, Homo sapiens
tgtgactgatctctcg

SEQ ID NO: 6507200 - DNA, 22 bp, Homo sapiens
tgtgactgatgttacatcacag

SEQ ID NO: 6507201 - DNA, 20 bp, Homo sapiens
tgtgactgatgttaggctgg

SEQ ID NO: 6507202 - DNA, 23 bp, Homo sapiens
tgtgactgatgttaggctgggcc

SEQ ID NO: 6507203 - DNA, 19 bp, Homo sapiens
tgtgactgcatcatatatt

SEQ ID NO: 6507204 - DNA, 20 bp, Homo sapiens
tgtgactgctggtaaaataa

SEQ ID NO: 6507205 - DNA, 18 bp, Homo sapiens
tgtgactggctaaagctc

SEQ ID NO: 6507206 - DNA, 20 bp, Homo sapiens
tgtgactgtacccaaatgga

SEQ ID NO: 6507207 - DNA, 16 bp, Homo sapiens
tgtgactgtgtttgca

SEQ ID NO: 6507208 - DNA, 17 bp, Homo sapiens
tgtgacttaagaagcct

SEQ ID NO: 6507209 - DNA, 15 bp, Homo sapiens
tgtgacttacaattt

SEQ ID NO: 6507210 - DNA, 14 bp, Homo sapiens
tgtgacttcactgt

SEQ ID NO: 6507211 - DNA, 19 bp, Homo sapiens
tgtgacttcactgtatata

SEQ ID NO: 6507212 - DNA, 18 bp, Homo sapiens
tgtgacttcagctctgtt

SEQ ID NO: 6507213 - DNA, 19 bp, Homo sapiens
tgtgacttcagctctgttt

SEQ ID NO: 6507214 - DNA, 23 bp, Homo sapiens
tgtgacttctattttaaagacaa

SEQ ID NO: 6507215 - DNA, 18 bp, Homo sapiens
tgtgacttctcccctgcc

SEQ ID NO: 6507216 - DNA, 19 bp, Homo sapiens
tgtgacttctcccctgccc

SEQ ID NO: 6507217 - DNA, 14 bp, Homo sapiens
tgtgacttctctct

SEQ ID NO: 6507218 - DNA, 14 bp, Homo sapiens
tgtgacttcttctt

SEQ ID NO: 6507219 - DNA, 18 bp, Homo sapiens
tgtgactttgaacacatc

SEQ ID NO: 6507220 - DNA, 15 bp, Homo sapiens
tgtgactttgacgct

SEQ ID NO: 6507221 - DNA, 15 bp, Homo sapiens
tgtgacttttagaca

SEQ ID NO: 6507222 - DNA, 15 bp, Homo sapiens
tgtgacttttctgat

SEQ ID NO: 6507223 - DNA, 20 bp, Homo sapiens
tgtgacttttctgattaata

SEQ ID NO: 6507224 - DNA, 16 bp, Homo sapiens
tgtgacttttgtgaaa

SEQ ID NO: 6507225 - DNA, 19 bp, Homo sapiens
tgtgactttttagccagtg

SEQ ID NO: 6507226 - DNA, 18 bp, Homo sapiens
tgtgagaaacatctcaat

SEQ ID NO: 6507227 - DNA, 15 bp, Homo sapiens
tgtgagaaatgtcta

SEQ ID NO: 6507228 - DNA, 21 bp, Homo sapiens
tgtgagaactgtgaatatgtg

SEQ ID NO: 6507229 - DNA, 15 bp, Homo sapiens
tgtgagaagaaatga

SEQ ID NO: 6507230 - DNA, 12 bp, Homo sapiens
tgtgagaagatg

SEQ ID NO: 6507231 - DNA, 22 bp, Homo sapiens
tgtgagaagatgggggctggag

SEQ ID NO: 6507232 - DNA, 16 bp, Homo sapiens
tgtgagaagtgccttc

SEQ ID NO: 6507233 - DNA, 14 bp, Homo sapiens
tgtgagaataaagc

SEQ ID NO: 6507234 - DNA, 18 bp, Homo sapiens
tgtgagaatggcctggag

SEQ ID NO: 6507235 - DNA, 14 bp, Homo sapiens
tgtgagacagcaag

SEQ ID NO: 6507236 - DNA, 18 bp, Homo sapiens
tgtgagacagtgggaaat

SEQ ID NO: 6507237 - DNA, 19 bp, Homo sapiens
tgtgagacccccacacctc

SEQ ID NO: 6507238 - DNA, 19 bp, Homo sapiens
tgtgagactcgagaacttt

SEQ ID NO: 6507239 - DNA, 16 bp, Homo sapiens
tgtgagacttaaaaca

SEQ ID NO: 6507240 - DNA, 23 bp, Homo sapiens
tgtgagagagagggcgcccagcc

SEQ ID NO: 6507241 - DNA, 15 bp, Homo sapiens
tgtgagagtgtgagc

SEQ ID NO: 6507242 - DNA, 14 bp, Homo sapiens
tgtgagagttgtct

SEQ ID NO: 6507243 - DNA, 16 bp, Homo sapiens
tgtgagagttgtctct

SEQ ID NO: 6507244 - DNA, 21 bp, Homo sapiens
tgtgagagttgtctctgttgg

SEQ ID NO: 6507245 - DNA, 22 bp, Homo sapiens
tgtgagataaatatcattatag

SEQ ID NO: 6507246 - DNA, 16 bp, Homo sapiens
tgtgagataacttcct

SEQ ID NO: 6507247 - DNA, 15 bp, Homo sapiens
tgtgagatactgtgt

SEQ ID NO: 6507248 - DNA, 15 bp, Homo sapiens
tgtgagatccgtgaa

SEQ ID NO: 6507249 - DNA, 20 bp, Homo sapiens
tgtgagatggatgtatttgt

SEQ ID NO: 6507250 - DNA, 18 bp, Homo sapiens
tgtgagcaaacagaggag

SEQ ID NO: 6507251 - DNA, 18 bp, Homo sapiens
tgtgagcaagagccaggg

SEQ ID NO: 6507252 - DNA, 19 bp, Homo sapiens
tgtgagcaagcatttatgt

SEQ ID NO: 6507253 - DNA, 15 bp, Homo sapiens
tgtgagcagaagact

SEQ ID NO: 6507254 - DNA, 17 bp, Homo sapiens
tgtgagcagaagactat

SEQ ID NO: 6507255 - DNA, 21 bp, Homo sapiens
tgtgagcaggcggggaggagg

SEQ ID NO: 6507256 - DNA, 20 bp, Homo sapiens
tgtgagcagggcttgctcct

SEQ ID NO: 6507257 - DNA, 14 bp, Homo sapiens
tgtgagcagggtga

SEQ ID NO: 6507258 - DNA, 17 bp, Homo sapiens
tgtgagcatggggccag

SEQ ID NO: 6507259 - DNA, 16 bp, Homo sapiens
tgtgagccaaagagaa

SEQ ID NO: 6507260 - DNA, 22 bp, Homo sapiens
tgtgagccaaagagaaaagatt

SEQ ID NO: 6507261 - DNA, 15 bp, Homo sapiens
tgtgagccacagcac

SEQ ID NO: 6507262 - DNA, 22 bp, Homo sapiens
tgtgagccacagtgcctggccc

SEQ ID NO: 6507263 - DNA, 16 bp, Homo sapiens
tgtgagccaccgctgc

SEQ ID NO: 6507264 - DNA, 23 bp, Homo sapiens
tgtgagccactgcgcccagcctg

SEQ ID NO: 6507265 - DNA, 15 bp, Homo sapiens
tgtgagcccagctgg

SEQ ID NO: 6507266 - DNA, 18 bp, Homo sapiens
tgtgagcccagctgggtc

SEQ ID NO: 6507267 - DNA, 22 bp, Homo sapiens
tgtgagccccaggggggcctcc

SEQ ID NO: 6507268 - DNA, 12 bp, Homo sapiens
tgtgagccctct

SEQ ID NO: 6507269 - DNA, 20 bp, Homo sapiens
tgtgagccctctagggcagg

SEQ ID NO: 6507270 - DNA, 14 bp, Homo sapiens
tgtgagccttgcat

SEQ ID NO: 6507271 - DNA, 17 bp, Homo sapiens
tgtgagcgagtgacaga

SEQ ID NO: 6507272 - DNA, 14 bp, Homo sapiens
tgtgagcgccttgg

SEQ ID NO: 6507273 - DNA, 22 bp, Homo sapiens
tgtgagcgctggctccctgggc

SEQ ID NO: 6507274 - DNA, 21 bp, Homo sapiens
tgtgagcgcttctgcagcctc

SEQ ID NO: 6507275 - DNA, 19 bp, Homo sapiens
tgtgagctaagcattttct

SEQ ID NO: 6507276 - DNA, 20 bp, Homo sapiens
tgtgagctctggttattttt

SEQ ID NO: 6507277 - DNA, 14 bp, Homo sapiens
tgtgagctcttccc

SEQ ID NO: 6507278 - DNA, 16 bp, Homo sapiens
tgtgagctcttccctt

SEQ ID NO: 6507279 - DNA, 12 bp, Homo sapiens
tgtgagctgcac

SEQ ID NO: 6507280 - DNA, 18 bp, Homo sapiens
tgtgagctggatagactt

SEQ ID NO: 6507281 - DNA, 22 bp, Homo sapiens
tgtgagctggatagacttggga

SEQ ID NO: 6507282 - DNA, 13 bp, Homo sapiens
tgtgagctttgaa

SEQ ID NO: 6507283 - DNA, 17 bp, Homo sapiens
tgtgaggacctccctgt

SEQ ID NO: 6507284 - DNA, 22 bp, Homo sapiens
tgtgaggagagtctgaatattt

SEQ ID NO: 6507285 - DNA, 14 bp, Homo sapiens
tgtgaggagctgct

SEQ ID NO: 6507286 - DNA, 23 bp, Homo sapiens
tgtgaggattatgggtcctgcaa

SEQ ID NO: 6507287 - DNA, 14 bp, Homo sapiens
tgtgaggcaataag

SEQ ID NO: 6507288 - DNA, 14 bp, Homo sapiens
tgtgaggcccctgg

SEQ ID NO: 6507289 - DNA, 14 bp, Homo sapiens
tgtgaggctgtcct

SEQ ID NO: 6507290 - DNA, 16 bp, Homo sapiens
tgtgaggctgtgtctc

SEQ ID NO: 6507291 - DNA, 13 bp, Homo sapiens
tgtgaggcttgcc

SEQ ID NO: 6507292 - DNA, 20 bp, Homo sapiens
tgtgaggcttgcccaggagc

SEQ ID NO: 6507293 - DNA, 15 bp, Homo sapiens
tgtgagggaaagagc

SEQ ID NO: 6507294 - DNA, 17 bp, Homo sapiens
tgtgagggagagaactg

SEQ ID NO: 6507295 - DNA, 18 bp, Homo sapiens
tgtgagggagtgcagaac

SEQ ID NO: 6507296 - DNA, 19 bp, Homo sapiens
tgtgagggagtgcagaaca

SEQ ID NO: 6507297 - DNA, 22 bp, Homo sapiens
tgtgagggatggggagcagctg

SEQ ID NO: 6507298 - DNA, 19 bp, Homo sapiens
tgtgagggcagcactggga

SEQ ID NO: 6507299 - DNA, 15 bp, Homo sapiens
tgtgagggcagtgca

SEQ ID NO: 6507300 - DNA, 23 bp, Homo sapiens
tgtgaggggtttcttttggaaat

SEQ ID NO: 6507301 - DNA, 15 bp, Homo sapiens
tgtgagggtgctgac

SEQ ID NO: 6507302 - DNA, 20 bp, Homo sapiens
tgtgagggtttgtaatggtg

SEQ ID NO: 6507303 - DNA, 17 bp, Homo sapiens
tgtgaggtgataggcaa

SEQ ID NO: 6507304 - DNA, 20 bp, Homo sapiens
tgtgaggtttaacattaaag

SEQ ID NO: 6507305 - DNA, 16 bp, Homo sapiens
tgtgaggtttcacctc

SEQ ID NO: 6507306 - DNA, 20 bp, Homo sapiens
tgtgaggtttcccaatggtg

SEQ ID NO: 6507307 - DNA, 12 bp, Homo sapiens
tgtgagtaaata

SEQ ID NO: 6507308 - DNA, 14 bp, Homo sapiens
tgtgagtaaatatt

SEQ ID NO: 6507309 - DNA, 15 bp, Homo sapiens
tgtgagtaaatattg

SEQ ID NO: 6507310 - DNA, 19 bp, Homo sapiens
tgtgagtactacagtcctc

SEQ ID NO: 6507311 - DNA, 20 bp, Homo sapiens
tgtgagtactacagtcctcc

SEQ ID NO: 6507312 - DNA, 21 bp, Homo sapiens
tgtgagtagcctatgaatgaa

SEQ ID NO: 6507313 - DNA, 17 bp, Homo sapiens
tgtgagtatcagaattg

SEQ ID NO: 6507314 - DNA, 13 bp, Homo sapiens
tgtgagtatgtgt

SEQ ID NO: 6507315 - DNA, 15 bp, Homo sapiens
tgtgagtattctatg

SEQ ID NO: 6507316 - DNA, 21 bp, Homo sapiens
tgtgagtattctatgtaaaaa

SEQ ID NO: 6507317 - DNA, 19 bp, Homo sapiens
tgtgagtcaccaagcccag

SEQ ID NO: 6507318 - DNA, 14 bp, Homo sapiens
tgtgagtcacttct

SEQ ID NO: 6507319 - DNA, 21 bp, Homo sapiens
tgtgagtcattatgtagctgt

SEQ ID NO: 6507320 - DNA, 22 bp, Homo sapiens
tgtgagtccctgtgatggccag

SEQ ID NO: 6507321 - DNA, 18 bp, Homo sapiens
tgtgagtcctgttgaaga

SEQ ID NO: 6507322 - DNA, 16 bp, Homo sapiens
tgtgagtctgggatat

SEQ ID NO: 6507323 - DNA, 21 bp, Homo sapiens
tgtgagtctgtcctttcccac

SEQ ID NO: 6507324 - DNA, 17 bp, Homo sapiens
tgtgagtgaaagttgcc

SEQ ID NO: 6507325 - DNA, 14 bp, Homo sapiens
tgtgagtgaagctc

SEQ ID NO: 6507326 - DNA, 20 bp, Homo sapiens
tgtgagtgactcggtgtaaa

SEQ ID NO: 6507327 - DNA, 19 bp, Homo sapiens
tgtgagtgccttttgcaga

SEQ ID NO: 6507328 - DNA, 17 bp, Homo sapiens
tgtgagtggcagccatg

SEQ ID NO: 6507329 - DNA, 19 bp, Homo sapiens
tgtgagtggcagccatgcc

SEQ ID NO: 6507330 - DNA, 13 bp, Homo sapiens
tgtgagtgggagg

SEQ ID NO: 6507331 - DNA, 23 bp, Homo sapiens
tgtgagtgggtgcgtggtataca

SEQ ID NO: 6507332 - DNA, 14 bp, Homo sapiens
tgtgagtggttgaa

SEQ ID NO: 6507333 - DNA, 15 bp, Homo sapiens
tgtgagtgtatgtat

SEQ ID NO: 6507334 - DNA, 19 bp, Homo sapiens
tgtgagtgtatgtatacac

SEQ ID NO: 6507335 - DNA, 22 bp, Homo sapiens
tgtgagtgtatgtatacacaca

SEQ ID NO: 6507336 - DNA, 12 bp, Homo sapiens
tgtgagtgtgac

SEQ ID NO: 6507337 - DNA, 15 bp, Homo sapiens
tgtgagtgtgacagg

SEQ ID NO: 6507338 - DNA, 16 bp, Homo sapiens
tgtgagtgtgacaggg

SEQ ID NO: 6507339 - DNA, 17 bp, Homo sapiens
tgtgagtgtgacagggc

SEQ ID NO: 6507340 - DNA, 23 bp, Homo sapiens
tgtgagtgtgtccaagtgtgtgt

SEQ ID NO: 6507341 - DNA, 15 bp, Homo sapiens
tgtgagtgtgtgcac

SEQ ID NO: 6507342 - DNA, 15 bp, Homo sapiens
tgtgagtgtgtgtgt

SEQ ID NO: 6507343 - DNA, 22 bp, Homo sapiens
tgtgagtgtttttatcttttta

SEQ ID NO: 6507344 - DNA, 21 bp, Homo sapiens
tgtgagttgagccttcaggcc

SEQ ID NO: 6507345 - DNA, 19 bp, Homo sapiens
tgtgagttgagtctcctct

SEQ ID NO: 6507346 - DNA, 16 bp, Homo sapiens
tgtgagtttaaagcaa

SEQ ID NO: 6507347 - DNA, 21 bp, Homo sapiens
tgtgagtttaccttgtatact

SEQ ID NO: 6507348 - DNA, 19 bp, Homo sapiens
tgtgagtttggtctggact

SEQ ID NO: 6507349 - DNA, 17 bp, Homo sapiens
tgtgagtttgtttcttt

SEQ ID NO: 6507350 - DNA, 21 bp, Homo sapiens
tgtgagtttgtttctttgaat

SEQ ID NO: 6507351 - DNA, 16 bp, Homo sapiens
tgtgataaaatgttga

SEQ ID NO: 6507352 - DNA, 18 bp, Homo sapiens
tgtgataacagagtgatt

SEQ ID NO: 6507353 - DNA, 16 bp, Homo sapiens
tgtgataatagcattt

SEQ ID NO: 6507354 - DNA, 15 bp, Homo sapiens
tgtgataattgtaaa

SEQ ID NO: 6507355 - DNA, 13 bp, Homo sapiens
tgtgataatttaa

SEQ ID NO: 6507356 - DNA, 21 bp, Homo sapiens
tgtgatacaatgctgtgccct

SEQ ID NO: 6507357 - DNA, 18 bp, Homo sapiens
tgtgatacagagtatatt

SEQ ID NO: 6507358 - DNA, 18 bp, Homo sapiens
tgtgatacatttctgaat

SEQ ID NO: 6507359 - DNA, 22 bp, Homo sapiens
tgtgatacccatagcttccatg

SEQ ID NO: 6507360 - DNA, 15 bp, Homo sapiens
tgtgatataaaatat

SEQ ID NO: 6507361 - DNA, 16 bp, Homo sapiens
tgtgatataagtgtgt

SEQ ID NO: 6507362 - DNA, 21 bp, Homo sapiens
tgtgatatgcacaatgtagat

SEQ ID NO: 6507363 - DNA, 19 bp, Homo sapiens
tgtgatattaaatttcaaa

SEQ ID NO: 6507364 - DNA, 19 bp, Homo sapiens
tgtgatattctaagactta

SEQ ID NO: 6507365 - DNA, 16 bp, Homo sapiens
tgtgatatttcagaaa

SEQ ID NO: 6507366 - DNA, 19 bp, Homo sapiens
tgtgatatttgacagacat

SEQ ID NO: 6507367 - DNA, 16 bp, Homo sapiens
tgtgatcagcattgtg

SEQ ID NO: 6507368 - DNA, 13 bp, Homo sapiens
tgtgatcaggccc

SEQ ID NO: 6507369 - DNA, 20 bp, Homo sapiens
tgtgatcaggccccacccct

SEQ ID NO: 6507370 - DNA, 16 bp, Homo sapiens
tgtgatcagtgatttt

SEQ ID NO: 6507371 - DNA, 19 bp, Homo sapiens
tgcccccaccccaggctgg

SEQ ID NO: 6507372 - DNA, 23 bp, Homo sapiens
tgcccccaccccatgcccccacc

SEQ ID NO: 6507373 - DNA, 13 bp, Homo sapiens
tgcccccaccctg

SEQ ID NO: 6507374 - DNA, 14 bp, Homo sapiens
tgcccccaccctgc

SEQ ID NO: 6507375 - DNA, 14 bp, Homo sapiens
tgcccccacctctg

SEQ ID NO: 6507376 - DNA, 17 bp, Homo sapiens
tgcccccacctctggtc

SEQ ID NO: 6507377 - DNA, 12 bp, Homo sapiens
tgcccccactgt

SEQ ID NO: 6507378 - DNA, 13 bp, Homo sapiens
tgcccccagaaag

SEQ ID NO: 6507379 - DNA, 18 bp, Homo sapiens
tgcccccagacagctgct

SEQ ID NO: 6507380 - DNA, 16 bp, Homo sapiens
tgcccccagccccggg

SEQ ID NO: 6507381 - DNA, 20 bp, Homo sapiens
tgcccccagcctcagcccaa

SEQ ID NO: 6507382 - DNA, 17 bp, Homo sapiens
tgcccccagctgctcct

SEQ ID NO: 6507383 - DNA, 13 bp, Homo sapiens
tgcccccagctgg

SEQ ID NO: 6507384 - DNA, 16 bp, Homo sapiens
tgcccccagctggccc

SEQ ID NO: 6507385 - DNA, 13 bp, Homo sapiens
tgcccccaggcag

SEQ ID NO: 6507386 - DNA, 14 bp, Homo sapiens
tgcccccaggcagc

SEQ ID NO: 6507387 - DNA, 21 bp, Homo sapiens
tgcccccaggcagccaccagt

SEQ ID NO: 6507388 - DNA, 18 bp, Homo sapiens
tgcccccagggtcctggg

SEQ ID NO: 6507389 - DNA, 22 bp, Homo sapiens
tgcccccagggtcctgggagga

SEQ ID NO: 6507390 - DNA, 14 bp, Homo sapiens
tgcccccagtgcct

SEQ ID NO: 6507391 - DNA, 16 bp, Homo sapiens
tgcccccatcacctct

SEQ ID NO: 6507392 - DNA, 22 bp, Homo sapiens
tgcccccatctccccaggcctc

SEQ ID NO: 6507393 - DNA, 18 bp, Homo sapiens
tgcccccatttctgaggt

SEQ ID NO: 6507394 - DNA, 21 bp, Homo sapiens
tgccccccaaggttctggttc

SEQ ID NO: 6507395 - DNA, 13 bp, Homo sapiens
tgccccccacccc

SEQ ID NO: 6507396 - DNA, 14 bp, Homo sapiens
tgccccccacccca

SEQ ID NO: 6507397 - DNA, 20 bp, Homo sapiens
tgccccccaccccagcctaa

SEQ ID NO: 6507398 - DNA, 12 bp, Homo sapiens
tgccccccagcc

SEQ ID NO: 6507399 - DNA, 19 bp, Homo sapiens
tgccccccagcctctggca

SEQ ID NO: 6507400 - DNA, 12 bp, Homo sapiens
tgccccccaggg

SEQ ID NO: 6507401 - DNA, 14 bp, Homo sapiens
tgccccccagggct

SEQ ID NO: 6507402 - DNA, 13 bp, Homo sapiens
tgccccccagtct

SEQ ID NO: 6507403 - DNA, 21 bp, Homo sapiens
tgccccccatcctggcccatc

SEQ ID NO: 6507404 - DNA, 23 bp, Homo sapiens
tgccccccatgaggaaggaacag

SEQ ID NO: 6507405 - DNA, 15 bp, Homo sapiens
tgccccccatgccct

SEQ ID NO: 6507406 - DNA, 19 bp, Homo sapiens
tgccccccctaagagacac

SEQ ID NO: 6507407 - DNA, 20 bp, Homo sapiens
tgccccccctaagagacaca

SEQ ID NO: 6507408 - DNA, 17 bp, Homo sapiens
tgccccccgccctcatg

SEQ ID NO: 6507409 - DNA, 20 bp, Homo sapiens
tgcccccctcaaacctcctc

SEQ ID NO: 6507410 - DNA, 22 bp, Homo sapiens
tgcccccctcaaacctcctctt

SEQ ID NO: 6507411 - DNA, 23 bp, Homo sapiens
tgcccccctcaaacctcctcttc

SEQ ID NO: 6507412 - DNA, 16 bp, Homo sapiens
tgcccccctcctccag

SEQ ID NO: 6507413 - DNA, 18 bp, Homo sapiens
tgcccccctcctccagta

SEQ ID NO: 6507414 - DNA, 11 bp, Homo sapiens
tgccccccttc

SEQ ID NO: 6507415 - DNA, 13 bp, Homo sapiens
tgccccccttccc

SEQ ID NO: 6507416 - DNA, 14 bp, Homo sapiens
tgccccccttccca

SEQ ID NO: 6507417 - DNA, 15 bp, Homo sapiens
tgccccccttcccac

SEQ ID NO: 6507418 - DNA, 18 bp, Homo sapiens
tgcccccgacagcccagc

SEQ ID NO: 6507419 - DNA, 21 bp, Homo sapiens
tgcccccgacagcccagccta

SEQ ID NO: 6507420 - DNA, 18 bp, Homo sapiens
tgcccccgcatcccctgc

SEQ ID NO: 6507421 - DNA, 20 bp, Homo sapiens
tgcccccgcatcccctgcct

SEQ ID NO: 6507422 - DNA, 22 bp, Homo sapiens
tgcccccgcatcccctgcctcc

SEQ ID NO: 6507423 - DNA, 22 bp, Homo sapiens
tgcccccgccacctccccactc

SEQ ID NO: 6507424 - DNA, 14 bp, Homo sapiens
tgcccccgcctgcc

SEQ ID NO: 6507425 - DNA, 21 bp, Homo sapiens
tgcccccgcgggttctagacg

SEQ ID NO: 6507426 - DNA, 21 bp, Homo sapiens
tgcccccgctcccgctcccag

SEQ ID NO: 6507427 - DNA, 18 bp, Homo sapiens
tgcccccgtcttctctcc

SEQ ID NO: 6507428 - DNA, 18 bp, Homo sapiens
tgcccccgtggggctccc

SEQ ID NO: 6507429 - DNA, 16 bp, Homo sapiens
tgcccccgttccagct

SEQ ID NO: 6507430 - DNA, 14 bp, Homo sapiens
tgccccctcacctc

SEQ ID NO: 6507431 - DNA, 20 bp, Homo sapiens
tgccccctcacctctccagg

SEQ ID NO: 6507432 - DNA, 12 bp, Homo sapiens
tgccccctcagg

SEQ ID NO: 6507433 - DNA, 13 bp, Homo sapiens
tgccccctcatct

SEQ ID NO: 6507434 - DNA, 16 bp, Homo sapiens
tgccccctcatctcac

SEQ ID NO: 6507435 - DNA, 11 bp, Homo sapiens
tgccccctccc

SEQ ID NO: 6507436 - DNA, 15 bp, Homo sapiens
tgccccctcccccgc

SEQ ID NO: 6507437 - DNA, 16 bp, Homo sapiens
tgccccctcccccgca

SEQ ID NO: 6507438 - DNA, 19 bp, Homo sapiens
tgccccctcccccgcagac

SEQ ID NO: 6507439 - DNA, 20 bp, Homo sapiens
tgccccctcccccgcagaca

SEQ ID NO: 6507440 - DNA, 19 bp, Homo sapiens
tgccccctcccttcacagg

SEQ ID NO: 6507441 - DNA, 12 bp, Homo sapiens
tgccccctcctc

SEQ ID NO: 6507442 - DNA, 14 bp, Homo sapiens
tgccccctcctctc

SEQ ID NO: 6507443 - DNA, 13 bp, Homo sapiens
tgccccctcgtgc

SEQ ID NO: 6507444 - DNA, 17 bp, Homo sapiens
tgccccctcgtgccagt

SEQ ID NO: 6507445 - DNA, 15 bp, Homo sapiens
tgccccctctgccct

SEQ ID NO: 6507446 - DNA, 16 bp, Homo sapiens
tgccccctctgccctg

SEQ ID NO: 6507447 - DNA, 18 bp, Homo sapiens
tgccccctctgccctgcg

SEQ ID NO: 6507448 - DNA, 14 bp, Homo sapiens
tgccccctgcagaa

SEQ ID NO: 6507449 - DNA, 14 bp, Homo sapiens
tgccccctgcagac

SEQ ID NO: 6507450 - DNA, 13 bp, Homo sapiens
tgccccctgcagg

SEQ ID NO: 6507451 - DNA, 14 bp, Homo sapiens
tgccccctgcagga

SEQ ID NO: 6507452 - DNA, 13 bp, Homo sapiens
tgccccctgctgg

SEQ ID NO: 6507453 - DNA, 12 bp, Homo sapiens
tgccccctgggc

SEQ ID NO: 6507454 - DNA, 18 bp, Homo sapiens
tgccccctgggctggggc

SEQ ID NO: 6507455 - DNA, 13 bp, Homo sapiens
tgccccctgggga

SEQ ID NO: 6507456 - DNA, 21 bp, Homo sapiens
tgccccctggtggacagtcct

SEQ ID NO: 6507457 - DNA, 19 bp, Homo sapiens
tgccccctgtggatgctgc

SEQ ID NO: 6507458 - DNA, 15 bp, Homo sapiens
tgcccccttccccag

SEQ ID NO: 6507459 - DNA, 20 bp, Homo sapiens
tgcccccttccccagccctt

SEQ ID NO: 6507460 - DNA, 17 bp, Homo sapiens
tgcccccttcgctcctc

SEQ ID NO: 6507461 - DNA, 13 bp, Homo sapiens
tgcccccttctcc

SEQ ID NO: 6507462 - DNA, 21 bp, Homo sapiens
tgccccctttcagatgtcttc

SEQ ID NO: 6507463 - DNA, 23 bp, Homo sapiens
tgccccgaacatgtttttcttct

SEQ ID NO: 6507464 - DNA, 23 bp, Homo sapiens
tgccccgcagacggtctgtgtgc

SEQ ID NO: 6507465 - DNA, 21 bp, Homo sapiens
tgccccgcaggcctgccttct

SEQ ID NO: 6507466 - DNA, 22 bp, Homo sapiens
tgccccgcccccagtccccacc

SEQ ID NO: 6507467 - DNA, 16 bp, Homo sapiens
tgccccgcctcccggg

SEQ ID NO: 6507468 - DNA, 23 bp, Homo sapiens
tgccccgcctcccggggtgcccg

SEQ ID NO: 6507469 - DNA, 22 bp, Homo sapiens
tgccccgccttcgtgtgctgct

SEQ ID NO: 6507470 - DNA, 15 bp, Homo sapiens
tgccccgcgggcttt

SEQ ID NO: 6507471 - DNA, 16 bp, Homo sapiens
tgccccgcgtcttcag

SEQ ID NO: 6507472 - DNA, 21 bp, Homo sapiens
tgccccgcttccccacagaac

SEQ ID NO: 6507473 - DNA, 16 bp, Homo sapiens
tgccccggacctacct

SEQ ID NO: 6507474 - DNA, 17 bp, Homo sapiens
tgccccggacctacctc

SEQ ID NO: 6507475 - DNA, 13 bp, Homo sapiens
tgccccggccacc

SEQ ID NO: 6507476 - DNA, 16 bp, Homo sapiens
tgccccggccacctct

SEQ ID NO: 6507477 - DNA, 23 bp, Homo sapiens
tgccccggccacctctgcggacc

SEQ ID NO: 6507478 - DNA, 15 bp, Homo sapiens
tgccccggcctcctc

SEQ ID NO: 6507479 - DNA, 22 bp, Homo sapiens
tgccccgggtccccagctcccc

SEQ ID NO: 6507480 - DNA, 15 bp, Homo sapiens
tgccccgtagagaat

SEQ ID NO: 6507481 - DNA, 18 bp, Homo sapiens
tgccccgtcaccatctca

SEQ ID NO: 6507482 - DNA, 18 bp, Homo sapiens
tgccccgtccccctctgg

SEQ ID NO: 6507483 - DNA, 19 bp, Homo sapiens
tgccccgtctacagctccc

SEQ ID NO: 6507484 - DNA, 19 bp, Homo sapiens
tgccccgtgtgtgtggccg

SEQ ID NO: 6507485 - DNA, 22 bp, Homo sapiens
tgccccgtgtgtgtggccggcc

SEQ ID NO: 6507486 - DNA, 18 bp, Homo sapiens
tgccccgttccctgtcag

SEQ ID NO: 6507487 - DNA, 23 bp, Homo sapiens
tgccccgttccctgtcagaggct

SEQ ID NO: 6507488 - DNA, 19 bp, Homo sapiens
tgcccctaaagatgggagg

SEQ ID NO: 6507489 - DNA, 15 bp, Homo sapiens
tgcccctaagttatt

SEQ ID NO: 6507490 - DNA, 22 bp, Homo sapiens
tgcccctacgggcgctgcagcc

SEQ ID NO: 6507491 - DNA, 23 bp, Homo sapiens
tgcccctaggatgctgcagcaga

SEQ ID NO: 6507492 - DNA, 18 bp, Homo sapiens
tgcccctattgggagagg

SEQ ID NO: 6507493 - DNA, 22 bp, Homo sapiens
tgcccctcacctgcctgccctc

SEQ ID NO: 6507494 - DNA, 16 bp, Homo sapiens
tgcccctcaccttggg

SEQ ID NO: 6507495 - DNA, 16 bp, Homo sapiens
tgcccctcagagactg

SEQ ID NO: 6507496 - DNA, 15 bp, Homo sapiens
tgcccctcagagagg

SEQ ID NO: 6507497 - DNA, 12 bp, Homo sapiens
tgcccctcaggg

SEQ ID NO: 6507498 - DNA, 17 bp, Homo sapiens
tgcccctcagggggcca

SEQ ID NO: 6507499 - DNA, 18 bp, Homo sapiens
tgcccctcagggggccag

SEQ ID NO: 6507500 - DNA, 20 bp, Homo sapiens
tgcccctcagggggccagct

SEQ ID NO: 6507501 - DNA, 22 bp, Homo sapiens
tgcccctcagggggccagctgg

SEQ ID NO: 6507502 - DNA, 15 bp, Homo sapiens
tgcccctcccatggc

SEQ ID NO: 6507503 - DNA, 22 bp, Homo sapiens
tgcccctcccatggcccagcag

SEQ ID NO: 6507504 - DNA, 14 bp, Homo sapiens
tgcccctccccagt

SEQ ID NO: 6507505 - DNA, 13 bp, Homo sapiens
tgcccctccccca

SEQ ID NO: 6507506 - DNA, 15 bp, Homo sapiens
tgcccctcccccagc

SEQ ID NO: 6507507 - DNA, 16 bp, Homo sapiens
tgcccctcccccagcc

SEQ ID NO: 6507508 - DNA, 16 bp, Homo sapiens
tgcccctcccccagct

SEQ ID NO: 6507509 - DNA, 17 bp, Homo sapiens
tgcccctcccccagctg

SEQ ID NO: 6507510 - DNA, 17 bp, Homo sapiens
tgcccctccccctaccg

SEQ ID NO: 6507511 - DNA, 13 bp, Homo sapiens
tgcccctcccctc

SEQ ID NO: 6507512 - DNA, 16 bp, Homo sapiens
tgcccctcccctcccc

SEQ ID NO: 6507513 - DNA, 14 bp, Homo sapiens
tgcccctccctcag

SEQ ID NO: 6507514 - DNA, 19 bp, Homo sapiens
tgcccctccctcagggagc

SEQ ID NO: 6507515 - DNA, 15 bp, Homo sapiens
tgcccctccctgctt

SEQ ID NO: 6507516 - DNA, 13 bp, Homo sapiens
tgcccctcccttc

SEQ ID NO: 6507517 - DNA, 22 bp, Homo sapiens
tgcccctccgatgctgaggcca

SEQ ID NO: 6507518 - DNA, 12 bp, Homo sapiens
tgcccctcctgg

SEQ ID NO: 6507519 - DNA, 13 bp, Homo sapiens
tgcccctcctggg

SEQ ID NO: 6507520 - DNA, 15 bp, Homo sapiens
tgcccctcgcacaca

SEQ ID NO: 6507521 - DNA, 15 bp, Homo sapiens
tgcccctcgccagct

SEQ ID NO: 6507522 - DNA, 18 bp, Homo sapiens
tgcccctcgccagcttct

SEQ ID NO: 6507523 - DNA, 19 bp, Homo sapiens
tgcccctcgccagcttctc

SEQ ID NO: 6507524 - DNA, 22 bp, Homo sapiens
tgcccctcggggtgtcagaaat

SEQ ID NO: 6507525 - DNA, 12 bp, Homo sapiens
tgcccctctcac

SEQ ID NO: 6507526 - DNA, 20 bp, Homo sapiens
tgcccctctccgaaagaaga

SEQ ID NO: 6507527 - DNA, 15 bp, Homo sapiens
tgcccctctccttct

SEQ ID NO: 6507528 - DNA, 20 bp, Homo sapiens
tgcccctctccttcttagct

SEQ ID NO: 6507529 - DNA, 13 bp, Homo sapiens
tgcccctctctcc

SEQ ID NO: 6507530 - DNA, 13 bp, Homo sapiens
tgcccctctctgg

SEQ ID NO: 6507531 - DNA, 21 bp, Homo sapiens
tgcccctctctgggcctcaga

SEQ ID NO: 6507532 - DNA, 14 bp, Homo sapiens
tgcccctctgcctt

SEQ ID NO: 6507533 - DNA, 17 bp, Homo sapiens
tgcccctctgttctctc

SEQ ID NO: 6507534 - DNA, 19 bp, Homo sapiens
tgcccctctgttctctccc

SEQ ID NO: 6507535 - DNA, 22 bp, Homo sapiens
tgcccctctttctctttcttcc

SEQ ID NO: 6507536 - DNA, 16 bp, Homo sapiens
tgcccctgatcactcc

SEQ ID NO: 6507537 - DNA, 17 bp, Homo sapiens
tgcccctgatgcagcct

SEQ ID NO: 6507538 - DNA, 18 bp, Homo sapiens
tgcccctgatgcagcctg

SEQ ID NO: 6507539 - DNA, 11 bp, Homo sapiens
tgcccctgcaa

SEQ ID NO: 6507540 - DNA, 16 bp, Homo sapiens
tgcccctgcaaagaca

SEQ ID NO: 6507541 - DNA, 18 bp, Homo sapiens
tgcccctgcacctgcttc

SEQ ID NO: 6507542 - DNA, 13 bp, Homo sapiens
tgcccctgcagct

SEQ ID NO: 6507543 - DNA, 12 bp, Homo sapiens
tgcccctgcagg

SEQ ID NO: 6507544 - DNA, 13 bp, Homo sapiens
tgcccctgcagtt

SEQ ID NO: 6507545 - DNA, 23 bp, Homo sapiens
tgcccctgcagtttggccctgga

SEQ ID NO: 6507546 - DNA, 17 bp, Homo sapiens
tgcccctgccccaaccc

SEQ ID NO: 6507547 - DNA, 18 bp, Homo sapiens
tgcccctgcccctgcccg

SEQ ID NO: 6507548 - DNA, 13 bp, Homo sapiens
tgcccctgccctg

SEQ ID NO: 6507549 - DNA, 14 bp, Homo sapiens
tgcccctgccctga

SEQ ID NO: 6507550 - DNA, 16 bp, Homo sapiens
tgcccctgcgtggcct

SEQ ID NO: 6507551 - DNA, 21 bp, Homo sapiens
tgcccctgcgtggcctgagtc

SEQ ID NO: 6507552 - DNA, 20 bp, Homo sapiens
aagagaacccacgaacattc

SEQ ID NO: 6507553 - DNA, 22 bp, Homo sapiens
aagagaaccgagcaaagatcaa

SEQ ID NO: 6507554 - DNA, 20 bp, Homo sapiens
aagagaactccagtgttgct

SEQ ID NO: 6507555 - DNA, 15 bp, Homo sapiens
aagagaacttccaga

SEQ ID NO: 6507556 - DNA, 23 bp, Homo sapiens
aagagaactttcggagcctgcct

SEQ ID NO: 6507557 - DNA, 12 bp, Homo sapiens
aagagaagaaaa

SEQ ID NO: 6507558 - DNA, 14 bp, Homo sapiens
aagagaagaaaaaa

SEQ ID NO: 6507559 - DNA, 16 bp, Homo sapiens
aagagaagatgcctgt

SEQ ID NO: 6507560 - DNA, 13 bp, Homo sapiens
aagagaaggaagc

SEQ ID NO: 6507561 - DNA, 19 bp, Homo sapiens
aagagaagtcacaacaaaa

SEQ ID NO: 6507562 - DNA, 21 bp, Homo sapiens
aagagaagttgtaaagtatgt

SEQ ID NO: 6507563 - DNA, 23 bp, Homo sapiens
aagagaagtttaacaagtattta

SEQ ID NO: 6507564 - DNA, 12 bp, Homo sapiens
aagagaataaag

SEQ ID NO: 6507565 - DNA, 20 bp, Homo sapiens
aagagaatattagctttact

SEQ ID NO: 6507566 - DNA, 20 bp, Homo sapiens
aagagaatattcctacttgc

SEQ ID NO: 6507567 - DNA, 21 bp, Homo sapiens
aagagaatattcctacttgca

SEQ ID NO: 6507568 - DNA, 12 bp, Homo sapiens
aagagaatattt

SEQ ID NO: 6507569 - DNA, 23 bp, Homo sapiens
aagagaatatttacaatatatga

SEQ ID NO: 6507570 - DNA, 13 bp, Homo sapiens
aagagaatatttt

SEQ ID NO: 6507571 - DNA, 19 bp, Homo sapiens
aagagaatcaacagatgat

SEQ ID NO: 6507572 - DNA, 16 bp, Homo sapiens
aagagaatgaactgtg

SEQ ID NO: 6507573 - DNA, 17 bp, Homo sapiens
aagagaatgaactgtgg

SEQ ID NO: 6507574 - DNA, 19 bp, Homo sapiens
aagagaatgaactgtggaa

SEQ ID NO: 6507575 - DNA, 20 bp, Homo sapiens
aagagaatgatgctcaaaat

SEQ ID NO: 6507576 - DNA, 13 bp, Homo sapiens
aagagaatgtaga

SEQ ID NO: 6507577 - DNA, 17 bp, Homo sapiens
aagagaatgtatttcct

SEQ ID NO: 6507578 - DNA, 13 bp, Homo sapiens
aagagaatgttat

SEQ ID NO: 6507579 - DNA, 21 bp, Homo sapiens
aagagaattgtagataatact

SEQ ID NO: 6507580 - DNA, 12 bp, Homo sapiens
aagagacaaata

SEQ ID NO: 6507581 - DNA, 13 bp, Homo sapiens
aagagacaaatag

SEQ ID NO: 6507582 - DNA, 16 bp, Homo sapiens
aagagacaataacttt

SEQ ID NO: 6507583 - DNA, 17 bp, Homo sapiens
aagagacaatttctgca

SEQ ID NO: 6507584 - DNA, 14 bp, Homo sapiens
aagagacagaatgt

SEQ ID NO: 6507585 - DNA, 18 bp, Homo sapiens
aagagacagagacaagta

SEQ ID NO: 6507586 - DNA, 13 bp, Homo sapiens
aagagacagagcc

SEQ ID NO: 6507587 - DNA, 21 bp, Homo sapiens
aagagacagagcccccaagcc

SEQ ID NO: 6507588 - DNA, 19 bp, Homo sapiens
aagagacagagtgctgagg

SEQ ID NO: 6507589 - DNA, 15 bp, Homo sapiens
aagagacagcccagg

SEQ ID NO: 6507590 - DNA, 16 bp, Homo sapiens
aagagacagcccagga

SEQ ID NO: 6507591 - DNA, 14 bp, Homo sapiens
aagagacagtcacc

SEQ ID NO: 6507592 - DNA, 20 bp, Homo sapiens
aagagacagtcaccccagga

SEQ ID NO: 6507593 - DNA, 14 bp, Homo sapiens
aagagaccaagctt

SEQ ID NO: 6507594 - DNA, 19 bp, Homo sapiens
aagagactaatagagacac

SEQ ID NO: 6507595 - DNA, 17 bp, Homo sapiens
aagagactactctgcct

SEQ ID NO: 6507596 - DNA, 13 bp, Homo sapiens
aagagactctcct

SEQ ID NO: 6507597 - DNA, 18 bp, Homo sapiens
aagagactctcctgcctc

SEQ ID NO: 6507598 - DNA, 17 bp, Homo sapiens
aagagactgcttgacaa

SEQ ID NO: 6507599 - DNA, 14 bp, Homo sapiens
aagagactggagca

SEQ ID NO: 6507600 - DNA, 23 bp, Homo sapiens
aagagactggttagtgatgcagt

SEQ ID NO: 6507601 - DNA, 20 bp, Homo sapiens
aagagacttaaaggacagga

SEQ ID NO: 6507602 - DNA, 14 bp, Homo sapiens
aagagacttctctg

SEQ ID NO: 6507603 - DNA, 19 bp, Homo sapiens
aagagacttctctgtaagt

SEQ ID NO: 6507604 - DNA, 16 bp, Homo sapiens
aagagactttgtcact

SEQ ID NO: 6507605 - DNA, 13 bp, Homo sapiens
aagagagaaaata

SEQ ID NO: 6507606 - DNA, 14 bp, Homo sapiens
aagagagaaaataa

SEQ ID NO: 6507607 - DNA, 15 bp, Homo sapiens
aagagagaaacattt

SEQ ID NO: 6507608 - DNA, 17 bp, Homo sapiens
aagagagaaagaagata

SEQ ID NO: 6507609 - DNA, 11 bp, Homo sapiens
aagagagaacc

SEQ ID NO: 6507610 - DNA, 20 bp, Homo sapiens
aagagagaacctaactgtat

SEQ ID NO: 6507611 - DNA, 13 bp, Homo sapiens
aagagagaatgta

SEQ ID NO: 6507612 - DNA, 19 bp, Homo sapiens
aagagagacagcacaggca

SEQ ID NO: 6507613 - DNA, 19 bp, Homo sapiens
aagagagacattgcctcca

SEQ ID NO: 6507614 - DNA, 23 bp, Homo sapiens
aagagagaccccagtcaagctcc

SEQ ID NO: 6507615 - DNA, 17 bp, Homo sapiens
aagagagatatatctga

SEQ ID NO: 6507616 - DNA, 15 bp, Homo sapiens
aagagagattctcca

SEQ ID NO: 6507617 - DNA, 15 bp, Homo sapiens
aagagagccctggtc

SEQ ID NO: 6507618 - DNA, 16 bp, Homo sapiens
aagagagccttggttc

SEQ ID NO: 6507619 - DNA, 20 bp, Homo sapiens
aagagagctctaaccagatg

SEQ ID NO: 6507620 - DNA, 13 bp, Homo sapiens
aagagagctggag

SEQ ID NO: 6507621 - DNA, 22 bp, Homo sapiens
aagagagcttaatgataatatt

SEQ ID NO: 6507622 - DNA, 15 bp, Homo sapiens
aagagaggacacaaa

SEQ ID NO: 6507623 - DNA, 12 bp, Homo sapiens
aagagaggactg

SEQ ID NO: 6507624 - DNA, 18 bp, Homo sapiens
aagagaggagttcaatga

SEQ ID NO: 6507625 - DNA, 13 bp, Homo sapiens
aagagaggcacct

SEQ ID NO: 6507626 - DNA, 16 bp, Homo sapiens
aagagaggcacctgct

SEQ ID NO: 6507627 - DNA, 20 bp, Homo sapiens
aagagaggccccggctgggt

SEQ ID NO: 6507628 - DNA, 16 bp, Homo sapiens
aagagagggacaggca

SEQ ID NO: 6507629 - DNA, 18 bp, Homo sapiens
aagagagggacaggcact

SEQ ID NO: 6507630 - DNA, 14 bp, Homo sapiens
aagagaggtccaga

SEQ ID NO: 6507631 - DNA, 11 bp, Homo sapiens
aagagaggtta

SEQ ID NO: 6507632 - DNA, 17 bp, Homo sapiens
aagagagtaccatgctg

SEQ ID NO: 6507633 - DNA, 17 bp, Homo sapiens
aagagagttaaaagcag

SEQ ID NO: 6507634 - DNA, 15 bp, Homo sapiens
aagagataagtcttt

SEQ ID NO: 6507635 - DNA, 14 bp, Homo sapiens
aagagataataaga

SEQ ID NO: 6507636 - DNA, 20 bp, Homo sapiens
aagagataataagattagtt

SEQ ID NO: 6507637 - DNA, 18 bp, Homo sapiens
aagagatacgaatttcta

SEQ ID NO: 6507638 - DNA, 17 bp, Homo sapiens
aagagatagcagaggaa

SEQ ID NO: 6507639 - DNA, 20 bp, Homo sapiens
aagagatagcagaggaaaaa

SEQ ID NO: 6507640 - DNA, 14 bp, Homo sapiens
aagagatatgggaa

SEQ ID NO: 6507641 - DNA, 21 bp, Homo sapiens
aagagatatgtagaaggcaca

SEQ ID NO: 6507642 - DNA, 21 bp, Homo sapiens
aagagatattttaaaatgaga

SEQ ID NO: 6507643 - DNA, 22 bp, Homo sapiens
aagagatattttgggcatgtgg

SEQ ID NO: 6507644 - DNA, 15 bp, Homo sapiens
aagagatcaggaaga

SEQ ID NO: 6507645 - DNA, 16 bp, Homo sapiens
aagagatcaggaagag

SEQ ID NO: 6507646 - DNA, 15 bp, Homo sapiens
aagagatccaaagac

SEQ ID NO: 6507647 - DNA, 18 bp, Homo sapiens
aagagatctacacatgtt

SEQ ID NO: 6507648 - DNA, 20 bp, Homo sapiens
aagagatctacacatgttgc

SEQ ID NO: 6507649 - DNA, 15 bp, Homo sapiens
aagagatctgggcat

SEQ ID NO: 6507650 - DNA, 14 bp, Homo sapiens
aagagatctgtgtg

SEQ ID NO: 6507651 - DNA, 23 bp, Homo sapiens
aagagatctgtgtggctcctggg

SEQ ID NO: 6507652 - DNA, 15 bp, Homo sapiens
aagagatgaaataat

SEQ ID NO: 6507653 - DNA, 17 bp, Homo sapiens
aagagatgaaataattt

SEQ ID NO: 6507654 - DNA, 17 bp, Homo sapiens
aagagatgagaaatgat

SEQ ID NO: 6507655 - DNA, 18 bp, Homo sapiens
aagagatgtagcagaata

SEQ ID NO: 6507656 - DNA, 17 bp, Homo sapiens
aagagatgtcaaaatgt

SEQ ID NO: 6507657 - DNA, 17 bp, Homo sapiens
aagagatgtttacagta

SEQ ID NO: 6507658 - DNA, 20 bp, Homo sapiens
aagagattagaacatttaat

SEQ ID NO: 6507659 - DNA, 14 bp, Homo sapiens
aagagatttatctt

SEQ ID NO: 6507660 - DNA, 15 bp, Homo sapiens
aagagatttcaacat

SEQ ID NO: 6507661 - DNA, 15 bp, Homo sapiens
aagagatttcaagag

SEQ ID NO: 6507662 - DNA, 13 bp, Homo sapiens
aagagcaaaaata

SEQ ID NO: 6507663 - DNA, 13 bp, Homo sapiens
aagagcaaaatga

SEQ ID NO: 6507664 - DNA, 16 bp, Homo sapiens
aagagcaaacaaaagt

SEQ ID NO: 6507665 - DNA, 13 bp, Homo sapiens
aagagcaaagtag

SEQ ID NO: 6507666 - DNA, 16 bp, Homo sapiens
aagagcaagctgtaca

SEQ ID NO: 6507667 - DNA, 15 bp, Homo sapiens
aagagcaagtctgga

SEQ ID NO: 6507668 - DNA, 19 bp, Homo sapiens
aagagcaatgtgtggctga

SEQ ID NO: 6507669 - DNA, 17 bp, Homo sapiens
aagagcacaaacatttt

SEQ ID NO: 6507670 - DNA, 21 bp, Homo sapiens
aagagcacagagccctgaggg

SEQ ID NO: 6507671 - DNA, 13 bp, Homo sapiens
aagagcacagccc

SEQ ID NO: 6507672 - DNA, 19 bp, Homo sapiens
aagagcaccttcctcactt

SEQ ID NO: 6507673 - DNA, 21 bp, Homo sapiens
aagagcacggtcccccaggag

SEQ ID NO: 6507674 - DNA, 17 bp, Homo sapiens
aagagcacttaagagaa

SEQ ID NO: 6507675 - DNA, 17 bp, Homo sapiens
aagagcacttcacacag

SEQ ID NO: 6507676 - DNA, 14 bp, Homo sapiens
aagagcagaacaga

SEQ ID NO: 6507677 - DNA, 17 bp, Homo sapiens
aagagcagagtctgggc

SEQ ID NO: 6507678 - DNA, 19 bp, Homo sapiens
aagagcagcctgatggcca

SEQ ID NO: 6507679 - DNA, 23 bp, Homo sapiens
aagagcagcctgatggccaaggg

SEQ ID NO: 6507680 - DNA, 13 bp, Homo sapiens
aagagcagcctgg

SEQ ID NO: 6507681 - DNA, 13 bp, Homo sapiens
aagagcaggccag

SEQ ID NO: 6507682 - DNA, 18 bp, Homo sapiens
aagagcagtggtaagaat

SEQ ID NO: 6507683 - DNA, 22 bp, Homo sapiens
aagagcatcagtacttgtttct

SEQ ID NO: 6507684 - DNA, 20 bp, Homo sapiens
aagagcatcatgcctctgag

SEQ ID NO: 6507685 - DNA, 22 bp, Homo sapiens
aagagcatcatgcctctgaggc

SEQ ID NO: 6507686 - DNA, 13 bp, Homo sapiens
aagagcatcctga

SEQ ID NO: 6507687 - DNA, 18 bp, Homo sapiens
aagagcatgaaattttta

SEQ ID NO: 6507688 - DNA, 17 bp, Homo sapiens
aagagcatggatgcatt

SEQ ID NO: 6507689 - DNA, 19 bp, Homo sapiens
aagagcatggatgcatttc

SEQ ID NO: 6507690 - DNA, 16 bp, Homo sapiens
aagagccaagttccaa

SEQ ID NO: 6507691 - DNA, 15 bp, Homo sapiens
aagagccacaggtct

SEQ ID NO: 6507692 - DNA, 12 bp, Homo sapiens
aagagccacctg

SEQ ID NO: 6507693 - DNA, 16 bp, Homo sapiens
aagagccacctgcaag

SEQ ID NO: 6507694 - DNA, 22 bp, Homo sapiens
aagagccaggggtgtcccagtc

SEQ ID NO: 6507695 - DNA, 9 bp, Homo sapiens
aagagccat

SEQ ID NO: 6507696 - DNA, 20 bp, Homo sapiens
aagagccatataagtttgaa

SEQ ID NO: 6507697 - DNA, 22 bp, Homo sapiens
aagagccatctgaagccacctc

SEQ ID NO: 6507698 - DNA, 21 bp, Homo sapiens
aagagccatgtagaagctgca

SEQ ID NO: 6507699 - DNA, 21 bp, Homo sapiens
aagagccatgtgtcatgtaat

SEQ ID NO: 6507700 - DNA, 17 bp, Homo sapiens
aagagccattttggtaa

SEQ ID NO: 6507701 - DNA, 13 bp, Homo sapiens
aagagccccactc

SEQ ID NO: 6507702 - DNA, 17 bp, Homo sapiens
aagagccccactctcag

SEQ ID NO: 6507703 - DNA, 18 bp, Homo sapiens
aagagccccactctcaga

SEQ ID NO: 6507704 - DNA, 22 bp, Homo sapiens
aagagcccgcagggccatgcag

SEQ ID NO: 6507705 - DNA, 18 bp, Homo sapiens
aagagcccgtgccacccc

SEQ ID NO: 6507706 - DNA, 11 bp, Homo sapiens
aagagccctga

SEQ ID NO: 6507707 - DNA, 14 bp, Homo sapiens
aagagccctgagct

SEQ ID NO: 6507708 - DNA, 22 bp, Homo sapiens
aagagccctggacacccctgct

SEQ ID NO: 6507709 - DNA, 21 bp, Homo sapiens
aagagccctggctctgcccct

SEQ ID NO: 6507710 - DNA, 16 bp, Homo sapiens
aagagcccttgcctcc

SEQ ID NO: 6507711 - DNA, 12 bp, Homo sapiens
aagagcctctgg

SEQ ID NO: 6507712 - DNA, 20 bp, Homo sapiens
aagagcctgaagctggcctg

SEQ ID NO: 6507713 - DNA, 15 bp, Homo sapiens
aagagcctgactgtg

SEQ ID NO: 6507714 - DNA, 20 bp, Homo sapiens
aagagcctgattttttgagg

SEQ ID NO: 6507715 - DNA, 17 bp, Homo sapiens
aagagcctggagaagct

SEQ ID NO: 6507716 - DNA, 22 bp, Homo sapiens
aagagccttcacatgaaattag

SEQ ID NO: 6507717 - DNA, 18 bp, Homo sapiens
aagagcgagagatcaaag

SEQ ID NO: 6507718 - DNA, 17 bp, Homo sapiens
aagagcgctcctctgcc

SEQ ID NO: 6507719 - DNA, 21 bp, Homo sapiens
aagagctacttctaattattc

SEQ ID NO: 6507720 - DNA, 15 bp, Homo sapiens
aagagctagagaaat

SEQ ID NO: 6507721 - DNA, 20 bp, Homo sapiens
aagagctagcgctgccgcac

SEQ ID NO: 6507722 - DNA, 23 bp, Homo sapiens
aagagctatttgtggttgttgag

SEQ ID NO: 6507723 - DNA, 20 bp, Homo sapiens
aagagctattttagaaagct

SEQ ID NO: 6507724 - DNA, 12 bp, Homo sapiens
aagagctcagga

SEQ ID NO: 6507725 - DNA, 17 bp, Homo sapiens
aagagctcccctccaca

SEQ ID NO: 6507726 - DNA, 12 bp, Homo sapiens
aagagctcttgg

SEQ ID NO: 6507727 - DNA, 13 bp, Homo sapiens
aagagctgcctgg

SEQ ID NO: 6507728 - DNA, 17 bp, Homo sapiens
aagagctgcctggatga

SEQ ID NO: 6507729 - DNA, 19 bp, Homo sapiens
aagagctgctgtatttgag

SEQ ID NO: 6507730 - DNA, 17 bp, Homo sapiens
aagagctgctgtccttt

SEQ ID NO: 6507731 - DNA, 21 bp, Homo sapiens
aagagctgggatcccacagcc

SEQ ID NO: 6507732 - DNA, 23 bp, Homo sapiens
tgcccctgctctgtagccacctc

SEQ ID NO: 6507733 - DNA, 16 bp, Homo sapiens
tgcccctgctgcctcc

SEQ ID NO: 6507734 - DNA, 19 bp, Homo sapiens
tgcccctgctgctgtcacc

SEQ ID NO: 6507735 - DNA, 17 bp, Homo sapiens
tgcccctggcccatctc

SEQ ID NO: 6507736 - DNA, 13 bp, Homo sapiens
tgcccctggccct

SEQ ID NO: 6507737 - DNA, 19 bp, Homo sapiens
tgcccctggccttgggatc

SEQ ID NO: 6507738 - DNA, 13 bp, Homo sapiens
tgcccctggctgg

SEQ ID NO: 6507739 - DNA, 13 bp, Homo sapiens
tgcccctggcttt

SEQ ID NO: 6507740 - DNA, 16 bp, Homo sapiens
tgcccctggctttgcc

SEQ ID NO: 6507741 - DNA, 21 bp, Homo sapiens
tgcccctgggaacacagtgcc

SEQ ID NO: 6507742 - DNA, 13 bp, Homo sapiens
tgcccctgtaaat

SEQ ID NO: 6507743 - DNA, 12 bp, Homo sapiens
tgcccctgtctg

SEQ ID NO: 6507744 - DNA, 13 bp, Homo sapiens
tgcccctgttcat

SEQ ID NO: 6507745 - DNA, 18 bp, Homo sapiens
tgcccctgttctcttcca

SEQ ID NO: 6507746 - DNA, 20 bp, Homo sapiens
tgccccttaaccccaaggac

SEQ ID NO: 6507747 - DNA, 22 bp, Homo sapiens
tgccccttaagggttgaaggca

SEQ ID NO: 6507748 - DNA, 14 bp, Homo sapiens
tgccccttcactca

SEQ ID NO: 6507749 - DNA, 22 bp, Homo sapiens
tgccccttcattgatttcctgt

SEQ ID NO: 6507750 - DNA, 18 bp, Homo sapiens
tgccccttccccatgctc

SEQ ID NO: 6507751 - DNA, 19 bp, Homo sapiens
tgccccttccgccactggg

SEQ ID NO: 6507752 - DNA, 21 bp, Homo sapiens
tgccccttccgccactggggc

SEQ ID NO: 6507753 - DNA, 23 bp, Homo sapiens
tgccccttccgccactggggctc

SEQ ID NO: 6507754 - DNA, 22 bp, Homo sapiens
tgccccttctaggggcaggtga

SEQ ID NO: 6507755 - DNA, 12 bp, Homo sapiens
tgccccttctcc

SEQ ID NO: 6507756 - DNA, 19 bp, Homo sapiens
tgccccttctccccttcct

SEQ ID NO: 6507757 - DNA, 19 bp, Homo sapiens
tgccccttctctttaatct

SEQ ID NO: 6507758 - DNA, 20 bp, Homo sapiens
tgccccttgaccccacacgc

SEQ ID NO: 6507759 - DNA, 21 bp, Homo sapiens
tgccccttgaccccacacgcc

SEQ ID NO: 6507760 - DNA, 13 bp, Homo sapiens
tgccccttgcaag

SEQ ID NO: 6507761 - DNA, 16 bp, Homo sapiens
tgccccttgcaagcca

SEQ ID NO: 6507762 - DNA, 20 bp, Homo sapiens
tgccccttggacacgctcag

SEQ ID NO: 6507763 - DNA, 17 bp, Homo sapiens
tgccccttgggcctccc

SEQ ID NO: 6507764 - DNA, 19 bp, Homo sapiens
tgccccttgggcctcccac

SEQ ID NO: 6507765 - DNA, 22 bp, Homo sapiens
tgccccttgggcctcccactcc

SEQ ID NO: 6507766 - DNA, 19 bp, Homo sapiens
tgccccttggggggcttga

SEQ ID NO: 6507767 - DNA, 19 bp, Homo sapiens
tgccccttgtcctgaagcc

SEQ ID NO: 6507768 - DNA, 11 bp, Homo sapiens
tgcccctttct

SEQ ID NO: 6507769 - DNA, 19 bp, Homo sapiens
tgcccgaaactaagccagg

SEQ ID NO: 6507770 - DNA, 20 bp, Homo sapiens
tgcccgagagagaccccacc

SEQ ID NO: 6507771 - DNA, 20 bp, Homo sapiens
tgcccgagagagctctggcc

SEQ ID NO: 6507772 - DNA, 21 bp, Homo sapiens
tgcccgagagagctctggccc

SEQ ID NO: 6507773 - DNA, 14 bp, Homo sapiens
tgcccgagctggtg

SEQ ID NO: 6507774 - DNA, 19 bp, Homo sapiens
tgcccgagctggtgcatta

SEQ ID NO: 6507775 - DNA, 19 bp, Homo sapiens
tgcccgagtctgtttttca

SEQ ID NO: 6507776 - DNA, 21 bp, Homo sapiens
tgcccgagtgcggcgtggaga

SEQ ID NO: 6507777 - DNA, 23 bp, Homo sapiens
tgcccgataccgggacacagaat

SEQ ID NO: 6507778 - DNA, 20 bp, Homo sapiens
tgcccgatccagattcccag

SEQ ID NO: 6507779 - DNA, 17 bp, Homo sapiens
tgcccgcacagcagcct

SEQ ID NO: 6507780 - DNA, 17 bp, Homo sapiens
tgcccgcaccctggcct

SEQ ID NO: 6507781 - DNA, 19 bp, Homo sapiens
tgcccgcaccctggcctgg

SEQ ID NO: 6507782 - DNA, 13 bp, Homo sapiens
tgcccgcagagcc

SEQ ID NO: 6507783 - DNA, 14 bp, Homo sapiens
tgcccgcagagccc

SEQ ID NO: 6507784 - DNA, 19 bp, Homo sapiens
tgcccgcagagcccacgcc

SEQ ID NO: 6507785 - DNA, 15 bp, Homo sapiens
tgcccgccagccagt

SEQ ID NO: 6507786 - DNA, 16 bp, Homo sapiens
tgcccgccagccagtg

SEQ ID NO: 6507787 - DNA, 15 bp, Homo sapiens
tgcccgccagcctca

SEQ ID NO: 6507788 - DNA, 18 bp, Homo sapiens
tgcccgccagcctcagtg

SEQ ID NO: 6507789 - DNA, 21 bp, Homo sapiens
tgcccgccagtgcacagggaa

SEQ ID NO: 6507790 - DNA, 18 bp, Homo sapiens
tgcccgccccaagccctg

SEQ ID NO: 6507791 - DNA, 15 bp, Homo sapiens
tgcccgccctccctc

SEQ ID NO: 6507792 - DNA, 23 bp, Homo sapiens
tgcccgccctgcccctgccccaa

SEQ ID NO: 6507793 - DNA, 18 bp, Homo sapiens
tgcccgcctaagaccctg

SEQ ID NO: 6507794 - DNA, 18 bp, Homo sapiens
tgcccgcctcggcctccc

SEQ ID NO: 6507795 - DNA, 12 bp, Homo sapiens
tgcccgcctgcc

SEQ ID NO: 6507796 - DNA, 17 bp, Homo sapiens
tgcccgcctgcccacct

SEQ ID NO: 6507797 - DNA, 15 bp, Homo sapiens
tgcccgcgccaggcc

SEQ ID NO: 6507798 - DNA, 20 bp, Homo sapiens
tgcccgcgccaggccctcag

SEQ ID NO: 6507799 - DNA, 21 bp, Homo sapiens
tgcccgcgcccgccgcctccc

SEQ ID NO: 6507800 - DNA, 16 bp, Homo sapiens
tgcccgcgctcaggag

SEQ ID NO: 6507801 - DNA, 19 bp, Homo sapiens
tgcccgctccatggaaaag

SEQ ID NO: 6507802 - DNA, 21 bp, Homo sapiens
tgcccgctcccaacccccctc

SEQ ID NO: 6507803 - DNA, 14 bp, Homo sapiens
tgcccgctcccaca

SEQ ID NO: 6507804 - DNA, 13 bp, Homo sapiens
tgcccgctcccag

SEQ ID NO: 6507805 - DNA, 15 bp, Homo sapiens
tgcccgctcccagtg

SEQ ID NO: 6507806 - DNA, 16 bp, Homo sapiens
tgcccgctcctcggga

SEQ ID NO: 6507807 - DNA, 19 bp, Homo sapiens
tgcccgctgcaatgcctag

SEQ ID NO: 6507808 - DNA, 16 bp, Homo sapiens
tgcccgctgcgctgcc

SEQ ID NO: 6507809 - DNA, 17 bp, Homo sapiens
tgcccgctgcgctgccc

SEQ ID NO: 6507810 - DNA, 13 bp, Homo sapiens
tgcccgctgtccc

SEQ ID NO: 6507811 - DNA, 15 bp, Homo sapiens
tgcccgctgtcccag

SEQ ID NO: 6507812 - DNA, 17 bp, Homo sapiens
tgcccgctgtcccaggg

SEQ ID NO: 6507813 - DNA, 18 bp, Homo sapiens
tgcccgctgtcccagggg

SEQ ID NO: 6507814 - DNA, 19 bp, Homo sapiens
tgcccgctgtcccaggggt

SEQ ID NO: 6507815 - DNA, 21 bp, Homo sapiens
tgcccggagattggacggcct

SEQ ID NO: 6507816 - DNA, 17 bp, Homo sapiens
tgcccggaggccgggcc

SEQ ID NO: 6507817 - DNA, 15 bp, Homo sapiens
tgcccggattctggg

SEQ ID NO: 6507818 - DNA, 14 bp, Homo sapiens
tgcccggcccagga

SEQ ID NO: 6507819 - DNA, 15 bp, Homo sapiens
tgcccggcccaggag

SEQ ID NO: 6507820 - DNA, 18 bp, Homo sapiens
tgcccggcccaggagcgc

SEQ ID NO: 6507821 - DNA, 21 bp, Homo sapiens
tgcccggcccaggagcgcagc

SEQ ID NO: 6507822 - DNA, 16 bp, Homo sapiens
tgcccggcgccctctg

SEQ ID NO: 6507823 - DNA, 18 bp, Homo sapiens
tgcccggcgccctctgtc

SEQ ID NO: 6507824 - DNA, 19 bp, Homo sapiens
tgcccggcgcctgccctgc

SEQ ID NO: 6507825 - DNA, 24 bp, Homo sapiens
tgcccggcgcctgccctgcccaag

SEQ ID NO: 6507826 - DNA, 17 bp, Homo sapiens
tgcccgggagctcagga

SEQ ID NO: 6507827 - DNA, 20 bp, Homo sapiens
tgcccgggcgcggccagccc

SEQ ID NO: 6507828 - DNA, 22 bp, Homo sapiens
tgcccggggcagcagcagccct

SEQ ID NO: 6507829 - DNA, 23 bp, Homo sapiens
tgcccggggcagctgccagagaa

SEQ ID NO: 6507830 - DNA, 19 bp, Homo sapiens
tgcccgggggacgcctgcc

SEQ ID NO: 6507831 - DNA, 14 bp, Homo sapiens
tgcccggtcccacc

SEQ ID NO: 6507832 - DNA, 21 bp, Homo sapiens
tgcccggtgcagggcctggca

SEQ ID NO: 6507833 - DNA, 23 bp, Homo sapiens
tgcccggtgcagggcctggcata

SEQ ID NO: 6507834 - DNA, 18 bp, Homo sapiens
tgcccggtgccatcttcc

SEQ ID NO: 6507835 - DNA, 20 bp, Homo sapiens
tgcccggtgccatcttccat

SEQ ID NO: 6507836 - DNA, 20 bp, Homo sapiens
tgcccggtggtttgccatgt

SEQ ID NO: 6507837 - DNA, 17 bp, Homo sapiens
tgcccgtaatcccagct

SEQ ID NO: 6507838 - DNA, 14 bp, Homo sapiens
tgcccgtcggccct

SEQ ID NO: 6507839 - DNA, 17 bp, Homo sapiens
tgcccgtcggccctgcg

SEQ ID NO: 6507840 - DNA, 18 bp, Homo sapiens
tgcccgtcggccctgcgt

SEQ ID NO: 6507841 - DNA, 21 bp, Homo sapiens
tgcccgtctctctcccatgga

SEQ ID NO: 6507842 - DNA, 16 bp, Homo sapiens
tgcccgtcttcagcct

SEQ ID NO: 6507843 - DNA, 19 bp, Homo sapiens
tgcccgtcttcagcctagc

SEQ ID NO: 6507844 - DNA, 17 bp, Homo sapiens
tgcccgtgcccgcagga

SEQ ID NO: 6507845 - DNA, 14 bp, Homo sapiens
tgcccgtgtacata

SEQ ID NO: 6507846 - DNA, 23 bp, Homo sapiens
tgcccgtgtcggttcttcctgga

SEQ ID NO: 6507847 - DNA, 19 bp, Homo sapiens
tgcccgtgtggcctgggtc

SEQ ID NO: 6507848 - DNA, 22 bp, Homo sapiens
tgcccgtgtggcctgggtcctc

SEQ ID NO: 6507849 - DNA, 23 bp, Homo sapiens
tgcccgtgtgtgtgtatgtgtgt

SEQ ID NO: 6507850 - DNA, 14 bp, Homo sapiens
tgcccgttcttgaa

SEQ ID NO: 6507851 - DNA, 17 bp, Homo sapiens
tgcccgttcttgaaatg

SEQ ID NO: 6507852 - DNA, 15 bp, Homo sapiens
tgcccgttgccgggc

SEQ ID NO: 6507853 - DNA, 21 bp, Homo sapiens
tgcccgttgccgggcctggac

SEQ ID NO: 6507854 - DNA, 19 bp, Homo sapiens
tgccctaaagtgtattttt

SEQ ID NO: 6507855 - DNA, 17 bp, Homo sapiens
tgccctaacctgacaga

SEQ ID NO: 6507856 - DNA, 19 bp, Homo sapiens
tgccctaagagtgtcactg

SEQ ID NO: 6507857 - DNA, 15 bp, Homo sapiens
tgccctaagccccca

SEQ ID NO: 6507858 - DNA, 17 bp, Homo sapiens
tgccctaagcccccagg

SEQ ID NO: 6507859 - DNA, 12 bp, Homo sapiens
tgccctaagtga

SEQ ID NO: 6507860 - DNA, 16 bp, Homo sapiens
tgccctaatgtctgta

SEQ ID NO: 6507861 - DNA, 13 bp, Homo sapiens
tgccctaattaaa

SEQ ID NO: 6507862 - DNA, 20 bp, Homo sapiens
tgccctacctgcctgttctc

SEQ ID NO: 6507863 - DNA, 17 bp, Homo sapiens
tgccctactgggagact

SEQ ID NO: 6507864 - DNA, 23 bp, Homo sapiens
tgccctagagcacactgtagcat

SEQ ID NO: 6507865 - DNA, 21 bp, Homo sapiens
tgccctagcagtttgcctctg

SEQ ID NO: 6507866 - DNA, 23 bp, Homo sapiens
tgccctagcagtttgcctctgca

SEQ ID NO: 6507867 - DNA, 20 bp, Homo sapiens
tgccctagcccagactctga

SEQ ID NO: 6507868 - DNA, 23 bp, Homo sapiens
tgccctagcccagactctgagct

SEQ ID NO: 6507869 - DNA, 14 bp, Homo sapiens
tgccctagcgctct

SEQ ID NO: 6507870 - DNA, 14 bp, Homo sapiens
tgccctaggctccg

SEQ ID NO: 6507871 - DNA, 15 bp, Homo sapiens
tgccctatgctgtgc

SEQ ID NO: 6507872 - DNA, 14 bp, Homo sapiens
tgccctcaagcaat

SEQ ID NO: 6507873 - DNA, 14 bp, Homo sapiens
tgccctcaccacca

SEQ ID NO: 6507874 - DNA, 12 bp, Homo sapiens
tgccctcactcc

SEQ ID NO: 6507875 - DNA, 20 bp, Homo sapiens
tgccctcactccactcccct

SEQ ID NO: 6507876 - DNA, 17 bp, Homo sapiens
tgccctcactccctctg

SEQ ID NO: 6507877 - DNA, 21 bp, Homo sapiens
tgccctcactccctctgcaga

SEQ ID NO: 6507878 - DNA, 22 bp, Homo sapiens
tgccctcactgcctctttgcag

SEQ ID NO: 6507879 - DNA, 21 bp, Homo sapiens
tgccctcaggctccccagtgc

SEQ ID NO: 6507880 - DNA, 17 bp, Homo sapiens
tgccctcatggcccctc

SEQ ID NO: 6507881 - DNA, 14 bp, Homo sapiens
tgccctccaaagag

SEQ ID NO: 6507882 - DNA, 21 bp, Homo sapiens
tgccctccacagccgcagcct

SEQ ID NO: 6507883 - DNA, 19 bp, Homo sapiens
tgccctccactccactgcc

SEQ ID NO: 6507884 - DNA, 18 bp, Homo sapiens
tgccctccagctctttcc

SEQ ID NO: 6507885 - DNA, 21 bp, Homo sapiens
tgccctccagctctttcctcc

SEQ ID NO: 6507886 - DNA, 13 bp, Homo sapiens
tgccctccaggcc

SEQ ID NO: 6507887 - DNA, 13 bp, Homo sapiens
tgccctccagggc

SEQ ID NO: 6507888 - DNA, 14 bp, Homo sapiens
tgccctccagggcc

SEQ ID NO: 6507889 - DNA, 19 bp, Homo sapiens
tgccctccagggccaggat

SEQ ID NO: 6507890 - DNA, 13 bp, Homo sapiens
tgccctccatccc

SEQ ID NO: 6507891 - DNA, 20 bp, Homo sapiens
tgccctccatcccgacatgg

SEQ ID NO: 6507892 - DNA, 20 bp, Homo sapiens
tgccctcccacagcctcctt

SEQ ID NO: 6507893 - DNA, 13 bp, Homo sapiens
tgccctcccaccc

SEQ ID NO: 6507894 - DNA, 21 bp, Homo sapiens
tgccctcccaccccctccccg

SEQ ID NO: 6507895 - DNA, 15 bp, Homo sapiens
tgccctcccatcccg

SEQ ID NO: 6507896 - DNA, 19 bp, Homo sapiens
tgccctccccagagcactg

SEQ ID NO: 6507897 - DNA, 17 bp, Homo sapiens
tgccctcccccacggcc

SEQ ID NO: 6507898 - DNA, 17 bp, Homo sapiens
tgccctcccctcagcgc

SEQ ID NO: 6507899 - DNA, 19 bp, Homo sapiens
tgccctcccctcagcgcag

SEQ ID NO: 6507900 - DNA, 20 bp, Homo sapiens
tgccctcccctcagcgcagg

SEQ ID NO: 6507901 - DNA, 21 bp, Homo sapiens
tgccctcccctctctgcaccg

SEQ ID NO: 6507902 - DNA, 14 bp, Homo sapiens
tgccctcccctgct

SEQ ID NO: 6507903 - DNA, 15 bp, Homo sapiens
tgccctcccctgctc

SEQ ID NO: 6507904 - DNA, 16 bp, Homo sapiens
tgccctcccctgctcc

SEQ ID NO: 6507905 - DNA, 15 bp, Homo sapiens
tgccctccctccttc

SEQ ID NO: 6507906 - DNA, 16 bp, Homo sapiens
tgccctccctctctgc

SEQ ID NO: 6507907 - DNA, 16 bp, Homo sapiens
tgccctccctgctgcc

SEQ ID NO: 6507908 - DNA, 19 bp, Homo sapiens
tgccctccctgctgccagg

SEQ ID NO: 6507909 - DNA, 17 bp, Homo sapiens
aagagctgtctgactgc

SEQ ID NO: 6507910 - DNA, 19 bp, Homo sapiens
aagagctgtcttcccctga

SEQ ID NO: 6507911 - DNA, 23 bp, Homo sapiens
aagagctgttttggatgaatgca

SEQ ID NO: 6507912 - DNA, 16 bp, Homo sapiens
aagagcttaacagtgt

SEQ ID NO: 6507913 - DNA, 17 bp, Homo sapiens
aagagcttataaaattt

SEQ ID NO: 6507914 - DNA, 18 bp, Homo sapiens
aagagcttccagagctct

SEQ ID NO: 6507915 - DNA, 22 bp, Homo sapiens
aagagcttcccctaacctgggt

SEQ ID NO: 6507916 - DNA, 17 bp, Homo sapiens
aagagcttgctccagat

SEQ ID NO: 6507917 - DNA, 20 bp, Homo sapiens
aagagcttgctccagattct

SEQ ID NO: 6507918 - DNA, 14 bp, Homo sapiens
aagagcttgctttg

SEQ ID NO: 6507919 - DNA, 14 bp, Homo sapiens
aagagctttatata

SEQ ID NO: 6507920 - DNA, 15 bp, Homo sapiens
aagagctttgtttca

SEQ ID NO: 6507921 - DNA, 18 bp, Homo sapiens
aagaggaaaaacagggaa

SEQ ID NO: 6507922 - DNA, 23 bp, Homo sapiens
aagaggaaaaccctcaagggcat

SEQ ID NO: 6507923 - DNA, 11 bp, Homo sapiens
aagaggaaaat

SEQ ID NO: 6507924 - DNA, 19 bp, Homo sapiens
aagaggaaaatattgacaa

SEQ ID NO: 6507925 - DNA, 14 bp, Homo sapiens
aagaggaaagaatg

SEQ ID NO: 6507926 - DNA, 18 bp, Homo sapiens
aagaggaaattaaataat

SEQ ID NO: 6507927 - DNA, 20 bp, Homo sapiens
aagaggaacagcactgggga

SEQ ID NO: 6507928 - DNA, 13 bp, Homo sapiens
aagaggaacagtg

SEQ ID NO: 6507929 - DNA, 13 bp, Homo sapiens
aagaggaagcaaa

SEQ ID NO: 6507930 - DNA, 16 bp, Homo sapiens
aagaggaagccttgcc

SEQ ID NO: 6507931 - DNA, 24 bp, Homo sapiens
aagaggaatctgtttctctgctgt

SEQ ID NO: 6507932 - DNA, 19 bp, Homo sapiens
aagaggaattacgtgctct

SEQ ID NO: 6507933 - DNA, 21 bp, Homo sapiens
aagaggaatttataacaaata

SEQ ID NO: 6507934 - DNA, 15 bp, Homo sapiens
aagaggacacaatgg

SEQ ID NO: 6507935 - DNA, 22 bp, Homo sapiens
aagaggacactagatgatatta

SEQ ID NO: 6507936 - DNA, 17 bp, Homo sapiens
aagaggaccagaggagc

SEQ ID NO: 6507937 - DNA, 13 bp, Homo sapiens
aagaggagaagga

SEQ ID NO: 6507938 - DNA, 14 bp, Homo sapiens
aagaggagaaggag

SEQ ID NO: 6507939 - DNA, 15 bp, Homo sapiens
aagaggagaccctgg

SEQ ID NO: 6507940 - DNA, 22 bp, Homo sapiens
aagaggagagaggaagctctct

SEQ ID NO: 6507941 - DNA, 15 bp, Homo sapiens
aagaggagatgacta

SEQ ID NO: 6507942 - DNA, 22 bp, Homo sapiens
aagaggagatgtgatcaggccc

SEQ ID NO: 6507943 - DNA, 20 bp, Homo sapiens
aagaggagcagagggcaggg

SEQ ID NO: 6507944 - DNA, 14 bp, Homo sapiens
aagaggagcaggaa

SEQ ID NO: 6507945 - DNA, 23 bp, Homo sapiens
aagaggagcccccaccctgttcc

SEQ ID NO: 6507946 - DNA, 11 bp, Homo sapiens
aagaggagcct

SEQ ID NO: 6507947 - DNA, 19 bp, Homo sapiens
aagaggaggacccctgcct

SEQ ID NO: 6507948 - DNA, 21 bp, Homo sapiens
aagaggaggggaagaggcctg

SEQ ID NO: 6507949 - DNA, 22 bp, Homo sapiens
aagaggagtaggccctggttcc

SEQ ID NO: 6507950 - DNA, 22 bp, Homo sapiens
aagaggagttctaacacatttc

SEQ ID NO: 6507951 - DNA, 21 bp, Homo sapiens
aagaggatgaaggaaggggct

SEQ ID NO: 6507952 - DNA, 17 bp, Homo sapiens
aagaggatgctgtgaaa

SEQ ID NO: 6507953 - DNA, 17 bp, Homo sapiens
aagaggcaagagacaga

SEQ ID NO: 6507954 - DNA, 16 bp, Homo sapiens
aagaggcagaaaattg

SEQ ID NO: 6507955 - DNA, 11 bp, Homo sapiens
aagaggcaggg

SEQ ID NO: 6507956 - DNA, 19 bp, Homo sapiens
aagaggcaggttagaagaa

SEQ ID NO: 6507957 - DNA, 16 bp, Homo sapiens
aagaggcatcttttct

SEQ ID NO: 6507958 - DNA, 15 bp, Homo sapiens
aagaggccaatgccc

SEQ ID NO: 6507959 - DNA, 21 bp, Homo sapiens
aagaggccagcgtgaaggacc

SEQ ID NO: 6507960 - DNA, 16 bp, Homo sapiens
aagaggccattgtaaa

SEQ ID NO: 6507961 - DNA, 17 bp, Homo sapiens
aagaggcccactagagg

SEQ ID NO: 6507962 - DNA, 16 bp, Homo sapiens
aagaggcccagccctc

SEQ ID NO: 6507963 - DNA, 12 bp, Homo sapiens
aagaggcccagg

SEQ ID NO: 6507964 - DNA, 18 bp, Homo sapiens
aagaggcccagggagcaa

SEQ ID NO: 6507965 - DNA, 17 bp, Homo sapiens
aagaggcccgccctgcc

SEQ ID NO: 6507966 - DNA, 21 bp, Homo sapiens
aagaggcccgccctgcccggg

SEQ ID NO: 6507967 - DNA, 17 bp, Homo sapiens
aagaggccgctgcaggg

SEQ ID NO: 6507968 - DNA, 22 bp, Homo sapiens
aagaggcctcatgcctgctgag

SEQ ID NO: 6507969 - DNA, 14 bp, Homo sapiens
aagaggcgggccag

SEQ ID NO: 6507970 - DNA, 18 bp, Homo sapiens
aagaggcgggccagccag

SEQ ID NO: 6507971 - DNA, 19 bp, Homo sapiens
aagaggcgtctgtatattt

SEQ ID NO: 6507972 - DNA, 20 bp, Homo sapiens
aagaggcgtgtgcaggccga

SEQ ID NO: 6507973 - DNA, 17 bp, Homo sapiens
aagaggctagccccagg

SEQ ID NO: 6507974 - DNA, 13 bp, Homo sapiens
aagaggctgactt

SEQ ID NO: 6507975 - DNA, 20 bp, Homo sapiens
aagaggctgaggcctggact

SEQ ID NO: 6507976 - DNA, 16 bp, Homo sapiens
aagaggctgccctcct

SEQ ID NO: 6507977 - DNA, 17 bp, Homo sapiens
aagaggctgccctcctg

SEQ ID NO: 6507978 - DNA, 14 bp, Homo sapiens
aagaggctgtgtgg

SEQ ID NO: 6507979 - DNA, 16 bp, Homo sapiens
aagagggaactaagca

SEQ ID NO: 6507980 - DNA, 16 bp, Homo sapiens
aagagggaatggtcaa

SEQ ID NO: 6507981 - DNA, 17 bp, Homo sapiens
aagagggacagagcccg

SEQ ID NO: 6507982 - DNA, 22 bp, Homo sapiens
aagagggaccagggtgggagag

SEQ ID NO: 6507983 - DNA, 17 bp, Homo sapiens
aagagggagaaggagag

SEQ ID NO: 6507984 - DNA, 18 bp, Homo sapiens
aagagggagaaggagagg

SEQ ID NO: 6507985 - DNA, 16 bp, Homo sapiens
aagagggagaccaaat

SEQ ID NO: 6507986 - DNA, 23 bp, Homo sapiens
aagagggagcaggtgcccccagg

SEQ ID NO: 6507987 - DNA, 17 bp, Homo sapiens
aagagggaggcttcctg

SEQ ID NO: 6507988 - DNA, 21 bp, Homo sapiens
aagagggaggggacagaggcc

SEQ ID NO: 6507989 - DNA, 14 bp, Homo sapiens
aagagggcaaagct

SEQ ID NO: 6507990 - DNA, 16 bp, Homo sapiens
aagagggcaagcctct

SEQ ID NO: 6507991 - DNA, 16 bp, Homo sapiens
aagagggcacaccgcc

SEQ ID NO: 6507992 - DNA, 19 bp, Homo sapiens
aagagggcccaaagaattg

SEQ ID NO: 6507993 - DNA, 14 bp, Homo sapiens
aagagggcccagcc

SEQ ID NO: 6507994 - DNA, 15 bp, Homo sapiens
aagagggcccagccc

SEQ ID NO: 6507995 - DNA, 21 bp, Homo sapiens
aagagggcccagcccagagcc

SEQ ID NO: 6507996 - DNA, 23 bp, Homo sapiens
aagagggcccagcccagagccac

SEQ ID NO: 6507997 - DNA, 19 bp, Homo sapiens
aagaggggaccagaagcca

SEQ ID NO: 6507998 - DNA, 19 bp, Homo sapiens
aagaggggaggggcctagg

SEQ ID NO: 6507999 - DNA, 21 bp, Homo sapiens
aagaggggaggggcctaggga

SEQ ID NO: 6508000 - DNA, 15 bp, Homo sapiens
aagaggggcagccct

SEQ ID NO: 6508001 - DNA, 18 bp, Homo sapiens
aagaggggcctgatgaga

SEQ ID NO: 6508002 - DNA, 13 bp, Homo sapiens
aagaggggcgctg

SEQ ID NO: 6508003 - DNA, 19 bp, Homo sapiens
aagaggggcgctgccccca

SEQ ID NO: 6508004 - DNA, 22 bp, Homo sapiens
aagaggggcgctgcccccacag

SEQ ID NO: 6508005 - DNA, 18 bp, Homo sapiens
aagaggggcgctgtcctg

SEQ ID NO: 6508006 - DNA, 23 bp, Homo sapiens
aagaggggcgggctcagagcttt

SEQ ID NO: 6508007 - DNA, 13 bp, Homo sapiens
aagaggggctggg

SEQ ID NO: 6508008 - DNA, 15 bp, Homo sapiens
aagaggggctgggct

SEQ ID NO: 6508009 - DNA, 16 bp, Homo sapiens
aagaggggctggggca

SEQ ID NO: 6508010 - DNA, 23 bp, Homo sapiens
aagagggggacctgccaccaggg

SEQ ID NO: 6508011 - DNA, 17 bp, Homo sapiens
aagagggggctggccat

SEQ ID NO: 6508012 - DNA, 13 bp, Homo sapiens
aagagggggtgga

SEQ ID NO: 6508013 - DNA, 13 bp, Homo sapiens
aagaggggtcacc

SEQ ID NO: 6508014 - DNA, 16 bp, Homo sapiens
aagaggggtcaccagg

SEQ ID NO: 6508015 - DNA, 21 bp, Homo sapiens
aagaggggtgcagaggctgtg

SEQ ID NO: 6508016 - DNA, 22 bp, Homo sapiens
aagaggggtgcagaggctgtgg

SEQ ID NO: 6508017 - DNA, 19 bp, Homo sapiens
aagagggtcccagggctgc

SEQ ID NO: 6508018 - DNA, 21 bp, Homo sapiens
aagagggtgagggccttctta

SEQ ID NO: 6508019 - DNA, 21 bp, Homo sapiens
aagagggttcacacagcccag

SEQ ID NO: 6508020 - DNA, 22 bp, Homo sapiens
aagagggttttaggtagaaaaa

SEQ ID NO: 6508021 - DNA, 20 bp, Homo sapiens
aagaggtacagggtttttac

SEQ ID NO: 6508022 - DNA, 21 bp, Homo sapiens
aagaggtaccaaaaaagaaag

SEQ ID NO: 6508023 - DNA, 19 bp, Homo sapiens
aagaggtagaaaagattgg

SEQ ID NO: 6508024 - DNA, 15 bp, Homo sapiens
aagaggtataaagct

SEQ ID NO: 6508025 - DNA, 16 bp, Homo sapiens
aagaggtattggattt

SEQ ID NO: 6508026 - DNA, 19 bp, Homo sapiens
aagaggtctccccatcccc

SEQ ID NO: 6508027 - DNA, 18 bp, Homo sapiens
aagaggtctgattggctg

SEQ ID NO: 6508028 - DNA, 22 bp, Homo sapiens
aagaggtgaccccagggcacag

SEQ ID NO: 6508029 - DNA, 24 bp, Homo sapiens
aagaggtgaccccagggcacagga

SEQ ID NO: 6508030 - DNA, 16 bp, Homo sapiens
aagaggtgactgggcc

SEQ ID NO: 6508031 - DNA, 17 bp, Homo sapiens
aagaggtgcctgggagg

SEQ ID NO: 6508032 - DNA, 18 bp, Homo sapiens
aagaggtgctagctctta

SEQ ID NO: 6508033 - DNA, 15 bp, Homo sapiens
aagaggtgggagggc

SEQ ID NO: 6508034 - DNA, 12 bp, Homo sapiens
aagaggtgggga

SEQ ID NO: 6508035 - DNA, 19 bp, Homo sapiens
aagaggtggggtgaagctg

SEQ ID NO: 6508036 - DNA, 13 bp, Homo sapiens
aagaggtgttatt

SEQ ID NO: 6508037 - DNA, 17 bp, Homo sapiens
aagaggtgttatttgga

SEQ ID NO: 6508038 - DNA, 17 bp, Homo sapiens
aagaggtgttttttcta

SEQ ID NO: 6508039 - DNA, 14 bp, Homo sapiens
aagaggttacttta

SEQ ID NO: 6508040 - DNA, 14 bp, Homo sapiens
aagaggttctaact

SEQ ID NO: 6508041 - DNA, 14 bp, Homo sapiens
aagaggttctcagc

SEQ ID NO: 6508042 - DNA, 15 bp, Homo sapiens
aagaggttctcagca

SEQ ID NO: 6508043 - DNA, 19 bp, Homo sapiens
aagaggttctcgactggag

SEQ ID NO: 6508044 - DNA, 14 bp, Homo sapiens
aagaggttttaaag

SEQ ID NO: 6508045 - DNA, 16 bp, Homo sapiens
aagaggtttttcttaa

SEQ ID NO: 6508046 - DNA, 12 bp, Homo sapiens
aagagtaaaaat

SEQ ID NO: 6508047 - DNA, 14 bp, Homo sapiens
aagagtaaaaccaa

SEQ ID NO: 6508048 - DNA, 16 bp, Homo sapiens
aagagtaaatatactt

SEQ ID NO: 6508049 - DNA, 17 bp, Homo sapiens
aagagtaacagtcatca

SEQ ID NO: 6508050 - DNA, 13 bp, Homo sapiens
aagagtaacttta

SEQ ID NO: 6508051 - DNA, 23 bp, Homo sapiens
aagagtaactttactctgtgttt

SEQ ID NO: 6508052 - DNA, 13 bp, Homo sapiens
aagagtaatcaat

SEQ ID NO: 6508053 - DNA, 22 bp, Homo sapiens
aagagtacaagctcttgtttct

SEQ ID NO: 6508054 - DNA, 23 bp, Homo sapiens
aagagtacaagctcttgtttctg

SEQ ID NO: 6508055 - DNA, 13 bp, Homo sapiens
aagagtacactca

SEQ ID NO: 6508056 - DNA, 13 bp, Homo sapiens
aagagtagacatt

SEQ ID NO: 6508057 - DNA, 21 bp, Homo sapiens
aagagtagcaagttctagaga

SEQ ID NO: 6508058 - DNA, 23 bp, Homo sapiens
aagagtagcaagttctagagaag

SEQ ID NO: 6508059 - DNA, 16 bp, Homo sapiens
aagagtagtaatagag

SEQ ID NO: 6508060 - DNA, 16 bp, Homo sapiens
aagagtatactttgta

SEQ ID NO: 6508061 - DNA, 17 bp, Homo sapiens
aagagtatcaaaggcag

SEQ ID NO: 6508062 - DNA, 19 bp, Homo sapiens
aagagtatcaaaggcagaa

SEQ ID NO: 6508063 - DNA, 16 bp, Homo sapiens
aagagtatgagaaata

SEQ ID NO: 6508064 - DNA, 21 bp, Homo sapiens
aagagtatgagaaatacagtg

SEQ ID NO: 6508065 - DNA, 23 bp, Homo sapiens
aagagtatgagaaatacagtgct

SEQ ID NO: 6508066 - DNA, 15 bp, Homo sapiens
aagagtcaaagtagt

SEQ ID NO: 6508067 - DNA, 13 bp, Homo sapiens
aagagtcagccct

SEQ ID NO: 6508068 - DNA, 22 bp, Homo sapiens
aagagtcattttcacttttaaa

SEQ ID NO: 6508069 - DNA, 13 bp, Homo sapiens
aagagtccaggaa

SEQ ID NO: 6508070 - DNA, 20 bp, Homo sapiens
aagagtccaggtaaatggta

SEQ ID NO: 6508071 - DNA, 21 bp, Homo sapiens
aagagtccccagactctgcct

SEQ ID NO: 6508072 - DNA, 16 bp, Homo sapiens
aagagtccctttgaag

SEQ ID NO: 6508073 - DNA, 15 bp, Homo sapiens
aagagtcgctgtgcc

SEQ ID NO: 6508074 - DNA, 22 bp, Homo sapiens
aagagtctaaaccccagattct

SEQ ID NO: 6508075 - DNA, 14 bp, Homo sapiens
aagagtctagattc

SEQ ID NO: 6508076 - DNA, 16 bp, Homo sapiens
aagagtctattgtctc

SEQ ID NO: 6508077 - DNA, 13 bp, Homo sapiens
aagagtctccagt

SEQ ID NO: 6508078 - DNA, 19 bp, Homo sapiens
aagagtctccttctcttct

SEQ ID NO: 6508079 - DNA, 21 bp, Homo sapiens
aagagtctctggctcagctgt

SEQ ID NO: 6508080 - DNA, 13 bp, Homo sapiens
aagagtctttctt

SEQ ID NO: 6508081 - DNA, 15 bp, Homo sapiens
aagagtgaaaaatga

SEQ ID NO: 6508082 - DNA, 21 bp, Homo sapiens
aagagtgaaatattgtaaatg

SEQ ID NO: 6508083 - DNA, 14 bp, Homo sapiens
aagagtgaagagca

SEQ ID NO: 6508084 - DNA, 15 bp, Homo sapiens
aagagtgaagagcat

SEQ ID NO: 6508085 - DNA, 16 bp, Homo sapiens
aagagtgaagagcatt

SEQ ID NO: 6508086 - DNA, 20 bp, Homo sapiens
aagagtgaagagcatttggt

SEQ ID NO: 6508087 - DNA, 15 bp, Homo sapiens
tgccctccctggcct

SEQ ID NO: 6508088 - DNA, 16 bp, Homo sapiens
tgccctccctggggtc

SEQ ID NO: 6508089 - DNA, 20 bp, Homo sapiens
tgccctccctggggtccttg

SEQ ID NO: 6508090 - DNA, 19 bp, Homo sapiens
tgccctcccttctccctgg

SEQ ID NO: 6508091 - DNA, 20 bp, Homo sapiens
tgccctcccttctccctgga

SEQ ID NO: 6508092 - DNA, 17 bp, Homo sapiens
tgccctccgcccttccc

SEQ ID NO: 6508093 - DNA, 18 bp, Homo sapiens
tgccctccgcccttccct

SEQ ID NO: 6508094 - DNA, 17 bp, Homo sapiens
tgccctccgcctgggat

SEQ ID NO: 6508095 - DNA, 18 bp, Homo sapiens
tgccctccgcctgggatc

SEQ ID NO: 6508096 - DNA, 14 bp, Homo sapiens
tgccctccggagga

SEQ ID NO: 6508097 - DNA, 17 bp, Homo sapiens
tgccctccgtcctggca

SEQ ID NO: 6508098 - DNA, 18 bp, Homo sapiens
tgccctccgtcctggcag

SEQ ID NO: 6508099 - DNA, 11 bp, Homo sapiens
tgccctcctct

SEQ ID NO: 6508100 - DNA, 15 bp, Homo sapiens
tgccctcctctccca

SEQ ID NO: 6508101 - DNA, 15 bp, Homo sapiens
tgccctcctctcccc

SEQ ID NO: 6508102 - DNA, 18 bp, Homo sapiens
tgccctcctgcccgccct

SEQ ID NO: 6508103 - DNA, 12 bp, Homo sapiens
tgccctcctgga

SEQ ID NO: 6508104 - DNA, 14 bp, Homo sapiens
tgccctccttccca

SEQ ID NO: 6508105 - DNA, 22 bp, Homo sapiens
tgccctccttcccaatcttctt

SEQ ID NO: 6508106 - DNA, 15 bp, Homo sapiens
tgccctcgcctcctc

SEQ ID NO: 6508107 - DNA, 21 bp, Homo sapiens
tgccctcgcctcctcctcctg

SEQ ID NO: 6508108 - DNA, 22 bp, Homo sapiens
tgccctcgggcgagtcactgcc

SEQ ID NO: 6508109 - DNA, 20 bp, Homo sapiens
tgccctcgggtggggctggt

SEQ ID NO: 6508110 - DNA, 23 bp, Homo sapiens
tgccctcgggtggggctggtggg

SEQ ID NO: 6508111 - DNA, 20 bp, Homo sapiens
tgccctcggtcactgagtct

SEQ ID NO: 6508112 - DNA, 19 bp, Homo sapiens
tgccctcgtctccctggcc

SEQ ID NO: 6508113 - DNA, 17 bp, Homo sapiens
tgccctcgtggccagcc

SEQ ID NO: 6508114 - DNA, 19 bp, Homo sapiens
tgccctcgtggccagcccg

SEQ ID NO: 6508115 - DNA, 15 bp, Homo sapiens
tgccctctccacacc

SEQ ID NO: 6508116 - DNA, 17 bp, Homo sapiens
tgccctctccacaccca

SEQ ID NO: 6508117 - DNA, 22 bp, Homo sapiens
tgccctctccacacccatgact

SEQ ID NO: 6508118 - DNA, 24 bp, Homo sapiens
tgccctctccacacccatgactgc

SEQ ID NO: 6508119 - DNA, 21 bp, Homo sapiens
tgccctctccttccttaccca

SEQ ID NO: 6508120 - DNA, 20 bp, Homo sapiens
tgccctctctgagtctggac

SEQ ID NO: 6508121 - DNA, 13 bp, Homo sapiens
tgccctctctgcg

SEQ ID NO: 6508122 - DNA, 23 bp, Homo sapiens
tgccctctctgcgctgaggccca

SEQ ID NO: 6508123 - DNA, 20 bp, Homo sapiens
tgccctctgcatcctctgga

SEQ ID NO: 6508124 - DNA, 14 bp, Homo sapiens
tgccctctgccact

SEQ ID NO: 6508125 - DNA, 12 bp, Homo sapiens
tgccctctgccc

SEQ ID NO: 6508126 - DNA, 17 bp, Homo sapiens
tgccctctgccccatca

SEQ ID NO: 6508127 - DNA, 15 bp, Homo sapiens
tgccctctgctctgc

SEQ ID NO: 6508128 - DNA, 12 bp, Homo sapiens
tgccctctgctg

SEQ ID NO: 6508129 - DNA, 18 bp, Homo sapiens
tgccctctggacagcttg

SEQ ID NO: 6508130 - DNA, 15 bp, Homo sapiens
tgccctctggatcct

SEQ ID NO: 6508131 - DNA, 19 bp, Homo sapiens
tgccctctggatcctgctg

SEQ ID NO: 6508132 - DNA, 14 bp, Homo sapiens
tgccctctgggctc

SEQ ID NO: 6508133 - DNA, 16 bp, Homo sapiens
tgccctctgggctctg

SEQ ID NO: 6508134 - DNA, 18 bp, Homo sapiens
tgccctctgggctctgag

SEQ ID NO: 6508135 - DNA, 17 bp, Homo sapiens
tgccctctggggccact

SEQ ID NO: 6508136 - DNA, 21 bp, Homo sapiens
tgccctgaaactactgtatct

SEQ ID NO: 6508137 - DNA, 19 bp, Homo sapiens
tgccctgaccatgcatttt

SEQ ID NO: 6508138 - DNA, 16 bp, Homo sapiens
tgccctgacccctgca

SEQ ID NO: 6508139 - DNA, 15 bp, Homo sapiens
tgccctgacccttcc

SEQ ID NO: 6508140 - DNA, 12 bp, Homo sapiens
tgccctgacctc

SEQ ID NO: 6508141 - DNA, 22 bp, Homo sapiens
tgccctgacctcccagccctat

SEQ ID NO: 6508142 - DNA, 20 bp, Homo sapiens
tgccctgagaagctgctcca

SEQ ID NO: 6508143 - DNA, 19 bp, Homo sapiens
tgccctgagcactcctggt

SEQ ID NO: 6508144 - DNA, 21 bp, Homo sapiens
tgccctgagcactcctggtgc

SEQ ID NO: 6508145 - DNA, 16 bp, Homo sapiens
tgccctgagccctcca

SEQ ID NO: 6508146 - DNA, 15 bp, Homo sapiens
tgccctgatcccaga

SEQ ID NO: 6508147 - DNA, 23 bp, Homo sapiens
tgccctgatgcgtctacccagac

SEQ ID NO: 6508148 - DNA, 12 bp, Homo sapiens
tgccctgcacct

SEQ ID NO: 6508149 - DNA, 22 bp, Homo sapiens
tgccctgcacgtatacacccag

SEQ ID NO: 6508150 - DNA, 23 bp, Homo sapiens
tgccctgcacgtatacacccaga

SEQ ID NO: 6508151 - DNA, 18 bp, Homo sapiens
tgccctgcagagcaataa

SEQ ID NO: 6508152 - DNA, 13 bp, Homo sapiens
tgccctgcaggca

SEQ ID NO: 6508153 - DNA, 16 bp, Homo sapiens
tgccctgcaggcacag

SEQ ID NO: 6508154 - DNA, 16 bp, Homo sapiens
tgccctgccaagcctg

SEQ ID NO: 6508155 - DNA, 17 bp, Homo sapiens
tgccctgccacctgtct

SEQ ID NO: 6508156 - DNA, 19 bp, Homo sapiens
tgccctgccacctgtctgt

SEQ ID NO: 6508157 - DNA, 12 bp, Homo sapiens
tgccctgcccaa

SEQ ID NO: 6508158 - DNA, 16 bp, Homo sapiens
tgccctgcccaagtga

SEQ ID NO: 6508159 - DNA, 20 bp, Homo sapiens
tgccctgcccaagtgaccag

SEQ ID NO: 6508160 - DNA, 21 bp, Homo sapiens
tgccctgcccacctggcctct

SEQ ID NO: 6508161 - DNA, 23 bp, Homo sapiens
tgccctgcccacctggcctctgc

SEQ ID NO: 6508162 - DNA, 21 bp, Homo sapiens
tgccctgcccaggtggcctcc

SEQ ID NO: 6508163 - DNA, 12 bp, Homo sapiens
tgccctgcccat

SEQ ID NO: 6508164 - DNA, 14 bp, Homo sapiens
tgccctgccctgcc

SEQ ID NO: 6508165 - DNA, 18 bp, Homo sapiens
tgccctgccctggccact

SEQ ID NO: 6508166 - DNA, 18 bp, Homo sapiens
tgccctgcccttcctcag

SEQ ID NO: 6508167 - DNA, 21 bp, Homo sapiens
tgccctgccgccgcctcccgg

SEQ ID NO: 6508168 - DNA, 17 bp, Homo sapiens
tgccctgcctcagccag

SEQ ID NO: 6508169 - DNA, 21 bp, Homo sapiens
tgccctgcctcagccaggccc

SEQ ID NO: 6508170 - DNA, 16 bp, Homo sapiens
tgccctgcctcccttt

SEQ ID NO: 6508171 - DNA, 11 bp, Homo sapiens
tgccctgcctg

SEQ ID NO: 6508172 - DNA, 14 bp, Homo sapiens
tgccctgcctgagg

SEQ ID NO: 6508173 - DNA, 13 bp, Homo sapiens
tgccctgcctgcc

SEQ ID NO: 6508174 - DNA, 19 bp, Homo sapiens
tgccctgcggccccgtctg

SEQ ID NO: 6508175 - DNA, 22 bp, Homo sapiens
tgccctgcggctctggaaagca

SEQ ID NO: 6508176 - DNA, 17 bp, Homo sapiens
tgccctgcgtcccttct

SEQ ID NO: 6508177 - DNA, 21 bp, Homo sapiens
tgccctgctatttcaggccct

SEQ ID NO: 6508178 - DNA, 23 bp, Homo sapiens
tgccctgctatttcaggccctca

SEQ ID NO: 6508179 - DNA, 12 bp, Homo sapiens
tgccctgctcct

SEQ ID NO: 6508180 - DNA, 17 bp, Homo sapiens
tgccctgctctggggat

SEQ ID NO: 6508181 - DNA, 20 bp, Homo sapiens
tgccctgctctggggatgca

SEQ ID NO: 6508182 - DNA, 19 bp, Homo sapiens
tgccctgctgagcacagac

SEQ ID NO: 6508183 - DNA, 18 bp, Homo sapiens
tgccctgctgagtcccag

SEQ ID NO: 6508184 - DNA, 11 bp, Homo sapiens
tgccctgctgc

SEQ ID NO: 6508185 - DNA, 14 bp, Homo sapiens
tgccctgctgccct

SEQ ID NO: 6508186 - DNA, 16 bp, Homo sapiens
tgccctgctgccctcc

SEQ ID NO: 6508187 - DNA, 17 bp, Homo sapiens
tgccctgctgccctccc

SEQ ID NO: 6508188 - DNA, 12 bp, Homo sapiens
tgccctgctttc

SEQ ID NO: 6508189 - DNA, 16 bp, Homo sapiens
tgccctgctttcagat

SEQ ID NO: 6508190 - DNA, 17 bp, Homo sapiens
tgccctgctttcagata

SEQ ID NO: 6508191 - DNA, 16 bp, Homo sapiens
tgccctgctttgcaaa

SEQ ID NO: 6508192 - DNA, 16 bp, Homo sapiens
tgccctggagcctcag

SEQ ID NO: 6508193 - DNA, 17 bp, Homo sapiens
tgccctggagcctcagc

SEQ ID NO: 6508194 - DNA, 19 bp, Homo sapiens
tgccctggagcctcagcag

SEQ ID NO: 6508195 - DNA, 21 bp, Homo sapiens
tgccctggaggctgacacaga

SEQ ID NO: 6508196 - DNA, 16 bp, Homo sapiens
tgccctggcagcagca

SEQ ID NO: 6508197 - DNA, 18 bp, Homo sapiens
tgccctggcagcagcagg

SEQ ID NO: 6508198 - DNA, 22 bp, Homo sapiens
tgccctggcagggtcatcctgt

SEQ ID NO: 6508199 - DNA, 21 bp, Homo sapiens
tgccctggccactggccctgt

SEQ ID NO: 6508200 - DNA, 14 bp, Homo sapiens
tgccctggcccagc

SEQ ID NO: 6508201 - DNA, 20 bp, Homo sapiens
tgccctggcccagcctgtgg

SEQ ID NO: 6508202 - DNA, 19 bp, Homo sapiens
tgccctggccccagcccta

SEQ ID NO: 6508203 - DNA, 13 bp, Homo sapiens
tgccctggccctg

SEQ ID NO: 6508204 - DNA, 14 bp, Homo sapiens
tgccctggccctga

SEQ ID NO: 6508205 - DNA, 18 bp, Homo sapiens
tgccctggccctgaggtg

SEQ ID NO: 6508206 - DNA, 22 bp, Homo sapiens
tgccctggccctgaggtgtggg

SEQ ID NO: 6508207 - DNA, 20 bp, Homo sapiens
tgccctggcctaccacagct

SEQ ID NO: 6508208 - DNA, 14 bp, Homo sapiens
tgccctggctccat

SEQ ID NO: 6508209 - DNA, 16 bp, Homo sapiens
tgccctggctccttgc

SEQ ID NO: 6508210 - DNA, 15 bp, Homo sapiens
tgccctggctgctgc

SEQ ID NO: 6508211 - DNA, 16 bp, Homo sapiens
tgccctggctgctgcc

SEQ ID NO: 6508212 - DNA, 18 bp, Homo sapiens
tgccctggctgctgcccc

SEQ ID NO: 6508213 - DNA, 16 bp, Homo sapiens
tgccctggctgtgggt

SEQ ID NO: 6508214 - DNA, 17 bp, Homo sapiens
tgccctgggatgcctca

SEQ ID NO: 6508215 - DNA, 18 bp, Homo sapiens
tgccctgggatgcctcac

SEQ ID NO: 6508216 - DNA, 20 bp, Homo sapiens
tgccctgggatgcctcacca

SEQ ID NO: 6508217 - DNA, 11 bp, Homo sapiens
tgccctgggcc

SEQ ID NO: 6508218 - DNA, 13 bp, Homo sapiens
tgccctgggccac

SEQ ID NO: 6508219 - DNA, 16 bp, Homo sapiens
tgccctgggccagccc

SEQ ID NO: 6508220 - DNA, 21 bp, Homo sapiens
tgccctgggccagcccaggat

SEQ ID NO: 6508221 - DNA, 12 bp, Homo sapiens
tgccctgggcga

SEQ ID NO: 6508222 - DNA, 21 bp, Homo sapiens
tgccctgggcgagcccctcct

SEQ ID NO: 6508223 - DNA, 22 bp, Homo sapiens
tgccctgggcgagcccctcctt

SEQ ID NO: 6508224 - DNA, 17 bp, Homo sapiens
tgccctgggctcctctt

SEQ ID NO: 6508225 - DNA, 16 bp, Homo sapiens
tgccctgggctgcctc

SEQ ID NO: 6508226 - DNA, 13 bp, Homo sapiens
tgccctggggaga

SEQ ID NO: 6508227 - DNA, 21 bp, Homo sapiens
tgccctggggcatccaccttc

SEQ ID NO: 6508228 - DNA, 22 bp, Homo sapiens
tgccctggggctgatctcaggg

SEQ ID NO: 6508229 - DNA, 20 bp, Homo sapiens
tgccctgggtcctgcctgca

SEQ ID NO: 6508230 - DNA, 21 bp, Homo sapiens
tgccctgggtcctgcctgcag

SEQ ID NO: 6508231 - DNA, 22 bp, Homo sapiens
tgccctgggtcctgcctgcagt

SEQ ID NO: 6508232 - DNA, 18 bp, Homo sapiens
tgccctggtgctgccaca

SEQ ID NO: 6508233 - DNA, 15 bp, Homo sapiens
tgccctggtggagaa

SEQ ID NO: 6508234 - DNA, 21 bp, Homo sapiens
tgccctggtggccctctcccc

SEQ ID NO: 6508235 - DNA, 16 bp, Homo sapiens
tgccctggtggcctgc

SEQ ID NO: 6508236 - DNA, 19 bp, Homo sapiens
tgccctggtggcctgcccc

SEQ ID NO: 6508237 - DNA, 15 bp, Homo sapiens
tgccctggtttcctg

SEQ ID NO: 6508238 - DNA, 18 bp, Homo sapiens
tgccctggtttcctgccc

SEQ ID NO: 6508239 - DNA, 19 bp, Homo sapiens
tgccctggtttcctgccct

SEQ ID NO: 6508240 - DNA, 17 bp, Homo sapiens
tgccctgtaacttatct

SEQ ID NO: 6508241 - DNA, 17 bp, Homo sapiens
tgccctgtacctctctc

SEQ ID NO: 6508242 - DNA, 19 bp, Homo sapiens
tgccctgtacctctctctg

SEQ ID NO: 6508243 - DNA, 15 bp, Homo sapiens
tgccctgtagctcct

SEQ ID NO: 6508244 - DNA, 20 bp, Homo sapiens
tgccctgtagctccttagct

SEQ ID NO: 6508245 - DNA, 19 bp, Homo sapiens
tgccctgtatataatacta

SEQ ID NO: 6508246 - DNA, 12 bp, Homo sapiens
tgccctgtccct

SEQ ID NO: 6508247 - DNA, 18 bp, Homo sapiens
tgccctgtccctagctca

SEQ ID NO: 6508248 - DNA, 19 bp, Homo sapiens
tgccctgtccctagctcac

SEQ ID NO: 6508249 - DNA, 12 bp, Homo sapiens
tgccctgtcctc

SEQ ID NO: 6508250 - DNA, 13 bp, Homo sapiens
tgccctgtcctcc

SEQ ID NO: 6508251 - DNA, 14 bp, Homo sapiens
tgccctgtcctcca

SEQ ID NO: 6508252 - DNA, 15 bp, Homo sapiens
tgccctgtcctccag

SEQ ID NO: 6508253 - DNA, 18 bp, Homo sapiens
tgccctgtgagagccacg

SEQ ID NO: 6508254 - DNA, 22 bp, Homo sapiens
tgccctgtgagagccacgctgg

SEQ ID NO: 6508255 - DNA, 23 bp, Homo sapiens
tgccctgtgagtactacagtcct

SEQ ID NO: 6508256 - DNA, 12 bp, Homo sapiens
tgccctgtgcaa

SEQ ID NO: 6508257 - DNA, 18 bp, Homo sapiens
tgccctgtgggaccccag

SEQ ID NO: 6508258 - DNA, 19 bp, Homo sapiens
tgccctgtgggaccccagg

SEQ ID NO: 6508259 - DNA, 15 bp, Homo sapiens
tgccctgtgtacttc

SEQ ID NO: 6508260 - DNA, 21 bp, Homo sapiens
tgccctgtgtccgctctctca

SEQ ID NO: 6508261 - DNA, 14 bp, Homo sapiens
tgccctgtgtgtgt

SEQ ID NO: 6508262 - DNA, 19 bp, Homo sapiens
tgccctgttgtgtatagat

SEQ ID NO: 6508263 - DNA, 14 bp, Homo sapiens
tgccctgtttccaa

SEQ ID NO: 6508264 - DNA, 19 bp, Homo sapiens
tgccctgtttcctgctgct

SEQ ID NO: 6508265 - DNA, 20 bp, Homo sapiens
tgccctgtttcctgctgctt

SEQ ID NO: 6508266 - DNA, 14 bp, Homo sapiens
tgcccttaaaataa

SEQ ID NO: 6508267 - DNA, 22 bp, Homo sapiens
tgcccttaaggatcaccccagc

SEQ ID NO: 6508268 - DNA, 18 bp, Homo sapiens
tgcccttacacttactgt

SEQ ID NO: 6508269 - DNA, 20 bp, Homo sapiens
tgcccttacacttactgttg

SEQ ID NO: 6508270 - DNA, 18 bp, Homo sapiens
tgcccttacctgccagga

SEQ ID NO: 6508271 - DNA, 19 bp, Homo sapiens
tgcccttacctgccaggaa

SEQ ID NO: 6508272 - DNA, 16 bp, Homo sapiens
tgcccttacctgtctc

SEQ ID NO: 6508273 - DNA, 17 bp, Homo sapiens
tgcccttcacagtgttt

SEQ ID NO: 6508274 - DNA, 14 bp, Homo sapiens
tgcccttcacccca

SEQ ID NO: 6508275 - DNA, 15 bp, Homo sapiens
tgcccttcactgtca

SEQ ID NO: 6508276 - DNA, 15 bp, Homo sapiens
tgcccttcactgttg

SEQ ID NO: 6508277 - DNA, 22 bp, Homo sapiens
tgcccttcaggacccttctact

SEQ ID NO: 6508278 - DNA, 14 bp, Homo sapiens
tgcccttcattcag

SEQ ID NO: 6508279 - DNA, 11 bp, Homo sapiens
tgcccttcccc

SEQ ID NO: 6508280 - DNA, 13 bp, Homo sapiens
tgcccttccccct

SEQ ID NO: 6508281 - DNA, 22 bp, Homo sapiens
tgcccttccccctgcaaaaaga

SEQ ID NO: 6508282 - DNA, 15 bp, Homo sapiens
tgcccttcccctccc

SEQ ID NO: 6508283 - DNA, 14 bp, Homo sapiens
tgcccttccctctg

SEQ ID NO: 6508284 - DNA, 19 bp, Homo sapiens
tgcccttccctctgggcac

SEQ ID NO: 6508285 - DNA, 17 bp, Homo sapiens
tgcccttccctgtccct

SEQ ID NO: 6508286 - DNA, 18 bp, Homo sapiens
tgcccttccctgtccctc

SEQ ID NO: 6508287 - DNA, 20 bp, Homo sapiens
tgcccttccctgtccctcta

SEQ ID NO: 6508288 - DNA, 16 bp, Homo sapiens
tgcccttcctactcct

SEQ ID NO: 6508289 - DNA, 16 bp, Homo sapiens
tgcccttcctcagttt

SEQ ID NO: 6508290 - DNA, 12 bp, Homo sapiens
tgcccttcctcc

SEQ ID NO: 6508291 - DNA, 23 bp, Homo sapiens
tgcccttcctcctgatggagtgt

SEQ ID NO: 6508292 - DNA, 14 bp, Homo sapiens
tgcccttcctgacc

SEQ ID NO: 6508293 - DNA, 15 bp, Homo sapiens
tgcccttcctttcta

SEQ ID NO: 6508294 - DNA, 15 bp, Homo sapiens
tgcccttcgctgcca

SEQ ID NO: 6508295 - DNA, 16 bp, Homo sapiens
tgcccttcgctgccag

SEQ ID NO: 6508296 - DNA, 20 bp, Homo sapiens
tgcccttcgctgccaggaca

SEQ ID NO: 6508297 - DNA, 22 bp, Homo sapiens
tgcccttcgctgccaggacacc

SEQ ID NO: 6508298 - DNA, 22 bp, Homo sapiens
tgcccttctatactttctcaca

SEQ ID NO: 6508299 - DNA, 20 bp, Homo sapiens
tgcccttctcaagactttag

SEQ ID NO: 6508300 - DNA, 14 bp, Homo sapiens
tgcccttctcctta

SEQ ID NO: 6508301 - DNA, 14 bp, Homo sapiens
tgcccttctctgcc

SEQ ID NO: 6508302 - DNA, 22 bp, Homo sapiens
tgcccttctgattcccctccac

SEQ ID NO: 6508303 - DNA, 18 bp, Homo sapiens
tgcccttgatttttatct

SEQ ID NO: 6508304 - DNA, 12 bp, Homo sapiens
tgcccttgcagg

SEQ ID NO: 6508305 - DNA, 13 bp, Homo sapiens
tgcccttgcaggg

SEQ ID NO: 6508306 - DNA, 14 bp, Homo sapiens
tgcccttgccctga

SEQ ID NO: 6508307 - DNA, 14 bp, Homo sapiens
tgcccttgcccttg

SEQ ID NO: 6508308 - DNA, 19 bp, Homo sapiens
tgcccttgcccttggagct

SEQ ID NO: 6508309 - DNA, 17 bp, Homo sapiens
tgcccttgctgggcctg

SEQ ID NO: 6508310 - DNA, 22 bp, Homo sapiens
tgcccttgctgggcctgggggt

SEQ ID NO: 6508311 - DNA, 19 bp, Homo sapiens
tgcccttggaggccagcca

SEQ ID NO: 6508312 - DNA, 20 bp, Homo sapiens
tgcccttggcaccaccaggg

SEQ ID NO: 6508313 - DNA, 11 bp, Homo sapiens
tgcccttgggg

SEQ ID NO: 6508314 - DNA, 17 bp, Homo sapiens
tgcccttggtgcgaggg

SEQ ID NO: 6508315 - DNA, 21 bp, Homo sapiens
tgccctttacttgtctttctg

SEQ ID NO: 6508316 - DNA, 14 bp, Homo sapiens
tgccctttcctggc

SEQ ID NO: 6508317 - DNA, 16 bp, Homo sapiens
tgccctttcctggcag

SEQ ID NO: 6508318 - DNA, 11 bp, Homo sapiens
tgccctttgag

SEQ ID NO: 6508319 - DNA, 16 bp, Homo sapiens
tgccctttggccaaca

SEQ ID NO: 6508320 - DNA, 19 bp, Homo sapiens
tgccctttggccaacaggg

SEQ ID NO: 6508321 - DNA, 20 bp, Homo sapiens
tgccctttgtcctcctgctg

SEQ ID NO: 6508322 - DNA, 17 bp, Homo sapiens
tgcccttttaaatggca

SEQ ID NO: 6508323 - DNA, 21 bp, Homo sapiens
tgcccttttcatctccagtgt

SEQ ID NO: 6508324 - DNA, 16 bp, Homo sapiens
tgcccttttgcccact

SEQ ID NO: 6508325 - DNA, 18 bp, Homo sapiens
tgcccttttttctgcctc

SEQ ID NO: 6508326 - DNA, 21 bp, Homo sapiens
tgcccttttttctgcctcctt

SEQ ID NO: 6508327 - DNA, 17 bp, Homo sapiens
tgccgaaacccttgact

SEQ ID NO: 6508328 - DNA, 13 bp, Homo sapiens
tgccgaaactgga

SEQ ID NO: 6508329 - DNA, 15 bp, Homo sapiens
tgccgaaactggaag

SEQ ID NO: 6508330 - DNA, 14 bp, Homo sapiens
tgccgaacacacat

SEQ ID NO: 6508331 - DNA, 17 bp, Homo sapiens
tgccgaacattaggaat

SEQ ID NO: 6508332 - DNA, 14 bp, Homo sapiens
tgccgaagtgtttc

SEQ ID NO: 6508333 - DNA, 19 bp, Homo sapiens
tgccgaatgactatgtcca

SEQ ID NO: 6508334 - DNA, 19 bp, Homo sapiens
tgccgaatgtgcaggtttg

SEQ ID NO: 6508335 - DNA, 22 bp, Homo sapiens
tgccgaatgtgcaggtttgtta

SEQ ID NO: 6508336 - DNA, 22 bp, Homo sapiens
tgccgaatttggtacacatgtg

SEQ ID NO: 6508337 - DNA, 23 bp, Homo sapiens
tgccgaatttggtacacatgtgt

SEQ ID NO: 6508338 - DNA, 18 bp, Homo sapiens
tgccgacactgagctgtg

SEQ ID NO: 6508339 - DNA, 13 bp, Homo sapiens
tgccgacactgtt

SEQ ID NO: 6508340 - DNA, 20 bp, Homo sapiens
tgccgaccacgccccaggac

SEQ ID NO: 6508341 - DNA, 21 bp, Homo sapiens
tgccgaccagagccccacacg

SEQ ID NO: 6508342 - DNA, 22 bp, Homo sapiens
tgccgaccagagccccacacgg

SEQ ID NO: 6508343 - DNA, 19 bp, Homo sapiens
tgccgacccctagttccct

SEQ ID NO: 6508344 - DNA, 15 bp, Homo sapiens
tgccgaccgaggctg

SEQ ID NO: 6508345 - DNA, 16 bp, Homo sapiens
tgccgaccgaggctgg

SEQ ID NO: 6508346 - DNA, 23 bp, Homo sapiens
tgccgaccgaggctggagctggc

SEQ ID NO: 6508347 - DNA, 15 bp, Homo sapiens
tgccgaccgcctgct

SEQ ID NO: 6508348 - DNA, 14 bp, Homo sapiens
tgccgacctcgtcc

SEQ ID NO: 6508349 - DNA, 15 bp, Homo sapiens
tgccgacctcgtcct

SEQ ID NO: 6508350 - DNA, 21 bp, Homo sapiens
tgccgacctcgtcctccccct

SEQ ID NO: 6508351 - DNA, 12 bp, Homo sapiens
tgccgactcccc

SEQ ID NO: 6508352 - DNA, 14 bp, Homo sapiens
tgccgactcctggg

SEQ ID NO: 6508353 - DNA, 20 bp, Homo sapiens
tgccgagacagaccctctgc

SEQ ID NO: 6508354 - DNA, 14 bp, Homo sapiens
tgccgagacctcaa

SEQ ID NO: 6508355 - DNA, 22 bp, Homo sapiens
tgccgagagtccatcagcctcc

SEQ ID NO: 6508356 - DNA, 15 bp, Homo sapiens
tgccgagcaaccgtg

SEQ ID NO: 6508357 - DNA, 21 bp, Homo sapiens
tgccgagcaaccgtggccctt

SEQ ID NO: 6508358 - DNA, 17 bp, Homo sapiens
tgccgagggctggccgg

SEQ ID NO: 6508359 - DNA, 18 bp, Homo sapiens
tgccgagggctggccggg

SEQ ID NO: 6508360 - DNA, 19 bp, Homo sapiens
tgccgagggctggccggga

SEQ ID NO: 6508361 - DNA, 20 bp, Homo sapiens
tgccgagggggctgtcatgc

SEQ ID NO: 6508362 - DNA, 21 bp, Homo sapiens
tgccgatatactctagatgaa

SEQ ID NO: 6508363 - DNA, 18 bp, Homo sapiens
tgccgatatcttcagaaa

SEQ ID NO: 6508364 - DNA, 13 bp, Homo sapiens
tgccgatgttgaa

SEQ ID NO: 6508365 - DNA, 16 bp, Homo sapiens
tgccgatgttgaactt

SEQ ID NO: 6508366 - DNA, 16 bp, Homo sapiens
tgccgattttgtaaat

SEQ ID NO: 6508367 - DNA, 16 bp, Homo sapiens
tgccgcaaggccctgt

SEQ ID NO: 6508368 - DNA, 18 bp, Homo sapiens
tgccgcaaggccctgtcc

SEQ ID NO: 6508369 - DNA, 21 bp, Homo sapiens
tgccgcaaggccctgtcccag

SEQ ID NO: 6508370 - DNA, 22 bp, Homo sapiens
tgccgcaatggccatgtgggga

SEQ ID NO: 6508371 - DNA, 17 bp, Homo sapiens
tgccgcaccagcccgaa

SEQ ID NO: 6508372 - DNA, 13 bp, Homo sapiens
tgccgcaccccag

SEQ ID NO: 6508373 - DNA, 18 bp, Homo sapiens
tgccgcaccccagagtgt

SEQ ID NO: 6508374 - DNA, 15 bp, Homo sapiens
tgccgcactctggcg

SEQ ID NO: 6508375 - DNA, 14 bp, Homo sapiens
tgccgcagagctgg

SEQ ID NO: 6508376 - DNA, 17 bp, Homo sapiens
tgccgcagagctggccg

SEQ ID NO: 6508377 - DNA, 21 bp, Homo sapiens
tgccgcagcggtgggaaggaa

SEQ ID NO: 6508378 - DNA, 21 bp, Homo sapiens
tgccgcagtggggtcaagctg

SEQ ID NO: 6508379 - DNA, 17 bp, Homo sapiens
tgccgcatctgcctgga

SEQ ID NO: 6508380 - DNA, 15 bp, Homo sapiens
tgccgcatgctccct

SEQ ID NO: 6508381 - DNA, 21 bp, Homo sapiens
tgccgccagctgccgcaccag

SEQ ID NO: 6508382 - DNA, 13 bp, Homo sapiens
tgccgcccacctc

SEQ ID NO: 6508383 - DNA, 19 bp, Homo sapiens
tgccgcccccgcctgggca

SEQ ID NO: 6508384 - DNA, 17 bp, Homo sapiens
tgccgccccctcctgaa

SEQ ID NO: 6508385 - DNA, 19 bp, Homo sapiens
tgccgccccctcctgaacc

SEQ ID NO: 6508386 - DNA, 19 bp, Homo sapiens
tgccgccccgtgcctgtac

SEQ ID NO: 6508387 - DNA, 21 bp, Homo sapiens
tgccgccgcccgctggggacc

SEQ ID NO: 6508388 - DNA, 17 bp, Homo sapiens
tgccgccgccgtggtga

SEQ ID NO: 6508389 - DNA, 15 bp, Homo sapiens
tgccgccgcctcgcc

SEQ ID NO: 6508390 - DNA, 22 bp, Homo sapiens
tgccgccgctaggtagagtctg

SEQ ID NO: 6508391 - DNA, 19 bp, Homo sapiens
tgccgccgtctctgtcccg

SEQ ID NO: 6508392 - DNA, 13 bp, Homo sapiens
tgccgcctcacct

SEQ ID NO: 6508393 - DNA, 24 bp, Homo sapiens
tgccgcctccccacggccgctcca

SEQ ID NO: 6508394 - DNA, 12 bp, Homo sapiens
tgccgcctcctt

SEQ ID NO: 6508395 - DNA, 20 bp, Homo sapiens
tgccgcctgcactcctcagg

SEQ ID NO: 6508396 - DNA, 16 bp, Homo sapiens
tgccgcctgctcctca

SEQ ID NO: 6508397 - DNA, 20 bp, Homo sapiens
tgccgcctgctcctcactgg

SEQ ID NO: 6508398 - DNA, 20 bp, Homo sapiens
tgccgcctgggaatcaggat

SEQ ID NO: 6508399 - DNA, 19 bp, Homo sapiens
tgccgcctggggctccggt

SEQ ID NO: 6508400 - DNA, 15 bp, Homo sapiens
tgccgcctgtcaata

SEQ ID NO: 6508401 - DNA, 20 bp, Homo sapiens
tgccgcctgtcaataaatgt

SEQ ID NO: 6508402 - DNA, 21 bp, Homo sapiens
tgccgcctgtgcccttgctgg

SEQ ID NO: 6508403 - DNA, 19 bp, Homo sapiens
tgccgcgggcggccaggca

SEQ ID NO: 6508404 - DNA, 20 bp, Homo sapiens
tgccgcgggcggccaggcaa

SEQ ID NO: 6508405 - DNA, 20 bp, Homo sapiens
tgccgcgtcgccctcccagg

SEQ ID NO: 6508406 - DNA, 23 bp, Homo sapiens
tgccgcgtgcgaccagaggtggg

SEQ ID NO: 6508407 - DNA, 15 bp, Homo sapiens
tgccgctacctccct

SEQ ID NO: 6508408 - DNA, 18 bp, Homo sapiens
tgccgctacctccctccc

SEQ ID NO: 6508409 - DNA, 23 bp, Homo sapiens
tgccgctccccttggacctccag

SEQ ID NO: 6508410 - DNA, 12 bp, Homo sapiens
tgccgctcctgc

SEQ ID NO: 6508411 - DNA, 15 bp, Homo sapiens
tgccgctcctgcttc

SEQ ID NO: 6508412 - DNA, 19 bp, Homo sapiens
tgccgctcctgcttcccct

SEQ ID NO: 6508413 - DNA, 20 bp, Homo sapiens
tgccgctcctgcttcccctc

SEQ ID NO: 6508414 - DNA, 22 bp, Homo sapiens
tgccgctcctgcttcccctccc

SEQ ID NO: 6508415 - DNA, 14 bp, Homo sapiens
tgccgctcttctgt

SEQ ID NO: 6508416 - DNA, 18 bp, Homo sapiens
tgccgctcttctgtcatc

SEQ ID NO: 6508417 - DNA, 20 bp, Homo sapiens
tgccgctcttctgtcatccc

SEQ ID NO: 6508418 - DNA, 22 bp, Homo sapiens
tgccgctgatgtttggccgtga

SEQ ID NO: 6508419 - DNA, 12 bp, Homo sapiens
tgccgctgcacc

SEQ ID NO: 6508420 - DNA, 14 bp, Homo sapiens
tgccgctgcaccac

SEQ ID NO: 6508421 - DNA, 15 bp, Homo sapiens
tgccgctgcaccacg

SEQ ID NO: 6508422 - DNA, 13 bp, Homo sapiens
tgccgctgcacct

SEQ ID NO: 6508423 - DNA, 12 bp, Homo sapiens
tgccgctgcagg

SEQ ID NO: 6508424 - DNA, 21 bp, Homo sapiens
tgccgctgccacccgcccacc

SEQ ID NO: 6508425 - DNA, 13 bp, Homo sapiens
tgccgctgccatg

SEQ ID NO: 6508426 - DNA, 16 bp, Homo sapiens
tgccgctgccatgctt

SEQ ID NO: 6508427 - DNA, 15 bp, Homo sapiens
tgccgctgcccccac

SEQ ID NO: 6508428 - DNA, 16 bp, Homo sapiens
tgccgctgcccccacc

SEQ ID NO: 6508429 - DNA, 21 bp, Homo sapiens
tgccgctgcccccaccctgct

SEQ ID NO: 6508430 - DNA, 16 bp, Homo sapiens
tgccgctgccgctgca

SEQ ID NO: 6508431 - DNA, 18 bp, Homo sapiens
tgccgctgctctcccagg

SEQ ID NO: 6508432 - DNA, 19 bp, Homo sapiens
tgccgctgctctcccaggt

SEQ ID NO: 6508433 - DNA, 13 bp, Homo sapiens
tgccgctgcttga

SEQ ID NO: 6508434 - DNA, 13 bp, Homo sapiens
tgccgctgggaga

SEQ ID NO: 6508435 - DNA, 14 bp, Homo sapiens
tgccgctgggagag

SEQ ID NO: 6508436 - DNA, 19 bp, Homo sapiens
tgccgctgtataaagcatg

SEQ ID NO: 6508437 - DNA, 12 bp, Homo sapiens
tgccgctgtctc

SEQ ID NO: 6508438 - DNA, 14 bp, Homo sapiens
tgccgctgtctctg

SEQ ID NO: 6508439 - DNA, 20 bp, Homo sapiens
tgccgcttaaacatttccct

SEQ ID NO: 6508440 - DNA, 15 bp, Homo sapiens
tgccgctttgtctgt

SEQ ID NO: 6508441 - DNA, 19 bp, Homo sapiens
tgccgctttgtctgtccag

SEQ ID NO: 6508442 - DNA, 18 bp, Homo sapiens
tgccgcttttgtgcctct

SEQ ID NO: 6508443 - DNA, 17 bp, Homo sapiens
tgccggaaagagagctg

SEQ ID NO: 6508444 - DNA, 23 bp, Homo sapiens
tgccggacccggaggccgaggcc

SEQ ID NO: 6508445 - DNA, 20 bp, Homo sapiens
tgtgatcatagctcactgca

SEQ ID NO: 6508446 - DNA, 18 bp, Homo sapiens
tgtgatcatatatcataa

SEQ ID NO: 6508447 - DNA, 18 bp, Homo sapiens
tgtgatcatgtgtggaag

SEQ ID NO: 6508448 - DNA, 15 bp, Homo sapiens
tgtgatccagccctg

SEQ ID NO: 6508449 - DNA, 20 bp, Homo sapiens
tgtgatccagttgttttcca

SEQ ID NO: 6508450 - DNA, 18 bp, Homo sapiens
tgtgatcccaagtgccag

SEQ ID NO: 6508451 - DNA, 23 bp, Homo sapiens
tgtgatcccaagtgccagtcttg

SEQ ID NO: 6508452 - DNA, 21 bp, Homo sapiens
tgtgatccttttatgttattt

SEQ ID NO: 6508453 - DNA, 16 bp, Homo sapiens
tgtgatcgtgtgttgc

SEQ ID NO: 6508454 - DNA, 15 bp, Homo sapiens
tgtgatctaagcagt

SEQ ID NO: 6508455 - DNA, 14 bp, Homo sapiens
tgtgatctgggcat

SEQ ID NO: 6508456 - DNA, 16 bp, Homo sapiens
tgtgatctgtcttgta

SEQ ID NO: 6508457 - DNA, 18 bp, Homo sapiens
tgtgatctgtcttgtaat

SEQ ID NO: 6508458 - DNA, 15 bp, Homo sapiens
tgtgatctgtgtaca

SEQ ID NO: 6508459 - DNA, 13 bp, Homo sapiens
tgtgatcttaaaa

SEQ ID NO: 6508460 - DNA, 17 bp, Homo sapiens
tgtgatcttatttttct

SEQ ID NO: 6508461 - DNA, 15 bp, Homo sapiens
tgtgatgaacatatt

SEQ ID NO: 6508462 - DNA, 19 bp, Homo sapiens
tgtgatgaatcaacaagat

SEQ ID NO: 6508463 - DNA, 18 bp, Homo sapiens
tgtgatgaatctacattt

SEQ ID NO: 6508464 - DNA, 20 bp, Homo sapiens
tgtgatgaatctacatttgt

SEQ ID NO: 6508465 - DNA, 19 bp, Homo sapiens
tgtgatgactggttgttca

SEQ ID NO: 6508466 - DNA, 19 bp, Homo sapiens
tgtgatgagaggaaatcac

SEQ ID NO: 6508467 - DNA, 16 bp, Homo sapiens
tgtgatgatagcactg

SEQ ID NO: 6508468 - DNA, 21 bp, Homo sapiens
tgtgatgatagcactggtttg

SEQ ID NO: 6508469 - DNA, 18 bp, Homo sapiens
tgtgatgatgctgtgaca

SEQ ID NO: 6508470 - DNA, 14 bp, Homo sapiens
tgtgatgatgtaat

SEQ ID NO: 6508471 - DNA, 17 bp, Homo sapiens
tgtgatgatgtaattga

SEQ ID NO: 6508472 - DNA, 15 bp, Homo sapiens
tgtgatgcatgagct

SEQ ID NO: 6508473 - DNA, 13 bp, Homo sapiens
tgtgatgcatttt

SEQ ID NO: 6508474 - DNA, 17 bp, Homo sapiens
tgtgatgccacacagag

SEQ ID NO: 6508475 - DNA, 14 bp, Homo sapiens
tgtgatgctgtgtg

SEQ ID NO: 6508476 - DNA, 18 bp, Homo sapiens
tgtgatgcttataataaa

SEQ ID NO: 6508477 - DNA, 17 bp, Homo sapiens
tgtgatggaacacacac

SEQ ID NO: 6508478 - DNA, 18 bp, Homo sapiens
tgtgatggaacacacaca

SEQ ID NO: 6508479 - DNA, 14 bp, Homo sapiens
tgtgatggagggga

SEQ ID NO: 6508480 - DNA, 17 bp, Homo sapiens
tgtgatggatggcacaa

SEQ ID NO: 6508481 - DNA, 18 bp, Homo sapiens
tgtgatgggatctgtaag

SEQ ID NO: 6508482 - DNA, 16 bp, Homo sapiens
tgtgatggggccctgc

SEQ ID NO: 6508483 - DNA, 18 bp, Homo sapiens
tgtgatggggccctgcct

SEQ ID NO: 6508484 - DNA, 17 bp, Homo sapiens
tgtgatggtatttgaga

SEQ ID NO: 6508485 - DNA, 22 bp, Homo sapiens
tgtgatggttcgttctgtttac

SEQ ID NO: 6508486 - DNA, 18 bp, Homo sapiens
tgtgatggttgattcaca

SEQ ID NO: 6508487 - DNA, 18 bp, Homo sapiens
tgtgatgtaaggcactgt

SEQ ID NO: 6508488 - DNA, 20 bp, Homo sapiens
tgtgatgtacacattttgta

SEQ ID NO: 6508489 - DNA, 18 bp, Homo sapiens
tgtgatgtaccagtttgt

SEQ ID NO: 6508490 - DNA, 16 bp, Homo sapiens
tgtgatgtcacagttt

SEQ ID NO: 6508491 - DNA, 18 bp, Homo sapiens
tgtgatgtcatacagaga

SEQ ID NO: 6508492 - DNA, 21 bp, Homo sapiens
tgtgatgtcccagtttcccac

SEQ ID NO: 6508493 - DNA, 17 bp, Homo sapiens
tgtgatgttttatcctt

SEQ ID NO: 6508494 - DNA, 14 bp, Homo sapiens
tgtgattaaatctc

SEQ ID NO: 6508495 - DNA, 15 bp, Homo sapiens
tgtgattaatgtttt

SEQ ID NO: 6508496 - DNA, 12 bp, Homo sapiens
tgtgattacagc

SEQ ID NO: 6508497 - DNA, 22 bp, Homo sapiens
tgtgattacgtgtatgtttctt

SEQ ID NO: 6508498 - DNA, 13 bp, Homo sapiens
tgtgattagatca

SEQ ID NO: 6508499 - DNA, 15 bp, Homo sapiens
tgtgattcaaaagat

SEQ ID NO: 6508500 - DNA, 20 bp, Homo sapiens
tgtgattcaatctgtaaact

SEQ ID NO: 6508501 - DNA, 16 bp, Homo sapiens
tgtgattcaatgcctc

SEQ ID NO: 6508502 - DNA, 20 bp, Homo sapiens
tgtgattcagaaaatgttct

SEQ ID NO: 6508503 - DNA, 20 bp, Homo sapiens
tgtgattcctttgaagagga

SEQ ID NO: 6508504 - DNA, 14 bp, Homo sapiens
tgtgattctaatgt

SEQ ID NO: 6508505 - DNA, 21 bp, Homo sapiens
tgtgattctaatgtcttcatt

SEQ ID NO: 6508506 - DNA, 14 bp, Homo sapiens
tgtgattctgttta

SEQ ID NO: 6508507 - DNA, 16 bp, Homo sapiens
tgtgattgacagaacc

SEQ ID NO: 6508508 - DNA, 23 bp, Homo sapiens
tgtgattgacagctttgctgctg

SEQ ID NO: 6508509 - DNA, 13 bp, Homo sapiens
tgtgattgctgcc

SEQ ID NO: 6508510 - DNA, 13 bp, Homo sapiens
tgtgattggagtg

SEQ ID NO: 6508511 - DNA, 17 bp, Homo sapiens
tgtgattggagtgtgtc

SEQ ID NO: 6508512 - DNA, 22 bp, Homo sapiens
tgtgattggcagcttcaaaaca

SEQ ID NO: 6508513 - DNA, 17 bp, Homo sapiens
tgtgattggcctgtaga

SEQ ID NO: 6508514 - DNA, 20 bp, Homo sapiens
tgtgattggctgcaggaaga

SEQ ID NO: 6508515 - DNA, 14 bp, Homo sapiens
tgtgattggctggt

SEQ ID NO: 6508516 - DNA, 16 bp, Homo sapiens
tgtgatttaatagtgt

SEQ ID NO: 6508517 - DNA, 16 bp, Homo sapiens
tgtgatttaggtcagt

SEQ ID NO: 6508518 - DNA, 14 bp, Homo sapiens
tgtgatttatcttt

SEQ ID NO: 6508519 - DNA, 17 bp, Homo sapiens
tgtgatttccatttctg

SEQ ID NO: 6508520 - DNA, 23 bp, Homo sapiens
tgtgatttcccgtggccccagcc

SEQ ID NO: 6508521 - DNA, 14 bp, Homo sapiens
tgtgatttcctaaa

SEQ ID NO: 6508522 - DNA, 20 bp, Homo sapiens
tgtgatttcctaaacataat

SEQ ID NO: 6508523 - DNA, 19 bp, Homo sapiens
tgtgatttcctaatatgat

SEQ ID NO: 6508524 - DNA, 17 bp, Homo sapiens
tgtgatttcctacagaa

SEQ ID NO: 6508525 - DNA, 17 bp, Homo sapiens
tgtgatttctgtgccat

SEQ ID NO: 6508526 - DNA, 14 bp, Homo sapiens
tgtgatttcttctc

SEQ ID NO: 6508527 - DNA, 16 bp, Homo sapiens
tgtgatttcttctccc

SEQ ID NO: 6508528 - DNA, 14 bp, Homo sapiens
tgtgatttctttaa

SEQ ID NO: 6508529 - DNA, 12 bp, Homo sapiens
tgtgatttgact

SEQ ID NO: 6508530 - DNA, 13 bp, Homo sapiens
tgtgatttgactg

SEQ ID NO: 6508531 - DNA, 14 bp, Homo sapiens
tgtgatttgactgt

SEQ ID NO: 6508532 - DNA, 23 bp, Homo sapiens
tgtgatttgactgtttttaccca

SEQ ID NO: 6508533 - DNA, 15 bp, Homo sapiens
tgtgatttggttgca

SEQ ID NO: 6508534 - DNA, 15 bp, Homo sapiens
tgtgatttgtctctg

SEQ ID NO: 6508535 - DNA, 22 bp, Homo sapiens
tgtgatttgtcttcccttcttt

SEQ ID NO: 6508536 - DNA, 14 bp, Homo sapiens
tgtgattttaactc

SEQ ID NO: 6508537 - DNA, 20 bp, Homo sapiens
tgtgattttaactctgtctt

SEQ ID NO: 6508538 - DNA, 17 bp, Homo sapiens
tgtgattttcaaatatg

SEQ ID NO: 6508539 - DNA, 17 bp, Homo sapiens
tgtgatttttataatac

SEQ ID NO: 6508540 - DNA, 15 bp, Homo sapiens
tgtgatttttatcac

SEQ ID NO: 6508541 - DNA, 20 bp, Homo sapiens
tgtgcaaaaaggactggaaa

SEQ ID NO: 6508542 - DNA, 14 bp, Homo sapiens
tgtgcaaaaatttt

SEQ ID NO: 6508543 - DNA, 15 bp, Homo sapiens
tgtgcaaaaattttt

SEQ ID NO: 6508544 - DNA, 17 bp, Homo sapiens
tgtgcaaaaatttttgg

SEQ ID NO: 6508545 - DNA, 19 bp, Homo sapiens
tgtgcaaaataaaatgagt

SEQ ID NO: 6508546 - DNA, 14 bp, Homo sapiens
tgtgcaaaatgtgt

SEQ ID NO: 6508547 - DNA, 23 bp, Homo sapiens
tgtgcaaaatgtgtttcagccgt

SEQ ID NO: 6508548 - DNA, 16 bp, Homo sapiens
tgtgcaaacagtaacg

SEQ ID NO: 6508549 - DNA, 13 bp, Homo sapiens
tgtgcaaacatgg

SEQ ID NO: 6508550 - DNA, 18 bp, Homo sapiens
tgtgcaaagatctctaga

SEQ ID NO: 6508551 - DNA, 19 bp, Homo sapiens
tgtgcaaaggataaatttt

SEQ ID NO: 6508552 - DNA, 20 bp, Homo sapiens
tgtgcaaattttaaaaagga

SEQ ID NO: 6508553 - DNA, 19 bp, Homo sapiens
tgtgcaaattttgcattta

SEQ ID NO: 6508554 - DNA, 17 bp, Homo sapiens
tgtgcaaattttttgaa

SEQ ID NO: 6508555 - DNA, 18 bp, Homo sapiens
tgtgcaacagggtatgga

SEQ ID NO: 6508556 - DNA, 14 bp, Homo sapiens
tgtgcaacctgtgg

SEQ ID NO: 6508557 - DNA, 18 bp, Homo sapiens
tgtgcaacggccagggtt

SEQ ID NO: 6508558 - DNA, 24 bp, Homo sapiens
tgtgcaactcttgtattgctccat

SEQ ID NO: 6508559 - DNA, 16 bp, Homo sapiens
tgtgcaactggccagc

SEQ ID NO: 6508560 - DNA, 18 bp, Homo sapiens
tgtgcaactggccagcca

SEQ ID NO: 6508561 - DNA, 13 bp, Homo sapiens
tgtgcaacttttt

SEQ ID NO: 6508562 - DNA, 15 bp, Homo sapiens
tgtgcaaggcagccg

SEQ ID NO: 6508563 - DNA, 18 bp, Homo sapiens
tgtgcaaggtattacact

SEQ ID NO: 6508564 - DNA, 18 bp, Homo sapiens
tgtgcaaggtggcctttg

SEQ ID NO: 6508565 - DNA, 21 bp, Homo sapiens
tgtgcaaggtggcctttgtgc

SEQ ID NO: 6508566 - DNA, 16 bp, Homo sapiens
tgtgcaagtgtatgca

SEQ ID NO: 6508567 - DNA, 21 bp, Homo sapiens
tgtgcaagtgtgtgcatgtgt

SEQ ID NO: 6508568 - DNA, 17 bp, Homo sapiens
tgtgcaataatttacat

SEQ ID NO: 6508569 - DNA, 14 bp, Homo sapiens
tgtgcaataatttg

SEQ ID NO: 6508570 - DNA, 22 bp, Homo sapiens
tgtgcaataatttgtacaatgg

SEQ ID NO: 6508571 - DNA, 23 bp, Homo sapiens
tgtgcaataatttgtacaatggt

SEQ ID NO: 6508572 - DNA, 15 bp, Homo sapiens
tgtgcaatacatttt

SEQ ID NO: 6508573 - DNA, 14 bp, Homo sapiens
tgtgcaatagaaat

SEQ ID NO: 6508574 - DNA, 13 bp, Homo sapiens
tgtgcaatagaag

SEQ ID NO: 6508575 - DNA, 13 bp, Homo sapiens
tgtgcaatatgag

SEQ ID NO: 6508576 - DNA, 23 bp, Homo sapiens
tgtgcaatatgaggggactgcat

SEQ ID NO: 6508577 - DNA, 15 bp, Homo sapiens
tgtgcaatatgtaac

SEQ ID NO: 6508578 - DNA, 16 bp, Homo sapiens
tgtgcaatatgtaaca

SEQ ID NO: 6508579 - DNA, 14 bp, Homo sapiens
tgtgcaatgtgtat

SEQ ID NO: 6508580 - DNA, 20 bp, Homo sapiens
tgtgcaatgtgtataaacaa

SEQ ID NO: 6508581 - DNA, 18 bp, Homo sapiens
tgtgcaattactgcctgc

SEQ ID NO: 6508582 - DNA, 20 bp, Homo sapiens
tgtgcaattcagtctgctct

SEQ ID NO: 6508583 - DNA, 23 bp, Homo sapiens
tgtgcaattgtcttttttttcct

SEQ ID NO: 6508584 - DNA, 16 bp, Homo sapiens
tgtgcaatttctgtac

SEQ ID NO: 6508585 - DNA, 18 bp, Homo sapiens
tgtgcaatttgtaaatat

SEQ ID NO: 6508586 - DNA, 14 bp, Homo sapiens
tgtgcacaaagtgg

SEQ ID NO: 6508587 - DNA, 15 bp, Homo sapiens
tgtgcacaattctgt

SEQ ID NO: 6508588 - DNA, 20 bp, Homo sapiens
tgtgcacacacacacacatg

SEQ ID NO: 6508589 - DNA, 17 bp, Homo sapiens
tgtgcacacgtgtgtat

SEQ ID NO: 6508590 - DNA, 18 bp, Homo sapiens
tgtgcacacgtgtgtatg

SEQ ID NO: 6508591 - DNA, 14 bp, Homo sapiens
tgtgcacaggcaga

SEQ ID NO: 6508592 - DNA, 16 bp, Homo sapiens
tgtgcacaggcagagc

SEQ ID NO: 6508593 - DNA, 15 bp, Homo sapiens
tgtgcacagtggctt

SEQ ID NO: 6508594 - DNA, 10 bp, Homo sapiens
tgtgcacatc

SEQ ID NO: 6508595 - DNA, 21 bp, Homo sapiens
tgtgcacatccgcgtgtgcct

SEQ ID NO: 6508596 - DNA, 21 bp, Homo sapiens
tgtgcacatctacatgccatg

SEQ ID NO: 6508597 - DNA, 13 bp, Homo sapiens
tgtgcacatctct

SEQ ID NO: 6508598 - DNA, 14 bp, Homo sapiens
tgtgcacatctctg

SEQ ID NO: 6508599 - DNA, 16 bp, Homo sapiens
tgtgcacattctccct

SEQ ID NO: 6508600 - DNA, 17 bp, Homo sapiens
tgtgcacattctccctt

SEQ ID NO: 6508601 - DNA, 13 bp, Homo sapiens
tgtgcaccagggt

SEQ ID NO: 6508602 - DNA, 13 bp, Homo sapiens
tgtgcacccggcc

SEQ ID NO: 6508603 - DNA, 23 bp, Homo sapiens
tgtgcacccggcctggatgccag

SEQ ID NO: 6508604 - DNA, 22 bp, Homo sapiens
tgtgcacctagagcttttttat

SEQ ID NO: 6508605 - DNA, 18 bp, Homo sapiens
tgtgcacctatggcccag

SEQ ID NO: 6508606 - DNA, 21 bp, Homo sapiens
tgtgcaccttacattcctaga

SEQ ID NO: 6508607 - DNA, 23 bp, Homo sapiens
tgtgcacgcagattagcaggcca

SEQ ID NO: 6508608 - DNA, 14 bp, Homo sapiens
tgtgcacgtacaca

SEQ ID NO: 6508609 - DNA, 17 bp, Homo sapiens
tgtgcactagcctgtga

SEQ ID NO: 6508610 - DNA, 22 bp, Homo sapiens
tgtgcactgacatgtttcacaa

SEQ ID NO: 6508611 - DNA, 21 bp, Homo sapiens
tgtgcactgcccatggacagg

SEQ ID NO: 6508612 - DNA, 19 bp, Homo sapiens
tgtgcactgcctgcatgag

SEQ ID NO: 6508613 - DNA, 15 bp, Homo sapiens
tgtgcactgggcagg

SEQ ID NO: 6508614 - DNA, 15 bp, Homo sapiens
tgtgcactgtagcct

SEQ ID NO: 6508615 - DNA, 14 bp, Homo sapiens
tgtgcactgtcact

SEQ ID NO: 6508616 - DNA, 17 bp, Homo sapiens
tgtgcactgtcactttg

SEQ ID NO: 6508617 - DNA, 19 bp, Homo sapiens
tgtgcactttatcttggga

SEQ ID NO: 6508618 - DNA, 23 bp, Homo sapiens
tgtgcactttatcttgggaccaa

SEQ ID NO: 6508619 - DNA, 20 bp, Homo sapiens
tgtgcactttttttctatat

SEQ ID NO: 6508620 - DNA, 19 bp, Homo sapiens
tgtgcagaaaacattgttc

SEQ ID NO: 6508621 - DNA, 13 bp, Homo sapiens
tgtgcagaaaagc

SEQ ID NO: 6508622 - DNA, 15 bp, Homo sapiens
tgtgcagaagacgcc

SEQ ID NO: 6508623 - DNA, 12 bp, Homo sapiens
tgtgcagaataa

SEQ ID NO: 6508624 - DNA, 13 bp, Homo sapiens
tgtgcagaataat

SEQ ID NO: 6508625 - DNA, 14 bp, Homo sapiens
tgccggagaggaag

SEQ ID NO: 6508626 - DNA, 20 bp, Homo sapiens
tgccggagccccaagactct

SEQ ID NO: 6508627 - DNA, 18 bp, Homo sapiens
tgccggatacaaactggt

SEQ ID NO: 6508628 - DNA, 15 bp, Homo sapiens
tgccggatctgggct

SEQ ID NO: 6508629 - DNA, 12 bp, Homo sapiens
tgccggcacagc

SEQ ID NO: 6508630 - DNA, 16 bp, Homo sapiens
tgccggccggggctga

SEQ ID NO: 6508631 - DNA, 19 bp, Homo sapiens
tgccggccttggccttggg

SEQ ID NO: 6508632 - DNA, 22 bp, Homo sapiens
tgccggcggcagccccacttca

SEQ ID NO: 6508633 - DNA, 15 bp, Homo sapiens
tgccggctcccctcg

SEQ ID NO: 6508634 - DNA, 12 bp, Homo sapiens
tgccggctctgg

SEQ ID NO: 6508635 - DNA, 21 bp, Homo sapiens
tgccggctctgggctggctgc

SEQ ID NO: 6508636 - DNA, 14 bp, Homo sapiens
tgccgggcctggac

SEQ ID NO: 6508637 - DNA, 16 bp, Homo sapiens
tgccgggcctggactg

SEQ ID NO: 6508638 - DNA, 18 bp, Homo sapiens
tgccgggcctgggcctcc

SEQ ID NO: 6508639 - DNA, 16 bp, Homo sapiens
tgccgggcgccaggac

SEQ ID NO: 6508640 - DNA, 17 bp, Homo sapiens
tgccgggcgccaggaca

SEQ ID NO: 6508641 - DNA, 18 bp, Homo sapiens
tgccgggcgtggtggcac

SEQ ID NO: 6508642 - DNA, 22 bp, Homo sapiens
tgccgggctgagggcctgctgg

SEQ ID NO: 6508643 - DNA, 23 bp, Homo sapiens
tgccgggctgagggcctgctgga

SEQ ID NO: 6508644 - DNA, 23 bp, Homo sapiens
tgccggggaggggcagagaggaa

SEQ ID NO: 6508645 - DNA, 13 bp, Homo sapiens
tgccggggcctgg

SEQ ID NO: 6508646 - DNA, 20 bp, Homo sapiens
tgccggtaaacacgcctgca

SEQ ID NO: 6508647 - DNA, 16 bp, Homo sapiens
tgccggtaccagcctg

SEQ ID NO: 6508648 - DNA, 22 bp, Homo sapiens
tgccggtcccccatgccaccac

SEQ ID NO: 6508649 - DNA, 16 bp, Homo sapiens
tgccggtcgggcagcc

SEQ ID NO: 6508650 - DNA, 18 bp, Homo sapiens
tgccggtcgggcagccag

SEQ ID NO: 6508651 - DNA, 19 bp, Homo sapiens
tgccggtcgggcagccagc

SEQ ID NO: 6508652 - DNA, 16 bp, Homo sapiens
tgccggtgagaataag

SEQ ID NO: 6508653 - DNA, 13 bp, Homo sapiens
tgccggtgggacc

SEQ ID NO: 6508654 - DNA, 17 bp, Homo sapiens
tgccggtggggccagcg

SEQ ID NO: 6508655 - DNA, 15 bp, Homo sapiens
tgccggttccgcccg

SEQ ID NO: 6508656 - DNA, 20 bp, Homo sapiens
tgccgtaattatgtaccatg

SEQ ID NO: 6508657 - DNA, 17 bp, Homo sapiens
tgccgtcaccaccaccc

SEQ ID NO: 6508658 - DNA, 19 bp, Homo sapiens
tgccgtcacccactctgca

SEQ ID NO: 6508659 - DNA, 20 bp, Homo sapiens
tgccgtcacccactctgcac

SEQ ID NO: 6508660 - DNA, 22 bp, Homo sapiens
tgccgtcacccactctgcactg

SEQ ID NO: 6508661 - DNA, 15 bp, Homo sapiens
tgccgtcctggactc

SEQ ID NO: 6508662 - DNA, 17 bp, Homo sapiens
tgccgtcgcgacacagg

SEQ ID NO: 6508663 - DNA, 19 bp, Homo sapiens
tgccgtctacctgaggggc

SEQ ID NO: 6508664 - DNA, 19 bp, Homo sapiens
tgccgtctcatcttctctc

SEQ ID NO: 6508665 - DNA, 13 bp, Homo sapiens
tgccgtctctgga

SEQ ID NO: 6508666 - DNA, 12 bp, Homo sapiens
tgccgtctttgg

SEQ ID NO: 6508667 - DNA, 14 bp, Homo sapiens
tgccgtgagcatgc

SEQ ID NO: 6508668 - DNA, 18 bp, Homo sapiens
tgccgtgagcatgcacac

SEQ ID NO: 6508669 - DNA, 18 bp, Homo sapiens
tgccgtgcacggggccag

SEQ ID NO: 6508670 - DNA, 17 bp, Homo sapiens
tgccgtgcgggcgaggc

SEQ ID NO: 6508671 - DNA, 22 bp, Homo sapiens
tgccgtggattgcacgtggcct

SEQ ID NO: 6508672 - DNA, 22 bp, Homo sapiens
tgccgtggcaccaggcgctgcc

SEQ ID NO: 6508673 - DNA, 16 bp, Homo sapiens
tgccgtgggaatttta

SEQ ID NO: 6508674 - DNA, 23 bp, Homo sapiens
tgccgtgggcctgtcgtgccagt

SEQ ID NO: 6508675 - DNA, 17 bp, Homo sapiens
tgccgtgtattttttaa

SEQ ID NO: 6508676 - DNA, 12 bp, Homo sapiens
tgccgtgtccaa

SEQ ID NO: 6508677 - DNA, 21 bp, Homo sapiens
tgccgtgtccaagggccgtgc

SEQ ID NO: 6508678 - DNA, 21 bp, Homo sapiens
tgccgtgtgagtgtgacaggg

SEQ ID NO: 6508679 - DNA, 22 bp, Homo sapiens
tgccgtgtgagtgtgacagggc

SEQ ID NO: 6508680 - DNA, 21 bp, Homo sapiens
tgccgtgtgtctcgtctcctg

SEQ ID NO: 6508681 - DNA, 19 bp, Homo sapiens
tgccgttactctccaacct

SEQ ID NO: 6508682 - DNA, 19 bp, Homo sapiens
tgccgttctgttccaacct

SEQ ID NO: 6508683 - DNA, 20 bp, Homo sapiens
tgccgttgccaagaactgaa

SEQ ID NO: 6508684 - DNA, 14 bp, Homo sapiens
tgccgttttctggg

SEQ ID NO: 6508685 - DNA, 17 bp, Homo sapiens
tgcctaaaaattccctt

SEQ ID NO: 6508686 - DNA, 19 bp, Homo sapiens
tgcctaaaaattcccttcc

SEQ ID NO: 6508687 - DNA, 15 bp, Homo sapiens
tgcctaaaatgttct

SEQ ID NO: 6508688 - DNA, 19 bp, Homo sapiens
tgcctaaaattgtatgaaa

SEQ ID NO: 6508689 - DNA, 21 bp, Homo sapiens
tgcctaaaattgtatgaaaat

SEQ ID NO: 6508690 - DNA, 20 bp, Homo sapiens
tgcctaaagcccattgctgc

SEQ ID NO: 6508691 - DNA, 13 bp, Homo sapiens
tgcctaaagtgct

SEQ ID NO: 6508692 - DNA, 14 bp, Homo sapiens
tgcctaaagtgctg

SEQ ID NO: 6508693 - DNA, 15 bp, Homo sapiens
tgcctaaatccaaag

SEQ ID NO: 6508694 - DNA, 15 bp, Homo sapiens
tgcctaaatccattt

SEQ ID NO: 6508695 - DNA, 19 bp, Homo sapiens
tgcctaaatccatttggaa

SEQ ID NO: 6508696 - DNA, 18 bp, Homo sapiens
tgcctaaatcccaagaaa

SEQ ID NO: 6508697 - DNA, 21 bp, Homo sapiens
tgcctaaatcccaagaaatgg

SEQ ID NO: 6508698 - DNA, 14 bp, Homo sapiens
tgcctaaattaaat

SEQ ID NO: 6508699 - DNA, 18 bp, Homo sapiens
tgcctaaattaaattggg

SEQ ID NO: 6508700 - DNA, 13 bp, Homo sapiens
tgcctaaatttca

SEQ ID NO: 6508701 - DNA, 15 bp, Homo sapiens
tgcctaaatttcaca

SEQ ID NO: 6508702 - DNA, 15 bp, Homo sapiens
tgcctaacaccagcg

SEQ ID NO: 6508703 - DNA, 15 bp, Homo sapiens
tgcctaaccatgggc

SEQ ID NO: 6508704 - DNA, 21 bp, Homo sapiens
tgcctaaccatgggctcaggg

SEQ ID NO: 6508705 - DNA, 15 bp, Homo sapiens
tgcctaacctgggac

SEQ ID NO: 6508706 - DNA, 15 bp, Homo sapiens
tgcctaacttgtaaa

SEQ ID NO: 6508707 - DNA, 20 bp, Homo sapiens
tgcctaagaagttattttct

SEQ ID NO: 6508708 - DNA, 23 bp, Homo sapiens
tgcctaagaagttattttcttgt

SEQ ID NO: 6508709 - DNA, 13 bp, Homo sapiens
tgcctaagacatg

SEQ ID NO: 6508710 - DNA, 22 bp, Homo sapiens
tgcctaagcattgcctggcctt

SEQ ID NO: 6508711 - DNA, 14 bp, Homo sapiens
tgcctaaggacttc

SEQ ID NO: 6508712 - DNA, 20 bp, Homo sapiens
tgcctaagtattaaaacatt

SEQ ID NO: 6508713 - DNA, 15 bp, Homo sapiens
tgcctaagtggctgc

SEQ ID NO: 6508714 - DNA, 22 bp, Homo sapiens
tgcctaatatgatgactgtttt

SEQ ID NO: 6508715 - DNA, 15 bp, Homo sapiens
tgcctaatggagaag

SEQ ID NO: 6508716 - DNA, 14 bp, Homo sapiens
tgcctaattcctgg

SEQ ID NO: 6508717 - DNA, 23 bp, Homo sapiens
tgcctaattggaaagtgccagca

SEQ ID NO: 6508718 - DNA, 16 bp, Homo sapiens
tgcctacaaccatccc

SEQ ID NO: 6508719 - DNA, 21 bp, Homo sapiens
tgcctacaaccatccctgcca

SEQ ID NO: 6508720 - DNA, 22 bp, Homo sapiens
tgcctacaatgggaaaacttca

SEQ ID NO: 6508721 - DNA, 18 bp, Homo sapiens
tgcctacacacacagcct

SEQ ID NO: 6508722 - DNA, 14 bp, Homo sapiens
tgcctacagataat

SEQ ID NO: 6508723 - DNA, 23 bp, Homo sapiens
tgcctacagataatttattttgt

SEQ ID NO: 6508724 - DNA, 14 bp, Homo sapiens
tgcctacagccagg

SEQ ID NO: 6508725 - DNA, 15 bp, Homo sapiens
tgcctacagctgtct

SEQ ID NO: 6508726 - DNA, 18 bp, Homo sapiens
tgcctacatcccgggcct

SEQ ID NO: 6508727 - DNA, 23 bp, Homo sapiens
tgcctacatcccgggcctcagtg

SEQ ID NO: 6508728 - DNA, 17 bp, Homo sapiens
tgcctaccaatatttaa

SEQ ID NO: 6508729 - DNA, 22 bp, Homo sapiens
tgcctaccagtcgccctctgtg

SEQ ID NO: 6508730 - DNA, 12 bp, Homo sapiens
tgcctaccattt

SEQ ID NO: 6508731 - DNA, 15 bp, Homo sapiens
tgcctaccatttcac

SEQ ID NO: 6508732 - DNA, 22 bp, Homo sapiens
tgcctaccgggttctcctgatt

SEQ ID NO: 6508733 - DNA, 20 bp, Homo sapiens
tgcctacctaatgaggactt

SEQ ID NO: 6508734 - DNA, 12 bp, Homo sapiens
tgcctaccttgt

SEQ ID NO: 6508735 - DNA, 13 bp, Homo sapiens
tgcctaccttgtg

SEQ ID NO: 6508736 - DNA, 15 bp, Homo sapiens
tgcctaccttgtgag

SEQ ID NO: 6508737 - DNA, 15 bp, Homo sapiens
tgcctacgccaggag

SEQ ID NO: 6508738 - DNA, 16 bp, Homo sapiens
tgcctacgccaggaga

SEQ ID NO: 6508739 - DNA, 18 bp, Homo sapiens
tgcctactgcccctgccc

SEQ ID NO: 6508740 - DNA, 22 bp, Homo sapiens
tgcctactggggggctttggcc

SEQ ID NO: 6508741 - DNA, 16 bp, Homo sapiens
tgcctactgttactct

SEQ ID NO: 6508742 - DNA, 15 bp, Homo sapiens
tgcctacttttggcc

SEQ ID NO: 6508743 - DNA, 19 bp, Homo sapiens
tgcctacttttggcctcat

SEQ ID NO: 6508744 - DNA, 22 bp, Homo sapiens
tgcctagaaacaacactgtagt

SEQ ID NO: 6508745 - DNA, 15 bp, Homo sapiens
tgcctagaaacagtg

SEQ ID NO: 6508746 - DNA, 14 bp, Homo sapiens
tgcctagaaagcaa

SEQ ID NO: 6508747 - DNA, 16 bp, Homo sapiens
tgcctagaaatatctt

SEQ ID NO: 6508748 - DNA, 22 bp, Homo sapiens
tgcctagaaatatctttctctt

SEQ ID NO: 6508749 - DNA, 23 bp, Homo sapiens
tgcctagaaatatctttctctta

SEQ ID NO: 6508750 - DNA, 16 bp, Homo sapiens
tgcctagaatctttat

SEQ ID NO: 6508751 - DNA, 16 bp, Homo sapiens
tgcctagactgttact

SEQ ID NO: 6508752 - DNA, 21 bp, Homo sapiens
tgcctagattaggtagacttt

SEQ ID NO: 6508753 - DNA, 17 bp, Homo sapiens
tgcctagattcagggaa

SEQ ID NO: 6508754 - DNA, 17 bp, Homo sapiens
tgcctagcaagctggcc

SEQ ID NO: 6508755 - DNA, 22 bp, Homo sapiens
tgcctagcactcacatgctgga

SEQ ID NO: 6508756 - DNA, 16 bp, Homo sapiens
tgcctagcagagtgct

SEQ ID NO: 6508757 - DNA, 20 bp, Homo sapiens
tgcctagcagagtgctggca

SEQ ID NO: 6508758 - DNA, 20 bp, Homo sapiens
tgcctagcatggggtcagcc

SEQ ID NO: 6508759 - DNA, 19 bp, Homo sapiens
tgcctagccctccccccag

SEQ ID NO: 6508760 - DNA, 14 bp, Homo sapiens
tgcctagctcttgg

SEQ ID NO: 6508761 - DNA, 19 bp, Homo sapiens
tgcctagctcttgggcctg

SEQ ID NO: 6508762 - DNA, 17 bp, Homo sapiens
tgcctaggagctggctg

SEQ ID NO: 6508763 - DNA, 22 bp, Homo sapiens
tgcctaggattcacaccccacc

SEQ ID NO: 6508764 - DNA, 13 bp, Homo sapiens
tgcctaggccaaa

SEQ ID NO: 6508765 - DNA, 23 bp, Homo sapiens
tgcctaggccaaatgcacaagct

SEQ ID NO: 6508766 - DNA, 13 bp, Homo sapiens
tgcctaggccagc

SEQ ID NO: 6508767 - DNA, 17 bp, Homo sapiens
tgcctaggcgattttgt

SEQ ID NO: 6508768 - DNA, 21 bp, Homo sapiens
tgcctaggcgattttgtctac

SEQ ID NO: 6508769 - DNA, 15 bp, Homo sapiens
tgcctaggctggaaa

SEQ ID NO: 6508770 - DNA, 17 bp, Homo sapiens
tgcctagggcctggtcc

SEQ ID NO: 6508771 - DNA, 18 bp, Homo sapiens
tgcctagggcctggtcca

SEQ ID NO: 6508772 - DNA, 17 bp, Homo sapiens
tgcctaggtcccttccc

SEQ ID NO: 6508773 - DNA, 15 bp, Homo sapiens
tgcctagtaaatgtt

SEQ ID NO: 6508774 - DNA, 18 bp, Homo sapiens
tgcctagtgatgtagaaa

SEQ ID NO: 6508775 - DNA, 19 bp, Homo sapiens
tgcctagtgctacagatgt

SEQ ID NO: 6508776 - DNA, 15 bp, Homo sapiens
tgcctagtggcttcc

SEQ ID NO: 6508777 - DNA, 20 bp, Homo sapiens
tgcctataaaggaaacacgt

SEQ ID NO: 6508778 - DNA, 13 bp, Homo sapiens
tgcctataaattt

SEQ ID NO: 6508779 - DNA, 19 bp, Homo sapiens
tgcctataaccatgttcta

SEQ ID NO: 6508780 - DNA, 21 bp, Homo sapiens
tgcctataagccaaaattaag

SEQ ID NO: 6508781 - DNA, 18 bp, Homo sapiens
tgcctatagtcccagcta

SEQ ID NO: 6508782 - DNA, 15 bp, Homo sapiens
tgcctatatatgtaa

SEQ ID NO: 6508783 - DNA, 14 bp, Homo sapiens
tgcctatccatcct

SEQ ID NO: 6508784 - DNA, 18 bp, Homo sapiens
tgcctatctgacttcata

SEQ ID NO: 6508785 - DNA, 14 bp, Homo sapiens
tgcctatctttaaa

SEQ ID NO: 6508786 - DNA, 15 bp, Homo sapiens
tgcctatctttaaac

SEQ ID NO: 6508787 - DNA, 16 bp, Homo sapiens
tgcctatgataaattc

SEQ ID NO: 6508788 - DNA, 17 bp, Homo sapiens
tgcctatgatactgtct

SEQ ID NO: 6508789 - DNA, 20 bp, Homo sapiens
tgcctatgatactgtctctc

SEQ ID NO: 6508790 - DNA, 15 bp, Homo sapiens
tgcctatgtctcctc

SEQ ID NO: 6508791 - DNA, 19 bp, Homo sapiens
tgcctatgtctcctctatg

SEQ ID NO: 6508792 - DNA, 21 bp, Homo sapiens
tgcctattatctgtcagctgc

SEQ ID NO: 6508793 - DNA, 13 bp, Homo sapiens
tgcctattcccac

SEQ ID NO: 6508794 - DNA, 22 bp, Homo sapiens
tgcctatttattcattcagtga

SEQ ID NO: 6508795 - DNA, 14 bp, Homo sapiens
tgcctatttgaagt

SEQ ID NO: 6508796 - DNA, 22 bp, Homo sapiens
tgcctcaaataaaaagtgcttt

SEQ ID NO: 6508797 - DNA, 23 bp, Homo sapiens
tgcctcaacagcaggaggcacag

SEQ ID NO: 6508798 - DNA, 14 bp, Homo sapiens
tgcctcaacctccc

SEQ ID NO: 6508799 - DNA, 17 bp, Homo sapiens
tgcctcaagaacacctt

SEQ ID NO: 6508800 - DNA, 19 bp, Homo sapiens
tgcctcaagttccatgctt

SEQ ID NO: 6508801 - DNA, 15 bp, Homo sapiens
tgcctcaataaagct

SEQ ID NO: 6508802 - DNA, 20 bp, Homo sapiens
tgcctcacaaatgctgtggt

SEQ ID NO: 6508803 - DNA, 15 bp, Homo sapiens
tgtgcagacagccat

SEQ ID NO: 6508804 - DNA, 14 bp, Homo sapiens
tgtgcagacagtgt

SEQ ID NO: 6508805 - DNA, 17 bp, Homo sapiens
tgtgcagaccttactca

SEQ ID NO: 6508806 - DNA, 18 bp, Homo sapiens
tgtgcagactcaataaaa

SEQ ID NO: 6508807 - DNA, 16 bp, Homo sapiens
tgtgcagactgtggct

SEQ ID NO: 6508808 - DNA, 20 bp, Homo sapiens
tgtgcagatcatccgtctgt

SEQ ID NO: 6508809 - DNA, 13 bp, Homo sapiens
tgtgcagatgaag

SEQ ID NO: 6508810 - DNA, 15 bp, Homo sapiens
tgtgcagatgctgct

SEQ ID NO: 6508811 - DNA, 16 bp, Homo sapiens
tgtgcagatgctgctg

SEQ ID NO: 6508812 - DNA, 13 bp, Homo sapiens
tgtgcagcaccct

SEQ ID NO: 6508813 - DNA, 15 bp, Homo sapiens
tgtgcagcagattgg

SEQ ID NO: 6508814 - DNA, 21 bp, Homo sapiens
tgtgcagcagcccagcttcct

SEQ ID NO: 6508815 - DNA, 22 bp, Homo sapiens
tgtgcagcagcccagcttcctg

SEQ ID NO: 6508816 - DNA, 23 bp, Homo sapiens
tgtgcagccccgccctctgcgtc

SEQ ID NO: 6508817 - DNA, 21 bp, Homo sapiens
tgtgcagccggggagctgagg

SEQ ID NO: 6508818 - DNA, 22 bp, Homo sapiens
tgtgcagctgacttttctgacc

SEQ ID NO: 6508819 - DNA, 14 bp, Homo sapiens
tgtgcaggagccag

SEQ ID NO: 6508820 - DNA, 20 bp, Homo sapiens
tgtgcaggagcctccctgca

SEQ ID NO: 6508821 - DNA, 17 bp, Homo sapiens
tgtgcaggagcggcaga

SEQ ID NO: 6508822 - DNA, 13 bp, Homo sapiens
tgtgcaggatatt

SEQ ID NO: 6508823 - DNA, 16 bp, Homo sapiens
tgtgcaggcccaggca

SEQ ID NO: 6508824 - DNA, 17 bp, Homo sapiens
tgtgcaggcccaggcag

SEQ ID NO: 6508825 - DNA, 20 bp, Homo sapiens
tgtgcaggcccaggcaggcc

SEQ ID NO: 6508826 - DNA, 22 bp, Homo sapiens
tgtgcaggcctgtccctgggag

SEQ ID NO: 6508827 - DNA, 18 bp, Homo sapiens
tgtgcaggctcctcctct

SEQ ID NO: 6508828 - DNA, 12 bp, Homo sapiens
tgtgcagggcac

SEQ ID NO: 6508829 - DNA, 15 bp, Homo sapiens
tgtgcagggcacaga

SEQ ID NO: 6508830 - DNA, 22 bp, Homo sapiens
tgtgcagggccctctggggctc

SEQ ID NO: 6508831 - DNA, 13 bp, Homo sapiens
tgtgcagggtgga

SEQ ID NO: 6508832 - DNA, 19 bp, Homo sapiens
tgtgcaggtgctattgtta

SEQ ID NO: 6508833 - DNA, 15 bp, Homo sapiens
tgtgcaggtgctgcc

SEQ ID NO: 6508834 - DNA, 18 bp, Homo sapiens
tgtgcaggtgctgccttg

SEQ ID NO: 6508835 - DNA, 21 bp, Homo sapiens
tgtgcaggtgctgccttgaga

SEQ ID NO: 6508836 - DNA, 19 bp, Homo sapiens
tgtgcagtaatagcactgc

SEQ ID NO: 6508837 - DNA, 16 bp, Homo sapiens
tgtgcagtatctgtga

SEQ ID NO: 6508838 - DNA, 21 bp, Homo sapiens
tgtgcagtcagcttttttcct

SEQ ID NO: 6508839 - DNA, 18 bp, Homo sapiens
tgtgcagtcagtgtcaat

SEQ ID NO: 6508840 - DNA, 19 bp, Homo sapiens
tgtgcagtcagtgtcaatc

SEQ ID NO: 6508841 - DNA, 16 bp, Homo sapiens
tgtgcagtcccgtgga

SEQ ID NO: 6508842 - DNA, 15 bp, Homo sapiens
tgtgcagtcctgggt

SEQ ID NO: 6508843 - DNA, 20 bp, Homo sapiens
tgtgcagtcctgggtcctcc

SEQ ID NO: 6508844 - DNA, 21 bp, Homo sapiens
tgtgcagtggccccatccagc

SEQ ID NO: 6508845 - DNA, 19 bp, Homo sapiens
tgtgcagttctagtttgca

SEQ ID NO: 6508846 - DNA, 22 bp, Homo sapiens
tgtgcagttctagtttgcattc

SEQ ID NO: 6508847 - DNA, 16 bp, Homo sapiens
tgtgcagttgctgttt

SEQ ID NO: 6508848 - DNA, 15 bp, Homo sapiens
tgtgcataaaagtta

SEQ ID NO: 6508849 - DNA, 18 bp, Homo sapiens
tgtgcataaaagttaaca

SEQ ID NO: 6508850 - DNA, 20 bp, Homo sapiens
tgtgcataagttcttaatgt

SEQ ID NO: 6508851 - DNA, 13 bp, Homo sapiens
tgtgcataatgct

SEQ ID NO: 6508852 - DNA, 22 bp, Homo sapiens
tgtgcataatgctttggaaaaa

SEQ ID NO: 6508853 - DNA, 16 bp, Homo sapiens
tgtgcataatggaaag

SEQ ID NO: 6508854 - DNA, 18 bp, Homo sapiens
tgtgcataattcttccaa

SEQ ID NO: 6508855 - DNA, 16 bp, Homo sapiens
tgtgcatagtttcttt

SEQ ID NO: 6508856 - DNA, 17 bp, Homo sapiens
tgtgcatatatactaca

SEQ ID NO: 6508857 - DNA, 19 bp, Homo sapiens
tgtgcatattgtacacttt

SEQ ID NO: 6508858 - DNA, 20 bp, Homo sapiens
tgtgcatatttagcatccct

SEQ ID NO: 6508859 - DNA, 13 bp, Homo sapiens
tgtgcatcaggct

SEQ ID NO: 6508860 - DNA, 15 bp, Homo sapiens
tgtgcatcctgtgaa

SEQ ID NO: 6508861 - DNA, 20 bp, Homo sapiens
tgtgcatctccttgactgcc

SEQ ID NO: 6508862 - DNA, 15 bp, Homo sapiens
tgtgcatctggccta

SEQ ID NO: 6508863 - DNA, 17 bp, Homo sapiens
tgtgcatctggcctatg

SEQ ID NO: 6508864 - DNA, 16 bp, Homo sapiens
tgtgcatctggcctgg

SEQ ID NO: 6508865 - DNA, 18 bp, Homo sapiens
tgtgcatctggcctgggg

SEQ ID NO: 6508866 - DNA, 22 bp, Homo sapiens
tgtgcatgagaatgtcatttgc

SEQ ID NO: 6508867 - DNA, 20 bp, Homo sapiens
tgtgcatgcaaaaatgaatt

SEQ ID NO: 6508868 - DNA, 22 bp, Homo sapiens
tgtgcatgctagtgttgtattt

SEQ ID NO: 6508869 - DNA, 16 bp, Homo sapiens
tgtgcatggaggccct

SEQ ID NO: 6508870 - DNA, 19 bp, Homo sapiens
tgtgcatgggtgaagggag

SEQ ID NO: 6508871 - DNA, 23 bp, Homo sapiens
tgtgcatgtatgtgcacatgtgt

SEQ ID NO: 6508872 - DNA, 14 bp, Homo sapiens
tgtgcatgtgagca

SEQ ID NO: 6508873 - DNA, 11 bp, Homo sapiens
tgtgcatgtgc

SEQ ID NO: 6508874 - DNA, 15 bp, Homo sapiens
tgtgcatgtgccgag

SEQ ID NO: 6508875 - DNA, 14 bp, Homo sapiens
tgtgcatgtgtgta

SEQ ID NO: 6508876 - DNA, 15 bp, Homo sapiens
tgtgcatgtgtgtgt

SEQ ID NO: 6508877 - DNA, 17 bp, Homo sapiens
tgtgcattaaaattaaa

SEQ ID NO: 6508878 - DNA, 19 bp, Homo sapiens
tgtgcattatctagatact

SEQ ID NO: 6508879 - DNA, 21 bp, Homo sapiens
tgtgcattatctagatactgt

SEQ ID NO: 6508880 - DNA, 21 bp, Homo sapiens
tgtgcattattcataaaaaat

SEQ ID NO: 6508881 - DNA, 16 bp, Homo sapiens
tgtgcattattttcca

SEQ ID NO: 6508882 - DNA, 14 bp, Homo sapiens
tgtgcattctttgg

SEQ ID NO: 6508883 - DNA, 20 bp, Homo sapiens
tgtgcatttcacctgtgaca

SEQ ID NO: 6508884 - DNA, 19 bp, Homo sapiens
tgtgcatttggcaaaatgt

SEQ ID NO: 6508885 - DNA, 15 bp, Homo sapiens
tgtgcatttgtgtct

SEQ ID NO: 6508886 - DNA, 12 bp, Homo sapiens
tgtgcattttat

SEQ ID NO: 6508887 - DNA, 13 bp, Homo sapiens
tgtgcattttcta

SEQ ID NO: 6508888 - DNA, 14 bp, Homo sapiens
tgtgcattttctaa

SEQ ID NO: 6508889 - DNA, 21 bp, Homo sapiens
tgtgcattttctaaacagaga

SEQ ID NO: 6508890 - DNA, 22 bp, Homo sapiens
tgtgcatttttgtgaaatgaaa

SEQ ID NO: 6508891 - DNA, 12 bp, Homo sapiens
tgtgccaaacta

SEQ ID NO: 6508892 - DNA, 22 bp, Homo sapiens
tgtgccaaatgactttgcacct

SEQ ID NO: 6508893 - DNA, 19 bp, Homo sapiens
tgtgccaacctattttgaa

SEQ ID NO: 6508894 - DNA, 17 bp, Homo sapiens
tgtgccaacctgatgcc

SEQ ID NO: 6508895 - DNA, 21 bp, Homo sapiens
tgtgccaactgccaggctgcc

SEQ ID NO: 6508896 - DNA, 15 bp, Homo sapiens
tgtgccaagccctgg

SEQ ID NO: 6508897 - DNA, 17 bp, Homo sapiens
tgtgccaatatgtattg

SEQ ID NO: 6508898 - DNA, 18 bp, Homo sapiens
tgtgccaatatgtattgt

SEQ ID NO: 6508899 - DNA, 20 bp, Homo sapiens
tgtgccaatgtgacaacatg

SEQ ID NO: 6508900 - DNA, 20 bp, Homo sapiens
tgtgccacaacgcctggcta

SEQ ID NO: 6508901 - DNA, 13 bp, Homo sapiens
tgtgccacacagt

SEQ ID NO: 6508902 - DNA, 19 bp, Homo sapiens
tgtgccacacgcatgggca

SEQ ID NO: 6508903 - DNA, 22 bp, Homo sapiens
tgtgccacacgcatgggcattg

SEQ ID NO: 6508904 - DNA, 17 bp, Homo sapiens
tgtgccacagaggcccc

SEQ ID NO: 6508905 - DNA, 23 bp, Homo sapiens
tgtgccacagaggccccacctga

SEQ ID NO: 6508906 - DNA, 16 bp, Homo sapiens
tgtgccacaggcttag

SEQ ID NO: 6508907 - DNA, 21 bp, Homo sapiens
tgtgccaccacccctccctct

SEQ ID NO: 6508908 - DNA, 23 bp, Homo sapiens
tgtgccaccacccctccctctgc

SEQ ID NO: 6508909 - DNA, 15 bp, Homo sapiens
tgtgccaccccttcc

SEQ ID NO: 6508910 - DNA, 18 bp, Homo sapiens
tgtgccaccctctgcagg

SEQ ID NO: 6508911 - DNA, 12 bp, Homo sapiens
tgtgccaccctg

SEQ ID NO: 6508912 - DNA, 15 bp, Homo sapiens
tgtgccaccctgggc

SEQ ID NO: 6508913 - DNA, 15 bp, Homo sapiens
tgtgccacctgcaag

SEQ ID NO: 6508914 - DNA, 23 bp, Homo sapiens
tgtgccactcaccgaagccactt

SEQ ID NO: 6508915 - DNA, 14 bp, Homo sapiens
tgtgccagaaagtc

SEQ ID NO: 6508916 - DNA, 21 bp, Homo sapiens
tgtgccagacattgctctcag

SEQ ID NO: 6508917 - DNA, 23 bp, Homo sapiens
tgtgccagagaacccagcccacc

SEQ ID NO: 6508918 - DNA, 16 bp, Homo sapiens
tgtgccagagcctggg

SEQ ID NO: 6508919 - DNA, 21 bp, Homo sapiens
tgtgccagaggaatcctggca

SEQ ID NO: 6508920 - DNA, 22 bp, Homo sapiens
tgtgccagagttattagtgcca

SEQ ID NO: 6508921 - DNA, 20 bp, Homo sapiens
tgtgccagatttatgcatat

SEQ ID NO: 6508922 - DNA, 15 bp, Homo sapiens
tgtgccagcaccaca

SEQ ID NO: 6508923 - DNA, 18 bp, Homo sapiens
tgtgccagcaccacagcc

SEQ ID NO: 6508924 - DNA, 13 bp, Homo sapiens
tgtgccagcccgg

SEQ ID NO: 6508925 - DNA, 21 bp, Homo sapiens
tgtgccagctgcttctgccca

SEQ ID NO: 6508926 - DNA, 17 bp, Homo sapiens
tgtgccaggactctctt

SEQ ID NO: 6508927 - DNA, 20 bp, Homo sapiens
tgtgccaggaggcggcagct

SEQ ID NO: 6508928 - DNA, 22 bp, Homo sapiens
tgtgccaggaggcggcagctct

SEQ ID NO: 6508929 - DNA, 12 bp, Homo sapiens
tgtgccaggctg

SEQ ID NO: 6508930 - DNA, 13 bp, Homo sapiens
tgtgccaggctgg

SEQ ID NO: 6508931 - DNA, 17 bp, Homo sapiens
tgtgccaggctgggagg

SEQ ID NO: 6508932 - DNA, 16 bp, Homo sapiens
tgtgccaggcttgcct

SEQ ID NO: 6508933 - DNA, 21 bp, Homo sapiens
tgtgccagggcaatgatgaat

SEQ ID NO: 6508934 - DNA, 19 bp, Homo sapiens
tgtgccagggcagcatttt

SEQ ID NO: 6508935 - DNA, 19 bp, Homo sapiens
tgtgccaggtgaaggaggc

SEQ ID NO: 6508936 - DNA, 20 bp, Homo sapiens
tgtgccaggtttttggtctg

SEQ ID NO: 6508937 - DNA, 20 bp, Homo sapiens
tgtgccagtgctaaactact

SEQ ID NO: 6508938 - DNA, 16 bp, Homo sapiens
tgtgccagttcctgta

SEQ ID NO: 6508939 - DNA, 17 bp, Homo sapiens
tgtgccagttgcctgga

SEQ ID NO: 6508940 - DNA, 20 bp, Homo sapiens
tgtgccatacttgttctgta

SEQ ID NO: 6508941 - DNA, 22 bp, Homo sapiens
tgtgccatagagtttaacacaa

SEQ ID NO: 6508942 - DNA, 16 bp, Homo sapiens
tgtgccatagtcacat

SEQ ID NO: 6508943 - DNA, 18 bp, Homo sapiens
tgtgccatagtcacatgg

SEQ ID NO: 6508944 - DNA, 17 bp, Homo sapiens
tgtgccatggcccccca

SEQ ID NO: 6508945 - DNA, 16 bp, Homo sapiens
tgtgccatgtcaaaca

SEQ ID NO: 6508946 - DNA, 15 bp, Homo sapiens
tgtgccattatattt

SEQ ID NO: 6508947 - DNA, 20 bp, Homo sapiens
tgtgccattatatttgcatt

SEQ ID NO: 6508948 - DNA, 17 bp, Homo sapiens
tgtgccatttctcaggg

SEQ ID NO: 6508949 - DNA, 19 bp, Homo sapiens
tgtgccattttctgtaaag

SEQ ID NO: 6508950 - DNA, 16 bp, Homo sapiens
tgtgccattttgcatt

SEQ ID NO: 6508951 - DNA, 21 bp, Homo sapiens
tgtgcccaccagcggccttga

SEQ ID NO: 6508952 - DNA, 12 bp, Homo sapiens
tgtgcccaccca

SEQ ID NO: 6508953 - DNA, 17 bp, Homo sapiens
tgtgcccacccagggaa

SEQ ID NO: 6508954 - DNA, 19 bp, Homo sapiens
tgtgcccacccagggcccg

SEQ ID NO: 6508955 - DNA, 22 bp, Homo sapiens
tgtgcccacccagggcccggca

SEQ ID NO: 6508956 - DNA, 20 bp, Homo sapiens
tgtgcccacccgtcttcaat

SEQ ID NO: 6508957 - DNA, 22 bp, Homo sapiens
tgtgcccacccgtcttcaatct

SEQ ID NO: 6508958 - DNA, 23 bp, Homo sapiens
tgtgcccaccctccactctcctc

SEQ ID NO: 6508959 - DNA, 14 bp, Homo sapiens
tgtgcccagcacct

SEQ ID NO: 6508960 - DNA, 15 bp, Homo sapiens
tgtgcccagcaggcc

SEQ ID NO: 6508961 - DNA, 17 bp, Homo sapiens
tgtgcccagcaggccca

SEQ ID NO: 6508962 - DNA, 18 bp, Homo sapiens
tgtgcccagcaggcccag

SEQ ID NO: 6508963 - DNA, 15 bp, Homo sapiens
tgtgcccagctcagt

SEQ ID NO: 6508964 - DNA, 22 bp, Homo sapiens
tgtgcccagttaatcttgcttt

SEQ ID NO: 6508965 - DNA, 14 bp, Homo sapiens
tgtgcccatgggca

SEQ ID NO: 6508966 - DNA, 22 bp, Homo sapiens
tgtgcccatgggcactgctggg

SEQ ID NO: 6508967 - DNA, 17 bp, Homo sapiens
tgtgcccattcctaata

SEQ ID NO: 6508968 - DNA, 13 bp, Homo sapiens
tgtgccccaccac

SEQ ID NO: 6508969 - DNA, 15 bp, Homo sapiens
tgtgccccaccacgt

SEQ ID NO: 6508970 - DNA, 21 bp, Homo sapiens
tgtgccccacctgttgtcctg

SEQ ID NO: 6508971 - DNA, 13 bp, Homo sapiens
tgtgccccactcc

SEQ ID NO: 6508972 - DNA, 15 bp, Homo sapiens
tgtgccccactccag

SEQ ID NO: 6508973 - DNA, 16 bp, Homo sapiens
tgtgccccactccagc

SEQ ID NO: 6508974 - DNA, 18 bp, Homo sapiens
tgtgccccactccagcct

SEQ ID NO: 6508975 - DNA, 23 bp, Homo sapiens
tgtgccccactccagcctgggga

SEQ ID NO: 6508976 - DNA, 15 bp, Homo sapiens
tgtgccccagctgcc

SEQ ID NO: 6508977 - DNA, 18 bp, Homo sapiens
tgtgccccagctgccagg

SEQ ID NO: 6508978 - DNA, 21 bp, Homo sapiens
tgtgccccagctgccaggcgg

SEQ ID NO: 6508979 - DNA, 23 bp, Homo sapiens
tgtgccccatgcctgtccagcct

SEQ ID NO: 6508980 - DNA, 21 bp, Homo sapiens
tgcctcaccacacccaggtct

SEQ ID NO: 6508981 - DNA, 23 bp, Homo sapiens
tgcctcaccacacccaggtctct

SEQ ID NO: 6508982 - DNA, 24 bp, Homo sapiens
tgcctcaccacacccaggtctctt

SEQ ID NO: 6508983 - DNA, 18 bp, Homo sapiens
tgcctcaccctcccaagt

SEQ ID NO: 6508984 - DNA, 18 bp, Homo sapiens
tgcctcactaatttttgt

SEQ ID NO: 6508985 - DNA, 18 bp, Homo sapiens
tgcctcactcctccgtga

SEQ ID NO: 6508986 - DNA, 20 bp, Homo sapiens
tgcctcactcctccgtgagc

SEQ ID NO: 6508987 - DNA, 15 bp, Homo sapiens
tgcctcactgggggc

SEQ ID NO: 6508988 - DNA, 20 bp, Homo sapiens
tgcctcactgggggctttgg

SEQ ID NO: 6508989 - DNA, 19 bp, Homo sapiens
tgcctcactgtgacctgct

SEQ ID NO: 6508990 - DNA, 14 bp, Homo sapiens
tgcctcactttctt

SEQ ID NO: 6508991 - DNA, 18 bp, Homo sapiens
tgcctcagaaaacaagga

SEQ ID NO: 6508992 - DNA, 17 bp, Homo sapiens
tgcctcagactccgccc

SEQ ID NO: 6508993 - DNA, 16 bp, Homo sapiens
tgcctcagagaccagg

SEQ ID NO: 6508994 - DNA, 21 bp, Homo sapiens
tgcctcagccagccctggagg

SEQ ID NO: 6508995 - DNA, 20 bp, Homo sapiens
tgcctcagccagtggcacag

SEQ ID NO: 6508996 - DNA, 15 bp, Homo sapiens
tgcctcagccctgac

SEQ ID NO: 6508997 - DNA, 19 bp, Homo sapiens
tgcctcagccctgaccctg

SEQ ID NO: 6508998 - DNA, 14 bp, Homo sapiens
tgcctcagcctccc

SEQ ID NO: 6508999 - DNA, 15 bp, Homo sapiens
tgcctcagcctcccg

SEQ ID NO: 6509000 - DNA, 18 bp, Homo sapiens
tgcctcagcctcccgagt

SEQ ID NO: 6509001 - DNA, 18 bp, Homo sapiens
tgcctcagcctccctggt

SEQ ID NO: 6509002 - DNA, 17 bp, Homo sapiens
tgcctcagcctcctgag

SEQ ID NO: 6509003 - DNA, 14 bp, Homo sapiens
tgcctcagccttcc

SEQ ID NO: 6509004 - DNA, 14 bp, Homo sapiens
tgcctcagcgctgc

SEQ ID NO: 6509005 - DNA, 17 bp, Homo sapiens
tgcctcagcgctgccca

SEQ ID NO: 6509006 - DNA, 18 bp, Homo sapiens
tgcctcagcgctgcccac

SEQ ID NO: 6509007 - DNA, 22 bp, Homo sapiens
tgcctcagcgctgcccacacca

SEQ ID NO: 6509008 - DNA, 17 bp, Homo sapiens
tgcctcagctgcatctg

SEQ ID NO: 6509009 - DNA, 20 bp, Homo sapiens
tgcctcagctgcatctgata

SEQ ID NO: 6509010 - DNA, 17 bp, Homo sapiens
tgcctcaggacccatcc

SEQ ID NO: 6509011 - DNA, 18 bp, Homo sapiens
tgcctcaggaccttttgg

SEQ ID NO: 6509012 - DNA, 18 bp, Homo sapiens
tgcctcaggaggcaggac

SEQ ID NO: 6509013 - DNA, 21 bp, Homo sapiens
tgcctcaggaggcaggacctt

SEQ ID NO: 6509014 - DNA, 13 bp, Homo sapiens
tgcctcaggcact

SEQ ID NO: 6509015 - DNA, 16 bp, Homo sapiens
tgcctcaggcactctc

SEQ ID NO: 6509016 - DNA, 22 bp, Homo sapiens
tgcctcaggccaagggaccagg

SEQ ID NO: 6509017 - DNA, 21 bp, Homo sapiens
tgcctcagtatatttaaactc

SEQ ID NO: 6509018 - DNA, 14 bp, Homo sapiens
tgcctcagtggcag

SEQ ID NO: 6509019 - DNA, 15 bp, Homo sapiens
tgcctcagtggcagc

SEQ ID NO: 6509020 - DNA, 19 bp, Homo sapiens
tgcctcagtggcagcatcc

SEQ ID NO: 6509021 - DNA, 14 bp, Homo sapiens
tgcctcagtttccc

SEQ ID NO: 6509022 - DNA, 16 bp, Homo sapiens
tgcctcagtttcccca

SEQ ID NO: 6509023 - DNA, 17 bp, Homo sapiens
tgcctcagtttccccat

SEQ ID NO: 6509024 - DNA, 16 bp, Homo sapiens
tgcctcagttttcctt

SEQ ID NO: 6509025 - DNA, 18 bp, Homo sapiens
tgcctcagttttccttct

SEQ ID NO: 6509026 - DNA, 18 bp, Homo sapiens
tgcctcataaattaatga

SEQ ID NO: 6509027 - DNA, 20 bp, Homo sapiens
tgcctcataaattaatgatt

SEQ ID NO: 6509028 - DNA, 21 bp, Homo sapiens
tgcctcatagcatagccagca

SEQ ID NO: 6509029 - DNA, 16 bp, Homo sapiens
tgcctcatcctcctcc

SEQ ID NO: 6509030 - DNA, 17 bp, Homo sapiens
tgcctcatcctcctcct

SEQ ID NO: 6509031 - DNA, 19 bp, Homo sapiens
tgcctcatcctcctcctca

SEQ ID NO: 6509032 - DNA, 20 bp, Homo sapiens
tgcctcatcctcctcctcat

SEQ ID NO: 6509033 - DNA, 23 bp, Homo sapiens
tgcctcatcctcctcctcattca

SEQ ID NO: 6509034 - DNA, 20 bp, Homo sapiens
tgcctcatctataacatgca

SEQ ID NO: 6509035 - DNA, 12 bp, Homo sapiens
tgcctcatgaac

SEQ ID NO: 6509036 - DNA, 15 bp, Homo sapiens
tgcctcatgaacact

SEQ ID NO: 6509037 - DNA, 23 bp, Homo sapiens
tgcctcatgaccctcctgtccag

SEQ ID NO: 6509038 - DNA, 23 bp, Homo sapiens
tgcctcatgcaaccgggccctct

SEQ ID NO: 6509039 - DNA, 15 bp, Homo sapiens
tgcctcatgccacac

SEQ ID NO: 6509040 - DNA, 14 bp, Homo sapiens
tgcctcatgctctc

SEQ ID NO: 6509041 - DNA, 15 bp, Homo sapiens
tgcctcatgctgact

SEQ ID NO: 6509042 - DNA, 21 bp, Homo sapiens
tgcctcatttcttcctctgca

SEQ ID NO: 6509043 - DNA, 21 bp, Homo sapiens
tgcctcattttagaaccacca

SEQ ID NO: 6509044 - DNA, 20 bp, Homo sapiens
tgcctcattttcacagcact

SEQ ID NO: 6509045 - DNA, 18 bp, Homo sapiens
tgcctcattttgcttccc

SEQ ID NO: 6509046 - DNA, 20 bp, Homo sapiens
tgcctcattttgcttcccat

SEQ ID NO: 6509047 - DNA, 21 bp, Homo sapiens
tgcctcatttttttccttgca

SEQ ID NO: 6509048 - DNA, 17 bp, Homo sapiens
tgcctccaagccattca

SEQ ID NO: 6509049 - DNA, 17 bp, Homo sapiens
tgcctccaagtcatggg

SEQ ID NO: 6509050 - DNA, 15 bp, Homo sapiens
tgcctccacatgctg

SEQ ID NO: 6509051 - DNA, 12 bp, Homo sapiens
tgcctccaccac

SEQ ID NO: 6509052 - DNA, 14 bp, Homo sapiens
tgcctccaccacca

SEQ ID NO: 6509053 - DNA, 15 bp, Homo sapiens
tgcctccaccaccac

SEQ ID NO: 6509054 - DNA, 19 bp, Homo sapiens
tgcctccaccaccactggc

SEQ ID NO: 6509055 - DNA, 20 bp, Homo sapiens
tgcctccaccaccactggcc

SEQ ID NO: 6509056 - DNA, 13 bp, Homo sapiens
tgcctccaccagc

SEQ ID NO: 6509057 - DNA, 18 bp, Homo sapiens
tgcctccacccgtcctcc

SEQ ID NO: 6509058 - DNA, 20 bp, Homo sapiens
tgcctccacccgtcctccct

SEQ ID NO: 6509059 - DNA, 15 bp, Homo sapiens
tgcctccaccctctg

SEQ ID NO: 6509060 - DNA, 11 bp, Homo sapiens
tgcctccaccg

SEQ ID NO: 6509061 - DNA, 22 bp, Homo sapiens
tgcctccaccgagccagcttgg

SEQ ID NO: 6509062 - DNA, 13 bp, Homo sapiens
tgcctccaccgct

SEQ ID NO: 6509063 - DNA, 17 bp, Homo sapiens
tgcctccaccgctgcct

SEQ ID NO: 6509064 - DNA, 13 bp, Homo sapiens
tgcctccactccc

SEQ ID NO: 6509065 - DNA, 14 bp, Homo sapiens
tgcctccactccca

SEQ ID NO: 6509066 - DNA, 15 bp, Homo sapiens
tgcctccactcccac

SEQ ID NO: 6509067 - DNA, 13 bp, Homo sapiens
tgcctccagccaa

SEQ ID NO: 6509068 - DNA, 21 bp, Homo sapiens
tgcctccagccaaacgggagc

SEQ ID NO: 6509069 - DNA, 14 bp, Homo sapiens
tgcctccagcctgg

SEQ ID NO: 6509070 - DNA, 17 bp, Homo sapiens
tgcctccaggaaccaca

SEQ ID NO: 6509071 - DNA, 20 bp, Homo sapiens
tgcctccaggaaccacacca

SEQ ID NO: 6509072 - DNA, 14 bp, Homo sapiens
tgcctccaggacca

SEQ ID NO: 6509073 - DNA, 15 bp, Homo sapiens
tgcctccaggaccag

SEQ ID NO: 6509074 - DNA, 15 bp, Homo sapiens
tgcctccagggctgg

SEQ ID NO: 6509075 - DNA, 16 bp, Homo sapiens
tgcctccagggctgga

SEQ ID NO: 6509076 - DNA, 20 bp, Homo sapiens
tgcctccagggctggactga

SEQ ID NO: 6509077 - DNA, 21 bp, Homo sapiens
tgcctccagggctggactgag

SEQ ID NO: 6509078 - DNA, 11 bp, Homo sapiens
tgcctccaggt

SEQ ID NO: 6509079 - DNA, 14 bp, Homo sapiens
tgcctccaggtgca

SEQ ID NO: 6509080 - DNA, 17 bp, Homo sapiens
tgcctccaggtgcagag

SEQ ID NO: 6509081 - DNA, 18 bp, Homo sapiens
tgcctccaggttgcctca

SEQ ID NO: 6509082 - DNA, 15 bp, Homo sapiens
tgcctccatggcagc

SEQ ID NO: 6509083 - DNA, 20 bp, Homo sapiens
tgcctccatggcagcagcca

SEQ ID NO: 6509084 - DNA, 20 bp, Homo sapiens
tgcctccatggtgcctctgg

SEQ ID NO: 6509085 - DNA, 20 bp, Homo sapiens
tgcctccattatccattccc

SEQ ID NO: 6509086 - DNA, 21 bp, Homo sapiens
tgcctcccaagctcagagcag

SEQ ID NO: 6509087 - DNA, 21 bp, Homo sapiens
tgcctcccacgctgggacaca

SEQ ID NO: 6509088 - DNA, 17 bp, Homo sapiens
tgcctcccacttcactg

SEQ ID NO: 6509089 - DNA, 19 bp, Homo sapiens
tgcctcccagccctgccag

SEQ ID NO: 6509090 - DNA, 22 bp, Homo sapiens
tgcctcccagccctgcccagag

SEQ ID NO: 6509091 - DNA, 12 bp, Homo sapiens
tgcctcccaggc

SEQ ID NO: 6509092 - DNA, 17 bp, Homo sapiens
tgcctcccaggcaagca

SEQ ID NO: 6509093 - DNA, 16 bp, Homo sapiens
tgcctcccaggctcaa

SEQ ID NO: 6509094 - DNA, 17 bp, Homo sapiens
tgcctcccagtggcctg

SEQ ID NO: 6509095 - DNA, 20 bp, Homo sapiens
tgcctcccagtggcctggct

SEQ ID NO: 6509096 - DNA, 13 bp, Homo sapiens
tgcctcccatgcc

SEQ ID NO: 6509097 - DNA, 20 bp, Homo sapiens
tgcctcccatgcctggtccc

SEQ ID NO: 6509098 - DNA, 16 bp, Homo sapiens
tgcctccccaaccctg

SEQ ID NO: 6509099 - DNA, 23 bp, Homo sapiens
tgcctccccaaccctgcccctgc

SEQ ID NO: 6509100 - DNA, 13 bp, Homo sapiens
tgcctccccaatc

SEQ ID NO: 6509101 - DNA, 15 bp, Homo sapiens
tgcctccccaatcca

SEQ ID NO: 6509102 - DNA, 16 bp, Homo sapiens
tgcctccccattcctt

SEQ ID NO: 6509103 - DNA, 15 bp, Homo sapiens
tgcctccccccagac

SEQ ID NO: 6509104 - DNA, 15 bp, Homo sapiens
tgcctcccccgaatg

SEQ ID NO: 6509105 - DNA, 18 bp, Homo sapiens
tgcctcccccgccacctg

SEQ ID NO: 6509106 - DNA, 22 bp, Homo sapiens
tgcctccccctcgactcccggt

SEQ ID NO: 6509107 - DNA, 12 bp, Homo sapiens
tgcctcccctcc

SEQ ID NO: 6509108 - DNA, 15 bp, Homo sapiens
tgcctcccctccgca

SEQ ID NO: 6509109 - DNA, 14 bp, Homo sapiens
tgcctcccctcctc

SEQ ID NO: 6509110 - DNA, 19 bp, Homo sapiens
tgcctcccctcctctcctg

SEQ ID NO: 6509111 - DNA, 18 bp, Homo sapiens
tgcctcccctctccttcc

SEQ ID NO: 6509112 - DNA, 19 bp, Homo sapiens
tgcctcccggctttgcagg

SEQ ID NO: 6509113 - DNA, 14 bp, Homo sapiens
tgcctccctagctt

SEQ ID NO: 6509114 - DNA, 16 bp, Homo sapiens
tgcctccctcaccctg

SEQ ID NO: 6509115 - DNA, 17 bp, Homo sapiens
tgcctccctcaccctga

SEQ ID NO: 6509116 - DNA, 17 bp, Homo sapiens
tgcctccctctcctcgg

SEQ ID NO: 6509117 - DNA, 16 bp, Homo sapiens
tgcctccctctcttcc

SEQ ID NO: 6509118 - DNA, 19 bp, Homo sapiens
tgcctccctctcttccggg

SEQ ID NO: 6509119 - DNA, 20 bp, Homo sapiens
tgcctccctgggccacctcc

SEQ ID NO: 6509120 - DNA, 13 bp, Homo sapiens
tgcctccctgtcc

SEQ ID NO: 6509121 - DNA, 17 bp, Homo sapiens
tgcctccctgtccaccc

SEQ ID NO: 6509122 - DNA, 12 bp, Homo sapiens
tgcctcccttcc

SEQ ID NO: 6509123 - DNA, 13 bp, Homo sapiens
tgcctcccttccc

SEQ ID NO: 6509124 - DNA, 14 bp, Homo sapiens
tgcctcccttccca

SEQ ID NO: 6509125 - DNA, 21 bp, Homo sapiens
tgcctcccttccgctgcgggc

SEQ ID NO: 6509126 - DNA, 13 bp, Homo sapiens
tgcctcccttcct

SEQ ID NO: 6509127 - DNA, 18 bp, Homo sapiens
tgcctcccttcctccgct

SEQ ID NO: 6509128 - DNA, 14 bp, Homo sapiens
tgcctccctttctg

SEQ ID NO: 6509129 - DNA, 15 bp, Homo sapiens
tgcctccctttctgg

SEQ ID NO: 6509130 - DNA, 17 bp, Homo sapiens
tgcctccctttctggga

SEQ ID NO: 6509131 - DNA, 19 bp, Homo sapiens
tgcctccgaggcctacctg

SEQ ID NO: 6509132 - DNA, 19 bp, Homo sapiens
tgcctccgctggctttggg

SEQ ID NO: 6509133 - DNA, 16 bp, Homo sapiens
tgcctccggccctgcc

SEQ ID NO: 6509134 - DNA, 19 bp, Homo sapiens
tgcctccggccctgcccca

SEQ ID NO: 6509135 - DNA, 15 bp, Homo sapiens
tgcctccggcctgca

SEQ ID NO: 6509136 - DNA, 16 bp, Homo sapiens
tgcctccggcctgcac

SEQ ID NO: 6509137 - DNA, 16 bp, Homo sapiens
tgcctccgggcctcgg

SEQ ID NO: 6509138 - DNA, 19 bp, Homo sapiens
tgcctccgggcctcggcct

SEQ ID NO: 6509139 - DNA, 19 bp, Homo sapiens
tgcctccgtcccctgccca

SEQ ID NO: 6509140 - DNA, 23 bp, Homo sapiens
tgcctccgtcccctgcccatgct

SEQ ID NO: 6509141 - DNA, 15 bp, Homo sapiens
tgcctcctactccag

SEQ ID NO: 6509142 - DNA, 23 bp, Homo sapiens
tgcctcctaggctggaagccatg

SEQ ID NO: 6509143 - DNA, 24 bp, Homo sapiens
tgcctcctcacccccagctttgct

SEQ ID NO: 6509144 - DNA, 13 bp, Homo sapiens
tgcctcctcagcc

SEQ ID NO: 6509145 - DNA, 13 bp, Homo sapiens
tgcctcctcagta

SEQ ID NO: 6509146 - DNA, 11 bp, Homo sapiens
tgcctcctcat

SEQ ID NO: 6509147 - DNA, 23 bp, Homo sapiens
tgcctcctccctcccagctgcac

SEQ ID NO: 6509148 - DNA, 19 bp, Homo sapiens
tgcctcctccctccctctc

SEQ ID NO: 6509149 - DNA, 13 bp, Homo sapiens
tgcctcctcctgc

SEQ ID NO: 6509150 - DNA, 15 bp, Homo sapiens
tgcctcctcctgccc

SEQ ID NO: 6509151 - DNA, 16 bp, Homo sapiens
tgcctcctcctgccct

SEQ ID NO: 6509152 - DNA, 17 bp, Homo sapiens
tgcctcctcctgccctc

SEQ ID NO: 6509153 - DNA, 19 bp, Homo sapiens
tgcctcctcctgccctccg

SEQ ID NO: 6509154 - DNA, 20 bp, Homo sapiens
tgcctcctccttcccaaagg

SEQ ID NO: 6509155 - DNA, 16 bp, Homo sapiens
tgcctcctcgttcctt

SEQ ID NO: 6509156 - DNA, 20 bp, Homo sapiens
tgcctcctctcctcctcagc

SEQ ID NO: 6509157 - DNA, 18 bp, Homo sapiens
tgcctcctctctccctgc

SEQ ID NO: 6509158 - DNA, 16 bp, Homo sapiens
tgcctcctctgtcctc

SEQ ID NO: 6509159 - DNA, 18 bp, Homo sapiens
tgtgcccccaaccatttc

SEQ ID NO: 6509160 - DNA, 17 bp, Homo sapiens
tgtgcccccacccccac

SEQ ID NO: 6509161 - DNA, 20 bp, Homo sapiens
tgtgcccccagcctcagccc

SEQ ID NO: 6509162 - DNA, 21 bp, Homo sapiens
tgtgcccccagcctcagccca

SEQ ID NO: 6509163 - DNA, 16 bp, Homo sapiens
tgtgcccccagggtcc

SEQ ID NO: 6509164 - DNA, 16 bp, Homo sapiens
tgtgccccccatcctg

SEQ ID NO: 6509165 - DNA, 23 bp, Homo sapiens
tgtgccccgaccccacctgaggc

SEQ ID NO: 6509166 - DNA, 16 bp, Homo sapiens
tgtgccccgcgggctt

SEQ ID NO: 6509167 - DNA, 19 bp, Homo sapiens
tgtgcccctaaagagcatc

SEQ ID NO: 6509168 - DNA, 23 bp, Homo sapiens
tgtgcccctaaagagcatcctga

SEQ ID NO: 6509169 - DNA, 13 bp, Homo sapiens
tgtgcccctgcca

SEQ ID NO: 6509170 - DNA, 17 bp, Homo sapiens
tgtgcccctgccaaggc

SEQ ID NO: 6509171 - DNA, 14 bp, Homo sapiens
tgtgcccctggccc

SEQ ID NO: 6509172 - DNA, 15 bp, Homo sapiens
tgtgcccctgtaaat

SEQ ID NO: 6509173 - DNA, 22 bp, Homo sapiens
tgtgcccgcctctccacgcact

SEQ ID NO: 6509174 - DNA, 18 bp, Homo sapiens
tgtgcccgctgcgctgcc

SEQ ID NO: 6509175 - DNA, 23 bp, Homo sapiens
tgtgcccgctgcgctgccctgca

SEQ ID NO: 6509176 - DNA, 14 bp, Homo sapiens
tgtgcccggtgcca

SEQ ID NO: 6509177 - DNA, 18 bp, Homo sapiens
tgtgccctcaccccaatc

SEQ ID NO: 6509178 - DNA, 13 bp, Homo sapiens
tgtgccctccctg

SEQ ID NO: 6509179 - DNA, 13 bp, Homo sapiens
tgtgccctcctga

SEQ ID NO: 6509180 - DNA, 17 bp, Homo sapiens
tgtgccctctgggctct

SEQ ID NO: 6509181 - DNA, 18 bp, Homo sapiens
tgtgccctctgggctctg

SEQ ID NO: 6509182 - DNA, 14 bp, Homo sapiens
tgtgccctcttgat

SEQ ID NO: 6509183 - DNA, 13 bp, Homo sapiens
tgtgccctggctc

SEQ ID NO: 6509184 - DNA, 14 bp, Homo sapiens
tgtgccctggctcc

SEQ ID NO: 6509185 - DNA, 13 bp, Homo sapiens
tgtgccctgggcc

SEQ ID NO: 6509186 - DNA, 19 bp, Homo sapiens
tgtgccctgggccaggcag

SEQ ID NO: 6509187 - DNA, 14 bp, Homo sapiens
tgtgccctgtgtgt

SEQ ID NO: 6509188 - DNA, 21 bp, Homo sapiens
tgtgcccttttataaggaaac

SEQ ID NO: 6509189 - DNA, 15 bp, Homo sapiens
tgtgccgaatgtgca

SEQ ID NO: 6509190 - DNA, 16 bp, Homo sapiens
tgtgccgggaggcagc

SEQ ID NO: 6509191 - DNA, 17 bp, Homo sapiens
tgtgccgtaattatgta

SEQ ID NO: 6509192 - DNA, 17 bp, Homo sapiens
tgtgccgtgaactgcgt

SEQ ID NO: 6509193 - DNA, 15 bp, Homo sapiens
tgtgcctaacaccag

SEQ ID NO: 6509194 - DNA, 16 bp, Homo sapiens
tgtgcctaacaccagc

SEQ ID NO: 6509195 - DNA, 17 bp, Homo sapiens
tgtgcctaatgtgtttg

SEQ ID NO: 6509196 - DNA, 16 bp, Homo sapiens
tgtgcctaattttcta

SEQ ID NO: 6509197 - DNA, 20 bp, Homo sapiens
tgtgcctatagtcccagcta

SEQ ID NO: 6509198 - DNA, 22 bp, Homo sapiens
tgtgcctattgctagagctcct

SEQ ID NO: 6509199 - DNA, 14 bp, Homo sapiens
tgtgcctcagcctc

SEQ ID NO: 6509200 - DNA, 14 bp, Homo sapiens
tgtgcctcaggcca

SEQ ID NO: 6509201 - DNA, 17 bp, Homo sapiens
tgtgcctcaggccaggg

SEQ ID NO: 6509202 - DNA, 19 bp, Homo sapiens
tgtgcctcaggccagggct

SEQ ID NO: 6509203 - DNA, 14 bp, Homo sapiens
tgtgcctcccaaaa

SEQ ID NO: 6509204 - DNA, 14 bp, Homo sapiens
tgtgcctcccagct

SEQ ID NO: 6509205 - DNA, 12 bp, Homo sapiens
tgtgcctccccc

SEQ ID NO: 6509206 - DNA, 15 bp, Homo sapiens
tgtgcctcccttccc

SEQ ID NO: 6509207 - DNA, 15 bp, Homo sapiens
tgtgcctcctagagt

SEQ ID NO: 6509208 - DNA, 12 bp, Homo sapiens
tgtgcctcctca

SEQ ID NO: 6509209 - DNA, 15 bp, Homo sapiens
tgtgcctcctcaccc

SEQ ID NO: 6509210 - DNA, 12 bp, Homo sapiens
tgtgcctcctgt

SEQ ID NO: 6509211 - DNA, 13 bp, Homo sapiens
tgtgcctcctgtg

SEQ ID NO: 6509212 - DNA, 22 bp, Homo sapiens
tgtgcctcctgtgtgtctgcag

SEQ ID NO: 6509213 - DNA, 21 bp, Homo sapiens
tgtgcctcgcatcctatgctt

SEQ ID NO: 6509214 - DNA, 16 bp, Homo sapiens
tgtgcctctagctgaa

SEQ ID NO: 6509215 - DNA, 18 bp, Homo sapiens
tgtgcctctagctgaatt

SEQ ID NO: 6509216 - DNA, 19 bp, Homo sapiens
tgtgcctctctctcccaac

SEQ ID NO: 6509217 - DNA, 18 bp, Homo sapiens
tgtgcctctgcccaagca

SEQ ID NO: 6509218 - DNA, 13 bp, Homo sapiens
tgtgcctctgcct

SEQ ID NO: 6509219 - DNA, 23 bp, Homo sapiens
tgtgcctctgcggggcagggcct

SEQ ID NO: 6509220 - DNA, 13 bp, Homo sapiens
tgtgcctctggga

SEQ ID NO: 6509221 - DNA, 17 bp, Homo sapiens
tgtgcctctgggactgg

SEQ ID NO: 6509222 - DNA, 16 bp, Homo sapiens
tgtgcctcttgggaga

SEQ ID NO: 6509223 - DNA, 15 bp, Homo sapiens
tgtgcctctttgtct

SEQ ID NO: 6509224 - DNA, 23 bp, Homo sapiens
tgtgcctgacaccacgctggagc

SEQ ID NO: 6509225 - DNA, 15 bp, Homo sapiens
tgtgcctgaccctac

SEQ ID NO: 6509226 - DNA, 19 bp, Homo sapiens
tgtgcctgaggctggctgg

SEQ ID NO: 6509227 - DNA, 16 bp, Homo sapiens
tgtgcctgcaccagga

SEQ ID NO: 6509228 - DNA, 20 bp, Homo sapiens
tgtgcctgccatgggccagc

SEQ ID NO: 6509229 - DNA, 13 bp, Homo sapiens
tgtgcctgccctg

SEQ ID NO: 6509230 - DNA, 18 bp, Homo sapiens
tgtgcctggagctcctgg

SEQ ID NO: 6509231 - DNA, 13 bp, Homo sapiens
tgtgcctggcccc

SEQ ID NO: 6509232 - DNA, 17 bp, Homo sapiens
tgtgcctggcctctgcc

SEQ ID NO: 6509233 - DNA, 15 bp, Homo sapiens
tgtgcctggctccct

SEQ ID NO: 6509234 - DNA, 13 bp, Homo sapiens
tgtgcctgggatc

SEQ ID NO: 6509235 - DNA, 13 bp, Homo sapiens
tgtgcctggggga

SEQ ID NO: 6509236 - DNA, 20 bp, Homo sapiens
tgtgcctggttaatattaat

SEQ ID NO: 6509237 - DNA, 22 bp, Homo sapiens
tgtgcctgtaatctttttctcc

SEQ ID NO: 6509238 - DNA, 18 bp, Homo sapiens
tgtgcctgtattcccagc

SEQ ID NO: 6509239 - DNA, 22 bp, Homo sapiens
tgtgcctgtcaggctctggccc

SEQ ID NO: 6509240 - DNA, 17 bp, Homo sapiens
tgtgcctgtctgtccaa

SEQ ID NO: 6509241 - DNA, 14 bp, Homo sapiens
tgtgcctgtgctcc

SEQ ID NO: 6509242 - DNA, 16 bp, Homo sapiens
tgtgcctgtgctcctg

SEQ ID NO: 6509243 - DNA, 18 bp, Homo sapiens
tgtgcctgtgctcctgcc

SEQ ID NO: 6509244 - DNA, 20 bp, Homo sapiens
tgtgcctgtgctcctgccca

SEQ ID NO: 6509245 - DNA, 22 bp, Homo sapiens
tgtgcctgtgctcctgcccagg

SEQ ID NO: 6509246 - DNA, 16 bp, Homo sapiens
tgtgcctgtgggaggg

SEQ ID NO: 6509247 - DNA, 20 bp, Homo sapiens
tgtgcctgtgggagggggag

SEQ ID NO: 6509248 - DNA, 13 bp, Homo sapiens
tgtgcctgtgttt

SEQ ID NO: 6509249 - DNA, 19 bp, Homo sapiens
tgtgcctgtgtttcatgtt

SEQ ID NO: 6509250 - DNA, 21 bp, Homo sapiens
tgtgcctgtgtttcatgttct

SEQ ID NO: 6509251 - DNA, 22 bp, Homo sapiens
tgtgccttaaaaatcaagacac

SEQ ID NO: 6509252 - DNA, 18 bp, Homo sapiens
tgtgccttaaaaggagag

SEQ ID NO: 6509253 - DNA, 15 bp, Homo sapiens
tgtgccttcagctgt

SEQ ID NO: 6509254 - DNA, 16 bp, Homo sapiens
tgtgccttcagctgtt

SEQ ID NO: 6509255 - DNA, 17 bp, Homo sapiens
tgtgccttcccttctct

SEQ ID NO: 6509256 - DNA, 21 bp, Homo sapiens
tgtgccttcccttctctggtc

SEQ ID NO: 6509257 - DNA, 17 bp, Homo sapiens
tgtgccttccctttcta

SEQ ID NO: 6509258 - DNA, 17 bp, Homo sapiens
tgtgccttgtaaataaa

SEQ ID NO: 6509259 - DNA, 12 bp, Homo sapiens
tgtgccttgtcc

SEQ ID NO: 6509260 - DNA, 19 bp, Homo sapiens
tgtgccttgtccaggaact

SEQ ID NO: 6509261 - DNA, 15 bp, Homo sapiens
tgtgcctttctttgc

SEQ ID NO: 6509262 - DNA, 20 bp, Homo sapiens
tgtgcctttctttgcctctg

SEQ ID NO: 6509263 - DNA, 13 bp, Homo sapiens
tgtgcctttggcc

SEQ ID NO: 6509264 - DNA, 16 bp, Homo sapiens
tgtgccttttatagct

SEQ ID NO: 6509265 - DNA, 18 bp, Homo sapiens
tgtgccttttatagctat

SEQ ID NO: 6509266 - DNA, 15 bp, Homo sapiens
tgtgccttttcccca

SEQ ID NO: 6509267 - DNA, 16 bp, Homo sapiens
tgtgcgaagcaagaag

SEQ ID NO: 6509268 - DNA, 17 bp, Homo sapiens
tgtgcgagggggccttg

SEQ ID NO: 6509269 - DNA, 17 bp, Homo sapiens
tgtgcgccggcgccccg

SEQ ID NO: 6509270 - DNA, 14 bp, Homo sapiens
tgtgcgctaaactt

SEQ ID NO: 6509271 - DNA, 15 bp, Homo sapiens
tgtgcgctgcctggc

SEQ ID NO: 6509272 - DNA, 17 bp, Homo sapiens
tgtgcgctgcctggcca

SEQ ID NO: 6509273 - DNA, 22 bp, Homo sapiens
tgtgcgctgcctggccaggccc

SEQ ID NO: 6509274 - DNA, 13 bp, Homo sapiens
tgtgcgctgctct

SEQ ID NO: 6509275 - DNA, 19 bp, Homo sapiens
tgtgcggcacaggaaacag

SEQ ID NO: 6509276 - DNA, 21 bp, Homo sapiens
tgtgcggctccagcccagccc

SEQ ID NO: 6509277 - DNA, 15 bp, Homo sapiens
tgtgcggctgtgtgt

SEQ ID NO: 6509278 - DNA, 17 bp, Homo sapiens
tgtgcggctgtgtgtgc

SEQ ID NO: 6509279 - DNA, 15 bp, Homo sapiens
tgtgcggtgcataca

SEQ ID NO: 6509280 - DNA, 16 bp, Homo sapiens
tgtgcgtcccagctga

SEQ ID NO: 6509281 - DNA, 17 bp, Homo sapiens
tgtgcgtggaaaaagac

SEQ ID NO: 6509282 - DNA, 16 bp, Homo sapiens
tgtgcgtggaagtgtt

SEQ ID NO: 6509283 - DNA, 17 bp, Homo sapiens
tgtgcgtggaagtgttc

SEQ ID NO: 6509284 - DNA, 19 bp, Homo sapiens
tgtgcgtggaagtgttcct

SEQ ID NO: 6509285 - DNA, 21 bp, Homo sapiens
tgtgcgtggtggtccctgggt

SEQ ID NO: 6509286 - DNA, 17 bp, Homo sapiens
tgtgcgtgtatatgtgc

SEQ ID NO: 6509287 - DNA, 14 bp, Homo sapiens
tgtgcgttcccttc

SEQ ID NO: 6509288 - DNA, 15 bp, Homo sapiens
tgtgcgttcccttca

SEQ ID NO: 6509289 - DNA, 22 bp, Homo sapiens
tgtgctaaacgtgtatgttttt

SEQ ID NO: 6509290 - DNA, 16 bp, Homo sapiens
tgtgctaaatcctagc

SEQ ID NO: 6509291 - DNA, 19 bp, Homo sapiens
tgtgctaacctcactgcct

SEQ ID NO: 6509292 - DNA, 22 bp, Homo sapiens
tgtgctaacctcactgcctcat

SEQ ID NO: 6509293 - DNA, 16 bp, Homo sapiens
tgtgctaagtctttcc

SEQ ID NO: 6509294 - DNA, 17 bp, Homo sapiens
tgtgctaatttctgtcc

SEQ ID NO: 6509295 - DNA, 22 bp, Homo sapiens
tgtgctacaattcattgtgtta

SEQ ID NO: 6509296 - DNA, 17 bp, Homo sapiens
tgtgctacagagaaaat

SEQ ID NO: 6509297 - DNA, 15 bp, Homo sapiens
tgtgctacctctaac

SEQ ID NO: 6509298 - DNA, 21 bp, Homo sapiens
tgtgctacctgggtccttttc

SEQ ID NO: 6509299 - DNA, 15 bp, Homo sapiens
tgtgctacgtgtgaa

SEQ ID NO: 6509300 - DNA, 20 bp, Homo sapiens
tgtgctacgtgtgaaatctg

SEQ ID NO: 6509301 - DNA, 13 bp, Homo sapiens
tgtgctactaaca

SEQ ID NO: 6509302 - DNA, 18 bp, Homo sapiens
tgtgctactaacagatta

SEQ ID NO: 6509303 - DNA, 22 bp, Homo sapiens
tgtgctacttagtaaaaattga

SEQ ID NO: 6509304 - DNA, 16 bp, Homo sapiens
tgtgctactttgcctt

SEQ ID NO: 6509305 - DNA, 13 bp, Homo sapiens
tgtgctagaacaa

SEQ ID NO: 6509306 - DNA, 16 bp, Homo sapiens
tgtgctagaatacttt

SEQ ID NO: 6509307 - DNA, 22 bp, Homo sapiens
tgtgctagtcactggcagcctg

SEQ ID NO: 6509308 - DNA, 21 bp, Homo sapiens
tgtgctataaaattaacagta

SEQ ID NO: 6509309 - DNA, 17 bp, Homo sapiens
tgtgctatacacacaca

SEQ ID NO: 6509310 - DNA, 20 bp, Homo sapiens
tgtgctatactgcatacttt

SEQ ID NO: 6509311 - DNA, 20 bp, Homo sapiens
tgtgctatatttttaaagaa

SEQ ID NO: 6509312 - DNA, 15 bp, Homo sapiens
tgtgctatcaatgag

SEQ ID NO: 6509313 - DNA, 15 bp, Homo sapiens
tgtgctatgaatttt

SEQ ID NO: 6509314 - DNA, 18 bp, Homo sapiens
tgtgctattaatatttgt

SEQ ID NO: 6509315 - DNA, 21 bp, Homo sapiens
tgtgctattcgtaagttctgt

SEQ ID NO: 6509316 - DNA, 14 bp, Homo sapiens
tgtgctatttaatt

SEQ ID NO: 6509317 - DNA, 21 bp, Homo sapiens
tgtgctcaaaaatgagagtga

SEQ ID NO: 6509318 - DNA, 19 bp, Homo sapiens
tgtgctcacaatgttctgg

SEQ ID NO: 6509319 - DNA, 18 bp, Homo sapiens
tgtgctcagaagaggaaa

SEQ ID NO: 6509320 - DNA, 14 bp, Homo sapiens
tgtgctcagaatta

SEQ ID NO: 6509321 - DNA, 12 bp, Homo sapiens
tgtgctcagaga

SEQ ID NO: 6509322 - DNA, 14 bp, Homo sapiens
tgtgctcagataca

SEQ ID NO: 6509323 - DNA, 14 bp, Homo sapiens
tgtgctcagccaaa

SEQ ID NO: 6509324 - DNA, 16 bp, Homo sapiens
tgtgctcagccccaga

SEQ ID NO: 6509325 - DNA, 20 bp, Homo sapiens
tgtgctcaggagccctggga

SEQ ID NO: 6509326 - DNA, 21 bp, Homo sapiens
tgtgctcaggagccctgggag

SEQ ID NO: 6509327 - DNA, 19 bp, Homo sapiens
tgtgctcagtcgccctgtt

SEQ ID NO: 6509328 - DNA, 16 bp, Homo sapiens
tgtgctcatcagaaac

SEQ ID NO: 6509329 - DNA, 14 bp, Homo sapiens
tgtgctcatgtgtg

SEQ ID NO: 6509330 - DNA, 15 bp, Homo sapiens
tgtgctcatttaagt

SEQ ID NO: 6509331 - DNA, 16 bp, Homo sapiens
tgtgctccaaatgtct

SEQ ID NO: 6509332 - DNA, 18 bp, Homo sapiens
tgtgctccacactcagaa

SEQ ID NO: 6509333 - DNA, 18 bp, Homo sapiens
tgtgctccagcagtgctg

SEQ ID NO: 6509334 - DNA, 20 bp, Homo sapiens
tgtgctccagcagtgctggg

SEQ ID NO: 6509335 - DNA, 23 bp, Homo sapiens
tgtgctccagcagtgctgggccc

SEQ ID NO: 6509336 - DNA, 17 bp, Homo sapiens
tgtgctccatagagcag

SEQ ID NO: 6509337 - DNA, 22 bp, Homo sapiens
tgtgctccatatttgatttcta

SEQ ID NO: 6509338 - DNA, 14 bp, Homo sapiens
tgtgctcccacggg

SEQ ID NO: 6509339 - DNA, 17 bp, Homo sapiens
tgcctcctctgtcctca

SEQ ID NO: 6509340 - DNA, 14 bp, Homo sapiens
tgcctcctgaggct

SEQ ID NO: 6509341 - DNA, 10 bp, Homo sapiens
tgcctcctgc

SEQ ID NO: 6509342 - DNA, 22 bp, Homo sapiens
tgcctcctgcagtttgggagac

SEQ ID NO: 6509343 - DNA, 20 bp, Homo sapiens
tgcctcctgccaccccttcc

SEQ ID NO: 6509344 - DNA, 21 bp, Homo sapiens
tgcctcctgccggctccttgg

SEQ ID NO: 6509345 - DNA, 15 bp, Homo sapiens
tgcctcctgcctccc

SEQ ID NO: 6509346 - DNA, 17 bp, Homo sapiens
tgcctcctgcgccctgt

SEQ ID NO: 6509347 - DNA, 13 bp, Homo sapiens
tgcctcctgctct

SEQ ID NO: 6509348 - DNA, 22 bp, Homo sapiens
tgcctcctggccaagcaggctg

SEQ ID NO: 6509349 - DNA, 13 bp, Homo sapiens
tgcctcctggccg

SEQ ID NO: 6509350 - DNA, 13 bp, Homo sapiens
tgcctcctgggaa

SEQ ID NO: 6509351 - DNA, 13 bp, Homo sapiens
tgcctcctgggac

SEQ ID NO: 6509352 - DNA, 17 bp, Homo sapiens
tgcctcctgggaccatg

SEQ ID NO: 6509353 - DNA, 15 bp, Homo sapiens
tgcctcctggtttcc

SEQ ID NO: 6509354 - DNA, 22 bp, Homo sapiens
tgcctcctggtttcctttctca

SEQ ID NO: 6509355 - DNA, 11 bp, Homo sapiens
tgcctcctgtc

SEQ ID NO: 6509356 - DNA, 12 bp, Homo sapiens
tgcctcctgtct

SEQ ID NO: 6509357 - DNA, 13 bp, Homo sapiens
tgcctcctgtggg

SEQ ID NO: 6509358 - DNA, 14 bp, Homo sapiens
tgcctcctgtgtac

SEQ ID NO: 6509359 - DNA, 20 bp, Homo sapiens
tgcctcctgtgtactgtgtc

SEQ ID NO: 6509360 - DNA, 14 bp, Homo sapiens
tgcctcctgtgtgt

SEQ ID NO: 6509361 - DNA, 19 bp, Homo sapiens
tgcctcctgtgtgtctgca

SEQ ID NO: 6509362 - DNA, 18 bp, Homo sapiens
tgcctcctgttctgccca

SEQ ID NO: 6509363 - DNA, 14 bp, Homo sapiens
tgcctcctgttttc

SEQ ID NO: 6509364 - DNA, 22 bp, Homo sapiens
tgcctcctgttttctccctctc

SEQ ID NO: 6509365 - DNA, 17 bp, Homo sapiens
tgcctccttcagtgaca

SEQ ID NO: 6509366 - DNA, 19 bp, Homo sapiens
tgcctccttccacctccct

SEQ ID NO: 6509367 - DNA, 12 bp, Homo sapiens
tgcctccttgaa

SEQ ID NO: 6509368 - DNA, 18 bp, Homo sapiens
tgcctccttgaaagaaag

SEQ ID NO: 6509369 - DNA, 22 bp, Homo sapiens
tgcctccttgatatttgtattt

SEQ ID NO: 6509370 - DNA, 19 bp, Homo sapiens
tgcctccttgccagcccca

SEQ ID NO: 6509371 - DNA, 22 bp, Homo sapiens
tgcctccttggccaccagacca

SEQ ID NO: 6509372 - DNA, 13 bp, Homo sapiens
tgcctcgaaacac

SEQ ID NO: 6509373 - DNA, 17 bp, Homo sapiens
tgcctcgaaacacagaa

SEQ ID NO: 6509374 - DNA, 14 bp, Homo sapiens
tgcctcgaggcacc

SEQ ID NO: 6509375 - DNA, 17 bp, Homo sapiens
tgcctcgagggccgcct

SEQ ID NO: 6509376 - DNA, 19 bp, Homo sapiens
tgcctcgagtccccccacc

SEQ ID NO: 6509377 - DNA, 22 bp, Homo sapiens
tgcctcgagtccccccacccct

SEQ ID NO: 6509378 - DNA, 23 bp, Homo sapiens
tgcctcgagtccccccacccctc

SEQ ID NO: 6509379 - DNA, 24 bp, Homo sapiens
tgcctcgagtccccccacccctcc

SEQ ID NO: 6509380 - DNA, 14 bp, Homo sapiens
tgcctcgcatccta

SEQ ID NO: 6509381 - DNA, 19 bp, Homo sapiens
tgcctcgcatcctatgctt

SEQ ID NO: 6509382 - DNA, 21 bp, Homo sapiens
tgcctcgcccccacttttcta

SEQ ID NO: 6509383 - DNA, 14 bp, Homo sapiens
tgcctcgccttgtg

SEQ ID NO: 6509384 - DNA, 13 bp, Homo sapiens
tgcctcggctcct

SEQ ID NO: 6509385 - DNA, 22 bp, Homo sapiens
tgcctcggctcctgctgcacca

SEQ ID NO: 6509386 - DNA, 20 bp, Homo sapiens
tgcctcggcttttctcagct

SEQ ID NO: 6509387 - DNA, 23 bp, Homo sapiens
tgcctcgggaacctcactcttgc

SEQ ID NO: 6509388 - DNA, 24 bp, Homo sapiens
tgcctcgggaacctcactcttgcc

SEQ ID NO: 6509389 - DNA, 15 bp, Homo sapiens
tgcctcggtggccct

SEQ ID NO: 6509390 - DNA, 20 bp, Homo sapiens
tgcctcggttgattgtgcat

SEQ ID NO: 6509391 - DNA, 22 bp, Homo sapiens
tgcctcgtagagtgacctcgga

SEQ ID NO: 6509392 - DNA, 17 bp, Homo sapiens
tgcctcgtgggttcttc

SEQ ID NO: 6509393 - DNA, 19 bp, Homo sapiens
tgcctcgtgggttcttcct

SEQ ID NO: 6509394 - DNA, 21 bp, Homo sapiens
tgcctctaactccctcctcac

SEQ ID NO: 6509395 - DNA, 21 bp, Homo sapiens
tgcctctacacaggggccctg

SEQ ID NO: 6509396 - DNA, 17 bp, Homo sapiens
tgcctctacctgacact

SEQ ID NO: 6509397 - DNA, 23 bp, Homo sapiens
tgcctctacctgacactcccttg

SEQ ID NO: 6509398 - DNA, 20 bp, Homo sapiens
tgcctctactttgattctga

SEQ ID NO: 6509399 - DNA, 18 bp, Homo sapiens
tgcctctagtccccaagg

SEQ ID NO: 6509400 - DNA, 21 bp, Homo sapiens
tgcctctagtccccaaggcct

SEQ ID NO: 6509401 - DNA, 22 bp, Homo sapiens
tgcctctagtccccaaggcctc

SEQ ID NO: 6509402 - DNA, 17 bp, Homo sapiens
tgcctctatccctggcc

SEQ ID NO: 6509403 - DNA, 14 bp, Homo sapiens
tgcctctatgccct

SEQ ID NO: 6509404 - DNA, 19 bp, Homo sapiens
tgcctctatgccctgcaga

SEQ ID NO: 6509405 - DNA, 22 bp, Homo sapiens
tgcctctatgccctgcagagca

SEQ ID NO: 6509406 - DNA, 16 bp, Homo sapiens
tgcctctatttttgtt

SEQ ID NO: 6509407 - DNA, 17 bp, Homo sapiens
tgcctctcacagctgag

SEQ ID NO: 6509408 - DNA, 21 bp, Homo sapiens
tgcctctcacagctgagttgt

SEQ ID NO: 6509409 - DNA, 21 bp, Homo sapiens
tgcctctcatcaactgaatga

SEQ ID NO: 6509410 - DNA, 14 bp, Homo sapiens
tgcctctccaggca

SEQ ID NO: 6509411 - DNA, 16 bp, Homo sapiens
tgcctctcccaggcag

SEQ ID NO: 6509412 - DNA, 17 bp, Homo sapiens
tgcctctcccaggcagg

SEQ ID NO: 6509413 - DNA, 16 bp, Homo sapiens
tgcctctcccaggctg

SEQ ID NO: 6509414 - DNA, 18 bp, Homo sapiens
tgcctctccctgggtctg

SEQ ID NO: 6509415 - DNA, 15 bp, Homo sapiens
tgcctctccgcccct

SEQ ID NO: 6509416 - DNA, 22 bp, Homo sapiens
tgcctctccgcccctgagccca

SEQ ID NO: 6509417 - DNA, 15 bp, Homo sapiens
tgcctctcctcagga

SEQ ID NO: 6509418 - DNA, 12 bp, Homo sapiens
tgcctctctaca

SEQ ID NO: 6509419 - DNA, 15 bp, Homo sapiens
tgcctctctaggacc

SEQ ID NO: 6509420 - DNA, 17 bp, Homo sapiens
tgcctctctcaggccaa

SEQ ID NO: 6509421 - DNA, 16 bp, Homo sapiens
tgcctctctgcaggtc

SEQ ID NO: 6509422 - DNA, 23 bp, Homo sapiens
tgcctctctgcaggtccctaata

SEQ ID NO: 6509423 - DNA, 18 bp, Homo sapiens
tgcctctctgccagccgc

SEQ ID NO: 6509424 - DNA, 20 bp, Homo sapiens
tgcctctctgccagccgctg

SEQ ID NO: 6509425 - DNA, 15 bp, Homo sapiens
tgcctctctgctcca

SEQ ID NO: 6509426 - DNA, 17 bp, Homo sapiens
tgcctctctgctccaga

SEQ ID NO: 6509427 - DNA, 18 bp, Homo sapiens
tgcctctctgctccagag

SEQ ID NO: 6509428 - DNA, 13 bp, Homo sapiens
tgcctctctgttt

SEQ ID NO: 6509429 - DNA, 19 bp, Homo sapiens
tgcctctcttcttcccctt

SEQ ID NO: 6509430 - DNA, 19 bp, Homo sapiens
tgcctctgaaacagaaagt

SEQ ID NO: 6509431 - DNA, 20 bp, Homo sapiens
tgcctctgaactgctgctgg

SEQ ID NO: 6509432 - DNA, 17 bp, Homo sapiens
tgcctctgaccccagca

SEQ ID NO: 6509433 - DNA, 11 bp, Homo sapiens
tgcctctgagg

SEQ ID NO: 6509434 - DNA, 16 bp, Homo sapiens
tgcctctgaggccagc

SEQ ID NO: 6509435 - DNA, 21 bp, Homo sapiens
tgcctctgaggccagcctggc

SEQ ID NO: 6509436 - DNA, 22 bp, Homo sapiens
tgcctctgaggccagcctggcc

SEQ ID NO: 6509437 - DNA, 23 bp, Homo sapiens
tgcctctgagttttgatgctgta

SEQ ID NO: 6509438 - DNA, 22 bp, Homo sapiens
tgcctctgatgtattttgtgag

SEQ ID NO: 6509439 - DNA, 18 bp, Homo sapiens
tgcctctgattttctcca

SEQ ID NO: 6509440 - DNA, 20 bp, Homo sapiens
tgcctctgattttctccaca

SEQ ID NO: 6509441 - DNA, 23 bp, Homo sapiens
tgcctctgcacgtgcacacacct

SEQ ID NO: 6509442 - DNA, 13 bp, Homo sapiens
tgcctctgcagtc

SEQ ID NO: 6509443 - DNA, 15 bp, Homo sapiens
tgcctctgcagtctc

SEQ ID NO: 6509444 - DNA, 21 bp, Homo sapiens
tgcctctgcagtctcatttct

SEQ ID NO: 6509445 - DNA, 21 bp, Homo sapiens
tgcctctgccaaaggatgtga

SEQ ID NO: 6509446 - DNA, 12 bp, Homo sapiens
tgcctctgccac

SEQ ID NO: 6509447 - DNA, 13 bp, Homo sapiens
tgcctctgccaca

SEQ ID NO: 6509448 - DNA, 16 bp, Homo sapiens
tgcctctgccacactc

SEQ ID NO: 6509449 - DNA, 11 bp, Homo sapiens
tgcctctgcct

SEQ ID NO: 6509450 - DNA, 16 bp, Homo sapiens
tgcctctgcctcccaa

SEQ ID NO: 6509451 - DNA, 13 bp, Homo sapiens
tgcctctgctccc

SEQ ID NO: 6509452 - DNA, 18 bp, Homo sapiens
tgcctctggaggcctctg

SEQ ID NO: 6509453 - DNA, 23 bp, Homo sapiens
tgcctctggaggcctctggccct

SEQ ID NO: 6509454 - DNA, 20 bp, Homo sapiens
tgcctctggaggcctctggg

SEQ ID NO: 6509455 - DNA, 21 bp, Homo sapiens
tgcctctggctctacacatat

SEQ ID NO: 6509456 - DNA, 12 bp, Homo sapiens
tgcctctgggca

SEQ ID NO: 6509457 - DNA, 13 bp, Homo sapiens
tgcctctgggcag

SEQ ID NO: 6509458 - DNA, 14 bp, Homo sapiens
tgcctctgggcagc

SEQ ID NO: 6509459 - DNA, 16 bp, Homo sapiens
tgcctctgggcagcct

SEQ ID NO: 6509460 - DNA, 14 bp, Homo sapiens
tgcctctgggccat

SEQ ID NO: 6509461 - DNA, 13 bp, Homo sapiens
tgcctctgggtga

SEQ ID NO: 6509462 - DNA, 19 bp, Homo sapiens
tgcctctgggtgagtggct

SEQ ID NO: 6509463 - DNA, 23 bp, Homo sapiens
tgcctctgggtgagtggctgaca

SEQ ID NO: 6509464 - DNA, 10 bp, Homo sapiens
tgcctctgtc

SEQ ID NO: 6509465 - DNA, 17 bp, Homo sapiens
tgcctctgtccccttct

SEQ ID NO: 6509466 - DNA, 21 bp, Homo sapiens
tgcctctgtccccttctctca

SEQ ID NO: 6509467 - DNA, 12 bp, Homo sapiens
tgcctctgtcct

SEQ ID NO: 6509468 - DNA, 15 bp, Homo sapiens
tgcctctgtcctccc

SEQ ID NO: 6509469 - DNA, 21 bp, Homo sapiens
tgcctctgtctagcatgccaa

SEQ ID NO: 6509470 - DNA, 16 bp, Homo sapiens
tgcctctgtcttaaag

SEQ ID NO: 6509471 - DNA, 11 bp, Homo sapiens
tgcctctgtgc

SEQ ID NO: 6509472 - DNA, 20 bp, Homo sapiens
tgcctctgtgcacagtggct

SEQ ID NO: 6509473 - DNA, 14 bp, Homo sapiens
tgcctctgtgctgt

SEQ ID NO: 6509474 - DNA, 19 bp, Homo sapiens
tgcctctgtgtagccgccc

SEQ ID NO: 6509475 - DNA, 19 bp, Homo sapiens
tgcctcttaaattatatat

SEQ ID NO: 6509476 - DNA, 15 bp, Homo sapiens
tgcctcttagacttc

SEQ ID NO: 6509477 - DNA, 16 bp, Homo sapiens
tgcctcttccagtgaa

SEQ ID NO: 6509478 - DNA, 23 bp, Homo sapiens
tgcctcttccccctgcttccacc

SEQ ID NO: 6509479 - DNA, 17 bp, Homo sapiens
tgcctcttctacctctt

SEQ ID NO: 6509480 - DNA, 21 bp, Homo sapiens
tgcctcttctctactctaggg

SEQ ID NO: 6509481 - DNA, 20 bp, Homo sapiens
tgcctcttctcttgacagtc

SEQ ID NO: 6509482 - DNA, 21 bp, Homo sapiens
tgcctcttctcttgacagtct

SEQ ID NO: 6509483 - DNA, 16 bp, Homo sapiens
tgcctcttctgggagg

SEQ ID NO: 6509484 - DNA, 21 bp, Homo sapiens
tgcctcttctgggagggcagc

SEQ ID NO: 6509485 - DNA, 13 bp, Homo sapiens
tgcctcttggctt

SEQ ID NO: 6509486 - DNA, 21 bp, Homo sapiens
tgcctcttgtctgagggacat

SEQ ID NO: 6509487 - DNA, 15 bp, Homo sapiens
tgcctctttaaatta

SEQ ID NO: 6509488 - DNA, 17 bp, Homo sapiens
tgcctctttccctagga

SEQ ID NO: 6509489 - DNA, 20 bp, Homo sapiens
tgcctctttcctcctcatga

SEQ ID NO: 6509490 - DNA, 14 bp, Homo sapiens
tgcctctttcctgt

SEQ ID NO: 6509491 - DNA, 18 bp, Homo sapiens
tgcctctttgctgctttg

SEQ ID NO: 6509492 - DNA, 14 bp, Homo sapiens
tgcctcttttcaca

SEQ ID NO: 6509493 - DNA, 19 bp, Homo sapiens
tgcctcttttccccatgaa

SEQ ID NO: 6509494 - DNA, 15 bp, Homo sapiens
tgcctgaaatgttac

SEQ ID NO: 6509495 - DNA, 16 bp, Homo sapiens
tgcctgaacagccctc

SEQ ID NO: 6509496 - DNA, 14 bp, Homo sapiens
tgcctgaacatcct

SEQ ID NO: 6509497 - DNA, 21 bp, Homo sapiens
tgcctgaacatccttccttcc

SEQ ID NO: 6509498 - DNA, 16 bp, Homo sapiens
tgcctgaaccttccat

SEQ ID NO: 6509499 - DNA, 15 bp, Homo sapiens
tgcctgaagacccca

SEQ ID NO: 6509500 - DNA, 14 bp, Homo sapiens
tgcctgaagagagg

SEQ ID NO: 6509501 - DNA, 17 bp, Homo sapiens
tgcctgaataaagagcc

SEQ ID NO: 6509502 - DNA, 15 bp, Homo sapiens
tgcctgaatatttgt

SEQ ID NO: 6509503 - DNA, 19 bp, Homo sapiens
tgcctgaatccacctgcag

SEQ ID NO: 6509504 - DNA, 22 bp, Homo sapiens
tgcctgaatccatcaggacttg

SEQ ID NO: 6509505 - DNA, 19 bp, Homo sapiens
tgcctgacaattatgaaaa

SEQ ID NO: 6509506 - DNA, 20 bp, Homo sapiens
tgcctgacaattatgaaaaa

SEQ ID NO: 6509507 - DNA, 22 bp, Homo sapiens
tgcctgacaattatgaaaaaat

SEQ ID NO: 6509508 - DNA, 16 bp, Homo sapiens
tgcctgacacactaac

SEQ ID NO: 6509509 - DNA, 22 bp, Homo sapiens
tgcctgacaccacgctggagct

SEQ ID NO: 6509510 - DNA, 19 bp, Homo sapiens
tgcctgacactgagcccca

SEQ ID NO: 6509511 - DNA, 15 bp, Homo sapiens
tgcctgacagcatcc

SEQ ID NO: 6509512 - DNA, 14 bp, Homo sapiens
tgcctgacagcctt

SEQ ID NO: 6509513 - DNA, 20 bp, Homo sapiens
tgcctgacagccttccccag

SEQ ID NO: 6509514 - DNA, 21 bp, Homo sapiens
tgcctgacagccttccccagc

SEQ ID NO: 6509515 - DNA, 16 bp, Homo sapiens
tgcctgacaggctgtg

SEQ ID NO: 6509516 - DNA, 20 bp, Homo sapiens
tgcctgaccatcccatgagc

SEQ ID NO: 6509517 - DNA, 16 bp, Homo sapiens
tgtgctcccacgggga

SEQ ID NO: 6509518 - DNA, 23 bp, Homo sapiens
tgtgctcccctgccacactgatg

SEQ ID NO: 6509519 - DNA, 17 bp, Homo sapiens
tgtgctccgtagcttct

SEQ ID NO: 6509520 - DNA, 20 bp, Homo sapiens
tgtgctccgtgcctccacca

SEQ ID NO: 6509521 - DNA, 20 bp, Homo sapiens
tgtgctcctcttgattcctg

SEQ ID NO: 6509522 - DNA, 15 bp, Homo sapiens
tgtgctcggacacag

SEQ ID NO: 6509523 - DNA, 15 bp, Homo sapiens
tgtgctctattacca

SEQ ID NO: 6509524 - DNA, 16 bp, Homo sapiens
tgtgctctcaccagct

SEQ ID NO: 6509525 - DNA, 19 bp, Homo sapiens
tgtgctctccaagcccagt

SEQ ID NO: 6509526 - DNA, 12 bp, Homo sapiens
tgtgctctcccc

SEQ ID NO: 6509527 - DNA, 21 bp, Homo sapiens
tgtgctctccccggcaggcct

SEQ ID NO: 6509528 - DNA, 13 bp, Homo sapiens
tgtgctctcctag

SEQ ID NO: 6509529 - DNA, 16 bp, Homo sapiens
tgtgctctggacaggc

SEQ ID NO: 6509530 - DNA, 19 bp, Homo sapiens
tgtgctctggacaggcatg

SEQ ID NO: 6509531 - DNA, 16 bp, Homo sapiens
tgtgctctgtacctgt

SEQ ID NO: 6509532 - DNA, 19 bp, Homo sapiens
tgtgctctgttttgacata

SEQ ID NO: 6509533 - DNA, 21 bp, Homo sapiens
tgtgctcttatccccagctgt

SEQ ID NO: 6509534 - DNA, 17 bp, Homo sapiens
tgtgctcttcctctggt

SEQ ID NO: 6509535 - DNA, 19 bp, Homo sapiens
tgtgctcttgttttgtctt

SEQ ID NO: 6509536 - DNA, 19 bp, Homo sapiens
tgtgctctttcctgccctt

SEQ ID NO: 6509537 - DNA, 15 bp, Homo sapiens
tgtgctctttgaaga

SEQ ID NO: 6509538 - DNA, 20 bp, Homo sapiens
tgtgctctttgttcatcatt

SEQ ID NO: 6509539 - DNA, 20 bp, Homo sapiens
tgtgctctttttttaaaagg

SEQ ID NO: 6509540 - DNA, 22 bp, Homo sapiens
tgtgctgacaacttagctcagg

SEQ ID NO: 6509541 - DNA, 22 bp, Homo sapiens
tgtgctgagaatagtgtctgat

SEQ ID NO: 6509542 - DNA, 17 bp, Homo sapiens
tgtgctgagcctgccca

SEQ ID NO: 6509543 - DNA, 16 bp, Homo sapiens
tgtgctgaggtgggcc

SEQ ID NO: 6509544 - DNA, 23 bp, Homo sapiens
tgtgctgaggtgggccttccatg

SEQ ID NO: 6509545 - DNA, 18 bp, Homo sapiens
tgtgctgagtctgaaggc

SEQ ID NO: 6509546 - DNA, 20 bp, Homo sapiens
tgtgctgattcaataaaatg

SEQ ID NO: 6509547 - DNA, 18 bp, Homo sapiens
tgtgctgcatcccaccag

SEQ ID NO: 6509548 - DNA, 23 bp, Homo sapiens
tgtgctgccatttgatttttcta

SEQ ID NO: 6509549 - DNA, 18 bp, Homo sapiens
tgtgctgccctgaagaat

SEQ ID NO: 6509550 - DNA, 13 bp, Homo sapiens
tgtgctgccctgc

SEQ ID NO: 6509551 - DNA, 21 bp, Homo sapiens
tgtgctgccctgcccacctgg

SEQ ID NO: 6509552 - DNA, 20 bp, Homo sapiens
tgtgctgcgcctgcaggcag

SEQ ID NO: 6509553 - DNA, 20 bp, Homo sapiens
tgtgctgctcgcgaaggtcc

SEQ ID NO: 6509554 - DNA, 13 bp, Homo sapiens
tgtgctgctgagt

SEQ ID NO: 6509555 - DNA, 16 bp, Homo sapiens
tgtgctgctgctgcta

SEQ ID NO: 6509556 - DNA, 17 bp, Homo sapiens
tgtgctgctgctgctat

SEQ ID NO: 6509557 - DNA, 18 bp, Homo sapiens
tgtgctgctgctgctatt

SEQ ID NO: 6509558 - DNA, 14 bp, Homo sapiens
tgtgctgctgggaa

SEQ ID NO: 6509559 - DNA, 14 bp, Homo sapiens
tgtgctgctgttct

SEQ ID NO: 6509560 - DNA, 19 bp, Homo sapiens
tgtgctgctgttctgtgta

SEQ ID NO: 6509561 - DNA, 20 bp, Homo sapiens
tgtgctggaattccacaggg

SEQ ID NO: 6509562 - DNA, 17 bp, Homo sapiens
tgtgctggaccagctgg

SEQ ID NO: 6509563 - DNA, 14 bp, Homo sapiens
tgtgctggagccac

SEQ ID NO: 6509564 - DNA, 15 bp, Homo sapiens
tgtgctggaggactg

SEQ ID NO: 6509565 - DNA, 16 bp, Homo sapiens
tgtgctggaggggtgg

SEQ ID NO: 6509566 - DNA, 19 bp, Homo sapiens
tgtgctggatggagcccag

SEQ ID NO: 6509567 - DNA, 18 bp, Homo sapiens
tgtgctgggagaaatact

SEQ ID NO: 6509568 - DNA, 12 bp, Homo sapiens
tgtgctgggagc

SEQ ID NO: 6509569 - DNA, 21 bp, Homo sapiens
tgtgctgggagctccactctg

SEQ ID NO: 6509570 - DNA, 13 bp, Homo sapiens
tgtgctgggccag

SEQ ID NO: 6509571 - DNA, 16 bp, Homo sapiens
tgtgctgggtcccagc

SEQ ID NO: 6509572 - DNA, 19 bp, Homo sapiens
tgtgctgggtcccagcctg

SEQ ID NO: 6509573 - DNA, 17 bp, Homo sapiens
tgtgctgggtgagctct

SEQ ID NO: 6509574 - DNA, 22 bp, Homo sapiens
tgtgctgggtgagctcttccag

SEQ ID NO: 6509575 - DNA, 19 bp, Homo sapiens
tgtgctggtctctaggcct

SEQ ID NO: 6509576 - DNA, 20 bp, Homo sapiens
tgtgctggtgaacactgtga

SEQ ID NO: 6509577 - DNA, 21 bp, Homo sapiens
tgtgctggtgaacactgtgac

SEQ ID NO: 6509578 - DNA, 20 bp, Homo sapiens
tgtgctggtgtatgtgtgaa

SEQ ID NO: 6509579 - DNA, 19 bp, Homo sapiens
tgtgctggtgtcctgacca

SEQ ID NO: 6509580 - DNA, 15 bp, Homo sapiens
tgtgctggttctgtt

SEQ ID NO: 6509581 - DNA, 17 bp, Homo sapiens
tgtgctgtcagcctccc

SEQ ID NO: 6509582 - DNA, 12 bp, Homo sapiens
tgtgctgtgcac

SEQ ID NO: 6509583 - DNA, 17 bp, Homo sapiens
tgtgctgtgcacccgtg

SEQ ID NO: 6509584 - DNA, 14 bp, Homo sapiens
tgtgctgtgcctgc

SEQ ID NO: 6509585 - DNA, 21 bp, Homo sapiens
tgtgctgtgcctgctagagca

SEQ ID NO: 6509586 - DNA, 17 bp, Homo sapiens
tgtgctgtggaagcaac

SEQ ID NO: 6509587 - DNA, 15 bp, Homo sapiens
tgtgctgtggagaga

SEQ ID NO: 6509588 - DNA, 20 bp, Homo sapiens
tgtgctgtggggctggtagc

SEQ ID NO: 6509589 - DNA, 14 bp, Homo sapiens
tgtgctgtgtaaag

SEQ ID NO: 6509590 - DNA, 15 bp, Homo sapiens
tgtgctgtgtaaagt

SEQ ID NO: 6509591 - DNA, 20 bp, Homo sapiens
tgtgctgtgtgacattggga

SEQ ID NO: 6509592 - DNA, 12 bp, Homo sapiens
tgtgctgtgtgt

SEQ ID NO: 6509593 - DNA, 15 bp, Homo sapiens
tgtgctgtgtgtgac

SEQ ID NO: 6509594 - DNA, 22 bp, Homo sapiens
tgtgctgtgtttaatcagggga

SEQ ID NO: 6509595 - DNA, 15 bp, Homo sapiens
tgtgctgtgtttgct

SEQ ID NO: 6509596 - DNA, 20 bp, Homo sapiens
tgtgctgtgtttgctcccct

SEQ ID NO: 6509597 - DNA, 20 bp, Homo sapiens
tgtgctgttgttatgatgtg

SEQ ID NO: 6509598 - DNA, 16 bp, Homo sapiens
tgtgctgtttgaaaat

SEQ ID NO: 6509599 - DNA, 23 bp, Homo sapiens
tgtgctgtttgcttgtagttgaa

SEQ ID NO: 6509600 - DNA, 19 bp, Homo sapiens
tgtgcttaacagggaacgt

SEQ ID NO: 6509601 - DNA, 17 bp, Homo sapiens
tgtgcttaataatacca

SEQ ID NO: 6509602 - DNA, 13 bp, Homo sapiens
tgtgcttacagta

SEQ ID NO: 6509603 - DNA, 23 bp, Homo sapiens
tgtgcttacagtaactaattttg

SEQ ID NO: 6509604 - DNA, 14 bp, Homo sapiens
tgtgcttacagtga

SEQ ID NO: 6509605 - DNA, 17 bp, Homo sapiens
tgtgcttacagtgactg

SEQ ID NO: 6509606 - DNA, 14 bp, Homo sapiens
tgtgcttacctgtg

SEQ ID NO: 6509607 - DNA, 13 bp, Homo sapiens
tgtgcttatattc

SEQ ID NO: 6509608 - DNA, 22 bp, Homo sapiens
tgtgcttatgtatgaggtacaa

SEQ ID NO: 6509609 - DNA, 18 bp, Homo sapiens
tgtgcttcacacaaagtg

SEQ ID NO: 6509610 - DNA, 15 bp, Homo sapiens
tgtgcttcacagtag

SEQ ID NO: 6509611 - DNA, 14 bp, Homo sapiens
tgtgcttcatctgt

SEQ ID NO: 6509612 - DNA, 16 bp, Homo sapiens
tgtgcttcgactactg

SEQ ID NO: 6509613 - DNA, 17 bp, Homo sapiens
tgtgcttcgactactgc

SEQ ID NO: 6509614 - DNA, 21 bp, Homo sapiens
tgtgcttctaatatttattgc

SEQ ID NO: 6509615 - DNA, 20 bp, Homo sapiens
tgtgcttctcagttgcagaa

SEQ ID NO: 6509616 - DNA, 20 bp, Homo sapiens
tgtgcttctccccagaattc

SEQ ID NO: 6509617 - DNA, 13 bp, Homo sapiens
tgtgcttgaagat

SEQ ID NO: 6509618 - DNA, 14 bp, Homo sapiens
tgtgcttgctccta

SEQ ID NO: 6509619 - DNA, 16 bp, Homo sapiens
tgtgcttggaggcctc

SEQ ID NO: 6509620 - DNA, 19 bp, Homo sapiens
tgtgcttggaggcctcaga

SEQ ID NO: 6509621 - DNA, 13 bp, Homo sapiens
tgtgcttgtgcct

SEQ ID NO: 6509622 - DNA, 20 bp, Homo sapiens
tgtgcttgtgcctacctggc

SEQ ID NO: 6509623 - DNA, 14 bp, Homo sapiens
tgtgcttgtgtgta

SEQ ID NO: 6509624 - DNA, 17 bp, Homo sapiens
tgtgcttgtgtgtatgt

SEQ ID NO: 6509625 - DNA, 14 bp, Homo sapiens
tgtgctttataaaa

SEQ ID NO: 6509626 - DNA, 13 bp, Homo sapiens
tgtgctttatgct

SEQ ID NO: 6509627 - DNA, 21 bp, Homo sapiens
tgtgctttattgaattagaaa

SEQ ID NO: 6509628 - DNA, 13 bp, Homo sapiens
tgtgctttcaaga

SEQ ID NO: 6509629 - DNA, 14 bp, Homo sapiens
tgtgctttcaagat

SEQ ID NO: 6509630 - DNA, 12 bp, Homo sapiens
tgtgctttcatc

SEQ ID NO: 6509631 - DNA, 13 bp, Homo sapiens
tgtgctttcatgt

SEQ ID NO: 6509632 - DNA, 12 bp, Homo sapiens
tgtgctttcctg

SEQ ID NO: 6509633 - DNA, 11 bp, Homo sapiens
tgtgctttcta

SEQ ID NO: 6509634 - DNA, 13 bp, Homo sapiens
tgtgctttctagc

SEQ ID NO: 6509635 - DNA, 14 bp, Homo sapiens
tgtgctttgaaaaa

SEQ ID NO: 6509636 - DNA, 14 bp, Homo sapiens
tgtgctttgagaag

SEQ ID NO: 6509637 - DNA, 17 bp, Homo sapiens
tgtgctttgcattccta

SEQ ID NO: 6509638 - DNA, 13 bp, Homo sapiens
tgtgctttggaac

SEQ ID NO: 6509639 - DNA, 22 bp, Homo sapiens
tgtgctttgtaagatccacccc

SEQ ID NO: 6509640 - DNA, 20 bp, Homo sapiens
tgtgctttgtatcagtcagt

SEQ ID NO: 6509641 - DNA, 12 bp, Homo sapiens
tgtgcttttcca

SEQ ID NO: 6509642 - DNA, 20 bp, Homo sapiens
tgtgcttttccatctaaaat

SEQ ID NO: 6509643 - DNA, 14 bp, Homo sapiens
tgtgcttttcctat

SEQ ID NO: 6509644 - DNA, 16 bp, Homo sapiens
tgtgcttttcctattt

SEQ ID NO: 6509645 - DNA, 14 bp, Homo sapiens
tgtgcttttcctga

SEQ ID NO: 6509646 - DNA, 15 bp, Homo sapiens
tgtgctttttaagaa

SEQ ID NO: 6509647 - DNA, 21 bp, Homo sapiens
tgtgctttttaagaatatttt

SEQ ID NO: 6509648 - DNA, 23 bp, Homo sapiens
tgtgctttttgtcatgttatgca

SEQ ID NO: 6509649 - DNA, 22 bp, Homo sapiens
tgtgcttttttgattttgctga

SEQ ID NO: 6509650 - DNA, 18 bp, Homo sapiens
tgtggaaaaatagctctg

SEQ ID NO: 6509651 - DNA, 16 bp, Homo sapiens
tgtggaaaaatgagag

SEQ ID NO: 6509652 - DNA, 19 bp, Homo sapiens
tgtggaaaaatgagagaag

SEQ ID NO: 6509653 - DNA, 12 bp, Homo sapiens
tgtggaaaacaa

SEQ ID NO: 6509654 - DNA, 22 bp, Homo sapiens
tgtggaaaacaatttgcataat

SEQ ID NO: 6509655 - DNA, 22 bp, Homo sapiens
tgtggaaaacacaataaaaaat

SEQ ID NO: 6509656 - DNA, 20 bp, Homo sapiens
tgtggaaaacatcctgactt

SEQ ID NO: 6509657 - DNA, 15 bp, Homo sapiens
tgtggaaaagaaaca

SEQ ID NO: 6509658 - DNA, 20 bp, Homo sapiens
tgtggaaaagaaacacgcac

SEQ ID NO: 6509659 - DNA, 21 bp, Homo sapiens
tgtggaaaagccaagaggctg

SEQ ID NO: 6509660 - DNA, 22 bp, Homo sapiens
tgtggaaaagccatctcaggtt

SEQ ID NO: 6509661 - DNA, 17 bp, Homo sapiens
tgtggaaaatgaaaatt

SEQ ID NO: 6509662 - DNA, 12 bp, Homo sapiens
tgtggaaacagc

SEQ ID NO: 6509663 - DNA, 15 bp, Homo sapiens
tgtggaaacagctgg

SEQ ID NO: 6509664 - DNA, 19 bp, Homo sapiens
tgtggaaacagctggtact

SEQ ID NO: 6509665 - DNA, 18 bp, Homo sapiens
tgtggaaacctccacagg

SEQ ID NO: 6509666 - DNA, 17 bp, Homo sapiens
tgtggaaacgcagttgt

SEQ ID NO: 6509667 - DNA, 17 bp, Homo sapiens
tgtggaaagcacttttt

SEQ ID NO: 6509668 - DNA, 19 bp, Homo sapiens
tgtggaaagtgaatttgaa

SEQ ID NO: 6509669 - DNA, 12 bp, Homo sapiens
tgtggaaagtgt

SEQ ID NO: 6509670 - DNA, 20 bp, Homo sapiens
tgtggaaagtgtaaagcatt

SEQ ID NO: 6509671 - DNA, 21 bp, Homo sapiens
tgtggaaagtgtaaagcattc

SEQ ID NO: 6509672 - DNA, 17 bp, Homo sapiens
tgtggaaatatgcaacc

SEQ ID NO: 6509673 - DNA, 19 bp, Homo sapiens
tgtggaaattaagaagaaa

SEQ ID NO: 6509674 - DNA, 16 bp, Homo sapiens
tgtggaacataaaaag

SEQ ID NO: 6509675 - DNA, 15 bp, Homo sapiens
tgtggaacccagcag

SEQ ID NO: 6509676 - DNA, 22 bp, Homo sapiens
tgtggaactaataaatacatac

SEQ ID NO: 6509677 - DNA, 15 bp, Homo sapiens
tgtggaactgccacc

SEQ ID NO: 6509678 - DNA, 15 bp, Homo sapiens
tgtggaactgctgcc

SEQ ID NO: 6509679 - DNA, 18 bp, Homo sapiens
tgtggaactgctgccact

SEQ ID NO: 6509680 - DNA, 22 bp, Homo sapiens
tgtggaactgctgccactgagg

SEQ ID NO: 6509681 - DNA, 19 bp, Homo sapiens
tgtggaagaaaatggttta

SEQ ID NO: 6509682 - DNA, 15 bp, Homo sapiens
tgtggaagcatggct

SEQ ID NO: 6509683 - DNA, 19 bp, Homo sapiens
tgtggaaggcaagccaggc

SEQ ID NO: 6509684 - DNA, 18 bp, Homo sapiens
tgtggaaggcctccctct

SEQ ID NO: 6509685 - DNA, 19 bp, Homo sapiens
tgtggaagggaccaagcga

SEQ ID NO: 6509686 - DNA, 20 bp, Homo sapiens
tgtggaagggccaatggaga

SEQ ID NO: 6509687 - DNA, 22 bp, Homo sapiens
tgtggaagggccaatggagaaa

SEQ ID NO: 6509688 - DNA, 20 bp, Homo sapiens
tgtggaagtcagtacgatca

SEQ ID NO: 6509689 - DNA, 18 bp, Homo sapiens
tgtggaatataaatagct

SEQ ID NO: 6509690 - DNA, 16 bp, Homo sapiens
tgtggaatgagtgtgc

SEQ ID NO: 6509691 - DNA, 17 bp, Homo sapiens
tgtggaatgatgtatat

SEQ ID NO: 6509692 - DNA, 13 bp, Homo sapiens
tgtggacacagct

SEQ ID NO: 6509693 - DNA, 14 bp, Homo sapiens
tgtggacacagctc

SEQ ID NO: 6509694 - DNA, 16 bp, Homo sapiens
tgtggacacagctctt

SEQ ID NO: 6509695 - DNA, 19 bp, Homo sapiens
tgtggacacagctcttctc

SEQ ID NO: 6509696 - DNA, 17 bp, Homo sapiens
tgcctgacccatccctt

SEQ ID NO: 6509697 - DNA, 15 bp, Homo sapiens
tgcctgaccccttca

SEQ ID NO: 6509698 - DNA, 21 bp, Homo sapiens
tgcctgaccccttgctccctt

SEQ ID NO: 6509699 - DNA, 16 bp, Homo sapiens
tgcctgactaaaatgt

SEQ ID NO: 6509700 - DNA, 22 bp, Homo sapiens
tgcctgactaattttgtatttt

SEQ ID NO: 6509701 - DNA, 20 bp, Homo sapiens
tgcctgactaatttttgtat

SEQ ID NO: 6509702 - DNA, 22 bp, Homo sapiens
tgcctgactaatttttgtattt

SEQ ID NO: 6509703 - DNA, 16 bp, Homo sapiens
tgcctgactcctgggt

SEQ ID NO: 6509704 - DNA, 21 bp, Homo sapiens
tgcctgagaagaagtggctgc

SEQ ID NO: 6509705 - DNA, 22 bp, Homo sapiens
tgcctgagaagaagtggctgcc

SEQ ID NO: 6509706 - DNA, 23 bp, Homo sapiens
tgcctgagaatgcctaggccagc

SEQ ID NO: 6509707 - DNA, 18 bp, Homo sapiens
tgcctgagaccagggtgg

SEQ ID NO: 6509708 - DNA, 19 bp, Homo sapiens
tgcctgagaccagggtggc

SEQ ID NO: 6509709 - DNA, 13 bp, Homo sapiens
tgcctgagaggca

SEQ ID NO: 6509710 - DNA, 15 bp, Homo sapiens
tgcctgagaggcagg

SEQ ID NO: 6509711 - DNA, 16 bp, Homo sapiens
tgcctgagaggcaggc

SEQ ID NO: 6509712 - DNA, 17 bp, Homo sapiens
tgcctgagaggcaggca

SEQ ID NO: 6509713 - DNA, 19 bp, Homo sapiens
tgcctgagaggcaggcata

SEQ ID NO: 6509714 - DNA, 12 bp, Homo sapiens
tgcctgagattc

SEQ ID NO: 6509715 - DNA, 22 bp, Homo sapiens
tgcctgagcacctcccagcccc

SEQ ID NO: 6509716 - DNA, 13 bp, Homo sapiens
tgcctgagcccct

SEQ ID NO: 6509717 - DNA, 15 bp, Homo sapiens
tgcctgagcccctca

SEQ ID NO: 6509718 - DNA, 17 bp, Homo sapiens
tgcctgagcccctcaga

SEQ ID NO: 6509719 - DNA, 12 bp, Homo sapiens
tgcctgagcccg

SEQ ID NO: 6509720 - DNA, 14 bp, Homo sapiens
tgcctgagcccgaa

SEQ ID NO: 6509721 - DNA, 17 bp, Homo sapiens
tgcctgagctggggaag

SEQ ID NO: 6509722 - DNA, 20 bp, Homo sapiens
tgcctgagctggggcctgga

SEQ ID NO: 6509723 - DNA, 23 bp, Homo sapiens
tgcctgagctggggcctggagag

SEQ ID NO: 6509724 - DNA, 15 bp, Homo sapiens
tgcctgaggctcaag

SEQ ID NO: 6509725 - DNA, 21 bp, Homo sapiens
tgcctgaggctcaagaggccc

SEQ ID NO: 6509726 - DNA, 22 bp, Homo sapiens
tgcctgaggctcaagaggccca

SEQ ID NO: 6509727 - DNA, 14 bp, Homo sapiens
tgcctgaggctggc

SEQ ID NO: 6509728 - DNA, 15 bp, Homo sapiens
tgcctgaggctggct

SEQ ID NO: 6509729 - DNA, 15 bp, Homo sapiens
tgcctgagggcccct

SEQ ID NO: 6509730 - DNA, 16 bp, Homo sapiens
tgcctgagggcccctc

SEQ ID NO: 6509731 - DNA, 17 bp, Homo sapiens
tgcctgagggcccctct

SEQ ID NO: 6509732 - DNA, 20 bp, Homo sapiens
tgcctgagggcccctctgcc

SEQ ID NO: 6509733 - DNA, 21 bp, Homo sapiens
tgcctgagggcccctctgccc

SEQ ID NO: 6509734 - DNA, 22 bp, Homo sapiens
tgcctgagggcccctctgccca

SEQ ID NO: 6509735 - DNA, 23 bp, Homo sapiens
tgcctgagggcccctctgcccag

SEQ ID NO: 6509736 - DNA, 19 bp, Homo sapiens
tgcctgagggcgaggggag

SEQ ID NO: 6509737 - DNA, 15 bp, Homo sapiens
tgcctgaggggcagc

SEQ ID NO: 6509738 - DNA, 16 bp, Homo sapiens
tgcctgaggggcagcc

SEQ ID NO: 6509739 - DNA, 12 bp, Homo sapiens
tgcctgagggtg

SEQ ID NO: 6509740 - DNA, 14 bp, Homo sapiens
tgcctgagggtgga

SEQ ID NO: 6509741 - DNA, 13 bp, Homo sapiens
tgcctgaggtccg

SEQ ID NO: 6509742 - DNA, 20 bp, Homo sapiens
tgcctgagtggcctgtagtc

SEQ ID NO: 6509743 - DNA, 17 bp, Homo sapiens
tgcctgagttataaata

SEQ ID NO: 6509744 - DNA, 18 bp, Homo sapiens
tgcctgatcctccaacag

SEQ ID NO: 6509745 - DNA, 23 bp, Homo sapiens
tgcctgatgggagtaggctccag

SEQ ID NO: 6509746 - DNA, 16 bp, Homo sapiens
tgcctgattcatagta

SEQ ID NO: 6509747 - DNA, 15 bp, Homo sapiens
tgcctgattgccaag

SEQ ID NO: 6509748 - DNA, 20 bp, Homo sapiens
tgcctgatttcattcctcga

SEQ ID NO: 6509749 - DNA, 16 bp, Homo sapiens
tgcctgcaaacctgct

SEQ ID NO: 6509750 - DNA, 23 bp, Homo sapiens
tgcctgcaaacctgctggtgggg

SEQ ID NO: 6509751 - DNA, 22 bp, Homo sapiens
tgcctgcaactttttgccttct

SEQ ID NO: 6509752 - DNA, 17 bp, Homo sapiens
tgcctgcacaaactcac

SEQ ID NO: 6509753 - DNA, 14 bp, Homo sapiens
tgcctgcaccagga

SEQ ID NO: 6509754 - DNA, 15 bp, Homo sapiens
tgcctgcaccaggag

SEQ ID NO: 6509755 - DNA, 19 bp, Homo sapiens
tgcctgcaccaggagacag

SEQ ID NO: 6509756 - DNA, 15 bp, Homo sapiens
tgcctgcacccttcc

SEQ ID NO: 6509757 - DNA, 16 bp, Homo sapiens
tgcctgcacccttccc

SEQ ID NO: 6509758 - DNA, 20 bp, Homo sapiens
tgcctgcacccttccctctt

SEQ ID NO: 6509759 - DNA, 22 bp, Homo sapiens
tgcctgcacccttccctcttcc

SEQ ID NO: 6509760 - DNA, 15 bp, Homo sapiens
tgcctgcactgggaa

SEQ ID NO: 6509761 - DNA, 21 bp, Homo sapiens
tgcctgcactgggaaggaaac

SEQ ID NO: 6509762 - DNA, 17 bp, Homo sapiens
tgcctgcagcacatgcg

SEQ ID NO: 6509763 - DNA, 14 bp, Homo sapiens
tgcctgcagcaggc

SEQ ID NO: 6509764 - DNA, 17 bp, Homo sapiens
tgcctgcagccagggct

SEQ ID NO: 6509765 - DNA, 12 bp, Homo sapiens
tgcctgcagctg

SEQ ID NO: 6509766 - DNA, 21 bp, Homo sapiens
tgcctgcaggtcagttgtaat

SEQ ID NO: 6509767 - DNA, 14 bp, Homo sapiens
tgcctgcagtttct

SEQ ID NO: 6509768 - DNA, 21 bp, Homo sapiens
tgcctgcatgagctggcaacc

SEQ ID NO: 6509769 - DNA, 13 bp, Homo sapiens
tgcctgcattctg

SEQ ID NO: 6509770 - DNA, 11 bp, Homo sapiens
tgcctgccact

SEQ ID NO: 6509771 - DNA, 17 bp, Homo sapiens
tgcctgccactctctgg

SEQ ID NO: 6509772 - DNA, 19 bp, Homo sapiens
tgcctgccactctctggga

SEQ ID NO: 6509773 - DNA, 15 bp, Homo sapiens
tgcctgccagggccc

SEQ ID NO: 6509774 - DNA, 11 bp, Homo sapiens
tgcctgccata

SEQ ID NO: 6509775 - DNA, 16 bp, Homo sapiens
tgcctgccatggctgt

SEQ ID NO: 6509776 - DNA, 18 bp, Homo sapiens
tgcctgccatggctgtga

SEQ ID NO: 6509777 - DNA, 20 bp, Homo sapiens
tgcctgccatgggccagcct

SEQ ID NO: 6509778 - DNA, 17 bp, Homo sapiens
tgcctgccatgtgtgag

SEQ ID NO: 6509779 - DNA, 15 bp, Homo sapiens
tgcctgcccacccgt

SEQ ID NO: 6509780 - DNA, 13 bp, Homo sapiens
tgcctgcccaggc

SEQ ID NO: 6509781 - DNA, 16 bp, Homo sapiens
tgcctgcccaggcccc

SEQ ID NO: 6509782 - DNA, 24 bp, Homo sapiens
tgcctgcccaggcccctgccaccc

SEQ ID NO: 6509783 - DNA, 17 bp, Homo sapiens
tgcctgcccccacaccc

SEQ ID NO: 6509784 - DNA, 17 bp, Homo sapiens
tgcctgccccgccccca

SEQ ID NO: 6509785 - DNA, 17 bp, Homo sapiens
tgcctgcccctgctgct

SEQ ID NO: 6509786 - DNA, 20 bp, Homo sapiens
tgcctgcccgcacagcagcc

SEQ ID NO: 6509787 - DNA, 22 bp, Homo sapiens
tgcctgcccgcacagcagcctg

SEQ ID NO: 6509788 - DNA, 18 bp, Homo sapiens
tgcctgcccgcaccctgg

SEQ ID NO: 6509789 - DNA, 22 bp, Homo sapiens
tgcctgcccgcaccctggcctg

SEQ ID NO: 6509790 - DNA, 15 bp, Homo sapiens
tgcctgccctattct

SEQ ID NO: 6509791 - DNA, 11 bp, Homo sapiens
tgcctgccctc

SEQ ID NO: 6509792 - DNA, 23 bp, Homo sapiens
tgcctgccctgcctcagccaggc

SEQ ID NO: 6509793 - DNA, 15 bp, Homo sapiens
tgcctgccctggtga

SEQ ID NO: 6509794 - DNA, 23 bp, Homo sapiens
tgcctgccctgtcaggaggcaga

SEQ ID NO: 6509795 - DNA, 15 bp, Homo sapiens
tgcctgccgctgcac

SEQ ID NO: 6509796 - DNA, 19 bp, Homo sapiens
tgcctgcctcatgctctct

SEQ ID NO: 6509797 - DNA, 15 bp, Homo sapiens
tgcctgcctccaccc

SEQ ID NO: 6509798 - DNA, 16 bp, Homo sapiens
tgcctgcctccacccg

SEQ ID NO: 6509799 - DNA, 13 bp, Homo sapiens
tgcctgcctccgg

SEQ ID NO: 6509800 - DNA, 16 bp, Homo sapiens
tgcctgcctcctaggc

SEQ ID NO: 6509801 - DNA, 19 bp, Homo sapiens
tgcctgcctctgccatgcc

SEQ ID NO: 6509802 - DNA, 14 bp, Homo sapiens
tgcctgcctgtctg

SEQ ID NO: 6509803 - DNA, 11 bp, Homo sapiens
tgcctgcctta

SEQ ID NO: 6509804 - DNA, 11 bp, Homo sapiens
tgcctgccttc

SEQ ID NO: 6509805 - DNA, 12 bp, Homo sapiens
tgcctgccttct

SEQ ID NO: 6509806 - DNA, 20 bp, Homo sapiens
tgcctgccttctcccctcca

SEQ ID NO: 6509807 - DNA, 14 bp, Homo sapiens
tgcctgcgcccacc

SEQ ID NO: 6509808 - DNA, 18 bp, Homo sapiens
tgcctgcgcctgctgcct

SEQ ID NO: 6509809 - DNA, 19 bp, Homo sapiens
tgcctgcgcctgctgcctg

SEQ ID NO: 6509810 - DNA, 17 bp, Homo sapiens
tgcctgcggtcaaggcc

SEQ ID NO: 6509811 - DNA, 17 bp, Homo sapiens
tgcctgcgtcttccgcc

SEQ ID NO: 6509812 - DNA, 18 bp, Homo sapiens
tgcctgctcagcagccag

SEQ ID NO: 6509813 - DNA, 13 bp, Homo sapiens
tgcctgctccatc

SEQ ID NO: 6509814 - DNA, 13 bp, Homo sapiens
tgcctgctccctg

SEQ ID NO: 6509815 - DNA, 20 bp, Homo sapiens
tgcctgctccctgtctgtgt

SEQ ID NO: 6509816 - DNA, 23 bp, Homo sapiens
tgcctgctctccttgccctgggc

SEQ ID NO: 6509817 - DNA, 15 bp, Homo sapiens
tgcctgctctgcagc

SEQ ID NO: 6509818 - DNA, 17 bp, Homo sapiens
tgcctgctctgcagccc

SEQ ID NO: 6509819 - DNA, 10 bp, Homo sapiens
tgcctgctga

SEQ ID NO: 6509820 - DNA, 14 bp, Homo sapiens
tgcctgctgaccat

SEQ ID NO: 6509821 - DNA, 15 bp, Homo sapiens
tgcctgctgagagag

SEQ ID NO: 6509822 - DNA, 13 bp, Homo sapiens
tgcctgctgagct

SEQ ID NO: 6509823 - DNA, 12 bp, Homo sapiens
tgcctgctgctg

SEQ ID NO: 6509824 - DNA, 15 bp, Homo sapiens
tgcctgctgggcact

SEQ ID NO: 6509825 - DNA, 17 bp, Homo sapiens
tgcctgctgggcactgg

SEQ ID NO: 6509826 - DNA, 15 bp, Homo sapiens
tgcctgctgggctct

SEQ ID NO: 6509827 - DNA, 16 bp, Homo sapiens
tgcctgctgggctctt

SEQ ID NO: 6509828 - DNA, 13 bp, Homo sapiens
tgcctgctgggga

SEQ ID NO: 6509829 - DNA, 13 bp, Homo sapiens
tgcctgctgtatt

SEQ ID NO: 6509830 - DNA, 14 bp, Homo sapiens
tgcctgctgtattt

SEQ ID NO: 6509831 - DNA, 13 bp, Homo sapiens
tgcctgctgtgga

SEQ ID NO: 6509832 - DNA, 20 bp, Homo sapiens
tgcctgctgttggtcctctc

SEQ ID NO: 6509833 - DNA, 12 bp, Homo sapiens
tgcctgcttcag

SEQ ID NO: 6509834 - DNA, 12 bp, Homo sapiens
tgcctgcttcct

SEQ ID NO: 6509835 - DNA, 13 bp, Homo sapiens
tgcctgcttctgt

SEQ ID NO: 6509836 - DNA, 16 bp, Homo sapiens
tgcctgcttctttcca

SEQ ID NO: 6509837 - DNA, 22 bp, Homo sapiens
tgcctgcttggggggtgatgag

SEQ ID NO: 6509838 - DNA, 14 bp, Homo sapiens
tgcctgctttagaa

SEQ ID NO: 6509839 - DNA, 17 bp, Homo sapiens
tgcctgctttctccaag

SEQ ID NO: 6509840 - DNA, 20 bp, Homo sapiens
tgcctgctttgacgggccag

SEQ ID NO: 6509841 - DNA, 23 bp, Homo sapiens
tgcctgcttttcactgctgcaag

SEQ ID NO: 6509842 - DNA, 16 bp, Homo sapiens
tgcctgcttttgatga

SEQ ID NO: 6509843 - DNA, 19 bp, Homo sapiens
tgcctgcttttgatgatgt

SEQ ID NO: 6509844 - DNA, 17 bp, Homo sapiens
tgcctgctttttggaaa

SEQ ID NO: 6509845 - DNA, 16 bp, Homo sapiens
tgcctggaaagtcctc

SEQ ID NO: 6509846 - DNA, 18 bp, Homo sapiens
tgcctggaacaccagcag

SEQ ID NO: 6509847 - DNA, 23 bp, Homo sapiens
tgcctggaacaccagcagcactg

SEQ ID NO: 6509848 - DNA, 12 bp, Homo sapiens
tgcctggactga

SEQ ID NO: 6509849 - DNA, 14 bp, Homo sapiens
tgcctggactgacc

SEQ ID NO: 6509850 - DNA, 15 bp, Homo sapiens
tgcctggactgacca

SEQ ID NO: 6509851 - DNA, 22 bp, Homo sapiens
tgcctggagaaaggatggcagc

SEQ ID NO: 6509852 - DNA, 23 bp, Homo sapiens
tgcctggagaaaggatggcagcc

SEQ ID NO: 6509853 - DNA, 22 bp, Homo sapiens
tgcctggagacaaggtgctaac

SEQ ID NO: 6509854 - DNA, 17 bp, Homo sapiens
tgcctggagagggtctc

SEQ ID NO: 6509855 - DNA, 14 bp, Homo sapiens
tgcctggagcaggg

SEQ ID NO: 6509856 - DNA, 14 bp, Homo sapiens
tgcctggagcccca

SEQ ID NO: 6509857 - DNA, 17 bp, Homo sapiens
tgcctggagctcctggg

SEQ ID NO: 6509858 - DNA, 10 bp, Homo sapiens
tgcctggagg

SEQ ID NO: 6509859 - DNA, 11 bp, Homo sapiens
tgcctggagga

SEQ ID NO: 6509860 - DNA, 21 bp, Homo sapiens
tgcctggaggagaaggaggaa

SEQ ID NO: 6509861 - DNA, 19 bp, Homo sapiens
tgcctggaggatccctcca

SEQ ID NO: 6509862 - DNA, 15 bp, Homo sapiens
tgcctggaggcaaag

SEQ ID NO: 6509863 - DNA, 15 bp, Homo sapiens
tgcctggaggctcct

SEQ ID NO: 6509864 - DNA, 21 bp, Homo sapiens
tgcctggagggtaactggggg

SEQ ID NO: 6509865 - DNA, 14 bp, Homo sapiens
tgcctggagtcagt

SEQ ID NO: 6509866 - DNA, 14 bp, Homo sapiens
tgcctggagtgtcg

SEQ ID NO: 6509867 - DNA, 23 bp, Homo sapiens
tgcctggatcccctctgtctaca

SEQ ID NO: 6509868 - DNA, 22 bp, Homo sapiens
tgcctggatgaggcacttctgt

SEQ ID NO: 6509869 - DNA, 14 bp, Homo sapiens
tgcctggatggggc

SEQ ID NO: 6509870 - DNA, 17 bp, Homo sapiens
tgcctggatggggctgc

SEQ ID NO: 6509871 - DNA, 18 bp, Homo sapiens
tgcctggatgggggtgca

SEQ ID NO: 6509872 - DNA, 16 bp, Homo sapiens
tgcctggatttcttcc

SEQ ID NO: 6509873 - DNA, 11 bp, Homo sapiens
tgcctggcaac

SEQ ID NO: 6509874 - DNA, 13 bp, Homo sapiens
tgcctggcactta

SEQ ID NO: 6509875 - DNA, 21 bp, Homo sapiens
tgcctggcacttactggtcct

SEQ ID NO: 6509876 - DNA, 14 bp, Homo sapiens
tgcctggcagccat

SEQ ID NO: 6509877 - DNA, 17 bp, Homo sapiens
tgtggacagcccgggag

SEQ ID NO: 6509878 - DNA, 11 bp, Homo sapiens
tgtggacagga

SEQ ID NO: 6509879 - DNA, 14 bp, Homo sapiens
tgtggacaggacta

SEQ ID NO: 6509880 - DNA, 23 bp, Homo sapiens
tgtggacaggatgaggacagagg

SEQ ID NO: 6509881 - DNA, 17 bp, Homo sapiens
tgtggacatgcacccgc

SEQ ID NO: 6509882 - DNA, 18 bp, Homo sapiens
tgtggacatgcacccgca

SEQ ID NO: 6509883 - DNA, 15 bp, Homo sapiens
tgtggaccaattatt

SEQ ID NO: 6509884 - DNA, 21 bp, Homo sapiens
tgtggaccggccgcagccccc

SEQ ID NO: 6509885 - DNA, 18 bp, Homo sapiens
tgtggaccgtggacaggc

SEQ ID NO: 6509886 - DNA, 22 bp, Homo sapiens
tgtggaccgtggacaggcccag

SEQ ID NO: 6509887 - DNA, 19 bp, Homo sapiens
tgtggacgagagggctgtg

SEQ ID NO: 6509888 - DNA, 22 bp, Homo sapiens
tgtggacgagagggctgtgagc

SEQ ID NO: 6509889 - DNA, 22 bp, Homo sapiens
tgtggacggcgctgcctcaggc

SEQ ID NO: 6509890 - DNA, 20 bp, Homo sapiens
tgtggacgtgcactgacagc

SEQ ID NO: 6509891 - DNA, 15 bp, Homo sapiens
tgtggactaaaagat

SEQ ID NO: 6509892 - DNA, 16 bp, Homo sapiens
tgtggactacaggaca

SEQ ID NO: 6509893 - DNA, 19 bp, Homo sapiens
tgtggactctctgcctgct

SEQ ID NO: 6509894 - DNA, 15 bp, Homo sapiens
tgtggactctggact

SEQ ID NO: 6509895 - DNA, 12 bp, Homo sapiens
tgtggactgagc

SEQ ID NO: 6509896 - DNA, 18 bp, Homo sapiens
tgtggactgagcgaggaa

SEQ ID NO: 6509897 - DNA, 19 bp, Homo sapiens
tgtggactgagcgaggaaa

SEQ ID NO: 6509898 - DNA, 18 bp, Homo sapiens
tgtggactggaacatggt

SEQ ID NO: 6509899 - DNA, 21 bp, Homo sapiens
tgtggactgtcctgaggagcc

SEQ ID NO: 6509900 - DNA, 15 bp, Homo sapiens
tgtggactgtgatgc

SEQ ID NO: 6509901 - DNA, 16 bp, Homo sapiens
tgtggactgtgccatc

SEQ ID NO: 6509902 - DNA, 24 bp, Homo sapiens
tgtggactgtgcctcaggccaggg

SEQ ID NO: 6509903 - DNA, 10 bp, Homo sapiens
tgtggacttt

SEQ ID NO: 6509904 - DNA, 12 bp, Homo sapiens
tgtggactttat

SEQ ID NO: 6509905 - DNA, 14 bp, Homo sapiens
tgtggagaaaagag

SEQ ID NO: 6509906 - DNA, 18 bp, Homo sapiens
tgtggagaactcagtgcc

SEQ ID NO: 6509907 - DNA, 12 bp, Homo sapiens
tgtggagaagcg

SEQ ID NO: 6509908 - DNA, 18 bp, Homo sapiens
tgtggagacaatgtctgc

SEQ ID NO: 6509909 - DNA, 14 bp, Homo sapiens
tgtggagaccaggc

SEQ ID NO: 6509910 - DNA, 21 bp, Homo sapiens
tgtggagaccctgccacagcc

SEQ ID NO: 6509911 - DNA, 22 bp, Homo sapiens
tgtggagaccctgccacagcca

SEQ ID NO: 6509912 - DNA, 18 bp, Homo sapiens
tgtggagactgctcctga

SEQ ID NO: 6509913 - DNA, 22 bp, Homo sapiens
tgtggagactgctcctgagccc

SEQ ID NO: 6509914 - DNA, 15 bp, Homo sapiens
tgtggagaggagaga

SEQ ID NO: 6509915 - DNA, 20 bp, Homo sapiens
tgtggagagggaatgtgaaa

SEQ ID NO: 6509916 - DNA, 14 bp, Homo sapiens
tgtggagaggggtg

SEQ ID NO: 6509917 - DNA, 18 bp, Homo sapiens
tgtggagagtgagaataa

SEQ ID NO: 6509918 - DNA, 20 bp, Homo sapiens
tgtggagagtgagaataatt

SEQ ID NO: 6509919 - DNA, 22 bp, Homo sapiens
tgtggagatgcccaggatttga

SEQ ID NO: 6509920 - DNA, 22 bp, Homo sapiens
tgtggagcaaaaggcagctcac

SEQ ID NO: 6509921 - DNA, 13 bp, Homo sapiens
tgtggagcgcccg

SEQ ID NO: 6509922 - DNA, 17 bp, Homo sapiens
tgtggagctctgggggg

SEQ ID NO: 6509923 - DNA, 17 bp, Homo sapiens
tgtggagctgcttccag

SEQ ID NO: 6509924 - DNA, 16 bp, Homo sapiens
tgtggaggaagagcca

SEQ ID NO: 6509925 - DNA, 18 bp, Homo sapiens
tgtggaggaagagccacc

SEQ ID NO: 6509926 - DNA, 19 bp, Homo sapiens
tgtggaggaagagccacct

SEQ ID NO: 6509927 - DNA, 23 bp, Homo sapiens
tgtggaggaagagccacctgcaa

SEQ ID NO: 6509928 - DNA, 15 bp, Homo sapiens
tgtggaggaaggatt

SEQ ID NO: 6509929 - DNA, 21 bp, Homo sapiens
tgtggaggaaggattgtaaaa

SEQ ID NO: 6509930 - DNA, 15 bp, Homo sapiens
tgtggaggaggtgaa

SEQ ID NO: 6509931 - DNA, 20 bp, Homo sapiens
tgtggaggagtccaggccat

SEQ ID NO: 6509932 - DNA, 19 bp, Homo sapiens
tgtggaggccgagtctgtc

SEQ ID NO: 6509933 - DNA, 13 bp, Homo sapiens
tgtggaggctcct

SEQ ID NO: 6509934 - DNA, 19 bp, Homo sapiens
tgtggagggagtgttcaaa

SEQ ID NO: 6509935 - DNA, 23 bp, Homo sapiens
tgtggagggcatttgctgcccca

SEQ ID NO: 6509936 - DNA, 20 bp, Homo sapiens
tgtggagggtcaccaggttg

SEQ ID NO: 6509937 - DNA, 20 bp, Homo sapiens
tgtggagggtggcgccctgc

SEQ ID NO: 6509938 - DNA, 23 bp, Homo sapiens
tgtggagtatttttataatttta

SEQ ID NO: 6509939 - DNA, 16 bp, Homo sapiens
tgtggagtcattctca

SEQ ID NO: 6509940 - DNA, 17 bp, Homo sapiens
tgtggagtccagctcta

SEQ ID NO: 6509941 - DNA, 14 bp, Homo sapiens
tgtggagtggaggg

SEQ ID NO: 6509942 - DNA, 15 bp, Homo sapiens
tgtggagtgtattaa

SEQ ID NO: 6509943 - DNA, 14 bp, Homo sapiens
tgtggagttattca

SEQ ID NO: 6509944 - DNA, 15 bp, Homo sapiens
tgtggagttcctgct

SEQ ID NO: 6509945 - DNA, 18 bp, Homo sapiens
tgtggagttttcatgaca

SEQ ID NO: 6509946 - DNA, 12 bp, Homo sapiens
tgtggataaaac

SEQ ID NO: 6509947 - DNA, 18 bp, Homo sapiens
tgtggataaaactgtgta

SEQ ID NO: 6509948 - DNA, 18 bp, Homo sapiens
tgtggataaattttggaa

SEQ ID NO: 6509949 - DNA, 19 bp, Homo sapiens
tgtggataaattttggaag

SEQ ID NO: 6509950 - DNA, 16 bp, Homo sapiens
tgtggataacaaagat

SEQ ID NO: 6509951 - DNA, 18 bp, Homo sapiens
tgtggataagaaaaatgc

SEQ ID NO: 6509952 - DNA, 19 bp, Homo sapiens
tgtggataagaaaaatgct

SEQ ID NO: 6509953 - DNA, 20 bp, Homo sapiens
tgtggataagaaaaatgctt

SEQ ID NO: 6509954 - DNA, 17 bp, Homo sapiens
tgtggataagggagagt

SEQ ID NO: 6509955 - DNA, 15 bp, Homo sapiens
tgtggatacagtgcc

SEQ ID NO: 6509956 - DNA, 20 bp, Homo sapiens
tgtggatagagcagcctgct

SEQ ID NO: 6509957 - DNA, 15 bp, Homo sapiens
tgtggatataaaatg

SEQ ID NO: 6509958 - DNA, 22 bp, Homo sapiens
tgtggatatcagggtataaatt

SEQ ID NO: 6509959 - DNA, 14 bp, Homo sapiens
tgtggatatttatt

SEQ ID NO: 6509960 - DNA, 15 bp, Homo sapiens
tgtggatatttattt

SEQ ID NO: 6509961 - DNA, 19 bp, Homo sapiens
tgtggatatttatttaaac

SEQ ID NO: 6509962 - DNA, 17 bp, Homo sapiens
tgtggatcagagatgca

SEQ ID NO: 6509963 - DNA, 17 bp, Homo sapiens
tgtggatccaatgttag

SEQ ID NO: 6509964 - DNA, 14 bp, Homo sapiens
tgtggatcttgcca

SEQ ID NO: 6509965 - DNA, 20 bp, Homo sapiens
tgtggatcttgccacatttc

SEQ ID NO: 6509966 - DNA, 16 bp, Homo sapiens
tgtggatcttttcatt

SEQ ID NO: 6509967 - DNA, 19 bp, Homo sapiens
tgtggatcttttcattctc

SEQ ID NO: 6509968 - DNA, 14 bp, Homo sapiens
tgtggatgaaaaaa

SEQ ID NO: 6509969 - DNA, 21 bp, Homo sapiens
tgtggatgatttttttgaact

SEQ ID NO: 6509970 - DNA, 22 bp, Homo sapiens
tgtggatgccgatttctgtaaa

SEQ ID NO: 6509971 - DNA, 22 bp, Homo sapiens
tgtggatgctccagggcagcct

SEQ ID NO: 6509972 - DNA, 15 bp, Homo sapiens
tgtggatgctgagct

SEQ ID NO: 6509973 - DNA, 19 bp, Homo sapiens
tgtggatggcagtgtgggg

SEQ ID NO: 6509974 - DNA, 19 bp, Homo sapiens
tgtggatgggaggctcctg

SEQ ID NO: 6509975 - DNA, 14 bp, Homo sapiens
tgtggatgggaggg

SEQ ID NO: 6509976 - DNA, 23 bp, Homo sapiens
tgtggatgtaattagctctgggg

SEQ ID NO: 6509977 - DNA, 16 bp, Homo sapiens
tgtggatgtgtaaatg

SEQ ID NO: 6509978 - DNA, 18 bp, Homo sapiens
tgtggattccagcatttg

SEQ ID NO: 6509979 - DNA, 16 bp, Homo sapiens
tgtggattctatattt

SEQ ID NO: 6509980 - DNA, 21 bp, Homo sapiens
tgtggattctatatttcatat

SEQ ID NO: 6509981 - DNA, 22 bp, Homo sapiens
tgtggatttaacagaaatgtac

SEQ ID NO: 6509982 - DNA, 14 bp, Homo sapiens
tgtggatttcagtt

SEQ ID NO: 6509983 - DNA, 23 bp, Homo sapiens
tgtggatttcctattttaaaacc

SEQ ID NO: 6509984 - DNA, 15 bp, Homo sapiens
tgtggatttggggac

SEQ ID NO: 6509985 - DNA, 21 bp, Homo sapiens
tgtggattttctactgtaaga

SEQ ID NO: 6509986 - DNA, 13 bp, Homo sapiens
tgtggattttgta

SEQ ID NO: 6509987 - DNA, 19 bp, Homo sapiens
tgtggattttgtggcttca

SEQ ID NO: 6509988 - DNA, 22 bp, Homo sapiens
tgtggcaaaaagagtcagacat

SEQ ID NO: 6509989 - DNA, 14 bp, Homo sapiens
tgtggcaactgaga

SEQ ID NO: 6509990 - DNA, 17 bp, Homo sapiens
tgtggcaaggaaaaaca

SEQ ID NO: 6509991 - DNA, 15 bp, Homo sapiens
tgtggcaagtgaatt

SEQ ID NO: 6509992 - DNA, 19 bp, Homo sapiens
tgtggcacagacccccgtc

SEQ ID NO: 6509993 - DNA, 13 bp, Homo sapiens
tgtggcacagccc

SEQ ID NO: 6509994 - DNA, 15 bp, Homo sapiens
tgtggcacagccctg

SEQ ID NO: 6509995 - DNA, 19 bp, Homo sapiens
tgtggcaccttgattggaa

SEQ ID NO: 6509996 - DNA, 17 bp, Homo sapiens
tgtggcacgtaaggtct

SEQ ID NO: 6509997 - DNA, 15 bp, Homo sapiens
tgtggcactgcttga

SEQ ID NO: 6509998 - DNA, 19 bp, Homo sapiens
tgtggcactggggcagggg

SEQ ID NO: 6509999 - DNA, 14 bp, Homo sapiens
tgtggcagagagag

SEQ ID NO: 6510000 - DNA, 22 bp, Homo sapiens
tgtggcagagagagagaaagag

SEQ ID NO: 6510001 - DNA, 23 bp, Homo sapiens
tgtggcagagagagagaaagaga

SEQ ID NO: 6510002 - DNA, 14 bp, Homo sapiens
tgtggcagagttac

SEQ ID NO: 6510003 - DNA, 11 bp, Homo sapiens
tgtggcagcag

SEQ ID NO: 6510004 - DNA, 16 bp, Homo sapiens
tgtggcagcaggcagc

SEQ ID NO: 6510005 - DNA, 20 bp, Homo sapiens
tgtggcagccgtcccaggcc

SEQ ID NO: 6510006 - DNA, 16 bp, Homo sapiens
tgtggcagctgcccct

SEQ ID NO: 6510007 - DNA, 16 bp, Homo sapiens
tgtggcagctgtctca

SEQ ID NO: 6510008 - DNA, 17 bp, Homo sapiens
tgtggcaggagggcagt

SEQ ID NO: 6510009 - DNA, 13 bp, Homo sapiens
tgtggcaggccta

SEQ ID NO: 6510010 - DNA, 20 bp, Homo sapiens
tgtggcaggcctaggacctc

SEQ ID NO: 6510011 - DNA, 22 bp, Homo sapiens
tgtggcagggagcagtacacaa

SEQ ID NO: 6510012 - DNA, 15 bp, Homo sapiens
tgtggcaggggcagt

SEQ ID NO: 6510013 - DNA, 20 bp, Homo sapiens
tgtggcaggggcagtggcct

SEQ ID NO: 6510014 - DNA, 23 bp, Homo sapiens
tgtggcaggggcagtggcctgga

SEQ ID NO: 6510015 - DNA, 20 bp, Homo sapiens
tgtggcagggggccccgcca

SEQ ID NO: 6510016 - DNA, 21 bp, Homo sapiens
tgtggcaggggttagagcagg

SEQ ID NO: 6510017 - DNA, 19 bp, Homo sapiens
tgtggcagtaaagagaaac

SEQ ID NO: 6510018 - DNA, 20 bp, Homo sapiens
tgtggcagtaaagagaaact

SEQ ID NO: 6510019 - DNA, 22 bp, Homo sapiens
tgtggcagtaaagagaaacttt

SEQ ID NO: 6510020 - DNA, 11 bp, Homo sapiens
tgtggcagtgg

SEQ ID NO: 6510021 - DNA, 22 bp, Homo sapiens
tgtggcagtggccaggcaggga

SEQ ID NO: 6510022 - DNA, 19 bp, Homo sapiens
tgtggcatccagagtccct

SEQ ID NO: 6510023 - DNA, 15 bp, Homo sapiens
tgtggcatgcaaaag

SEQ ID NO: 6510024 - DNA, 17 bp, Homo sapiens
tgtggcatgggtgaaga

SEQ ID NO: 6510025 - DNA, 16 bp, Homo sapiens
tgtggcatttccaaac

SEQ ID NO: 6510026 - DNA, 15 bp, Homo sapiens
tgtggccaaccagga

SEQ ID NO: 6510027 - DNA, 14 bp, Homo sapiens
tgtggccaagaaga

SEQ ID NO: 6510028 - DNA, 19 bp, Homo sapiens
tgtggccaaggagctgcta

SEQ ID NO: 6510029 - DNA, 20 bp, Homo sapiens
tgtggccaaggagctgctat

SEQ ID NO: 6510030 - DNA, 21 bp, Homo sapiens
tgtggccaaggagctgctata

SEQ ID NO: 6510031 - DNA, 22 bp, Homo sapiens
tgtggccacaactgctgtggcc

SEQ ID NO: 6510032 - DNA, 14 bp, Homo sapiens
tgtggccacagtgg

SEQ ID NO: 6510033 - DNA, 16 bp, Homo sapiens
tgtggccacttatttc

SEQ ID NO: 6510034 - DNA, 22 bp, Homo sapiens
tgtggccagagcacctcaggac

SEQ ID NO: 6510035 - DNA, 14 bp, Homo sapiens
tgtggccagagctg

SEQ ID NO: 6510036 - DNA, 16 bp, Homo sapiens
tgtggccagcctggca

SEQ ID NO: 6510037 - DNA, 17 bp, Homo sapiens
tgtggccagcctggcat

SEQ ID NO: 6510038 - DNA, 14 bp, Homo sapiens
tgtggccagctgca

SEQ ID NO: 6510039 - DNA, 12 bp, Homo sapiens
tgtggccaggct

SEQ ID NO: 6510040 - DNA, 20 bp, Homo sapiens
tgtggccatatttatagaat

SEQ ID NO: 6510041 - DNA, 21 bp, Homo sapiens
tgtggccatcactcagcccct

SEQ ID NO: 6510042 - DNA, 20 bp, Homo sapiens
tgtggcccaagtcattccta

SEQ ID NO: 6510043 - DNA, 21 bp, Homo sapiens
tgtggcccacgggccggccag

SEQ ID NO: 6510044 - DNA, 12 bp, Homo sapiens
tgtggcccagca

SEQ ID NO: 6510045 - DNA, 20 bp, Homo sapiens
tgtggcccatcttactggaa

SEQ ID NO: 6510046 - DNA, 17 bp, Homo sapiens
tgtggccccaagagggg

SEQ ID NO: 6510047 - DNA, 14 bp, Homo sapiens
tgtggccccagccc

SEQ ID NO: 6510048 - DNA, 18 bp, Homo sapiens
tgtggcccccgccccctc

SEQ ID NO: 6510049 - DNA, 16 bp, Homo sapiens
tgtggcccctcccctg

SEQ ID NO: 6510050 - DNA, 17 bp, Homo sapiens
tgtggcccctccttctc

SEQ ID NO: 6510051 - DNA, 19 bp, Homo sapiens
tgtggcccctccttctccc

SEQ ID NO: 6510052 - DNA, 19 bp, Homo sapiens
tgtggccccttttactttt

SEQ ID NO: 6510053 - DNA, 23 bp, Homo sapiens
tgtggccccttttacttttttat

SEQ ID NO: 6510054 - DNA, 17 bp, Homo sapiens
tgcctggccagattttt

SEQ ID NO: 6510055 - DNA, 14 bp, Homo sapiens
tgcctggccaggca

SEQ ID NO: 6510056 - DNA, 15 bp, Homo sapiens
tgcctggccaggccc

SEQ ID NO: 6510057 - DNA, 17 bp, Homo sapiens
tgcctggccaggccctg

SEQ ID NO: 6510058 - DNA, 13 bp, Homo sapiens
tgcctggccatgc

SEQ ID NO: 6510059 - DNA, 13 bp, Homo sapiens
tgcctggccccag

SEQ ID NO: 6510060 - DNA, 19 bp, Homo sapiens
tgcctggccccagcctggg

SEQ ID NO: 6510061 - DNA, 16 bp, Homo sapiens
tgcctggcccccagct

SEQ ID NO: 6510062 - DNA, 16 bp, Homo sapiens
tgcctggcccccctcc

SEQ ID NO: 6510063 - DNA, 19 bp, Homo sapiens
tgcctggcccccctccagg

SEQ ID NO: 6510064 - DNA, 20 bp, Homo sapiens
tgcctggcccccctccaggc

SEQ ID NO: 6510065 - DNA, 21 bp, Homo sapiens
tgcctggcccctcgcctgtgg

SEQ ID NO: 6510066 - DNA, 14 bp, Homo sapiens
tgcctggccctcct

SEQ ID NO: 6510067 - DNA, 15 bp, Homo sapiens
tgcctggcccttgcc

SEQ ID NO: 6510068 - DNA, 19 bp, Homo sapiens
tgcctggcccttggcttta

SEQ ID NO: 6510069 - DNA, 14 bp, Homo sapiens
tgcctggccggcca

SEQ ID NO: 6510070 - DNA, 16 bp, Homo sapiens
tgcctggccggccagc

SEQ ID NO: 6510071 - DNA, 23 bp, Homo sapiens
tgcctggccggccagccagccac

SEQ ID NO: 6510072 - DNA, 14 bp, Homo sapiens
tgcctggcctctgc

SEQ ID NO: 6510073 - DNA, 16 bp, Homo sapiens
tgcctggcctctgcct

SEQ ID NO: 6510074 - DNA, 19 bp, Homo sapiens
tgcctggcctgccagacac

SEQ ID NO: 6510075 - DNA, 19 bp, Homo sapiens
tgcctggcctggctcccca

SEQ ID NO: 6510076 - DNA, 16 bp, Homo sapiens
tgcctggcggcagggg

SEQ ID NO: 6510077 - DNA, 14 bp, Homo sapiens
tgcctggcgggcag

SEQ ID NO: 6510078 - DNA, 18 bp, Homo sapiens
tgcctggcgggcagcccc

SEQ ID NO: 6510079 - DNA, 16 bp, Homo sapiens
tgcctggctcagagcc

SEQ ID NO: 6510080 - DNA, 20 bp, Homo sapiens
tgcctggctgattcagcatt

SEQ ID NO: 6510081 - DNA, 12 bp, Homo sapiens
tgcctggctggg

SEQ ID NO: 6510082 - DNA, 12 bp, Homo sapiens
tgcctggctgtg

SEQ ID NO: 6510083 - DNA, 14 bp, Homo sapiens
tgcctggctgtgga

SEQ ID NO: 6510084 - DNA, 15 bp, Homo sapiens
tgcctggctgtggag

SEQ ID NO: 6510085 - DNA, 19 bp, Homo sapiens
tgcctggctgtggaggcct

SEQ ID NO: 6510086 - DNA, 17 bp, Homo sapiens
tgcctggcttgctgtgg

SEQ ID NO: 6510087 - DNA, 21 bp, Homo sapiens
tgcctgggaaccttcctgtct

SEQ ID NO: 6510088 - DNA, 21 bp, Homo sapiens
tgcctgggaaggcgagtctgg

SEQ ID NO: 6510089 - DNA, 11 bp, Homo sapiens
tgcctgggaga

SEQ ID NO: 6510090 - DNA, 12 bp, Homo sapiens
tgcctgggagga

SEQ ID NO: 6510091 - DNA, 16 bp, Homo sapiens
tgcctgggaggagtgg

SEQ ID NO: 6510092 - DNA, 19 bp, Homo sapiens
tgcctgggatcagtggggc

SEQ ID NO: 6510093 - DNA, 14 bp, Homo sapiens
tgcctgggatgccc

SEQ ID NO: 6510094 - DNA, 14 bp, Homo sapiens
tgcctgggcaatgg

SEQ ID NO: 6510095 - DNA, 13 bp, Homo sapiens
tgcctgggcagtg

SEQ ID NO: 6510096 - DNA, 23 bp, Homo sapiens
tgcctgggcagtgcccaccatgc

SEQ ID NO: 6510097 - DNA, 16 bp, Homo sapiens
tgcctgggcccaggcc

SEQ ID NO: 6510098 - DNA, 20 bp, Homo sapiens
tgcctgggcccaggcccagc

SEQ ID NO: 6510099 - DNA, 21 bp, Homo sapiens
tgcctgggcccaggcccagcc

SEQ ID NO: 6510100 - DNA, 14 bp, Homo sapiens
tgcctgggcccctc

SEQ ID NO: 6510101 - DNA, 22 bp, Homo sapiens
tgcctgggcccggaagggcttt

SEQ ID NO: 6510102 - DNA, 15 bp, Homo sapiens
tgcctgggccctggg

SEQ ID NO: 6510103 - DNA, 14 bp, Homo sapiens
tgcctgggcctagc

SEQ ID NO: 6510104 - DNA, 16 bp, Homo sapiens
tgcctgggcctcccaa

SEQ ID NO: 6510105 - DNA, 12 bp, Homo sapiens
tgcctgggcctg

SEQ ID NO: 6510106 - DNA, 16 bp, Homo sapiens
tgcctgggcctgtgca

SEQ ID NO: 6510107 - DNA, 21 bp, Homo sapiens
tgcctgggcctgtgcagcagc

SEQ ID NO: 6510108 - DNA, 19 bp, Homo sapiens
tgcctgggccttggctggg

SEQ ID NO: 6510109 - DNA, 22 bp, Homo sapiens
tgcctgggccttggctgggcct

SEQ ID NO: 6510110 - DNA, 11 bp, Homo sapiens
tgcctgggctc

SEQ ID NO: 6510111 - DNA, 22 bp, Homo sapiens
tgcctgggctcccttgtgcgtg

SEQ ID NO: 6510112 - DNA, 15 bp, Homo sapiens
tgcctgggctctgga

SEQ ID NO: 6510113 - DNA, 18 bp, Homo sapiens
tgcctgggctgggcagcc

SEQ ID NO: 6510114 - DNA, 12 bp, Homo sapiens
tgcctgggctgt

SEQ ID NO: 6510115 - DNA, 16 bp, Homo sapiens
tgcctgggctgttggc

SEQ ID NO: 6510116 - DNA, 11 bp, Homo sapiens
tgcctggggcc

SEQ ID NO: 6510117 - DNA, 17 bp, Homo sapiens
tgcctggggcggcatga

SEQ ID NO: 6510118 - DNA, 17 bp, Homo sapiens
tgcctggggctggctgc

SEQ ID NO: 6510119 - DNA, 20 bp, Homo sapiens
tgcctggggctggctgcaga

SEQ ID NO: 6510120 - DNA, 21 bp, Homo sapiens
tgcctggggctggctgcagac

SEQ ID NO: 6510121 - DNA, 19 bp, Homo sapiens
tgcctgggggagttttcct

SEQ ID NO: 6510122 - DNA, 23 bp, Homo sapiens
tgcctggggtggaggctaagcct

SEQ ID NO: 6510123 - DNA, 21 bp, Homo sapiens
tgcctggggtgtaatgagctc

SEQ ID NO: 6510124 - DNA, 15 bp, Homo sapiens
tgcctgggtgggaca

SEQ ID NO: 6510125 - DNA, 17 bp, Homo sapiens
tgcctgggtggggctgc

SEQ ID NO: 6510126 - DNA, 19 bp, Homo sapiens
tgcctgggtggggctgctc

SEQ ID NO: 6510127 - DNA, 22 bp, Homo sapiens
tgcctgggtttaaggggagagg

SEQ ID NO: 6510128 - DNA, 19 bp, Homo sapiens
tgcctgggttttctaactg

SEQ ID NO: 6510129 - DNA, 16 bp, Homo sapiens
tgcctggtaaaattaa

SEQ ID NO: 6510130 - DNA, 14 bp, Homo sapiens
tgcctggtacagta

SEQ ID NO: 6510131 - DNA, 19 bp, Homo sapiens
tgcctggtactctggcaaa

SEQ ID NO: 6510132 - DNA, 22 bp, Homo sapiens
tgcctggtcaataaaccactgt

SEQ ID NO: 6510133 - DNA, 23 bp, Homo sapiens
tgcctggtcaccctggggctgct

SEQ ID NO: 6510134 - DNA, 20 bp, Homo sapiens
tgcctggtcagaaggccagc

SEQ ID NO: 6510135 - DNA, 21 bp, Homo sapiens
tgcctggtcagaaggccagcc

SEQ ID NO: 6510136 - DNA, 17 bp, Homo sapiens
tgcctggtcctcacact

SEQ ID NO: 6510137 - DNA, 19 bp, Homo sapiens
tgcctggtcctccctccca

SEQ ID NO: 6510138 - DNA, 20 bp, Homo sapiens
tgcctggtcctccctcccaa

SEQ ID NO: 6510139 - DNA, 18 bp, Homo sapiens
tgcctggtctcctgcccc

SEQ ID NO: 6510140 - DNA, 18 bp, Homo sapiens
tgcctggtgaatggcctt

SEQ ID NO: 6510141 - DNA, 18 bp, Homo sapiens
tgcctggtgcattgctgt

SEQ ID NO: 6510142 - DNA, 11 bp, Homo sapiens
tgcctggtgcg

SEQ ID NO: 6510143 - DNA, 23 bp, Homo sapiens
tgcctggtgcgctgtgctccagc

SEQ ID NO: 6510144 - DNA, 15 bp, Homo sapiens
tgcctggtggcagct

SEQ ID NO: 6510145 - DNA, 16 bp, Homo sapiens
tgcctggtggcagctg

SEQ ID NO: 6510146 - DNA, 16 bp, Homo sapiens
tgcctggtgggccacg

SEQ ID NO: 6510147 - DNA, 18 bp, Homo sapiens
tgcctggtggtcagatgc

SEQ ID NO: 6510148 - DNA, 19 bp, Homo sapiens
tgcctggtggtcagatgca

SEQ ID NO: 6510149 - DNA, 18 bp, Homo sapiens
tgcctggttccctcccca

SEQ ID NO: 6510150 - DNA, 19 bp, Homo sapiens
tgcctggttcgtgccatgc

SEQ ID NO: 6510151 - DNA, 19 bp, Homo sapiens
tgcctggttctaggctgct

SEQ ID NO: 6510152 - DNA, 18 bp, Homo sapiens
tgcctgtaatcacagcta

SEQ ID NO: 6510153 - DNA, 17 bp, Homo sapiens
tgcctgtaatcccagct

SEQ ID NO: 6510154 - DNA, 20 bp, Homo sapiens
tgcctgtaatctttttctcc

SEQ ID NO: 6510155 - DNA, 22 bp, Homo sapiens
tgcctgtaattaaactagttta

SEQ ID NO: 6510156 - DNA, 23 bp, Homo sapiens
tgcctgtactactctagggagta

SEQ ID NO: 6510157 - DNA, 22 bp, Homo sapiens
tgcctgtactcgcttgtgcaga

SEQ ID NO: 6510158 - DNA, 22 bp, Homo sapiens
tgcctgtagagacaatacagta

SEQ ID NO: 6510159 - DNA, 14 bp, Homo sapiens
tgcctgtagagcca

SEQ ID NO: 6510160 - DNA, 22 bp, Homo sapiens
tgcctgtagcaatggccagagc

SEQ ID NO: 6510161 - DNA, 20 bp, Homo sapiens
tgcctgtagccccagtgaca

SEQ ID NO: 6510162 - DNA, 22 bp, Homo sapiens
tgcctgtagctttcctggtccc

SEQ ID NO: 6510163 - DNA, 17 bp, Homo sapiens
tgcctgtagtcccaggc

SEQ ID NO: 6510164 - DNA, 16 bp, Homo sapiens
tgcctgtagtctcagc

SEQ ID NO: 6510165 - DNA, 21 bp, Homo sapiens
tgcctgtagtctcagctactt

SEQ ID NO: 6510166 - DNA, 20 bp, Homo sapiens
tgcctgtagttaggaaataa

SEQ ID NO: 6510167 - DNA, 21 bp, Homo sapiens
tgcctgtagttaggaaataaa

SEQ ID NO: 6510168 - DNA, 22 bp, Homo sapiens
tgcctgtagttaggaaataaaa

SEQ ID NO: 6510169 - DNA, 11 bp, Homo sapiens
tgcctgtcacc

SEQ ID NO: 6510170 - DNA, 19 bp, Homo sapiens
tgcctgtcaccccagtcac

SEQ ID NO: 6510171 - DNA, 17 bp, Homo sapiens
tgcctgtcacgctctgg

SEQ ID NO: 6510172 - DNA, 21 bp, Homo sapiens
tgcctgtcaggaccattttag

SEQ ID NO: 6510173 - DNA, 16 bp, Homo sapiens
tgcctgtcccaccccc

SEQ ID NO: 6510174 - DNA, 21 bp, Homo sapiens
tgcctgtcctgaaagcggctg

SEQ ID NO: 6510175 - DNA, 13 bp, Homo sapiens
tgcctgtctaaag

SEQ ID NO: 6510176 - DNA, 22 bp, Homo sapiens
tgcctgtctaaagccttaacta

SEQ ID NO: 6510177 - DNA, 11 bp, Homo sapiens
tgcctgtctcc

SEQ ID NO: 6510178 - DNA, 16 bp, Homo sapiens
tgcctgtctccatgag

SEQ ID NO: 6510179 - DNA, 15 bp, Homo sapiens
tgcctgtctctgttc

SEQ ID NO: 6510180 - DNA, 14 bp, Homo sapiens
tgcctgtctgaagc

SEQ ID NO: 6510181 - DNA, 13 bp, Homo sapiens
tgcctgtctgccc

SEQ ID NO: 6510182 - DNA, 21 bp, Homo sapiens
tgcctgtctgcttgcatctgc

SEQ ID NO: 6510183 - DNA, 14 bp, Homo sapiens
tgcctgtgaactga

SEQ ID NO: 6510184 - DNA, 23 bp, Homo sapiens
tgcctgtgaagaaccctgcaggg

SEQ ID NO: 6510185 - DNA, 20 bp, Homo sapiens
tgcctgtgaccggggtcctg

SEQ ID NO: 6510186 - DNA, 19 bp, Homo sapiens
tgcctgtgagcatggggcc

SEQ ID NO: 6510187 - DNA, 15 bp, Homo sapiens
tgcctgtgagccagt

SEQ ID NO: 6510188 - DNA, 21 bp, Homo sapiens
tgcctgtgcacggccagctgc

SEQ ID NO: 6510189 - DNA, 19 bp, Homo sapiens
tgcctgtgccacccaccag

SEQ ID NO: 6510190 - DNA, 20 bp, Homo sapiens
tgcctgtgccacccaccagg

SEQ ID NO: 6510191 - DNA, 16 bp, Homo sapiens
tgcctgtgccaggtga

SEQ ID NO: 6510192 - DNA, 23 bp, Homo sapiens
tgcctgtgccaggtgaggtcagc

SEQ ID NO: 6510193 - DNA, 16 bp, Homo sapiens
tgcctgtgccatgccc

SEQ ID NO: 6510194 - DNA, 22 bp, Homo sapiens
tgcctgtgcccgcatgtgtgcc

SEQ ID NO: 6510195 - DNA, 16 bp, Homo sapiens
tgcctgtgcccgctgc

SEQ ID NO: 6510196 - DNA, 19 bp, Homo sapiens
tgcctgtgctacaattcat

SEQ ID NO: 6510197 - DNA, 18 bp, Homo sapiens
tgcctgtgctcctgccca

SEQ ID NO: 6510198 - DNA, 16 bp, Homo sapiens
tgcctgtggagacagc

SEQ ID NO: 6510199 - DNA, 21 bp, Homo sapiens
tgcctgtggagacagccctgc

SEQ ID NO: 6510200 - DNA, 18 bp, Homo sapiens
tgcctgtggaggtgacct

SEQ ID NO: 6510201 - DNA, 11 bp, Homo sapiens
tgcctgtggca

SEQ ID NO: 6510202 - DNA, 14 bp, Homo sapiens
tgcctgtggccatg

SEQ ID NO: 6510203 - DNA, 15 bp, Homo sapiens
tgcctgtggcccctc

SEQ ID NO: 6510204 - DNA, 18 bp, Homo sapiens
tgcctgtggcccctcccc

SEQ ID NO: 6510205 - DNA, 21 bp, Homo sapiens
tgcctgtggcccctcccctgc

SEQ ID NO: 6510206 - DNA, 21 bp, Homo sapiens
tgcctgtggcgccgtctccag

SEQ ID NO: 6510207 - DNA, 22 bp, Homo sapiens
tgcctgtggcgccgtctccagg

SEQ ID NO: 6510208 - DNA, 11 bp, Homo sapiens
tgcctgtggct

SEQ ID NO: 6510209 - DNA, 17 bp, Homo sapiens
tgcctgtgggaggggga

SEQ ID NO: 6510210 - DNA, 16 bp, Homo sapiens
tgcctgtgggcctggg

SEQ ID NO: 6510211 - DNA, 20 bp, Homo sapiens
tgcctgtggtgaggtcctgt

SEQ ID NO: 6510212 - DNA, 22 bp, Homo sapiens
tgcctgtggtgaggtcctgtcc

SEQ ID NO: 6510213 - DNA, 14 bp, Homo sapiens
tgcctgtgtcttct

SEQ ID NO: 6510214 - DNA, 13 bp, Homo sapiens
tgcctgtgtgagc

SEQ ID NO: 6510215 - DNA, 21 bp, Homo sapiens
tgcctgtgtgcgagtctgagt

SEQ ID NO: 6510216 - DNA, 22 bp, Homo sapiens
tgcctgtgtgcgagtctgagtc

SEQ ID NO: 6510217 - DNA, 12 bp, Homo sapiens
tgcctgtgtgct

SEQ ID NO: 6510218 - DNA, 22 bp, Homo sapiens
tgcctgtgtttgtgtggatacc

SEQ ID NO: 6510219 - DNA, 18 bp, Homo sapiens
tgcctgttaagtctgaga

SEQ ID NO: 6510220 - DNA, 19 bp, Homo sapiens
tgcctgttaggtctgttga

SEQ ID NO: 6510221 - DNA, 22 bp, Homo sapiens
tgcctgttatggatatagtatc

SEQ ID NO: 6510222 - DNA, 15 bp, Homo sapiens
tgcctgttcagctcc

SEQ ID NO: 6510223 - DNA, 17 bp, Homo sapiens
tgcctgttcagctccag

SEQ ID NO: 6510224 - DNA, 18 bp, Homo sapiens
tgcctgttcagctccagc

SEQ ID NO: 6510225 - DNA, 19 bp, Homo sapiens
tgcctgttcagttacagaa

SEQ ID NO: 6510226 - DNA, 21 bp, Homo sapiens
tgcctgttcagttacagaaag

SEQ ID NO: 6510227 - DNA, 23 bp, Homo sapiens
tgcctgttcctcccaagaggcca

SEQ ID NO: 6510228 - DNA, 12 bp, Homo sapiens
tgcctgttcctt

SEQ ID NO: 6510229 - DNA, 13 bp, Homo sapiens
tgcctgttctgct

SEQ ID NO: 6510230 - DNA, 15 bp, Homo sapiens
tgcctgttctgcttc

SEQ ID NO: 6510231 - DNA, 20 bp, Homo sapiens
tgcctgttgatctatgggaa

SEQ ID NO: 6510232 - DNA, 24 bp, Homo sapiens
tgtggcccgaggaagctggacagc

SEQ ID NO: 6510233 - DNA, 14 bp, Homo sapiens
tgtggccctgccat

SEQ ID NO: 6510234 - DNA, 21 bp, Homo sapiens
tgtggccctgccatcttccca

SEQ ID NO: 6510235 - DNA, 19 bp, Homo sapiens
tgtggccctgcccttggca

SEQ ID NO: 6510236 - DNA, 13 bp, Homo sapiens
tgtggccctggag

SEQ ID NO: 6510237 - DNA, 14 bp, Homo sapiens
tgtggccctggcct

SEQ ID NO: 6510238 - DNA, 20 bp, Homo sapiens
tgtggccctggcctgctggg

SEQ ID NO: 6510239 - DNA, 16 bp, Homo sapiens
tgtggccctggctgcc

SEQ ID NO: 6510240 - DNA, 16 bp, Homo sapiens
tgtggccctgtctgga

SEQ ID NO: 6510241 - DNA, 16 bp, Homo sapiens
tgtggccctgtgggag

SEQ ID NO: 6510242 - DNA, 19 bp, Homo sapiens
tgtggccgactctgcactc

SEQ ID NO: 6510243 - DNA, 15 bp, Homo sapiens
tgtggccgccatctg

SEQ ID NO: 6510244 - DNA, 17 bp, Homo sapiens
tgtggccgcctggcagg

SEQ ID NO: 6510245 - DNA, 13 bp, Homo sapiens
tgtggccggcctc

SEQ ID NO: 6510246 - DNA, 17 bp, Homo sapiens
tgtggccggcctcctcc

SEQ ID NO: 6510247 - DNA, 18 bp, Homo sapiens
tgtggccggcctcctcct

SEQ ID NO: 6510248 - DNA, 21 bp, Homo sapiens
tgtggccggcctcctcctcac

SEQ ID NO: 6510249 - DNA, 23 bp, Homo sapiens
tgtggccggcctcctcctcaccc

SEQ ID NO: 6510250 - DNA, 19 bp, Homo sapiens
tgtggccggtgccagctgc

SEQ ID NO: 6510251 - DNA, 20 bp, Homo sapiens
tgtggccggtgccagctgcc

SEQ ID NO: 6510252 - DNA, 22 bp, Homo sapiens
tgtggccggtgccagctgccct

SEQ ID NO: 6510253 - DNA, 19 bp, Homo sapiens
tgtggccgtctcctccctc

SEQ ID NO: 6510254 - DNA, 18 bp, Homo sapiens
tgtggccgttatctggaa

SEQ ID NO: 6510255 - DNA, 22 bp, Homo sapiens
tgtggcctaccttgtgagggag

SEQ ID NO: 6510256 - DNA, 21 bp, Homo sapiens
tgtggcctagacttctgagta

SEQ ID NO: 6510257 - DNA, 13 bp, Homo sapiens
tgtggcctatgaa

SEQ ID NO: 6510258 - DNA, 10 bp, Homo sapiens
tgtggcctca

SEQ ID NO: 6510259 - DNA, 22 bp, Homo sapiens
tgtggcctcaagcaatccacct

SEQ ID NO: 6510260 - DNA, 12 bp, Homo sapiens
tgtggcctcagc

SEQ ID NO: 6510261 - DNA, 14 bp, Homo sapiens
tgtggcctcagcat

SEQ ID NO: 6510262 - DNA, 16 bp, Homo sapiens
tgtggcctcagcatct

SEQ ID NO: 6510263 - DNA, 17 bp, Homo sapiens
tgtggcctcagccctca

SEQ ID NO: 6510264 - DNA, 18 bp, Homo sapiens
tgtggcctcagccctcag

SEQ ID NO: 6510265 - DNA, 23 bp, Homo sapiens
tgtggcctcagctcccacaagcc

SEQ ID NO: 6510266 - DNA, 19 bp, Homo sapiens
tgtggcctccctggctcct

SEQ ID NO: 6510267 - DNA, 12 bp, Homo sapiens
tgtggcctgccc

SEQ ID NO: 6510268 - DNA, 22 bp, Homo sapiens
tgtggcctggatccatcctgct

SEQ ID NO: 6510269 - DNA, 16 bp, Homo sapiens
tgtggcctgggcctcc

SEQ ID NO: 6510270 - DNA, 16 bp, Homo sapiens
tgtggcctgggtcctc

SEQ ID NO: 6510271 - DNA, 22 bp, Homo sapiens
tgtggcctgggtcctcggccct

SEQ ID NO: 6510272 - DNA, 20 bp, Homo sapiens
tgtggcctggtgggtcaggg

SEQ ID NO: 6510273 - DNA, 22 bp, Homo sapiens
tgtggcctgtgccagcaccaca

SEQ ID NO: 6510274 - DNA, 13 bp, Homo sapiens
tgtggcctgtggc

SEQ ID NO: 6510275 - DNA, 17 bp, Homo sapiens
tgtggcctgtggcctgt

SEQ ID NO: 6510276 - DNA, 17 bp, Homo sapiens
tgtggccttctcagcct

SEQ ID NO: 6510277 - DNA, 21 bp, Homo sapiens
tgtggccttgcccgccagcct

SEQ ID NO: 6510278 - DNA, 16 bp, Homo sapiens
tgtggccttggccctg

SEQ ID NO: 6510279 - DNA, 17 bp, Homo sapiens
tgtggccttggccctga

SEQ ID NO: 6510280 - DNA, 19 bp, Homo sapiens
tgtggcctttatgttcttt

SEQ ID NO: 6510281 - DNA, 17 bp, Homo sapiens
tgtggcctttgcgctcc

SEQ ID NO: 6510282 - DNA, 12 bp, Homo sapiens
tgtggcgagcca

SEQ ID NO: 6510283 - DNA, 22 bp, Homo sapiens
tgtggcgagccatttgtcccaa

SEQ ID NO: 6510284 - DNA, 17 bp, Homo sapiens
tgtggcgccgcgtggac

SEQ ID NO: 6510285 - DNA, 20 bp, Homo sapiens
tgtggcgccgcgtggacagc

SEQ ID NO: 6510286 - DNA, 21 bp, Homo sapiens
tgtggcgccgcgtggacagcc

SEQ ID NO: 6510287 - DNA, 18 bp, Homo sapiens
tgtggcgccgtctccagg

SEQ ID NO: 6510288 - DNA, 16 bp, Homo sapiens
tgtggcgtctccctcg

SEQ ID NO: 6510289 - DNA, 22 bp, Homo sapiens
tgtggctattaaaactctttta

SEQ ID NO: 6510290 - DNA, 19 bp, Homo sapiens
tgtggctcaggggagcaag

SEQ ID NO: 6510291 - DNA, 21 bp, Homo sapiens
tgtggctcaggggagcaagct

SEQ ID NO: 6510292 - DNA, 12 bp, Homo sapiens
tgtggctccaca

SEQ ID NO: 6510293 - DNA, 18 bp, Homo sapiens
tgtggctccaggagcagc

SEQ ID NO: 6510294 - DNA, 22 bp, Homo sapiens
tgtggctccaggccaaagtgcc

SEQ ID NO: 6510295 - DNA, 18 bp, Homo sapiens
tgtggctcccacaggtct

SEQ ID NO: 6510296 - DNA, 17 bp, Homo sapiens
tgtggctccctctctcc

SEQ ID NO: 6510297 - DNA, 19 bp, Homo sapiens
tgtggctccctctctcctg

SEQ ID NO: 6510298 - DNA, 12 bp, Homo sapiens
tgtggctccctg

SEQ ID NO: 6510299 - DNA, 13 bp, Homo sapiens
tgtggctcctacc

SEQ ID NO: 6510300 - DNA, 19 bp, Homo sapiens
tgtggctcctatctgtgtt

SEQ ID NO: 6510301 - DNA, 20 bp, Homo sapiens
tgtggctcctatctgtgttt

SEQ ID NO: 6510302 - DNA, 11 bp, Homo sapiens
tgtggctcctg

SEQ ID NO: 6510303 - DNA, 15 bp, Homo sapiens
tgtggctcctgggcc

SEQ ID NO: 6510304 - DNA, 14 bp, Homo sapiens
tgtggctccttccc

SEQ ID NO: 6510305 - DNA, 13 bp, Homo sapiens
tgtggctctgccc

SEQ ID NO: 6510306 - DNA, 17 bp, Homo sapiens
tgtggctctgccctgga

SEQ ID NO: 6510307 - DNA, 16 bp, Homo sapiens
tgtggctcttatttct

SEQ ID NO: 6510308 - DNA, 18 bp, Homo sapiens
tgtggctcttatttctga

SEQ ID NO: 6510309 - DNA, 19 bp, Homo sapiens
tgtggctcttatttctgaa

SEQ ID NO: 6510310 - DNA, 21 bp, Homo sapiens
tgtggctcttatttctgaatt

SEQ ID NO: 6510311 - DNA, 13 bp, Homo sapiens
tgtggctgaaaat

SEQ ID NO: 6510312 - DNA, 19 bp, Homo sapiens
tgtggctgaaaatgcaaag

SEQ ID NO: 6510313 - DNA, 22 bp, Homo sapiens
tgtggctgaaaatgcaaagctg

SEQ ID NO: 6510314 - DNA, 13 bp, Homo sapiens
tgtggctgaggag

SEQ ID NO: 6510315 - DNA, 19 bp, Homo sapiens
tgtggctgcagagaccttg

SEQ ID NO: 6510316 - DNA, 16 bp, Homo sapiens
tgtggctgcagcagcg

SEQ ID NO: 6510317 - DNA, 18 bp, Homo sapiens
tgtggctggaggagctgg

SEQ ID NO: 6510318 - DNA, 22 bp, Homo sapiens
tgtggctggaggagctggcctg

SEQ ID NO: 6510319 - DNA, 12 bp, Homo sapiens
tgtggctggctc

SEQ ID NO: 6510320 - DNA, 13 bp, Homo sapiens
tgtggctggctct

SEQ ID NO: 6510321 - DNA, 15 bp, Homo sapiens
tgtggctgggggcag

SEQ ID NO: 6510322 - DNA, 21 bp, Homo sapiens
tgtggctgggggcaggagggc

SEQ ID NO: 6510323 - DNA, 20 bp, Homo sapiens
tgtggctgggtggtcagcag

SEQ ID NO: 6510324 - DNA, 12 bp, Homo sapiens
tgtggctggtgt

SEQ ID NO: 6510325 - DNA, 13 bp, Homo sapiens
tgtggctggtgtc

SEQ ID NO: 6510326 - DNA, 19 bp, Homo sapiens
tgtggctggtgtccccttc

SEQ ID NO: 6510327 - DNA, 19 bp, Homo sapiens
tgtggctgtcagcaggaag

SEQ ID NO: 6510328 - DNA, 17 bp, Homo sapiens
tgtggcttaaacatttt

SEQ ID NO: 6510329 - DNA, 12 bp, Homo sapiens
tgtggcttggag

SEQ ID NO: 6510330 - DNA, 21 bp, Homo sapiens
tgtggcttggagtggccaaat

SEQ ID NO: 6510331 - DNA, 22 bp, Homo sapiens
tgtggcttggtttggtcatgcc

SEQ ID NO: 6510332 - DNA, 11 bp, Homo sapiens
tgtggctttcc

SEQ ID NO: 6510333 - DNA, 17 bp, Homo sapiens
tgtggctttctttcttt

SEQ ID NO: 6510334 - DNA, 21 bp, Homo sapiens
tgtggctttttgttcagaatt

SEQ ID NO: 6510335 - DNA, 18 bp, Homo sapiens
tgtggcttttttaaaaaa

SEQ ID NO: 6510336 - DNA, 15 bp, Homo sapiens
tgtgggaaaaaaatg

SEQ ID NO: 6510337 - DNA, 13 bp, Homo sapiens
tgtgggaaagagc

SEQ ID NO: 6510338 - DNA, 12 bp, Homo sapiens
tgtgggaacaga

SEQ ID NO: 6510339 - DNA, 15 bp, Homo sapiens
tgtgggaagaccaaa

SEQ ID NO: 6510340 - DNA, 11 bp, Homo sapiens
tgtgggaagag

SEQ ID NO: 6510341 - DNA, 22 bp, Homo sapiens
tgtgggaagatgaactttgtca

SEQ ID NO: 6510342 - DNA, 12 bp, Homo sapiens
tgtgggaagggg

SEQ ID NO: 6510343 - DNA, 12 bp, Homo sapiens
tgtgggacccca

SEQ ID NO: 6510344 - DNA, 19 bp, Homo sapiens
tgtgggaccgcctggccct

SEQ ID NO: 6510345 - DNA, 22 bp, Homo sapiens
tgtgggactccaggccagctcc

SEQ ID NO: 6510346 - DNA, 16 bp, Homo sapiens
tgtgggactgtacaca

SEQ ID NO: 6510347 - DNA, 19 bp, Homo sapiens
tgtgggactgtacacactt

SEQ ID NO: 6510348 - DNA, 20 bp, Homo sapiens
tgtgggactgtacacacttt

SEQ ID NO: 6510349 - DNA, 12 bp, Homo sapiens
tgtgggagaagg

SEQ ID NO: 6510350 - DNA, 14 bp, Homo sapiens
tgtgggagacagca

SEQ ID NO: 6510351 - DNA, 17 bp, Homo sapiens
tgtgggagacagcagcc

SEQ ID NO: 6510352 - DNA, 18 bp, Homo sapiens
tgtgggagacagcagcct

SEQ ID NO: 6510353 - DNA, 17 bp, Homo sapiens
tgtgggagaccggcctg

SEQ ID NO: 6510354 - DNA, 15 bp, Homo sapiens
tgtgggagctcagct

SEQ ID NO: 6510355 - DNA, 18 bp, Homo sapiens
tgtgggagggggaggaag

SEQ ID NO: 6510356 - DNA, 20 bp, Homo sapiens
tgtgggagtccactttcctc

SEQ ID NO: 6510357 - DNA, 13 bp, Homo sapiens
tgtgggagtgagg

SEQ ID NO: 6510358 - DNA, 13 bp, Homo sapiens
tgtgggattatgg

SEQ ID NO: 6510359 - DNA, 18 bp, Homo sapiens
tgtgggattatgggtcac

SEQ ID NO: 6510360 - DNA, 18 bp, Homo sapiens
tgtgggcaaaggcagggc

SEQ ID NO: 6510361 - DNA, 23 bp, Homo sapiens
tgtgggcaagcagatgacagagg

SEQ ID NO: 6510362 - DNA, 19 bp, Homo sapiens
tgtgggcaattgttacaag

SEQ ID NO: 6510363 - DNA, 13 bp, Homo sapiens
tgtgggcaccccc

SEQ ID NO: 6510364 - DNA, 17 bp, Homo sapiens
tgtgggcactggcccag

SEQ ID NO: 6510365 - DNA, 23 bp, Homo sapiens
tgtgggcactggcccaggttcat

SEQ ID NO: 6510366 - DNA, 16 bp, Homo sapiens
tgtgggcactgtgcca

SEQ ID NO: 6510367 - DNA, 12 bp, Homo sapiens
tgtgggcagggt

SEQ ID NO: 6510368 - DNA, 13 bp, Homo sapiens
tgtgggcagggtt

SEQ ID NO: 6510369 - DNA, 24 bp, Homo sapiens
tgtgggccaagtccactgtcctcc

SEQ ID NO: 6510370 - DNA, 19 bp, Homo sapiens
tgtgggccaccgtgcctgg

SEQ ID NO: 6510371 - DNA, 13 bp, Homo sapiens
tgtgggccaggag

SEQ ID NO: 6510372 - DNA, 23 bp, Homo sapiens
tgtgggccatcgcaagtcacaga

SEQ ID NO: 6510373 - DNA, 15 bp, Homo sapiens
tgtgggcccaaggcc

SEQ ID NO: 6510374 - DNA, 23 bp, Homo sapiens
tgtgggccctaccctcctgctga

SEQ ID NO: 6510375 - DNA, 11 bp, Homo sapiens
tgtgggcctgg

SEQ ID NO: 6510376 - DNA, 13 bp, Homo sapiens
tgtgggcctgggc

SEQ ID NO: 6510377 - DNA, 14 bp, Homo sapiens
tgtgggcctgggct

SEQ ID NO: 6510378 - DNA, 17 bp, Homo sapiens
tgtgggcctgggctcct

SEQ ID NO: 6510379 - DNA, 19 bp, Homo sapiens
tgtgggcctgggctcctgg

SEQ ID NO: 6510380 - DNA, 17 bp, Homo sapiens
tgtgggcgcccaccctg

SEQ ID NO: 6510381 - DNA, 20 bp, Homo sapiens
tgtgggcgtgagacctgccc

SEQ ID NO: 6510382 - DNA, 22 bp, Homo sapiens
tgtgggctagttgggcttcctc

SEQ ID NO: 6510383 - DNA, 19 bp, Homo sapiens
tgtgggctccaggcctgta

SEQ ID NO: 6510384 - DNA, 18 bp, Homo sapiens
tgtgggctcccacgccct

SEQ ID NO: 6510385 - DNA, 14 bp, Homo sapiens
tgtgggctgcactc

SEQ ID NO: 6510386 - DNA, 16 bp, Homo sapiens
tgtgggcttcctgctg

SEQ ID NO: 6510387 - DNA, 19 bp, Homo sapiens
tgtggggaacacagctaca

SEQ ID NO: 6510388 - DNA, 23 bp, Homo sapiens
tgtggggaagaggggctggggca

SEQ ID NO: 6510389 - DNA, 18 bp, Homo sapiens
tgtggggacctcagcctg

SEQ ID NO: 6510390 - DNA, 13 bp, Homo sapiens
tgtggggagctgg

SEQ ID NO: 6510391 - DNA, 20 bp, Homo sapiens
tgtggggaggcagctccaac

SEQ ID NO: 6510392 - DNA, 21 bp, Homo sapiens
tgtggggagggtcatgtactt

SEQ ID NO: 6510393 - DNA, 22 bp, Homo sapiens
tgtggggagggtgtctggggac

SEQ ID NO: 6510394 - DNA, 18 bp, Homo sapiens
tgtggggataaagacaga

SEQ ID NO: 6510395 - DNA, 20 bp, Homo sapiens
tgtggggatctcaggggctg

SEQ ID NO: 6510396 - DNA, 19 bp, Homo sapiens
tgtggggatggtgatggag

SEQ ID NO: 6510397 - DNA, 16 bp, Homo sapiens
tgtggggcaggagtgc

SEQ ID NO: 6510398 - DNA, 22 bp, Homo sapiens
tgtggggcaggagtgccaggac

SEQ ID NO: 6510399 - DNA, 16 bp, Homo sapiens
tgtggggccaggacca

SEQ ID NO: 6510400 - DNA, 12 bp, Homo sapiens
tgtggggcccct

SEQ ID NO: 6510401 - DNA, 12 bp, Homo sapiens
tgtggggccttg

SEQ ID NO: 6510402 - DNA, 18 bp, Homo sapiens
tgtggggcttggcgtgga

SEQ ID NO: 6510403 - DNA, 13 bp, Homo sapiens
tgtgggggaaggc

SEQ ID NO: 6510404 - DNA, 18 bp, Homo sapiens
tgtgggggaggtccctgc

SEQ ID NO: 6510405 - DNA, 21 bp, Homo sapiens
tgtgggggccccgtctcaggt

SEQ ID NO: 6510406 - DNA, 18 bp, Homo sapiens
tgtgggggctagaaaaaa

SEQ ID NO: 6510407 - DNA, 23 bp, Homo sapiens
tgtggggggaggctgactcctgg

SEQ ID NO: 6510408 - DNA, 22 bp, Homo sapiens
tgtggggggtaatccctgcttt

SEQ ID NO: 6510409 - DNA, 16 bp, Homo sapiens
tgtgggggtctgggag

SEQ ID NO: 6510410 - DNA, 20 bp, Homo sapiens
tgtgggggtctgggaggcag

SEQ ID NO: 6510411 - DNA, 21 bp, Homo sapiens
tgcctgttgatctatgggaaa

SEQ ID NO: 6510412 - DNA, 18 bp, Homo sapiens
tgcctgttgcaggcaaat

SEQ ID NO: 6510413 - DNA, 20 bp, Homo sapiens
tgcctgttgcaggcaaatgt

SEQ ID NO: 6510414 - DNA, 20 bp, Homo sapiens
tgcctgttggcaggcccact

SEQ ID NO: 6510415 - DNA, 23 bp, Homo sapiens
tgcctgttggcaggcccactccc

SEQ ID NO: 6510416 - DNA, 19 bp, Homo sapiens
tgcctgttggctgctgcgg

SEQ ID NO: 6510417 - DNA, 20 bp, Homo sapiens
tgcctgttgggccaggagcc

SEQ ID NO: 6510418 - DNA, 14 bp, Homo sapiens
tgcctgttgtattt

SEQ ID NO: 6510419 - DNA, 19 bp, Homo sapiens
tgcctgtttggggaggggg

SEQ ID NO: 6510420 - DNA, 18 bp, Homo sapiens
tgcctgttttgagaccag

SEQ ID NO: 6510421 - DNA, 19 bp, Homo sapiens
tgcctgttttgagaccaga

SEQ ID NO: 6510422 - DNA, 21 bp, Homo sapiens
tgcctgttttgagaccagaag

SEQ ID NO: 6510423 - DNA, 19 bp, Homo sapiens
tgccttaaaaatcaagaca

SEQ ID NO: 6510424 - DNA, 18 bp, Homo sapiens
tgccttaaaaccaaagag

SEQ ID NO: 6510425 - DNA, 20 bp, Homo sapiens
tgccttaaaaccaaagaggg

SEQ ID NO: 6510426 - DNA, 15 bp, Homo sapiens
tgccttaaaacttta

SEQ ID NO: 6510427 - DNA, 23 bp, Homo sapiens
tgccttaaacctgaagatgtctc

SEQ ID NO: 6510428 - DNA, 15 bp, Homo sapiens
tgccttaaagaaagt

SEQ ID NO: 6510429 - DNA, 13 bp, Homo sapiens
tgccttaaatata

SEQ ID NO: 6510430 - DNA, 15 bp, Homo sapiens
tgccttaacctggga

SEQ ID NO: 6510431 - DNA, 17 bp, Homo sapiens
tgccttaacctgggacc

SEQ ID NO: 6510432 - DNA, 19 bp, Homo sapiens
tgccttaagcagaacaaat

SEQ ID NO: 6510433 - DNA, 21 bp, Homo sapiens
tgccttaaggtatattataga

SEQ ID NO: 6510434 - DNA, 22 bp, Homo sapiens
tgccttaagtgaggaaatcaaa

SEQ ID NO: 6510435 - DNA, 16 bp, Homo sapiens
tgccttaataaatatg

SEQ ID NO: 6510436 - DNA, 20 bp, Homo sapiens
tgccttaataaatatgtaat

SEQ ID NO: 6510437 - DNA, 23 bp, Homo sapiens
tgccttaataaatatgtaatata

SEQ ID NO: 6510438 - DNA, 19 bp, Homo sapiens
tgccttaatgagaacattt

SEQ ID NO: 6510439 - DNA, 18 bp, Homo sapiens
tgccttaattcttacctc

SEQ ID NO: 6510440 - DNA, 14 bp, Homo sapiens
tgccttaatttaga

SEQ ID NO: 6510441 - DNA, 19 bp, Homo sapiens
tgccttaatttagaaactg

SEQ ID NO: 6510442 - DNA, 21 bp, Homo sapiens
tgccttaatttagaaactgaa

SEQ ID NO: 6510443 - DNA, 22 bp, Homo sapiens
tgccttaatttagaaactgaaa

SEQ ID NO: 6510444 - DNA, 15 bp, Homo sapiens
tgccttaatttttga

SEQ ID NO: 6510445 - DNA, 19 bp, Homo sapiens
tgccttacatcttttctaa

SEQ ID NO: 6510446 - DNA, 20 bp, Homo sapiens
tgccttacatcttttctaat

SEQ ID NO: 6510447 - DNA, 21 bp, Homo sapiens
tgccttaccctcatgttctta

SEQ ID NO: 6510448 - DNA, 20 bp, Homo sapiens
tgccttaccgagagccaaac

SEQ ID NO: 6510449 - DNA, 15 bp, Homo sapiens
tgccttacctcctgc

SEQ ID NO: 6510450 - DNA, 18 bp, Homo sapiens
tgccttaccttcacttaa

SEQ ID NO: 6510451 - DNA, 22 bp, Homo sapiens
tgccttactggtttccccaggg

SEQ ID NO: 6510452 - DNA, 15 bp, Homo sapiens
tgccttactttgtat

SEQ ID NO: 6510453 - DNA, 19 bp, Homo sapiens
tgccttactttgtatgata

SEQ ID NO: 6510454 - DNA, 17 bp, Homo sapiens
tgccttagagccaggca

SEQ ID NO: 6510455 - DNA, 18 bp, Homo sapiens
tgccttagagccaggcac

SEQ ID NO: 6510456 - DNA, 19 bp, Homo sapiens
tgccttagagccaggcaca

SEQ ID NO: 6510457 - DNA, 23 bp, Homo sapiens
tgccttagagccaggcacacact

SEQ ID NO: 6510458 - DNA, 16 bp, Homo sapiens
tgccttagaggagccc

SEQ ID NO: 6510459 - DNA, 19 bp, Homo sapiens
tgccttagaggagcccacg

SEQ ID NO: 6510460 - DNA, 20 bp, Homo sapiens
tgccttagcaatgggggcct

SEQ ID NO: 6510461 - DNA, 22 bp, Homo sapiens
tgccttagcaatgggggcctcc

SEQ ID NO: 6510462 - DNA, 16 bp, Homo sapiens
tgccttagcacttctt

SEQ ID NO: 6510463 - DNA, 17 bp, Homo sapiens
tgccttagcacttcttt

SEQ ID NO: 6510464 - DNA, 11 bp, Homo sapiens
tgccttagcat

SEQ ID NO: 6510465 - DNA, 17 bp, Homo sapiens
tgccttaggaagtgact

SEQ ID NO: 6510466 - DNA, 21 bp, Homo sapiens
tgccttaggcctacctgatgg

SEQ ID NO: 6510467 - DNA, 16 bp, Homo sapiens
tgccttatattatttt

SEQ ID NO: 6510468 - DNA, 18 bp, Homo sapiens
tgccttatattattttct

SEQ ID NO: 6510469 - DNA, 23 bp, Homo sapiens
tgccttatatttgtccaacaact

SEQ ID NO: 6510470 - DNA, 22 bp, Homo sapiens
tgccttatcaaataatattcat

SEQ ID NO: 6510471 - DNA, 21 bp, Homo sapiens
tgccttatctaaatcaccaga

SEQ ID NO: 6510472 - DNA, 14 bp, Homo sapiens
tgccttatcttgca

SEQ ID NO: 6510473 - DNA, 22 bp, Homo sapiens
tgccttatgggctgaagtgttc

SEQ ID NO: 6510474 - DNA, 18 bp, Homo sapiens
tgccttatgtaattattt

SEQ ID NO: 6510475 - DNA, 16 bp, Homo sapiens
tgccttattaaagttc

SEQ ID NO: 6510476 - DNA, 21 bp, Homo sapiens
tgccttattagagtgtctttc

SEQ ID NO: 6510477 - DNA, 21 bp, Homo sapiens
tgccttattgctgttgcttat

SEQ ID NO: 6510478 - DNA, 19 bp, Homo sapiens
tgccttatttttgaattct

SEQ ID NO: 6510479 - DNA, 23 bp, Homo sapiens
tgccttcaaaaatgtgctgccta

SEQ ID NO: 6510480 - DNA, 13 bp, Homo sapiens
tgccttcaaatag

SEQ ID NO: 6510481 - DNA, 16 bp, Homo sapiens
tgccttcaaatagtat

SEQ ID NO: 6510482 - DNA, 21 bp, Homo sapiens
tgccttcaacaacgtgagaga

SEQ ID NO: 6510483 - DNA, 23 bp, Homo sapiens
tgccttcaacaacgtgagagaaa

SEQ ID NO: 6510484 - DNA, 19 bp, Homo sapiens
tgccttcaaggactgtttc

SEQ ID NO: 6510485 - DNA, 20 bp, Homo sapiens
tgccttcaaggactgtttca

SEQ ID NO: 6510486 - DNA, 16 bp, Homo sapiens
tgccttcacaaatgtc

SEQ ID NO: 6510487 - DNA, 15 bp, Homo sapiens
tgccttcacatttgg

SEQ ID NO: 6510488 - DNA, 22 bp, Homo sapiens
tgccttcagagtatctaatcct

SEQ ID NO: 6510489 - DNA, 15 bp, Homo sapiens
tgccttcagccctaa

SEQ ID NO: 6510490 - DNA, 19 bp, Homo sapiens
tgccttcagctagaatcct

SEQ ID NO: 6510491 - DNA, 13 bp, Homo sapiens
tgccttcagctgt

SEQ ID NO: 6510492 - DNA, 20 bp, Homo sapiens
tgccttcagtcttggtaaaa

SEQ ID NO: 6510493 - DNA, 18 bp, Homo sapiens
tgccttccaccctgccct

SEQ ID NO: 6510494 - DNA, 19 bp, Homo sapiens
tgccttccaccctgccctg

SEQ ID NO: 6510495 - DNA, 22 bp, Homo sapiens
tgccttccaccctgccctggcc

SEQ ID NO: 6510496 - DNA, 17 bp, Homo sapiens
tgccttccacgctgtct

SEQ ID NO: 6510497 - DNA, 21 bp, Homo sapiens
tgccttccacgctgtctccag

SEQ ID NO: 6510498 - DNA, 12 bp, Homo sapiens
tgccttccagat

SEQ ID NO: 6510499 - DNA, 22 bp, Homo sapiens
tgccttccaggcgtagggccag

SEQ ID NO: 6510500 - DNA, 17 bp, Homo sapiens
tgccttccataattatg

SEQ ID NO: 6510501 - DNA, 15 bp, Homo sapiens
tgccttcccctgggc

SEQ ID NO: 6510502 - DNA, 20 bp, Homo sapiens
tgccttcccctgggccctga

SEQ ID NO: 6510503 - DNA, 14 bp, Homo sapiens
tgccttccctagct

SEQ ID NO: 6510504 - DNA, 17 bp, Homo sapiens
tgccttccctagcttta

SEQ ID NO: 6510505 - DNA, 11 bp, Homo sapiens
tgccttccctt

SEQ ID NO: 6510506 - DNA, 16 bp, Homo sapiens
tgccttcctaagcctg

SEQ ID NO: 6510507 - DNA, 17 bp, Homo sapiens
tgccttcctcctgggcc

SEQ ID NO: 6510508 - DNA, 19 bp, Homo sapiens
tgccttcctcctgggccct

SEQ ID NO: 6510509 - DNA, 13 bp, Homo sapiens
tgccttcctcctt

SEQ ID NO: 6510510 - DNA, 21 bp, Homo sapiens
tgccttcctctctctaccagt

SEQ ID NO: 6510511 - DNA, 16 bp, Homo sapiens
tgccttcctctgagga

SEQ ID NO: 6510512 - DNA, 19 bp, Homo sapiens
tgccttcctgtttttcaca

SEQ ID NO: 6510513 - DNA, 17 bp, Homo sapiens
tgccttccttagcagct

SEQ ID NO: 6510514 - DNA, 19 bp, Homo sapiens
tgccttcctttctccagga

SEQ ID NO: 6510515 - DNA, 22 bp, Homo sapiens
tgccttcgcaccttgctgtgtg

SEQ ID NO: 6510516 - DNA, 20 bp, Homo sapiens
tgccttcgcggtggaaggcc

SEQ ID NO: 6510517 - DNA, 16 bp, Homo sapiens
tgccttcgcttcttgc

SEQ ID NO: 6510518 - DNA, 17 bp, Homo sapiens
tgccttcgcttcttgcc

SEQ ID NO: 6510519 - DNA, 21 bp, Homo sapiens
tgccttcgcttcttgcctctg

SEQ ID NO: 6510520 - DNA, 22 bp, Homo sapiens
tgccttcgcttcttgcctctgt

SEQ ID NO: 6510521 - DNA, 20 bp, Homo sapiens
tgccttcgttaactgtgtat

SEQ ID NO: 6510522 - DNA, 22 bp, Homo sapiens
tgccttcgttaactgtgtatgt

SEQ ID NO: 6510523 - DNA, 16 bp, Homo sapiens
tgccttcgtttatatt

SEQ ID NO: 6510524 - DNA, 16 bp, Homo sapiens
tgccttctactcccct

SEQ ID NO: 6510525 - DNA, 19 bp, Homo sapiens
tgccttctagaatacatat

SEQ ID NO: 6510526 - DNA, 23 bp, Homo sapiens
tgccttctcaccagctgcaaagt

SEQ ID NO: 6510527 - DNA, 11 bp, Homo sapiens
tgccttctcag

SEQ ID NO: 6510528 - DNA, 23 bp, Homo sapiens
tgccttctccagacaaaccagaa

SEQ ID NO: 6510529 - DNA, 14 bp, Homo sapiens
tgccttctcctctc

SEQ ID NO: 6510530 - DNA, 20 bp, Homo sapiens
tgccttctccttccccagga

SEQ ID NO: 6510531 - DNA, 15 bp, Homo sapiens
tgccttctctcagct

SEQ ID NO: 6510532 - DNA, 13 bp, Homo sapiens
tgccttctcttct

SEQ ID NO: 6510533 - DNA, 19 bp, Homo sapiens
tgccttctgacggccctgc

SEQ ID NO: 6510534 - DNA, 14 bp, Homo sapiens
tgccttctgctgaa

SEQ ID NO: 6510535 - DNA, 16 bp, Homo sapiens
tgccttctgctgaaag

SEQ ID NO: 6510536 - DNA, 13 bp, Homo sapiens
tgccttctgggga

SEQ ID NO: 6510537 - DNA, 18 bp, Homo sapiens
tgccttctgtcctggtgt

SEQ ID NO: 6510538 - DNA, 11 bp, Homo sapiens
tgccttctgtg

SEQ ID NO: 6510539 - DNA, 22 bp, Homo sapiens
tgccttctgtggccagagtctt

SEQ ID NO: 6510540 - DNA, 13 bp, Homo sapiens
tgccttcttcacc

SEQ ID NO: 6510541 - DNA, 13 bp, Homo sapiens
tgccttcttcagg

SEQ ID NO: 6510542 - DNA, 15 bp, Homo sapiens
tgccttcttcagggc

SEQ ID NO: 6510543 - DNA, 19 bp, Homo sapiens
tgccttcttcagggcctgg

SEQ ID NO: 6510544 - DNA, 12 bp, Homo sapiens
tgccttcttctt

SEQ ID NO: 6510545 - DNA, 19 bp, Homo sapiens
tgccttcttctttttgctg

SEQ ID NO: 6510546 - DNA, 20 bp, Homo sapiens
tgccttcttctttttgctgt

SEQ ID NO: 6510547 - DNA, 12 bp, Homo sapiens
tgccttctttga

SEQ ID NO: 6510548 - DNA, 16 bp, Homo sapiens
tgccttctttgaagaa

SEQ ID NO: 6510549 - DNA, 13 bp, Homo sapiens
tgccttcttttgt

SEQ ID NO: 6510550 - DNA, 12 bp, Homo sapiens
tgccttgaaaaa

SEQ ID NO: 6510551 - DNA, 16 bp, Homo sapiens
tgccttgaaaaagaca

SEQ ID NO: 6510552 - DNA, 16 bp, Homo sapiens
tgccttgaaaaatgac

SEQ ID NO: 6510553 - DNA, 22 bp, Homo sapiens
tgccttgaaaaatgacaattgt

SEQ ID NO: 6510554 - DNA, 18 bp, Homo sapiens
tgccttgaaatttacaca

SEQ ID NO: 6510555 - DNA, 17 bp, Homo sapiens
tgccttgaaccacttcc

SEQ ID NO: 6510556 - DNA, 23 bp, Homo sapiens
tgccttgaacctgtgagtaaata

SEQ ID NO: 6510557 - DNA, 12 bp, Homo sapiens
tgccttgaactg

SEQ ID NO: 6510558 - DNA, 13 bp, Homo sapiens
tgccttgaactgt

SEQ ID NO: 6510559 - DNA, 14 bp, Homo sapiens
tgccttgaactgtt

SEQ ID NO: 6510560 - DNA, 14 bp, Homo sapiens
tgccttgaagccac

SEQ ID NO: 6510561 - DNA, 15 bp, Homo sapiens
tgccttgaataataa

SEQ ID NO: 6510562 - DNA, 19 bp, Homo sapiens
tgccttgacaacagactga

SEQ ID NO: 6510563 - DNA, 16 bp, Homo sapiens
tgccttgagcttttca

SEQ ID NO: 6510564 - DNA, 20 bp, Homo sapiens
tgccttgagtctttaatccc

SEQ ID NO: 6510565 - DNA, 19 bp, Homo sapiens
tgccttgatgaagcctgtg

SEQ ID NO: 6510566 - DNA, 16 bp, Homo sapiens
tgccttgatggagaag

SEQ ID NO: 6510567 - DNA, 14 bp, Homo sapiens
tgccttgatgtttc

SEQ ID NO: 6510568 - DNA, 15 bp, Homo sapiens
tgccttgcagaactg

SEQ ID NO: 6510569 - DNA, 20 bp, Homo sapiens
tgccttgcagaactgccatt

SEQ ID NO: 6510570 - DNA, 18 bp, Homo sapiens
tgccttgcccacaggtgc

SEQ ID NO: 6510571 - DNA, 19 bp, Homo sapiens
tgccttgcccacaggtgcg

SEQ ID NO: 6510572 - DNA, 19 bp, Homo sapiens
tgccttgcccactcctgct

SEQ ID NO: 6510573 - DNA, 17 bp, Homo sapiens
tgccttgccgctcccct

SEQ ID NO: 6510574 - DNA, 15 bp, Homo sapiens
tgccttgcctcctca

SEQ ID NO: 6510575 - DNA, 17 bp, Homo sapiens
tgccttgcctcctcagt

SEQ ID NO: 6510576 - DNA, 12 bp, Homo sapiens
tgccttgccttt

SEQ ID NO: 6510577 - DNA, 13 bp, Homo sapiens
tgccttgccttta

SEQ ID NO: 6510578 - DNA, 21 bp, Homo sapiens
tgccttgctagaaacataatt

SEQ ID NO: 6510579 - DNA, 15 bp, Homo sapiens
tgccttgctcggcgc

SEQ ID NO: 6510580 - DNA, 18 bp, Homo sapiens
tgccttgctgcacctgag

SEQ ID NO: 6510581 - DNA, 13 bp, Homo sapiens
tgccttgctgcct

SEQ ID NO: 6510582 - DNA, 14 bp, Homo sapiens
tgccttgctgcctt

SEQ ID NO: 6510583 - DNA, 21 bp, Homo sapiens
tgccttgctgccttcaccctg

SEQ ID NO: 6510584 - DNA, 14 bp, Homo sapiens
tgccttgctgttct

SEQ ID NO: 6510585 - DNA, 23 bp, Homo sapiens
tgccttgcttctcccatttcctg

SEQ ID NO: 6510586 - DNA, 18 bp, Homo sapiens
tgccttggaagttgcatg

SEQ ID NO: 6510587 - DNA, 18 bp, Homo sapiens
tgccttggaggaaatgtg

SEQ ID NO: 6510588 - DNA, 17 bp, Homo sapiens
tgtgggggtggccatcc

SEQ ID NO: 6510589 - DNA, 21 bp, Homo sapiens
tgtgggggtggccatccctgg

SEQ ID NO: 6510590 - DNA, 14 bp, Homo sapiens
tgtggggtctggct

SEQ ID NO: 6510591 - DNA, 20 bp, Homo sapiens
tgtggggtgacgggactcag

SEQ ID NO: 6510592 - DNA, 21 bp, Homo sapiens
tgtggggtggagcactggact

SEQ ID NO: 6510593 - DNA, 14 bp, Homo sapiens
tgtggggtgggctg

SEQ ID NO: 6510594 - DNA, 12 bp, Homo sapiens
tgtggggtgggg

SEQ ID NO: 6510595 - DNA, 13 bp, Homo sapiens
tgtggggtggggt

SEQ ID NO: 6510596 - DNA, 14 bp, Homo sapiens
tgtggggttgctga

SEQ ID NO: 6510597 - DNA, 18 bp, Homo sapiens
tgtgggtaagaggagcag

SEQ ID NO: 6510598 - DNA, 21 bp, Homo sapiens
tgtgggtaagaggagcagagg

SEQ ID NO: 6510599 - DNA, 16 bp, Homo sapiens
tgtgggtagtcattct

SEQ ID NO: 6510600 - DNA, 21 bp, Homo sapiens
tgtgggtatttcttggcatgc

SEQ ID NO: 6510601 - DNA, 15 bp, Homo sapiens
tgtgggtcaaggaat

SEQ ID NO: 6510602 - DNA, 14 bp, Homo sapiens
tgtgggtcagggag

SEQ ID NO: 6510603 - DNA, 15 bp, Homo sapiens
tgtgggtccccactc

SEQ ID NO: 6510604 - DNA, 12 bp, Homo sapiens
tgtgggtcccgc

SEQ ID NO: 6510605 - DNA, 18 bp, Homo sapiens
tgtgggtccctctgcccc

SEQ ID NO: 6510606 - DNA, 12 bp, Homo sapiens
tgtgggtctctg

SEQ ID NO: 6510607 - DNA, 16 bp, Homo sapiens
tgtgggtgaagcgcct

SEQ ID NO: 6510608 - DNA, 15 bp, Homo sapiens
tgtgggtgaccaggt

SEQ ID NO: 6510609 - DNA, 13 bp, Homo sapiens
tgtgggtgagcca

SEQ ID NO: 6510610 - DNA, 17 bp, Homo sapiens
tgtgggtgatcagaagg

SEQ ID NO: 6510611 - DNA, 17 bp, Homo sapiens
tgtgggtgatggggagg

SEQ ID NO: 6510612 - DNA, 14 bp, Homo sapiens
tgtgggtggaaggg

SEQ ID NO: 6510613 - DNA, 17 bp, Homo sapiens
tgtgggtggaagggctg

SEQ ID NO: 6510614 - DNA, 13 bp, Homo sapiens
tgtgggtgggaga

SEQ ID NO: 6510615 - DNA, 13 bp, Homo sapiens
tgtgggtggggaa

SEQ ID NO: 6510616 - DNA, 21 bp, Homo sapiens
tgtgggtggggaggccctgcc

SEQ ID NO: 6510617 - DNA, 23 bp, Homo sapiens
tgtgggtggggcttctctgggac

SEQ ID NO: 6510618 - DNA, 13 bp, Homo sapiens
tgtgggtgtcctg

SEQ ID NO: 6510619 - DNA, 14 bp, Homo sapiens
tgtgggtgtgtgcg

SEQ ID NO: 6510620 - DNA, 19 bp, Homo sapiens
tgtgggtgtgtgcgcctga

SEQ ID NO: 6510621 - DNA, 17 bp, Homo sapiens
tgtgggttatcctcctc

SEQ ID NO: 6510622 - DNA, 16 bp, Homo sapiens
tgtgggttggccagga

SEQ ID NO: 6510623 - DNA, 17 bp, Homo sapiens
tgtgggttggccaggag

SEQ ID NO: 6510624 - DNA, 15 bp, Homo sapiens
tgtgggttgtgatat

SEQ ID NO: 6510625 - DNA, 19 bp, Homo sapiens
tgtgggtttactctgtgct

SEQ ID NO: 6510626 - DNA, 20 bp, Homo sapiens
tgtgggtttactctgtgcta

SEQ ID NO: 6510627 - DNA, 23 bp, Homo sapiens
tgtgggtttgggtgcctcctgca

SEQ ID NO: 6510628 - DNA, 16 bp, Homo sapiens
tgtggtaaatgccaca

SEQ ID NO: 6510629 - DNA, 23 bp, Homo sapiens
tgtggtaaatgccacacaccttt

SEQ ID NO: 6510630 - DNA, 17 bp, Homo sapiens
tgtggtaacttctttga

SEQ ID NO: 6510631 - DNA, 18 bp, Homo sapiens
tgtggtaacttctttgaa

SEQ ID NO: 6510632 - DNA, 14 bp, Homo sapiens
tgtggtaacttgag

SEQ ID NO: 6510633 - DNA, 22 bp, Homo sapiens
tgtggtaacttgagattcaaga

SEQ ID NO: 6510634 - DNA, 20 bp, Homo sapiens
tgtggtaagcaacatggctt

SEQ ID NO: 6510635 - DNA, 21 bp, Homo sapiens
tgtggtaagcaacatggcttt

SEQ ID NO: 6510636 - DNA, 20 bp, Homo sapiens
tgtggtaattctatttgtat

SEQ ID NO: 6510637 - DNA, 13 bp, Homo sapiens
tgtggtacagaga

SEQ ID NO: 6510638 - DNA, 19 bp, Homo sapiens
tgtggtacagagaagccag

SEQ ID NO: 6510639 - DNA, 21 bp, Homo sapiens
tgtggtacagagaagccagct

SEQ ID NO: 6510640 - DNA, 19 bp, Homo sapiens
tgtggtacatacacaccag

SEQ ID NO: 6510641 - DNA, 16 bp, Homo sapiens
tgtggtacatggtgtt

SEQ ID NO: 6510642 - DNA, 17 bp, Homo sapiens
tgtggtaccctggcaga

SEQ ID NO: 6510643 - DNA, 22 bp, Homo sapiens
tgtggtacctagtcagatggta

SEQ ID NO: 6510644 - DNA, 20 bp, Homo sapiens
tgtggtaccttcagccctgg

SEQ ID NO: 6510645 - DNA, 15 bp, Homo sapiens
tgtggtactggcaat

SEQ ID NO: 6510646 - DNA, 15 bp, Homo sapiens
tgtggtagaaatttt

SEQ ID NO: 6510647 - DNA, 22 bp, Homo sapiens
tgtggtaggccttttaacattt

SEQ ID NO: 6510648 - DNA, 15 bp, Homo sapiens
tgtggtaggggcagg

SEQ ID NO: 6510649 - DNA, 20 bp, Homo sapiens
tgtggtaggggcagggaggc

SEQ ID NO: 6510650 - DNA, 20 bp, Homo sapiens
tgtggtagtcctcccaagct

SEQ ID NO: 6510651 - DNA, 21 bp, Homo sapiens
tgtggtagtcctcccaagctg

SEQ ID NO: 6510652 - DNA, 20 bp, Homo sapiens
tgtggtatatttgtgtatgt

SEQ ID NO: 6510653 - DNA, 21 bp, Homo sapiens
tgtggtatatttgtgtatgtg

SEQ ID NO: 6510654 - DNA, 21 bp, Homo sapiens
tgtggtatgtagcccggccag

SEQ ID NO: 6510655 - DNA, 20 bp, Homo sapiens
tgtggtattggtgctttgtg

SEQ ID NO: 6510656 - DNA, 23 bp, Homo sapiens
tgtggtattttggcattttggct

SEQ ID NO: 6510657 - DNA, 15 bp, Homo sapiens
tgtggtcaacatttc

SEQ ID NO: 6510658 - DNA, 17 bp, Homo sapiens
tgtggtcaacatttctc

SEQ ID NO: 6510659 - DNA, 21 bp, Homo sapiens
tgtggtcaacatttctcatgt

SEQ ID NO: 6510660 - DNA, 20 bp, Homo sapiens
tgtggtcacaggaagtagag

SEQ ID NO: 6510661 - DNA, 14 bp, Homo sapiens
tgtggtcacagtga

SEQ ID NO: 6510662 - DNA, 18 bp, Homo sapiens
tgtggtcagcggcctggg

SEQ ID NO: 6510663 - DNA, 20 bp, Homo sapiens
tgtggtcagcggtatgtgcg

SEQ ID NO: 6510664 - DNA, 17 bp, Homo sapiens
tgtggtcaggcccagcc

SEQ ID NO: 6510665 - DNA, 21 bp, Homo sapiens
tgtggtcatgtgagtctggga

SEQ ID NO: 6510666 - DNA, 13 bp, Homo sapiens
tgtggtccaaata

SEQ ID NO: 6510667 - DNA, 17 bp, Homo sapiens
tgtggtccatctctgaa

SEQ ID NO: 6510668 - DNA, 19 bp, Homo sapiens
tgtggtcccacccaggaag

SEQ ID NO: 6510669 - DNA, 16 bp, Homo sapiens
tgtggtcccaccccac

SEQ ID NO: 6510670 - DNA, 20 bp, Homo sapiens
tgtggtccctccactaggag

SEQ ID NO: 6510671 - DNA, 16 bp, Homo sapiens
tgtggtctactaaata

SEQ ID NO: 6510672 - DNA, 11 bp, Homo sapiens
tgtggtctcag

SEQ ID NO: 6510673 - DNA, 14 bp, Homo sapiens
tgtggtctccagct

SEQ ID NO: 6510674 - DNA, 16 bp, Homo sapiens
tgtggtctccagctcc

SEQ ID NO: 6510675 - DNA, 21 bp, Homo sapiens
tgtggtctcgatgctgctggc

SEQ ID NO: 6510676 - DNA, 18 bp, Homo sapiens
tgtggtctctgccccagc

SEQ ID NO: 6510677 - DNA, 17 bp, Homo sapiens
tgtggtcttatgatttt

SEQ ID NO: 6510678 - DNA, 16 bp, Homo sapiens
tgtggtctttttcctg

SEQ ID NO: 6510679 - DNA, 17 bp, Homo sapiens
tgtggtgaaaagcaggt

SEQ ID NO: 6510680 - DNA, 17 bp, Homo sapiens
tgtggtgaagtgtggct

SEQ ID NO: 6510681 - DNA, 15 bp, Homo sapiens
tgtggtgaatgtgtg

SEQ ID NO: 6510682 - DNA, 17 bp, Homo sapiens
tgtggtgactttggata

SEQ ID NO: 6510683 - DNA, 23 bp, Homo sapiens
tgtggtgaggggctttctcttcc

SEQ ID NO: 6510684 - DNA, 19 bp, Homo sapiens
tgtggtgaggttgggcagc

SEQ ID NO: 6510685 - DNA, 13 bp, Homo sapiens
tgtggtgatgaaa

SEQ ID NO: 6510686 - DNA, 16 bp, Homo sapiens
tgtggtgcagtgtgaa

SEQ ID NO: 6510687 - DNA, 12 bp, Homo sapiens
tgtggtgcattc

SEQ ID NO: 6510688 - DNA, 19 bp, Homo sapiens
tgtggtgcctgaggtctgt

SEQ ID NO: 6510689 - DNA, 13 bp, Homo sapiens
tgtggtgctgaca

SEQ ID NO: 6510690 - DNA, 15 bp, Homo sapiens
tgtggtggagccagg

SEQ ID NO: 6510691 - DNA, 14 bp, Homo sapiens
tgtggtggcctcag

SEQ ID NO: 6510692 - DNA, 23 bp, Homo sapiens
tgtggtgggttctttggaaggag

SEQ ID NO: 6510693 - DNA, 19 bp, Homo sapiens
tgtggtgtaaagctggccc

SEQ ID NO: 6510694 - DNA, 14 bp, Homo sapiens
tgtggtgtaattta

SEQ ID NO: 6510695 - DNA, 20 bp, Homo sapiens
tgtggtgtaatttataaaat

SEQ ID NO: 6510696 - DNA, 21 bp, Homo sapiens
tgtggtgtattttttaaaaaa

SEQ ID NO: 6510697 - DNA, 15 bp, Homo sapiens
tgtggtgtctgcctg

SEQ ID NO: 6510698 - DNA, 16 bp, Homo sapiens
tgtggtgtgagcttca

SEQ ID NO: 6510699 - DNA, 23 bp, Homo sapiens
tgtggtgtgtccccctctgtcca

SEQ ID NO: 6510700 - DNA, 18 bp, Homo sapiens
tgtggtgttagggtgcag

SEQ ID NO: 6510701 - DNA, 16 bp, Homo sapiens
tgtggtgttgggaagg

SEQ ID NO: 6510702 - DNA, 14 bp, Homo sapiens
tgtggttaatgcca

SEQ ID NO: 6510703 - DNA, 15 bp, Homo sapiens
tgtggttaatgccat

SEQ ID NO: 6510704 - DNA, 20 bp, Homo sapiens
tgtggttaatgccatggaca

SEQ ID NO: 6510705 - DNA, 19 bp, Homo sapiens
tgtggttatttttatacag

SEQ ID NO: 6510706 - DNA, 21 bp, Homo sapiens
tgtggttatttttatacagta

SEQ ID NO: 6510707 - DNA, 14 bp, Homo sapiens
tgtggttcactgca

SEQ ID NO: 6510708 - DNA, 22 bp, Homo sapiens
tgtggttcactgcactgttcag

SEQ ID NO: 6510709 - DNA, 21 bp, Homo sapiens
tgtggttcagctactttccat

SEQ ID NO: 6510710 - DNA, 20 bp, Homo sapiens
tgtggttctataataagttt

SEQ ID NO: 6510711 - DNA, 19 bp, Homo sapiens
tgtggttgacttatgggcc

SEQ ID NO: 6510712 - DNA, 16 bp, Homo sapiens
tgtggttgcagcctga

SEQ ID NO: 6510713 - DNA, 16 bp, Homo sapiens
tgtggttggaaaactt

SEQ ID NO: 6510714 - DNA, 20 bp, Homo sapiens
tgtggttgtggatgggaggc

SEQ ID NO: 6510715 - DNA, 15 bp, Homo sapiens
tgtggttgtgtgtgt

SEQ ID NO: 6510716 - DNA, 22 bp, Homo sapiens
tgtggtttcaaatcagccagct

SEQ ID NO: 6510717 - DNA, 21 bp, Homo sapiens
tgtggtttcagttctgtgtac

SEQ ID NO: 6510718 - DNA, 22 bp, Homo sapiens
tgtggtttcagttctgtgtaca

SEQ ID NO: 6510719 - DNA, 23 bp, Homo sapiens
tgtggtttcccctttctttcctt

SEQ ID NO: 6510720 - DNA, 16 bp, Homo sapiens
tgtggtttccctgccc

SEQ ID NO: 6510721 - DNA, 19 bp, Homo sapiens
tgtggtttccctgcccctg

SEQ ID NO: 6510722 - DNA, 22 bp, Homo sapiens
tgtggtttccctgcccctgtcc

SEQ ID NO: 6510723 - DNA, 12 bp, Homo sapiens
tgtggtttcttt

SEQ ID NO: 6510724 - DNA, 20 bp, Homo sapiens
tgtggttttcttttgccatg

SEQ ID NO: 6510725 - DNA, 13 bp, Homo sapiens
tgtggttttgtaa

SEQ ID NO: 6510726 - DNA, 16 bp, Homo sapiens
tgtggttttgtaattt

SEQ ID NO: 6510727 - DNA, 10 bp, Homo sapiens
tgtggttttt

SEQ ID NO: 6510728 - DNA, 13 bp, Homo sapiens
tgtggtttttagt

SEQ ID NO: 6510729 - DNA, 22 bp, Homo sapiens
tgtggtttttgtgtgtgtggac

SEQ ID NO: 6510730 - DNA, 16 bp, Homo sapiens
tgtgtaaaaaaaccac

SEQ ID NO: 6510731 - DNA, 16 bp, Homo sapiens
tgtgtaaaaaatggaa

SEQ ID NO: 6510732 - DNA, 20 bp, Homo sapiens
tgtgtaaaaaatggaaaaaa

SEQ ID NO: 6510733 - DNA, 15 bp, Homo sapiens
tgtgtaaaaagagag

SEQ ID NO: 6510734 - DNA, 14 bp, Homo sapiens
tgtgtaaaatgtga

SEQ ID NO: 6510735 - DNA, 13 bp, Homo sapiens
tgtgtaaaattaa

SEQ ID NO: 6510736 - DNA, 14 bp, Homo sapiens
tgtgtaaaattaat

SEQ ID NO: 6510737 - DNA, 23 bp, Homo sapiens
tgtgtaaaattaatgtaataaag

SEQ ID NO: 6510738 - DNA, 17 bp, Homo sapiens
tgtgtaaacctaattgt

SEQ ID NO: 6510739 - DNA, 20 bp, Homo sapiens
tgtgtaaagatctacatgaa

SEQ ID NO: 6510740 - DNA, 19 bp, Homo sapiens
tgtgtaaagatttatacag

SEQ ID NO: 6510741 - DNA, 19 bp, Homo sapiens
tgtgtaaagtatgcatgca

SEQ ID NO: 6510742 - DNA, 14 bp, Homo sapiens
tgtgtaaagttagt

SEQ ID NO: 6510743 - DNA, 20 bp, Homo sapiens
tgtgtaaataatttgcactg

SEQ ID NO: 6510744 - DNA, 15 bp, Homo sapiens
tgtgtaaatatatgt

SEQ ID NO: 6510745 - DNA, 20 bp, Homo sapiens
tgtgtaaatatgtacatttg

SEQ ID NO: 6510746 - DNA, 19 bp, Homo sapiens
tgtgtaaatatttttccct

SEQ ID NO: 6510747 - DNA, 18 bp, Homo sapiens
tgtgtaaatctgaaaaac

SEQ ID NO: 6510748 - DNA, 23 bp, Homo sapiens
tgtgtaaattaatggtttattct

SEQ ID NO: 6510749 - DNA, 21 bp, Homo sapiens
tgtgtaacaattttaatgcta

SEQ ID NO: 6510750 - DNA, 15 bp, Homo sapiens
tgtgtaacactgtgt

SEQ ID NO: 6510751 - DNA, 13 bp, Homo sapiens
tgtgtaacagaac

SEQ ID NO: 6510752 - DNA, 19 bp, Homo sapiens
tgtgtaacatccaagccag

SEQ ID NO: 6510753 - DNA, 21 bp, Homo sapiens
tgtgtaacatccaagccagag

SEQ ID NO: 6510754 - DNA, 16 bp, Homo sapiens
tgtgtaacatctgcca

SEQ ID NO: 6510755 - DNA, 20 bp, Homo sapiens
tgtgtaaccagctcagtgtt

SEQ ID NO: 6510756 - DNA, 15 bp, Homo sapiens
tgtgtaactgaaagg

SEQ ID NO: 6510757 - DNA, 12 bp, Homo sapiens
tgtgtaactgtt

SEQ ID NO: 6510758 - DNA, 17 bp, Homo sapiens
tgtgtaagaaatacaga

SEQ ID NO: 6510759 - DNA, 13 bp, Homo sapiens
tgtgtaagacact

SEQ ID NO: 6510760 - DNA, 19 bp, Homo sapiens
tgtgtaagagaatgttgaa

SEQ ID NO: 6510761 - DNA, 12 bp, Homo sapiens
tgtgtaagattt

SEQ ID NO: 6510762 - DNA, 18 bp, Homo sapiens
tgtgtaataagaaagtat

SEQ ID NO: 6510763 - DNA, 19 bp, Homo sapiens
tgtgtaatctaagtatatg

SEQ ID NO: 6510764 - DNA, 16 bp, Homo sapiens
tgtgtaatctctgatt

SEQ ID NO: 6510765 - DNA, 14 bp, Homo sapiens
tgtgtaatgactga

SEQ ID NO: 6510766 - DNA, 21 bp, Homo sapiens
tgtgtaattagtgccacttaa

SEQ ID NO: 6510767 - DNA, 17 bp, Homo sapiens
tgccttggatgagaagt

SEQ ID NO: 6510768 - DNA, 19 bp, Homo sapiens
tgccttggcctcccaaagt

SEQ ID NO: 6510769 - DNA, 17 bp, Homo sapiens
tgccttggcctcccaag

SEQ ID NO: 6510770 - DNA, 15 bp, Homo sapiens
tgccttggcctcggc

SEQ ID NO: 6510771 - DNA, 22 bp, Homo sapiens
tgccttggcctcggcgggcttt

SEQ ID NO: 6510772 - DNA, 16 bp, Homo sapiens
tgccttggctcagaca

SEQ ID NO: 6510773 - DNA, 17 bp, Homo sapiens
tgccttggctcagacat

SEQ ID NO: 6510774 - DNA, 14 bp, Homo sapiens
tgccttgggccttg

SEQ ID NO: 6510775 - DNA, 16 bp, Homo sapiens
tgccttgggccttgct

SEQ ID NO: 6510776 - DNA, 11 bp, Homo sapiens
tgccttgggct

SEQ ID NO: 6510777 - DNA, 19 bp, Homo sapiens
tgccttgggctgctcctca

SEQ ID NO: 6510778 - DNA, 20 bp, Homo sapiens
tgccttggggaatttcctct

SEQ ID NO: 6510779 - DNA, 15 bp, Homo sapiens
tgccttggtgccggt

SEQ ID NO: 6510780 - DNA, 22 bp, Homo sapiens
tgccttggtgccggtcacactc

SEQ ID NO: 6510781 - DNA, 16 bp, Homo sapiens
tgccttggtgtgctgt

SEQ ID NO: 6510782 - DNA, 11 bp, Homo sapiens
tgccttggttt

SEQ ID NO: 6510783 - DNA, 23 bp, Homo sapiens
tgccttggtttttactgctctga

SEQ ID NO: 6510784 - DNA, 17 bp, Homo sapiens
tgccttgtcacgccaga

SEQ ID NO: 6510785 - DNA, 15 bp, Homo sapiens
tgccttgtctgggga

SEQ ID NO: 6510786 - DNA, 15 bp, Homo sapiens
tgccttgtgctgtta

SEQ ID NO: 6510787 - DNA, 19 bp, Homo sapiens
tgccttgtgtacagttatt

SEQ ID NO: 6510788 - DNA, 15 bp, Homo sapiens
tgccttgtttaatgt

SEQ ID NO: 6510789 - DNA, 19 bp, Homo sapiens
tgccttgtttaatgttaat

SEQ ID NO: 6510790 - DNA, 17 bp, Homo sapiens
tgccttgtttgagtttt

SEQ ID NO: 6510791 - DNA, 14 bp, Homo sapiens
tgccttgtttggat

SEQ ID NO: 6510792 - DNA, 16 bp, Homo sapiens
tgccttgttttttgtt

SEQ ID NO: 6510793 - DNA, 20 bp, Homo sapiens
tgccttgttttttgtttgtt

SEQ ID NO: 6510794 - DNA, 14 bp, Homo sapiens
tgcctttaaatgaa

SEQ ID NO: 6510795 - DNA, 16 bp, Homo sapiens
tgcctttaagccaaag

SEQ ID NO: 6510796 - DNA, 13 bp, Homo sapiens
tgcctttaatatt

SEQ ID NO: 6510797 - DNA, 18 bp, Homo sapiens
tgcctttaatattttgta

SEQ ID NO: 6510798 - DNA, 14 bp, Homo sapiens
tgcctttacttcag

SEQ ID NO: 6510799 - DNA, 21 bp, Homo sapiens
tgcctttagcccctcccaagc

SEQ ID NO: 6510800 - DNA, 17 bp, Homo sapiens
tgcctttatctcagcca

SEQ ID NO: 6510801 - DNA, 16 bp, Homo sapiens
tgcctttatgatgcta

SEQ ID NO: 6510802 - DNA, 20 bp, Homo sapiens
tgcctttattgtgtttgtca

SEQ ID NO: 6510803 - DNA, 17 bp, Homo sapiens
tgcctttatttccactg

SEQ ID NO: 6510804 - DNA, 12 bp, Homo sapiens
tgcctttcaaat

SEQ ID NO: 6510805 - DNA, 18 bp, Homo sapiens
tgcctttcagaagtgatt

SEQ ID NO: 6510806 - DNA, 20 bp, Homo sapiens
tgcctttccacctgctttct

SEQ ID NO: 6510807 - DNA, 20 bp, Homo sapiens
tgcctttccatccatggcca

SEQ ID NO: 6510808 - DNA, 11 bp, Homo sapiens
tgcctttcccc

SEQ ID NO: 6510809 - DNA, 13 bp, Homo sapiens
tgcctttcccccc

SEQ ID NO: 6510810 - DNA, 14 bp, Homo sapiens
tgcctttcctgttc

SEQ ID NO: 6510811 - DNA, 17 bp, Homo sapiens
tgcctttcgaggcctga

SEQ ID NO: 6510812 - DNA, 13 bp, Homo sapiens
tgcctttcgtgat

SEQ ID NO: 6510813 - DNA, 23 bp, Homo sapiens
tgcctttctcgtggtagaagcca

SEQ ID NO: 6510814 - DNA, 20 bp, Homo sapiens
tgcctttctgcagtttttca

SEQ ID NO: 6510815 - DNA, 13 bp, Homo sapiens
tgcctttctgcct

SEQ ID NO: 6510816 - DNA, 14 bp, Homo sapiens
tgcctttctgcctt

SEQ ID NO: 6510817 - DNA, 13 bp, Homo sapiens
tgcctttcttcca

SEQ ID NO: 6510818 - DNA, 18 bp, Homo sapiens
tgcctttcttctgccctt

SEQ ID NO: 6510819 - DNA, 14 bp, Homo sapiens
tgcctttctttgcc

SEQ ID NO: 6510820 - DNA, 15 bp, Homo sapiens
tgcctttctttgcct

SEQ ID NO: 6510821 - DNA, 19 bp, Homo sapiens
tgcctttgaaattccccca

SEQ ID NO: 6510822 - DNA, 21 bp, Homo sapiens
tgcctttgaaattcccccact

SEQ ID NO: 6510823 - DNA, 12 bp, Homo sapiens
tgcctttgaaga

SEQ ID NO: 6510824 - DNA, 18 bp, Homo sapiens
tgcctttgaagagtgaaa

SEQ ID NO: 6510825 - DNA, 13 bp, Homo sapiens
tgcctttgacctg

SEQ ID NO: 6510826 - DNA, 17 bp, Homo sapiens
tgcctttgacctgcctc

SEQ ID NO: 6510827 - DNA, 23 bp, Homo sapiens
tgcctttgacctgcctcccttca

SEQ ID NO: 6510828 - DNA, 19 bp, Homo sapiens
tgcctttgagacagtttct

SEQ ID NO: 6510829 - DNA, 15 bp, Homo sapiens
tgcctttgagcttct

SEQ ID NO: 6510830 - DNA, 20 bp, Homo sapiens
tgcctttgatcacaggagca

SEQ ID NO: 6510831 - DNA, 18 bp, Homo sapiens
tgcctttgcagaaacaga

SEQ ID NO: 6510832 - DNA, 21 bp, Homo sapiens
tgcctttgcagttggactctc

SEQ ID NO: 6510833 - DNA, 16 bp, Homo sapiens
tgcctttgccaggtga

SEQ ID NO: 6510834 - DNA, 18 bp, Homo sapiens
tgcctttgctgccttctg

SEQ ID NO: 6510835 - DNA, 19 bp, Homo sapiens
tgcctttgctgccttctgt

SEQ ID NO: 6510836 - DNA, 15 bp, Homo sapiens
tgcctttgctgttta

SEQ ID NO: 6510837 - DNA, 19 bp, Homo sapiens
tgcctttggcactctgact

SEQ ID NO: 6510838 - DNA, 12 bp, Homo sapiens
tgcctttgggag

SEQ ID NO: 6510839 - DNA, 13 bp, Homo sapiens
tgcctttgtaagt

SEQ ID NO: 6510840 - DNA, 16 bp, Homo sapiens
tgcctttgtaatatga

SEQ ID NO: 6510841 - DNA, 16 bp, Homo sapiens
tgcctttgtatgtgga

SEQ ID NO: 6510842 - DNA, 17 bp, Homo sapiens
tgcctttgtatgtggaa

SEQ ID NO: 6510843 - DNA, 21 bp, Homo sapiens
tgcctttgtatgtggaagtat

SEQ ID NO: 6510844 - DNA, 15 bp, Homo sapiens
tgcctttgtggcctt

SEQ ID NO: 6510845 - DNA, 18 bp, Homo sapiens
tgcctttgtggccttccc

SEQ ID NO: 6510846 - DNA, 23 bp, Homo sapiens
tgcctttgtggtgggcgctgggg

SEQ ID NO: 6510847 - DNA, 22 bp, Homo sapiens
tgccttttatagctattactgt

SEQ ID NO: 6510848 - DNA, 16 bp, Homo sapiens
tgccttttatgtaaat

SEQ ID NO: 6510849 - DNA, 17 bp, Homo sapiens
tgccttttatgtaaatt

SEQ ID NO: 6510850 - DNA, 15 bp, Homo sapiens
tgccttttccctctg

SEQ ID NO: 6510851 - DNA, 15 bp, Homo sapiens
tgccttttctagccc

SEQ ID NO: 6510852 - DNA, 13 bp, Homo sapiens
tgccttttctgaa

SEQ ID NO: 6510853 - DNA, 13 bp, Homo sapiens
tgccttttctgga

SEQ ID NO: 6510854 - DNA, 14 bp, Homo sapiens
tgccttttctgtga

SEQ ID NO: 6510855 - DNA, 15 bp, Homo sapiens
tgccttttcttcccc

SEQ ID NO: 6510856 - DNA, 21 bp, Homo sapiens
tgccttttgcacccctcccat

SEQ ID NO: 6510857 - DNA, 14 bp, Homo sapiens
tgccttttgctgcg

SEQ ID NO: 6510858 - DNA, 20 bp, Homo sapiens
tgccttttgctgcgcaccaa

SEQ ID NO: 6510859 - DNA, 14 bp, Homo sapiens
tgccttttgtagct

SEQ ID NO: 6510860 - DNA, 12 bp, Homo sapiens
tgccttttgtgt

SEQ ID NO: 6510861 - DNA, 13 bp, Homo sapiens
tgccttttgttaa

SEQ ID NO: 6510862 - DNA, 18 bp, Homo sapiens
tgccttttgttaatgcat

SEQ ID NO: 6510863 - DNA, 20 bp, Homo sapiens
tgccttttgttaatgcattg

SEQ ID NO: 6510864 - DNA, 21 bp, Homo sapiens
tgccttttgttaatgcattgt

SEQ ID NO: 6510865 - DNA, 16 bp, Homo sapiens
tgcctttttacagcca

SEQ ID NO: 6510866 - DNA, 20 bp, Homo sapiens
tgcctttttataacttttta

SEQ ID NO: 6510867 - DNA, 15 bp, Homo sapiens
tgcctttttatttat

SEQ ID NO: 6510868 - DNA, 20 bp, Homo sapiens
tgcctttttcattttccaat

SEQ ID NO: 6510869 - DNA, 16 bp, Homo sapiens
tgcctttttccttatt

SEQ ID NO: 6510870 - DNA, 15 bp, Homo sapiens
tgcctttttgtttac

SEQ ID NO: 6510871 - DNA, 21 bp, Homo sapiens
tgcctttttgtttttgtaaaa

SEQ ID NO: 6510872 - DNA, 16 bp, Homo sapiens
tgccttttttcacagc

SEQ ID NO: 6510873 - DNA, 23 bp, Homo sapiens
tgccttttttcacagcccgggtg

SEQ ID NO: 6510874 - DNA, 13 bp, Homo sapiens
tgccttttttcta

SEQ ID NO: 6510875 - DNA, 23 bp, Homo sapiens
tgccttttttctgtataaatgtc

SEQ ID NO: 6510876 - DNA, 14 bp, Homo sapiens
tgccttttttgatc

SEQ ID NO: 6510877 - DNA, 19 bp, Homo sapiens
tgccttttttgtagttttt

SEQ ID NO: 6510878 - DNA, 14 bp, Homo sapiens
tgcgaaaacttgaa

SEQ ID NO: 6510879 - DNA, 21 bp, Homo sapiens
tgcgaaaacttgaatctgtta

SEQ ID NO: 6510880 - DNA, 13 bp, Homo sapiens
tgcgaaaggatga

SEQ ID NO: 6510881 - DNA, 22 bp, Homo sapiens
tgcgaacctatgtctaaattca

SEQ ID NO: 6510882 - DNA, 18 bp, Homo sapiens
tgcgaactctcaggacta

SEQ ID NO: 6510883 - DNA, 20 bp, Homo sapiens
tgcgaagcaagaagaattga

SEQ ID NO: 6510884 - DNA, 16 bp, Homo sapiens
tgcgaaggggccctgg

SEQ ID NO: 6510885 - DNA, 16 bp, Homo sapiens
tgcgaagtcctatgga

SEQ ID NO: 6510886 - DNA, 18 bp, Homo sapiens
tgcgaagtcctatggaaa

SEQ ID NO: 6510887 - DNA, 22 bp, Homo sapiens
tgcgaatggttccattctctct

SEQ ID NO: 6510888 - DNA, 14 bp, Homo sapiens
tgcgacaagtagtt

SEQ ID NO: 6510889 - DNA, 18 bp, Homo sapiens
tgcgacaccaccaacagg

SEQ ID NO: 6510890 - DNA, 15 bp, Homo sapiens
tgcgacagagagagg

SEQ ID NO: 6510891 - DNA, 14 bp, Homo sapiens
tgcgaccaccaaca

SEQ ID NO: 6510892 - DNA, 19 bp, Homo sapiens
tgcgaccccatctgcccag

SEQ ID NO: 6510893 - DNA, 16 bp, Homo sapiens
tgcgaccccccacccc

SEQ ID NO: 6510894 - DNA, 18 bp, Homo sapiens
tgcgaccccccacccccg

SEQ ID NO: 6510895 - DNA, 19 bp, Homo sapiens
tgcgacggagagaaaaaag

SEQ ID NO: 6510896 - DNA, 22 bp, Homo sapiens
tgcgacggaggcaggaccaggc

SEQ ID NO: 6510897 - DNA, 13 bp, Homo sapiens
tgcgagaattttc

SEQ ID NO: 6510898 - DNA, 15 bp, Homo sapiens
tgcgagaattttcaa

SEQ ID NO: 6510899 - DNA, 21 bp, Homo sapiens
tgcgagacgcacacagctgag

SEQ ID NO: 6510900 - DNA, 12 bp, Homo sapiens
tgcgagactctg

SEQ ID NO: 6510901 - DNA, 21 bp, Homo sapiens
tgcgagagaccctacagacag

SEQ ID NO: 6510902 - DNA, 19 bp, Homo sapiens
tgcgagagaggtgggcagc

SEQ ID NO: 6510903 - DNA, 20 bp, Homo sapiens
tgcgagagaggtgggcagca

SEQ ID NO: 6510904 - DNA, 13 bp, Homo sapiens
tgcgagagatgtg

SEQ ID NO: 6510905 - DNA, 13 bp, Homo sapiens
tgcgagcatttcc

SEQ ID NO: 6510906 - DNA, 12 bp, Homo sapiens
tgcgagctgccg

SEQ ID NO: 6510907 - DNA, 19 bp, Homo sapiens
tgcgagctgccgtgtgggt

SEQ ID NO: 6510908 - DNA, 12 bp, Homo sapiens
tgcgaggaccac

SEQ ID NO: 6510909 - DNA, 15 bp, Homo sapiens
tgcgaggctcggagc

SEQ ID NO: 6510910 - DNA, 15 bp, Homo sapiens
tgcgagggaagcaat

SEQ ID NO: 6510911 - DNA, 19 bp, Homo sapiens
tgcgaggggccagcagagg

SEQ ID NO: 6510912 - DNA, 19 bp, Homo sapiens
tgcgaggtcgcaactgaga

SEQ ID NO: 6510913 - DNA, 18 bp, Homo sapiens
tgcgagtccaaggccagt

SEQ ID NO: 6510914 - DNA, 14 bp, Homo sapiens
tgcgagtctgagtc

SEQ ID NO: 6510915 - DNA, 14 bp, Homo sapiens
tgcgataactgaga

SEQ ID NO: 6510916 - DNA, 23 bp, Homo sapiens
tgcgatcatggctcactgcagcc

SEQ ID NO: 6510917 - DNA, 19 bp, Homo sapiens
tgcgatctcggctcagtgc

SEQ ID NO: 6510918 - DNA, 19 bp, Homo sapiens
tgcgatctgggttcactgc

SEQ ID NO: 6510919 - DNA, 23 bp, Homo sapiens
tgcgatgtggacgtcacgctccc

SEQ ID NO: 6510920 - DNA, 22 bp, Homo sapiens
tgcgattatagcccggtgcagc

SEQ ID NO: 6510921 - DNA, 13 bp, Homo sapiens
tgcgatttcttcc

SEQ ID NO: 6510922 - DNA, 17 bp, Homo sapiens
tgcgcaaaactgcctga

SEQ ID NO: 6510923 - DNA, 18 bp, Homo sapiens
tgcgcaaatacaaaatga

SEQ ID NO: 6510924 - DNA, 16 bp, Homo sapiens
tgcgcaagtgcctggg

SEQ ID NO: 6510925 - DNA, 13 bp, Homo sapiens
tgcgcaatgtggc

SEQ ID NO: 6510926 - DNA, 16 bp, Homo sapiens
tgcgcacaacttaaaa

SEQ ID NO: 6510927 - DNA, 16 bp, Homo sapiens
tgcgcacaggtgggag

SEQ ID NO: 6510928 - DNA, 17 bp, Homo sapiens
tgcgcaccaatgcccag

SEQ ID NO: 6510929 - DNA, 19 bp, Homo sapiens
tgcgcaccaatgcccagca

SEQ ID NO: 6510930 - DNA, 21 bp, Homo sapiens
tgcgcaccccgttcccagcgc

SEQ ID NO: 6510931 - DNA, 12 bp, Homo sapiens
tgcgcactgcat

SEQ ID NO: 6510932 - DNA, 14 bp, Homo sapiens
tgcgcactgcatgg

SEQ ID NO: 6510933 - DNA, 21 bp, Homo sapiens
tgcgcagatctgtgcctggga

SEQ ID NO: 6510934 - DNA, 17 bp, Homo sapiens
tgcgcagatgaggggcc

SEQ ID NO: 6510935 - DNA, 21 bp, Homo sapiens
tgcgcagatgaggggccactg

SEQ ID NO: 6510936 - DNA, 16 bp, Homo sapiens
tgcgcagccccatctg

SEQ ID NO: 6510937 - DNA, 17 bp, Homo sapiens
tgcgcagccccatctgt

SEQ ID NO: 6510938 - DNA, 19 bp, Homo sapiens
tgcgcagccgcgctctgcc

SEQ ID NO: 6510939 - DNA, 20 bp, Homo sapiens
tgcgcagccgcgctctgccc

SEQ ID NO: 6510940 - DNA, 16 bp, Homo sapiens
tgcgcagcctccaggg

SEQ ID NO: 6510941 - DNA, 17 bp, Homo sapiens
tgcgcagcctccagggc

SEQ ID NO: 6510942 - DNA, 18 bp, Homo sapiens
tgcgcagcctccagggcc

SEQ ID NO: 6510943 - DNA, 23 bp, Homo sapiens
tgcgcaggccctccgcgggggac

SEQ ID NO: 6510944 - DNA, 19 bp, Homo sapiens
tgcgcaggctggccctgcc

SEQ ID NO: 6510945 - DNA, 21 bp, Homo sapiens
tgcgcaggctggccctgccct

SEQ ID NO: 6510946 - DNA, 23 bp, Homo sapiens
tgcgcaggctggccctgccctgg

SEQ ID NO: 6510947 - DNA, 16 bp, Homo sapiens
tgtgtaatttaagtga

SEQ ID NO: 6510948 - DNA, 19 bp, Homo sapiens
tgtgtaatttatgtgaaaa

SEQ ID NO: 6510949 - DNA, 21 bp, Homo sapiens
tgtgtaatttcctgctcctcc

SEQ ID NO: 6510950 - DNA, 12 bp, Homo sapiens
tgtgtaattttt

SEQ ID NO: 6510951 - DNA, 17 bp, Homo sapiens
tgtgtaatttttctgta

SEQ ID NO: 6510952 - DNA, 19 bp, Homo sapiens
tgtgtaatttttctgtata

SEQ ID NO: 6510953 - DNA, 13 bp, Homo sapiens
tgtgtacaaaata

SEQ ID NO: 6510954 - DNA, 19 bp, Homo sapiens
tgtgtacaaagtagagaag

SEQ ID NO: 6510955 - DNA, 22 bp, Homo sapiens
tgtgtacaacaatgctttgata

SEQ ID NO: 6510956 - DNA, 21 bp, Homo sapiens
tgtgtacaactttttaaatag

SEQ ID NO: 6510957 - DNA, 15 bp, Homo sapiens
tgtgtacaatgtgag

SEQ ID NO: 6510958 - DNA, 19 bp, Homo sapiens
tgtgtacacctgcggggcc

SEQ ID NO: 6510959 - DNA, 22 bp, Homo sapiens
tgtgtacacgggactgacgcaa

SEQ ID NO: 6510960 - DNA, 21 bp, Homo sapiens
tgtgtacagatgaatgataaa

SEQ ID NO: 6510961 - DNA, 17 bp, Homo sapiens
tgtgtacagtatgtgtc

SEQ ID NO: 6510962 - DNA, 19 bp, Homo sapiens
tgtgtacagtatgtgtcta

SEQ ID NO: 6510963 - DNA, 14 bp, Homo sapiens
tgtgtacagtgaat

SEQ ID NO: 6510964 - DNA, 19 bp, Homo sapiens
tgtgtacagtgtgtaaagt

SEQ ID NO: 6510965 - DNA, 20 bp, Homo sapiens
tgtgtacataactctgtaaa

SEQ ID NO: 6510966 - DNA, 16 bp, Homo sapiens
tgtgtacatagagcaa

SEQ ID NO: 6510967 - DNA, 19 bp, Homo sapiens
tgtgtacatagagcaatgt

SEQ ID NO: 6510968 - DNA, 15 bp, Homo sapiens
tgtgtacatatatgt

SEQ ID NO: 6510969 - DNA, 19 bp, Homo sapiens
tgtgtacatatatgtataa

SEQ ID NO: 6510970 - DNA, 20 bp, Homo sapiens
tgtgtacatcccatgtaaca

SEQ ID NO: 6510971 - DNA, 16 bp, Homo sapiens
tgtgtacatgtacatg

SEQ ID NO: 6510972 - DNA, 13 bp, Homo sapiens
tgtgtacatttta

SEQ ID NO: 6510973 - DNA, 15 bp, Homo sapiens
tgtgtaccacaccct

SEQ ID NO: 6510974 - DNA, 18 bp, Homo sapiens
tgtgtaccacaccctgcc

SEQ ID NO: 6510975 - DNA, 23 bp, Homo sapiens
tgtgtaccacttcctgaggcctc

SEQ ID NO: 6510976 - DNA, 18 bp, Homo sapiens
tgtgtaccacttctgtgg

SEQ ID NO: 6510977 - DNA, 19 bp, Homo sapiens
tgtgtacctcactgtccaa

SEQ ID NO: 6510978 - DNA, 16 bp, Homo sapiens
tgtgtacctcatatcc

SEQ ID NO: 6510979 - DNA, 15 bp, Homo sapiens
tgtgtacctctagaa

SEQ ID NO: 6510980 - DNA, 17 bp, Homo sapiens
tgtgtaccttaagatat

SEQ ID NO: 6510981 - DNA, 18 bp, Homo sapiens
tgtgtaccttaagatatt

SEQ ID NO: 6510982 - DNA, 17 bp, Homo sapiens
tgtgtacctttgtgtaa

SEQ ID NO: 6510983 - DNA, 20 bp, Homo sapiens
tgtgtacctttgtgtaaaga

SEQ ID NO: 6510984 - DNA, 16 bp, Homo sapiens
tgtgtacgtggagagg

SEQ ID NO: 6510985 - DNA, 14 bp, Homo sapiens
tgtgtactcagggc

SEQ ID NO: 6510986 - DNA, 16 bp, Homo sapiens
tgtgtactgataaaat

SEQ ID NO: 6510987 - DNA, 10 bp, Homo sapiens
tgtgtactgt

SEQ ID NO: 6510988 - DNA, 20 bp, Homo sapiens
tgtgtactgtatagacagtt

SEQ ID NO: 6510989 - DNA, 14 bp, Homo sapiens
tgtgtactgtgtca

SEQ ID NO: 6510990 - DNA, 21 bp, Homo sapiens
tgtgtacttcttcatccatag

SEQ ID NO: 6510991 - DNA, 15 bp, Homo sapiens
tgtgtactttcttcc

SEQ ID NO: 6510992 - DNA, 14 bp, Homo sapiens
tgtgtacttttcct

SEQ ID NO: 6510993 - DNA, 17 bp, Homo sapiens
tgtgtacttttcctttg

SEQ ID NO: 6510994 - DNA, 20 bp, Homo sapiens
tgtgtacttttcctttgcta

SEQ ID NO: 6510995 - DNA, 17 bp, Homo sapiens
tgtgtagaaaaaaaaac

SEQ ID NO: 6510996 - DNA, 21 bp, Homo sapiens
tgtgtagacaaatatttggag

SEQ ID NO: 6510997 - DNA, 23 bp, Homo sapiens
tgtgtagacgaagggggcatctg

SEQ ID NO: 6510998 - DNA, 17 bp, Homo sapiens
tgtgtagagcctgcatc

SEQ ID NO: 6510999 - DNA, 19 bp, Homo sapiens
tgtgtagatttgaaaattg

SEQ ID NO: 6511000 - DNA, 13 bp, Homo sapiens
tgtgtagccagga

SEQ ID NO: 6511001 - DNA, 20 bp, Homo sapiens
tgtgtagccccttttctttg

SEQ ID NO: 6511002 - DNA, 14 bp, Homo sapiens
tgtgtagccgccct

SEQ ID NO: 6511003 - DNA, 17 bp, Homo sapiens
tgtgtagccgccctgag

SEQ ID NO: 6511004 - DNA, 13 bp, Homo sapiens
tgtgtagcctatg

SEQ ID NO: 6511005 - DNA, 14 bp, Homo sapiens
tgtgtagcctatgt

SEQ ID NO: 6511006 - DNA, 14 bp, Homo sapiens
tgtgtagcctgtgc

SEQ ID NO: 6511007 - DNA, 17 bp, Homo sapiens
tgtgtagctctgtccac

SEQ ID NO: 6511008 - DNA, 18 bp, Homo sapiens
tgtgtagctgcaaaaata

SEQ ID NO: 6511009 - DNA, 23 bp, Homo sapiens
tgtgtagctgctcttttgtctct

SEQ ID NO: 6511010 - DNA, 22 bp, Homo sapiens
tgtgtagctgtgacctgctgag

SEQ ID NO: 6511011 - DNA, 13 bp, Homo sapiens
tgtgtaggaaatc

SEQ ID NO: 6511012 - DNA, 16 bp, Homo sapiens
tgtgtaggaaatctga

SEQ ID NO: 6511013 - DNA, 20 bp, Homo sapiens
tgtgtaggaggggttaataa

SEQ ID NO: 6511014 - DNA, 14 bp, Homo sapiens
tgtgtagggaaagt

SEQ ID NO: 6511015 - DNA, 16 bp, Homo sapiens
tgtgtagggcgggagg

SEQ ID NO: 6511016 - DNA, 20 bp, Homo sapiens
tgtgtagggcttttttttga

SEQ ID NO: 6511017 - DNA, 18 bp, Homo sapiens
tgtgtaggtgtctgcctt

SEQ ID NO: 6511018 - DNA, 17 bp, Homo sapiens
tgtgtagttcatgtaaa

SEQ ID NO: 6511019 - DNA, 13 bp, Homo sapiens
tgtgtagttccct

SEQ ID NO: 6511020 - DNA, 18 bp, Homo sapiens
tgtgtagttccctctgcc

SEQ ID NO: 6511021 - DNA, 19 bp, Homo sapiens
tgtgtagttccctctgcct

SEQ ID NO: 6511022 - DNA, 14 bp, Homo sapiens
tgtgtataaacaag

SEQ ID NO: 6511023 - DNA, 18 bp, Homo sapiens
tgtgtataatgtgcttta

SEQ ID NO: 6511024 - DNA, 14 bp, Homo sapiens
tgtgtatacatatg

SEQ ID NO: 6511025 - DNA, 17 bp, Homo sapiens
tgtgtatacatatgtat

SEQ ID NO: 6511026 - DNA, 21 bp, Homo sapiens
tgtgtatagatgcaagatatt

SEQ ID NO: 6511027 - DNA, 15 bp, Homo sapiens
tgtgtatataaacta

SEQ ID NO: 6511028 - DNA, 13 bp, Homo sapiens
tgtgtatataatt

SEQ ID NO: 6511029 - DNA, 16 bp, Homo sapiens
tgtgtatataattttt

SEQ ID NO: 6511030 - DNA, 13 bp, Homo sapiens
tgtgtatatatac

SEQ ID NO: 6511031 - DNA, 20 bp, Homo sapiens
tgtgtatatatatgtgagga

SEQ ID NO: 6511032 - DNA, 12 bp, Homo sapiens
tgtgtatatatc

SEQ ID NO: 6511033 - DNA, 20 bp, Homo sapiens
tgtgtatatatcttataact

SEQ ID NO: 6511034 - DNA, 17 bp, Homo sapiens
tgtgtatatatgtcaaa

SEQ ID NO: 6511035 - DNA, 18 bp, Homo sapiens
tgtgtatatatgtgtata

SEQ ID NO: 6511036 - DNA, 23 bp, Homo sapiens
tgtgtatatatgtgtatatatac

SEQ ID NO: 6511037 - DNA, 14 bp, Homo sapiens
tgtgtatatattat

SEQ ID NO: 6511038 - DNA, 19 bp, Homo sapiens
tgtgtatatattttgtgtg

SEQ ID NO: 6511039 - DNA, 16 bp, Homo sapiens
tgtgtatatctcttgg

SEQ ID NO: 6511040 - DNA, 13 bp, Homo sapiens
tgtgtatatggac

SEQ ID NO: 6511041 - DNA, 15 bp, Homo sapiens
tgtgtatatgtataa

SEQ ID NO: 6511042 - DNA, 20 bp, Homo sapiens
tgtgtatatgtttatacaca

SEQ ID NO: 6511043 - DNA, 13 bp, Homo sapiens
tgtgtatattaca

SEQ ID NO: 6511044 - DNA, 21 bp, Homo sapiens
tgtgtatattgagaatccctt

SEQ ID NO: 6511045 - DNA, 14 bp, Homo sapiens
tgtgtatcattaaa

SEQ ID NO: 6511046 - DNA, 23 bp, Homo sapiens
tgtgtatccattatcatgtgtaa

SEQ ID NO: 6511047 - DNA, 23 bp, Homo sapiens
tgtgtatccgactctaagctgtg

SEQ ID NO: 6511048 - DNA, 15 bp, Homo sapiens
tgtgtatcctgacag

SEQ ID NO: 6511049 - DNA, 18 bp, Homo sapiens
tgtgtatctcaataaagc

SEQ ID NO: 6511050 - DNA, 16 bp, Homo sapiens
tgtgtatcttgattaa

SEQ ID NO: 6511051 - DNA, 12 bp, Homo sapiens
tgtgtatgagaa

SEQ ID NO: 6511052 - DNA, 23 bp, Homo sapiens
tgtgtatgagaagtactttgtgc

SEQ ID NO: 6511053 - DNA, 18 bp, Homo sapiens
tgtgtatgagtgtgaatg

SEQ ID NO: 6511054 - DNA, 14 bp, Homo sapiens
tgtgtatgatccaa

SEQ ID NO: 6511055 - DNA, 19 bp, Homo sapiens
tgtgtatgctgatgatcaa

SEQ ID NO: 6511056 - DNA, 20 bp, Homo sapiens
tgtgtatggaagacaaatac

SEQ ID NO: 6511057 - DNA, 21 bp, Homo sapiens
tgtgtatggaagacaaataca

SEQ ID NO: 6511058 - DNA, 14 bp, Homo sapiens
tgtgtatggtgacc

SEQ ID NO: 6511059 - DNA, 23 bp, Homo sapiens
tgtgtatgtacttagctgtacta

SEQ ID NO: 6511060 - DNA, 16 bp, Homo sapiens
tgtgtatgtatacaca

SEQ ID NO: 6511061 - DNA, 18 bp, Homo sapiens
tgtgtatgtctatgtgta

SEQ ID NO: 6511062 - DNA, 22 bp, Homo sapiens
tgtgtatgtgagtattctcatt

SEQ ID NO: 6511063 - DNA, 19 bp, Homo sapiens
tgtgtatgtgcgtgtgtgc

SEQ ID NO: 6511064 - DNA, 13 bp, Homo sapiens
tgtgtatgtgggg

SEQ ID NO: 6511065 - DNA, 12 bp, Homo sapiens
tgtgtatgtgta

SEQ ID NO: 6511066 - DNA, 13 bp, Homo sapiens
tgtgtatgtgtaa

SEQ ID NO: 6511067 - DNA, 22 bp, Homo sapiens
tgtgtatgtgtacgtgtgtgtg

SEQ ID NO: 6511068 - DNA, 20 bp, Homo sapiens
tgtgtatgtgtatgtgtgtg

SEQ ID NO: 6511069 - DNA, 14 bp, Homo sapiens
tgtgtatgtgttta

SEQ ID NO: 6511070 - DNA, 12 bp, Homo sapiens
tgtgtatgtttt

SEQ ID NO: 6511071 - DNA, 21 bp, Homo sapiens
tgtgtattaaaaaaaacaaaa

SEQ ID NO: 6511072 - DNA, 16 bp, Homo sapiens
tgtgtattaaatggtt

SEQ ID NO: 6511073 - DNA, 15 bp, Homo sapiens
tgtgtattagatatc

SEQ ID NO: 6511074 - DNA, 15 bp, Homo sapiens
tgtgtattcatactg

SEQ ID NO: 6511075 - DNA, 14 bp, Homo sapiens
tgtgtattctggct

SEQ ID NO: 6511076 - DNA, 15 bp, Homo sapiens
tgtgtattctggctg

SEQ ID NO: 6511077 - DNA, 14 bp, Homo sapiens
tgtgtattcttaaa

SEQ ID NO: 6511078 - DNA, 20 bp, Homo sapiens
tgtgtattcttaaaatgcaa

SEQ ID NO: 6511079 - DNA, 16 bp, Homo sapiens
tgtgtattgatgcaat

SEQ ID NO: 6511080 - DNA, 13 bp, Homo sapiens
tgtgtattgttcc

SEQ ID NO: 6511081 - DNA, 15 bp, Homo sapiens
tgtgtattgttccca

SEQ ID NO: 6511082 - DNA, 13 bp, Homo sapiens
tgtgtatttaaca

SEQ ID NO: 6511083 - DNA, 20 bp, Homo sapiens
tgtgtatttaattgtaaact

SEQ ID NO: 6511084 - DNA, 20 bp, Homo sapiens
tgtgtatttatttaaaactc

SEQ ID NO: 6511085 - DNA, 21 bp, Homo sapiens
tgtgtatttatttaaaactct

SEQ ID NO: 6511086 - DNA, 22 bp, Homo sapiens
tgtgtatttatttaaaactctg

SEQ ID NO: 6511087 - DNA, 23 bp, Homo sapiens
tgtgtatttcagttattgtccct

SEQ ID NO: 6511088 - DNA, 15 bp, Homo sapiens
tgtgtatttctctgt

SEQ ID NO: 6511089 - DNA, 17 bp, Homo sapiens
tgtgtatttctctgtga

SEQ ID NO: 6511090 - DNA, 12 bp, Homo sapiens
tgtgtatttctg

SEQ ID NO: 6511091 - DNA, 14 bp, Homo sapiens
tgtgtatttctgta

SEQ ID NO: 6511092 - DNA, 14 bp, Homo sapiens
tgtgtatttcttaa

SEQ ID NO: 6511093 - DNA, 11 bp, Homo sapiens
tgtgtatttgc

SEQ ID NO: 6511094 - DNA, 13 bp, Homo sapiens
tgtgtatttgcta

SEQ ID NO: 6511095 - DNA, 14 bp, Homo sapiens
tgtgtatttgtatt

SEQ ID NO: 6511096 - DNA, 16 bp, Homo sapiens
tgtgtatttgtattaa

SEQ ID NO: 6511097 - DNA, 15 bp, Homo sapiens
tgtgtattttcagtc

SEQ ID NO: 6511098 - DNA, 21 bp, Homo sapiens
tgtgtattttctttgggggtg

SEQ ID NO: 6511099 - DNA, 15 bp, Homo sapiens
tgtgtattttttcat

SEQ ID NO: 6511100 - DNA, 16 bp, Homo sapiens
tgtgtattttttcata

SEQ ID NO: 6511101 - DNA, 18 bp, Homo sapiens
tgtgtattttttcatagt

SEQ ID NO: 6511102 - DNA, 22 bp, Homo sapiens
tgtgtcaaagagatgaggaaat

SEQ ID NO: 6511103 - DNA, 18 bp, Homo sapiens
tgtgtcaagattgcaaag

SEQ ID NO: 6511104 - DNA, 15 bp, Homo sapiens
tgtgtcaagctgctt

SEQ ID NO: 6511105 - DNA, 19 bp, Homo sapiens
tgtgtcaatgtaaagccaa

SEQ ID NO: 6511106 - DNA, 15 bp, Homo sapiens
tgtgtcacagctctg

SEQ ID NO: 6511107 - DNA, 17 bp, Homo sapiens
tgtgtcacagttcttgg

SEQ ID NO: 6511108 - DNA, 18 bp, Homo sapiens
tgtgtcacccagactgga

SEQ ID NO: 6511109 - DNA, 13 bp, Homo sapiens
tgtgtcacgtgac

SEQ ID NO: 6511110 - DNA, 22 bp, Homo sapiens
tgtgtcacgtgaccctgtgccc

SEQ ID NO: 6511111 - DNA, 23 bp, Homo sapiens
tgtgtcacgtgaccctgtgcccc

SEQ ID NO: 6511112 - DNA, 13 bp, Homo sapiens
tgtgtcactggct

SEQ ID NO: 6511113 - DNA, 22 bp, Homo sapiens
tgtgtcactggctgcctccact

SEQ ID NO: 6511114 - DNA, 15 bp, Homo sapiens
tgtgtcactgtacag

SEQ ID NO: 6511115 - DNA, 14 bp, Homo sapiens
tgtgtcacttgtgc

SEQ ID NO: 6511116 - DNA, 17 bp, Homo sapiens
tgtgtcacttgtgcttt

SEQ ID NO: 6511117 - DNA, 22 bp, Homo sapiens
tgtgtcacttgtgctttgctct

SEQ ID NO: 6511118 - DNA, 12 bp, Homo sapiens
tgtgtcagaaac

SEQ ID NO: 6511119 - DNA, 19 bp, Homo sapiens
tgtgtcagaataggaaaac

SEQ ID NO: 6511120 - DNA, 11 bp, Homo sapiens
tgtgtcagagc

SEQ ID NO: 6511121 - DNA, 12 bp, Homo sapiens
tgtgtcagagcc

SEQ ID NO: 6511122 - DNA, 20 bp, Homo sapiens
tgtgtcagagcccagcccag

SEQ ID NO: 6511123 - DNA, 21 bp, Homo sapiens
tgtgtcagagcccagcccagg

SEQ ID NO: 6511124 - DNA, 16 bp, Homo sapiens
tgtgtcagagcccagg

SEQ ID NO: 6511125 - DNA, 16 bp, Homo sapiens
tgtgtcagagcctacc

SEQ ID NO: 6511126 - DNA, 13 bp, Homo sapiens
tgtgtcagagtgt

SEQ ID NO: 6511127 - DNA, 17 bp, Homo sapiens
tgcgcagggctctttga

SEQ ID NO: 6511128 - DNA, 14 bp, Homo sapiens
tgcgcaggtctctt

SEQ ID NO: 6511129 - DNA, 23 bp, Homo sapiens
tgcgcaggtctcttctgggcgtc

SEQ ID NO: 6511130 - DNA, 22 bp, Homo sapiens
tgcgcagtagtttggtttgact

SEQ ID NO: 6511131 - DNA, 20 bp, Homo sapiens
tgcgcataggcctgctttgt

SEQ ID NO: 6511132 - DNA, 19 bp, Homo sapiens
tgcgcattctcatggagaa

SEQ ID NO: 6511133 - DNA, 18 bp, Homo sapiens
tgcgccaccatgccctat

SEQ ID NO: 6511134 - DNA, 17 bp, Homo sapiens
tgcgccaccgcccagag

SEQ ID NO: 6511135 - DNA, 21 bp, Homo sapiens
tgcgccactgcactccagcct

SEQ ID NO: 6511136 - DNA, 23 bp, Homo sapiens
tgcgccactgcactccagcctgg

SEQ ID NO: 6511137 - DNA, 15 bp, Homo sapiens
tgcgccactgccatc

SEQ ID NO: 6511138 - DNA, 14 bp, Homo sapiens
tgcgccactgctcc

SEQ ID NO: 6511139 - DNA, 14 bp, Homo sapiens
tgcgccaggcagag

SEQ ID NO: 6511140 - DNA, 15 bp, Homo sapiens
tgcgccagtcctgct

SEQ ID NO: 6511141 - DNA, 13 bp, Homo sapiens
tgcgcccaccccg

SEQ ID NO: 6511142 - DNA, 20 bp, Homo sapiens
tgcgcccagagctggcctcc

SEQ ID NO: 6511143 - DNA, 18 bp, Homo sapiens
tgcgcccagggctgggag

SEQ ID NO: 6511144 - DNA, 12 bp, Homo sapiens
tgcgccccagcg

SEQ ID NO: 6511145 - DNA, 14 bp, Homo sapiens
tgcgcccccagctt

SEQ ID NO: 6511146 - DNA, 17 bp, Homo sapiens
tgcgccccccagtggac

SEQ ID NO: 6511147 - DNA, 21 bp, Homo sapiens
tgcgccccctccgccctgcca

SEQ ID NO: 6511148 - DNA, 14 bp, Homo sapiens
tgcgccccgcccac

SEQ ID NO: 6511149 - DNA, 19 bp, Homo sapiens
tgcgccccgcccacaccct

SEQ ID NO: 6511150 - DNA, 21 bp, Homo sapiens
tgcgccccgcccacaccctcg

SEQ ID NO: 6511151 - DNA, 17 bp, Homo sapiens
tgcgccccgcctgacct

SEQ ID NO: 6511152 - DNA, 12 bp, Homo sapiens
tgcgcccctgcc

SEQ ID NO: 6511153 - DNA, 14 bp, Homo sapiens
tgcgcccctgccca

SEQ ID NO: 6511154 - DNA, 15 bp, Homo sapiens
tgcgcccctgcccag

SEQ ID NO: 6511155 - DNA, 16 bp, Homo sapiens
tgcgcccctgcccagc

SEQ ID NO: 6511156 - DNA, 17 bp, Homo sapiens
tgcgcccctgcccagca

SEQ ID NO: 6511157 - DNA, 18 bp, Homo sapiens
tgcgcccggccacattca

SEQ ID NO: 6511158 - DNA, 16 bp, Homo sapiens
tgcgcccttaccttcc

SEQ ID NO: 6511159 - DNA, 23 bp, Homo sapiens
tgcgcccttgtgccctgcctcca

SEQ ID NO: 6511160 - DNA, 14 bp, Homo sapiens
tgcgcctacaggag

SEQ ID NO: 6511161 - DNA, 16 bp, Homo sapiens
tgcgcctacaggagtg

SEQ ID NO: 6511162 - DNA, 22 bp, Homo sapiens
tgcgcctacaggagtgagcact

SEQ ID NO: 6511163 - DNA, 12 bp, Homo sapiens
tgcgcctcacca

SEQ ID NO: 6511164 - DNA, 13 bp, Homo sapiens
tgcgcctcagccc

SEQ ID NO: 6511165 - DNA, 15 bp, Homo sapiens
tgcgcctcagccctc

SEQ ID NO: 6511166 - DNA, 23 bp, Homo sapiens
tgcgcctccatccatctgtccgt

SEQ ID NO: 6511167 - DNA, 15 bp, Homo sapiens
tgcgcctcctcctgc

SEQ ID NO: 6511168 - DNA, 16 bp, Homo sapiens
tgcgcctcctcctgca

SEQ ID NO: 6511169 - DNA, 17 bp, Homo sapiens
tgcgcctcctcctgcat

SEQ ID NO: 6511170 - DNA, 18 bp, Homo sapiens
tgcgcctcctcctgcatg

SEQ ID NO: 6511171 - DNA, 19 bp, Homo sapiens
tgcgcctcggtatctggct

SEQ ID NO: 6511172 - DNA, 16 bp, Homo sapiens
tgcgcctctccactgt

SEQ ID NO: 6511173 - DNA, 15 bp, Homo sapiens
tgcgcctgagtgagt

SEQ ID NO: 6511174 - DNA, 12 bp, Homo sapiens
tgcgcctgcccg

SEQ ID NO: 6511175 - DNA, 14 bp, Homo sapiens
tgcgcctgcccgcc

SEQ ID NO: 6511176 - DNA, 18 bp, Homo sapiens
tgcgcctgcgcctcctcc

SEQ ID NO: 6511177 - DNA, 17 bp, Homo sapiens
tgcgccttcgtgcctga

SEQ ID NO: 6511178 - DNA, 13 bp, Homo sapiens
tgcgcctttgtat

SEQ ID NO: 6511179 - DNA, 16 bp, Homo sapiens
tgcgcctttgtattat

SEQ ID NO: 6511180 - DNA, 20 bp, Homo sapiens
tgcgcctttgtattataaaa

SEQ ID NO: 6511181 - DNA, 20 bp, Homo sapiens
tgcgcgcatgtaatcccagc

SEQ ID NO: 6511182 - DNA, 16 bp, Homo sapiens
tgcgcgctatcccctc

SEQ ID NO: 6511183 - DNA, 23 bp, Homo sapiens
tgcgcggatgtagcatgttctat

SEQ ID NO: 6511184 - DNA, 17 bp, Homo sapiens
tgcgcgtggcgtggccc

SEQ ID NO: 6511185 - DNA, 13 bp, Homo sapiens
tgcgctagcagcc

SEQ ID NO: 6511186 - DNA, 14 bp, Homo sapiens
tgcgctcacctcag

SEQ ID NO: 6511187 - DNA, 15 bp, Homo sapiens
tgcgctcacctcaga

SEQ ID NO: 6511188 - DNA, 17 bp, Homo sapiens
tgcgctcacctcagagc

SEQ ID NO: 6511189 - DNA, 15 bp, Homo sapiens
tgcgctcacctgcag

SEQ ID NO: 6511190 - DNA, 14 bp, Homo sapiens
tgcgctcagggcca

SEQ ID NO: 6511191 - DNA, 19 bp, Homo sapiens
tgcgctcagggccatgctg

SEQ ID NO: 6511192 - DNA, 21 bp, Homo sapiens
tgcgctcagggccatgctgag

SEQ ID NO: 6511193 - DNA, 19 bp, Homo sapiens
tgcgctcaggggctccatg

SEQ ID NO: 6511194 - DNA, 21 bp, Homo sapiens
tgcgctcattttaggcctcct

SEQ ID NO: 6511195 - DNA, 17 bp, Homo sapiens
tgcgctcctctgcagcc

SEQ ID NO: 6511196 - DNA, 19 bp, Homo sapiens
tgcgctcctctgcagcctg

SEQ ID NO: 6511197 - DNA, 23 bp, Homo sapiens
tgcgctcctctgcagcctgagct

SEQ ID NO: 6511198 - DNA, 13 bp, Homo sapiens
tgcgctcctggcc

SEQ ID NO: 6511199 - DNA, 17 bp, Homo sapiens
tgcgctcctggcccagc

SEQ ID NO: 6511200 - DNA, 18 bp, Homo sapiens
tgcgctcctggcccagcc

SEQ ID NO: 6511201 - DNA, 15 bp, Homo sapiens
tgcgctcctggcttt

SEQ ID NO: 6511202 - DNA, 17 bp, Homo sapiens
tgcgctcggcaggaagg

SEQ ID NO: 6511203 - DNA, 16 bp, Homo sapiens
tgcgctcttcaccagg

SEQ ID NO: 6511204 - DNA, 20 bp, Homo sapiens
tgcgctcttcaccaggaaga

SEQ ID NO: 6511205 - DNA, 17 bp, Homo sapiens
tgcgctcttggtccctg

SEQ ID NO: 6511206 - DNA, 23 bp, Homo sapiens
tgcgctgacctaggaatgttggt

SEQ ID NO: 6511207 - DNA, 11 bp, Homo sapiens
tgcgctgcctg

SEQ ID NO: 6511208 - DNA, 13 bp, Homo sapiens
tgcgctgcctggc

SEQ ID NO: 6511209 - DNA, 16 bp, Homo sapiens
tgcgctgcctggccag

SEQ ID NO: 6511210 - DNA, 20 bp, Homo sapiens
tgcgctgcctggccaggccc

SEQ ID NO: 6511211 - DNA, 15 bp, Homo sapiens
tgcgctgctcaacct

SEQ ID NO: 6511212 - DNA, 18 bp, Homo sapiens
tgcgctgggcacttccct

SEQ ID NO: 6511213 - DNA, 21 bp, Homo sapiens
tgcgctggtggaccacaggca

SEQ ID NO: 6511214 - DNA, 23 bp, Homo sapiens
tgcgctggttccgccaggcgctg

SEQ ID NO: 6511215 - DNA, 11 bp, Homo sapiens
tgcgctgtgct

SEQ ID NO: 6511216 - DNA, 22 bp, Homo sapiens
tgcgctgtgctggtctctaggc

SEQ ID NO: 6511217 - DNA, 15 bp, Homo sapiens
tgcgctgtgtacaat

SEQ ID NO: 6511218 - DNA, 19 bp, Homo sapiens
tgcgctgtgtacaatgtga

SEQ ID NO: 6511219 - DNA, 17 bp, Homo sapiens
tgcgcttatttggaaat

SEQ ID NO: 6511220 - DNA, 12 bp, Homo sapiens
tgcgcttcaaag

SEQ ID NO: 6511221 - DNA, 13 bp, Homo sapiens
tgcgcttcaaagt

SEQ ID NO: 6511222 - DNA, 15 bp, Homo sapiens
tgcgcttcacttggg

SEQ ID NO: 6511223 - DNA, 20 bp, Homo sapiens
tgcgcttcagtaacaagtgt

SEQ ID NO: 6511224 - DNA, 15 bp, Homo sapiens
tgcgcttctgctgga

SEQ ID NO: 6511225 - DNA, 16 bp, Homo sapiens
tgcgcttctgctggag

SEQ ID NO: 6511226 - DNA, 21 bp, Homo sapiens
tgcgcttggtaggtgtggtgg

SEQ ID NO: 6511227 - DNA, 17 bp, Homo sapiens
tgcgctttattgcccat

SEQ ID NO: 6511228 - DNA, 13 bp, Homo sapiens
tgcgctttgaacg

SEQ ID NO: 6511229 - DNA, 22 bp, Homo sapiens
tgcgctttgaacgtgccagcag

SEQ ID NO: 6511230 - DNA, 23 bp, Homo sapiens
tgcgctttgaacgtgccagcagc

SEQ ID NO: 6511231 - DNA, 16 bp, Homo sapiens
tgcggaaaggagatgg

SEQ ID NO: 6511232 - DNA, 23 bp, Homo sapiens
tgcggaaaggtatttgggaaact

SEQ ID NO: 6511233 - DNA, 17 bp, Homo sapiens
tgcggaagccacagggt

SEQ ID NO: 6511234 - DNA, 12 bp, Homo sapiens
tgcggaagccat

SEQ ID NO: 6511235 - DNA, 13 bp, Homo sapiens
tgcggaagccata

SEQ ID NO: 6511236 - DNA, 14 bp, Homo sapiens
tgcggaagccatag

SEQ ID NO: 6511237 - DNA, 16 bp, Homo sapiens
tgcggaagccataggg

SEQ ID NO: 6511238 - DNA, 20 bp, Homo sapiens
tgcggaagccatagggggct

SEQ ID NO: 6511239 - DNA, 15 bp, Homo sapiens
tgcggacaagtttta

SEQ ID NO: 6511240 - DNA, 18 bp, Homo sapiens
tgcggacaccgtggcctg

SEQ ID NO: 6511241 - DNA, 20 bp, Homo sapiens
tgcggacaccgtggcctggg

SEQ ID NO: 6511242 - DNA, 19 bp, Homo sapiens
tgcggacacttttgaggac

SEQ ID NO: 6511243 - DNA, 18 bp, Homo sapiens
tgcggaccaccctcactg

SEQ ID NO: 6511244 - DNA, 22 bp, Homo sapiens
tgcggaccccagctgtgagcct

SEQ ID NO: 6511245 - DNA, 23 bp, Homo sapiens
tgcggaccccagctgtgagcctt

SEQ ID NO: 6511246 - DNA, 21 bp, Homo sapiens
tgcggacccttcccagccctc

SEQ ID NO: 6511247 - DNA, 16 bp, Homo sapiens
tgcggaccggagcggc

SEQ ID NO: 6511248 - DNA, 19 bp, Homo sapiens
tgcggaccggagcggctga

SEQ ID NO: 6511249 - DNA, 15 bp, Homo sapiens
tgcggagaacaaatg

SEQ ID NO: 6511250 - DNA, 13 bp, Homo sapiens
tgcggagcacact

SEQ ID NO: 6511251 - DNA, 13 bp, Homo sapiens
tgcggagccagca

SEQ ID NO: 6511252 - DNA, 20 bp, Homo sapiens
tgcggagccagcgcctgccc

SEQ ID NO: 6511253 - DNA, 21 bp, Homo sapiens
tgcggagccagcgcctgcccg

SEQ ID NO: 6511254 - DNA, 21 bp, Homo sapiens
tgcggaggaaggaggacccag

SEQ ID NO: 6511255 - DNA, 22 bp, Homo sapiens
tgcggaggaaggaggacccagg

SEQ ID NO: 6511256 - DNA, 16 bp, Homo sapiens
tgcggaggagctgcct

SEQ ID NO: 6511257 - DNA, 18 bp, Homo sapiens
tgcggaggcaggagcatg

SEQ ID NO: 6511258 - DNA, 18 bp, Homo sapiens
tgcggagtccattatttg

SEQ ID NO: 6511259 - DNA, 16 bp, Homo sapiens
tgcggatcctgctggg

SEQ ID NO: 6511260 - DNA, 15 bp, Homo sapiens
tgcggatctcagctt

SEQ ID NO: 6511261 - DNA, 15 bp, Homo sapiens
tgcggatctctggag

SEQ ID NO: 6511262 - DNA, 17 bp, Homo sapiens
tgcggcacaggaaacag

SEQ ID NO: 6511263 - DNA, 13 bp, Homo sapiens
tgcggcaccgccc

SEQ ID NO: 6511264 - DNA, 17 bp, Homo sapiens
tgcggcaccgcccaccc

SEQ ID NO: 6511265 - DNA, 21 bp, Homo sapiens
tgcggcaggactgcagagcag

SEQ ID NO: 6511266 - DNA, 18 bp, Homo sapiens
tgcggcaggagcaggaac

SEQ ID NO: 6511267 - DNA, 17 bp, Homo sapiens
tgcggcagggcaggagc

SEQ ID NO: 6511268 - DNA, 17 bp, Homo sapiens
tgcggcagtgttccttg

SEQ ID NO: 6511269 - DNA, 12 bp, Homo sapiens
tgcggccacagc

SEQ ID NO: 6511270 - DNA, 14 bp, Homo sapiens
tgcggccagagccg

SEQ ID NO: 6511271 - DNA, 21 bp, Homo sapiens
tgcggcccactttcctgagct

SEQ ID NO: 6511272 - DNA, 13 bp, Homo sapiens
tgcggcccagcca

SEQ ID NO: 6511273 - DNA, 22 bp, Homo sapiens
tgcggcccagccatgggccctc

SEQ ID NO: 6511274 - DNA, 14 bp, Homo sapiens
tgcggcccagcccg

SEQ ID NO: 6511275 - DNA, 18 bp, Homo sapiens
tgcggcccagcccggctc

SEQ ID NO: 6511276 - DNA, 21 bp, Homo sapiens
tgcggcccagcccggctccca

SEQ ID NO: 6511277 - DNA, 14 bp, Homo sapiens
tgcggccccaggag

SEQ ID NO: 6511278 - DNA, 15 bp, Homo sapiens
tgcggcccctccccc

SEQ ID NO: 6511279 - DNA, 18 bp, Homo sapiens
tgcggcccctcccccgtc

SEQ ID NO: 6511280 - DNA, 22 bp, Homo sapiens
tgcggccgccccccgcccctcg

SEQ ID NO: 6511281 - DNA, 15 bp, Homo sapiens
tgcggccggcctggg

SEQ ID NO: 6511282 - DNA, 16 bp, Homo sapiens
tgcggccgggctgccc

SEQ ID NO: 6511283 - DNA, 20 bp, Homo sapiens
tgcggcctggggggaacgga

SEQ ID NO: 6511284 - DNA, 14 bp, Homo sapiens
tgcggccttgggtc

SEQ ID NO: 6511285 - DNA, 14 bp, Homo sapiens
tgcggcgccagcct

SEQ ID NO: 6511286 - DNA, 13 bp, Homo sapiens
tgcggcggtccca

SEQ ID NO: 6511287 - DNA, 17 bp, Homo sapiens
tgcggcggtcccagctc

SEQ ID NO: 6511288 - DNA, 19 bp, Homo sapiens
tgcggcgtggagactggca

SEQ ID NO: 6511289 - DNA, 16 bp, Homo sapiens
tgcggctccagcccag

SEQ ID NO: 6511290 - DNA, 16 bp, Homo sapiens
tgcggctctggaaagc

SEQ ID NO: 6511291 - DNA, 16 bp, Homo sapiens
tgcggctgcccacgct

SEQ ID NO: 6511292 - DNA, 16 bp, Homo sapiens
tgcggctgctggcaca

SEQ ID NO: 6511293 - DNA, 19 bp, Homo sapiens
tgcggctgctggcacagac

SEQ ID NO: 6511294 - DNA, 15 bp, Homo sapiens
tgcggctggccatgg

SEQ ID NO: 6511295 - DNA, 20 bp, Homo sapiens
tgcggctgtgcagcctgtcc

SEQ ID NO: 6511296 - DNA, 11 bp, Homo sapiens
tgcggctgtgg

SEQ ID NO: 6511297 - DNA, 13 bp, Homo sapiens
tgcggctgtgggc

SEQ ID NO: 6511298 - DNA, 19 bp, Homo sapiens
tgcggctttctctgcctct

SEQ ID NO: 6511299 - DNA, 22 bp, Homo sapiens
tgcggctttctctgcctctggg

SEQ ID NO: 6511300 - DNA, 15 bp, Homo sapiens
tgcgggacagagggt

SEQ ID NO: 6511301 - DNA, 14 bp, Homo sapiens
tgcgggacagagta

SEQ ID NO: 6511302 - DNA, 15 bp, Homo sapiens
tgcgggaccatctga

SEQ ID NO: 6511303 - DNA, 19 bp, Homo sapiens
tgcgggaccatctgatgtg

SEQ ID NO: 6511304 - DNA, 22 bp, Homo sapiens
tgcgggagccagactgtccagg

SEQ ID NO: 6511305 - DNA, 17 bp, Homo sapiens
tgcgggagctctgtatg

SEQ ID NO: 6511306 - DNA, 15 bp, Homo sapiens
tgcgggaggccctgg

SEQ ID NO: 6511307 - DNA, 23 bp, Homo sapiens
tgtgtcagcatctttgcccttct

SEQ ID NO: 6511308 - DNA, 13 bp, Homo sapiens
tgtgtcaggccct

SEQ ID NO: 6511309 - DNA, 15 bp, Homo sapiens
tgtgtcagtttatgt

SEQ ID NO: 6511310 - DNA, 19 bp, Homo sapiens
tgtgtcataccagaaagct

SEQ ID NO: 6511311 - DNA, 12 bp, Homo sapiens
tgtgtcatatta

SEQ ID NO: 6511312 - DNA, 18 bp, Homo sapiens
tgtgtcatattttaaaat

SEQ ID NO: 6511313 - DNA, 20 bp, Homo sapiens
tgtgtcatcaatagtgtcct

SEQ ID NO: 6511314 - DNA, 22 bp, Homo sapiens
tgtgtcatctagcattaggtat

SEQ ID NO: 6511315 - DNA, 15 bp, Homo sapiens
tgtgtcatctgtcag

SEQ ID NO: 6511316 - DNA, 16 bp, Homo sapiens
tgtgtcatctgtcagc

SEQ ID NO: 6511317 - DNA, 18 bp, Homo sapiens
tgtgtcatctgtcagctt

SEQ ID NO: 6511318 - DNA, 21 bp, Homo sapiens
tgtgtcatgaagaatgtttct

SEQ ID NO: 6511319 - DNA, 12 bp, Homo sapiens
tgtgtcatttct

SEQ ID NO: 6511320 - DNA, 13 bp, Homo sapiens
tgtgtcatttcta

SEQ ID NO: 6511321 - DNA, 19 bp, Homo sapiens
tgtgtccaaaaccgccagc

SEQ ID NO: 6511322 - DNA, 16 bp, Homo sapiens
tgtgtccaaaactgcc

SEQ ID NO: 6511323 - DNA, 15 bp, Homo sapiens
tgtgtccaccgttgt

SEQ ID NO: 6511324 - DNA, 16 bp, Homo sapiens
tgtgtccacctgtggg

SEQ ID NO: 6511325 - DNA, 19 bp, Homo sapiens
tgtgtccaggctctgggca

SEQ ID NO: 6511326 - DNA, 18 bp, Homo sapiens
tgtgtccatcatattaaa

SEQ ID NO: 6511327 - DNA, 15 bp, Homo sapiens
tgtgtccatcccagc

SEQ ID NO: 6511328 - DNA, 14 bp, Homo sapiens
tgtgtccatctgac

SEQ ID NO: 6511329 - DNA, 20 bp, Homo sapiens
tgtgtccatgcgctcagggc

SEQ ID NO: 6511330 - DNA, 18 bp, Homo sapiens
tgtgtccatgtgtgtgca

SEQ ID NO: 6511331 - DNA, 19 bp, Homo sapiens
tgtgtcccaaaatcccctc

SEQ ID NO: 6511332 - DNA, 23 bp, Homo sapiens
tgtgtcccagaagatgactgagg

SEQ ID NO: 6511333 - DNA, 24 bp, Homo sapiens
tgtgtcccagatgggccacggctg

SEQ ID NO: 6511334 - DNA, 14 bp, Homo sapiens
tgtgtcccaggcag

SEQ ID NO: 6511335 - DNA, 12 bp, Homo sapiens
tgtgtcccagtg

SEQ ID NO: 6511336 - DNA, 15 bp, Homo sapiens
tgtgtcccagtgaac

SEQ ID NO: 6511337 - DNA, 16 bp, Homo sapiens
tgtgtcccagtgtctg

SEQ ID NO: 6511338 - DNA, 17 bp, Homo sapiens
tgtgtcccagtgtctgg

SEQ ID NO: 6511339 - DNA, 14 bp, Homo sapiens
tgtgtcccatgacc

SEQ ID NO: 6511340 - DNA, 21 bp, Homo sapiens
tgtgtcccatgacccacccct

SEQ ID NO: 6511341 - DNA, 22 bp, Homo sapiens
tgtgtcccatgcataacacact

SEQ ID NO: 6511342 - DNA, 14 bp, Homo sapiens
tgtgtcccatgtcc

SEQ ID NO: 6511343 - DNA, 15 bp, Homo sapiens
tgtgtcccccctgtg

SEQ ID NO: 6511344 - DNA, 16 bp, Homo sapiens
tgtgtcccccctgtgg

SEQ ID NO: 6511345 - DNA, 21 bp, Homo sapiens
tgtgtcccccctgtggtctgt

SEQ ID NO: 6511346 - DNA, 23 bp, Homo sapiens
tgtgtcccccctgtggtctgtgt

SEQ ID NO: 6511347 - DNA, 19 bp, Homo sapiens
tgtgtcccctcactctgtc

SEQ ID NO: 6511348 - DNA, 17 bp, Homo sapiens
tgtgtccctctctctgg

SEQ ID NO: 6511349 - DNA, 15 bp, Homo sapiens
tgtgtccctggacac

SEQ ID NO: 6511350 - DNA, 22 bp, Homo sapiens
tgtgtccctggacacagctctt

SEQ ID NO: 6511351 - DNA, 16 bp, Homo sapiens
tgtgtccgatgctgga

SEQ ID NO: 6511352 - DNA, 21 bp, Homo sapiens
tgtgtccgctctctcatgtgg

SEQ ID NO: 6511353 - DNA, 14 bp, Homo sapiens
tgtgtccgtctgtg

SEQ ID NO: 6511354 - DNA, 17 bp, Homo sapiens
tgtgtcctaaggcccat

SEQ ID NO: 6511355 - DNA, 14 bp, Homo sapiens
tgtgtcctcaggga

SEQ ID NO: 6511356 - DNA, 23 bp, Homo sapiens
tgtgtcctccaccatgcactcac

SEQ ID NO: 6511357 - DNA, 11 bp, Homo sapiens
tgtgtcctcct

SEQ ID NO: 6511358 - DNA, 12 bp, Homo sapiens
tgtgtcctcctg

SEQ ID NO: 6511359 - DNA, 21 bp, Homo sapiens
tgtgtcctcctgctctgcttc

SEQ ID NO: 6511360 - DNA, 12 bp, Homo sapiens
tgtgtcctctcc

SEQ ID NO: 6511361 - DNA, 16 bp, Homo sapiens
tgtgtcctctccagct

SEQ ID NO: 6511362 - DNA, 13 bp, Homo sapiens
tgtgtcctctccc

SEQ ID NO: 6511363 - DNA, 14 bp, Homo sapiens
tgtgtcctctgcct

SEQ ID NO: 6511364 - DNA, 15 bp, Homo sapiens
tgtgtcctctgtgcc

SEQ ID NO: 6511365 - DNA, 21 bp, Homo sapiens
tgtgtcctggtgagaaaatat

SEQ ID NO: 6511366 - DNA, 13 bp, Homo sapiens
tgtgtccttcggg

SEQ ID NO: 6511367 - DNA, 19 bp, Homo sapiens
tgtgtccttgaactgaggc

SEQ ID NO: 6511368 - DNA, 20 bp, Homo sapiens
tgtgtccttgcacctgcatc

SEQ ID NO: 6511369 - DNA, 19 bp, Homo sapiens
tgtgtcggggctgacctct

SEQ ID NO: 6511370 - DNA, 19 bp, Homo sapiens
tgtgtcggggggcgaggga

SEQ ID NO: 6511371 - DNA, 19 bp, Homo sapiens
tgtgtctaaatttgaatgt

SEQ ID NO: 6511372 - DNA, 18 bp, Homo sapiens
tgtgtctaagattctaga

SEQ ID NO: 6511373 - DNA, 20 bp, Homo sapiens
tgtgtctaagattctagatc

SEQ ID NO: 6511374 - DNA, 15 bp, Homo sapiens
tgtgtctaccttgtt

SEQ ID NO: 6511375 - DNA, 20 bp, Homo sapiens
tgtgtctaggcaggacctgt

SEQ ID NO: 6511376 - DNA, 15 bp, Homo sapiens
tgtgtctattttgta

SEQ ID NO: 6511377 - DNA, 15 bp, Homo sapiens
tgtgtctcaaaaata

SEQ ID NO: 6511378 - DNA, 22 bp, Homo sapiens
tgtgtctcaggaaaacagctag

SEQ ID NO: 6511379 - DNA, 15 bp, Homo sapiens
tgtgtctcaggctca

SEQ ID NO: 6511380 - DNA, 16 bp, Homo sapiens
tgtgtctcatggtccc

SEQ ID NO: 6511381 - DNA, 18 bp, Homo sapiens
tgtgtctccagctgattt

SEQ ID NO: 6511382 - DNA, 16 bp, Homo sapiens
tgtgtctcctctcaga

SEQ ID NO: 6511383 - DNA, 16 bp, Homo sapiens
tgtgtctcgtctcctg

SEQ ID NO: 6511384 - DNA, 14 bp, Homo sapiens
tgtgtctcgtgtca

SEQ ID NO: 6511385 - DNA, 21 bp, Homo sapiens
tgtgtctctatcttgcatcta

SEQ ID NO: 6511386 - DNA, 18 bp, Homo sapiens
tgtgtctctgctttcctt

SEQ ID NO: 6511387 - DNA, 15 bp, Homo sapiens
tgtgtctctgtatat

SEQ ID NO: 6511388 - DNA, 13 bp, Homo sapiens
tgtgtctctgtct

SEQ ID NO: 6511389 - DNA, 17 bp, Homo sapiens
tgtgtctctgtctctcc

SEQ ID NO: 6511390 - DNA, 18 bp, Homo sapiens
tgtgtctctgtttcctga

SEQ ID NO: 6511391 - DNA, 20 bp, Homo sapiens
tgtgtctctgtttcctgaaa

SEQ ID NO: 6511392 - DNA, 21 bp, Homo sapiens
tgtgtctcttggtcctgctgc

SEQ ID NO: 6511393 - DNA, 18 bp, Homo sapiens
tgtgtctgaatcatgtct

SEQ ID NO: 6511394 - DNA, 21 bp, Homo sapiens
tgtgtctgaatcatgtctgta

SEQ ID NO: 6511395 - DNA, 15 bp, Homo sapiens
tgtgtctgacatgtt

SEQ ID NO: 6511396 - DNA, 12 bp, Homo sapiens
tgtgtctgactc

SEQ ID NO: 6511397 - DNA, 12 bp, Homo sapiens
tgtgtctgcctg

SEQ ID NO: 6511398 - DNA, 15 bp, Homo sapiens
tgtgtctgcctgcct

SEQ ID NO: 6511399 - DNA, 16 bp, Homo sapiens
tgtgtctgcctgcctc

SEQ ID NO: 6511400 - DNA, 20 bp, Homo sapiens
tgtgtctgctaatgtaaact

SEQ ID NO: 6511401 - DNA, 12 bp, Homo sapiens
tgtgtctgctga

SEQ ID NO: 6511402 - DNA, 12 bp, Homo sapiens
tgtgtctggaag

SEQ ID NO: 6511403 - DNA, 13 bp, Homo sapiens
tgtgtctggccct

SEQ ID NO: 6511404 - DNA, 22 bp, Homo sapiens
tgtgtctggcgttctcaagaat

SEQ ID NO: 6511405 - DNA, 20 bp, Homo sapiens
tgtgtctgggagagcctggc

SEQ ID NO: 6511406 - DNA, 16 bp, Homo sapiens
tgtgtctggtgcagaa

SEQ ID NO: 6511407 - DNA, 13 bp, Homo sapiens
tgtgtctgtacac

SEQ ID NO: 6511408 - DNA, 21 bp, Homo sapiens
tgtgtctgtacacgtgtcctg

SEQ ID NO: 6511409 - DNA, 23 bp, Homo sapiens
tgtgtctgtaggtgtctctgggc

SEQ ID NO: 6511410 - DNA, 21 bp, Homo sapiens
tgtgtctgtattcatacagca

SEQ ID NO: 6511411 - DNA, 12 bp, Homo sapiens
tgtgtctgtcac

SEQ ID NO: 6511412 - DNA, 17 bp, Homo sapiens
tgtgtctgtcacaggct

SEQ ID NO: 6511413 - DNA, 16 bp, Homo sapiens
tgtgtcttgtattatc

SEQ ID NO: 6511414 - DNA, 14 bp, Homo sapiens
tgtgtctttagaca

SEQ ID NO: 6511415 - DNA, 20 bp, Homo sapiens
tgtgtctttggaggtgctgc

SEQ ID NO: 6511416 - DNA, 15 bp, Homo sapiens
tgtgtctttgtctgg

SEQ ID NO: 6511417 - DNA, 10 bp, Homo sapiens
tgtgtctttt

SEQ ID NO: 6511418 - DNA, 17 bp, Homo sapiens
tgtgtcttttaaactgg

SEQ ID NO: 6511419 - DNA, 22 bp, Homo sapiens
tgtgtgaaaggaagctccactg

SEQ ID NO: 6511420 - DNA, 21 bp, Homo sapiens
tgtgtgaaaggtacttcaaat

SEQ ID NO: 6511421 - DNA, 14 bp, Homo sapiens
tgtgtgaaattgca

SEQ ID NO: 6511422 - DNA, 16 bp, Homo sapiens
tgtgtgaactgggcac

SEQ ID NO: 6511423 - DNA, 12 bp, Homo sapiens
tgtgtgaagaaa

SEQ ID NO: 6511424 - DNA, 14 bp, Homo sapiens
tgtgtgaagaaatg

SEQ ID NO: 6511425 - DNA, 14 bp, Homo sapiens
tgtgtgaagaataa

SEQ ID NO: 6511426 - DNA, 21 bp, Homo sapiens
tgtgtgaagccgccagttcat

SEQ ID NO: 6511427 - DNA, 12 bp, Homo sapiens
tgtgtgaagttt

SEQ ID NO: 6511428 - DNA, 12 bp, Homo sapiens
tgtgtgaatgaa

SEQ ID NO: 6511429 - DNA, 14 bp, Homo sapiens
tgtgtgaattcctt

SEQ ID NO: 6511430 - DNA, 15 bp, Homo sapiens
tgtgtgaattccttt

SEQ ID NO: 6511431 - DNA, 18 bp, Homo sapiens
tgtgtgaattctgcaact

SEQ ID NO: 6511432 - DNA, 15 bp, Homo sapiens
tgtgtgacaattctg

SEQ ID NO: 6511433 - DNA, 19 bp, Homo sapiens
tgtgtgacaccaccactgt

SEQ ID NO: 6511434 - DNA, 21 bp, Homo sapiens
tgtgtgacaccaccactgtgt

SEQ ID NO: 6511435 - DNA, 19 bp, Homo sapiens
tgtgtgacagaatcttgta

SEQ ID NO: 6511436 - DNA, 23 bp, Homo sapiens
tgtgtgacagaatcttgtatttg

SEQ ID NO: 6511437 - DNA, 23 bp, Homo sapiens
tgtgtgacatcacagggcctcag

SEQ ID NO: 6511438 - DNA, 16 bp, Homo sapiens
tgtgtgaccaactgtg

SEQ ID NO: 6511439 - DNA, 19 bp, Homo sapiens
tgtgtgaccaactgtgttg

SEQ ID NO: 6511440 - DNA, 23 bp, Homo sapiens
tgtgtgacccctcctggggccag

SEQ ID NO: 6511441 - DNA, 18 bp, Homo sapiens
tgtgtgactctttagcaa

SEQ ID NO: 6511442 - DNA, 16 bp, Homo sapiens
tgtgtgacttacagaa

SEQ ID NO: 6511443 - DNA, 23 bp, Homo sapiens
tgtgtgagaaaaactaacttgat

SEQ ID NO: 6511444 - DNA, 21 bp, Homo sapiens
tgtgtgagaccaggggaccag

SEQ ID NO: 6511445 - DNA, 23 bp, Homo sapiens
tgtgtgagaccaggggaccagag

SEQ ID NO: 6511446 - DNA, 19 bp, Homo sapiens
tgtgtgagacttaaaacat

SEQ ID NO: 6511447 - DNA, 21 bp, Homo sapiens
tgtgtgagcatcctgcaaggt

SEQ ID NO: 6511448 - DNA, 23 bp, Homo sapiens
tgtgtgagcgcttctgcagcctc

SEQ ID NO: 6511449 - DNA, 20 bp, Homo sapiens
tgtgtgaggagctgctggct

SEQ ID NO: 6511450 - DNA, 20 bp, Homo sapiens
tgtgtgaggctgtgtctctg

SEQ ID NO: 6511451 - DNA, 23 bp, Homo sapiens
tgtgtgagggcaaaccaggctgc

SEQ ID NO: 6511452 - DNA, 21 bp, Homo sapiens
tgtgtgagtgagcacacccgt

SEQ ID NO: 6511453 - DNA, 16 bp, Homo sapiens
tgtgtgagtgtaattc

SEQ ID NO: 6511454 - DNA, 18 bp, Homo sapiens
tgtgtgagtgtatgtata

SEQ ID NO: 6511455 - DNA, 16 bp, Homo sapiens
tgtgtgatatttcaga

SEQ ID NO: 6511456 - DNA, 15 bp, Homo sapiens
tgtgtgatccagccc

SEQ ID NO: 6511457 - DNA, 19 bp, Homo sapiens
tgtgtgatccggtttcttt

SEQ ID NO: 6511458 - DNA, 19 bp, Homo sapiens
tgtgtgatggagggaaggg

SEQ ID NO: 6511459 - DNA, 15 bp, Homo sapiens
tgtgtgatgtgacat

SEQ ID NO: 6511460 - DNA, 14 bp, Homo sapiens
tgtgtgatgtgcat

SEQ ID NO: 6511461 - DNA, 15 bp, Homo sapiens
tgtgtgattaaaagg

SEQ ID NO: 6511462 - DNA, 20 bp, Homo sapiens
tgtgtgatttcctaaacata

SEQ ID NO: 6511463 - DNA, 22 bp, Homo sapiens
tgtgtgatttcctaaacataat

SEQ ID NO: 6511464 - DNA, 16 bp, Homo sapiens
tgtgtgcaaaagcagt

SEQ ID NO: 6511465 - DNA, 23 bp, Homo sapiens
tgtgtgcaatgttccgttcatct

SEQ ID NO: 6511466 - DNA, 9 bp, Homo sapiens
tgtgtgcac

SEQ ID NO: 6511467 - DNA, 17 bp, Homo sapiens
tgtgtgcacacgtgtgt

SEQ ID NO: 6511468 - DNA, 17 bp, Homo sapiens
tgtgtgcaccttaccaa

SEQ ID NO: 6511469 - DNA, 15 bp, Homo sapiens
tgtgtgcagacaatt

SEQ ID NO: 6511470 - DNA, 19 bp, Homo sapiens
tgtgtgcagactcaataaa

SEQ ID NO: 6511471 - DNA, 14 bp, Homo sapiens
tgtgtgcagagcag

SEQ ID NO: 6511472 - DNA, 14 bp, Homo sapiens
tgtgtgcagagctg

SEQ ID NO: 6511473 - DNA, 12 bp, Homo sapiens
tgtgtgcagcaa

SEQ ID NO: 6511474 - DNA, 14 bp, Homo sapiens
tgtgtgcaggagcc

SEQ ID NO: 6511475 - DNA, 14 bp, Homo sapiens
tgtgtgcatggaag

SEQ ID NO: 6511476 - DNA, 13 bp, Homo sapiens
tgtgtgcatgtga

SEQ ID NO: 6511477 - DNA, 16 bp, Homo sapiens
tgtgtgcatgtgagca

SEQ ID NO: 6511478 - DNA, 13 bp, Homo sapiens
tgtgtgcatgtgc

SEQ ID NO: 6511479 - DNA, 15 bp, Homo sapiens
tgtgtgcatgtgtgt

SEQ ID NO: 6511480 - DNA, 19 bp, Homo sapiens
tgtgtgcatgtgtgtataa

SEQ ID NO: 6511481 - DNA, 22 bp, Homo sapiens
tgtgtgcattggggtggggctt

SEQ ID NO: 6511482 - DNA, 14 bp, Homo sapiens
tgtgtgccaagccc

SEQ ID NO: 6511483 - DNA, 24 bp, Homo sapiens
tgtgtgccatagagtttaacacaa

SEQ ID NO: 6511484 - DNA, 17 bp, Homo sapiens
tgtgtgccccactccag

SEQ ID NO: 6511485 - DNA, 12 bp, Homo sapiens
tgtgtgccctgg

SEQ ID NO: 6511486 - DNA, 14 bp, Homo sapiens
tgtgtgccctgggc

SEQ ID NO: 6511487 - DNA, 12 bp, Homo sapiens
tgcgggaggctg

SEQ ID NO: 6511488 - DNA, 14 bp, Homo sapiens
tgcgggatacagct

SEQ ID NO: 6511489 - DNA, 16 bp, Homo sapiens
tgcgggatacagctga

SEQ ID NO: 6511490 - DNA, 18 bp, Homo sapiens
tgcgggatacagctgagt

SEQ ID NO: 6511491 - DNA, 21 bp, Homo sapiens
tgcgggcattttgaatgtgat

SEQ ID NO: 6511492 - DNA, 12 bp, Homo sapiens
tgcgggccaggg

SEQ ID NO: 6511493 - DNA, 14 bp, Homo sapiens
tgcgggccagggtc

SEQ ID NO: 6511494 - DNA, 22 bp, Homo sapiens
tgcgggccagggtcctgtcgcc

SEQ ID NO: 6511495 - DNA, 20 bp, Homo sapiens
tgcgggccaggtctggcgcc

SEQ ID NO: 6511496 - DNA, 15 bp, Homo sapiens
tgcgggcccagctga

SEQ ID NO: 6511497 - DNA, 16 bp, Homo sapiens
tgcgggcccagctgag

SEQ ID NO: 6511498 - DNA, 13 bp, Homo sapiens
tgcgggcctggcc

SEQ ID NO: 6511499 - DNA, 23 bp, Homo sapiens
tgcgggcgcgggcagccacccaa

SEQ ID NO: 6511500 - DNA, 13 bp, Homo sapiens
tgcgggctccctc

SEQ ID NO: 6511501 - DNA, 20 bp, Homo sapiens
tgcgggctccctcctctggc

SEQ ID NO: 6511502 - DNA, 14 bp, Homo sapiens
tgcgggctcgccca

SEQ ID NO: 6511503 - DNA, 18 bp, Homo sapiens
tgcgggctgaggccagag

SEQ ID NO: 6511504 - DNA, 13 bp, Homo sapiens
tgcgggctgaggg

SEQ ID NO: 6511505 - DNA, 16 bp, Homo sapiens
tgcgggctgagggcat

SEQ ID NO: 6511506 - DNA, 13 bp, Homo sapiens
tgcgggctgggca

SEQ ID NO: 6511507 - DNA, 15 bp, Homo sapiens
tgcgggctgggcagc

SEQ ID NO: 6511508 - DNA, 20 bp, Homo sapiens
tgcgggcttcctcctggtgt

SEQ ID NO: 6511509 - DNA, 13 bp, Homo sapiens
tgcggggagaaga

SEQ ID NO: 6511510 - DNA, 15 bp, Homo sapiens
tgcggggcagagcca

SEQ ID NO: 6511511 - DNA, 14 bp, Homo sapiens
tgcggggcagcagg

SEQ ID NO: 6511512 - DNA, 15 bp, Homo sapiens
tgcggggcagcaggg

SEQ ID NO: 6511513 - DNA, 21 bp, Homo sapiens
tgcggggcttttaaaaggaaa

SEQ ID NO: 6511514 - DNA, 17 bp, Homo sapiens
tgcgggggagcaggcag

SEQ ID NO: 6511515 - DNA, 18 bp, Homo sapiens
tgcgggggagccagttct

SEQ ID NO: 6511516 - DNA, 18 bp, Homo sapiens
tgcgggggagctggaaat

SEQ ID NO: 6511517 - DNA, 21 bp, Homo sapiens
tgcgggtcaacatttccaaaa

SEQ ID NO: 6511518 - DNA, 17 bp, Homo sapiens
tgcgggtcacaggaggg

SEQ ID NO: 6511519 - DNA, 16 bp, Homo sapiens
tgcgggtcctcagctg

SEQ ID NO: 6511520 - DNA, 19 bp, Homo sapiens
tgcgggtcctcagctgctc

SEQ ID NO: 6511521 - DNA, 22 bp, Homo sapiens
tgcgggtgaacaaagcagccac

SEQ ID NO: 6511522 - DNA, 17 bp, Homo sapiens
tgcgggtttgaggatag

SEQ ID NO: 6511523 - DNA, 18 bp, Homo sapiens
tgcggtagccagcacaca

SEQ ID NO: 6511524 - DNA, 13 bp, Homo sapiens
tgcggtaggtgct

SEQ ID NO: 6511525 - DNA, 17 bp, Homo sapiens
tgcggtaggtgctggcc

SEQ ID NO: 6511526 - DNA, 14 bp, Homo sapiens
tgcggtcaaggcca

SEQ ID NO: 6511527 - DNA, 17 bp, Homo sapiens
tgcggtccacccaggag

SEQ ID NO: 6511528 - DNA, 18 bp, Homo sapiens
tgcggtccacccaggagc

SEQ ID NO: 6511529 - DNA, 14 bp, Homo sapiens
tgcggtctggtctc

SEQ ID NO: 6511530 - DNA, 20 bp, Homo sapiens
tgcggtgaagttgaggctta

SEQ ID NO: 6511531 - DNA, 17 bp, Homo sapiens
tgcggtgctatctcccc

SEQ ID NO: 6511532 - DNA, 16 bp, Homo sapiens
tgcggtgtctgcagct

SEQ ID NO: 6511533 - DNA, 19 bp, Homo sapiens
tgcggttataaaaaatggt

SEQ ID NO: 6511534 - DNA, 15 bp, Homo sapiens
tgcggttgggaggca

SEQ ID NO: 6511535 - DNA, 13 bp, Homo sapiens
tgcgtaaatcaac

SEQ ID NO: 6511536 - DNA, 20 bp, Homo sapiens
tgcgtaaccctcgccctgtc

SEQ ID NO: 6511537 - DNA, 16 bp, Homo sapiens
tgcgtacacagagaag

SEQ ID NO: 6511538 - DNA, 17 bp, Homo sapiens
tgcgtacacagagaagg

SEQ ID NO: 6511539 - DNA, 20 bp, Homo sapiens
tgcgtacgtttcctgagaag

SEQ ID NO: 6511540 - DNA, 15 bp, Homo sapiens
tgcgtagaagatatg

SEQ ID NO: 6511541 - DNA, 15 bp, Homo sapiens
tgcgtagcatttgct

SEQ ID NO: 6511542 - DNA, 19 bp, Homo sapiens
tgcgtatgtctgttaccat

SEQ ID NO: 6511543 - DNA, 14 bp, Homo sapiens
tgcgtattctgtgg

SEQ ID NO: 6511544 - DNA, 16 bp, Homo sapiens
tgcgtcaggagcagca

SEQ ID NO: 6511545 - DNA, 23 bp, Homo sapiens
tgcgtcaggcacgtctcctgctg

SEQ ID NO: 6511546 - DNA, 15 bp, Homo sapiens
tgcgtcataaggaga

SEQ ID NO: 6511547 - DNA, 20 bp, Homo sapiens
tgcgtcattacagggcacag

SEQ ID NO: 6511548 - DNA, 14 bp, Homo sapiens
tgcgtccaccaggc

SEQ ID NO: 6511549 - DNA, 21 bp, Homo sapiens
tgcgtccaccaggcctcactg

SEQ ID NO: 6511550 - DNA, 17 bp, Homo sapiens
tgcgtccaccctgagct

SEQ ID NO: 6511551 - DNA, 19 bp, Homo sapiens
tgcgtccacgagctgttta

SEQ ID NO: 6511552 - DNA, 15 bp, Homo sapiens
tgcgtccactttccc

SEQ ID NO: 6511553 - DNA, 14 bp, Homo sapiens
tgcgtcccagcctg

SEQ ID NO: 6511554 - DNA, 15 bp, Homo sapiens
tgcgtcccagcctgc

SEQ ID NO: 6511555 - DNA, 15 bp, Homo sapiens
tgcgtcccagctgaa

SEQ ID NO: 6511556 - DNA, 21 bp, Homo sapiens
tgcgtcccagctgaaggcagt

SEQ ID NO: 6511557 - DNA, 14 bp, Homo sapiens
tgcgtcccccagcc

SEQ ID NO: 6511558 - DNA, 15 bp, Homo sapiens
tgcgtcccccagccc

SEQ ID NO: 6511559 - DNA, 21 bp, Homo sapiens
tgcgtcccccgttgtgcctgg

SEQ ID NO: 6511560 - DNA, 15 bp, Homo sapiens
tgcgtccctgctcag

SEQ ID NO: 6511561 - DNA, 16 bp, Homo sapiens
tgcgtcctcatttccc

SEQ ID NO: 6511562 - DNA, 16 bp, Homo sapiens
tgcgtcctcctcacct

SEQ ID NO: 6511563 - DNA, 19 bp, Homo sapiens
tgcgtcctcctcacctcat

SEQ ID NO: 6511564 - DNA, 15 bp, Homo sapiens
tgcgtctccagtcat

SEQ ID NO: 6511565 - DNA, 17 bp, Homo sapiens
tgcgtctccagtcatct

SEQ ID NO: 6511566 - DNA, 16 bp, Homo sapiens
tgcgtctgacatcctg

SEQ ID NO: 6511567 - DNA, 15 bp, Homo sapiens
tgcgtctggaggggc

SEQ ID NO: 6511568 - DNA, 11 bp, Homo sapiens
tgcgtctgtgt

SEQ ID NO: 6511569 - DNA, 19 bp, Homo sapiens
tgcgtctgttttgtgtctg

SEQ ID NO: 6511570 - DNA, 21 bp, Homo sapiens
tgcgtcttccgcccctgcctg

SEQ ID NO: 6511571 - DNA, 13 bp, Homo sapiens
tgcgtcttgtgaa

SEQ ID NO: 6511572 - DNA, 14 bp, Homo sapiens
tgcgtcttgtgaaa

SEQ ID NO: 6511573 - DNA, 16 bp, Homo sapiens
tgcgtcttgtgaaatt

SEQ ID NO: 6511574 - DNA, 17 bp, Homo sapiens
tgcgtcttgtgaaattg

SEQ ID NO: 6511575 - DNA, 19 bp, Homo sapiens
tgcgtcttttttctcttcc

SEQ ID NO: 6511576 - DNA, 20 bp, Homo sapiens
tgcgtcttttttctcttccc

SEQ ID NO: 6511577 - DNA, 22 bp, Homo sapiens
tgcgtgaaacacaccaggctgt

SEQ ID NO: 6511578 - DNA, 17 bp, Homo sapiens
tgcgtgaaggctctcag

SEQ ID NO: 6511579 - DNA, 20 bp, Homo sapiens
tgcgtgacactctccttgca

SEQ ID NO: 6511580 - DNA, 17 bp, Homo sapiens
tgcgtgaccggcccgcc

SEQ ID NO: 6511581 - DNA, 17 bp, Homo sapiens
tgcgtgcccggggcagc

SEQ ID NO: 6511582 - DNA, 16 bp, Homo sapiens
tgcgtgcccttttcat

SEQ ID NO: 6511583 - DNA, 23 bp, Homo sapiens
tgcgtgccgcctgctcctcactg

SEQ ID NO: 6511584 - DNA, 23 bp, Homo sapiens
tgcgtgccgggagaggactctgc

SEQ ID NO: 6511585 - DNA, 18 bp, Homo sapiens
tgcgtgccgtgtgagtgt

SEQ ID NO: 6511586 - DNA, 23 bp, Homo sapiens
tgcgtgccgtgtgagtgtgacag

SEQ ID NO: 6511587 - DNA, 14 bp, Homo sapiens
tgcgtggaaatctc

SEQ ID NO: 6511588 - DNA, 13 bp, Homo sapiens
tgcgtggaccccg

SEQ ID NO: 6511589 - DNA, 22 bp, Homo sapiens
tgcgtggatcaagcttgtgtac

SEQ ID NO: 6511590 - DNA, 13 bp, Homo sapiens
tgcgtggcctgag

SEQ ID NO: 6511591 - DNA, 21 bp, Homo sapiens
tgcgtggcctgagtcctggtc

SEQ ID NO: 6511592 - DNA, 13 bp, Homo sapiens
tgcgtggcctggg

SEQ ID NO: 6511593 - DNA, 14 bp, Homo sapiens
tgcgtggctgaccc

SEQ ID NO: 6511594 - DNA, 16 bp, Homo sapiens
tgcgtggctgtggcac

SEQ ID NO: 6511595 - DNA, 21 bp, Homo sapiens
tgcgtggctgtggcacagact

SEQ ID NO: 6511596 - DNA, 18 bp, Homo sapiens
tgcgtgggagtgtgtgcc

SEQ ID NO: 6511597 - DNA, 12 bp, Homo sapiens
tgcgtgggcaga

SEQ ID NO: 6511598 - DNA, 14 bp, Homo sapiens
tgcgtgggcagagg

SEQ ID NO: 6511599 - DNA, 16 bp, Homo sapiens
tgcgtgggcagaggaa

SEQ ID NO: 6511600 - DNA, 13 bp, Homo sapiens
tgcgtgggtcaga

SEQ ID NO: 6511601 - DNA, 21 bp, Homo sapiens
tgcgtggtatacatgtgtaca

SEQ ID NO: 6511602 - DNA, 23 bp, Homo sapiens
tgcgtggtatacatgtgtacata

SEQ ID NO: 6511603 - DNA, 15 bp, Homo sapiens
tgcgtggtgtggccc

SEQ ID NO: 6511604 - DNA, 21 bp, Homo sapiens
tgcgtgtcagttactttttta

SEQ ID NO: 6511605 - DNA, 18 bp, Homo sapiens
tgcgtgtccgtctgtctg

SEQ ID NO: 6511606 - DNA, 16 bp, Homo sapiens
tgcgtgtctctgccat

SEQ ID NO: 6511607 - DNA, 17 bp, Homo sapiens
tgcgtgtctctgccatg

SEQ ID NO: 6511608 - DNA, 13 bp, Homo sapiens
tgcgtgtctgttt

SEQ ID NO: 6511609 - DNA, 12 bp, Homo sapiens
tgcgtgtggccc

SEQ ID NO: 6511610 - DNA, 16 bp, Homo sapiens
tgcgtgtggccctgtg

SEQ ID NO: 6511611 - DNA, 20 bp, Homo sapiens
tgcgtgtggccctgtgggag

SEQ ID NO: 6511612 - DNA, 20 bp, Homo sapiens
tgcgtgtgtagagttaagaa

SEQ ID NO: 6511613 - DNA, 21 bp, Homo sapiens
tgcgtgtgtagagttaagaag

SEQ ID NO: 6511614 - DNA, 19 bp, Homo sapiens
tgcgtgtgtccatgtgtgt

SEQ ID NO: 6511615 - DNA, 18 bp, Homo sapiens
tgcgtgtgtgtgtgtttg

SEQ ID NO: 6511616 - DNA, 18 bp, Homo sapiens
tgcgtgtgtttgtatgtc

SEQ ID NO: 6511617 - DNA, 22 bp, Homo sapiens
tgcgtgtgtttgtatgtctgtg

SEQ ID NO: 6511618 - DNA, 20 bp, Homo sapiens
tgcgtgttagtgtgtgtgca

SEQ ID NO: 6511619 - DNA, 16 bp, Homo sapiens
tgcgtgttcagcagaa

SEQ ID NO: 6511620 - DNA, 18 bp, Homo sapiens
tgcgtgttcagcagaacc

SEQ ID NO: 6511621 - DNA, 22 bp, Homo sapiens
tgcgtgttccagccaaagcatg

SEQ ID NO: 6511622 - DNA, 15 bp, Homo sapiens
tgcgtgttctcagag

SEQ ID NO: 6511623 - DNA, 13 bp, Homo sapiens
tgcgttcaaagag

SEQ ID NO: 6511624 - DNA, 18 bp, Homo sapiens
tgcgttcccagaccatgg

SEQ ID NO: 6511625 - DNA, 14 bp, Homo sapiens
tgcgttcccttcag

SEQ ID NO: 6511626 - DNA, 19 bp, Homo sapiens
tgcgttcccttcagtactg

SEQ ID NO: 6511627 - DNA, 15 bp, Homo sapiens
tgcgttctcccagca

SEQ ID NO: 6511628 - DNA, 13 bp, Homo sapiens
tgcgttggagcca

SEQ ID NO: 6511629 - DNA, 16 bp, Homo sapiens
tgcgttggcttctccc

SEQ ID NO: 6511630 - DNA, 18 bp, Homo sapiens
tgcgttggcttctccctg

SEQ ID NO: 6511631 - DNA, 21 bp, Homo sapiens
tgcgtttcttccactgagtct

SEQ ID NO: 6511632 - DNA, 13 bp, Homo sapiens
tgcgtttgcctcc

SEQ ID NO: 6511633 - DNA, 15 bp, Homo sapiens
tgcgtttgcctcctg

SEQ ID NO: 6511634 - DNA, 23 bp, Homo sapiens
tgcgtttggaggcccctgggctc

SEQ ID NO: 6511635 - DNA, 20 bp, Homo sapiens
tgcgttttctccgggtcctc

SEQ ID NO: 6511636 - DNA, 13 bp, Homo sapiens
tgcgtttttcctt

SEQ ID NO: 6511637 - DNA, 13 bp, Homo sapiens
tgctaaaaaaagt

SEQ ID NO: 6511638 - DNA, 21 bp, Homo sapiens
tgctaaaaaattaaaccaagc

SEQ ID NO: 6511639 - DNA, 23 bp, Homo sapiens
tgctaaaaatgagcttgattaaa

SEQ ID NO: 6511640 - DNA, 17 bp, Homo sapiens
tgctaaaaatgggactt

SEQ ID NO: 6511641 - DNA, 12 bp, Homo sapiens
tgctaaaaatgt

SEQ ID NO: 6511642 - DNA, 15 bp, Homo sapiens
tgctaaaagaagaga

SEQ ID NO: 6511643 - DNA, 17 bp, Homo sapiens
tgctaaaagaagagagg

SEQ ID NO: 6511644 - DNA, 23 bp, Homo sapiens
tgctaaaagaagagaggggaaga

SEQ ID NO: 6511645 - DNA, 17 bp, Homo sapiens
tgctaaaagcatgtata

SEQ ID NO: 6511646 - DNA, 18 bp, Homo sapiens
tgctaaaagcatgtatag

SEQ ID NO: 6511647 - DNA, 14 bp, Homo sapiens
tgctaaaaggaata

SEQ ID NO: 6511648 - DNA, 12 bp, Homo sapiens
tgctaaaagtgc

SEQ ID NO: 6511649 - DNA, 14 bp, Homo sapiens
tgctaaaataacag

SEQ ID NO: 6511650 - DNA, 23 bp, Homo sapiens
tgctaaaattctatagagataga

SEQ ID NO: 6511651 - DNA, 20 bp, Homo sapiens
tgctaaacagatgtcttctt

SEQ ID NO: 6511652 - DNA, 19 bp, Homo sapiens
tgctaaacctatctgtatt

SEQ ID NO: 6511653 - DNA, 14 bp, Homo sapiens
tgctaaaccttagt

SEQ ID NO: 6511654 - DNA, 21 bp, Homo sapiens
tgctaaaccttagtactgagt

SEQ ID NO: 6511655 - DNA, 22 bp, Homo sapiens
tgctaaacgactccgagaacaa

SEQ ID NO: 6511656 - DNA, 23 bp, Homo sapiens
tgctaaacgactccgagaacaac

SEQ ID NO: 6511657 - DNA, 18 bp, Homo sapiens
tgctaaacgtgtatgttt

SEQ ID NO: 6511658 - DNA, 14 bp, Homo sapiens
tgctaaactgtgaa

SEQ ID NO: 6511659 - DNA, 12 bp, Homo sapiens
tgctaaacttgg

SEQ ID NO: 6511660 - DNA, 15 bp, Homo sapiens
tgctaaagcactttg

SEQ ID NO: 6511661 - DNA, 17 bp, Homo sapiens
tgctaaagcactttgca

SEQ ID NO: 6511662 - DNA, 19 bp, Homo sapiens
tgctaaagcactttgcact

SEQ ID NO: 6511663 - DNA, 13 bp, Homo sapiens
tgctaaagccagg

SEQ ID NO: 6511664 - DNA, 19 bp, Homo sapiens
tgctaaagcctgtgggttt

SEQ ID NO: 6511665 - DNA, 20 bp, Homo sapiens
tgctaaagggagaaatgcca

SEQ ID NO: 6511666 - DNA, 16 bp, Homo sapiens
tgctaaagttggaaag

SEQ ID NO: 6511667 - DNA, 18 bp, Homo sapiens
tgtgtgccgagcccttgc

SEQ ID NO: 6511668 - DNA, 22 bp, Homo sapiens
tgtgtgccgagcccttgcccat

SEQ ID NO: 6511669 - DNA, 20 bp, Homo sapiens
tgtgtgcctcctagagtgca

SEQ ID NO: 6511670 - DNA, 18 bp, Homo sapiens
tgtgtgcctctagctgaa

SEQ ID NO: 6511671 - DNA, 13 bp, Homo sapiens
tgtgtgcgcctga

SEQ ID NO: 6511672 - DNA, 14 bp, Homo sapiens
tgtgtgcgcgtgca

SEQ ID NO: 6511673 - DNA, 14 bp, Homo sapiens
tgtgtgcgctgcct

SEQ ID NO: 6511674 - DNA, 16 bp, Homo sapiens
tgtgtgcgctgcctgg

SEQ ID NO: 6511675 - DNA, 13 bp, Homo sapiens
tgtgtgctactaa

SEQ ID NO: 6511676 - DNA, 20 bp, Homo sapiens
tgtgtgctcacaatgttctg

SEQ ID NO: 6511677 - DNA, 22 bp, Homo sapiens
tgtgtgctcatgtatgtgcgaa

SEQ ID NO: 6511678 - DNA, 12 bp, Homo sapiens
tgtgtgctccgg

SEQ ID NO: 6511679 - DNA, 12 bp, Homo sapiens
tgtgtgctctta

SEQ ID NO: 6511680 - DNA, 13 bp, Homo sapiens
tgtgtgctgatgt

SEQ ID NO: 6511681 - DNA, 16 bp, Homo sapiens
tgtgtgctgtttgaaa

SEQ ID NO: 6511682 - DNA, 14 bp, Homo sapiens
tgtgtgcttacagt

SEQ ID NO: 6511683 - DNA, 21 bp, Homo sapiens
tgtgtgcttacagtaactaat

SEQ ID NO: 6511684 - DNA, 16 bp, Homo sapiens
tgtgtgcttcacacaa

SEQ ID NO: 6511685 - DNA, 12 bp, Homo sapiens
tgtgtgctttcc

SEQ ID NO: 6511686 - DNA, 23 bp, Homo sapiens
tgtgtggaaaaaaaaaaaaacta

SEQ ID NO: 6511687 - DNA, 19 bp, Homo sapiens
tgtgtggaaggcacccgcc

SEQ ID NO: 6511688 - DNA, 23 bp, Homo sapiens
tgtgtggaaggcagggacagaga

SEQ ID NO: 6511689 - DNA, 19 bp, Homo sapiens
tgtgtggacggcgctgcct

SEQ ID NO: 6511690 - DNA, 17 bp, Homo sapiens
tgtgtggactcaagtcc

SEQ ID NO: 6511691 - DNA, 19 bp, Homo sapiens
tgtgtggactgtgatgcca

SEQ ID NO: 6511692 - DNA, 17 bp, Homo sapiens
tgtgtggagaagtgtgt

SEQ ID NO: 6511693 - DNA, 21 bp, Homo sapiens
tgtgtggagagggaatgtgaa

SEQ ID NO: 6511694 - DNA, 13 bp, Homo sapiens
tgtgtggaggggg

SEQ ID NO: 6511695 - DNA, 15 bp, Homo sapiens
tgtgtggatgtgtaa

SEQ ID NO: 6511696 - DNA, 9 bp, Homo sapiens
tgtgtggca

SEQ ID NO: 6511697 - DNA, 18 bp, Homo sapiens
tgtgtggccacttctgtc

SEQ ID NO: 6511698 - DNA, 20 bp, Homo sapiens
tgtgtggccacttctgtcca

SEQ ID NO: 6511699 - DNA, 12 bp, Homo sapiens
tgtgtggcccag

SEQ ID NO: 6511700 - DNA, 12 bp, Homo sapiens
tgtgtggccctg

SEQ ID NO: 6511701 - DNA, 13 bp, Homo sapiens
tgtgtggccctgg

SEQ ID NO: 6511702 - DNA, 18 bp, Homo sapiens
tgtgtggccgcctggcag

SEQ ID NO: 6511703 - DNA, 20 bp, Homo sapiens
tgtgtggcctaatccacctg

SEQ ID NO: 6511704 - DNA, 20 bp, Homo sapiens
tgtgtggcctccctggctcc

SEQ ID NO: 6511705 - DNA, 14 bp, Homo sapiens
tgtgtggcctgcct

SEQ ID NO: 6511706 - DNA, 16 bp, Homo sapiens
tgtgtggcctggtggg

SEQ ID NO: 6511707 - DNA, 22 bp, Homo sapiens
tgtgtggctgccccacctgccg

SEQ ID NO: 6511708 - DNA, 14 bp, Homo sapiens
tgtgtggctgggac

SEQ ID NO: 6511709 - DNA, 15 bp, Homo sapiens
tgtgtgggactgtac

SEQ ID NO: 6511710 - DNA, 18 bp, Homo sapiens
tgtgtgggactgtacaca

SEQ ID NO: 6511711 - DNA, 12 bp, Homo sapiens
tgtgtgggaggg

SEQ ID NO: 6511712 - DNA, 16 bp, Homo sapiens
tgtgtgggagtgtgta

SEQ ID NO: 6511713 - DNA, 12 bp, Homo sapiens
tgtgtgggcagg

SEQ ID NO: 6511714 - DNA, 13 bp, Homo sapiens
tgtgtgggcaggg

SEQ ID NO: 6511715 - DNA, 14 bp, Homo sapiens
tgtgtgggggagat

SEQ ID NO: 6511716 - DNA, 22 bp, Homo sapiens
tgtgtgggggagattctgggtt

SEQ ID NO: 6511717 - DNA, 13 bp, Homo sapiens
tgtgtgggtctat

SEQ ID NO: 6511718 - DNA, 20 bp, Homo sapiens
tgtgtgggtctggggaggga

SEQ ID NO: 6511719 - DNA, 21 bp, Homo sapiens
tgtgtgggtggatataaatat

SEQ ID NO: 6511720 - DNA, 20 bp, Homo sapiens
tgtgtggtactttgcagctg

SEQ ID NO: 6511721 - DNA, 14 bp, Homo sapiens
tgtgtggtcaacat

SEQ ID NO: 6511722 - DNA, 18 bp, Homo sapiens
tgtgtggtcaacatttct

SEQ ID NO: 6511723 - DNA, 15 bp, Homo sapiens
tgtgtggtccatgcc

SEQ ID NO: 6511724 - DNA, 18 bp, Homo sapiens
tgtgtggtctccagctcc

SEQ ID NO: 6511725 - DNA, 20 bp, Homo sapiens
tgtgtggtgaggggctttct

SEQ ID NO: 6511726 - DNA, 16 bp, Homo sapiens
tgtgtggtgcattcct

SEQ ID NO: 6511727 - DNA, 16 bp, Homo sapiens
tgtgtggtggcctcag

SEQ ID NO: 6511728 - DNA, 21 bp, Homo sapiens
tgtgtggtttcagttctgtgt

SEQ ID NO: 6511729 - DNA, 20 bp, Homo sapiens
tgtgtggtttcccctttctt

SEQ ID NO: 6511730 - DNA, 20 bp, Homo sapiens
tgtgtggtttggtgtgttcc

SEQ ID NO: 6511731 - DNA, 15 bp, Homo sapiens
tgtgtgtaaaaaagt

SEQ ID NO: 6511732 - DNA, 16 bp, Homo sapiens
tgtgtgtaatctgtta

SEQ ID NO: 6511733 - DNA, 21 bp, Homo sapiens
tgtgtgtaccacaccctgcct

SEQ ID NO: 6511734 - DNA, 11 bp, Homo sapiens
tgtgtgtactc

SEQ ID NO: 6511735 - DNA, 21 bp, Homo sapiens
tgtgtgtactcactgaagcct

SEQ ID NO: 6511736 - DNA, 13 bp, Homo sapiens
tgtgtgtatatat

SEQ ID NO: 6511737 - DNA, 14 bp, Homo sapiens
tgtgtgtatatatg

SEQ ID NO: 6511738 - DNA, 12 bp, Homo sapiens
tgtgtgtatgca

SEQ ID NO: 6511739 - DNA, 15 bp, Homo sapiens
tgtgtgtatgctgat

SEQ ID NO: 6511740 - DNA, 14 bp, Homo sapiens
tgtgtgtatgctgc

SEQ ID NO: 6511741 - DNA, 17 bp, Homo sapiens
tgtgtgtatgctgcttt

SEQ ID NO: 6511742 - DNA, 12 bp, Homo sapiens
tgtgtgtatgta

SEQ ID NO: 6511743 - DNA, 12 bp, Homo sapiens
tgtgtgtatgtc

SEQ ID NO: 6511744 - DNA, 18 bp, Homo sapiens
tgtgtgtatgtctatgtg

SEQ ID NO: 6511745 - DNA, 18 bp, Homo sapiens
tgtgtgtattcagaggca

SEQ ID NO: 6511746 - DNA, 19 bp, Homo sapiens
tgtgtgtattcagaggcag

SEQ ID NO: 6511747 - DNA, 15 bp, Homo sapiens
tgtgtgtatttgtat

SEQ ID NO: 6511748 - DNA, 12 bp, Homo sapiens
tgtgtgtcacaa

SEQ ID NO: 6511749 - DNA, 19 bp, Homo sapiens
tgtgtgtccccttgcagcc

SEQ ID NO: 6511750 - DNA, 21 bp, Homo sapiens
tgtgtgtccgtttgagtgtct

SEQ ID NO: 6511751 - DNA, 22 bp, Homo sapiens
tgtgtgtctaggcaggacctgt

SEQ ID NO: 6511752 - DNA, 13 bp, Homo sapiens
tgtgtgtctctga

SEQ ID NO: 6511753 - DNA, 15 bp, Homo sapiens
tgtgtgtctgtcttt

SEQ ID NO: 6511754 - DNA, 17 bp, Homo sapiens
tgtgtgtgaaaatgtgt

SEQ ID NO: 6511755 - DNA, 16 bp, Homo sapiens
tgtgtgtgagtttgct

SEQ ID NO: 6511756 - DNA, 12 bp, Homo sapiens
tgtgtgtgcaga

SEQ ID NO: 6511757 - DNA, 22 bp, Homo sapiens
tgtgtgtgccctctgggctctg

SEQ ID NO: 6511758 - DNA, 24 bp, Homo sapiens
tgtgtgtgccctgggccaggcagg

SEQ ID NO: 6511759 - DNA, 12 bp, Homo sapiens
tgtgtgtggaat

SEQ ID NO: 6511760 - DNA, 13 bp, Homo sapiens
tgtgtgtggacag

SEQ ID NO: 6511761 - DNA, 14 bp, Homo sapiens
tgtgtgtggcaggg

SEQ ID NO: 6511762 - DNA, 13 bp, Homo sapiens
tgtgtgtggtttt

SEQ ID NO: 6511763 - DNA, 14 bp, Homo sapiens
tgtgtgtgtatgtg

SEQ ID NO: 6511764 - DNA, 15 bp, Homo sapiens
tgtgtgtgtatgtga

SEQ ID NO: 6511765 - DNA, 12 bp, Homo sapiens
tgtgtgtgtgca

SEQ ID NO: 6511766 - DNA, 15 bp, Homo sapiens
tgtgtgtgtgcacat

SEQ ID NO: 6511767 - DNA, 13 bp, Homo sapiens
tgtgtgtgtgcat

SEQ ID NO: 6511768 - DNA, 11 bp, Homo sapiens
tgtgtgtgtgt

SEQ ID NO: 6511769 - DNA, 12 bp, Homo sapiens
tgtgtgtgtgta

SEQ ID NO: 6511770 - DNA, 13 bp, Homo sapiens
tgtgtgtgtgtat

SEQ ID NO: 6511771 - DNA, 14 bp, Homo sapiens
tgtgtgtgtgtgcg

SEQ ID NO: 6511772 - DNA, 13 bp, Homo sapiens
tgtgtgtgtgtgt

SEQ ID NO: 6511773 - DNA, 14 bp, Homo sapiens
tgtgtgtgtgtgtg

SEQ ID NO: 6511774 - DNA, 14 bp, Homo sapiens
tgtgtgtgtgtttg

SEQ ID NO: 6511775 - DNA, 15 bp, Homo sapiens
tgtgtgtgttctgta

SEQ ID NO: 6511776 - DNA, 20 bp, Homo sapiens
tgtgtgttaagctctgctat

SEQ ID NO: 6511777 - DNA, 14 bp, Homo sapiens
tgtgtgttacaatg

SEQ ID NO: 6511778 - DNA, 11 bp, Homo sapiens
tgtgtgttcct

SEQ ID NO: 6511779 - DNA, 13 bp, Homo sapiens
tgtgtgttcctgg

SEQ ID NO: 6511780 - DNA, 12 bp, Homo sapiens
tgtgtgttctgt

SEQ ID NO: 6511781 - DNA, 20 bp, Homo sapiens
tgtgtgttcttcaagccagc

SEQ ID NO: 6511782 - DNA, 16 bp, Homo sapiens
tgtgtgttcttttgat

SEQ ID NO: 6511783 - DNA, 14 bp, Homo sapiens
tgtgtgttgactgc

SEQ ID NO: 6511784 - DNA, 15 bp, Homo sapiens
tgtgtgttgatactg

SEQ ID NO: 6511785 - DNA, 21 bp, Homo sapiens
tgtgtgttgatactgttgcac

SEQ ID NO: 6511786 - DNA, 22 bp, Homo sapiens
tgtgtgttgcaaatcactctgc

SEQ ID NO: 6511787 - DNA, 17 bp, Homo sapiens
tgtgtgttgccacagga

SEQ ID NO: 6511788 - DNA, 22 bp, Homo sapiens
tgtgtgttggctttgcagctgc

SEQ ID NO: 6511789 - DNA, 18 bp, Homo sapiens
tgtgtgttgtgtgtggga

SEQ ID NO: 6511790 - DNA, 16 bp, Homo sapiens
tgtgtgttgtttccat

SEQ ID NO: 6511791 - DNA, 15 bp, Homo sapiens
tgtgtgtttaaagaa

SEQ ID NO: 6511792 - DNA, 22 bp, Homo sapiens
tgtgtgtttaaataaagtatca

SEQ ID NO: 6511793 - DNA, 23 bp, Homo sapiens
tgtgtgtttattgtcaaagtggt

SEQ ID NO: 6511794 - DNA, 15 bp, Homo sapiens
tgtgtgtttcacttt

SEQ ID NO: 6511795 - DNA, 15 bp, Homo sapiens
tgtgtgtttctgtcc

SEQ ID NO: 6511796 - DNA, 13 bp, Homo sapiens
tgtgtgtttggaa

SEQ ID NO: 6511797 - DNA, 17 bp, Homo sapiens
tgtgtgtttgtgtgtct

SEQ ID NO: 6511798 - DNA, 15 bp, Homo sapiens
tgtgtgttttcccaa

SEQ ID NO: 6511799 - DNA, 18 bp, Homo sapiens
tgtgttaatttaagtttt

SEQ ID NO: 6511800 - DNA, 15 bp, Homo sapiens
tgtgttacattattc

SEQ ID NO: 6511801 - DNA, 16 bp, Homo sapiens
tgtgttagagattttt

SEQ ID NO: 6511802 - DNA, 18 bp, Homo sapiens
tgtgttagtgtctgtcca

SEQ ID NO: 6511803 - DNA, 15 bp, Homo sapiens
tgtgttatattccaa

SEQ ID NO: 6511804 - DNA, 22 bp, Homo sapiens
tgtgttatcacccagaagaaaa

SEQ ID NO: 6511805 - DNA, 22 bp, Homo sapiens
tgtgttatcggacattctaatg

SEQ ID NO: 6511806 - DNA, 19 bp, Homo sapiens
tgtgttatgcaaaagcaag

SEQ ID NO: 6511807 - DNA, 14 bp, Homo sapiens
tgtgttattataga

SEQ ID NO: 6511808 - DNA, 21 bp, Homo sapiens
tgtgttattattttttaataa

SEQ ID NO: 6511809 - DNA, 14 bp, Homo sapiens
tgtgttattcgtga

SEQ ID NO: 6511810 - DNA, 22 bp, Homo sapiens
tgtgttattcgtgaatagtctt

SEQ ID NO: 6511811 - DNA, 13 bp, Homo sapiens
tgtgttatttaaa

SEQ ID NO: 6511812 - DNA, 14 bp, Homo sapiens
tgtgttatttaaat

SEQ ID NO: 6511813 - DNA, 16 bp, Homo sapiens
tgtgttatttaaatga

SEQ ID NO: 6511814 - DNA, 19 bp, Homo sapiens
tgtgttcaatatttagaaa

SEQ ID NO: 6511815 - DNA, 17 bp, Homo sapiens
tgtgttcacagacctca

SEQ ID NO: 6511816 - DNA, 20 bp, Homo sapiens
tgtgttcactaaactctgaa

SEQ ID NO: 6511817 - DNA, 13 bp, Homo sapiens
tgtgttcagttcc

SEQ ID NO: 6511818 - DNA, 18 bp, Homo sapiens
tgtgttcatgctgaatcc

SEQ ID NO: 6511819 - DNA, 14 bp, Homo sapiens
tgtgttcattcaag

SEQ ID NO: 6511820 - DNA, 16 bp, Homo sapiens
tgtgttcattcaagct

SEQ ID NO: 6511821 - DNA, 18 bp, Homo sapiens
tgtgttcattcaagctat

SEQ ID NO: 6511822 - DNA, 14 bp, Homo sapiens
tgtgttcatttcat

SEQ ID NO: 6511823 - DNA, 20 bp, Homo sapiens
tgtgttcatttggtgttcct

SEQ ID NO: 6511824 - DNA, 22 bp, Homo sapiens
tgtgttccaaatttgctttaca

SEQ ID NO: 6511825 - DNA, 15 bp, Homo sapiens
tgtgttccaaccact

SEQ ID NO: 6511826 - DNA, 18 bp, Homo sapiens
tgtgttccaagtttccaa

SEQ ID NO: 6511827 - DNA, 19 bp, Homo sapiens
tgtgttccaagtttccaaa

SEQ ID NO: 6511828 - DNA, 18 bp, Homo sapiens
tgtgttccagccattctg

SEQ ID NO: 6511829 - DNA, 14 bp, Homo sapiens
tgtgttcccagagg

SEQ ID NO: 6511830 - DNA, 16 bp, Homo sapiens
tgtgttcccagaggca

SEQ ID NO: 6511831 - DNA, 19 bp, Homo sapiens
tgtgttcctccattttctt

SEQ ID NO: 6511832 - DNA, 14 bp, Homo sapiens
tgtgttcctcctgc

SEQ ID NO: 6511833 - DNA, 16 bp, Homo sapiens
tgtgttcctcctgctg

SEQ ID NO: 6511834 - DNA, 14 bp, Homo sapiens
tgtgttcctgcttt

SEQ ID NO: 6511835 - DNA, 12 bp, Homo sapiens
tgtgttcctggc

SEQ ID NO: 6511836 - DNA, 18 bp, Homo sapiens
tgtgttcctggcccactc

SEQ ID NO: 6511837 - DNA, 22 bp, Homo sapiens
tgtgttcctggcccactctgta

SEQ ID NO: 6511838 - DNA, 19 bp, Homo sapiens
tgtgttcctggctgatgat

SEQ ID NO: 6511839 - DNA, 16 bp, Homo sapiens
tgtgttctaacttatt

SEQ ID NO: 6511840 - DNA, 20 bp, Homo sapiens
tgtgttctatccaaacatgt

SEQ ID NO: 6511841 - DNA, 15 bp, Homo sapiens
tgtgttctcaacaca

SEQ ID NO: 6511842 - DNA, 18 bp, Homo sapiens
tgtgttctcaacacacag

SEQ ID NO: 6511843 - DNA, 19 bp, Homo sapiens
tgtgttctcaacacacagt

SEQ ID NO: 6511844 - DNA, 20 bp, Homo sapiens
tgtgttctcaacacacagta

SEQ ID NO: 6511845 - DNA, 18 bp, Homo sapiens
tgtgttctcacagtgaca

SEQ ID NO: 6511846 - DNA, 17 bp, Homo sapiens
tgtgttctgattagaaa

SEQ ID NO: 6511847 - DNA, 12 bp, Homo sapiens
tgtgttctgcaa

SEQ ID NO: 6511848 - DNA, 18 bp, Homo sapiens
tgtgttctgggctggggc

SEQ ID NO: 6511849 - DNA, 14 bp, Homo sapiens
tgtgttctgtagac

SEQ ID NO: 6511850 - DNA, 23 bp, Homo sapiens
tgctaaataaaatttgttgcata

SEQ ID NO: 6511851 - DNA, 24 bp, Homo sapiens
tgctaaataaacatgtgccctcag

SEQ ID NO: 6511852 - DNA, 18 bp, Homo sapiens
tgctaaatactgtacata

SEQ ID NO: 6511853 - DNA, 21 bp, Homo sapiens
tgctaaatactgtacatagat

SEQ ID NO: 6511854 - DNA, 12 bp, Homo sapiens
tgctaaatagtt

SEQ ID NO: 6511855 - DNA, 15 bp, Homo sapiens
tgctaaatcctagca

SEQ ID NO: 6511856 - DNA, 17 bp, Homo sapiens
tgctaaatctcctattt

SEQ ID NO: 6511857 - DNA, 20 bp, Homo sapiens
tgctaaatggtcgcccagga

SEQ ID NO: 6511858 - DNA, 18 bp, Homo sapiens
tgctaaatgtaacagtct

SEQ ID NO: 6511859 - DNA, 19 bp, Homo sapiens
tgctaaatgtaacagtctg

SEQ ID NO: 6511860 - DNA, 15 bp, Homo sapiens
tgctaaatgtgaatg

SEQ ID NO: 6511861 - DNA, 13 bp, Homo sapiens
tgctaaatgtgta

SEQ ID NO: 6511862 - DNA, 15 bp, Homo sapiens
tgctaaatgtgtaat

SEQ ID NO: 6511863 - DNA, 22 bp, Homo sapiens
tgctaaattgattgaattaaat

SEQ ID NO: 6511864 - DNA, 15 bp, Homo sapiens
tgctaaatttacgta

SEQ ID NO: 6511865 - DNA, 21 bp, Homo sapiens
tgctaaattttcagtagggct

SEQ ID NO: 6511866 - DNA, 21 bp, Homo sapiens
tgctaacagcaacacaaagct

SEQ ID NO: 6511867 - DNA, 23 bp, Homo sapiens
tgctaacagcaacacaaagcttt

SEQ ID NO: 6511868 - DNA, 22 bp, Homo sapiens
tgctaaccccgtctgctcctcc

SEQ ID NO: 6511869 - DNA, 16 bp, Homo sapiens
tgctaacctcaattta

SEQ ID NO: 6511870 - DNA, 14 bp, Homo sapiens
tgctaacctcactg

SEQ ID NO: 6511871 - DNA, 16 bp, Homo sapiens
tgctaacctcactgcc

SEQ ID NO: 6511872 - DNA, 14 bp, Homo sapiens
tgctaacctggaaa

SEQ ID NO: 6511873 - DNA, 12 bp, Homo sapiens
tgctaactgaac

SEQ ID NO: 6511874 - DNA, 15 bp, Homo sapiens
tgctaactgaacttt

SEQ ID NO: 6511875 - DNA, 15 bp, Homo sapiens
tgctaactgggttaa

SEQ ID NO: 6511876 - DNA, 12 bp, Homo sapiens
tgctaactggtt

SEQ ID NO: 6511877 - DNA, 13 bp, Homo sapiens
tgctaactggtta

SEQ ID NO: 6511878 - DNA, 16 bp, Homo sapiens
tgctaactggttaaac

SEQ ID NO: 6511879 - DNA, 16 bp, Homo sapiens
tgctaactgtatgtgt

SEQ ID NO: 6511880 - DNA, 19 bp, Homo sapiens
tgctaactgtatgtgtctt

SEQ ID NO: 6511881 - DNA, 17 bp, Homo sapiens
tgctaacttggagcccc

SEQ ID NO: 6511882 - DNA, 13 bp, Homo sapiens
tgctaactttgcc

SEQ ID NO: 6511883 - DNA, 12 bp, Homo sapiens
tgctaagaaatg

SEQ ID NO: 6511884 - DNA, 19 bp, Homo sapiens
tgctaagaagcctataaga

SEQ ID NO: 6511885 - DNA, 13 bp, Homo sapiens
tgctaagagaagt

SEQ ID NO: 6511886 - DNA, 16 bp, Homo sapiens
tgctaagagcctctgg

SEQ ID NO: 6511887 - DNA, 20 bp, Homo sapiens
tgctaagcaagctaacctta

SEQ ID NO: 6511888 - DNA, 14 bp, Homo sapiens
tgctaagcatattt

SEQ ID NO: 6511889 - DNA, 18 bp, Homo sapiens
tgctaagctaaagaaact

SEQ ID NO: 6511890 - DNA, 19 bp, Homo sapiens
tgctaagctaaagaaactg

SEQ ID NO: 6511891 - DNA, 22 bp, Homo sapiens
tgctaagctaaagaaactgctt

SEQ ID NO: 6511892 - DNA, 12 bp, Homo sapiens
tgctaaggaaca

SEQ ID NO: 6511893 - DNA, 17 bp, Homo sapiens
tgctaaggaacaatgcc

SEQ ID NO: 6511894 - DNA, 23 bp, Homo sapiens
tgctaaggaacaatgccgcctgt

SEQ ID NO: 6511895 - DNA, 18 bp, Homo sapiens
tgctaaggacttgttaga

SEQ ID NO: 6511896 - DNA, 12 bp, Homo sapiens
tgctaaggcagc

SEQ ID NO: 6511897 - DNA, 13 bp, Homo sapiens
tgctaaggcagct

SEQ ID NO: 6511898 - DNA, 19 bp, Homo sapiens
tgctaaggctgctggcttc

SEQ ID NO: 6511899 - DNA, 15 bp, Homo sapiens
tgctaaggtcttgga

SEQ ID NO: 6511900 - DNA, 23 bp, Homo sapiens
tgctaaggtcttggaacttgcct

SEQ ID NO: 6511901 - DNA, 16 bp, Homo sapiens
tgctaaggttctaagg

SEQ ID NO: 6511902 - DNA, 17 bp, Homo sapiens
tgctaaggttctaaggc

SEQ ID NO: 6511903 - DNA, 16 bp, Homo sapiens
tgctaagtaatttaga

SEQ ID NO: 6511904 - DNA, 17 bp, Homo sapiens
tgctaagtaatttagaa

SEQ ID NO: 6511905 - DNA, 22 bp, Homo sapiens
tgctaagtaatttagaagatat

SEQ ID NO: 6511906 - DNA, 19 bp, Homo sapiens
tgctaagtcattggcaaag

SEQ ID NO: 6511907 - DNA, 17 bp, Homo sapiens
tgctaagtgtgaactgg

SEQ ID NO: 6511908 - DNA, 22 bp, Homo sapiens
tgctaataaacactggctctgg

SEQ ID NO: 6511909 - DNA, 13 bp, Homo sapiens
tgctaataaactg

SEQ ID NO: 6511910 - DNA, 14 bp, Homo sapiens
tgctaataaactgt

SEQ ID NO: 6511911 - DNA, 21 bp, Homo sapiens
tgctaataaagttaaattgca

SEQ ID NO: 6511912 - DNA, 22 bp, Homo sapiens
tgctaataaatgaccagtttac

SEQ ID NO: 6511913 - DNA, 22 bp, Homo sapiens
tgctaataatttgccattatct

SEQ ID NO: 6511914 - DNA, 17 bp, Homo sapiens
tgctaatacatttggct

SEQ ID NO: 6511915 - DNA, 15 bp, Homo sapiens
tgctaataccaaaat

SEQ ID NO: 6511916 - DNA, 22 bp, Homo sapiens
tgctaataccaactatttcaat

SEQ ID NO: 6511917 - DNA, 21 bp, Homo sapiens
tgctaatattttatttgaaaa

SEQ ID NO: 6511918 - DNA, 18 bp, Homo sapiens
tgctaatattttcctcct

SEQ ID NO: 6511919 - DNA, 14 bp, Homo sapiens
tgctaatattttta

SEQ ID NO: 6511920 - DNA, 15 bp, Homo sapiens
tgctaatcaaaactt

SEQ ID NO: 6511921 - DNA, 17 bp, Homo sapiens
tgctaatcaaagccagg

SEQ ID NO: 6511922 - DNA, 22 bp, Homo sapiens
tgctaatcagggaggtcatttt

SEQ ID NO: 6511923 - DNA, 23 bp, Homo sapiens
tgctaatcatgtgggtgagccag

SEQ ID NO: 6511924 - DNA, 20 bp, Homo sapiens
tgctaatcttcttatgcaat

SEQ ID NO: 6511925 - DNA, 13 bp, Homo sapiens
tgctaatcttgtc

SEQ ID NO: 6511926 - DNA, 18 bp, Homo sapiens
tgctaatcttgtgaaaat

SEQ ID NO: 6511927 - DNA, 16 bp, Homo sapiens
tgctaatgacagcctt

SEQ ID NO: 6511928 - DNA, 15 bp, Homo sapiens
tgctaatgcaaatta

SEQ ID NO: 6511929 - DNA, 18 bp, Homo sapiens
tgctaatgcaaattaaaa

SEQ ID NO: 6511930 - DNA, 21 bp, Homo sapiens
tgctaatgtaatcatttatct

SEQ ID NO: 6511931 - DNA, 16 bp, Homo sapiens
tgctaatgtcaaacca

SEQ ID NO: 6511932 - DNA, 21 bp, Homo sapiens
tgctaatgtcaaacttgagtc

SEQ ID NO: 6511933 - DNA, 22 bp, Homo sapiens
tgctaatgttgatcagcaaatt

SEQ ID NO: 6511934 - DNA, 11 bp, Homo sapiens
tgctaattaat

SEQ ID NO: 6511935 - DNA, 18 bp, Homo sapiens
tgctaattcccaacattt

SEQ ID NO: 6511936 - DNA, 12 bp, Homo sapiens
tgctaattcttt

SEQ ID NO: 6511937 - DNA, 15 bp, Homo sapiens
tgctaattctttgca

SEQ ID NO: 6511938 - DNA, 16 bp, Homo sapiens
tgctaattctttgcaa

SEQ ID NO: 6511939 - DNA, 20 bp, Homo sapiens
tgctaattctttgcaaaaat

SEQ ID NO: 6511940 - DNA, 15 bp, Homo sapiens
tgctaattgctgttg

SEQ ID NO: 6511941 - DNA, 17 bp, Homo sapiens
tgctaattgctgttgaa

SEQ ID NO: 6511942 - DNA, 22 bp, Homo sapiens
tgctaattgctgttgaaagcaa

SEQ ID NO: 6511943 - DNA, 23 bp, Homo sapiens
tgctaattgctgttgaaagcaaa

SEQ ID NO: 6511944 - DNA, 18 bp, Homo sapiens
tgctaatttatcctgaaa

SEQ ID NO: 6511945 - DNA, 23 bp, Homo sapiens
tgctaatttctgtccagaaaata

SEQ ID NO: 6511946 - DNA, 18 bp, Homo sapiens
tgctaattttgaaaaact

SEQ ID NO: 6511947 - DNA, 23 bp, Homo sapiens
tgctaatttttggagaaatgtca

SEQ ID NO: 6511948 - DNA, 15 bp, Homo sapiens
tgctacaaaaacaca

SEQ ID NO: 6511949 - DNA, 17 bp, Homo sapiens
tgctacaaaaacacagc

SEQ ID NO: 6511950 - DNA, 19 bp, Homo sapiens
tgctacaaaaacacagcaa

SEQ ID NO: 6511951 - DNA, 16 bp, Homo sapiens
tgctacaaaatgtgtg

SEQ ID NO: 6511952 - DNA, 12 bp, Homo sapiens
tgctacaaagaa

SEQ ID NO: 6511953 - DNA, 17 bp, Homo sapiens
tgctacaaagaagacat

SEQ ID NO: 6511954 - DNA, 18 bp, Homo sapiens
tgctacaaagaagacatg

SEQ ID NO: 6511955 - DNA, 21 bp, Homo sapiens
tgctacaaagaagacatgttt

SEQ ID NO: 6511956 - DNA, 14 bp, Homo sapiens
tgctacaaatttat

SEQ ID NO: 6511957 - DNA, 20 bp, Homo sapiens
tgctacaaatttatgcattt

SEQ ID NO: 6511958 - DNA, 22 bp, Homo sapiens
tgctacaaatttatgcatttca

SEQ ID NO: 6511959 - DNA, 23 bp, Homo sapiens
tgctacaaatttatgcatttcat

SEQ ID NO: 6511960 - DNA, 15 bp, Homo sapiens
tgctacaatggaaac

SEQ ID NO: 6511961 - DNA, 14 bp, Homo sapiens
tgctacacaggcag

SEQ ID NO: 6511962 - DNA, 15 bp, Homo sapiens
tgctacacaggcagg

SEQ ID NO: 6511963 - DNA, 22 bp, Homo sapiens
tgctacacttacaagtaatgaa

SEQ ID NO: 6511964 - DNA, 23 bp, Homo sapiens
tgctacacttacaagtaatgaat

SEQ ID NO: 6511965 - DNA, 16 bp, Homo sapiens
tgctacagaaagcaca

SEQ ID NO: 6511966 - DNA, 20 bp, Homo sapiens
tgctacagagagtgaataca

SEQ ID NO: 6511967 - DNA, 19 bp, Homo sapiens
tgctacagaggaaacaata

SEQ ID NO: 6511968 - DNA, 18 bp, Homo sapiens
tgctacagggtccaacat

SEQ ID NO: 6511969 - DNA, 20 bp, Homo sapiens
tgctacagtactatgtaaat

SEQ ID NO: 6511970 - DNA, 19 bp, Homo sapiens
tgctacagtagctgtgggg

SEQ ID NO: 6511971 - DNA, 13 bp, Homo sapiens
tgctacagtattt

SEQ ID NO: 6511972 - DNA, 16 bp, Homo sapiens
tgctacagttagtctt

SEQ ID NO: 6511973 - DNA, 15 bp, Homo sapiens
tgctacatcagactc

SEQ ID NO: 6511974 - DNA, 16 bp, Homo sapiens
tgctacatcagactct

SEQ ID NO: 6511975 - DNA, 19 bp, Homo sapiens
tgctacatcagactctaga

SEQ ID NO: 6511976 - DNA, 16 bp, Homo sapiens
tgctacatcagagtgt

SEQ ID NO: 6511977 - DNA, 19 bp, Homo sapiens
tgctaccaaggcccagcta

SEQ ID NO: 6511978 - DNA, 21 bp, Homo sapiens
tgctaccaatctgtgagaagt

SEQ ID NO: 6511979 - DNA, 21 bp, Homo sapiens
tgctaccacagacttgcactg

SEQ ID NO: 6511980 - DNA, 20 bp, Homo sapiens
tgctaccaccagctgtgtcc

SEQ ID NO: 6511981 - DNA, 18 bp, Homo sapiens
tgctaccacggcctcctt

SEQ ID NO: 6511982 - DNA, 22 bp, Homo sapiens
tgctaccagcgccaaatgttca

SEQ ID NO: 6511983 - DNA, 22 bp, Homo sapiens
tgctaccagtatttagaagcca

SEQ ID NO: 6511984 - DNA, 19 bp, Homo sapiens
tgctacccagaaccttttt

SEQ ID NO: 6511985 - DNA, 16 bp, Homo sapiens
tgctaccgccctgggc

SEQ ID NO: 6511986 - DNA, 20 bp, Homo sapiens
tgctaccgccctgggctgga

SEQ ID NO: 6511987 - DNA, 23 bp, Homo sapiens
tgctaccgccctgggctggactg

SEQ ID NO: 6511988 - DNA, 15 bp, Homo sapiens
tgctaccgttgactt

SEQ ID NO: 6511989 - DNA, 15 bp, Homo sapiens
tgctacctcactggg

SEQ ID NO: 6511990 - DNA, 22 bp, Homo sapiens
tgctacctcactggggtcctgg

SEQ ID NO: 6511991 - DNA, 13 bp, Homo sapiens
tgctacctcagtc

SEQ ID NO: 6511992 - DNA, 16 bp, Homo sapiens
tgctacctcagtgctc

SEQ ID NO: 6511993 - DNA, 18 bp, Homo sapiens
tgctacctcagtgctcct

SEQ ID NO: 6511994 - DNA, 20 bp, Homo sapiens
tgctacctcagtgctcctgg

SEQ ID NO: 6511995 - DNA, 15 bp, Homo sapiens
tgctacctcccttgc

SEQ ID NO: 6511996 - DNA, 18 bp, Homo sapiens
tgctacctcccttgcctt

SEQ ID NO: 6511997 - DNA, 16 bp, Homo sapiens
tgctacctctgagaag

SEQ ID NO: 6511998 - DNA, 18 bp, Homo sapiens
tgctacctctgagaagac

SEQ ID NO: 6511999 - DNA, 20 bp, Homo sapiens
tgctacctctgagaagacac

SEQ ID NO: 6512000 - DNA, 19 bp, Homo sapiens
tgctacctgatcccactcc

SEQ ID NO: 6512001 - DNA, 19 bp, Homo sapiens
tgctacctgggtccttttc

SEQ ID NO: 6512002 - DNA, 23 bp, Homo sapiens
tgctacctgggtccttttcagaa

SEQ ID NO: 6512003 - DNA, 15 bp, Homo sapiens
tgctaccttctttgg

SEQ ID NO: 6512004 - DNA, 19 bp, Homo sapiens
tgctacggtagtgatgaaa

SEQ ID NO: 6512005 - DNA, 20 bp, Homo sapiens
tgctacggtagtgatgaaat

SEQ ID NO: 6512006 - DNA, 21 bp, Homo sapiens
tgctacggtagtgatgaaatt

SEQ ID NO: 6512007 - DNA, 19 bp, Homo sapiens
tgctacgtacatgtgaggc

SEQ ID NO: 6512008 - DNA, 16 bp, Homo sapiens
tgctacgtgtgaaatc

SEQ ID NO: 6512009 - DNA, 18 bp, Homo sapiens
tgctacgtgtgaaatctg

SEQ ID NO: 6512010 - DNA, 21 bp, Homo sapiens
tgctacgtgtgaaatctgtct

SEQ ID NO: 6512011 - DNA, 16 bp, Homo sapiens
tgctacgtgtgatttt

SEQ ID NO: 6512012 - DNA, 16 bp, Homo sapiens
tgctactaacagatta

SEQ ID NO: 6512013 - DNA, 18 bp, Homo sapiens
tgctactaagttcacatt

SEQ ID NO: 6512014 - DNA, 15 bp, Homo sapiens
tgctactactgcagt

SEQ ID NO: 6512015 - DNA, 17 bp, Homo sapiens
tgctactactgcagtct

SEQ ID NO: 6512016 - DNA, 14 bp, Homo sapiens
tgctactataatca

SEQ ID NO: 6512017 - DNA, 14 bp, Homo sapiens
tgctactccatgca

SEQ ID NO: 6512018 - DNA, 12 bp, Homo sapiens
tgctactcctgt

SEQ ID NO: 6512019 - DNA, 17 bp, Homo sapiens
tgctactcctgtgctct

SEQ ID NO: 6512020 - DNA, 15 bp, Homo sapiens
tgctactctgttcct

SEQ ID NO: 6512021 - DNA, 13 bp, Homo sapiens
tgctactgaaact

SEQ ID NO: 6512022 - DNA, 12 bp, Homo sapiens
tgctactgatgc

SEQ ID NO: 6512023 - DNA, 20 bp, Homo sapiens
tgctactgattgtttcattg

SEQ ID NO: 6512024 - DNA, 15 bp, Homo sapiens
tgctactgcactcca

SEQ ID NO: 6512025 - DNA, 18 bp, Homo sapiens
tgctactgcactccagcc

SEQ ID NO: 6512026 - DNA, 16 bp, Homo sapiens
tgctactgctcagctt

SEQ ID NO: 6512027 - DNA, 17 bp, Homo sapiens
tgctactgctcagcttc

SEQ ID NO: 6512028 - DNA, 15 bp, Homo sapiens
tgtgttctgtagact

SEQ ID NO: 6512029 - DNA, 21 bp, Homo sapiens
tgtgttctgtttgttaaaact

SEQ ID NO: 6512030 - DNA, 12 bp, Homo sapiens
tgtgttcttact

SEQ ID NO: 6512031 - DNA, 15 bp, Homo sapiens
tgtgttctttataac

SEQ ID NO: 6512032 - DNA, 14 bp, Homo sapiens
tgtgttcttttctc

SEQ ID NO: 6512033 - DNA, 17 bp, Homo sapiens
tgtgttcttttgataca

SEQ ID NO: 6512034 - DNA, 18 bp, Homo sapiens
tgtgttcttttgatacat

SEQ ID NO: 6512035 - DNA, 23 bp, Homo sapiens
tgtgttgaaatatagttgaaagt

SEQ ID NO: 6512036 - DNA, 12 bp, Homo sapiens
tgtgttgacact

SEQ ID NO: 6512037 - DNA, 23 bp, Homo sapiens
tgtgttgactgctgctccccacc

SEQ ID NO: 6512038 - DNA, 18 bp, Homo sapiens
tgtgttgatactgttgca

SEQ ID NO: 6512039 - DNA, 21 bp, Homo sapiens
tgtgttgatactgttgcacgt

SEQ ID NO: 6512040 - DNA, 23 bp, Homo sapiens
tgtgttgcaaatcactctgcaat

SEQ ID NO: 6512041 - DNA, 21 bp, Homo sapiens
tgtgttgcaaattattctagt

SEQ ID NO: 6512042 - DNA, 16 bp, Homo sapiens
tgtgttgcataaacaa

SEQ ID NO: 6512043 - DNA, 23 bp, Homo sapiens
tgtgttgcataaacaatccaaat

SEQ ID NO: 6512044 - DNA, 13 bp, Homo sapiens
tgtgttgccaagc

SEQ ID NO: 6512045 - DNA, 18 bp, Homo sapiens
tgtgttgccacaggacac

SEQ ID NO: 6512046 - DNA, 19 bp, Homo sapiens
tgtgttgccattttgtctg

SEQ ID NO: 6512047 - DNA, 24 bp, Homo sapiens
tgtgttgccattttgtctggctgt

SEQ ID NO: 6512048 - DNA, 14 bp, Homo sapiens
tgtgttgcccaggc

SEQ ID NO: 6512049 - DNA, 17 bp, Homo sapiens
tgtgttgcctgctgagc

SEQ ID NO: 6512050 - DNA, 23 bp, Homo sapiens
tgtgttgctaaaaaaagtgcatg

SEQ ID NO: 6512051 - DNA, 18 bp, Homo sapiens
tgtgttgctgtttagagt

SEQ ID NO: 6512052 - DNA, 15 bp, Homo sapiens
tgtgttgcttatgtt

SEQ ID NO: 6512053 - DNA, 15 bp, Homo sapiens
tgtgttgcttctcta

SEQ ID NO: 6512054 - DNA, 17 bp, Homo sapiens
tgtgttggccaggctgg

SEQ ID NO: 6512055 - DNA, 12 bp, Homo sapiens
tgtgttggcttg

SEQ ID NO: 6512056 - DNA, 22 bp, Homo sapiens
tgtgttggctttacaaataatt

SEQ ID NO: 6512057 - DNA, 22 bp, Homo sapiens
tgtgttgggattgagtctgtgc

SEQ ID NO: 6512058 - DNA, 22 bp, Homo sapiens
tgtgttggtatttactgcaatg

SEQ ID NO: 6512059 - DNA, 18 bp, Homo sapiens
tgtgttgtcccatctgcc

SEQ ID NO: 6512060 - DNA, 13 bp, Homo sapiens
tgtgttgtctgtg

SEQ ID NO: 6512061 - DNA, 18 bp, Homo sapiens
tgtgttgtcttgaaagat

SEQ ID NO: 6512062 - DNA, 13 bp, Homo sapiens
tgtgttgtgaatg

SEQ ID NO: 6512063 - DNA, 17 bp, Homo sapiens
tgtgttgtgtcctgaca

SEQ ID NO: 6512064 - DNA, 12 bp, Homo sapiens
tgtgttgtgtga

SEQ ID NO: 6512065 - DNA, 15 bp, Homo sapiens
tgtgttgtgtgagcg

SEQ ID NO: 6512066 - DNA, 12 bp, Homo sapiens
tgtgttgtgtta

SEQ ID NO: 6512067 - DNA, 21 bp, Homo sapiens
tgtgttgttgttgctgctgtt

SEQ ID NO: 6512068 - DNA, 13 bp, Homo sapiens
tgtgttgtttaat

SEQ ID NO: 6512069 - DNA, 13 bp, Homo sapiens
tgtgttgtttcca

SEQ ID NO: 6512070 - DNA, 15 bp, Homo sapiens
tgtgttgttttctct

SEQ ID NO: 6512071 - DNA, 19 bp, Homo sapiens
tgtgttgttttttgttcaa

SEQ ID NO: 6512072 - DNA, 20 bp, Homo sapiens
tgtgttgttttttgttcaat

SEQ ID NO: 6512073 - DNA, 18 bp, Homo sapiens
tgtgtttaaagtgaattt

SEQ ID NO: 6512074 - DNA, 13 bp, Homo sapiens
tgtgtttaaataa

SEQ ID NO: 6512075 - DNA, 15 bp, Homo sapiens
tgtgtttaaataaag

SEQ ID NO: 6512076 - DNA, 22 bp, Homo sapiens
tgtgtttaaataaagtatcatg

SEQ ID NO: 6512077 - DNA, 13 bp, Homo sapiens
tgtgtttacagac

SEQ ID NO: 6512078 - DNA, 21 bp, Homo sapiens
tgtgtttacatttactgaaat

SEQ ID NO: 6512079 - DNA, 16 bp, Homo sapiens
tgtgtttagaagccta

SEQ ID NO: 6512080 - DNA, 13 bp, Homo sapiens
tgtgtttagattt

SEQ ID NO: 6512081 - DNA, 15 bp, Homo sapiens
tgtgtttagctattt

SEQ ID NO: 6512082 - DNA, 19 bp, Homo sapiens
tgtgtttagctatttaata

SEQ ID NO: 6512083 - DNA, 16 bp, Homo sapiens
tgtgtttataattgtt

SEQ ID NO: 6512084 - DNA, 17 bp, Homo sapiens
tgtgtttataattgtta

SEQ ID NO: 6512085 - DNA, 13 bp, Homo sapiens
tgtgtttatgtgt

SEQ ID NO: 6512086 - DNA, 12 bp, Homo sapiens
tgtgtttattct

SEQ ID NO: 6512087 - DNA, 14 bp, Homo sapiens
tgtgtttattcttg

SEQ ID NO: 6512088 - DNA, 22 bp, Homo sapiens
tgtgtttattcttgatgaaaag

SEQ ID NO: 6512089 - DNA, 23 bp, Homo sapiens
tgtgtttattcttgatgaaaagc

SEQ ID NO: 6512090 - DNA, 16 bp, Homo sapiens
tgtgtttattgtcaaa

SEQ ID NO: 6512091 - DNA, 15 bp, Homo sapiens
tgtgtttcaaatgga

SEQ ID NO: 6512092 - DNA, 15 bp, Homo sapiens
tgtgtttcaagttca

SEQ ID NO: 6512093 - DNA, 16 bp, Homo sapiens
tgtgtttcatgttctg

SEQ ID NO: 6512094 - DNA, 20 bp, Homo sapiens
tgtgtttcattacttgaatg

SEQ ID NO: 6512095 - DNA, 12 bp, Homo sapiens
tgtgtttccaca

SEQ ID NO: 6512096 - DNA, 21 bp, Homo sapiens
tgtgtttccagatcgatcctg

SEQ ID NO: 6512097 - DNA, 23 bp, Homo sapiens
tgtgtttccatcctttgcatttc

SEQ ID NO: 6512098 - DNA, 20 bp, Homo sapiens
tgtgtttccttttcaggaga

SEQ ID NO: 6512099 - DNA, 10 bp, Homo sapiens
tgtgtttcta

SEQ ID NO: 6512100 - DNA, 12 bp, Homo sapiens
tgtgtttctgta

SEQ ID NO: 6512101 - DNA, 20 bp, Homo sapiens
tgtgtttctgtgctccaagt

SEQ ID NO: 6512102 - DNA, 21 bp, Homo sapiens
tgtgtttcttgggcagtcttt

SEQ ID NO: 6512103 - DNA, 17 bp, Homo sapiens
tgtgtttgaaagtgaaa

SEQ ID NO: 6512104 - DNA, 22 bp, Homo sapiens
tgtgtttgatatttgtgtaaag

SEQ ID NO: 6512105 - DNA, 10 bp, Homo sapiens
tgtgtttgcc

SEQ ID NO: 6512106 - DNA, 21 bp, Homo sapiens
tgtgtttgccttgggcctttc

SEQ ID NO: 6512107 - DNA, 15 bp, Homo sapiens
tgtgtttgcttaaac

SEQ ID NO: 6512108 - DNA, 21 bp, Homo sapiens
tgtgtttgcttaaacaaagtg

SEQ ID NO: 6512109 - DNA, 20 bp, Homo sapiens
tgtgtttggatcaaaaagaa

SEQ ID NO: 6512110 - DNA, 17 bp, Homo sapiens
tgtgtttggctttcagg

SEQ ID NO: 6512111 - DNA, 15 bp, Homo sapiens
tgtgtttggttcaat

SEQ ID NO: 6512112 - DNA, 16 bp, Homo sapiens
tgtgtttggtttacat

SEQ ID NO: 6512113 - DNA, 22 bp, Homo sapiens
tgtgtttgtatataaatggtga

SEQ ID NO: 6512114 - DNA, 14 bp, Homo sapiens
tgtgtttgtcatta

SEQ ID NO: 6512115 - DNA, 23 bp, Homo sapiens
tgtgtttgtttttcaagaaatga

SEQ ID NO: 6512116 - DNA, 20 bp, Homo sapiens
tgtgttttaaaaaaactgaa

SEQ ID NO: 6512117 - DNA, 22 bp, Homo sapiens
tgtgttttaaaaaaactgaagg

SEQ ID NO: 6512118 - DNA, 14 bp, Homo sapiens
tgtgttttacagta

SEQ ID NO: 6512119 - DNA, 20 bp, Homo sapiens
tgtgttttagagtaagaaat

SEQ ID NO: 6512120 - DNA, 18 bp, Homo sapiens
tgtgttttcaggttttgt

SEQ ID NO: 6512121 - DNA, 17 bp, Homo sapiens
tgtgttttcataataaa

SEQ ID NO: 6512122 - DNA, 14 bp, Homo sapiens
tgtgttttcatcat

SEQ ID NO: 6512123 - DNA, 17 bp, Homo sapiens
tgtgttttcatcatttc

SEQ ID NO: 6512124 - DNA, 17 bp, Homo sapiens
tgtgttttcatgttgaa

SEQ ID NO: 6512125 - DNA, 19 bp, Homo sapiens
tgtgttttcccaaagcact

SEQ ID NO: 6512126 - DNA, 14 bp, Homo sapiens
tgtgttttctccta

SEQ ID NO: 6512127 - DNA, 13 bp, Homo sapiens
tgtgttttctgta

SEQ ID NO: 6512128 - DNA, 20 bp, Homo sapiens
tgtgttttcttgtaaatgtt

SEQ ID NO: 6512129 - DNA, 19 bp, Homo sapiens
tgtgttttgcaagccagat

SEQ ID NO: 6512130 - DNA, 18 bp, Homo sapiens
tgtgttttgtcctgcctc

SEQ ID NO: 6512131 - DNA, 15 bp, Homo sapiens
tgtgttttgtctttt

SEQ ID NO: 6512132 - DNA, 16 bp, Homo sapiens
tgtgtttttaaatttt

SEQ ID NO: 6512133 - DNA, 13 bp, Homo sapiens
tgtgtttttctca

SEQ ID NO: 6512134 - DNA, 18 bp, Homo sapiens
tgtgtttttctccagtgc

SEQ ID NO: 6512135 - DNA, 20 bp, Homo sapiens
tgtgtttttctccagtgctg

SEQ ID NO: 6512136 - DNA, 14 bp, Homo sapiens
tgtgtttttctttt

SEQ ID NO: 6512137 - DNA, 16 bp, Homo sapiens
tgtgtttttgcactgt

SEQ ID NO: 6512138 - DNA, 15 bp, Homo sapiens
tgtgttttttaagat

SEQ ID NO: 6512139 - DNA, 16 bp, Homo sapiens
tgtgttttttttcctt

SEQ ID NO: 6512140 - DNA, 18 bp, Homo sapiens
tgtgttttttttcctttg

SEQ ID NO: 6512141 - DNA, 19 bp, Homo sapiens
tgtgttttttttcctttgc

SEQ ID NO: 6512142 - DNA, 22 bp, Homo sapiens
tgtgtttttttttcgtttgttt

SEQ ID NO: 6512143 - DNA, 23 bp, Homo sapiens
tgttaaaaaaaaaatccatttta

SEQ ID NO: 6512144 - DNA, 19 bp, Homo sapiens
tgttaaaaaaataagaaga

SEQ ID NO: 6512145 - DNA, 20 bp, Homo sapiens
tgttaaaaaaataagaagaa

SEQ ID NO: 6512146 - DNA, 14 bp, Homo sapiens
tgttaaaaaacaac

SEQ ID NO: 6512147 - DNA, 18 bp, Homo sapiens
tgttaaaaagaaatccag

SEQ ID NO: 6512148 - DNA, 21 bp, Homo sapiens
tgttaaaaatattttctgaat

SEQ ID NO: 6512149 - DNA, 14 bp, Homo sapiens
tgttaaaaatgtca

SEQ ID NO: 6512150 - DNA, 21 bp, Homo sapiens
tgttaaaacacaaaatgaata

SEQ ID NO: 6512151 - DNA, 17 bp, Homo sapiens
tgttaaaacatcaaaat

SEQ ID NO: 6512152 - DNA, 18 bp, Homo sapiens
tgttaaaacatcaaaatg

SEQ ID NO: 6512153 - DNA, 16 bp, Homo sapiens
tgttaaaactgtacct

SEQ ID NO: 6512154 - DNA, 17 bp, Homo sapiens
tgttaaaactgtacctt

SEQ ID NO: 6512155 - DNA, 19 bp, Homo sapiens
tgttaaaactgtacctttt

SEQ ID NO: 6512156 - DNA, 14 bp, Homo sapiens
tgttaaaagaaaat

SEQ ID NO: 6512157 - DNA, 21 bp, Homo sapiens
tgttaaaagatgaaaatattt

SEQ ID NO: 6512158 - DNA, 20 bp, Homo sapiens
tgttaaaagttttatatgct

SEQ ID NO: 6512159 - DNA, 13 bp, Homo sapiens
tgttaaaataaat

SEQ ID NO: 6512160 - DNA, 14 bp, Homo sapiens
tgttaaaataacta

SEQ ID NO: 6512161 - DNA, 13 bp, Homo sapiens
tgttaaaatacat

SEQ ID NO: 6512162 - DNA, 16 bp, Homo sapiens
tgttaaaatacataac

SEQ ID NO: 6512163 - DNA, 23 bp, Homo sapiens
tgttaaaatacataacttcagtg

SEQ ID NO: 6512164 - DNA, 13 bp, Homo sapiens
tgttaaaatatag

SEQ ID NO: 6512165 - DNA, 17 bp, Homo sapiens
tgttaaaatatagtgtt

SEQ ID NO: 6512166 - DNA, 20 bp, Homo sapiens
tgttaaaatattgatttcta

SEQ ID NO: 6512167 - DNA, 14 bp, Homo sapiens
tgttaaaatctatt

SEQ ID NO: 6512168 - DNA, 12 bp, Homo sapiens
tgttaaaatgag

SEQ ID NO: 6512169 - DNA, 16 bp, Homo sapiens
tgttaaaatgtacact

SEQ ID NO: 6512170 - DNA, 23 bp, Homo sapiens
tgttaaaatgtattcttaaattc

SEQ ID NO: 6512171 - DNA, 17 bp, Homo sapiens
tgttaaaattatgaatc

SEQ ID NO: 6512172 - DNA, 13 bp, Homo sapiens
tgttaaacaaatg

SEQ ID NO: 6512173 - DNA, 15 bp, Homo sapiens
tgttaaacaaatgat

SEQ ID NO: 6512174 - DNA, 17 bp, Homo sapiens
tgttaaacagcctattc

SEQ ID NO: 6512175 - DNA, 16 bp, Homo sapiens
tgttaaaccatgggat

SEQ ID NO: 6512176 - DNA, 23 bp, Homo sapiens
tgttaaactagcatatctgcctt

SEQ ID NO: 6512177 - DNA, 11 bp, Homo sapiens
tgttaaactgt

SEQ ID NO: 6512178 - DNA, 12 bp, Homo sapiens
tgttaaactgtt

SEQ ID NO: 6512179 - DNA, 12 bp, Homo sapiens
tgttaaagaaac

SEQ ID NO: 6512180 - DNA, 21 bp, Homo sapiens
tgttaaagaaacatctacagg

SEQ ID NO: 6512181 - DNA, 12 bp, Homo sapiens
tgttaaagagaa

SEQ ID NO: 6512182 - DNA, 14 bp, Homo sapiens
tgttaaagagataa

SEQ ID NO: 6512183 - DNA, 17 bp, Homo sapiens
tgttaaagagataaaga

SEQ ID NO: 6512184 - DNA, 22 bp, Homo sapiens
tgttaaagaggcgtcttgtatt

SEQ ID NO: 6512185 - DNA, 21 bp, Homo sapiens
tgttaaagctggaacatttga

SEQ ID NO: 6512186 - DNA, 22 bp, Homo sapiens
tgttaaagctggaacatttgat

SEQ ID NO: 6512187 - DNA, 13 bp, Homo sapiens
tgttaaataaatt

SEQ ID NO: 6512188 - DNA, 18 bp, Homo sapiens
tgttaaataaattgtata

SEQ ID NO: 6512189 - DNA, 20 bp, Homo sapiens
tgttaaataaattgtatatt

SEQ ID NO: 6512190 - DNA, 16 bp, Homo sapiens
tgttaaatacaggaaa

SEQ ID NO: 6512191 - DNA, 12 bp, Homo sapiens
tgttaaatactg

SEQ ID NO: 6512192 - DNA, 13 bp, Homo sapiens
tgttaaatactgt

SEQ ID NO: 6512193 - DNA, 18 bp, Homo sapiens
tgttaaatatttttgtac

SEQ ID NO: 6512194 - DNA, 24 bp, Homo sapiens
tgttaaatcccattcataactttc

SEQ ID NO: 6512195 - DNA, 18 bp, Homo sapiens
tgttaaatgaaattgtaa

SEQ ID NO: 6512196 - DNA, 18 bp, Homo sapiens
tgttaaatgagcttaatg

SEQ ID NO: 6512197 - DNA, 13 bp, Homo sapiens
tgttaaatgataa

SEQ ID NO: 6512198 - DNA, 12 bp, Homo sapiens
tgttaaattcag

SEQ ID NO: 6512199 - DNA, 17 bp, Homo sapiens
tgttaaattcattttat

SEQ ID NO: 6512200 - DNA, 16 bp, Homo sapiens
tgttaaatttaaaaat

SEQ ID NO: 6512201 - DNA, 14 bp, Homo sapiens
tgttaaatttgtaa

SEQ ID NO: 6512202 - DNA, 17 bp, Homo sapiens
tgttaaatttgtaagtt

SEQ ID NO: 6512203 - DNA, 23 bp, Homo sapiens
tgttaaattttctctaaactgtt

SEQ ID NO: 6512204 - DNA, 21 bp, Homo sapiens
tgttaacaagaggggaaaaca

SEQ ID NO: 6512205 - DNA, 18 bp, Homo sapiens
tgttaacacattttgtat

SEQ ID NO: 6512206 - DNA, 20 bp, Homo sapiens
tgttaacacattttgtataa

SEQ ID NO: 6512207 - DNA, 20 bp, Homo sapiens
tgttaacactgtaatatctt

SEQ ID NO: 6512208 - DNA, 15 bp, Homo sapiens
tgctactgctgctgc

SEQ ID NO: 6512209 - DNA, 22 bp, Homo sapiens
tgctactgtctcactgaaacat

SEQ ID NO: 6512210 - DNA, 16 bp, Homo sapiens
tgctactgtcttacta

SEQ ID NO: 6512211 - DNA, 20 bp, Homo sapiens
tgctacttaaatttgaatct

SEQ ID NO: 6512212 - DNA, 15 bp, Homo sapiens
tgctacttatcattt

SEQ ID NO: 6512213 - DNA, 17 bp, Homo sapiens
tgctactttgccttttg

SEQ ID NO: 6512214 - DNA, 13 bp, Homo sapiens
tgctagaactccc

SEQ ID NO: 6512215 - DNA, 18 bp, Homo sapiens
tgctagaactccctttca

SEQ ID NO: 6512216 - DNA, 20 bp, Homo sapiens
tgctagaactccctttcaac

SEQ ID NO: 6512217 - DNA, 21 bp, Homo sapiens
tgctagaacttttttaaataa

SEQ ID NO: 6512218 - DNA, 13 bp, Homo sapiens
tgctagaatactt

SEQ ID NO: 6512219 - DNA, 17 bp, Homo sapiens
tgctagaattgattttt

SEQ ID NO: 6512220 - DNA, 20 bp, Homo sapiens
tgctagacaaggttgctgtt

SEQ ID NO: 6512221 - DNA, 19 bp, Homo sapiens
tgctagactctagacaaga

SEQ ID NO: 6512222 - DNA, 14 bp, Homo sapiens
tgctagagcagaca

SEQ ID NO: 6512223 - DNA, 16 bp, Homo sapiens
tgctagagcagacagg

SEQ ID NO: 6512224 - DNA, 16 bp, Homo sapiens
tgctagagcctctgcc

SEQ ID NO: 6512225 - DNA, 15 bp, Homo sapiens
tgctagaggtggcat

SEQ ID NO: 6512226 - DNA, 13 bp, Homo sapiens
tgctagataaaag

SEQ ID NO: 6512227 - DNA, 21 bp, Homo sapiens
tgctagatatcacttactcag

SEQ ID NO: 6512228 - DNA, 17 bp, Homo sapiens
tgctagatctttattat

SEQ ID NO: 6512229 - DNA, 19 bp, Homo sapiens
tgctagatgtgcaaatgca

SEQ ID NO: 6512230 - DNA, 15 bp, Homo sapiens
tgctagatttctaca

SEQ ID NO: 6512231 - DNA, 17 bp, Homo sapiens
tgctagattttaattta

SEQ ID NO: 6512232 - DNA, 20 bp, Homo sapiens
tgctagattttaatttattt

SEQ ID NO: 6512233 - DNA, 13 bp, Homo sapiens
tgctagcacagag

SEQ ID NO: 6512234 - DNA, 15 bp, Homo sapiens
tgctagcacagaggc

SEQ ID NO: 6512235 - DNA, 16 bp, Homo sapiens
tgctagcacagaggcc

SEQ ID NO: 6512236 - DNA, 19 bp, Homo sapiens
tgctagcacagaggcctga

SEQ ID NO: 6512237 - DNA, 22 bp, Homo sapiens
tgctagcacagaggcctgactg

SEQ ID NO: 6512238 - DNA, 16 bp, Homo sapiens
tgctagcacctcccca

SEQ ID NO: 6512239 - DNA, 17 bp, Homo sapiens
tgctagcacctccccag

SEQ ID NO: 6512240 - DNA, 22 bp, Homo sapiens
tgctagcacctccccagacagg

SEQ ID NO: 6512241 - DNA, 18 bp, Homo sapiens
tgctagcacttggagcca

SEQ ID NO: 6512242 - DNA, 13 bp, Homo sapiens
tgctagccccaga

SEQ ID NO: 6512243 - DNA, 23 bp, Homo sapiens
tgctagccccagagatgccagcc

SEQ ID NO: 6512244 - DNA, 13 bp, Homo sapiens
tgctagccctggg

SEQ ID NO: 6512245 - DNA, 20 bp, Homo sapiens
tgctagccggccactttgga

SEQ ID NO: 6512246 - DNA, 23 bp, Homo sapiens
tgctagcctcacgaaactggaat

SEQ ID NO: 6512247 - DNA, 16 bp, Homo sapiens
tgctagctagccagcc

SEQ ID NO: 6512248 - DNA, 18 bp, Homo sapiens
tgctagctagccagccaa

SEQ ID NO: 6512249 - DNA, 13 bp, Homo sapiens
tgctagctagctc

SEQ ID NO: 6512250 - DNA, 17 bp, Homo sapiens
tgctagctatgtgacct

SEQ ID NO: 6512251 - DNA, 18 bp, Homo sapiens
tgctagctatgtgacctt

SEQ ID NO: 6512252 - DNA, 13 bp, Homo sapiens
tgctagctgtaga

SEQ ID NO: 6512253 - DNA, 16 bp, Homo sapiens
tgctagctgtagaaat

SEQ ID NO: 6512254 - DNA, 13 bp, Homo sapiens
tgctagctgtctc

SEQ ID NO: 6512255 - DNA, 16 bp, Homo sapiens
tgctagcttgacacag

SEQ ID NO: 6512256 - DNA, 17 bp, Homo sapiens
tgctagcttgacacagt

SEQ ID NO: 6512257 - DNA, 17 bp, Homo sapiens
tgctaggaacactcctt

SEQ ID NO: 6512258 - DNA, 22 bp, Homo sapiens
tgctaggaacactccttcacag

SEQ ID NO: 6512259 - DNA, 20 bp, Homo sapiens
tgctaggaacctcatttgtc

SEQ ID NO: 6512260 - DNA, 12 bp, Homo sapiens
tgctaggaagtg

SEQ ID NO: 6512261 - DNA, 16 bp, Homo sapiens
tgctaggagccccagc

SEQ ID NO: 6512262 - DNA, 17 bp, Homo sapiens
tgctaggagccccagct

SEQ ID NO: 6512263 - DNA, 19 bp, Homo sapiens
tgctaggccagagcccact

SEQ ID NO: 6512264 - DNA, 20 bp, Homo sapiens
tgctaggcccccgggtgtga

SEQ ID NO: 6512265 - DNA, 17 bp, Homo sapiens
tgctaggcgagtgccag

SEQ ID NO: 6512266 - DNA, 19 bp, Homo sapiens
tgctaggcgagtgccagga

SEQ ID NO: 6512267 - DNA, 19 bp, Homo sapiens
tgctaggcgctggggagac

SEQ ID NO: 6512268 - DNA, 16 bp, Homo sapiens
tgctagggagagggaa

SEQ ID NO: 6512269 - DNA, 19 bp, Homo sapiens
tgctagggagagggaagag

SEQ ID NO: 6512270 - DNA, 12 bp, Homo sapiens
tgctagggcccc

SEQ ID NO: 6512271 - DNA, 18 bp, Homo sapiens
tgctaggggaaggactgg

SEQ ID NO: 6512272 - DNA, 23 bp, Homo sapiens
tgctaggggaaggactggccgtg

SEQ ID NO: 6512273 - DNA, 15 bp, Homo sapiens
tgctaggggatgagg

SEQ ID NO: 6512274 - DNA, 19 bp, Homo sapiens
tgctaggggatgaggggct

SEQ ID NO: 6512275 - DNA, 16 bp, Homo sapiens
tgctagggtgcctgct

SEQ ID NO: 6512276 - DNA, 21 bp, Homo sapiens
tgctagggttaggaggtcctt

SEQ ID NO: 6512277 - DNA, 19 bp, Homo sapiens
tgctaggtaaagaggtcag

SEQ ID NO: 6512278 - DNA, 22 bp, Homo sapiens
tgctaggtctcggactaagcct

SEQ ID NO: 6512279 - DNA, 19 bp, Homo sapiens
tgctaggtgggccagcccc

SEQ ID NO: 6512280 - DNA, 17 bp, Homo sapiens
tgctaggtgtctgggat

SEQ ID NO: 6512281 - DNA, 21 bp, Homo sapiens
tgctagtaaattttcaaacta

SEQ ID NO: 6512282 - DNA, 14 bp, Homo sapiens
tgctagtaattgga

SEQ ID NO: 6512283 - DNA, 17 bp, Homo sapiens
tgctagtacctgtaagc

SEQ ID NO: 6512284 - DNA, 19 bp, Homo sapiens
tgctagtagtgttctagat

SEQ ID NO: 6512285 - DNA, 19 bp, Homo sapiens
tgctagtattcgctgtgtt

SEQ ID NO: 6512286 - DNA, 20 bp, Homo sapiens
tgctagtattcgctgtgttc

SEQ ID NO: 6512287 - DNA, 14 bp, Homo sapiens
tgctagtatttgaa

SEQ ID NO: 6512288 - DNA, 20 bp, Homo sapiens
tgctagtcactggcagcctg

SEQ ID NO: 6512289 - DNA, 20 bp, Homo sapiens
tgctagtcgcccctcagagc

SEQ ID NO: 6512290 - DNA, 23 bp, Homo sapiens
tgctagtcgcccctcagagcatg

SEQ ID NO: 6512291 - DNA, 21 bp, Homo sapiens
tgctagtctcagataggtgct

SEQ ID NO: 6512292 - DNA, 12 bp, Homo sapiens
tgctagtgaaaa

SEQ ID NO: 6512293 - DNA, 20 bp, Homo sapiens
tgctagtgaaatggctgggg

SEQ ID NO: 6512294 - DNA, 19 bp, Homo sapiens
tgctagtgagctgggcatg

SEQ ID NO: 6512295 - DNA, 13 bp, Homo sapiens
tgctagtgataca

SEQ ID NO: 6512296 - DNA, 22 bp, Homo sapiens
tgctagtgggccctctctctgg

SEQ ID NO: 6512297 - DNA, 11 bp, Homo sapiens
tgctagtgtga

SEQ ID NO: 6512298 - DNA, 15 bp, Homo sapiens
tgctagtgttctgtc

SEQ ID NO: 6512299 - DNA, 17 bp, Homo sapiens
tgctagttctgctgccc

SEQ ID NO: 6512300 - DNA, 17 bp, Homo sapiens
tgctagttggagtgctt

SEQ ID NO: 6512301 - DNA, 22 bp, Homo sapiens
tgctagttggagtgcttgttta

SEQ ID NO: 6512302 - DNA, 16 bp, Homo sapiens
tgctagttttacagat

SEQ ID NO: 6512303 - DNA, 21 bp, Homo sapiens
tgctagttttttgcttctctt

SEQ ID NO: 6512304 - DNA, 22 bp, Homo sapiens
tgctagttttttgcttctcttt

SEQ ID NO: 6512305 - DNA, 19 bp, Homo sapiens
tgctataaaattaacagta

SEQ ID NO: 6512306 - DNA, 17 bp, Homo sapiens
tgctataaagttaaagt

SEQ ID NO: 6512307 - DNA, 21 bp, Homo sapiens
tgctataaatgccagagccaa

SEQ ID NO: 6512308 - DNA, 23 bp, Homo sapiens
tgctataaatgccagagccaacc

SEQ ID NO: 6512309 - DNA, 21 bp, Homo sapiens
tgctataactatgttgataaa

SEQ ID NO: 6512310 - DNA, 13 bp, Homo sapiens
tgctataataaat

SEQ ID NO: 6512311 - DNA, 22 bp, Homo sapiens
tgctataatcattagttttaga

SEQ ID NO: 6512312 - DNA, 19 bp, Homo sapiens
tgctataattctatactgt

SEQ ID NO: 6512313 - DNA, 17 bp, Homo sapiens
tgctatacatgttggaa

SEQ ID NO: 6512314 - DNA, 13 bp, Homo sapiens
tgctatagacatt

SEQ ID NO: 6512315 - DNA, 20 bp, Homo sapiens
tgctataggctggagaagct

SEQ ID NO: 6512316 - DNA, 20 bp, Homo sapiens
tgctatagtatttgattcaa

SEQ ID NO: 6512317 - DNA, 21 bp, Homo sapiens
tgctatagtatttgattcaaa

SEQ ID NO: 6512318 - DNA, 21 bp, Homo sapiens
tgctatagtgtataccacctg

SEQ ID NO: 6512319 - DNA, 18 bp, Homo sapiens
tgctatataaataaagca

SEQ ID NO: 6512320 - DNA, 12 bp, Homo sapiens
tgctatatatat

SEQ ID NO: 6512321 - DNA, 16 bp, Homo sapiens
tgctatatatataaat

SEQ ID NO: 6512322 - DNA, 20 bp, Homo sapiens
tgctatattaacatcatctt

SEQ ID NO: 6512323 - DNA, 16 bp, Homo sapiens
tgctatattgcccagg

SEQ ID NO: 6512324 - DNA, 16 bp, Homo sapiens
tgctatatttgctaat

SEQ ID NO: 6512325 - DNA, 18 bp, Homo sapiens
tgctatattttcatgact

SEQ ID NO: 6512326 - DNA, 19 bp, Homo sapiens
tgctatatttttaaagaag

SEQ ID NO: 6512327 - DNA, 20 bp, Homo sapiens
tgctatatttttaaagaagg

SEQ ID NO: 6512328 - DNA, 14 bp, Homo sapiens
tgctatcaagaaat

SEQ ID NO: 6512329 - DNA, 13 bp, Homo sapiens
tgctatcaatgag

SEQ ID NO: 6512330 - DNA, 14 bp, Homo sapiens
tgctatcacacagt

SEQ ID NO: 6512331 - DNA, 12 bp, Homo sapiens
tgctatcactgt

SEQ ID NO: 6512332 - DNA, 15 bp, Homo sapiens
tgctatcagaaacag

SEQ ID NO: 6512333 - DNA, 16 bp, Homo sapiens
tgctatcatatattat

SEQ ID NO: 6512334 - DNA, 23 bp, Homo sapiens
tgctatcatatattataagattt

SEQ ID NO: 6512335 - DNA, 17 bp, Homo sapiens
tgctatcattattcgta

SEQ ID NO: 6512336 - DNA, 23 bp, Homo sapiens
tgctatcctgcaggaaatataaa

SEQ ID NO: 6512337 - DNA, 18 bp, Homo sapiens
tgctatcgccctcctttc

SEQ ID NO: 6512338 - DNA, 20 bp, Homo sapiens
tgctatctactaagtttcct

SEQ ID NO: 6512339 - DNA, 21 bp, Homo sapiens
tgctatctactaagtttcctt

SEQ ID NO: 6512340 - DNA, 21 bp, Homo sapiens
tgctatctagcagtaaaagat

SEQ ID NO: 6512341 - DNA, 17 bp, Homo sapiens
tgctatctcccccagcc

SEQ ID NO: 6512342 - DNA, 18 bp, Homo sapiens
tgctatctcccccagccc

SEQ ID NO: 6512343 - DNA, 21 bp, Homo sapiens
tgctatctgaactaattcatt

SEQ ID NO: 6512344 - DNA, 20 bp, Homo sapiens
tgctatctggaggccttcca

SEQ ID NO: 6512345 - DNA, 16 bp, Homo sapiens
tgctatgaaaatgagc

SEQ ID NO: 6512346 - DNA, 19 bp, Homo sapiens
tgctatgaaaatgagcatc

SEQ ID NO: 6512347 - DNA, 22 bp, Homo sapiens
tgctatgaaaatgagcatcaga

SEQ ID NO: 6512348 - DNA, 16 bp, Homo sapiens
tgctatgaaaggaata

SEQ ID NO: 6512349 - DNA, 22 bp, Homo sapiens
tgctatgaagactacttttaga

SEQ ID NO: 6512350 - DNA, 15 bp, Homo sapiens
tgctatgacagctgg

SEQ ID NO: 6512351 - DNA, 18 bp, Homo sapiens
tgctatgactacattttg

SEQ ID NO: 6512352 - DNA, 20 bp, Homo sapiens
tgctatgagctggggatgtc

SEQ ID NO: 6512353 - DNA, 16 bp, Homo sapiens
tgctatgagttttctc

SEQ ID NO: 6512354 - DNA, 22 bp, Homo sapiens
tgctatgatgttagttttcctt

SEQ ID NO: 6512355 - DNA, 23 bp, Homo sapiens
tgctatgcaaaatagacatcttt

SEQ ID NO: 6512356 - DNA, 16 bp, Homo sapiens
tgctatgcattttctt

SEQ ID NO: 6512357 - DNA, 18 bp, Homo sapiens
tgctatgcattttcttca

SEQ ID NO: 6512358 - DNA, 20 bp, Homo sapiens
tgctatgcattttcttcaca

SEQ ID NO: 6512359 - DNA, 20 bp, Homo sapiens
tgctatgcgggttgattatt

SEQ ID NO: 6512360 - DNA, 18 bp, Homo sapiens
tgctatgctgttcattga

SEQ ID NO: 6512361 - DNA, 16 bp, Homo sapiens
tgctatggaaatacat

SEQ ID NO: 6512362 - DNA, 18 bp, Homo sapiens
tgctatggaaatacattt

SEQ ID NO: 6512363 - DNA, 19 bp, Homo sapiens
tgctatggaaatacattta

SEQ ID NO: 6512364 - DNA, 21 bp, Homo sapiens
tgctatggaaatacatttaga

SEQ ID NO: 6512365 - DNA, 22 bp, Homo sapiens
tgctatggaaatacatttagaa

SEQ ID NO: 6512366 - DNA, 20 bp, Homo sapiens
tgctatggaacataaagttg

SEQ ID NO: 6512367 - DNA, 16 bp, Homo sapiens
tgctatggactgcaca

SEQ ID NO: 6512368 - DNA, 13 bp, Homo sapiens
tgctatggagagg

SEQ ID NO: 6512369 - DNA, 16 bp, Homo sapiens
tgctatggatggcttc

SEQ ID NO: 6512370 - DNA, 12 bp, Homo sapiens
tgctatggggac

SEQ ID NO: 6512371 - DNA, 18 bp, Homo sapiens
tgctatggggagaaaaga

SEQ ID NO: 6512372 - DNA, 19 bp, Homo sapiens
tgctatgtgtgagatatgt

SEQ ID NO: 6512373 - DNA, 14 bp, Homo sapiens
tgctatgtgtgctt

SEQ ID NO: 6512374 - DNA, 15 bp, Homo sapiens
tgctatgtgtgctta

SEQ ID NO: 6512375 - DNA, 17 bp, Homo sapiens
tgctatgtgtttggttt

SEQ ID NO: 6512376 - DNA, 18 bp, Homo sapiens
tgctatgttactattttc

SEQ ID NO: 6512377 - DNA, 19 bp, Homo sapiens
tgctatgttattttcagtg

SEQ ID NO: 6512378 - DNA, 12 bp, Homo sapiens
tgctatgttctg

SEQ ID NO: 6512379 - DNA, 22 bp, Homo sapiens
tgctatgttctgtcttcccaaa

SEQ ID NO: 6512380 - DNA, 13 bp, Homo sapiens
tgctatgttgccc

SEQ ID NO: 6512381 - DNA, 23 bp, Homo sapiens
tgctattaaccttgccttagaaa

SEQ ID NO: 6512382 - DNA, 13 bp, Homo sapiens
tgctattaatatt

SEQ ID NO: 6512383 - DNA, 14 bp, Homo sapiens
tgctattagactgt

SEQ ID NO: 6512384 - DNA, 23 bp, Homo sapiens
tgctattatgatgttttgcaaag

SEQ ID NO: 6512385 - DNA, 20 bp, Homo sapiens
tgttaacagacactgtaaaa

SEQ ID NO: 6512386 - DNA, 14 bp, Homo sapiens
tgttaacagagcaa

SEQ ID NO: 6512387 - DNA, 15 bp, Homo sapiens
tgttaacagtatttc

SEQ ID NO: 6512388 - DNA, 20 bp, Homo sapiens
tgttaacagtattttaagaa

SEQ ID NO: 6512389 - DNA, 19 bp, Homo sapiens
tgttaacatggaatttaat

SEQ ID NO: 6512390 - DNA, 21 bp, Homo sapiens
tgttaacattccaagactcta

SEQ ID NO: 6512391 - DNA, 16 bp, Homo sapiens
tgttaaccaaggaaat

SEQ ID NO: 6512392 - DNA, 16 bp, Homo sapiens
tgttaaccagaataaa

SEQ ID NO: 6512393 - DNA, 15 bp, Homo sapiens
tgttaaccatttaag

SEQ ID NO: 6512394 - DNA, 14 bp, Homo sapiens
tgttaacctaggca

SEQ ID NO: 6512395 - DNA, 22 bp, Homo sapiens
tgttaacctaggcagtgggagg

SEQ ID NO: 6512396 - DNA, 19 bp, Homo sapiens
tgttaacctcagtgtcatt

SEQ ID NO: 6512397 - DNA, 19 bp, Homo sapiens
tgttaacctctgcttttat

SEQ ID NO: 6512398 - DNA, 15 bp, Homo sapiens
tgttaaccttaaata

SEQ ID NO: 6512399 - DNA, 18 bp, Homo sapiens
tgttaaccttaaatacac

SEQ ID NO: 6512400 - DNA, 19 bp, Homo sapiens
tgttaaccttaaatacact

SEQ ID NO: 6512401 - DNA, 21 bp, Homo sapiens
tgttaacgtgatgtgccacta

SEQ ID NO: 6512402 - DNA, 17 bp, Homo sapiens
tgttaactatgacagat

SEQ ID NO: 6512403 - DNA, 22 bp, Homo sapiens
tgttaactatgacagatatatt

SEQ ID NO: 6512404 - DNA, 21 bp, Homo sapiens
tgttaactgaagatattccaa

SEQ ID NO: 6512405 - DNA, 15 bp, Homo sapiens
tgttaactgaatacc

SEQ ID NO: 6512406 - DNA, 17 bp, Homo sapiens
tgttaactgaataccac

SEQ ID NO: 6512407 - DNA, 16 bp, Homo sapiens
tgttaactgagtgcct

SEQ ID NO: 6512408 - DNA, 13 bp, Homo sapiens
tgttaactgccaa

SEQ ID NO: 6512409 - DNA, 22 bp, Homo sapiens
tgttaacttaatagtatttatg

SEQ ID NO: 6512410 - DNA, 14 bp, Homo sapiens
tgttaacttagctt

SEQ ID NO: 6512411 - DNA, 14 bp, Homo sapiens
tgttaacttattca

SEQ ID NO: 6512412 - DNA, 23 bp, Homo sapiens
tgttaacttattcaaagagaaaa

SEQ ID NO: 6512413 - DNA, 21 bp, Homo sapiens
tgttaacttgcctccatcttt

SEQ ID NO: 6512414 - DNA, 23 bp, Homo sapiens
tgttaacttggttctcagactct

SEQ ID NO: 6512415 - DNA, 13 bp, Homo sapiens
tgttaactttatt

SEQ ID NO: 6512416 - DNA, 15 bp, Homo sapiens
tgttaactttattac

SEQ ID NO: 6512417 - DNA, 19 bp, Homo sapiens
tgttaactttattacaatt

SEQ ID NO: 6512418 - DNA, 11 bp, Homo sapiens
tgttaagaaag

SEQ ID NO: 6512419 - DNA, 13 bp, Homo sapiens
tgttaagaaagga

SEQ ID NO: 6512420 - DNA, 14 bp, Homo sapiens
tgttaagaaaggat

SEQ ID NO: 6512421 - DNA, 16 bp, Homo sapiens
tgttaagaaaggatat

SEQ ID NO: 6512422 - DNA, 13 bp, Homo sapiens
tgttaagaataac

SEQ ID NO: 6512423 - DNA, 17 bp, Homo sapiens
tgttaagaataataaaa

SEQ ID NO: 6512424 - DNA, 14 bp, Homo sapiens
tgttaagaatagaa

SEQ ID NO: 6512425 - DNA, 22 bp, Homo sapiens
tgttaagaatgaagttctgcta

SEQ ID NO: 6512426 - DNA, 17 bp, Homo sapiens
tgttaagacttacacag

SEQ ID NO: 6512427 - DNA, 15 bp, Homo sapiens
tgttaagacttgaca

SEQ ID NO: 6512428 - DNA, 12 bp, Homo sapiens
tgttaagataac

SEQ ID NO: 6512429 - DNA, 15 bp, Homo sapiens
tgttaagataactta

SEQ ID NO: 6512430 - DNA, 21 bp, Homo sapiens
tgttaagataacttactgtat

SEQ ID NO: 6512431 - DNA, 22 bp, Homo sapiens
tgttaagataacttactgtata

SEQ ID NO: 6512432 - DNA, 23 bp, Homo sapiens
tgttaagatatgcacagtctatt

SEQ ID NO: 6512433 - DNA, 22 bp, Homo sapiens
tgttaagcaaaggaaaccaaag

SEQ ID NO: 6512434 - DNA, 21 bp, Homo sapiens
tgttaagcaagtggttgtttt

SEQ ID NO: 6512435 - DNA, 20 bp, Homo sapiens
tgttaagcgtgtctgtattt

SEQ ID NO: 6512436 - DNA, 17 bp, Homo sapiens
tgttaagctcaggattt

SEQ ID NO: 6512437 - DNA, 17 bp, Homo sapiens
tgttaaggaaactctta

SEQ ID NO: 6512438 - DNA, 22 bp, Homo sapiens
tgttaaggaaactcttatctca

SEQ ID NO: 6512439 - DNA, 23 bp, Homo sapiens
tgttaaggacccttttaagcatg

SEQ ID NO: 6512440 - DNA, 15 bp, Homo sapiens
tgttaagggaagctg

SEQ ID NO: 6512441 - DNA, 18 bp, Homo sapiens
tgttaagggaagctgata

SEQ ID NO: 6512442 - DNA, 21 bp, Homo sapiens
tgttaaggttgaactttgcca

SEQ ID NO: 6512443 - DNA, 23 bp, Homo sapiens
tgttaaggttgaactttgccaaa

SEQ ID NO: 6512444 - DNA, 13 bp, Homo sapiens
tgttaagtctgag

SEQ ID NO: 6512445 - DNA, 13 bp, Homo sapiens
tgttaagtgcttt

SEQ ID NO: 6512446 - DNA, 15 bp, Homo sapiens
tgttaagtggtttca

SEQ ID NO: 6512447 - DNA, 20 bp, Homo sapiens
tgttaagttacagtttgcac

SEQ ID NO: 6512448 - DNA, 21 bp, Homo sapiens
tgttaagttatagtgaatact

SEQ ID NO: 6512449 - DNA, 13 bp, Homo sapiens
tgttaataaaagt

SEQ ID NO: 6512450 - DNA, 18 bp, Homo sapiens
tgttaataaaagtacatg

SEQ ID NO: 6512451 - DNA, 16 bp, Homo sapiens
tgttaataatctcaca

SEQ ID NO: 6512452 - DNA, 22 bp, Homo sapiens
tgttaatacaaggtataataaa

SEQ ID NO: 6512453 - DNA, 13 bp, Homo sapiens
tgttaatacacag

SEQ ID NO: 6512454 - DNA, 18 bp, Homo sapiens
tgttaatacacagtactt

SEQ ID NO: 6512455 - DNA, 20 bp, Homo sapiens
tgttaatacacagtacttta

SEQ ID NO: 6512456 - DNA, 13 bp, Homo sapiens
tgttaatacatca

SEQ ID NO: 6512457 - DNA, 15 bp, Homo sapiens
tgttaatactgtatt

SEQ ID NO: 6512458 - DNA, 20 bp, Homo sapiens
tgttaatataatttaacaga

SEQ ID NO: 6512459 - DNA, 12 bp, Homo sapiens
tgttaatatcac

SEQ ID NO: 6512460 - DNA, 13 bp, Homo sapiens
tgttaatatcact

SEQ ID NO: 6512461 - DNA, 21 bp, Homo sapiens
tgttaatatcactcattaatt

SEQ ID NO: 6512462 - DNA, 22 bp, Homo sapiens
tgttaatatcactcattaatta

SEQ ID NO: 6512463 - DNA, 16 bp, Homo sapiens
tgttaatattaattta

SEQ ID NO: 6512464 - DNA, 14 bp, Homo sapiens
tgttaatattcttt

SEQ ID NO: 6512465 - DNA, 18 bp, Homo sapiens
tgttaatattctttcaat

SEQ ID NO: 6512466 - DNA, 13 bp, Homo sapiens
tgttaatattgat

SEQ ID NO: 6512467 - DNA, 19 bp, Homo sapiens
tgttaatattgatttatta

SEQ ID NO: 6512468 - DNA, 14 bp, Homo sapiens
tgttaatatttctt

SEQ ID NO: 6512469 - DNA, 23 bp, Homo sapiens
tgttaatattttacttttacagt

SEQ ID NO: 6512470 - DNA, 14 bp, Homo sapiens
tgttaatcaaacaa

SEQ ID NO: 6512471 - DNA, 16 bp, Homo sapiens
tgttaatcaaacaagt

SEQ ID NO: 6512472 - DNA, 13 bp, Homo sapiens
tgttaatcaaaga

SEQ ID NO: 6512473 - DNA, 16 bp, Homo sapiens
tgttaatcatcttctc

SEQ ID NO: 6512474 - DNA, 20 bp, Homo sapiens
tgttaatcctagctgtgtgc

SEQ ID NO: 6512475 - DNA, 21 bp, Homo sapiens
tgttaatctctgttatgtact

SEQ ID NO: 6512476 - DNA, 16 bp, Homo sapiens
tgttaatctgatgtat

SEQ ID NO: 6512477 - DNA, 19 bp, Homo sapiens
tgttaatgaaaatgataaa

SEQ ID NO: 6512478 - DNA, 16 bp, Homo sapiens
tgttaatgattcttgt

SEQ ID NO: 6512479 - DNA, 17 bp, Homo sapiens
tgttaatgattcttgtg

SEQ ID NO: 6512480 - DNA, 14 bp, Homo sapiens
tgttaatgcattgt

SEQ ID NO: 6512481 - DNA, 20 bp, Homo sapiens
tgttaatgcattgttgtaaa

SEQ ID NO: 6512482 - DNA, 14 bp, Homo sapiens
tgttaatgcatttt

SEQ ID NO: 6512483 - DNA, 19 bp, Homo sapiens
tgttaatgcatttttgatg

SEQ ID NO: 6512484 - DNA, 19 bp, Homo sapiens
tgttaatgcctataacttt

SEQ ID NO: 6512485 - DNA, 15 bp, Homo sapiens
tgttaatgctttctg

SEQ ID NO: 6512486 - DNA, 22 bp, Homo sapiens
tgttaatggctaacctgttaca

SEQ ID NO: 6512487 - DNA, 19 bp, Homo sapiens
tgttaatgtatttgttcat

SEQ ID NO: 6512488 - DNA, 22 bp, Homo sapiens
tgttaatgtatttgttcatgtt

SEQ ID NO: 6512489 - DNA, 12 bp, Homo sapiens
tgttaatgtgat

SEQ ID NO: 6512490 - DNA, 19 bp, Homo sapiens
tgttaattataaacagcag

SEQ ID NO: 6512491 - DNA, 18 bp, Homo sapiens
tgttaattataggagcct

SEQ ID NO: 6512492 - DNA, 20 bp, Homo sapiens
tgttaattcagcactgattt

SEQ ID NO: 6512493 - DNA, 16 bp, Homo sapiens
tgttaattcctatgaa

SEQ ID NO: 6512494 - DNA, 20 bp, Homo sapiens
tgttaattgattaaactgta

SEQ ID NO: 6512495 - DNA, 19 bp, Homo sapiens
tgttaattgtaattgcatg

SEQ ID NO: 6512496 - DNA, 20 bp, Homo sapiens
tgttaattgttcaaactttc

SEQ ID NO: 6512497 - DNA, 15 bp, Homo sapiens
tgttaatttagaaaa

SEQ ID NO: 6512498 - DNA, 20 bp, Homo sapiens
tgttaatttagaaaacttta

SEQ ID NO: 6512499 - DNA, 19 bp, Homo sapiens
tgttaatttataatgtatt

SEQ ID NO: 6512500 - DNA, 22 bp, Homo sapiens
tgttaatttataatgtatttga

SEQ ID NO: 6512501 - DNA, 13 bp, Homo sapiens
tgttaatttatgc

SEQ ID NO: 6512502 - DNA, 15 bp, Homo sapiens
tgttaatttcttgca

SEQ ID NO: 6512503 - DNA, 16 bp, Homo sapiens
tgttaatttcttgcaa

SEQ ID NO: 6512504 - DNA, 15 bp, Homo sapiens
tgttaatttggacca

SEQ ID NO: 6512505 - DNA, 22 bp, Homo sapiens
tgttaatttggaccattttcct

SEQ ID NO: 6512506 - DNA, 20 bp, Homo sapiens
tgttaatttgtgtgttttta

SEQ ID NO: 6512507 - DNA, 19 bp, Homo sapiens
tgttaattttaatttctga

SEQ ID NO: 6512508 - DNA, 20 bp, Homo sapiens
tgttaattttattgcaaagt

SEQ ID NO: 6512509 - DNA, 14 bp, Homo sapiens
tgttaattttgcta

SEQ ID NO: 6512510 - DNA, 16 bp, Homo sapiens
tgttaattttgctaac

SEQ ID NO: 6512511 - DNA, 19 bp, Homo sapiens
tgttaattttttggtacaa

SEQ ID NO: 6512512 - DNA, 12 bp, Homo sapiens
tgttacaaaaga

SEQ ID NO: 6512513 - DNA, 23 bp, Homo sapiens
tgttacaaaagaaaaaagcaagt

SEQ ID NO: 6512514 - DNA, 18 bp, Homo sapiens
tgttacaaaatgttcagt

SEQ ID NO: 6512515 - DNA, 20 bp, Homo sapiens
tgttacaacttgtatttcca

SEQ ID NO: 6512516 - DNA, 16 bp, Homo sapiens
tgttacaaggcacttg

SEQ ID NO: 6512517 - DNA, 19 bp, Homo sapiens
tgttacaagtttatatata

SEQ ID NO: 6512518 - DNA, 23 bp, Homo sapiens
tgttacaataaaactaaatgtgt

SEQ ID NO: 6512519 - DNA, 17 bp, Homo sapiens
tgttacaatagaattta

SEQ ID NO: 6512520 - DNA, 20 bp, Homo sapiens
tgttacaatcagtgtgaatg

SEQ ID NO: 6512521 - DNA, 15 bp, Homo sapiens
tgttacaatgtaact

SEQ ID NO: 6512522 - DNA, 16 bp, Homo sapiens
tgttacacaatggttt

SEQ ID NO: 6512523 - DNA, 14 bp, Homo sapiens
tgttacactgggct

SEQ ID NO: 6512524 - DNA, 19 bp, Homo sapiens
tgttacactgggctgggtt

SEQ ID NO: 6512525 - DNA, 15 bp, Homo sapiens
tgttacagactgaaa

SEQ ID NO: 6512526 - DNA, 15 bp, Homo sapiens
tgttacagaggacat

SEQ ID NO: 6512527 - DNA, 18 bp, Homo sapiens
tgttacagctcatgtttt

SEQ ID NO: 6512528 - DNA, 21 bp, Homo sapiens
tgttacaggcaccgagaatgt

SEQ ID NO: 6512529 - DNA, 23 bp, Homo sapiens
tgttacaggcaccgagaatgttg

SEQ ID NO: 6512530 - DNA, 17 bp, Homo sapiens
tgttacagtaatgtcat

SEQ ID NO: 6512531 - DNA, 19 bp, Homo sapiens
tgttacatgaagatgttaa

SEQ ID NO: 6512532 - DNA, 15 bp, Homo sapiens
tgttacatgtatcaa

SEQ ID NO: 6512533 - DNA, 19 bp, Homo sapiens
tgttaccaaaaataaatat

SEQ ID NO: 6512534 - DNA, 17 bp, Homo sapiens
tgttaccacagagtttt

SEQ ID NO: 6512535 - DNA, 18 bp, Homo sapiens
tgttaccacattggggaa

SEQ ID NO: 6512536 - DNA, 21 bp, Homo sapiens
tgttaccactggtaacatgtg

SEQ ID NO: 6512537 - DNA, 12 bp, Homo sapiens
tgttaccagact

SEQ ID NO: 6512538 - DNA, 22 bp, Homo sapiens
tgttaccagtgttaataaatgg

SEQ ID NO: 6512539 - DNA, 19 bp, Homo sapiens
tgttaccatactgtctctg

SEQ ID NO: 6512540 - DNA, 18 bp, Homo sapiens
tgttaccatgtatgtata

SEQ ID NO: 6512541 - DNA, 19 bp, Homo sapiens
tgttaccatgtcactgtgg

SEQ ID NO: 6512542 - DNA, 14 bp, Homo sapiens
tgttacccatttga

SEQ ID NO: 6512543 - DNA, 16 bp, Homo sapiens
tgttacccatttgaaa

SEQ ID NO: 6512544 - DNA, 23 bp, Homo sapiens
tgttacccatttgaaagaatatt

SEQ ID NO: 6512545 - DNA, 18 bp, Homo sapiens
tgttacctaaagtatttt

SEQ ID NO: 6512546 - DNA, 16 bp, Homo sapiens
tgttacctaattatta

SEQ ID NO: 6512547 - DNA, 16 bp, Homo sapiens
tgttacctgaaaacac

SEQ ID NO: 6512548 - DNA, 16 bp, Homo sapiens
tgttacctgagatact

SEQ ID NO: 6512549 - DNA, 14 bp, Homo sapiens
tgttacctgtagat

SEQ ID NO: 6512550 - DNA, 23 bp, Homo sapiens
tgttacctgtcattttgcactgt

SEQ ID NO: 6512551 - DNA, 19 bp, Homo sapiens
tgttacctgttagctccct

SEQ ID NO: 6512552 - DNA, 12 bp, Homo sapiens
tgttaccttaaa

SEQ ID NO: 6512553 - DNA, 17 bp, Homo sapiens
tgttaccttaaaactag

SEQ ID NO: 6512554 - DNA, 15 bp, Homo sapiens
tgttaccttcacatg

SEQ ID NO: 6512555 - DNA, 20 bp, Homo sapiens
tgttacctttcccatgctga

SEQ ID NO: 6512556 - DNA, 22 bp, Homo sapiens
tgttacctttcccatgctgaat

SEQ ID NO: 6512557 - DNA, 18 bp, Homo sapiens
tgttaccttttacagaat

SEQ ID NO: 6512558 - DNA, 19 bp, Homo sapiens
tgttaccttttacagaata

SEQ ID NO: 6512559 - DNA, 15 bp, Homo sapiens
tgttacgtgtgcaac

SEQ ID NO: 6512560 - DNA, 13 bp, Homo sapiens
tgttactaaagtc

SEQ ID NO: 6512561 - DNA, 22 bp, Homo sapiens
tgttactaaatggtgttacatt

SEQ ID NO: 6512562 - DNA, 17 bp, Homo sapiens
tgttactaaattacgta

SEQ ID NO: 6512563 - DNA, 23 bp, Homo sapiens
tgctattatgtaacatccagaag

SEQ ID NO: 6512564 - DNA, 18 bp, Homo sapiens
tgctattcagataaggca

SEQ ID NO: 6512565 - DNA, 20 bp, Homo sapiens
tgctattctagagcttttat

SEQ ID NO: 6512566 - DNA, 14 bp, Homo sapiens
tgctattctgtccc

SEQ ID NO: 6512567 - DNA, 15 bp, Homo sapiens
tgctattctgtccct

SEQ ID NO: 6512568 - DNA, 14 bp, Homo sapiens
tgctattctgtgtt

SEQ ID NO: 6512569 - DNA, 17 bp, Homo sapiens
tgctattgaaattactg

SEQ ID NO: 6512570 - DNA, 16 bp, Homo sapiens
tgctattgacaagtca

SEQ ID NO: 6512571 - DNA, 13 bp, Homo sapiens
tgctattgacaat

SEQ ID NO: 6512572 - DNA, 21 bp, Homo sapiens
tgctattgacaataaaatatt

SEQ ID NO: 6512573 - DNA, 13 bp, Homo sapiens
tgctattgctgtc

SEQ ID NO: 6512574 - DNA, 20 bp, Homo sapiens
tgctattggaggatcagttt

SEQ ID NO: 6512575 - DNA, 15 bp, Homo sapiens
tgctattgtaaatat

SEQ ID NO: 6512576 - DNA, 20 bp, Homo sapiens
tgctattgtaaggtctttgt

SEQ ID NO: 6512577 - DNA, 21 bp, Homo sapiens
tgctattgtaaggtctttgta

SEQ ID NO: 6512578 - DNA, 22 bp, Homo sapiens
tgctattgtagagccagaggtc

SEQ ID NO: 6512579 - DNA, 18 bp, Homo sapiens
tgctattgtctgaacttg

SEQ ID NO: 6512580 - DNA, 16 bp, Homo sapiens
tgctattgtgaatagt

SEQ ID NO: 6512581 - DNA, 18 bp, Homo sapiens
tgctattgttgtgggctt

SEQ ID NO: 6512582 - DNA, 19 bp, Homo sapiens
tgctattgtttataggaaa

SEQ ID NO: 6512583 - DNA, 14 bp, Homo sapiens
tgctatttaacatt

SEQ ID NO: 6512584 - DNA, 16 bp, Homo sapiens
tgctatttaacatttt

SEQ ID NO: 6512585 - DNA, 21 bp, Homo sapiens
tgctatttatattcattcaga

SEQ ID NO: 6512586 - DNA, 19 bp, Homo sapiens
tgctatttattttcctaaa

SEQ ID NO: 6512587 - DNA, 20 bp, Homo sapiens
tgctatttatttttacaaga

SEQ ID NO: 6512588 - DNA, 19 bp, Homo sapiens
tgctatttcaataacagat

SEQ ID NO: 6512589 - DNA, 11 bp, Homo sapiens
tgctatttcag

SEQ ID NO: 6512590 - DNA, 20 bp, Homo sapiens
tgctatttcagccaatctgg

SEQ ID NO: 6512591 - DNA, 14 bp, Homo sapiens
tgctatttctatat

SEQ ID NO: 6512592 - DNA, 20 bp, Homo sapiens
tgctatttctatattttcat

SEQ ID NO: 6512593 - DNA, 21 bp, Homo sapiens
tgctatttctatattttcatt

SEQ ID NO: 6512594 - DNA, 22 bp, Homo sapiens
tgctatttctatattttcattc

SEQ ID NO: 6512595 - DNA, 17 bp, Homo sapiens
tgctatttctggcctca

SEQ ID NO: 6512596 - DNA, 19 bp, Homo sapiens
tgctatttctggcctcagc

SEQ ID NO: 6512597 - DNA, 21 bp, Homo sapiens
tgctatttctggcctcagcag

SEQ ID NO: 6512598 - DNA, 17 bp, Homo sapiens
tgctatttgaacaagtg

SEQ ID NO: 6512599 - DNA, 13 bp, Homo sapiens
tgctatttgaagt

SEQ ID NO: 6512600 - DNA, 19 bp, Homo sapiens
tgctatttgagcatgcaca

SEQ ID NO: 6512601 - DNA, 17 bp, Homo sapiens
tgctatttgtacaaata

SEQ ID NO: 6512602 - DNA, 14 bp, Homo sapiens
tgctatttgtcagt

SEQ ID NO: 6512603 - DNA, 15 bp, Homo sapiens
tgctattttaaaaaa

SEQ ID NO: 6512604 - DNA, 15 bp, Homo sapiens
tgctattttcatcac

SEQ ID NO: 6512605 - DNA, 14 bp, Homo sapiens
tgctatttttcatc

SEQ ID NO: 6512606 - DNA, 17 bp, Homo sapiens
tgctattttttatcatt

SEQ ID NO: 6512607 - DNA, 20 bp, Homo sapiens
tgctattttttttaaatcaa

SEQ ID NO: 6512608 - DNA, 23 bp, Homo sapiens
tgctcaaaacacttccagtctgg

SEQ ID NO: 6512609 - DNA, 22 bp, Homo sapiens
tgctcaaaacctcttaaatcat

SEQ ID NO: 6512610 - DNA, 17 bp, Homo sapiens
tgctcaaaatctgtgac

SEQ ID NO: 6512611 - DNA, 13 bp, Homo sapiens
tgctcaaaatgca

SEQ ID NO: 6512612 - DNA, 16 bp, Homo sapiens
tgctcaaaattgcttc

SEQ ID NO: 6512613 - DNA, 18 bp, Homo sapiens
tgctcaaaattgcttcta

SEQ ID NO: 6512614 - DNA, 14 bp, Homo sapiens
tgctcaaaatttga

SEQ ID NO: 6512615 - DNA, 13 bp, Homo sapiens
tgctcaaagaaat

SEQ ID NO: 6512616 - DNA, 20 bp, Homo sapiens
tgctcaaagatgtactgaga

SEQ ID NO: 6512617 - DNA, 18 bp, Homo sapiens
tgctcaaatctattcaga

SEQ ID NO: 6512618 - DNA, 23 bp, Homo sapiens
tgctcaacaatttatccattcaa

SEQ ID NO: 6512619 - DNA, 23 bp, Homo sapiens
tgctcaacagcatatgggtggga

SEQ ID NO: 6512620 - DNA, 16 bp, Homo sapiens
tgctcaaccactgtgg

SEQ ID NO: 6512621 - DNA, 15 bp, Homo sapiens
tgctcaacccccctc

SEQ ID NO: 6512622 - DNA, 18 bp, Homo sapiens
tgctcaacccccctccca

SEQ ID NO: 6512623 - DNA, 19 bp, Homo sapiens
tgctcaacccccctcccag

SEQ ID NO: 6512624 - DNA, 23 bp, Homo sapiens
tgctcaacccccctcccagacag

SEQ ID NO: 6512625 - DNA, 23 bp, Homo sapiens
tgctcaacctacagtggagggag

SEQ ID NO: 6512626 - DNA, 13 bp, Homo sapiens
tgctcaacctctc

SEQ ID NO: 6512627 - DNA, 20 bp, Homo sapiens
tgctcaacctctctccttct

SEQ ID NO: 6512628 - DNA, 22 bp, Homo sapiens
tgctcaactaattttatttcta

SEQ ID NO: 6512629 - DNA, 23 bp, Homo sapiens
tgctcaactctacccctgctccc

SEQ ID NO: 6512630 - DNA, 16 bp, Homo sapiens
tgctcaacttgcaaaa

SEQ ID NO: 6512631 - DNA, 14 bp, Homo sapiens
tgctcaagaagaca

SEQ ID NO: 6512632 - DNA, 13 bp, Homo sapiens
tgctcaagatatg

SEQ ID NO: 6512633 - DNA, 16 bp, Homo sapiens
tgctcaagatatggaa

SEQ ID NO: 6512634 - DNA, 18 bp, Homo sapiens
tgctcaagcagcaaaatc

SEQ ID NO: 6512635 - DNA, 19 bp, Homo sapiens
tgctcaagccgcaagctct

SEQ ID NO: 6512636 - DNA, 13 bp, Homo sapiens
tgctcaaggccag

SEQ ID NO: 6512637 - DNA, 19 bp, Homo sapiens
tgctcaagggttctttcct

SEQ ID NO: 6512638 - DNA, 19 bp, Homo sapiens
tgctcaataaacttgtgcc

SEQ ID NO: 6512639 - DNA, 21 bp, Homo sapiens
tgctcaataaagaagcccatg

SEQ ID NO: 6512640 - DNA, 18 bp, Homo sapiens
tgctcaatacctggcctc

SEQ ID NO: 6512641 - DNA, 20 bp, Homo sapiens
tgctcaatatgatcttgata

SEQ ID NO: 6512642 - DNA, 19 bp, Homo sapiens
tgctcaatcatgtgccaga

SEQ ID NO: 6512643 - DNA, 15 bp, Homo sapiens
tgctcaatgccattg

SEQ ID NO: 6512644 - DNA, 18 bp, Homo sapiens
tgctcaatgccattgtgc

SEQ ID NO: 6512645 - DNA, 19 bp, Homo sapiens
tgctcaatggagaatataa

SEQ ID NO: 6512646 - DNA, 12 bp, Homo sapiens
tgctcaatgtgc

SEQ ID NO: 6512647 - DNA, 14 bp, Homo sapiens
tgctcaatgtgctg

SEQ ID NO: 6512648 - DNA, 18 bp, Homo sapiens
tgctcaatgtgctgttga

SEQ ID NO: 6512649 - DNA, 19 bp, Homo sapiens
tgctcaatgtgctgttgat

SEQ ID NO: 6512650 - DNA, 14 bp, Homo sapiens
tgctcaatttcagc

SEQ ID NO: 6512651 - DNA, 16 bp, Homo sapiens
tgctcaatttcagcac

SEQ ID NO: 6512652 - DNA, 21 bp, Homo sapiens
tgctcacacaatcagaccaag

SEQ ID NO: 6512653 - DNA, 16 bp, Homo sapiens
tgctcacacattacaa

SEQ ID NO: 6512654 - DNA, 19 bp, Homo sapiens
tgctcacactccacatccc

SEQ ID NO: 6512655 - DNA, 14 bp, Homo sapiens
tgctcacaggcagg

SEQ ID NO: 6512656 - DNA, 17 bp, Homo sapiens
tgctcacagggatgctg

SEQ ID NO: 6512657 - DNA, 18 bp, Homo sapiens
tgctcacagggatgctgg

SEQ ID NO: 6512658 - DNA, 15 bp, Homo sapiens
tgctcacagtaaccc

SEQ ID NO: 6512659 - DNA, 15 bp, Homo sapiens
tgctcacagttatta

SEQ ID NO: 6512660 - DNA, 15 bp, Homo sapiens
tgctcacatatctgt

SEQ ID NO: 6512661 - DNA, 14 bp, Homo sapiens
tgctcacatgtctt

SEQ ID NO: 6512662 - DNA, 14 bp, Homo sapiens
tgctcacattccct

SEQ ID NO: 6512663 - DNA, 14 bp, Homo sapiens
tgctcaccagccct

SEQ ID NO: 6512664 - DNA, 20 bp, Homo sapiens
tgctcaccagccctgcagcc

SEQ ID NO: 6512665 - DNA, 13 bp, Homo sapiens
tgctcacccagga

SEQ ID NO: 6512666 - DNA, 20 bp, Homo sapiens
tgctcacccaggacctctgg

SEQ ID NO: 6512667 - DNA, 15 bp, Homo sapiens
tgctcacccattgtc

SEQ ID NO: 6512668 - DNA, 19 bp, Homo sapiens
tgctcacccgtaggcaaat

SEQ ID NO: 6512669 - DNA, 17 bp, Homo sapiens
tgctcaccgactcacct

SEQ ID NO: 6512670 - DNA, 23 bp, Homo sapiens
tgctcaccgcccatcagggttct

SEQ ID NO: 6512671 - DNA, 15 bp, Homo sapiens
tgctcaccgcctgct

SEQ ID NO: 6512672 - DNA, 13 bp, Homo sapiens
tgctcacctctag

SEQ ID NO: 6512673 - DNA, 14 bp, Homo sapiens
tgctcacctctgcc

SEQ ID NO: 6512674 - DNA, 19 bp, Homo sapiens
tgctcacctggaacacctg

SEQ ID NO: 6512675 - DNA, 23 bp, Homo sapiens
tgctcacgactcttcctgcaaag

SEQ ID NO: 6512676 - DNA, 22 bp, Homo sapiens
tgctcacggaccccatgttgga

SEQ ID NO: 6512677 - DNA, 16 bp, Homo sapiens
tgctcacgttaccttg

SEQ ID NO: 6512678 - DNA, 17 bp, Homo sapiens
tgctcactacctcctca

SEQ ID NO: 6512679 - DNA, 21 bp, Homo sapiens
tgctcactacctcctcaggga

SEQ ID NO: 6512680 - DNA, 14 bp, Homo sapiens
tgctcactcaacaa

SEQ ID NO: 6512681 - DNA, 14 bp, Homo sapiens
tgctcactcactca

SEQ ID NO: 6512682 - DNA, 21 bp, Homo sapiens
tgctcactcactcactccaag

SEQ ID NO: 6512683 - DNA, 24 bp, Homo sapiens
tgctcactcactcactccaagacc

SEQ ID NO: 6512684 - DNA, 21 bp, Homo sapiens
tgctcactcccaagggacagc

SEQ ID NO: 6512685 - DNA, 13 bp, Homo sapiens
tgctcactcccta

SEQ ID NO: 6512686 - DNA, 15 bp, Homo sapiens
tgctcactttaaacc

SEQ ID NO: 6512687 - DNA, 14 bp, Homo sapiens
tgctcactttatta

SEQ ID NO: 6512688 - DNA, 22 bp, Homo sapiens
tgctcagaacttgctgctgtct

SEQ ID NO: 6512689 - DNA, 14 bp, Homo sapiens
tgctcagaagggct

SEQ ID NO: 6512690 - DNA, 19 bp, Homo sapiens
tgctcagagctttaaaagt

SEQ ID NO: 6512691 - DNA, 17 bp, Homo sapiens
tgctcagaggccttgct

SEQ ID NO: 6512692 - DNA, 21 bp, Homo sapiens
tgctcagaggggccccggtcc

SEQ ID NO: 6512693 - DNA, 17 bp, Homo sapiens
tgctcagatagatctgt

SEQ ID NO: 6512694 - DNA, 22 bp, Homo sapiens
tgctcagatgctggtcatcctg

SEQ ID NO: 6512695 - DNA, 21 bp, Homo sapiens
tgctcagattccccccatctc

SEQ ID NO: 6512696 - DNA, 21 bp, Homo sapiens
tgctcagcaattcagacccct

SEQ ID NO: 6512697 - DNA, 19 bp, Homo sapiens
tgctcagcacactctcctg

SEQ ID NO: 6512698 - DNA, 12 bp, Homo sapiens
tgctcagcagcc

SEQ ID NO: 6512699 - DNA, 13 bp, Homo sapiens
tgctcagcagcca

SEQ ID NO: 6512700 - DNA, 14 bp, Homo sapiens
tgctcagcagccag

SEQ ID NO: 6512701 - DNA, 12 bp, Homo sapiens
tgctcagcagct

SEQ ID NO: 6512702 - DNA, 18 bp, Homo sapiens
tgctcagccaaatttcct

SEQ ID NO: 6512703 - DNA, 19 bp, Homo sapiens
tgctcagcccatcccctgc

SEQ ID NO: 6512704 - DNA, 21 bp, Homo sapiens
tgctcagccccagacctgccg

SEQ ID NO: 6512705 - DNA, 21 bp, Homo sapiens
tgctcagcccgcttggccacc

SEQ ID NO: 6512706 - DNA, 17 bp, Homo sapiens
tgctcagccctgactgg

SEQ ID NO: 6512707 - DNA, 22 bp, Homo sapiens
tgctcagccctgactggtgcta

SEQ ID NO: 6512708 - DNA, 16 bp, Homo sapiens
tgctcagccctgagga

SEQ ID NO: 6512709 - DNA, 13 bp, Homo sapiens
tgctcagccctgc

SEQ ID NO: 6512710 - DNA, 16 bp, Homo sapiens
tgctcagccctggagg

SEQ ID NO: 6512711 - DNA, 20 bp, Homo sapiens
tgctcagccctggaggtgcc

SEQ ID NO: 6512712 - DNA, 22 bp, Homo sapiens
tgctcagcctcatcctgagaga

SEQ ID NO: 6512713 - DNA, 14 bp, Homo sapiens
tgctcagccttgct

SEQ ID NO: 6512714 - DNA, 17 bp, Homo sapiens
tgctcagccttgctgct

SEQ ID NO: 6512715 - DNA, 18 bp, Homo sapiens
tgctcagccttgctgctc

SEQ ID NO: 6512716 - DNA, 20 bp, Homo sapiens
tgctcagccttgctgctctg

SEQ ID NO: 6512717 - DNA, 23 bp, Homo sapiens
tgctcagccttgctgctctgcgt

SEQ ID NO: 6512718 - DNA, 20 bp, Homo sapiens
tgctcagctgtcaaggctca

SEQ ID NO: 6512719 - DNA, 21 bp, Homo sapiens
tgctcagcttctcctgtgtga

SEQ ID NO: 6512720 - DNA, 17 bp, Homo sapiens
tgctcaggaattgaaga

SEQ ID NO: 6512721 - DNA, 18 bp, Homo sapiens
tgctcaggagccctggga

SEQ ID NO: 6512722 - DNA, 13 bp, Homo sapiens
tgctcaggccggg

SEQ ID NO: 6512723 - DNA, 16 bp, Homo sapiens
tgctcaggcctcacct

SEQ ID NO: 6512724 - DNA, 17 bp, Homo sapiens
tgctcaggcctcacctc

SEQ ID NO: 6512725 - DNA, 20 bp, Homo sapiens
tgctcaggcctcacctggct

SEQ ID NO: 6512726 - DNA, 21 bp, Homo sapiens
tgctcaggcctcacctggctt

SEQ ID NO: 6512727 - DNA, 23 bp, Homo sapiens
tgctcaggctccccaagacttga

SEQ ID NO: 6512728 - DNA, 12 bp, Homo sapiens
tgctcaggctgc

SEQ ID NO: 6512729 - DNA, 19 bp, Homo sapiens
tgctcaggctgcagctgga

SEQ ID NO: 6512730 - DNA, 20 bp, Homo sapiens
tgctcaggctgcagctggac

SEQ ID NO: 6512731 - DNA, 21 bp, Homo sapiens
tgctcagggaaaagcagctct

SEQ ID NO: 6512732 - DNA, 16 bp, Homo sapiens
tgctcagggtcaattt

SEQ ID NO: 6512733 - DNA, 20 bp, Homo sapiens
tgctcagggtcaatttcttt

SEQ ID NO: 6512734 - DNA, 16 bp, Homo sapiens
tgctcagggtcactga

SEQ ID NO: 6512735 - DNA, 18 bp, Homo sapiens
tgctcagggtcactgaac

SEQ ID NO: 6512736 - DNA, 18 bp, Homo sapiens
tgctcaggtacagagaag

SEQ ID NO: 6512737 - DNA, 14 bp, Homo sapiens
tgctcagtctccct

SEQ ID NO: 6512738 - DNA, 16 bp, Homo sapiens
tgctcagtctcccttt

SEQ ID NO: 6512739 - DNA, 13 bp, Homo sapiens
tgctcagtggatc

SEQ ID NO: 6512740 - DNA, 17 bp, Homo sapiens
tgctcagtgtccagctt

SEQ ID NO: 6512741 - DNA, 14 bp, Homo sapiens
tgttactaagtttt

SEQ ID NO: 6512742 - DNA, 17 bp, Homo sapiens
tgttactaatgatcact

SEQ ID NO: 6512743 - DNA, 14 bp, Homo sapiens
tgttactatggtaa

SEQ ID NO: 6512744 - DNA, 19 bp, Homo sapiens
tgttactcatcgggcccag

SEQ ID NO: 6512745 - DNA, 19 bp, Homo sapiens
tgttactccaaaaagaaat

SEQ ID NO: 6512746 - DNA, 19 bp, Homo sapiens
tgttactccattactgtga

SEQ ID NO: 6512747 - DNA, 15 bp, Homo sapiens
tgttactccctgtta

SEQ ID NO: 6512748 - DNA, 15 bp, Homo sapiens
tgttactgaccagca

SEQ ID NO: 6512749 - DNA, 13 bp, Homo sapiens
tgttactgatcat

SEQ ID NO: 6512750 - DNA, 20 bp, Homo sapiens
tgttactgatcatgcattgt

SEQ ID NO: 6512751 - DNA, 14 bp, Homo sapiens
tgttactgcagttg

SEQ ID NO: 6512752 - DNA, 14 bp, Homo sapiens
tgttactgccaaaa

SEQ ID NO: 6512753 - DNA, 21 bp, Homo sapiens
tgttactgccaaaaccaaatt

SEQ ID NO: 6512754 - DNA, 22 bp, Homo sapiens
tgttactgccaaaaccaaattg

SEQ ID NO: 6512755 - DNA, 23 bp, Homo sapiens
tgttactgccaaaaccaaattga

SEQ ID NO: 6512756 - DNA, 12 bp, Homo sapiens
tgttactgcttc

SEQ ID NO: 6512757 - DNA, 15 bp, Homo sapiens
tgttactgcttcatt

SEQ ID NO: 6512758 - DNA, 15 bp, Homo sapiens
tgttactgcttctct

SEQ ID NO: 6512759 - DNA, 13 bp, Homo sapiens
tgttactgctttg

SEQ ID NO: 6512760 - DNA, 15 bp, Homo sapiens
tgttactgggccctg

SEQ ID NO: 6512761 - DNA, 16 bp, Homo sapiens
tgttactgtcattccc

SEQ ID NO: 6512762 - DNA, 17 bp, Homo sapiens
tgttactgtcattccca

SEQ ID NO: 6512763 - DNA, 17 bp, Homo sapiens
tgttactgtccaccctc

SEQ ID NO: 6512764 - DNA, 16 bp, Homo sapiens
tgttactgtctgtagt

SEQ ID NO: 6512765 - DNA, 17 bp, Homo sapiens
tgttactgtctgtagtg

SEQ ID NO: 6512766 - DNA, 18 bp, Homo sapiens
tgttactgttaaccattt

SEQ ID NO: 6512767 - DNA, 13 bp, Homo sapiens
tgttactgttctt

SEQ ID NO: 6512768 - DNA, 14 bp, Homo sapiens
tgttactgttcttg

SEQ ID NO: 6512769 - DNA, 22 bp, Homo sapiens
tgttactgttcttgctgctaga

SEQ ID NO: 6512770 - DNA, 14 bp, Homo sapiens
tgttacttaaacat

SEQ ID NO: 6512771 - DNA, 16 bp, Homo sapiens
tgttacttaaatagca

SEQ ID NO: 6512772 - DNA, 14 bp, Homo sapiens
tgttacttccttat

SEQ ID NO: 6512773 - DNA, 14 bp, Homo sapiens
tgttacttctctaa

SEQ ID NO: 6512774 - DNA, 14 bp, Homo sapiens
tgttacttctctga

SEQ ID NO: 6512775 - DNA, 15 bp, Homo sapiens
tgttactttatacag

SEQ ID NO: 6512776 - DNA, 22 bp, Homo sapiens
tgttactttctttcagatgttt

SEQ ID NO: 6512777 - DNA, 17 bp, Homo sapiens
tgttactttttagtctt

SEQ ID NO: 6512778 - DNA, 17 bp, Homo sapiens
tgttagaaaaaactgga

SEQ ID NO: 6512779 - DNA, 17 bp, Homo sapiens
tgttagaaaacaaaatt

SEQ ID NO: 6512780 - DNA, 17 bp, Homo sapiens
tgttagaaaatgactta

SEQ ID NO: 6512781 - DNA, 21 bp, Homo sapiens
tgttagaacactattttcaga

SEQ ID NO: 6512782 - DNA, 17 bp, Homo sapiens
tgttagaacctagattc

SEQ ID NO: 6512783 - DNA, 20 bp, Homo sapiens
tgttagaagaagaggaagaa

SEQ ID NO: 6512784 - DNA, 18 bp, Homo sapiens
tgttagaataattttatt

SEQ ID NO: 6512785 - DNA, 17 bp, Homo sapiens
tgttagaatcaaatact

SEQ ID NO: 6512786 - DNA, 15 bp, Homo sapiens
tgttagaattgattt

SEQ ID NO: 6512787 - DNA, 15 bp, Homo sapiens
tgttagactcatggt

SEQ ID NO: 6512788 - DNA, 18 bp, Homo sapiens
tgttagactcttactttt

SEQ ID NO: 6512789 - DNA, 18 bp, Homo sapiens
tgttagacttgctccctc

SEQ ID NO: 6512790 - DNA, 18 bp, Homo sapiens
tgttagagacttttttct

SEQ ID NO: 6512791 - DNA, 21 bp, Homo sapiens
tgttagagacttttttctagt

SEQ ID NO: 6512792 - DNA, 14 bp, Homo sapiens
tgttagagagcttt

SEQ ID NO: 6512793 - DNA, 12 bp, Homo sapiens
tgttagagaggt

SEQ ID NO: 6512794 - DNA, 17 bp, Homo sapiens
tgttagagagtataact

SEQ ID NO: 6512795 - DNA, 11 bp, Homo sapiens
tgttagagcac

SEQ ID NO: 6512796 - DNA, 22 bp, Homo sapiens
tgttagaggatccctctctgga

SEQ ID NO: 6512797 - DNA, 23 bp, Homo sapiens
tgttagagtccaacgtggggcag

SEQ ID NO: 6512798 - DNA, 20 bp, Homo sapiens
tgttagatatttttcataaa

SEQ ID NO: 6512799 - DNA, 12 bp, Homo sapiens
tgttagatgttt

SEQ ID NO: 6512800 - DNA, 20 bp, Homo sapiens
tgttagattaggtgtaagac

SEQ ID NO: 6512801 - DNA, 23 bp, Homo sapiens
tgttagcaaatgacagatttctg

SEQ ID NO: 6512802 - DNA, 19 bp, Homo sapiens
tgttagcactgatagtcct

SEQ ID NO: 6512803 - DNA, 12 bp, Homo sapiens
tgttagcagagt

SEQ ID NO: 6512804 - DNA, 14 bp, Homo sapiens
tgttagcagagtct

SEQ ID NO: 6512805 - DNA, 17 bp, Homo sapiens
tgttagcagagtctgtc

SEQ ID NO: 6512806 - DNA, 18 bp, Homo sapiens
tgttagcagagtctgtct

SEQ ID NO: 6512807 - DNA, 21 bp, Homo sapiens
tgttagcagagtctgtctctt

SEQ ID NO: 6512808 - DNA, 15 bp, Homo sapiens
tgttagcattattgc

SEQ ID NO: 6512809 - DNA, 18 bp, Homo sapiens
tgttagccaacttcaaga

SEQ ID NO: 6512810 - DNA, 16 bp, Homo sapiens
tgttagcctgcaaaca

SEQ ID NO: 6512811 - DNA, 12 bp, Homo sapiens
tgttagccttag

SEQ ID NO: 6512812 - DNA, 14 bp, Homo sapiens
tgttagccttagac

SEQ ID NO: 6512813 - DNA, 19 bp, Homo sapiens
tgttagccttttttcccca

SEQ ID NO: 6512814 - DNA, 15 bp, Homo sapiens
tgttagctcagagga

SEQ ID NO: 6512815 - DNA, 19 bp, Homo sapiens
tgttagcttaatcttaatg

SEQ ID NO: 6512816 - DNA, 20 bp, Homo sapiens
tgttagcttccttaagtata

SEQ ID NO: 6512817 - DNA, 14 bp, Homo sapiens
tgttagctttccaa

SEQ ID NO: 6512818 - DNA, 18 bp, Homo sapiens
tgttagcttttaccttaa

SEQ ID NO: 6512819 - DNA, 16 bp, Homo sapiens
tgttaggaaaatttca

SEQ ID NO: 6512820 - DNA, 17 bp, Homo sapiens
tgttaggaacagcagtg

SEQ ID NO: 6512821 - DNA, 18 bp, Homo sapiens
tgttaggaacagcagtgt

SEQ ID NO: 6512822 - DNA, 22 bp, Homo sapiens
tgttaggacagcaaagcagcag

SEQ ID NO: 6512823 - DNA, 19 bp, Homo sapiens
tgttaggaggctgcatgct

SEQ ID NO: 6512824 - DNA, 23 bp, Homo sapiens
tgttaggaggctgcatgctctgg

SEQ ID NO: 6512825 - DNA, 18 bp, Homo sapiens
tgttaggcatgtcccacc

SEQ ID NO: 6512826 - DNA, 20 bp, Homo sapiens
tgttaggcatgtcccaccca

SEQ ID NO: 6512827 - DNA, 20 bp, Homo sapiens
tgttaggcctggcacagtgt

SEQ ID NO: 6512828 - DNA, 14 bp, Homo sapiens
tgttagggattcct

SEQ ID NO: 6512829 - DNA, 20 bp, Homo sapiens
tgttagggattccttccaat

SEQ ID NO: 6512830 - DNA, 18 bp, Homo sapiens
tgttaggggccaataaaa

SEQ ID NO: 6512831 - DNA, 22 bp, Homo sapiens
tgttaggggccaataaaatgta

SEQ ID NO: 6512832 - DNA, 23 bp, Homo sapiens
tgttaggggccaataaaatgtat

SEQ ID NO: 6512833 - DNA, 21 bp, Homo sapiens
tgttagggtataagttgctgt

SEQ ID NO: 6512834 - DNA, 22 bp, Homo sapiens
tgttagggtataagttgctgta

SEQ ID NO: 6512835 - DNA, 23 bp, Homo sapiens
tgttagggtataagttgctgtaa

SEQ ID NO: 6512836 - DNA, 17 bp, Homo sapiens
tgttaggtctcatgccc

SEQ ID NO: 6512837 - DNA, 23 bp, Homo sapiens
tgttagtaaataaaattaacaaa

SEQ ID NO: 6512838 - DNA, 14 bp, Homo sapiens
tgttagtaatacct

SEQ ID NO: 6512839 - DNA, 22 bp, Homo sapiens
tgttagtactatatctgtttta

SEQ ID NO: 6512840 - DNA, 19 bp, Homo sapiens
tgttagtatgaggcatttg

SEQ ID NO: 6512841 - DNA, 15 bp, Homo sapiens
tgttagtattaacta

SEQ ID NO: 6512842 - DNA, 17 bp, Homo sapiens
tgttagtattgattcaa

SEQ ID NO: 6512843 - DNA, 15 bp, Homo sapiens
tgttagtattttaat

SEQ ID NO: 6512844 - DNA, 18 bp, Homo sapiens
tgttagtattttaatcct

SEQ ID NO: 6512845 - DNA, 15 bp, Homo sapiens
tgttagtcatttgct

SEQ ID NO: 6512846 - DNA, 18 bp, Homo sapiens
tgttagtgacagagccca

SEQ ID NO: 6512847 - DNA, 16 bp, Homo sapiens
tgttagtgatttgcta

SEQ ID NO: 6512848 - DNA, 14 bp, Homo sapiens
tgttagtgctggtc

SEQ ID NO: 6512849 - DNA, 16 bp, Homo sapiens
tgttagtgctggtcag

SEQ ID NO: 6512850 - DNA, 21 bp, Homo sapiens
tgttagtgctggtcagagaga

SEQ ID NO: 6512851 - DNA, 15 bp, Homo sapiens
tgttagtgtgtgtgc

SEQ ID NO: 6512852 - DNA, 20 bp, Homo sapiens
tgttagtgtgtgtgcatgtg

SEQ ID NO: 6512853 - DNA, 14 bp, Homo sapiens
tgttagttaagttt

SEQ ID NO: 6512854 - DNA, 11 bp, Homo sapiens
tgttagttata

SEQ ID NO: 6512855 - DNA, 12 bp, Homo sapiens
tgttagttccca

SEQ ID NO: 6512856 - DNA, 13 bp, Homo sapiens
tgttagttcccaa

SEQ ID NO: 6512857 - DNA, 14 bp, Homo sapiens
tgttagttcccaac

SEQ ID NO: 6512858 - DNA, 16 bp, Homo sapiens
tgttagtttagtgtgt

SEQ ID NO: 6512859 - DNA, 14 bp, Homo sapiens
tgttagtttcttgg

SEQ ID NO: 6512860 - DNA, 20 bp, Homo sapiens
tgttagttttgctccttctg

SEQ ID NO: 6512861 - DNA, 12 bp, Homo sapiens
tgttagttttgt

SEQ ID NO: 6512862 - DNA, 23 bp, Homo sapiens
tgttagttttgtaaaaactgaag

SEQ ID NO: 6512863 - DNA, 22 bp, Homo sapiens
tgttataaaataatgtactgaa

SEQ ID NO: 6512864 - DNA, 14 bp, Homo sapiens
tgttataaaatctg

SEQ ID NO: 6512865 - DNA, 20 bp, Homo sapiens
tgttataaaatctgtattgc

SEQ ID NO: 6512866 - DNA, 17 bp, Homo sapiens
tgttataaagacacatg

SEQ ID NO: 6512867 - DNA, 13 bp, Homo sapiens
tgttataaataaa

SEQ ID NO: 6512868 - DNA, 14 bp, Homo sapiens
tgttataactactc

SEQ ID NO: 6512869 - DNA, 18 bp, Homo sapiens
tgttataactctgcacta

SEQ ID NO: 6512870 - DNA, 15 bp, Homo sapiens
tgttataatctttca

SEQ ID NO: 6512871 - DNA, 21 bp, Homo sapiens
tgttatacaaccttcatttaa

SEQ ID NO: 6512872 - DNA, 21 bp, Homo sapiens
tgttatacatcaatatgtata

SEQ ID NO: 6512873 - DNA, 14 bp, Homo sapiens
tgttatacttcaaa

SEQ ID NO: 6512874 - DNA, 15 bp, Homo sapiens
tgttatagaatactt

SEQ ID NO: 6512875 - DNA, 17 bp, Homo sapiens
tgttatagattgtctta

SEQ ID NO: 6512876 - DNA, 13 bp, Homo sapiens
tgttatatataaa

SEQ ID NO: 6512877 - DNA, 18 bp, Homo sapiens
tgttatatataaatatat

SEQ ID NO: 6512878 - DNA, 15 bp, Homo sapiens
tgttatatataataa

SEQ ID NO: 6512879 - DNA, 18 bp, Homo sapiens
tgttatatataataaata

SEQ ID NO: 6512880 - DNA, 15 bp, Homo sapiens
tgttatatcatatgt

SEQ ID NO: 6512881 - DNA, 17 bp, Homo sapiens
tgttatatcatatgtat

SEQ ID NO: 6512882 - DNA, 22 bp, Homo sapiens
tgttatatcctgacaagattat

SEQ ID NO: 6512883 - DNA, 15 bp, Homo sapiens
tgttatatgaacata

SEQ ID NO: 6512884 - DNA, 16 bp, Homo sapiens
tgttatattaagcaga

SEQ ID NO: 6512885 - DNA, 18 bp, Homo sapiens
tgttatattcattcttta

SEQ ID NO: 6512886 - DNA, 17 bp, Homo sapiens
tgttatattccaaggaa

SEQ ID NO: 6512887 - DNA, 19 bp, Homo sapiens
tgttatattccaaggaaaa

SEQ ID NO: 6512888 - DNA, 21 bp, Homo sapiens
tgttatattccaaggaaaatt

SEQ ID NO: 6512889 - DNA, 22 bp, Homo sapiens
tgttatattccaaggaaaattg

SEQ ID NO: 6512890 - DNA, 21 bp, Homo sapiens
tgttatattgcttcctgtgta

SEQ ID NO: 6512891 - DNA, 18 bp, Homo sapiens
tgttatatttaatgcatt

SEQ ID NO: 6512892 - DNA, 19 bp, Homo sapiens
tgttatatttaatgcatta

SEQ ID NO: 6512893 - DNA, 23 bp, Homo sapiens
tgttatatttaatgcattaaacc

SEQ ID NO: 6512894 - DNA, 14 bp, Homo sapiens
tgttatatttttct

SEQ ID NO: 6512895 - DNA, 22 bp, Homo sapiens
tgttatcaaacaccaacataaa

SEQ ID NO: 6512896 - DNA, 22 bp, Homo sapiens
tgttatcaccttccaaacaaaa

SEQ ID NO: 6512897 - DNA, 14 bp, Homo sapiens
tgttatcagctttc

SEQ ID NO: 6512898 - DNA, 20 bp, Homo sapiens
tgttatcagtacaattcttt

SEQ ID NO: 6512899 - DNA, 13 bp, Homo sapiens
tgttatcattttt

SEQ ID NO: 6512900 - DNA, 18 bp, Homo sapiens
tgttatcattttttcctg

SEQ ID NO: 6512901 - DNA, 20 bp, Homo sapiens
tgttatcccaagaccctgcc

SEQ ID NO: 6512902 - DNA, 13 bp, Homo sapiens
tgttatcctattt

SEQ ID NO: 6512903 - DNA, 20 bp, Homo sapiens
tgttatcctcttgtatactt

SEQ ID NO: 6512904 - DNA, 23 bp, Homo sapiens
tgttatcctgctagctgtagaaa

SEQ ID NO: 6512905 - DNA, 19 bp, Homo sapiens
tgttatccttgtttcctta

SEQ ID NO: 6512906 - DNA, 23 bp, Homo sapiens
tgttatcggacattctaatgcat

SEQ ID NO: 6512907 - DNA, 19 bp, Homo sapiens
tgttatcggctctattctc

SEQ ID NO: 6512908 - DNA, 21 bp, Homo sapiens
tgttatcggctctattctcta

SEQ ID NO: 6512909 - DNA, 16 bp, Homo sapiens
tgttatctaatacaaa

SEQ ID NO: 6512910 - DNA, 16 bp, Homo sapiens
tgttatctgtctttat

SEQ ID NO: 6512911 - DNA, 18 bp, Homo sapiens
tgttatctgtttgagaaa

SEQ ID NO: 6512912 - DNA, 19 bp, Homo sapiens
tgttatctgtttgagaaag

SEQ ID NO: 6512913 - DNA, 19 bp, Homo sapiens
tgttatcttatactgtaca

SEQ ID NO: 6512914 - DNA, 21 bp, Homo sapiens
tgttatcttatactgtacaat

SEQ ID NO: 6512915 - DNA, 15 bp, Homo sapiens
tgttatgaaaatcct

SEQ ID NO: 6512916 - DNA, 23 bp, Homo sapiens
tgttatgaaaatcctatatctgt

SEQ ID NO: 6512917 - DNA, 20 bp, Homo sapiens
tgttatgaacagctgtgtct

SEQ ID NO: 6512918 - DNA, 15 bp, Homo sapiens
tgttatgaacatcca

SEQ ID NO: 6512919 - DNA, 14 bp, Homo sapiens
tgttatgaatctgt

SEQ ID NO: 6512920 - DNA, 15 bp, Homo sapiens
tgctcagtgtgtaat

SEQ ID NO: 6512921 - DNA, 20 bp, Homo sapiens
tgctcagttgctaaacactg

SEQ ID NO: 6512922 - DNA, 14 bp, Homo sapiens
tgctcagttgtact

SEQ ID NO: 6512923 - DNA, 16 bp, Homo sapiens
tgctcagttgtacttt

SEQ ID NO: 6512924 - DNA, 19 bp, Homo sapiens
tgctcagttgtacttttta

SEQ ID NO: 6512925 - DNA, 15 bp, Homo sapiens
tgctcagttgtagaa

SEQ ID NO: 6512926 - DNA, 13 bp, Homo sapiens
tgctcataaattg

SEQ ID NO: 6512927 - DNA, 19 bp, Homo sapiens
tgctcataagtaaatgtct

SEQ ID NO: 6512928 - DNA, 21 bp, Homo sapiens
tgctcatagcgggcgctgcca

SEQ ID NO: 6512929 - DNA, 15 bp, Homo sapiens
tgctcataggacctg

SEQ ID NO: 6512930 - DNA, 21 bp, Homo sapiens
tgctcatattgtgattctgcc

SEQ ID NO: 6512931 - DNA, 22 bp, Homo sapiens
tgctcatattgtgattctgcct

SEQ ID NO: 6512932 - DNA, 14 bp, Homo sapiens
tgctcatatttccc

SEQ ID NO: 6512933 - DNA, 15 bp, Homo sapiens
tgctcatatttccca

SEQ ID NO: 6512934 - DNA, 24 bp, Homo sapiens
tgctcatatttcccatgatttcat

SEQ ID NO: 6512935 - DNA, 23 bp, Homo sapiens
tgctcatcacccggatagaggac

SEQ ID NO: 6512936 - DNA, 15 bp, Homo sapiens
tgctcatcattctct

SEQ ID NO: 6512937 - DNA, 17 bp, Homo sapiens
tgctcatcggagactgc

SEQ ID NO: 6512938 - DNA, 14 bp, Homo sapiens
tgctcatctacaca

SEQ ID NO: 6512939 - DNA, 17 bp, Homo sapiens
tgctcatctacacatat

SEQ ID NO: 6512940 - DNA, 21 bp, Homo sapiens
tgctcatctacacatataaac

SEQ ID NO: 6512941 - DNA, 20 bp, Homo sapiens
tgctcatctcagtcctcaaa

SEQ ID NO: 6512942 - DNA, 16 bp, Homo sapiens
tgctcatctgtacata

SEQ ID NO: 6512943 - DNA, 18 bp, Homo sapiens
tgctcatctgtacatact

SEQ ID NO: 6512944 - DNA, 20 bp, Homo sapiens
tgctcatgagctcctgatca

SEQ ID NO: 6512945 - DNA, 15 bp, Homo sapiens
tgctcatgccctgcc

SEQ ID NO: 6512946 - DNA, 19 bp, Homo sapiens
tgctcatgggctgtgtgat

SEQ ID NO: 6512947 - DNA, 13 bp, Homo sapiens
tgctcatgggtgg

SEQ ID NO: 6512948 - DNA, 21 bp, Homo sapiens
tgctcatgtccctgtccccag

SEQ ID NO: 6512949 - DNA, 23 bp, Homo sapiens
tgctcattaaactgattccagga

SEQ ID NO: 6512950 - DNA, 15 bp, Homo sapiens
tgctcattaattttg

SEQ ID NO: 6512951 - DNA, 16 bp, Homo sapiens
tgctcattacagttct

SEQ ID NO: 6512952 - DNA, 18 bp, Homo sapiens
tgctcattacagttcttt

SEQ ID NO: 6512953 - DNA, 19 bp, Homo sapiens
tgctcattacagttctttc

SEQ ID NO: 6512954 - DNA, 20 bp, Homo sapiens
tgctcattacagttctttcc

SEQ ID NO: 6512955 - DNA, 23 bp, Homo sapiens
tgctcattctaatgatggcccat

SEQ ID NO: 6512956 - DNA, 15 bp, Homo sapiens
tgctcattcttcagt

SEQ ID NO: 6512957 - DNA, 18 bp, Homo sapiens
tgctcattcttcagttct

SEQ ID NO: 6512958 - DNA, 19 bp, Homo sapiens
tgctcattcttcagttctc

SEQ ID NO: 6512959 - DNA, 14 bp, Homo sapiens
tgctcattcttgag

SEQ ID NO: 6512960 - DNA, 17 bp, Homo sapiens
tgctcattcttgaggag

SEQ ID NO: 6512961 - DNA, 19 bp, Homo sapiens
tgctcattcttgaggagca

SEQ ID NO: 6512962 - DNA, 16 bp, Homo sapiens
tgctcattgctaacca

SEQ ID NO: 6512963 - DNA, 16 bp, Homo sapiens
tgctcattgtggccag

SEQ ID NO: 6512964 - DNA, 14 bp, Homo sapiens
tgctcatttcatgg

SEQ ID NO: 6512965 - DNA, 21 bp, Homo sapiens
tgctcattttctggtttggca

SEQ ID NO: 6512966 - DNA, 14 bp, Homo sapiens
tgctccaaatataa

SEQ ID NO: 6512967 - DNA, 14 bp, Homo sapiens
tgctccaaatgtct

SEQ ID NO: 6512968 - DNA, 18 bp, Homo sapiens
tgctccaaatgtctactg

SEQ ID NO: 6512969 - DNA, 18 bp, Homo sapiens
tgctccaacagacaccct

SEQ ID NO: 6512970 - DNA, 19 bp, Homo sapiens
tgctccaacagacaccctc

SEQ ID NO: 6512971 - DNA, 13 bp, Homo sapiens
tgctccaacctga

SEQ ID NO: 6512972 - DNA, 16 bp, Homo sapiens
tgctccaacctgaagg

SEQ ID NO: 6512973 - DNA, 19 bp, Homo sapiens
tgctccaagattctagatg

SEQ ID NO: 6512974 - DNA, 13 bp, Homo sapiens
tgctccaagggac

SEQ ID NO: 6512975 - DNA, 22 bp, Homo sapiens
tgctccaagggaccctttgcct

SEQ ID NO: 6512976 - DNA, 18 bp, Homo sapiens
tgctccaataaaggaaca

SEQ ID NO: 6512977 - DNA, 17 bp, Homo sapiens
tgctccaatgactgagc

SEQ ID NO: 6512978 - DNA, 16 bp, Homo sapiens
tgctccaccagcagca

SEQ ID NO: 6512979 - DNA, 17 bp, Homo sapiens
tgctccaccccactcac

SEQ ID NO: 6512980 - DNA, 18 bp, Homo sapiens
tgctccaccctcccccag

SEQ ID NO: 6512981 - DNA, 17 bp, Homo sapiens
tgctccacccttggcct

SEQ ID NO: 6512982 - DNA, 21 bp, Homo sapiens
tgctccacgaagccttaagcc

SEQ ID NO: 6512983 - DNA, 20 bp, Homo sapiens
tgctccagaagatgccagct

SEQ ID NO: 6512984 - DNA, 14 bp, Homo sapiens
tgctccagaattaa

SEQ ID NO: 6512985 - DNA, 21 bp, Homo sapiens
tgctccagaatttggaaatcc

SEQ ID NO: 6512986 - DNA, 12 bp, Homo sapiens
tgctccagacct

SEQ ID NO: 6512987 - DNA, 21 bp, Homo sapiens
tgctccagacctgcccctccc

SEQ ID NO: 6512988 - DNA, 23 bp, Homo sapiens
tgctccagataactctctttcct

SEQ ID NO: 6512989 - DNA, 12 bp, Homo sapiens
tgctccagatcc

SEQ ID NO: 6512990 - DNA, 17 bp, Homo sapiens
tgctccagatcctcttt

SEQ ID NO: 6512991 - DNA, 20 bp, Homo sapiens
tgctccagatcctctttccc

SEQ ID NO: 6512992 - DNA, 15 bp, Homo sapiens
tgctccagattctga

SEQ ID NO: 6512993 - DNA, 18 bp, Homo sapiens
tgctccagattctgatgc

SEQ ID NO: 6512994 - DNA, 18 bp, Homo sapiens
tgctccagcaactgccct

SEQ ID NO: 6512995 - DNA, 22 bp, Homo sapiens
tgctccagcaactgcccttcca

SEQ ID NO: 6512996 - DNA, 14 bp, Homo sapiens
tgctccagcactca

SEQ ID NO: 6512997 - DNA, 13 bp, Homo sapiens
tgctccagcagca

SEQ ID NO: 6512998 - DNA, 19 bp, Homo sapiens
tgctccagcagcacacctc

SEQ ID NO: 6512999 - DNA, 12 bp, Homo sapiens
tgctccagcagt

SEQ ID NO: 6513000 - DNA, 15 bp, Homo sapiens
tgctccagccaaccc

SEQ ID NO: 6513001 - DNA, 22 bp, Homo sapiens
tgctccagccaacccctgtgga

SEQ ID NO: 6513002 - DNA, 12 bp, Homo sapiens
tgctccagcccc

SEQ ID NO: 6513003 - DNA, 21 bp, Homo sapiens
tgctccagcccctttgcctct

SEQ ID NO: 6513004 - DNA, 22 bp, Homo sapiens
tgctccagcccctttgcctctg

SEQ ID NO: 6513005 - DNA, 14 bp, Homo sapiens
tgctccagcctctg

SEQ ID NO: 6513006 - DNA, 20 bp, Homo sapiens
tgctccagcctctgccgctg

SEQ ID NO: 6513007 - DNA, 14 bp, Homo sapiens
tgctccagcctgac

SEQ ID NO: 6513008 - DNA, 21 bp, Homo sapiens
tgctccagcctgacaacagcc

SEQ ID NO: 6513009 - DNA, 16 bp, Homo sapiens
tgctccagcctggctc

SEQ ID NO: 6513010 - DNA, 17 bp, Homo sapiens
tgctccagcctggctcc

SEQ ID NO: 6513011 - DNA, 17 bp, Homo sapiens
tgctccagctctggcat

SEQ ID NO: 6513012 - DNA, 21 bp, Homo sapiens
tgctccagctgttcagctggt

SEQ ID NO: 6513013 - DNA, 18 bp, Homo sapiens
tgctccaggcctgcagca

SEQ ID NO: 6513014 - DNA, 20 bp, Homo sapiens
tgctccaggcctgcagcagg

SEQ ID NO: 6513015 - DNA, 18 bp, Homo sapiens
tgctccaggcttcctgcc

SEQ ID NO: 6513016 - DNA, 22 bp, Homo sapiens
tgctccaggcttcctgccctag

SEQ ID NO: 6513017 - DNA, 19 bp, Homo sapiens
tgctccagggatgattcaa

SEQ ID NO: 6513018 - DNA, 15 bp, Homo sapiens
tgctccagggcagcc

SEQ ID NO: 6513019 - DNA, 16 bp, Homo sapiens
tgctccagggtcaggc

SEQ ID NO: 6513020 - DNA, 14 bp, Homo sapiens
tgctccagggtctt

SEQ ID NO: 6513021 - DNA, 16 bp, Homo sapiens
tgctccagggtcttgg

SEQ ID NO: 6513022 - DNA, 14 bp, Homo sapiens
tgctccagtataaa

SEQ ID NO: 6513023 - DNA, 18 bp, Homo sapiens
tgctccagtataaattac

SEQ ID NO: 6513024 - DNA, 18 bp, Homo sapiens
tgctccagtttcacctct

SEQ ID NO: 6513025 - DNA, 17 bp, Homo sapiens
tgctccataccttttct

SEQ ID NO: 6513026 - DNA, 23 bp, Homo sapiens
tgctccatagacatcagtattct

SEQ ID NO: 6513027 - DNA, 17 bp, Homo sapiens
tgctccatccccctgcc

SEQ ID NO: 6513028 - DNA, 15 bp, Homo sapiens
tgctccatcctttgt

SEQ ID NO: 6513029 - DNA, 13 bp, Homo sapiens
tgctccatgcaca

SEQ ID NO: 6513030 - DNA, 18 bp, Homo sapiens
tgctccatgcacaggaaa

SEQ ID NO: 6513031 - DNA, 22 bp, Homo sapiens
tgctccatgcagatctagccag

SEQ ID NO: 6513032 - DNA, 18 bp, Homo sapiens
tgctccattcatacacaa

SEQ ID NO: 6513033 - DNA, 13 bp, Homo sapiens
tgctccattcctg

SEQ ID NO: 6513034 - DNA, 16 bp, Homo sapiens
tgctccattcctgagt

SEQ ID NO: 6513035 - DNA, 13 bp, Homo sapiens
tgctccatttcaa

SEQ ID NO: 6513036 - DNA, 20 bp, Homo sapiens
tgctcccaatggtgcttgga

SEQ ID NO: 6513037 - DNA, 18 bp, Homo sapiens
tgctcccacacttgtgcc

SEQ ID NO: 6513038 - DNA, 21 bp, Homo sapiens
tgctcccacacttgtgccagc

SEQ ID NO: 6513039 - DNA, 23 bp, Homo sapiens
tgctcccacacttgtgccagccc

SEQ ID NO: 6513040 - DNA, 15 bp, Homo sapiens
tgctcccaccccaga

SEQ ID NO: 6513041 - DNA, 21 bp, Homo sapiens
tgctcccaccccagaaatcac

SEQ ID NO: 6513042 - DNA, 14 bp, Homo sapiens
tgctcccacctcct

SEQ ID NO: 6513043 - DNA, 18 bp, Homo sapiens
tgctcccacctggctctg

SEQ ID NO: 6513044 - DNA, 17 bp, Homo sapiens
tgctcccacggggacca

SEQ ID NO: 6513045 - DNA, 21 bp, Homo sapiens
tgctcccacggggaccactgg

SEQ ID NO: 6513046 - DNA, 20 bp, Homo sapiens
tgctcccagcagccctaagg

SEQ ID NO: 6513047 - DNA, 21 bp, Homo sapiens
tgctcccagcagccctaagga

SEQ ID NO: 6513048 - DNA, 14 bp, Homo sapiens
tgctcccagcctgc

SEQ ID NO: 6513049 - DNA, 21 bp, Homo sapiens
tgctcccagcctgctgagagc

SEQ ID NO: 6513050 - DNA, 14 bp, Homo sapiens
tgctcccagctctc

SEQ ID NO: 6513051 - DNA, 13 bp, Homo sapiens
tgctcccagctgt

SEQ ID NO: 6513052 - DNA, 14 bp, Homo sapiens
tgctcccaggatct

SEQ ID NO: 6513053 - DNA, 15 bp, Homo sapiens
tgctcccaggatctc

SEQ ID NO: 6513054 - DNA, 11 bp, Homo sapiens
tgctcccaggc

SEQ ID NO: 6513055 - DNA, 13 bp, Homo sapiens
tgctcccagtgcc

SEQ ID NO: 6513056 - DNA, 17 bp, Homo sapiens
tgctcccagtttcttga

SEQ ID NO: 6513057 - DNA, 15 bp, Homo sapiens
tgctcccatcctcac

SEQ ID NO: 6513058 - DNA, 19 bp, Homo sapiens
tgctcccatcctcacccag

SEQ ID NO: 6513059 - DNA, 20 bp, Homo sapiens
tgctcccatcctcacccaga

SEQ ID NO: 6513060 - DNA, 17 bp, Homo sapiens
tgctcccattcctccct

SEQ ID NO: 6513061 - DNA, 19 bp, Homo sapiens
tgctcccattcctccctcc

SEQ ID NO: 6513062 - DNA, 11 bp, Homo sapiens
tgctccccaca

SEQ ID NO: 6513063 - DNA, 13 bp, Homo sapiens
tgctccccacagc

SEQ ID NO: 6513064 - DNA, 17 bp, Homo sapiens
tgctccccagccctggc

SEQ ID NO: 6513065 - DNA, 16 bp, Homo sapiens
tgctcccccaccccct

SEQ ID NO: 6513066 - DNA, 21 bp, Homo sapiens
tgctcccccaccccctcccca

SEQ ID NO: 6513067 - DNA, 15 bp, Homo sapiens
tgctcccccatcctc

SEQ ID NO: 6513068 - DNA, 20 bp, Homo sapiens
tgctcccccatcctcccctt

SEQ ID NO: 6513069 - DNA, 20 bp, Homo sapiens
tgctcccccattttaacttg

SEQ ID NO: 6513070 - DNA, 23 bp, Homo sapiens
tgctcccctaaagccaggctcag

SEQ ID NO: 6513071 - DNA, 13 bp, Homo sapiens
tgctcccctaacc

SEQ ID NO: 6513072 - DNA, 17 bp, Homo sapiens
tgctcccctacttctca

SEQ ID NO: 6513073 - DNA, 15 bp, Homo sapiens
tgctcccctgccaca

SEQ ID NO: 6513074 - DNA, 23 bp, Homo sapiens
tgctcccctgccacactgatggc

SEQ ID NO: 6513075 - DNA, 14 bp, Homo sapiens
tgctcccctgttca

SEQ ID NO: 6513076 - DNA, 15 bp, Homo sapiens
tgctcccctttgggg

SEQ ID NO: 6513077 - DNA, 20 bp, Homo sapiens
tgctcccggcccgcctgccc

SEQ ID NO: 6513078 - DNA, 21 bp, Homo sapiens
tgctccctaagccagcctggt

SEQ ID NO: 6513079 - DNA, 21 bp, Homo sapiens
tgctccctaccccagggccct

SEQ ID NO: 6513080 - DNA, 20 bp, Homo sapiens
tgctccctcagcctcagagg

SEQ ID NO: 6513081 - DNA, 14 bp, Homo sapiens
tgctccctccagaa

SEQ ID NO: 6513082 - DNA, 14 bp, Homo sapiens
tgctccctcccctg

SEQ ID NO: 6513083 - DNA, 19 bp, Homo sapiens
tgctccctcccctgccctg

SEQ ID NO: 6513084 - DNA, 21 bp, Homo sapiens
tgctccctccgggtcttccta

SEQ ID NO: 6513085 - DNA, 14 bp, Homo sapiens
tgctccctctccaa

SEQ ID NO: 6513086 - DNA, 15 bp, Homo sapiens
tgctccctctgttag

SEQ ID NO: 6513087 - DNA, 15 bp, Homo sapiens
tgctccctgaagcca

SEQ ID NO: 6513088 - DNA, 21 bp, Homo sapiens
tgctccctgagttcactctcc

SEQ ID NO: 6513089 - DNA, 13 bp, Homo sapiens
tgctccctgcaag

SEQ ID NO: 6513090 - DNA, 20 bp, Homo sapiens
tgctccctgcaagctccgcc

SEQ ID NO: 6513091 - DNA, 18 bp, Homo sapiens
tgctccctgcctcctgcc

SEQ ID NO: 6513092 - DNA, 19 bp, Homo sapiens
tgctccctgcctcctgcct

SEQ ID NO: 6513093 - DNA, 16 bp, Homo sapiens
tgctccctgctcccag

SEQ ID NO: 6513094 - DNA, 17 bp, Homo sapiens
tgctccctgctcccagg

SEQ ID NO: 6513095 - DNA, 20 bp, Homo sapiens
tgctccctgctttggctgag

SEQ ID NO: 6513096 - DNA, 23 bp, Homo sapiens
tgctccctgctttggctgagggg

SEQ ID NO: 6513097 - DNA, 14 bp, Homo sapiens
tgctccctggaggc

SEQ ID NO: 6513098 - DNA, 18 bp, Homo sapiens
tgctccctggttctgatg

SEQ ID NO: 6513099 - DNA, 23 bp, Homo sapiens
tgttatgacagccctaggaaact

SEQ ID NO: 6513100 - DNA, 18 bp, Homo sapiens
tgttatgactatgtaaac

SEQ ID NO: 6513101 - DNA, 15 bp, Homo sapiens
tgttatgataaaaaa

SEQ ID NO: 6513102 - DNA, 21 bp, Homo sapiens
tgttatgatattgtttaaaat

SEQ ID NO: 6513103 - DNA, 17 bp, Homo sapiens
tgttatgatgtgcttaa

SEQ ID NO: 6513104 - DNA, 15 bp, Homo sapiens
tgttatgcactgtgg

SEQ ID NO: 6513105 - DNA, 14 bp, Homo sapiens
tgttatgccagctc

SEQ ID NO: 6513106 - DNA, 12 bp, Homo sapiens
tgttatgctatt

SEQ ID NO: 6513107 - DNA, 15 bp, Homo sapiens
tgttatgctgtgaca

SEQ ID NO: 6513108 - DNA, 15 bp, Homo sapiens
tgttatgctgtttcc

SEQ ID NO: 6513109 - DNA, 19 bp, Homo sapiens
tgttatggaaaatgtcaac

SEQ ID NO: 6513110 - DNA, 20 bp, Homo sapiens
tgttatgggatgtaaacaat

SEQ ID NO: 6513111 - DNA, 16 bp, Homo sapiens
tgttatggtagaaaaa

SEQ ID NO: 6513112 - DNA, 14 bp, Homo sapiens
tgttatgtaaaact

SEQ ID NO: 6513113 - DNA, 15 bp, Homo sapiens
tgttatgtaaaactc

SEQ ID NO: 6513114 - DNA, 14 bp, Homo sapiens
tgttatgtactgta

SEQ ID NO: 6513115 - DNA, 16 bp, Homo sapiens
tgttatgtactgtact

SEQ ID NO: 6513116 - DNA, 20 bp, Homo sapiens
tgttatgtatatagatgtgc

SEQ ID NO: 6513117 - DNA, 15 bp, Homo sapiens
tgttatgtatgaagg

SEQ ID NO: 6513118 - DNA, 17 bp, Homo sapiens
tgttatgtatgaaggaa

SEQ ID NO: 6513119 - DNA, 13 bp, Homo sapiens
tgttatgtattcc

SEQ ID NO: 6513120 - DNA, 13 bp, Homo sapiens
tgttatgtatttc

SEQ ID NO: 6513121 - DNA, 17 bp, Homo sapiens
tgttatgtcattgtgtt

SEQ ID NO: 6513122 - DNA, 19 bp, Homo sapiens
tgttatgtccagaaattgt

SEQ ID NO: 6513123 - DNA, 19 bp, Homo sapiens
tgttatgtgaatttgagtt

SEQ ID NO: 6513124 - DNA, 15 bp, Homo sapiens
tgttatgtgagaaca

SEQ ID NO: 6513125 - DNA, 23 bp, Homo sapiens
tgttatgtttctacacattgcta

SEQ ID NO: 6513126 - DNA, 16 bp, Homo sapiens
tgttattaaaaaaaca

SEQ ID NO: 6513127 - DNA, 12 bp, Homo sapiens
tgttattaaaca

SEQ ID NO: 6513128 - DNA, 15 bp, Homo sapiens
tgttattaatattgt

SEQ ID NO: 6513129 - DNA, 14 bp, Homo sapiens
tgttattacatcct

SEQ ID NO: 6513130 - DNA, 18 bp, Homo sapiens
tgttattacttgtaaata

SEQ ID NO: 6513131 - DNA, 23 bp, Homo sapiens
tgttattagagattacctcctga

SEQ ID NO: 6513132 - DNA, 15 bp, Homo sapiens
tgttattataacata

SEQ ID NO: 6513133 - DNA, 21 bp, Homo sapiens
tgttattatagagcagaaatt

SEQ ID NO: 6513134 - DNA, 22 bp, Homo sapiens
tgttattatagagcagaaattc

SEQ ID NO: 6513135 - DNA, 16 bp, Homo sapiens
tgttattatcctgcat

SEQ ID NO: 6513136 - DNA, 13 bp, Homo sapiens
tgttattatctac

SEQ ID NO: 6513137 - DNA, 16 bp, Homo sapiens
tgttattatctgggct

SEQ ID NO: 6513138 - DNA, 12 bp, Homo sapiens
tgttattatgaa

SEQ ID NO: 6513139 - DNA, 13 bp, Homo sapiens
tgttattatgaag

SEQ ID NO: 6513140 - DNA, 16 bp, Homo sapiens
tgttattattagataa

SEQ ID NO: 6513141 - DNA, 19 bp, Homo sapiens
tgttattattttgcactgt

SEQ ID NO: 6513142 - DNA, 15 bp, Homo sapiens
tgttattcaaatttg

SEQ ID NO: 6513143 - DNA, 15 bp, Homo sapiens
tgttattccatcaat

SEQ ID NO: 6513144 - DNA, 23 bp, Homo sapiens
tgttattcctagtggatgactgt

SEQ ID NO: 6513145 - DNA, 13 bp, Homo sapiens
tgttattcttgtt

SEQ ID NO: 6513146 - DNA, 16 bp, Homo sapiens
tgttattctttgcact

SEQ ID NO: 6513147 - DNA, 13 bp, Homo sapiens
tgttattgaaaaa

SEQ ID NO: 6513148 - DNA, 20 bp, Homo sapiens
tgttattgagagagatgtgt

SEQ ID NO: 6513149 - DNA, 22 bp, Homo sapiens
tgttattgatcccttctcctgc

SEQ ID NO: 6513150 - DNA, 14 bp, Homo sapiens
tgttattggaattt

SEQ ID NO: 6513151 - DNA, 17 bp, Homo sapiens
tgttattggaattttct

SEQ ID NO: 6513152 - DNA, 12 bp, Homo sapiens
tgttattgtgaa

SEQ ID NO: 6513153 - DNA, 16 bp, Homo sapiens
tgttattgtgaatgat

SEQ ID NO: 6513154 - DNA, 13 bp, Homo sapiens
tgttattgtggaa

SEQ ID NO: 6513155 - DNA, 22 bp, Homo sapiens
tgttattgttttgttaattaca

SEQ ID NO: 6513156 - DNA, 14 bp, Homo sapiens
tgttatttaaagaa

SEQ ID NO: 6513157 - DNA, 15 bp, Homo sapiens
tgttatttaaatgag

SEQ ID NO: 6513158 - DNA, 18 bp, Homo sapiens
tgttatttacactggtct

SEQ ID NO: 6513159 - DNA, 17 bp, Homo sapiens
tgttatttagactcatc

SEQ ID NO: 6513160 - DNA, 18 bp, Homo sapiens
tgttatttataatcactt

SEQ ID NO: 6513161 - DNA, 15 bp, Homo sapiens
tgttatttattatta

SEQ ID NO: 6513162 - DNA, 15 bp, Homo sapiens
tgttatttattgaaa

SEQ ID NO: 6513163 - DNA, 18 bp, Homo sapiens
tgttatttattgaaatga

SEQ ID NO: 6513164 - DNA, 19 bp, Homo sapiens
tgttatttattgaaatgat

SEQ ID NO: 6513165 - DNA, 12 bp, Homo sapiens
tgttatttcaat

SEQ ID NO: 6513166 - DNA, 17 bp, Homo sapiens
tgttatttcactttttc

SEQ ID NO: 6513167 - DNA, 19 bp, Homo sapiens
tgttatttccccagccaca

SEQ ID NO: 6513168 - DNA, 23 bp, Homo sapiens
tgttatttccctacattaaacat

SEQ ID NO: 6513169 - DNA, 18 bp, Homo sapiens
tgttatttcctaatcaaa

SEQ ID NO: 6513170 - DNA, 16 bp, Homo sapiens
tgttatttctatgaaa

SEQ ID NO: 6513171 - DNA, 17 bp, Homo sapiens
tgttatttctatgaaaa

SEQ ID NO: 6513172 - DNA, 13 bp, Homo sapiens
tgttatttctgca

SEQ ID NO: 6513173 - DNA, 18 bp, Homo sapiens
tgttatttcttacaggca

SEQ ID NO: 6513174 - DNA, 16 bp, Homo sapiens
tgttatttcttccctg

SEQ ID NO: 6513175 - DNA, 19 bp, Homo sapiens
tgttattttaatctcagaa

SEQ ID NO: 6513176 - DNA, 18 bp, Homo sapiens
tgttattttcaagtagct

SEQ ID NO: 6513177 - DNA, 22 bp, Homo sapiens
tgttattttcagcatgaaaatg

SEQ ID NO: 6513178 - DNA, 15 bp, Homo sapiens
tgttattttcagtga

SEQ ID NO: 6513179 - DNA, 16 bp, Homo sapiens
tgttattttcagtgct

SEQ ID NO: 6513180 - DNA, 16 bp, Homo sapiens
tgttattttccttctg

SEQ ID NO: 6513181 - DNA, 17 bp, Homo sapiens
tgttattttccttctga

SEQ ID NO: 6513182 - DNA, 16 bp, Homo sapiens
tgttattttgtacgtg

SEQ ID NO: 6513183 - DNA, 23 bp, Homo sapiens
tgttatttttacagcaaaagatg

SEQ ID NO: 6513184 - DNA, 21 bp, Homo sapiens
tgttatttttgtttcttccaa

SEQ ID NO: 6513185 - DNA, 21 bp, Homo sapiens
tgttattttttatttccacat

SEQ ID NO: 6513186 - DNA, 12 bp, Homo sapiens
tgttcaaaaatt

SEQ ID NO: 6513187 - DNA, 14 bp, Homo sapiens
tgttcaaaatgtta

SEQ ID NO: 6513188 - DNA, 19 bp, Homo sapiens
tgttcaaaatgttaataaa

SEQ ID NO: 6513189 - DNA, 13 bp, Homo sapiens
tgttcaaacaata

SEQ ID NO: 6513190 - DNA, 20 bp, Homo sapiens
tgttcaaacaatatcatatc

SEQ ID NO: 6513191 - DNA, 22 bp, Homo sapiens
tgttcaaacacaacctactctg

SEQ ID NO: 6513192 - DNA, 17 bp, Homo sapiens
tgttcaaacacaatgga

SEQ ID NO: 6513193 - DNA, 21 bp, Homo sapiens
tgttcaaactttctgccttct

SEQ ID NO: 6513194 - DNA, 21 bp, Homo sapiens
tgttcaaagaacccccctccc

SEQ ID NO: 6513195 - DNA, 22 bp, Homo sapiens
tgttcaaagaacccccctcccc

SEQ ID NO: 6513196 - DNA, 20 bp, Homo sapiens
tgttcaaagactgtgaacag

SEQ ID NO: 6513197 - DNA, 18 bp, Homo sapiens
tgttcaaagatgcatttt

SEQ ID NO: 6513198 - DNA, 13 bp, Homo sapiens
tgttcaaagtact

SEQ ID NO: 6513199 - DNA, 16 bp, Homo sapiens
tgttcaaatacttcaa

SEQ ID NO: 6513200 - DNA, 15 bp, Homo sapiens
tgttcaaatgcattt

SEQ ID NO: 6513201 - DNA, 16 bp, Homo sapiens
tgttcaaatgcatttt

SEQ ID NO: 6513202 - DNA, 13 bp, Homo sapiens
tgttcaaattcac

SEQ ID NO: 6513203 - DNA, 14 bp, Homo sapiens
tgttcaaattctga

SEQ ID NO: 6513204 - DNA, 16 bp, Homo sapiens
tgttcaaattctgatt

SEQ ID NO: 6513205 - DNA, 18 bp, Homo sapiens
tgttcaaattctgattat

SEQ ID NO: 6513206 - DNA, 13 bp, Homo sapiens
tgttcaaattttt

SEQ ID NO: 6513207 - DNA, 19 bp, Homo sapiens
tgttcaacaatcagtcatc

SEQ ID NO: 6513208 - DNA, 19 bp, Homo sapiens
tgttcaactaggatcagaa

SEQ ID NO: 6513209 - DNA, 17 bp, Homo sapiens
tgttcaacttaatgaag

SEQ ID NO: 6513210 - DNA, 19 bp, Homo sapiens
tgttcaagaccagcctggt

SEQ ID NO: 6513211 - DNA, 14 bp, Homo sapiens
tgttcaagtatcta

SEQ ID NO: 6513212 - DNA, 19 bp, Homo sapiens
tgttcaagtatctaactct

SEQ ID NO: 6513213 - DNA, 22 bp, Homo sapiens
tgttcaagtgtccccagaccct

SEQ ID NO: 6513214 - DNA, 18 bp, Homo sapiens
tgttcaagtttgctgcaa

SEQ ID NO: 6513215 - DNA, 16 bp, Homo sapiens
tgttcaatactgtatg

SEQ ID NO: 6513216 - DNA, 16 bp, Homo sapiens
tgttcaatagaacatg

SEQ ID NO: 6513217 - DNA, 13 bp, Homo sapiens
tgttcaatgaaat

SEQ ID NO: 6513218 - DNA, 16 bp, Homo sapiens
tgttcaatgcaaagta

SEQ ID NO: 6513219 - DNA, 22 bp, Homo sapiens
tgttcaatgccaatgagtctgt

SEQ ID NO: 6513220 - DNA, 15 bp, Homo sapiens
tgttcaatgttccat

SEQ ID NO: 6513221 - DNA, 16 bp, Homo sapiens
tgttcacaaactgtga

SEQ ID NO: 6513222 - DNA, 16 bp, Homo sapiens
tgttcacaatatattt

SEQ ID NO: 6513223 - DNA, 18 bp, Homo sapiens
tgttcacacaaagcctgt

SEQ ID NO: 6513224 - DNA, 22 bp, Homo sapiens
tgttcacacctagcgtcagtat

SEQ ID NO: 6513225 - DNA, 16 bp, Homo sapiens
tgttcacactctcaca

SEQ ID NO: 6513226 - DNA, 22 bp, Homo sapiens
tgttcacactctcacatgttta

SEQ ID NO: 6513227 - DNA, 13 bp, Homo sapiens
tgttcacagcttt

SEQ ID NO: 6513228 - DNA, 21 bp, Homo sapiens
tgttcacagcttttcttgata

SEQ ID NO: 6513229 - DNA, 18 bp, Homo sapiens
tgttcacagtctctggaa

SEQ ID NO: 6513230 - DNA, 19 bp, Homo sapiens
tgttcacagtctctggaaa

SEQ ID NO: 6513231 - DNA, 21 bp, Homo sapiens
tgttcacatccagttgtctaa

SEQ ID NO: 6513232 - DNA, 10 bp, Homo sapiens
tgttcacctt

SEQ ID NO: 6513233 - DNA, 18 bp, Homo sapiens
tgttcaccttcaaaatgt

SEQ ID NO: 6513234 - DNA, 20 bp, Homo sapiens
tgttcaccttcaaaatgttc

SEQ ID NO: 6513235 - DNA, 17 bp, Homo sapiens
tgttcacgcaacttgaa

SEQ ID NO: 6513236 - DNA, 18 bp, Homo sapiens
tgttcacgcaacttgaaa

SEQ ID NO: 6513237 - DNA, 15 bp, Homo sapiens
tgttcacgctcaccc

SEQ ID NO: 6513238 - DNA, 16 bp, Homo sapiens
tgttcacgctcaccca

SEQ ID NO: 6513239 - DNA, 19 bp, Homo sapiens
tgttcacggcagaccagaa

SEQ ID NO: 6513240 - DNA, 15 bp, Homo sapiens
tgttcactaaactct

SEQ ID NO: 6513241 - DNA, 18 bp, Homo sapiens
tgttcactggacacttca

SEQ ID NO: 6513242 - DNA, 12 bp, Homo sapiens
tgttcactgtga

SEQ ID NO: 6513243 - DNA, 16 bp, Homo sapiens
tgttcacttttcctcc

SEQ ID NO: 6513244 - DNA, 21 bp, Homo sapiens
tgttcagaaagcaataacttt

SEQ ID NO: 6513245 - DNA, 22 bp, Homo sapiens
tgttcagaacttcatctgccac

SEQ ID NO: 6513246 - DNA, 15 bp, Homo sapiens
tgttcagaagaaatt

SEQ ID NO: 6513247 - DNA, 22 bp, Homo sapiens
tgttcagaagaatcttcctggc

SEQ ID NO: 6513248 - DNA, 19 bp, Homo sapiens
tgttcagaattaagcagaa

SEQ ID NO: 6513249 - DNA, 23 bp, Homo sapiens
tgttcagaattttggaaaaatgt

SEQ ID NO: 6513250 - DNA, 20 bp, Homo sapiens
tgttcagagtggctcactgg

SEQ ID NO: 6513251 - DNA, 18 bp, Homo sapiens
tgttcagagttccacagt

SEQ ID NO: 6513252 - DNA, 16 bp, Homo sapiens
tgttcagatctcatag

SEQ ID NO: 6513253 - DNA, 18 bp, Homo sapiens
tgttcagattgctttgat

SEQ ID NO: 6513254 - DNA, 15 bp, Homo sapiens
tgttcagcactgtcc

SEQ ID NO: 6513255 - DNA, 18 bp, Homo sapiens
tgttcagcactgtccctt

SEQ ID NO: 6513256 - DNA, 15 bp, Homo sapiens
tgttcagcagaacct

SEQ ID NO: 6513257 - DNA, 20 bp, Homo sapiens
tgttcagccaaacagtatga

SEQ ID NO: 6513258 - DNA, 18 bp, Homo sapiens
tgttcagccactgaggga

SEQ ID NO: 6513259 - DNA, 19 bp, Homo sapiens
tgttcagccactgagggac

SEQ ID NO: 6513260 - DNA, 15 bp, Homo sapiens
tgttcagctccagct

SEQ ID NO: 6513261 - DNA, 18 bp, Homo sapiens
tgttcagctccagctcac

SEQ ID NO: 6513262 - DNA, 22 bp, Homo sapiens
tgttcagctccagctcaccagc

SEQ ID NO: 6513263 - DNA, 17 bp, Homo sapiens
tgttcagctctttccaa

SEQ ID NO: 6513264 - DNA, 11 bp, Homo sapiens
tgttcagctgg

SEQ ID NO: 6513265 - DNA, 17 bp, Homo sapiens
tgttcagcttataatga

SEQ ID NO: 6513266 - DNA, 23 bp, Homo sapiens
tgttcaggaaaaggttgaataat

SEQ ID NO: 6513267 - DNA, 23 bp, Homo sapiens
tgttcaggcagaaccggtcccag

SEQ ID NO: 6513268 - DNA, 16 bp, Homo sapiens
tgttcaggcattccag

SEQ ID NO: 6513269 - DNA, 16 bp, Homo sapiens
tgttcaggtctctaga

SEQ ID NO: 6513270 - DNA, 15 bp, Homo sapiens
tgttcagtcacatgt

SEQ ID NO: 6513271 - DNA, 14 bp, Homo sapiens
tgttcagtcctctg

SEQ ID NO: 6513272 - DNA, 15 bp, Homo sapiens
tgttcagtcctctgc

SEQ ID NO: 6513273 - DNA, 14 bp, Homo sapiens
tgttcagtctttca

SEQ ID NO: 6513274 - DNA, 17 bp, Homo sapiens
tgttcagtgcaatcaga

SEQ ID NO: 6513275 - DNA, 17 bp, Homo sapiens
tgttcagtgctttttcc

SEQ ID NO: 6513276 - DNA, 21 bp, Homo sapiens
tgttcagtgttgacatagcct

SEQ ID NO: 6513277 - DNA, 15 bp, Homo sapiens
tgttcagttacagaa

SEQ ID NO: 6513278 - DNA, 15 bp, Homo sapiens
tgttcagtttcccca

SEQ ID NO: 6513279 - DNA, 17 bp, Homo sapiens
tgctccctgtctgtgtc

SEQ ID NO: 6513280 - DNA, 23 bp, Homo sapiens
tgctccctgtgtccacctgtggg

SEQ ID NO: 6513281 - DNA, 19 bp, Homo sapiens
tgctcccttcgctctgctg

SEQ ID NO: 6513282 - DNA, 16 bp, Homo sapiens
tgctcccttgatgggg

SEQ ID NO: 6513283 - DNA, 18 bp, Homo sapiens
tgctccgaggggctcatg

SEQ ID NO: 6513284 - DNA, 13 bp, Homo sapiens
tgctccgccagga

SEQ ID NO: 6513285 - DNA, 14 bp, Homo sapiens
tgctccgccaggaa

SEQ ID NO: 6513286 - DNA, 20 bp, Homo sapiens
tgctccgccatggtgtcccg

SEQ ID NO: 6513287 - DNA, 13 bp, Homo sapiens
tgctccgcccgct

SEQ ID NO: 6513288 - DNA, 18 bp, Homo sapiens
tgctccgcctggcctggc

SEQ ID NO: 6513289 - DNA, 15 bp, Homo sapiens
tgctccgctcccacc

SEQ ID NO: 6513290 - DNA, 16 bp, Homo sapiens
tgctccgctcccaccg

SEQ ID NO: 6513291 - DNA, 14 bp, Homo sapiens
tgctccgctgcctg

SEQ ID NO: 6513292 - DNA, 17 bp, Homo sapiens
tgctccgctgcctggaa

SEQ ID NO: 6513293 - DNA, 18 bp, Homo sapiens
tgctccgctgctccttgg

SEQ ID NO: 6513294 - DNA, 23 bp, Homo sapiens
tgctccgctgctccttggcttac

SEQ ID NO: 6513295 - DNA, 18 bp, Homo sapiens
tgctccgtagctctgctg

SEQ ID NO: 6513296 - DNA, 20 bp, Homo sapiens
tgctccgtagctctgctgct

SEQ ID NO: 6513297 - DNA, 17 bp, Homo sapiens
tgctccgtgcctccacc

SEQ ID NO: 6513298 - DNA, 16 bp, Homo sapiens
tgctccgtgtgtctca

SEQ ID NO: 6513299 - DNA, 21 bp, Homo sapiens
tgctcctaaaccattgagcta

SEQ ID NO: 6513300 - DNA, 18 bp, Homo sapiens
tgctcctaactccaccgc

SEQ ID NO: 6513301 - DNA, 18 bp, Homo sapiens
tgctcctacatccagctc

SEQ ID NO: 6513302 - DNA, 21 bp, Homo sapiens
tgctcctacatccagctcctc

SEQ ID NO: 6513303 - DNA, 12 bp, Homo sapiens
tgctcctaccta

SEQ ID NO: 6513304 - DNA, 19 bp, Homo sapiens
tgctcctagaagtcttaat

SEQ ID NO: 6513305 - DNA, 20 bp, Homo sapiens
tgctcctagtttgacctcac

SEQ ID NO: 6513306 - DNA, 14 bp, Homo sapiens
tgctcctcaccccc

SEQ ID NO: 6513307 - DNA, 21 bp, Homo sapiens
tgctcctcacccccacccctg

SEQ ID NO: 6513308 - DNA, 19 bp, Homo sapiens
tgctcctcacccctgtagg

SEQ ID NO: 6513309 - DNA, 17 bp, Homo sapiens
tgctcctcactggagga

SEQ ID NO: 6513310 - DNA, 12 bp, Homo sapiens
tgctcctcaggg

SEQ ID NO: 6513311 - DNA, 13 bp, Homo sapiens
tgctcctcagggt

SEQ ID NO: 6513312 - DNA, 22 bp, Homo sapiens
tgctcctcagggtccctcagga

SEQ ID NO: 6513313 - DNA, 21 bp, Homo sapiens
tgctcctcatctgcctggaaa

SEQ ID NO: 6513314 - DNA, 20 bp, Homo sapiens
tgctcctccagcccttcaga

SEQ ID NO: 6513315 - DNA, 23 bp, Homo sapiens
tgctcctccagcccttcagacga

SEQ ID NO: 6513316 - DNA, 20 bp, Homo sapiens
tgctcctccagtacaataaa

SEQ ID NO: 6513317 - DNA, 10 bp, Homo sapiens
tgctcctccc

SEQ ID NO: 6513318 - DNA, 18 bp, Homo sapiens
tgctcctcccacttctca

SEQ ID NO: 6513319 - DNA, 13 bp, Homo sapiens
tgctcctccctcc

SEQ ID NO: 6513320 - DNA, 13 bp, Homo sapiens
tgctcctccctct

SEQ ID NO: 6513321 - DNA, 21 bp, Homo sapiens
tgctcctccctgccccccaag

SEQ ID NO: 6513322 - DNA, 13 bp, Homo sapiens
tgctcctccctgg

SEQ ID NO: 6513323 - DNA, 17 bp, Homo sapiens
tgctcctccctggctgc

SEQ ID NO: 6513324 - DNA, 16 bp, Homo sapiens
tgctcctcctgccctg

SEQ ID NO: 6513325 - DNA, 23 bp, Homo sapiens
tgctcctcggccagagctcccag

SEQ ID NO: 6513326 - DNA, 12 bp, Homo sapiens
tgctcctctcca

SEQ ID NO: 6513327 - DNA, 17 bp, Homo sapiens
tgctcctctccccagca

SEQ ID NO: 6513328 - DNA, 19 bp, Homo sapiens
tgctcctctccccagcaag

SEQ ID NO: 6513329 - DNA, 15 bp, Homo sapiens
tgctcctctcgcaca

SEQ ID NO: 6513330 - DNA, 14 bp, Homo sapiens
tgctcctctcttgg

SEQ ID NO: 6513331 - DNA, 13 bp, Homo sapiens
tgctcctctgccc

SEQ ID NO: 6513332 - DNA, 14 bp, Homo sapiens
tgctcctctgcccg

SEQ ID NO: 6513333 - DNA, 16 bp, Homo sapiens
tgctcctctgcctgtg

SEQ ID NO: 6513334 - DNA, 16 bp, Homo sapiens
tgctcctcttccccag

SEQ ID NO: 6513335 - DNA, 19 bp, Homo sapiens
tgctcctcttgttcctgaa

SEQ ID NO: 6513336 - DNA, 20 bp, Homo sapiens
tgctcctcttgttcctgaaa

SEQ ID NO: 6513337 - DNA, 23 bp, Homo sapiens
tgctcctgaaaaatgactgtccc

SEQ ID NO: 6513338 - DNA, 22 bp, Homo sapiens
tgctcctgaaccagtcctgctg

SEQ ID NO: 6513339 - DNA, 15 bp, Homo sapiens
tgctcctgagccccc

SEQ ID NO: 6513340 - DNA, 13 bp, Homo sapiens
tgctcctgcagca

SEQ ID NO: 6513341 - DNA, 14 bp, Homo sapiens
tgctcctgcatgca

SEQ ID NO: 6513342 - DNA, 19 bp, Homo sapiens
tgctcctgcatgcaactaa

SEQ ID NO: 6513343 - DNA, 15 bp, Homo sapiens
tgctcctgccaacca

SEQ ID NO: 6513344 - DNA, 22 bp, Homo sapiens
tgctcctgccaggccttcagaa

SEQ ID NO: 6513345 - DNA, 14 bp, Homo sapiens
tgctcctgcccacg

SEQ ID NO: 6513346 - DNA, 17 bp, Homo sapiens
tgctcctgcccacgtgc

SEQ ID NO: 6513347 - DNA, 13 bp, Homo sapiens
tgctcctgcccag

SEQ ID NO: 6513348 - DNA, 16 bp, Homo sapiens
tgctcctgcccagcca

SEQ ID NO: 6513349 - DNA, 17 bp, Homo sapiens
tgctcctgcccagccac

SEQ ID NO: 6513350 - DNA, 14 bp, Homo sapiens
tgctcctgcccagg

SEQ ID NO: 6513351 - DNA, 15 bp, Homo sapiens
tgctcctgcccagga

SEQ ID NO: 6513352 - DNA, 16 bp, Homo sapiens
tgctcctgcccaggag

SEQ ID NO: 6513353 - DNA, 20 bp, Homo sapiens
tgctcctgcccaggagcagc

SEQ ID NO: 6513354 - DNA, 16 bp, Homo sapiens
tgctcctgcttctcct

SEQ ID NO: 6513355 - DNA, 16 bp, Homo sapiens
tgctcctgcttttctg

SEQ ID NO: 6513356 - DNA, 21 bp, Homo sapiens
tgctcctgcttttctgtcctg

SEQ ID NO: 6513357 - DNA, 9 bp, Homo sapiens
tgctcctgg

SEQ ID NO: 6513358 - DNA, 21 bp, Homo sapiens
tgctcctggaacctggcaggc

SEQ ID NO: 6513359 - DNA, 22 bp, Homo sapiens
tgctcctggaacctggcaggcc

SEQ ID NO: 6513360 - DNA, 18 bp, Homo sapiens
tgctcctggatctccctg

SEQ ID NO: 6513361 - DNA, 11 bp, Homo sapiens
tgctcctggga

SEQ ID NO: 6513362 - DNA, 20 bp, Homo sapiens
tgctcctggggagaaagagg

SEQ ID NO: 6513363 - DNA, 22 bp, Homo sapiens
tgctcctggggagaaagagggg

SEQ ID NO: 6513364 - DNA, 18 bp, Homo sapiens
tgctcctgtacttgtcct

SEQ ID NO: 6513365 - DNA, 22 bp, Homo sapiens
tgctcctgtacttgtcctcagc

SEQ ID NO: 6513366 - DNA, 14 bp, Homo sapiens
tgctcctgtgctca

SEQ ID NO: 6513367 - DNA, 18 bp, Homo sapiens
tgctcctgtgctcaccct

SEQ ID NO: 6513368 - DNA, 20 bp, Homo sapiens
tgctcctgtgctcaccctct

SEQ ID NO: 6513369 - DNA, 22 bp, Homo sapiens
tgctcctgtgctcaccctctct

SEQ ID NO: 6513370 - DNA, 19 bp, Homo sapiens
tgctcctgtggcaggaggc

SEQ ID NO: 6513371 - DNA, 13 bp, Homo sapiens
tgctcctgtggcg

SEQ ID NO: 6513372 - DNA, 16 bp, Homo sapiens
tgctccttagctgcca

SEQ ID NO: 6513373 - DNA, 20 bp, Homo sapiens
tgctccttagctgccaagcc

SEQ ID NO: 6513374 - DNA, 19 bp, Homo sapiens
tgctccttccaacaggagc

SEQ ID NO: 6513375 - DNA, 20 bp, Homo sapiens
tgctccttcctgtggcctca

SEQ ID NO: 6513376 - DNA, 22 bp, Homo sapiens
tgctccttcctgtggcctcatc

SEQ ID NO: 6513377 - DNA, 16 bp, Homo sapiens
tgctccttctgtgttt

SEQ ID NO: 6513378 - DNA, 15 bp, Homo sapiens
tgctccttgaataag

SEQ ID NO: 6513379 - DNA, 17 bp, Homo sapiens
tgctccttgagaggaga

SEQ ID NO: 6513380 - DNA, 18 bp, Homo sapiens
tgctccttgcctctgctc

SEQ ID NO: 6513381 - DNA, 12 bp, Homo sapiens
tgctccttgctg

SEQ ID NO: 6513382 - DNA, 20 bp, Homo sapiens
tgctccttggcctagtcaga

SEQ ID NO: 6513383 - DNA, 23 bp, Homo sapiens
tgctccttggcctagtcagatgg

SEQ ID NO: 6513384 - DNA, 18 bp, Homo sapiens
tgctcctttccatcagct

SEQ ID NO: 6513385 - DNA, 20 bp, Homo sapiens
tgctcctttccatcagcttt

SEQ ID NO: 6513386 - DNA, 14 bp, Homo sapiens
tgctccttttctct

SEQ ID NO: 6513387 - DNA, 15 bp, Homo sapiens
tgctccttttctctt

SEQ ID NO: 6513388 - DNA, 17 bp, Homo sapiens
tgctcgagacacagtga

SEQ ID NO: 6513389 - DNA, 20 bp, Homo sapiens
tgctcgagtcacattctgct

SEQ ID NO: 6513390 - DNA, 14 bp, Homo sapiens
tgctcgcagcctgg

SEQ ID NO: 6513391 - DNA, 19 bp, Homo sapiens
tgctcgcccagacaccatg

SEQ ID NO: 6513392 - DNA, 15 bp, Homo sapiens
tgctcgcccaggaag

SEQ ID NO: 6513393 - DNA, 17 bp, Homo sapiens
tgctcgcccaggaaggc

SEQ ID NO: 6513394 - DNA, 18 bp, Homo sapiens
tgctcgcccaggaaggcc

SEQ ID NO: 6513395 - DNA, 14 bp, Homo sapiens
tgctcgccccagca

SEQ ID NO: 6513396 - DNA, 15 bp, Homo sapiens
tgctcgccctgtgcc

SEQ ID NO: 6513397 - DNA, 18 bp, Homo sapiens
tgctcgcctctgcccagc

SEQ ID NO: 6513398 - DNA, 17 bp, Homo sapiens
tgctcgctgttgctgaa

SEQ ID NO: 6513399 - DNA, 19 bp, Homo sapiens
tgctcgctgttgctgaata

SEQ ID NO: 6513400 - DNA, 20 bp, Homo sapiens
tgctcgcttgctggaacaca

SEQ ID NO: 6513401 - DNA, 16 bp, Homo sapiens
tgctcggacacagttt

SEQ ID NO: 6513402 - DNA, 20 bp, Homo sapiens
tgctcggagaagagcgcagt

SEQ ID NO: 6513403 - DNA, 16 bp, Homo sapiens
tgctcgggaagggagg

SEQ ID NO: 6513404 - DNA, 14 bp, Homo sapiens
tgctcgggagtggc

SEQ ID NO: 6513405 - DNA, 16 bp, Homo sapiens
tgctcggggtgcacag

SEQ ID NO: 6513406 - DNA, 17 bp, Homo sapiens
tgctcggggtgcacagg

SEQ ID NO: 6513407 - DNA, 18 bp, Homo sapiens
tgctcggggtgcacagga

SEQ ID NO: 6513408 - DNA, 19 bp, Homo sapiens
tgctcggggtgcacaggag

SEQ ID NO: 6513409 - DNA, 16 bp, Homo sapiens
tgctcgtggactgtgc

SEQ ID NO: 6513410 - DNA, 16 bp, Homo sapiens
tgctcgtttacactgc

SEQ ID NO: 6513411 - DNA, 13 bp, Homo sapiens
tgctctaaaatat

SEQ ID NO: 6513412 - DNA, 15 bp, Homo sapiens
tgctctaaaatattt

SEQ ID NO: 6513413 - DNA, 23 bp, Homo sapiens
tgctctaaaatatttatgaagaa

SEQ ID NO: 6513414 - DNA, 17 bp, Homo sapiens
tgctctaaataaagacg

SEQ ID NO: 6513415 - DNA, 19 bp, Homo sapiens
tgctctaacacctgcctag

SEQ ID NO: 6513416 - DNA, 15 bp, Homo sapiens
tgctctaacagccct

SEQ ID NO: 6513417 - DNA, 16 bp, Homo sapiens
tgctctaacagccctc

SEQ ID NO: 6513418 - DNA, 21 bp, Homo sapiens
tgctctaagaagctgcaataa

SEQ ID NO: 6513419 - DNA, 14 bp, Homo sapiens
tgctctaagaggct

SEQ ID NO: 6513420 - DNA, 15 bp, Homo sapiens
tgctctaagcacacg

SEQ ID NO: 6513421 - DNA, 17 bp, Homo sapiens
tgctctaagcacacgga

SEQ ID NO: 6513422 - DNA, 16 bp, Homo sapiens
tgctctaagcccagga

SEQ ID NO: 6513423 - DNA, 19 bp, Homo sapiens
tgctctaatgagcatttcc

SEQ ID NO: 6513424 - DNA, 21 bp, Homo sapiens
tgctctaatgatcaaaacatg

SEQ ID NO: 6513425 - DNA, 19 bp, Homo sapiens
tgctctaccaaatagtgat

SEQ ID NO: 6513426 - DNA, 15 bp, Homo sapiens
tgctctacctggccg

SEQ ID NO: 6513427 - DNA, 14 bp, Homo sapiens
tgctctactttgag

SEQ ID NO: 6513428 - DNA, 13 bp, Homo sapiens
tgctctagaaagt

SEQ ID NO: 6513429 - DNA, 18 bp, Homo sapiens
tgctctagattcataaat

SEQ ID NO: 6513430 - DNA, 13 bp, Homo sapiens
tgctctagccagg

SEQ ID NO: 6513431 - DNA, 19 bp, Homo sapiens
tgctctagctggcaggaca

SEQ ID NO: 6513432 - DNA, 13 bp, Homo sapiens
tgctctaggaaga

SEQ ID NO: 6513433 - DNA, 19 bp, Homo sapiens
tgctctaggaagacatttt

SEQ ID NO: 6513434 - DNA, 21 bp, Homo sapiens
tgctctagggaatctggatta

SEQ ID NO: 6513435 - DNA, 23 bp, Homo sapiens
tgctctagtcttgctttgctgtc

SEQ ID NO: 6513436 - DNA, 16 bp, Homo sapiens
tgctctagtgggacag

SEQ ID NO: 6513437 - DNA, 20 bp, Homo sapiens
tgctctatactgtggcctgc

SEQ ID NO: 6513438 - DNA, 15 bp, Homo sapiens
tgctctatatgtaat

SEQ ID NO: 6513439 - DNA, 17 bp, Homo sapiens
tgctctatctcacagca

SEQ ID NO: 6513440 - DNA, 13 bp, Homo sapiens
tgctctatgccag

SEQ ID NO: 6513441 - DNA, 16 bp, Homo sapiens
tgctctatgctttcca

SEQ ID NO: 6513442 - DNA, 12 bp, Homo sapiens
tgctctattgta

SEQ ID NO: 6513443 - DNA, 14 bp, Homo sapiens
tgctctcaaaatgt

SEQ ID NO: 6513444 - DNA, 16 bp, Homo sapiens
tgctctcaaaatgtga

SEQ ID NO: 6513445 - DNA, 19 bp, Homo sapiens
tgctctcaaacccctgacc

SEQ ID NO: 6513446 - DNA, 21 bp, Homo sapiens
tgctctcaaacccctgacctc

SEQ ID NO: 6513447 - DNA, 22 bp, Homo sapiens
tgctctcaccagctgctgctct

SEQ ID NO: 6513448 - DNA, 14 bp, Homo sapiens
tgctctcagcctcc

SEQ ID NO: 6513449 - DNA, 15 bp, Homo sapiens
tgctctcagcctccc

SEQ ID NO: 6513450 - DNA, 16 bp, Homo sapiens
tgctctcagcctccca

SEQ ID NO: 6513451 - DNA, 19 bp, Homo sapiens
tgctctcagcctcccacaa

SEQ ID NO: 6513452 - DNA, 16 bp, Homo sapiens
tgctctcagctccggg

SEQ ID NO: 6513453 - DNA, 16 bp, Homo sapiens
tgctctcagctggcag

SEQ ID NO: 6513454 - DNA, 23 bp, Homo sapiens
tgctctcaggctgagggaggcag

SEQ ID NO: 6513455 - DNA, 23 bp, Homo sapiens
tgctctcataggagttaggctgt

SEQ ID NO: 6513456 - DNA, 15 bp, Homo sapiens
tgctctcatatatat

SEQ ID NO: 6513457 - DNA, 21 bp, Homo sapiens
tgctctcatatatattttaaa

SEQ ID NO: 6513458 - DNA, 15 bp, Homo sapiens
tgttcagttttcctt

SEQ ID NO: 6513459 - DNA, 13 bp, Homo sapiens
tgttcataaataa

SEQ ID NO: 6513460 - DNA, 16 bp, Homo sapiens
tgttcataatacataa

SEQ ID NO: 6513461 - DNA, 12 bp, Homo sapiens
tgttcatacatt

SEQ ID NO: 6513462 - DNA, 19 bp, Homo sapiens
tgttcatagaatcgttgga

SEQ ID NO: 6513463 - DNA, 18 bp, Homo sapiens
tgttcatagaccctctca

SEQ ID NO: 6513464 - DNA, 14 bp, Homo sapiens
tgttcatagcccag

SEQ ID NO: 6513465 - DNA, 20 bp, Homo sapiens
tgttcatagcccagtagacc

SEQ ID NO: 6513466 - DNA, 23 bp, Homo sapiens
tgttcatagcccagtagaccttg

SEQ ID NO: 6513467 - DNA, 16 bp, Homo sapiens
tgttcatatagccagg

SEQ ID NO: 6513468 - DNA, 22 bp, Homo sapiens
tgttcatataggggcaaaaatt

SEQ ID NO: 6513469 - DNA, 19 bp, Homo sapiens
tgttcatatctatgggaaa

SEQ ID NO: 6513470 - DNA, 17 bp, Homo sapiens
tgttcatattaagaatg

SEQ ID NO: 6513471 - DNA, 11 bp, Homo sapiens
tgttcatattg

SEQ ID NO: 6513472 - DNA, 19 bp, Homo sapiens
tgttcatcaccagtctgta

SEQ ID NO: 6513473 - DNA, 20 bp, Homo sapiens
tgttcatcatccagatgtgg

SEQ ID NO: 6513474 - DNA, 19 bp, Homo sapiens
tgttcatcatcctaagcta

SEQ ID NO: 6513475 - DNA, 13 bp, Homo sapiens
tgttcatccaagg

SEQ ID NO: 6513476 - DNA, 15 bp, Homo sapiens
tgttcatccaaggaa

SEQ ID NO: 6513477 - DNA, 15 bp, Homo sapiens
tgttcatctgtaact

SEQ ID NO: 6513478 - DNA, 21 bp, Homo sapiens
tgttcatctgtaactctaaaa

SEQ ID NO: 6513479 - DNA, 21 bp, Homo sapiens
tgttcatcttgtacaaacttt

SEQ ID NO: 6513480 - DNA, 16 bp, Homo sapiens
tgttcatgatagaaag

SEQ ID NO: 6513481 - DNA, 21 bp, Homo sapiens
tgttcatgatagaaagaataa

SEQ ID NO: 6513482 - DNA, 20 bp, Homo sapiens
tgttcatgctgaatccacct

SEQ ID NO: 6513483 - DNA, 22 bp, Homo sapiens
tgttcatgctgaatccacctcg

SEQ ID NO: 6513484 - DNA, 15 bp, Homo sapiens
tgttcatggagagct

SEQ ID NO: 6513485 - DNA, 16 bp, Homo sapiens
tgttcatggagagctg

SEQ ID NO: 6513486 - DNA, 13 bp, Homo sapiens
tgttcatggcaga

SEQ ID NO: 6513487 - DNA, 14 bp, Homo sapiens
tgttcatggcagat

SEQ ID NO: 6513488 - DNA, 13 bp, Homo sapiens
tgttcatgtgatt

SEQ ID NO: 6513489 - DNA, 15 bp, Homo sapiens
tgttcatgtgcctct

SEQ ID NO: 6513490 - DNA, 17 bp, Homo sapiens
tgttcatgtgcctctgc

SEQ ID NO: 6513491 - DNA, 13 bp, Homo sapiens
tgttcatgtttgg

SEQ ID NO: 6513492 - DNA, 18 bp, Homo sapiens
tgttcattaaattttcta

SEQ ID NO: 6513493 - DNA, 17 bp, Homo sapiens
tgttcattataatctca

SEQ ID NO: 6513494 - DNA, 20 bp, Homo sapiens
tgttcattataatctcaaag

SEQ ID NO: 6513495 - DNA, 17 bp, Homo sapiens
tgttcattatttgtgct

SEQ ID NO: 6513496 - DNA, 18 bp, Homo sapiens
tgttcattcaagctattt

SEQ ID NO: 6513497 - DNA, 20 bp, Homo sapiens
tgttcattcaagctatttaa

SEQ ID NO: 6513498 - DNA, 22 bp, Homo sapiens
tgttcattcaagctatttaata

SEQ ID NO: 6513499 - DNA, 15 bp, Homo sapiens
tgttcattcactgca

SEQ ID NO: 6513500 - DNA, 14 bp, Homo sapiens
tgttcattcctcca

SEQ ID NO: 6513501 - DNA, 23 bp, Homo sapiens
tgttcattctgcattgagaagga

SEQ ID NO: 6513502 - DNA, 16 bp, Homo sapiens
tgttcattgtaatgtt

SEQ ID NO: 6513503 - DNA, 18 bp, Homo sapiens
tgttcattgtaatgttac

SEQ ID NO: 6513504 - DNA, 23 bp, Homo sapiens
tgttcattgtaatgttactgatc

SEQ ID NO: 6513505 - DNA, 10 bp, Homo sapiens
tgttcattta

SEQ ID NO: 6513506 - DNA, 20 bp, Homo sapiens
tgttcatttagataatttga

SEQ ID NO: 6513507 - DNA, 13 bp, Homo sapiens
tgttcatttcctc

SEQ ID NO: 6513508 - DNA, 16 bp, Homo sapiens
tgttcatttctaaatt

SEQ ID NO: 6513509 - DNA, 14 bp, Homo sapiens
tgttcatttctgtc

SEQ ID NO: 6513510 - DNA, 15 bp, Homo sapiens
tgttcatttctgtct

SEQ ID NO: 6513511 - DNA, 14 bp, Homo sapiens
tgttcatttgaaac

SEQ ID NO: 6513512 - DNA, 16 bp, Homo sapiens
tgttcatttgaaacct

SEQ ID NO: 6513513 - DNA, 21 bp, Homo sapiens
tgttcatttgaaacctttttc

SEQ ID NO: 6513514 - DNA, 17 bp, Homo sapiens
tgttcatttgaagaaaa

SEQ ID NO: 6513515 - DNA, 20 bp, Homo sapiens
tgttcatttggtgttcctgg

SEQ ID NO: 6513516 - DNA, 15 bp, Homo sapiens
tgttcattttaagta

SEQ ID NO: 6513517 - DNA, 23 bp, Homo sapiens
tgttcattttaagtaacgtgctc

SEQ ID NO: 6513518 - DNA, 17 bp, Homo sapiens
tgttcattttaagtgat

SEQ ID NO: 6513519 - DNA, 18 bp, Homo sapiens
tgttcattttagtgactg

SEQ ID NO: 6513520 - DNA, 18 bp, Homo sapiens
tgttcattttattttcat

SEQ ID NO: 6513521 - DNA, 13 bp, Homo sapiens
tgttcattttctc

SEQ ID NO: 6513522 - DNA, 16 bp, Homo sapiens
tgttccaaagccagtg

SEQ ID NO: 6513523 - DNA, 18 bp, Homo sapiens
tgttccaaagccagtgaa

SEQ ID NO: 6513524 - DNA, 21 bp, Homo sapiens
tgttccaaattcagtttcata

SEQ ID NO: 6513525 - DNA, 20 bp, Homo sapiens
tgttccaacctcctgctctg

SEQ ID NO: 6513526 - DNA, 19 bp, Homo sapiens
tgttccaagacattgtcaa

SEQ ID NO: 6513527 - DNA, 14 bp, Homo sapiens
tgttccaagtgtgt

SEQ ID NO: 6513528 - DNA, 21 bp, Homo sapiens
tgttccaatgccacatacttg

SEQ ID NO: 6513529 - DNA, 19 bp, Homo sapiens
tgttccacaagttaaataa

SEQ ID NO: 6513530 - DNA, 20 bp, Homo sapiens
tgttccacaagttaaataaa

SEQ ID NO: 6513531 - DNA, 22 bp, Homo sapiens
tgttccaccaaatacaattcaa

SEQ ID NO: 6513532 - DNA, 19 bp, Homo sapiens
tgttccacccgacctctga

SEQ ID NO: 6513533 - DNA, 16 bp, Homo sapiens
tgttccacctgccaca

SEQ ID NO: 6513534 - DNA, 17 bp, Homo sapiens
tgttccagattcctatg

SEQ ID NO: 6513535 - DNA, 23 bp, Homo sapiens
tgttccagattcctatgatggat

SEQ ID NO: 6513536 - DNA, 16 bp, Homo sapiens
tgttccagctgcctgg

SEQ ID NO: 6513537 - DNA, 14 bp, Homo sapiens
tgttccagcttcta

SEQ ID NO: 6513538 - DNA, 19 bp, Homo sapiens
tgttccaggccctccagtg

SEQ ID NO: 6513539 - DNA, 14 bp, Homo sapiens
tgttccaggctcac

SEQ ID NO: 6513540 - DNA, 21 bp, Homo sapiens
tgttccagtgaggaaccctga

SEQ ID NO: 6513541 - DNA, 14 bp, Homo sapiens
tgttccagtgttta

SEQ ID NO: 6513542 - DNA, 18 bp, Homo sapiens
tgttccatcctgtacaag

SEQ ID NO: 6513543 - DNA, 19 bp, Homo sapiens
tgttccatgcctggccctt

SEQ ID NO: 6513544 - DNA, 18 bp, Homo sapiens
tgttccattacaccacag

SEQ ID NO: 6513545 - DNA, 21 bp, Homo sapiens
tgttccattgaagccgactct

SEQ ID NO: 6513546 - DNA, 19 bp, Homo sapiens
tgttccattttatgcagaa

SEQ ID NO: 6513547 - DNA, 16 bp, Homo sapiens
tgttcccaagagcatc

SEQ ID NO: 6513548 - DNA, 23 bp, Homo sapiens
tgttcccaaggacttccacattt

SEQ ID NO: 6513549 - DNA, 16 bp, Homo sapiens
tgttcccaaggcccca

SEQ ID NO: 6513550 - DNA, 17 bp, Homo sapiens
tgttcccaatatgtagc

SEQ ID NO: 6513551 - DNA, 20 bp, Homo sapiens
tgttcccacaatggctggga

SEQ ID NO: 6513552 - DNA, 21 bp, Homo sapiens
tgttcccaccaggctgctcag

SEQ ID NO: 6513553 - DNA, 21 bp, Homo sapiens
tgttcccactcagcagtgaga

SEQ ID NO: 6513554 - DNA, 17 bp, Homo sapiens
tgttcccactgaaatgg

SEQ ID NO: 6513555 - DNA, 16 bp, Homo sapiens
tgttcccagaggcagg

SEQ ID NO: 6513556 - DNA, 17 bp, Homo sapiens
tgttcccagaggcaggc

SEQ ID NO: 6513557 - DNA, 15 bp, Homo sapiens
tgttcccagcccctc

SEQ ID NO: 6513558 - DNA, 20 bp, Homo sapiens
tgttcccagcccctcctccc

SEQ ID NO: 6513559 - DNA, 23 bp, Homo sapiens
tgttcccagcccctcctccctca

SEQ ID NO: 6513560 - DNA, 17 bp, Homo sapiens
tgttcccagcccctgca

SEQ ID NO: 6513561 - DNA, 17 bp, Homo sapiens
tgttcccaggctgcccc

SEQ ID NO: 6513562 - DNA, 21 bp, Homo sapiens
tgttcccagtagttataaagt

SEQ ID NO: 6513563 - DNA, 22 bp, Homo sapiens
tgttcccagtgacacttcagag

SEQ ID NO: 6513564 - DNA, 18 bp, Homo sapiens
tgttcccatcctcttctt

SEQ ID NO: 6513565 - DNA, 16 bp, Homo sapiens
tgttcccatttcagct

SEQ ID NO: 6513566 - DNA, 13 bp, Homo sapiens
tgttccccaccca

SEQ ID NO: 6513567 - DNA, 19 bp, Homo sapiens
tgttccccaccgccctgcc

SEQ ID NO: 6513568 - DNA, 22 bp, Homo sapiens
tgttccccactgacagcctccc

SEQ ID NO: 6513569 - DNA, 14 bp, Homo sapiens
tgttccccactgga

SEQ ID NO: 6513570 - DNA, 18 bp, Homo sapiens
tgttccccatggccactt

SEQ ID NO: 6513571 - DNA, 17 bp, Homo sapiens
tgttcccccagcctgcc

SEQ ID NO: 6513572 - DNA, 16 bp, Homo sapiens
tgttccccctgtgcag

SEQ ID NO: 6513573 - DNA, 15 bp, Homo sapiens
tgttcccctaagtgg

SEQ ID NO: 6513574 - DNA, 15 bp, Homo sapiens
tgttcccctcactgg

SEQ ID NO: 6513575 - DNA, 15 bp, Homo sapiens
tgttcccctccccct

SEQ ID NO: 6513576 - DNA, 13 bp, Homo sapiens
tgttcccctctcc

SEQ ID NO: 6513577 - DNA, 15 bp, Homo sapiens
tgttcccctctccct

SEQ ID NO: 6513578 - DNA, 21 bp, Homo sapiens
tgttcccctctcccttccctc

SEQ ID NO: 6513579 - DNA, 20 bp, Homo sapiens
tgttcccctcttccctacac

SEQ ID NO: 6513580 - DNA, 18 bp, Homo sapiens
tgttcccctcttgtctcc

SEQ ID NO: 6513581 - DNA, 21 bp, Homo sapiens
tgttcccctcttgtctcccct

SEQ ID NO: 6513582 - DNA, 22 bp, Homo sapiens
tgttcccctcttgtctcccctg

SEQ ID NO: 6513583 - DNA, 14 bp, Homo sapiens
tgttcccctgtcct

SEQ ID NO: 6513584 - DNA, 17 bp, Homo sapiens
tgttccccttccactga

SEQ ID NO: 6513585 - DNA, 16 bp, Homo sapiens
tgttccccttccctca

SEQ ID NO: 6513586 - DNA, 22 bp, Homo sapiens
tgttcccctttgcttcattcaa

SEQ ID NO: 6513587 - DNA, 21 bp, Homo sapiens
tgttcccgagcgatagatggg

SEQ ID NO: 6513588 - DNA, 16 bp, Homo sapiens
tgttcccgtgcctggg

SEQ ID NO: 6513589 - DNA, 13 bp, Homo sapiens
tgttccctagaga

SEQ ID NO: 6513590 - DNA, 19 bp, Homo sapiens
tgttccctagagagaataa

SEQ ID NO: 6513591 - DNA, 20 bp, Homo sapiens
tgttccctagagagaataaa

SEQ ID NO: 6513592 - DNA, 20 bp, Homo sapiens
tgttccctatggagaggctt

SEQ ID NO: 6513593 - DNA, 22 bp, Homo sapiens
tgttccctatttttctctcctg

SEQ ID NO: 6513594 - DNA, 14 bp, Homo sapiens
tgttccctccaagg

SEQ ID NO: 6513595 - DNA, 13 bp, Homo sapiens
tgttccctcctgg

SEQ ID NO: 6513596 - DNA, 18 bp, Homo sapiens
tgttccctctgctcctgg

SEQ ID NO: 6513597 - DNA, 18 bp, Homo sapiens
tgttccctctggcttccc

SEQ ID NO: 6513598 - DNA, 14 bp, Homo sapiens
tgttccctctttct

SEQ ID NO: 6513599 - DNA, 16 bp, Homo sapiens
tgttccctgcaccctg

SEQ ID NO: 6513600 - DNA, 17 bp, Homo sapiens
tgttcccttatctgttt

SEQ ID NO: 6513601 - DNA, 14 bp, Homo sapiens
tgttccctttgcct

SEQ ID NO: 6513602 - DNA, 18 bp, Homo sapiens
tgttccctttgtctttca

SEQ ID NO: 6513603 - DNA, 19 bp, Homo sapiens
tgttccctttgtctttcaa

SEQ ID NO: 6513604 - DNA, 14 bp, Homo sapiens
tgttccgcctcact

SEQ ID NO: 6513605 - DNA, 21 bp, Homo sapiens
tgttccgcttctctcttttaa

SEQ ID NO: 6513606 - DNA, 21 bp, Homo sapiens
tgttccgtggttaaactcgct

SEQ ID NO: 6513607 - DNA, 21 bp, Homo sapiens
tgttccgttcatctgaggagt

SEQ ID NO: 6513608 - DNA, 23 bp, Homo sapiens
tgttcctaaaaatctgtggcaag

SEQ ID NO: 6513609 - DNA, 16 bp, Homo sapiens
tgttcctaacaaaatg

SEQ ID NO: 6513610 - DNA, 20 bp, Homo sapiens
tgttcctaacaaaatgagat

SEQ ID NO: 6513611 - DNA, 18 bp, Homo sapiens
tgttcctaagttcttaga

SEQ ID NO: 6513612 - DNA, 19 bp, Homo sapiens
tgttcctacagcccctttt

SEQ ID NO: 6513613 - DNA, 15 bp, Homo sapiens
tgttcctacgggctt

SEQ ID NO: 6513614 - DNA, 22 bp, Homo sapiens
tgttcctactcacacttcagct

SEQ ID NO: 6513615 - DNA, 14 bp, Homo sapiens
tgttcctagagtag

SEQ ID NO: 6513616 - DNA, 18 bp, Homo sapiens
tgttcctagtgaaagagg

SEQ ID NO: 6513617 - DNA, 21 bp, Homo sapiens
tgttcctatattccaggttta

SEQ ID NO: 6513618 - DNA, 16 bp, Homo sapiens
tgttcctatctgcagg

SEQ ID NO: 6513619 - DNA, 21 bp, Homo sapiens
tgttcctatggaaacatttta

SEQ ID NO: 6513620 - DNA, 20 bp, Homo sapiens
tgttcctcatgttgctgaat

SEQ ID NO: 6513621 - DNA, 15 bp, Homo sapiens
tgttcctccattttc

SEQ ID NO: 6513622 - DNA, 17 bp, Homo sapiens
tgttcctccattttctt

SEQ ID NO: 6513623 - DNA, 23 bp, Homo sapiens
tgttcctcccaagaggccagggt

SEQ ID NO: 6513624 - DNA, 18 bp, Homo sapiens
tgttcctccctcccacac

SEQ ID NO: 6513625 - DNA, 24 bp, Homo sapiens
tgttcctcggtgggccagagctga

SEQ ID NO: 6513626 - DNA, 18 bp, Homo sapiens
tgttcctctatactttgt

SEQ ID NO: 6513627 - DNA, 19 bp, Homo sapiens
tgttcctctatactttgtt

SEQ ID NO: 6513628 - DNA, 15 bp, Homo sapiens
tgttcctgaagctgc

SEQ ID NO: 6513629 - DNA, 20 bp, Homo sapiens
tgttcctgaagctgctgtgt

SEQ ID NO: 6513630 - DNA, 14 bp, Homo sapiens
tgttcctgactgtt

SEQ ID NO: 6513631 - DNA, 10 bp, Homo sapiens
tgttcctgcc

SEQ ID NO: 6513632 - DNA, 13 bp, Homo sapiens
tgttcctgccttc

SEQ ID NO: 6513633 - DNA, 16 bp, Homo sapiens
tgttcctgccttctct

SEQ ID NO: 6513634 - DNA, 19 bp, Homo sapiens
tgttcctgctccatgactg

SEQ ID NO: 6513635 - DNA, 13 bp, Homo sapiens
tgttcctgctgta

SEQ ID NO: 6513636 - DNA, 15 bp, Homo sapiens
tgttcctgctgtatt

SEQ ID NO: 6513637 - DNA, 16 bp, Homo sapiens
tgttcctgctgtattt

SEQ ID NO: 6513638 - DNA, 17 bp, Homo sapiens
tgttcctgctttctctt

SEQ ID NO: 6513639 - DNA, 10 bp, Homo sapiens
tgttcctgga

SEQ ID NO: 6513640 - DNA, 13 bp, Homo sapiens
tgttcctggaagc

SEQ ID NO: 6513641 - DNA, 19 bp, Homo sapiens
tgttcctggcagtttaaaa

SEQ ID NO: 6513642 - DNA, 14 bp, Homo sapiens
tgttcctggcctca

SEQ ID NO: 6513643 - DNA, 24 bp, Homo sapiens
tgttcctggcctcagccagctgcc

SEQ ID NO: 6513644 - DNA, 17 bp, Homo sapiens
tgttcctggctgatgat

SEQ ID NO: 6513645 - DNA, 13 bp, Homo sapiens
tgttcctgtctca

SEQ ID NO: 6513646 - DNA, 13 bp, Homo sapiens
tgttcctgtgcat

SEQ ID NO: 6513647 - DNA, 14 bp, Homo sapiens
tgttcctgtgctta

SEQ ID NO: 6513648 - DNA, 15 bp, Homo sapiens
tgttcctgtgttctt

SEQ ID NO: 6513649 - DNA, 23 bp, Homo sapiens
tgttcctgtttatttttaaattt

SEQ ID NO: 6513650 - DNA, 19 bp, Homo sapiens
tgttccttagaccttccat

SEQ ID NO: 6513651 - DNA, 22 bp, Homo sapiens
tgttccttagtggtagaggtgt

SEQ ID NO: 6513652 - DNA, 21 bp, Homo sapiens
tgttccttatgatattctcat

SEQ ID NO: 6513653 - DNA, 16 bp, Homo sapiens
tgttccttatttctct

SEQ ID NO: 6513654 - DNA, 13 bp, Homo sapiens
tgttccttcctcc

SEQ ID NO: 6513655 - DNA, 13 bp, Homo sapiens
tgttccttcctgc

SEQ ID NO: 6513656 - DNA, 14 bp, Homo sapiens
tgttccttcctgca

SEQ ID NO: 6513657 - DNA, 15 bp, Homo sapiens
tgttccttcctgcag

SEQ ID NO: 6513658 - DNA, 23 bp, Homo sapiens
tgttccttcctgcagacctggct

SEQ ID NO: 6513659 - DNA, 16 bp, Homo sapiens
tgttccttctgtgaag

SEQ ID NO: 6513660 - DNA, 18 bp, Homo sapiens
tgttccttctgtgaagaa

SEQ ID NO: 6513661 - DNA, 13 bp, Homo sapiens
tgttccttgcttt

SEQ ID NO: 6513662 - DNA, 16 bp, Homo sapiens
tgttccttgtactctt

SEQ ID NO: 6513663 - DNA, 19 bp, Homo sapiens
tgttccttgtactcttagg

SEQ ID NO: 6513664 - DNA, 20 bp, Homo sapiens
tgttccttgtactcttagga

SEQ ID NO: 6513665 - DNA, 13 bp, Homo sapiens
tgttcctttctct

SEQ ID NO: 6513666 - DNA, 19 bp, Homo sapiens
tgttcctttgtaattgaca

SEQ ID NO: 6513667 - DNA, 15 bp, Homo sapiens
tgttccttttattta

SEQ ID NO: 6513668 - DNA, 15 bp, Homo sapiens
tgttccttttgaaat

SEQ ID NO: 6513669 - DNA, 17 bp, Homo sapiens
tgttcctttttaaatgt

SEQ ID NO: 6513670 - DNA, 14 bp, Homo sapiens
tgttcctttttctg

SEQ ID NO: 6513671 - DNA, 18 bp, Homo sapiens
tgttcctttttctgggtt

SEQ ID NO: 6513672 - DNA, 16 bp, Homo sapiens
tgttcgaagttcattt

SEQ ID NO: 6513673 - DNA, 22 bp, Homo sapiens
tgttcgatgcctgcatgctgaa

SEQ ID NO: 6513674 - DNA, 20 bp, Homo sapiens
tgttcgcatggtcacacact

SEQ ID NO: 6513675 - DNA, 23 bp, Homo sapiens
tgttcgccgtctggcgagccctt

SEQ ID NO: 6513676 - DNA, 20 bp, Homo sapiens
tgttcgggggacaacttgta

SEQ ID NO: 6513677 - DNA, 17 bp, Homo sapiens
tgttcgggggagcagag

SEQ ID NO: 6513678 - DNA, 22 bp, Homo sapiens
tgttcgtctttagttttgattt

SEQ ID NO: 6513679 - DNA, 19 bp, Homo sapiens
tgttcgttggttatacaag

SEQ ID NO: 6513680 - DNA, 23 bp, Homo sapiens
tgttcgtttccatcatgtctgta

SEQ ID NO: 6513681 - DNA, 14 bp, Homo sapiens
tgttctaaaatata

SEQ ID NO: 6513682 - DNA, 14 bp, Homo sapiens
tgttctaaaatgaa

SEQ ID NO: 6513683 - DNA, 22 bp, Homo sapiens
tgttctaaaatgtcaaggcagt

SEQ ID NO: 6513684 - DNA, 16 bp, Homo sapiens
tgttctaaagctctga

SEQ ID NO: 6513685 - DNA, 13 bp, Homo sapiens
tgttctaagatgt

SEQ ID NO: 6513686 - DNA, 20 bp, Homo sapiens
tgttctaagcaatgcaaatg

SEQ ID NO: 6513687 - DNA, 10 bp, Homo sapiens
tgttctaagg

SEQ ID NO: 6513688 - DNA, 14 bp, Homo sapiens
tgttctaaggctct

SEQ ID NO: 6513689 - DNA, 18 bp, Homo sapiens
tgttctaaggctctgaga

SEQ ID NO: 6513690 - DNA, 17 bp, Homo sapiens
tgttctaagtctttcca

SEQ ID NO: 6513691 - DNA, 13 bp, Homo sapiens
tgttctaagtgcc

SEQ ID NO: 6513692 - DNA, 15 bp, Homo sapiens
tgttctaatggatta

SEQ ID NO: 6513693 - DNA, 22 bp, Homo sapiens
tgttctaattaataaattattt

SEQ ID NO: 6513694 - DNA, 17 bp, Homo sapiens
tgttctacccgttccaa

SEQ ID NO: 6513695 - DNA, 21 bp, Homo sapiens
tgttctaccgtggatttgtac

SEQ ID NO: 6513696 - DNA, 18 bp, Homo sapiens
tgttctactcatatatat

SEQ ID NO: 6513697 - DNA, 19 bp, Homo sapiens
tgttctactcttaatgatg

SEQ ID NO: 6513698 - DNA, 16 bp, Homo sapiens
tgttctacttgatatt

SEQ ID NO: 6513699 - DNA, 11 bp, Homo sapiens
tgttctagact

SEQ ID NO: 6513700 - DNA, 16 bp, Homo sapiens
tgttctagacttcccc

SEQ ID NO: 6513701 - DNA, 20 bp, Homo sapiens
tgttctagacttccccatcc

SEQ ID NO: 6513702 - DNA, 20 bp, Homo sapiens
tgttctaggtcagtctaaca

SEQ ID NO: 6513703 - DNA, 22 bp, Homo sapiens
tgttctagttttcagtttgtat

SEQ ID NO: 6513704 - DNA, 21 bp, Homo sapiens
tgttctagttttttacttttg

SEQ ID NO: 6513705 - DNA, 18 bp, Homo sapiens
tgttctatagagcctggc

SEQ ID NO: 6513706 - DNA, 15 bp, Homo sapiens
tgttctatgaacaac

SEQ ID NO: 6513707 - DNA, 17 bp, Homo sapiens
tgttctatggttatgaa

SEQ ID NO: 6513708 - DNA, 16 bp, Homo sapiens
tgttctattcatctca

SEQ ID NO: 6513709 - DNA, 15 bp, Homo sapiens
tgttctcaacacaca

SEQ ID NO: 6513710 - DNA, 20 bp, Homo sapiens
tgttctcaacacacagtata

SEQ ID NO: 6513711 - DNA, 23 bp, Homo sapiens
tgttctcaacacacagtatagat

SEQ ID NO: 6513712 - DNA, 13 bp, Homo sapiens
tgttctcaatcat

SEQ ID NO: 6513713 - DNA, 14 bp, Homo sapiens
tgttctcaatcatt

SEQ ID NO: 6513714 - DNA, 22 bp, Homo sapiens
tgttctcaatcattgtcagaga

SEQ ID NO: 6513715 - DNA, 23 bp, Homo sapiens
tgttctcaatcattgtcagagat

SEQ ID NO: 6513716 - DNA, 14 bp, Homo sapiens
tgttctcaatgctt

SEQ ID NO: 6513717 - DNA, 13 bp, Homo sapiens
tgttctcagaatc

SEQ ID NO: 6513718 - DNA, 12 bp, Homo sapiens
tgttctcagatt

SEQ ID NO: 6513719 - DNA, 10 bp, Homo sapiens
tgttctcagc

SEQ ID NO: 6513720 - DNA, 15 bp, Homo sapiens
tgttctcagcacata

SEQ ID NO: 6513721 - DNA, 16 bp, Homo sapiens
tgttctcagcacatat

SEQ ID NO: 6513722 - DNA, 15 bp, Homo sapiens
tgttctcagctcccc

SEQ ID NO: 6513723 - DNA, 14 bp, Homo sapiens
tgttctcaggggtg

SEQ ID NO: 6513724 - DNA, 17 bp, Homo sapiens
tgttctcaggggtgctg

SEQ ID NO: 6513725 - DNA, 15 bp, Homo sapiens
tgttctcatgaacta

SEQ ID NO: 6513726 - DNA, 17 bp, Homo sapiens
tgttctcatgaagcagg

SEQ ID NO: 6513727 - DNA, 20 bp, Homo sapiens
tgttctcatgtttgtgcatg

SEQ ID NO: 6513728 - DNA, 22 bp, Homo sapiens
tgttctcattcctgttctttct

SEQ ID NO: 6513729 - DNA, 16 bp, Homo sapiens
tgttctcatttgatca

SEQ ID NO: 6513730 - DNA, 14 bp, Homo sapiens
tgttctccaggctt

SEQ ID NO: 6513731 - DNA, 18 bp, Homo sapiens
tgttctccaggcttcaca

SEQ ID NO: 6513732 - DNA, 20 bp, Homo sapiens
tgttctccaggcttcacagt

SEQ ID NO: 6513733 - DNA, 20 bp, Homo sapiens
tgttctccattttcaagctg

SEQ ID NO: 6513734 - DNA, 20 bp, Homo sapiens
tgttctccctttctctctcc

SEQ ID NO: 6513735 - DNA, 17 bp, Homo sapiens
tgttctcctgaatattt

SEQ ID NO: 6513736 - DNA, 11 bp, Homo sapiens
tgttctcctgc

SEQ ID NO: 6513737 - DNA, 23 bp, Homo sapiens
tgttctcctgctgctccctcaga

SEQ ID NO: 6513738 - DNA, 23 bp, Homo sapiens
tgttctcctgtccctccatccca

SEQ ID NO: 6513739 - DNA, 18 bp, Homo sapiens
tgttctcggagtgtgtat

SEQ ID NO: 6513740 - DNA, 17 bp, Homo sapiens
tgttctcgttgccctaa

SEQ ID NO: 6513741 - DNA, 15 bp, Homo sapiens
tgttctcgttttgaa

SEQ ID NO: 6513742 - DNA, 11 bp, Homo sapiens
tgttctctaga

SEQ ID NO: 6513743 - DNA, 15 bp, Homo sapiens
tgttctctcccaggg

SEQ ID NO: 6513744 - DNA, 20 bp, Homo sapiens
tgttctctccccttgcactg

SEQ ID NO: 6513745 - DNA, 20 bp, Homo sapiens
tgttctctcttggtctcttt

SEQ ID NO: 6513746 - DNA, 19 bp, Homo sapiens
tgttctctgaattttcaga

SEQ ID NO: 6513747 - DNA, 14 bp, Homo sapiens
tgttctctgccctc

SEQ ID NO: 6513748 - DNA, 15 bp, Homo sapiens
tgttctctgccctcc

SEQ ID NO: 6513749 - DNA, 15 bp, Homo sapiens
tgttctctgggagaa

SEQ ID NO: 6513750 - DNA, 17 bp, Homo sapiens
tgttctcttactgccga

SEQ ID NO: 6513751 - DNA, 13 bp, Homo sapiens
tgttctcttctgc

SEQ ID NO: 6513752 - DNA, 20 bp, Homo sapiens
tgttctcttctgcgtaggcg

SEQ ID NO: 6513753 - DNA, 14 bp, Homo sapiens
tgttctcttcttca

SEQ ID NO: 6513754 - DNA, 20 bp, Homo sapiens
tgttctcttcttcattctat

SEQ ID NO: 6513755 - DNA, 13 bp, Homo sapiens
tgttctcttgctt

SEQ ID NO: 6513756 - DNA, 17 bp, Homo sapiens
tgttctctttgctgaca

SEQ ID NO: 6513757 - DNA, 20 bp, Homo sapiens
tgttctctttgctgacactg

SEQ ID NO: 6513758 - DNA, 17 bp, Homo sapiens
tgttctgaaaggagaca

SEQ ID NO: 6513759 - DNA, 17 bp, Homo sapiens
tgttctgaaatgttctt

SEQ ID NO: 6513760 - DNA, 18 bp, Homo sapiens
tgttctgaaatgttctta

SEQ ID NO: 6513761 - DNA, 15 bp, Homo sapiens
tgttctgaactgtgg

SEQ ID NO: 6513762 - DNA, 19 bp, Homo sapiens
tgttctgaaggtgcccagg

SEQ ID NO: 6513763 - DNA, 16 bp, Homo sapiens
tgttctgacagcattt

SEQ ID NO: 6513764 - DNA, 17 bp, Homo sapiens
tgttctgacattaacag

SEQ ID NO: 6513765 - DNA, 12 bp, Homo sapiens
tgttctgagccc

SEQ ID NO: 6513766 - DNA, 20 bp, Homo sapiens
tgttctgagtaagtgtgttc

SEQ ID NO: 6513767 - DNA, 14 bp, Homo sapiens
tgttctgattagaa

SEQ ID NO: 6513768 - DNA, 22 bp, Homo sapiens
tgttctgattagaaatgaccaa

SEQ ID NO: 6513769 - DNA, 15 bp, Homo sapiens
tgttctgattatgta

SEQ ID NO: 6513770 - DNA, 23 bp, Homo sapiens
tgttctgcaaaaatatttataaa

SEQ ID NO: 6513771 - DNA, 18 bp, Homo sapiens
tgttctgcaagaattaaa

SEQ ID NO: 6513772 - DNA, 22 bp, Homo sapiens
tgttctgcaagaattaaaactg

SEQ ID NO: 6513773 - DNA, 20 bp, Homo sapiens
tgttctgcaatatgcctagt

SEQ ID NO: 6513774 - DNA, 12 bp, Homo sapiens
tgttctgcactg

SEQ ID NO: 6513775 - DNA, 14 bp, Homo sapiens
tgttctgcactgaa

SEQ ID NO: 6513776 - DNA, 15 bp, Homo sapiens
tgttctgcactgaaa

SEQ ID NO: 6513777 - DNA, 15 bp, Homo sapiens
tgttctgcagagact

SEQ ID NO: 6513778 - DNA, 22 bp, Homo sapiens
tgttctgcagagacttctagga

SEQ ID NO: 6513779 - DNA, 21 bp, Homo sapiens
tgttctgcagtggagaagaca

SEQ ID NO: 6513780 - DNA, 17 bp, Homo sapiens
tgttctgcatggattca

SEQ ID NO: 6513781 - DNA, 20 bp, Homo sapiens
tgttctgcatggattcagca

SEQ ID NO: 6513782 - DNA, 17 bp, Homo sapiens
tgttctgctccatacct

SEQ ID NO: 6513783 - DNA, 13 bp, Homo sapiens
tgttctgctcctg

SEQ ID NO: 6513784 - DNA, 15 bp, Homo sapiens
tgttctgctcctgct

SEQ ID NO: 6513785 - DNA, 20 bp, Homo sapiens
tgttctgctcctgcttttct

SEQ ID NO: 6513786 - DNA, 11 bp, Homo sapiens
tgttctgctga

SEQ ID NO: 6513787 - DNA, 15 bp, Homo sapiens
tgttctgctgagact

SEQ ID NO: 6513788 - DNA, 20 bp, Homo sapiens
tgttctgctgtctgggactc

SEQ ID NO: 6513789 - DNA, 13 bp, Homo sapiens
tgttctgctttat

SEQ ID NO: 6513790 - DNA, 15 bp, Homo sapiens
tgttctgctttcctc

SEQ ID NO: 6513791 - DNA, 12 bp, Homo sapiens
tgttctggacct

SEQ ID NO: 6513792 - DNA, 16 bp, Homo sapiens
tgttctggagctgctg

SEQ ID NO: 6513793 - DNA, 13 bp, Homo sapiens
tgttctggaggaa

SEQ ID NO: 6513794 - DNA, 13 bp, Homo sapiens
tgttctggccctc

SEQ ID NO: 6513795 - DNA, 16 bp, Homo sapiens
tgttctggctcttcca

SEQ ID NO: 6513796 - DNA, 20 bp, Homo sapiens
tgttctggctcttccaggct

SEQ ID NO: 6513797 - DNA, 16 bp, Homo sapiens
tgttctgggacacagt

SEQ ID NO: 6513798 - DNA, 20 bp, Homo sapiens
tgttctgggagttgctgtta

SEQ ID NO: 6513799 - DNA, 18 bp, Homo sapiens
tgttctgggatttctcta

SEQ ID NO: 6513800 - DNA, 18 bp, Homo sapiens
tgttctgggcatggcagg

SEQ ID NO: 6513801 - DNA, 12 bp, Homo sapiens
tgttctgggctg

SEQ ID NO: 6513802 - DNA, 13 bp, Homo sapiens
tgttctgggctgg

SEQ ID NO: 6513803 - DNA, 17 bp, Homo sapiens
tgttctgggctggggcc

SEQ ID NO: 6513804 - DNA, 22 bp, Homo sapiens
tgttctggggggacccagtgca

SEQ ID NO: 6513805 - DNA, 21 bp, Homo sapiens
tgttctgggtgatttctagaa

SEQ ID NO: 6513806 - DNA, 19 bp, Homo sapiens
tgttctgggttaacagtaa

SEQ ID NO: 6513807 - DNA, 23 bp, Homo sapiens
tgttctggtatttcccctgtcag

SEQ ID NO: 6513808 - DNA, 20 bp, Homo sapiens
tgttctggtgaggccttgct

SEQ ID NO: 6513809 - DNA, 15 bp, Homo sapiens
tgttctggtggcccc

SEQ ID NO: 6513810 - DNA, 20 bp, Homo sapiens
tgttctggtggtttgattgt

SEQ ID NO: 6513811 - DNA, 16 bp, Homo sapiens
tgttctgtagactgcc

SEQ ID NO: 6513812 - DNA, 22 bp, Homo sapiens
tgttctgtagcttatctgcccc

SEQ ID NO: 6513813 - DNA, 12 bp, Homo sapiens
tgttctgtattt

SEQ ID NO: 6513814 - DNA, 13 bp, Homo sapiens
tgttctgtatttt

SEQ ID NO: 6513815 - DNA, 21 bp, Homo sapiens
tgttctgtccagtttccaaag

SEQ ID NO: 6513816 - DNA, 13 bp, Homo sapiens
tgctctccatctc

SEQ ID NO: 6513817 - DNA, 14 bp, Homo sapiens
tgctctccatctct

SEQ ID NO: 6513818 - DNA, 21 bp, Homo sapiens
tgctctccattctgctccttc

SEQ ID NO: 6513819 - DNA, 13 bp, Homo sapiens
tgctctcccaggt

SEQ ID NO: 6513820 - DNA, 15 bp, Homo sapiens
tgctctcccaggtga

SEQ ID NO: 6513821 - DNA, 18 bp, Homo sapiens
tgctctccccggcaggcc

SEQ ID NO: 6513822 - DNA, 19 bp, Homo sapiens
tgctctccccggcaggcct

SEQ ID NO: 6513823 - DNA, 15 bp, Homo sapiens
tgctctcccctccca

SEQ ID NO: 6513824 - DNA, 12 bp, Homo sapiens
tgctctcccctg

SEQ ID NO: 6513825 - DNA, 17 bp, Homo sapiens
tgctctcccctgccctg

SEQ ID NO: 6513826 - DNA, 23 bp, Homo sapiens
tgctctccgaccagacaccttga

SEQ ID NO: 6513827 - DNA, 21 bp, Homo sapiens
tgctctccggcgcagacaggc

SEQ ID NO: 6513828 - DNA, 14 bp, Homo sapiens
tgctctcctcatct

SEQ ID NO: 6513829 - DNA, 21 bp, Homo sapiens
tgctctcctcgggccctgtgg

SEQ ID NO: 6513830 - DNA, 23 bp, Homo sapiens
tgctctcctcgggccctgtggtg

SEQ ID NO: 6513831 - DNA, 15 bp, Homo sapiens
tgctctcctcttcta

SEQ ID NO: 6513832 - DNA, 16 bp, Homo sapiens
tgctctcctcttgcca

SEQ ID NO: 6513833 - DNA, 14 bp, Homo sapiens
tgctctcctgacag

SEQ ID NO: 6513834 - DNA, 22 bp, Homo sapiens
tgctctcctgacagccacacgc

SEQ ID NO: 6513835 - DNA, 12 bp, Homo sapiens
tgctctcctgga

SEQ ID NO: 6513836 - DNA, 21 bp, Homo sapiens
tgctctcctggagcaagctct

SEQ ID NO: 6513837 - DNA, 12 bp, Homo sapiens
tgctctccttcc

SEQ ID NO: 6513838 - DNA, 18 bp, Homo sapiens
tgctctccttgccctggg

SEQ ID NO: 6513839 - DNA, 13 bp, Homo sapiens
tgctctctaaact

SEQ ID NO: 6513840 - DNA, 14 bp, Homo sapiens
tgctctctacccag

SEQ ID NO: 6513841 - DNA, 17 bp, Homo sapiens
tgctctctacccagccc

SEQ ID NO: 6513842 - DNA, 18 bp, Homo sapiens
tgctctctacccagccca

SEQ ID NO: 6513843 - DNA, 19 bp, Homo sapiens
tgctctctacccagcccat

SEQ ID NO: 6513844 - DNA, 15 bp, Homo sapiens
tgctctctcattccc

SEQ ID NO: 6513845 - DNA, 14 bp, Homo sapiens
tgctctctctccct

SEQ ID NO: 6513846 - DNA, 15 bp, Homo sapiens
tgctctctctccctg

SEQ ID NO: 6513847 - DNA, 17 bp, Homo sapiens
tgctctctctccctgcc

SEQ ID NO: 6513848 - DNA, 18 bp, Homo sapiens
tgctctctgaacagaagg

SEQ ID NO: 6513849 - DNA, 17 bp, Homo sapiens
tgctctctgagagcaca

SEQ ID NO: 6513850 - DNA, 13 bp, Homo sapiens
tgctctctgagtt

SEQ ID NO: 6513851 - DNA, 14 bp, Homo sapiens
tgctctctgctgga

SEQ ID NO: 6513852 - DNA, 14 bp, Homo sapiens
tgctctctgtgacc

SEQ ID NO: 6513853 - DNA, 14 bp, Homo sapiens
tgctctctgttctc

SEQ ID NO: 6513854 - DNA, 19 bp, Homo sapiens
tgctctctgttctcttgct

SEQ ID NO: 6513855 - DNA, 16 bp, Homo sapiens
tgctctcttcaataaa

SEQ ID NO: 6513856 - DNA, 18 bp, Homo sapiens
tgctctcttcaataaacc

SEQ ID NO: 6513857 - DNA, 12 bp, Homo sapiens
tgctctcttcag

SEQ ID NO: 6513858 - DNA, 22 bp, Homo sapiens
tgctctcttgtgacgtgcactg

SEQ ID NO: 6513859 - DNA, 20 bp, Homo sapiens
tgctctgaatattttgtaat

SEQ ID NO: 6513860 - DNA, 12 bp, Homo sapiens
tgctctgaccct

SEQ ID NO: 6513861 - DNA, 19 bp, Homo sapiens
tgctctgaccttccagagc

SEQ ID NO: 6513862 - DNA, 21 bp, Homo sapiens
tgctctgaccttccagagccc

SEQ ID NO: 6513863 - DNA, 18 bp, Homo sapiens
tgctctgagaagaggagc

SEQ ID NO: 6513864 - DNA, 22 bp, Homo sapiens
tgctctgagaagaggagccctc

SEQ ID NO: 6513865 - DNA, 12 bp, Homo sapiens
tgctctgagagc

SEQ ID NO: 6513866 - DNA, 23 bp, Homo sapiens
tgctctgagagcaaactggcttg

SEQ ID NO: 6513867 - DNA, 21 bp, Homo sapiens
tgctctgagcacaggtgacag

SEQ ID NO: 6513868 - DNA, 15 bp, Homo sapiens
tgctctgagccacag

SEQ ID NO: 6513869 - DNA, 16 bp, Homo sapiens
tgctctgagccacagt

SEQ ID NO: 6513870 - DNA, 23 bp, Homo sapiens
tgctctgaggtcaataaagcaga

SEQ ID NO: 6513871 - DNA, 15 bp, Homo sapiens
tgctctgaggtccct

SEQ ID NO: 6513872 - DNA, 16 bp, Homo sapiens
tgctctgaggtccctt

SEQ ID NO: 6513873 - DNA, 13 bp, Homo sapiens
tgctctgatccct

SEQ ID NO: 6513874 - DNA, 16 bp, Homo sapiens
tgctctgatccctcta

SEQ ID NO: 6513875 - DNA, 19 bp, Homo sapiens
tgctctgatgaagaggagt

SEQ ID NO: 6513876 - DNA, 14 bp, Homo sapiens
tgctctgatttatc

SEQ ID NO: 6513877 - DNA, 17 bp, Homo sapiens
tgctctgatttccttcc

SEQ ID NO: 6513878 - DNA, 13 bp, Homo sapiens
tgctctgcagccc

SEQ ID NO: 6513879 - DNA, 14 bp, Homo sapiens
tgctctgcagccca

SEQ ID NO: 6513880 - DNA, 19 bp, Homo sapiens
tgctctgcagcccacagag

SEQ ID NO: 6513881 - DNA, 20 bp, Homo sapiens
tgctctgcagcccacagagg

SEQ ID NO: 6513882 - DNA, 14 bp, Homo sapiens
tgctctgcaggcag

SEQ ID NO: 6513883 - DNA, 19 bp, Homo sapiens
tgctctgcaggcagccttg

SEQ ID NO: 6513884 - DNA, 15 bp, Homo sapiens
tgctctgcatgttac

SEQ ID NO: 6513885 - DNA, 14 bp, Homo sapiens
tgctctgcccagag

SEQ ID NO: 6513886 - DNA, 17 bp, Homo sapiens
tgctctgcccagagctg

SEQ ID NO: 6513887 - DNA, 20 bp, Homo sapiens
tgctctgcccagagctgggt

SEQ ID NO: 6513888 - DNA, 20 bp, Homo sapiens
tgctctgcccaggcaaggaa

SEQ ID NO: 6513889 - DNA, 23 bp, Homo sapiens
tgctctgcccaggcaaggaacag

SEQ ID NO: 6513890 - DNA, 13 bp, Homo sapiens
tgctctgcccatg

SEQ ID NO: 6513891 - DNA, 19 bp, Homo sapiens
tgctctgccccaccttgcc

SEQ ID NO: 6513892 - DNA, 23 bp, Homo sapiens
tgctctgccccagcttgggcaga

SEQ ID NO: 6513893 - DNA, 13 bp, Homo sapiens
tgctctgcccctt

SEQ ID NO: 6513894 - DNA, 17 bp, Homo sapiens
tgctctgcgtggcgcag

SEQ ID NO: 6513895 - DNA, 22 bp, Homo sapiens
tgctctgcgtgtcacctgtgct

SEQ ID NO: 6513896 - DNA, 21 bp, Homo sapiens
tgctctgctgacagacacagg

SEQ ID NO: 6513897 - DNA, 18 bp, Homo sapiens
tgctctgctggtcttcaa

SEQ ID NO: 6513898 - DNA, 11 bp, Homo sapiens
tgctctgcttc

SEQ ID NO: 6513899 - DNA, 14 bp, Homo sapiens
tgctctgcttcctc

SEQ ID NO: 6513900 - DNA, 15 bp, Homo sapiens
tgctctgcttcctca

SEQ ID NO: 6513901 - DNA, 17 bp, Homo sapiens
tgctctgcttcctcagg

SEQ ID NO: 6513902 - DNA, 21 bp, Homo sapiens
tgctctgcttgacaacatctg

SEQ ID NO: 6513903 - DNA, 21 bp, Homo sapiens
tgctctgcttttcctgtctgt

SEQ ID NO: 6513904 - DNA, 16 bp, Homo sapiens
tgctctggaagcctgc

SEQ ID NO: 6513905 - DNA, 12 bp, Homo sapiens
tgctctggaata

SEQ ID NO: 6513906 - DNA, 15 bp, Homo sapiens
tgctctggacaggca

SEQ ID NO: 6513907 - DNA, 16 bp, Homo sapiens
tgctctggacaggcat

SEQ ID NO: 6513908 - DNA, 15 bp, Homo sapiens
tgctctggacctgcc

SEQ ID NO: 6513909 - DNA, 18 bp, Homo sapiens
tgctctggagcagccaag

SEQ ID NO: 6513910 - DNA, 18 bp, Homo sapiens
tgctctggaggaagttct

SEQ ID NO: 6513911 - DNA, 21 bp, Homo sapiens
tgctctggaggaagttctcca

SEQ ID NO: 6513912 - DNA, 18 bp, Homo sapiens
tgctctggcaccatcagc

SEQ ID NO: 6513913 - DNA, 21 bp, Homo sapiens
tgctctggcaccatcagcctg

SEQ ID NO: 6513914 - DNA, 16 bp, Homo sapiens
tgctctggcggcttcc

SEQ ID NO: 6513915 - DNA, 24 bp, Homo sapiens
tgctctggcggcttcctgtccact

SEQ ID NO: 6513916 - DNA, 16 bp, Homo sapiens
tgctctgggaaggggc

SEQ ID NO: 6513917 - DNA, 18 bp, Homo sapiens
tgctctgggctcactgca

SEQ ID NO: 6513918 - DNA, 20 bp, Homo sapiens
tgctctggggatttctggga

SEQ ID NO: 6513919 - DNA, 14 bp, Homo sapiens
tgctctggtcatac

SEQ ID NO: 6513920 - DNA, 21 bp, Homo sapiens
tgctctggtctgaccgatgtg

SEQ ID NO: 6513921 - DNA, 15 bp, Homo sapiens
tgctctggtgcacgc

SEQ ID NO: 6513922 - DNA, 22 bp, Homo sapiens
tgctctggtggcttaagtgagc

SEQ ID NO: 6513923 - DNA, 13 bp, Homo sapiens
tgctctgtacctg

SEQ ID NO: 6513924 - DNA, 16 bp, Homo sapiens
tgctctgtagccacct

SEQ ID NO: 6513925 - DNA, 20 bp, Homo sapiens
tgctctgtagccacctcctt

SEQ ID NO: 6513926 - DNA, 16 bp, Homo sapiens
tgctctgtatgtgttc

SEQ ID NO: 6513927 - DNA, 22 bp, Homo sapiens
tgctctgtccaattccagagct

SEQ ID NO: 6513928 - DNA, 11 bp, Homo sapiens
tgctctgtccc

SEQ ID NO: 6513929 - DNA, 12 bp, Homo sapiens
tgctctgtcccc

SEQ ID NO: 6513930 - DNA, 20 bp, Homo sapiens
tgctctgtcccccaggctgg

SEQ ID NO: 6513931 - DNA, 21 bp, Homo sapiens
tgctctgtcccccaggctgga

SEQ ID NO: 6513932 - DNA, 22 bp, Homo sapiens
tgctctgtcccccaggctggag

SEQ ID NO: 6513933 - DNA, 18 bp, Homo sapiens
tgctctgtcctccccacc

SEQ ID NO: 6513934 - DNA, 15 bp, Homo sapiens
tgctctgtgaactat

SEQ ID NO: 6513935 - DNA, 12 bp, Homo sapiens
tgctctgtgaca

SEQ ID NO: 6513936 - DNA, 17 bp, Homo sapiens
tgctctgtgcctgggat

SEQ ID NO: 6513937 - DNA, 14 bp, Homo sapiens
tgctctgtggcctt

SEQ ID NO: 6513938 - DNA, 19 bp, Homo sapiens
tgctctgtggtaagagata

SEQ ID NO: 6513939 - DNA, 18 bp, Homo sapiens
tgctctgtgtatatctct

SEQ ID NO: 6513940 - DNA, 22 bp, Homo sapiens
tgctctgtgtatatctcttgga

SEQ ID NO: 6513941 - DNA, 20 bp, Homo sapiens
tgctctgtgtcaaggtgaag

SEQ ID NO: 6513942 - DNA, 22 bp, Homo sapiens
tgctctgtgttcccagaggcag

SEQ ID NO: 6513943 - DNA, 16 bp, Homo sapiens
tgctctgtttgtgggg

SEQ ID NO: 6513944 - DNA, 16 bp, Homo sapiens
tgctcttaaaaatctt

SEQ ID NO: 6513945 - DNA, 19 bp, Homo sapiens
tgctcttaagtaccagaag

SEQ ID NO: 6513946 - DNA, 16 bp, Homo sapiens
tgctcttaattgccac

SEQ ID NO: 6513947 - DNA, 22 bp, Homo sapiens
tgctcttagattgggccatggc

SEQ ID NO: 6513948 - DNA, 12 bp, Homo sapiens
tgctcttagctg

SEQ ID NO: 6513949 - DNA, 18 bp, Homo sapiens
tgctcttagctgtctgct

SEQ ID NO: 6513950 - DNA, 21 bp, Homo sapiens
tgctcttagtgcccgcctagg

SEQ ID NO: 6513951 - DNA, 15 bp, Homo sapiens
tgctcttataaagtg

SEQ ID NO: 6513952 - DNA, 15 bp, Homo sapiens
tgctcttatccccag

SEQ ID NO: 6513953 - DNA, 17 bp, Homo sapiens
tgctcttatgccatttg

SEQ ID NO: 6513954 - DNA, 19 bp, Homo sapiens
tgctcttccatttcttcca

SEQ ID NO: 6513955 - DNA, 13 bp, Homo sapiens
tgctcttcccagc

SEQ ID NO: 6513956 - DNA, 22 bp, Homo sapiens
tgctcttctccacgtctttcct

SEQ ID NO: 6513957 - DNA, 20 bp, Homo sapiens
tgctcttctctccccagccc

SEQ ID NO: 6513958 - DNA, 23 bp, Homo sapiens
tgctcttctgatcagtctgtctg

SEQ ID NO: 6513959 - DNA, 15 bp, Homo sapiens
tgctcttgaactcct

SEQ ID NO: 6513960 - DNA, 20 bp, Homo sapiens
tgctcttgaactcctgacct

SEQ ID NO: 6513961 - DNA, 15 bp, Homo sapiens
tgctcttgcatctgg

SEQ ID NO: 6513962 - DNA, 16 bp, Homo sapiens
tgctcttgcatctggg

SEQ ID NO: 6513963 - DNA, 21 bp, Homo sapiens
tgctcttgcctgcacccttcc

SEQ ID NO: 6513964 - DNA, 12 bp, Homo sapiens
tgctcttggaaa

SEQ ID NO: 6513965 - DNA, 17 bp, Homo sapiens
tgctcttggctgacccc

SEQ ID NO: 6513966 - DNA, 15 bp, Homo sapiens
tgctcttgggcaata

SEQ ID NO: 6513967 - DNA, 18 bp, Homo sapiens
tgctcttgggcaatattc

SEQ ID NO: 6513968 - DNA, 19 bp, Homo sapiens
tgctcttgtagcccaggct

SEQ ID NO: 6513969 - DNA, 18 bp, Homo sapiens
tgctcttgtttcactcca

SEQ ID NO: 6513970 - DNA, 22 bp, Homo sapiens
tgctcttgtttcactccaccat

SEQ ID NO: 6513971 - DNA, 23 bp, Homo sapiens
tgctcttgtttctaacaaggact

SEQ ID NO: 6513972 - DNA, 22 bp, Homo sapiens
tgctctttaatcaaactctggt

SEQ ID NO: 6513973 - DNA, 22 bp, Homo sapiens
tgctctttacatttcttttaaa

SEQ ID NO: 6513974 - DNA, 15 bp, Homo sapiens
tgctctttagatgca

SEQ ID NO: 6513975 - DNA, 18 bp, Homo sapiens
tgctctttcaccctgcca

SEQ ID NO: 6513976 - DNA, 14 bp, Homo sapiens
tgctctttcacctg

SEQ ID NO: 6513977 - DNA, 19 bp, Homo sapiens
tgctctttcacctgggtgt

SEQ ID NO: 6513978 - DNA, 18 bp, Homo sapiens
tgctctttcatctctgct

SEQ ID NO: 6513979 - DNA, 13 bp, Homo sapiens
tgctctttccacc

SEQ ID NO: 6513980 - DNA, 13 bp, Homo sapiens
tgctctttcccag

SEQ ID NO: 6513981 - DNA, 15 bp, Homo sapiens
tgctctttcccagga

SEQ ID NO: 6513982 - DNA, 17 bp, Homo sapiens
tgctctttcccaggacg

SEQ ID NO: 6513983 - DNA, 23 bp, Homo sapiens
tgctctttcccccttccatctct

SEQ ID NO: 6513984 - DNA, 12 bp, Homo sapiens
tgctctttctct

SEQ ID NO: 6513985 - DNA, 14 bp, Homo sapiens
tgctctttctctgc

SEQ ID NO: 6513986 - DNA, 16 bp, Homo sapiens
tgctctttctctgcca

SEQ ID NO: 6513987 - DNA, 17 bp, Homo sapiens
tgctctttctctgccag

SEQ ID NO: 6513988 - DNA, 21 bp, Homo sapiens
tgctctttctctgccagtgac

SEQ ID NO: 6513989 - DNA, 22 bp, Homo sapiens
tgctctttctctgccagtgaca

SEQ ID NO: 6513990 - DNA, 18 bp, Homo sapiens
tgctctttgttcatcatt

SEQ ID NO: 6513991 - DNA, 15 bp, Homo sapiens
tgctctttgttttgt

SEQ ID NO: 6513992 - DNA, 20 bp, Homo sapiens
tgctctttgttttgtgtctc

SEQ ID NO: 6513993 - DNA, 15 bp, Homo sapiens
tgctcttttcctggt

SEQ ID NO: 6513994 - DNA, 21 bp, Homo sapiens
tgctcttttgcacaaggaaat

SEQ ID NO: 6513995 - DNA, 13 bp, Homo sapiens
tgttctgtccctt

SEQ ID NO: 6513996 - DNA, 14 bp, Homo sapiens
tgttctgtcccttc

SEQ ID NO: 6513997 - DNA, 15 bp, Homo sapiens
tgttctgtcttccca

SEQ ID NO: 6513998 - DNA, 14 bp, Homo sapiens
tgttctgtgaatag

SEQ ID NO: 6513999 - DNA, 22 bp, Homo sapiens
tgttctgtgatacagaactctt

SEQ ID NO: 6514000 - DNA, 14 bp, Homo sapiens
tgttctgtgataga

SEQ ID NO: 6514001 - DNA, 20 bp, Homo sapiens
tgttctgtgggcttggcctt

SEQ ID NO: 6514002 - DNA, 16 bp, Homo sapiens
tgttctgtgtctgctg

SEQ ID NO: 6514003 - DNA, 13 bp, Homo sapiens
tgttctgtgtctt

SEQ ID NO: 6514004 - DNA, 16 bp, Homo sapiens
tgttctgttaactgaa

SEQ ID NO: 6514005 - DNA, 15 bp, Homo sapiens
tgttctgttcacttt

SEQ ID NO: 6514006 - DNA, 18 bp, Homo sapiens
tgttctgttgtctgcgcc

SEQ ID NO: 6514007 - DNA, 19 bp, Homo sapiens
tgttctgtttaatactcat

SEQ ID NO: 6514008 - DNA, 14 bp, Homo sapiens
tgttctgtttcaag

SEQ ID NO: 6514009 - DNA, 13 bp, Homo sapiens
tgttctgtttcct

SEQ ID NO: 6514010 - DNA, 16 bp, Homo sapiens
tgttctgtttgaaact

SEQ ID NO: 6514011 - DNA, 15 bp, Homo sapiens
tgttctgtttgttaa

SEQ ID NO: 6514012 - DNA, 13 bp, Homo sapiens
tgttctgttttgt

SEQ ID NO: 6514013 - DNA, 18 bp, Homo sapiens
tgttcttaaaaaaataaa

SEQ ID NO: 6514014 - DNA, 20 bp, Homo sapiens
tgttcttaaaaaaataaaat

SEQ ID NO: 6514015 - DNA, 16 bp, Homo sapiens
tgttcttaaaaatgca

SEQ ID NO: 6514016 - DNA, 13 bp, Homo sapiens
tgttcttaaaata

SEQ ID NO: 6514017 - DNA, 22 bp, Homo sapiens
tgttcttacacatacagtttta

SEQ ID NO: 6514018 - DNA, 22 bp, Homo sapiens
tgttcttacctgtatgtctcca

SEQ ID NO: 6514019 - DNA, 18 bp, Homo sapiens
tgttcttagcaataaatg

SEQ ID NO: 6514020 - DNA, 18 bp, Homo sapiens
tgttcttagctcaatgag

SEQ ID NO: 6514021 - DNA, 22 bp, Homo sapiens
tgttcttagctcaatgagcatg

SEQ ID NO: 6514022 - DNA, 18 bp, Homo sapiens
tgttcttagtttgcagtt

SEQ ID NO: 6514023 - DNA, 16 bp, Homo sapiens
tgttcttataagaaga

SEQ ID NO: 6514024 - DNA, 14 bp, Homo sapiens
tgttcttatagaat

SEQ ID NO: 6514025 - DNA, 16 bp, Homo sapiens
tgttcttatagaataa

SEQ ID NO: 6514026 - DNA, 18 bp, Homo sapiens
tgttcttatagaataaaa

SEQ ID NO: 6514027 - DNA, 20 bp, Homo sapiens
tgttcttcaactcctgggct

SEQ ID NO: 6514028 - DNA, 20 bp, Homo sapiens
tgttcttcaagccagctcta

SEQ ID NO: 6514029 - DNA, 22 bp, Homo sapiens
tgttcttcaatgtgaaactgag

SEQ ID NO: 6514030 - DNA, 23 bp, Homo sapiens
tgttcttcaatgtgaaactgaga

SEQ ID NO: 6514031 - DNA, 12 bp, Homo sapiens
tgttcttcagtg

SEQ ID NO: 6514032 - DNA, 13 bp, Homo sapiens
tgttcttcagtgt

SEQ ID NO: 6514033 - DNA, 19 bp, Homo sapiens
tgttcttcatctgctatta

SEQ ID NO: 6514034 - DNA, 14 bp, Homo sapiens
tgttcttcatttct

SEQ ID NO: 6514035 - DNA, 20 bp, Homo sapiens
tgttcttccaaagcagagag

SEQ ID NO: 6514036 - DNA, 21 bp, Homo sapiens
tgttcttccagttactttcca

SEQ ID NO: 6514037 - DNA, 16 bp, Homo sapiens
tgttcttcctcagcca

SEQ ID NO: 6514038 - DNA, 20 bp, Homo sapiens
tgttcttcctcagccagcct

SEQ ID NO: 6514039 - DNA, 12 bp, Homo sapiens
tgttcttcctgg

SEQ ID NO: 6514040 - DNA, 13 bp, Homo sapiens
tgttcttcctggc

SEQ ID NO: 6514041 - DNA, 15 bp, Homo sapiens
tgttcttcctggccg

SEQ ID NO: 6514042 - DNA, 17 bp, Homo sapiens
tgttcttccttcctaga

SEQ ID NO: 6514043 - DNA, 19 bp, Homo sapiens
tgttcttcgtaactttatg

SEQ ID NO: 6514044 - DNA, 24 bp, Homo sapiens
tgttcttcgtaactttatggagta

SEQ ID NO: 6514045 - DNA, 12 bp, Homo sapiens
tgttcttcttgg

SEQ ID NO: 6514046 - DNA, 15 bp, Homo sapiens
tgttcttgaatcctc

SEQ ID NO: 6514047 - DNA, 20 bp, Homo sapiens
tgttcttgaatcctctatta

SEQ ID NO: 6514048 - DNA, 18 bp, Homo sapiens
tgttcttgagattttgta

SEQ ID NO: 6514049 - DNA, 16 bp, Homo sapiens
tgttcttgagcagctg

SEQ ID NO: 6514050 - DNA, 21 bp, Homo sapiens
tgttcttgagcagctgaattg

SEQ ID NO: 6514051 - DNA, 17 bp, Homo sapiens
tgttcttgaggtctctt

SEQ ID NO: 6514052 - DNA, 21 bp, Homo sapiens
tgttcttgctgagcaccctct

SEQ ID NO: 6514053 - DNA, 17 bp, Homo sapiens
tgttcttgctgctagaa

SEQ ID NO: 6514054 - DNA, 18 bp, Homo sapiens
tgttcttgctgctagaac

SEQ ID NO: 6514055 - DNA, 16 bp, Homo sapiens
tgttcttggcaataaa

SEQ ID NO: 6514056 - DNA, 17 bp, Homo sapiens
tgttcttggcaataaat

SEQ ID NO: 6514057 - DNA, 23 bp, Homo sapiens
tgttcttggcttggaagattcta

SEQ ID NO: 6514058 - DNA, 19 bp, Homo sapiens
tgttcttgggagaaaatca

SEQ ID NO: 6514059 - DNA, 18 bp, Homo sapiens
tgttcttggtttgtaaat

SEQ ID NO: 6514060 - DNA, 22 bp, Homo sapiens
tgttcttgtaaaactgtgacat

SEQ ID NO: 6514061 - DNA, 13 bp, Homo sapiens
tgttcttgtattt

SEQ ID NO: 6514062 - DNA, 14 bp, Homo sapiens
tgttcttgtattta

SEQ ID NO: 6514063 - DNA, 13 bp, Homo sapiens
tgttcttgttgta

SEQ ID NO: 6514064 - DNA, 13 bp, Homo sapiens
tgttcttgttgtt

SEQ ID NO: 6514065 - DNA, 18 bp, Homo sapiens
tgttcttgtttgtatcat

SEQ ID NO: 6514066 - DNA, 22 bp, Homo sapiens
tgttctttagatggtggcacat

SEQ ID NO: 6514067 - DNA, 15 bp, Homo sapiens
tgttctttaggagat

SEQ ID NO: 6514068 - DNA, 12 bp, Homo sapiens
tgttctttataa

SEQ ID NO: 6514069 - DNA, 20 bp, Homo sapiens
tgttctttatatacaataat

SEQ ID NO: 6514070 - DNA, 14 bp, Homo sapiens
tgttctttcagaaa

SEQ ID NO: 6514071 - DNA, 17 bp, Homo sapiens
tgttctttcatactaca

SEQ ID NO: 6514072 - DNA, 18 bp, Homo sapiens
tgttctttcatactacat

SEQ ID NO: 6514073 - DNA, 13 bp, Homo sapiens
tgttctttccaaa

SEQ ID NO: 6514074 - DNA, 14 bp, Homo sapiens
tgttctttccaaag

SEQ ID NO: 6514075 - DNA, 18 bp, Homo sapiens
tgttctttccaaagtaca

SEQ ID NO: 6514076 - DNA, 21 bp, Homo sapiens
tgttctttccccaggggcatg

SEQ ID NO: 6514077 - DNA, 15 bp, Homo sapiens
tgttctttcctgccc

SEQ ID NO: 6514078 - DNA, 22 bp, Homo sapiens
tgttctttcctgccctgtccaa

SEQ ID NO: 6514079 - DNA, 11 bp, Homo sapiens
tgttctttctg

SEQ ID NO: 6514080 - DNA, 15 bp, Homo sapiens
tgttctttgcagtga

SEQ ID NO: 6514081 - DNA, 17 bp, Homo sapiens
tgttcttttcccgcctc

SEQ ID NO: 6514082 - DNA, 13 bp, Homo sapiens
tgttcttttctcc

SEQ ID NO: 6514083 - DNA, 23 bp, Homo sapiens
tgttcttttctggtaggttctgt

SEQ ID NO: 6514084 - DNA, 14 bp, Homo sapiens
tgttcttttgatac

SEQ ID NO: 6514085 - DNA, 23 bp, Homo sapiens
tgttctttttctgaactccattt

SEQ ID NO: 6514086 - DNA, 16 bp, Homo sapiens
tgttctttttgactga

SEQ ID NO: 6514087 - DNA, 13 bp, Homo sapiens
tgttgaaaaagaa

SEQ ID NO: 6514088 - DNA, 18 bp, Homo sapiens
tgttgaaaaagataaaga

SEQ ID NO: 6514089 - DNA, 21 bp, Homo sapiens
tgttgaaaaatatctttgcat

SEQ ID NO: 6514090 - DNA, 16 bp, Homo sapiens
tgttgaaaaatgttgc

SEQ ID NO: 6514091 - DNA, 15 bp, Homo sapiens
tgttgaaaaccaaaa

SEQ ID NO: 6514092 - DNA, 19 bp, Homo sapiens
tgttgaaaacccagactgt

SEQ ID NO: 6514093 - DNA, 20 bp, Homo sapiens
tgttgaaaagagtagtactt

SEQ ID NO: 6514094 - DNA, 23 bp, Homo sapiens
tgttgaaaagccatgtttaagat

SEQ ID NO: 6514095 - DNA, 23 bp, Homo sapiens
tgttgaaaataatccattttcac

SEQ ID NO: 6514096 - DNA, 21 bp, Homo sapiens
tgttgaaaatatttctctagt

SEQ ID NO: 6514097 - DNA, 23 bp, Homo sapiens
tgttgaaaatatttctctagtgt

SEQ ID NO: 6514098 - DNA, 21 bp, Homo sapiens
tgttgaaaatgagcctgtaat

SEQ ID NO: 6514099 - DNA, 14 bp, Homo sapiens
tgttgaaacagaaa

SEQ ID NO: 6514100 - DNA, 23 bp, Homo sapiens
tgttgaaacggatgatttctatg

SEQ ID NO: 6514101 - DNA, 20 bp, Homo sapiens
tgttgaaacttacactgttt

SEQ ID NO: 6514102 - DNA, 19 bp, Homo sapiens
tgttgaaagcaaaaatgct

SEQ ID NO: 6514103 - DNA, 23 bp, Homo sapiens
tgttgaaagcaaaaatgctaata

SEQ ID NO: 6514104 - DNA, 17 bp, Homo sapiens
tgttgaaataaaacatt

SEQ ID NO: 6514105 - DNA, 16 bp, Homo sapiens
tgttgaaatatagttg

SEQ ID NO: 6514106 - DNA, 14 bp, Homo sapiens
tgttgaaatatgca

SEQ ID NO: 6514107 - DNA, 18 bp, Homo sapiens
tgttgaaatatgcatact

SEQ ID NO: 6514108 - DNA, 13 bp, Homo sapiens
tgttgaaatcttt

SEQ ID NO: 6514109 - DNA, 14 bp, Homo sapiens
tgttgaaattatgt

SEQ ID NO: 6514110 - DNA, 21 bp, Homo sapiens
tgttgaaattatgtatgttta

SEQ ID NO: 6514111 - DNA, 20 bp, Homo sapiens
tgttgaaattggaaaggact

SEQ ID NO: 6514112 - DNA, 18 bp, Homo sapiens
tgttgaaattttgcaaat

SEQ ID NO: 6514113 - DNA, 23 bp, Homo sapiens
tgttgaaattttgcaaatataaa

SEQ ID NO: 6514114 - DNA, 20 bp, Homo sapiens
tgttgaacaggtgtttttcc

SEQ ID NO: 6514115 - DNA, 23 bp, Homo sapiens
tgttgaaccaaacctccctgcta

SEQ ID NO: 6514116 - DNA, 20 bp, Homo sapiens
tgttgaaccacctgtgtagt

SEQ ID NO: 6514117 - DNA, 15 bp, Homo sapiens
tgttgaactgttaga

SEQ ID NO: 6514118 - DNA, 20 bp, Homo sapiens
tgttgaagaaaaaagcttat

SEQ ID NO: 6514119 - DNA, 14 bp, Homo sapiens
tgttgaagacttcc

SEQ ID NO: 6514120 - DNA, 15 bp, Homo sapiens
tgttgaagcctttgt

SEQ ID NO: 6514121 - DNA, 17 bp, Homo sapiens
tgttgaagctttaagaa

SEQ ID NO: 6514122 - DNA, 18 bp, Homo sapiens
tgttgaagtcaaatttgg

SEQ ID NO: 6514123 - DNA, 15 bp, Homo sapiens
tgttgaagtgcatgt

SEQ ID NO: 6514124 - DNA, 16 bp, Homo sapiens
tgttgaagtgcatgtt

SEQ ID NO: 6514125 - DNA, 22 bp, Homo sapiens
tgttgaagtgcatgttaaaata

SEQ ID NO: 6514126 - DNA, 12 bp, Homo sapiens
tgttgaataaat

SEQ ID NO: 6514127 - DNA, 19 bp, Homo sapiens
tgttgaataaatgtatctg

SEQ ID NO: 6514128 - DNA, 15 bp, Homo sapiens
tgttgaatatttagc

SEQ ID NO: 6514129 - DNA, 17 bp, Homo sapiens
tgttgaatatttagcat

SEQ ID NO: 6514130 - DNA, 13 bp, Homo sapiens
tgttgaatgtatt

SEQ ID NO: 6514131 - DNA, 19 bp, Homo sapiens
tgttgaattttattgaaag

SEQ ID NO: 6514132 - DNA, 15 bp, Homo sapiens
tgttgacaatttgcc

SEQ ID NO: 6514133 - DNA, 14 bp, Homo sapiens
tgttgacacaccag

SEQ ID NO: 6514134 - DNA, 19 bp, Homo sapiens
tgttgacacaccagttttg

SEQ ID NO: 6514135 - DNA, 14 bp, Homo sapiens
tgttgacagcttgg

SEQ ID NO: 6514136 - DNA, 14 bp, Homo sapiens
tgttgacatagcct

SEQ ID NO: 6514137 - DNA, 15 bp, Homo sapiens
tgttgacatatttaa

SEQ ID NO: 6514138 - DNA, 20 bp, Homo sapiens
tgttgacatgggacatttgc

SEQ ID NO: 6514139 - DNA, 23 bp, Homo sapiens
tgttgacattctgaatgcttcta

SEQ ID NO: 6514140 - DNA, 15 bp, Homo sapiens
tgttgacatttgttt

SEQ ID NO: 6514141 - DNA, 18 bp, Homo sapiens
tgttgaccatgtctatga

SEQ ID NO: 6514142 - DNA, 18 bp, Homo sapiens
tgttgacctgtgcaccta

SEQ ID NO: 6514143 - DNA, 18 bp, Homo sapiens
tgttgactggactgcttg

SEQ ID NO: 6514144 - DNA, 22 bp, Homo sapiens
tgttgactgtaggcgcccctgg

SEQ ID NO: 6514145 - DNA, 11 bp, Homo sapiens
tgttgactgtg

SEQ ID NO: 6514146 - DNA, 14 bp, Homo sapiens
tgttgactgtgatt

SEQ ID NO: 6514147 - DNA, 14 bp, Homo sapiens
tgttgactgtgtca

SEQ ID NO: 6514148 - DNA, 16 bp, Homo sapiens
tgttgactgtgtcatt

SEQ ID NO: 6514149 - DNA, 13 bp, Homo sapiens
tgttgacttattt

SEQ ID NO: 6514150 - DNA, 22 bp, Homo sapiens
tgttgacttattttctctgtgt

SEQ ID NO: 6514151 - DNA, 18 bp, Homo sapiens
tgttgacttctatcctgt

SEQ ID NO: 6514152 - DNA, 19 bp, Homo sapiens
tgttgacttctatcctgtt

SEQ ID NO: 6514153 - DNA, 21 bp, Homo sapiens
tgttgactttatttctgagca

SEQ ID NO: 6514154 - DNA, 22 bp, Homo sapiens
tgttgactttatttctgagcaa

SEQ ID NO: 6514155 - DNA, 23 bp, Homo sapiens
tgttgagaatcccaaatttgatt

SEQ ID NO: 6514156 - DNA, 22 bp, Homo sapiens
tgttgagacctcagcttggcac

SEQ ID NO: 6514157 - DNA, 15 bp, Homo sapiens
tgttgagaggctgag

SEQ ID NO: 6514158 - DNA, 23 bp, Homo sapiens
tgttgagagggggatgcccctgg

SEQ ID NO: 6514159 - DNA, 15 bp, Homo sapiens
tgttgagatccagtg

SEQ ID NO: 6514160 - DNA, 17 bp, Homo sapiens
tgttgagatggtaacag

SEQ ID NO: 6514161 - DNA, 14 bp, Homo sapiens
tgttgagcaagcag

SEQ ID NO: 6514162 - DNA, 18 bp, Homo sapiens
tgttgagccccagtgctg

SEQ ID NO: 6514163 - DNA, 23 bp, Homo sapiens
tgttgagcgtattcttgaaagta

SEQ ID NO: 6514164 - DNA, 21 bp, Homo sapiens
tgttgagctggtaacatcgtt

SEQ ID NO: 6514165 - DNA, 19 bp, Homo sapiens
tgttgagggcaagccacca

SEQ ID NO: 6514166 - DNA, 18 bp, Homo sapiens
tgttgaggggtcccctct

SEQ ID NO: 6514167 - DNA, 20 bp, Homo sapiens
tgttgaggtggtctgaatgt

SEQ ID NO: 6514168 - DNA, 19 bp, Homo sapiens
tgttgaggttaagtttctc

SEQ ID NO: 6514169 - DNA, 15 bp, Homo sapiens
tgttgagtaaaacac

SEQ ID NO: 6514170 - DNA, 17 bp, Homo sapiens
tgttgagtatttgctgt

SEQ ID NO: 6514171 - DNA, 16 bp, Homo sapiens
tgttgagtgcaacaag

SEQ ID NO: 6514172 - DNA, 22 bp, Homo sapiens
tgttgagttagttaagttgggt

SEQ ID NO: 6514173 - DNA, 22 bp, Homo sapiens
tgctcttttggtggggagcact

SEQ ID NO: 6514174 - DNA, 12 bp, Homo sapiens
tgctcttttgtg

SEQ ID NO: 6514175 - DNA, 17 bp, Homo sapiens
tgctcttttgtgatgaa

SEQ ID NO: 6514176 - DNA, 17 bp, Homo sapiens
tgctcttttttactcat

SEQ ID NO: 6514177 - DNA, 18 bp, Homo sapiens
tgctcttttttactcatt

SEQ ID NO: 6514178 - DNA, 16 bp, Homo sapiens
tgctgaaaaatatagc

SEQ ID NO: 6514179 - DNA, 17 bp, Homo sapiens
tgctgaaaaatatagcc

SEQ ID NO: 6514180 - DNA, 14 bp, Homo sapiens
tgctgaaaacatta

SEQ ID NO: 6514181 - DNA, 16 bp, Homo sapiens
tgctgaaaacattaca

SEQ ID NO: 6514182 - DNA, 20 bp, Homo sapiens
tgctgaaaaccatctggcct

SEQ ID NO: 6514183 - DNA, 22 bp, Homo sapiens
tgctgaaaaccatctggcctgg

SEQ ID NO: 6514184 - DNA, 19 bp, Homo sapiens
tgctgaaaactagctcgtg

SEQ ID NO: 6514185 - DNA, 14 bp, Homo sapiens
tgctgaaaatggta

SEQ ID NO: 6514186 - DNA, 22 bp, Homo sapiens
tgctgaaaattgcctttctgtg

SEQ ID NO: 6514187 - DNA, 17 bp, Homo sapiens
tgctgaaacaacaaata

SEQ ID NO: 6514188 - DNA, 18 bp, Homo sapiens
tgctgaaacacctcccag

SEQ ID NO: 6514189 - DNA, 19 bp, Homo sapiens
tgctgaaacagacatgaaa

SEQ ID NO: 6514190 - DNA, 17 bp, Homo sapiens
tgctgaaacaggagaga

SEQ ID NO: 6514191 - DNA, 20 bp, Homo sapiens
tgctgaaacgcatctagttc

SEQ ID NO: 6514192 - DNA, 22 bp, Homo sapiens
tgctgaacaaaattaaacttca

SEQ ID NO: 6514193 - DNA, 16 bp, Homo sapiens
tgctgaacaccttgtg

SEQ ID NO: 6514194 - DNA, 19 bp, Homo sapiens
tgctgaacataacttctca

SEQ ID NO: 6514195 - DNA, 22 bp, Homo sapiens
tgctgaacataacttctcatgt

SEQ ID NO: 6514196 - DNA, 21 bp, Homo sapiens
tgctgaacattgcatataact

SEQ ID NO: 6514197 - DNA, 22 bp, Homo sapiens
tgctgaacattggagaatctca

SEQ ID NO: 6514198 - DNA, 17 bp, Homo sapiens
tgctgaacgacagtccc

SEQ ID NO: 6514199 - DNA, 13 bp, Homo sapiens
tgctgaactcagc

SEQ ID NO: 6514200 - DNA, 17 bp, Homo sapiens
tgctgaactcagcacat

SEQ ID NO: 6514201 - DNA, 11 bp, Homo sapiens
tgctgaactcc

SEQ ID NO: 6514202 - DNA, 16 bp, Homo sapiens
tgctgaactccttgtt

SEQ ID NO: 6514203 - DNA, 14 bp, Homo sapiens
tgctgaactgtgca

SEQ ID NO: 6514204 - DNA, 16 bp, Homo sapiens
tgctgaagacattcaa

SEQ ID NO: 6514205 - DNA, 13 bp, Homo sapiens
tgctgaagagagg

SEQ ID NO: 6514206 - DNA, 14 bp, Homo sapiens
tgctgaagctgcct

SEQ ID NO: 6514207 - DNA, 22 bp, Homo sapiens
tgctgaagctgctgcagccctg

SEQ ID NO: 6514208 - DNA, 23 bp, Homo sapiens
tgctgaaggaataaattgctcct

SEQ ID NO: 6514209 - DNA, 17 bp, Homo sapiens
tgctgaaggagatgagt

SEQ ID NO: 6514210 - DNA, 18 bp, Homo sapiens
tgctgaagggcattcttt

SEQ ID NO: 6514211 - DNA, 22 bp, Homo sapiens
tgctgaaggtggggattgccca

SEQ ID NO: 6514212 - DNA, 18 bp, Homo sapiens
tgctgaagtacagtccca

SEQ ID NO: 6514213 - DNA, 21 bp, Homo sapiens
tgctgaagtacagtcccagca

SEQ ID NO: 6514214 - DNA, 16 bp, Homo sapiens
tgctgaagtccggaac

SEQ ID NO: 6514215 - DNA, 15 bp, Homo sapiens
tgctgaagttctgag

SEQ ID NO: 6514216 - DNA, 17 bp, Homo sapiens
tgctgaagttctgagcc

SEQ ID NO: 6514217 - DNA, 16 bp, Homo sapiens
tgctgaataacaacaa

SEQ ID NO: 6514218 - DNA, 18 bp, Homo sapiens
tgctgaatacagaggcaa

SEQ ID NO: 6514219 - DNA, 18 bp, Homo sapiens
tgctgaataggcgatcac

SEQ ID NO: 6514220 - DNA, 19 bp, Homo sapiens
tgctgaatatctgttcact

SEQ ID NO: 6514221 - DNA, 18 bp, Homo sapiens
tgctgaatccacctcgga

SEQ ID NO: 6514222 - DNA, 17 bp, Homo sapiens
tgctgaatcccatcagg

SEQ ID NO: 6514223 - DNA, 18 bp, Homo sapiens
tgctgaatcccatcaggc

SEQ ID NO: 6514224 - DNA, 13 bp, Homo sapiens
tgctgaatgaatc

SEQ ID NO: 6514225 - DNA, 21 bp, Homo sapiens
tgctgaatgcattcaggggaa

SEQ ID NO: 6514226 - DNA, 13 bp, Homo sapiens
tgctgaatgtcat

SEQ ID NO: 6514227 - DNA, 23 bp, Homo sapiens
tgctgaatgtcattatttgataa

SEQ ID NO: 6514228 - DNA, 20 bp, Homo sapiens
tgctgaatgttgggactgct

SEQ ID NO: 6514229 - DNA, 23 bp, Homo sapiens
tgctgaattattttgttgtgatt

SEQ ID NO: 6514230 - DNA, 15 bp, Homo sapiens
tgctgaattcatcta

SEQ ID NO: 6514231 - DNA, 22 bp, Homo sapiens
tgctgaattgtttataatggca

SEQ ID NO: 6514232 - DNA, 20 bp, Homo sapiens
tgctgaatttacagtagtta

SEQ ID NO: 6514233 - DNA, 14 bp, Homo sapiens
tgctgaatttcagg

SEQ ID NO: 6514234 - DNA, 17 bp, Homo sapiens
tgctgaatttcaggcat

SEQ ID NO: 6514235 - DNA, 16 bp, Homo sapiens
tgctgaattttcacat

SEQ ID NO: 6514236 - DNA, 17 bp, Homo sapiens
tgctgaattttcacatg

SEQ ID NO: 6514237 - DNA, 15 bp, Homo sapiens
tgctgacaaccgcaa

SEQ ID NO: 6514238 - DNA, 13 bp, Homo sapiens
tgctgacaataaa

SEQ ID NO: 6514239 - DNA, 14 bp, Homo sapiens
tgctgacaatgctg

SEQ ID NO: 6514240 - DNA, 18 bp, Homo sapiens
tgctgacaatgctgccat

SEQ ID NO: 6514241 - DNA, 17 bp, Homo sapiens
tgctgacaccagcggcc

SEQ ID NO: 6514242 - DNA, 13 bp, Homo sapiens
tgctgacagacac

SEQ ID NO: 6514243 - DNA, 16 bp, Homo sapiens
tgctgacagacacagg

SEQ ID NO: 6514244 - DNA, 14 bp, Homo sapiens
tgctgacagagccc

SEQ ID NO: 6514245 - DNA, 15 bp, Homo sapiens
tgctgacagctgctc

SEQ ID NO: 6514246 - DNA, 17 bp, Homo sapiens
tgctgacagctgctcct

SEQ ID NO: 6514247 - DNA, 14 bp, Homo sapiens
tgctgacaggatgt

SEQ ID NO: 6514248 - DNA, 18 bp, Homo sapiens
tgctgacaggatgtggca

SEQ ID NO: 6514249 - DNA, 23 bp, Homo sapiens
tgctgacaggatgtggcactgct

SEQ ID NO: 6514250 - DNA, 20 bp, Homo sapiens
tgctgacaggtgatgctctg

SEQ ID NO: 6514251 - DNA, 22 bp, Homo sapiens
tgctgacaggtgatgctctggc

SEQ ID NO: 6514252 - DNA, 20 bp, Homo sapiens
tgctgacatagtggatggac

SEQ ID NO: 6514253 - DNA, 21 bp, Homo sapiens
tgctgacatagtggatggaca

SEQ ID NO: 6514254 - DNA, 22 bp, Homo sapiens
tgctgacatagtggatggacag

SEQ ID NO: 6514255 - DNA, 23 bp, Homo sapiens
tgctgacatagtggatggacaga

SEQ ID NO: 6514256 - DNA, 15 bp, Homo sapiens
tgctgacatcatttg

SEQ ID NO: 6514257 - DNA, 17 bp, Homo sapiens
tgctgaccaaatggcca

SEQ ID NO: 6514258 - DNA, 16 bp, Homo sapiens
tgctgaccaattgtgc

SEQ ID NO: 6514259 - DNA, 21 bp, Homo sapiens
tgctgaccaattgtgctgcca

SEQ ID NO: 6514260 - DNA, 22 bp, Homo sapiens
tgctgaccaattgtgctgccat

SEQ ID NO: 6514261 - DNA, 21 bp, Homo sapiens
tgctgaccataacagtgccag

SEQ ID NO: 6514262 - DNA, 22 bp, Homo sapiens
tgctgacccaacagcctctgtg

SEQ ID NO: 6514263 - DNA, 14 bp, Homo sapiens
tgctgacccaggaa

SEQ ID NO: 6514264 - DNA, 16 bp, Homo sapiens
tgctgacccatgggca

SEQ ID NO: 6514265 - DNA, 12 bp, Homo sapiens
tgctgaccccag

SEQ ID NO: 6514266 - DNA, 13 bp, Homo sapiens
tgctgaccccagg

SEQ ID NO: 6514267 - DNA, 16 bp, Homo sapiens
tgctgaccccaggtca

SEQ ID NO: 6514268 - DNA, 14 bp, Homo sapiens
tgctgacccctgtg

SEQ ID NO: 6514269 - DNA, 22 bp, Homo sapiens
tgctgacccctgtgtgacatca

SEQ ID NO: 6514270 - DNA, 22 bp, Homo sapiens
tgctgaccggaatggtcaaatc

SEQ ID NO: 6514271 - DNA, 15 bp, Homo sapiens
tgctgacctcacctg

SEQ ID NO: 6514272 - DNA, 21 bp, Homo sapiens
tgctgacctcagcggttgcca

SEQ ID NO: 6514273 - DNA, 13 bp, Homo sapiens
tgctgacctgctg

SEQ ID NO: 6514274 - DNA, 23 bp, Homo sapiens
tgctgacctgctgacctgtgcac

SEQ ID NO: 6514275 - DNA, 14 bp, Homo sapiens
tgctgaccttctgc

SEQ ID NO: 6514276 - DNA, 22 bp, Homo sapiens
tgctgaccttggaggaatgaca

SEQ ID NO: 6514277 - DNA, 20 bp, Homo sapiens
tgctgacgcccgagagcctc

SEQ ID NO: 6514278 - DNA, 17 bp, Homo sapiens
tgctgacggccagggag

SEQ ID NO: 6514279 - DNA, 20 bp, Homo sapiens
tgctgactatttgaccccca

SEQ ID NO: 6514280 - DNA, 16 bp, Homo sapiens
tgctgactctctgagc

SEQ ID NO: 6514281 - DNA, 13 bp, Homo sapiens
tgctgactgaggc

SEQ ID NO: 6514282 - DNA, 16 bp, Homo sapiens
tgctgactgaggcctg

SEQ ID NO: 6514283 - DNA, 23 bp, Homo sapiens
tgctgactgaggcctgcttcccc

SEQ ID NO: 6514284 - DNA, 14 bp, Homo sapiens
tgctgactgtactc

SEQ ID NO: 6514285 - DNA, 21 bp, Homo sapiens
tgctgactgtactcctcccag

SEQ ID NO: 6514286 - DNA, 14 bp, Homo sapiens
tgctgactgtagct

SEQ ID NO: 6514287 - DNA, 13 bp, Homo sapiens
tgctgactgtcaa

SEQ ID NO: 6514288 - DNA, 17 bp, Homo sapiens
tgctgactgttttctct

SEQ ID NO: 6514289 - DNA, 24 bp, Homo sapiens
tgctgactgttttctcttgagagg

SEQ ID NO: 6514290 - DNA, 13 bp, Homo sapiens
tgctgacttttta

SEQ ID NO: 6514291 - DNA, 13 bp, Homo sapiens
tgctgagaaatgg

SEQ ID NO: 6514292 - DNA, 19 bp, Homo sapiens
tgctgagaacctggccttc

SEQ ID NO: 6514293 - DNA, 15 bp, Homo sapiens
tgctgagaatagtgt

SEQ ID NO: 6514294 - DNA, 17 bp, Homo sapiens
tgctgagacatccctca

SEQ ID NO: 6514295 - DNA, 21 bp, Homo sapiens
tgctgagagacccaaggagga

SEQ ID NO: 6514296 - DNA, 20 bp, Homo sapiens
tgctgagaggcaccagtcca

SEQ ID NO: 6514297 - DNA, 22 bp, Homo sapiens
tgctgagagggctcgaggggtg

SEQ ID NO: 6514298 - DNA, 18 bp, Homo sapiens
tgctgagatacatacaga

SEQ ID NO: 6514299 - DNA, 18 bp, Homo sapiens
tgctgagatgataaagtc

SEQ ID NO: 6514300 - DNA, 19 bp, Homo sapiens
tgctgagatgtttagtagc

SEQ ID NO: 6514301 - DNA, 22 bp, Homo sapiens
tgctgagatgtttagtagctga

SEQ ID NO: 6514302 - DNA, 20 bp, Homo sapiens
tgctgagcaggaaccggagg

SEQ ID NO: 6514303 - DNA, 19 bp, Homo sapiens
tgctgagccagccatcttt

SEQ ID NO: 6514304 - DNA, 16 bp, Homo sapiens
tgctgagccagctgca

SEQ ID NO: 6514305 - DNA, 12 bp, Homo sapiens
tgctgagcctct

SEQ ID NO: 6514306 - DNA, 14 bp, Homo sapiens
tgctgagcctctgc

SEQ ID NO: 6514307 - DNA, 17 bp, Homo sapiens
tgctgagcctctgctcc

SEQ ID NO: 6514308 - DNA, 17 bp, Homo sapiens
tgctgagctctgagagg

SEQ ID NO: 6514309 - DNA, 12 bp, Homo sapiens
tgctgagctgcc

SEQ ID NO: 6514310 - DNA, 12 bp, Homo sapiens
tgctgagctggg

SEQ ID NO: 6514311 - DNA, 14 bp, Homo sapiens
tgctgagctgggcc

SEQ ID NO: 6514312 - DNA, 15 bp, Homo sapiens
tgctgagctgggccc

SEQ ID NO: 6514313 - DNA, 24 bp, Homo sapiens
tgctgagctgggcccagcccctcc

SEQ ID NO: 6514314 - DNA, 14 bp, Homo sapiens
tgctgagctgtgat

SEQ ID NO: 6514315 - DNA, 17 bp, Homo sapiens
tgctgagcttagccttg

SEQ ID NO: 6514316 - DNA, 23 bp, Homo sapiens
tgctgagcttagccttgtgccct

SEQ ID NO: 6514317 - DNA, 24 bp, Homo sapiens
tgctgagcttagccttgtgccctg

SEQ ID NO: 6514318 - DNA, 20 bp, Homo sapiens
tgctgagcttgtcttttctg

SEQ ID NO: 6514319 - DNA, 22 bp, Homo sapiens
tgctgagcttgtcttttctgct

SEQ ID NO: 6514320 - DNA, 15 bp, Homo sapiens
tgctgaggactccct

SEQ ID NO: 6514321 - DNA, 18 bp, Homo sapiens
tgctgaggagctcagggc

SEQ ID NO: 6514322 - DNA, 21 bp, Homo sapiens
tgctgaggagtctgaggactg

SEQ ID NO: 6514323 - DNA, 18 bp, Homo sapiens
tgctgaggatacagctct

SEQ ID NO: 6514324 - DNA, 15 bp, Homo sapiens
tgctgaggccaccca

SEQ ID NO: 6514325 - DNA, 18 bp, Homo sapiens
tgctgaggcccagtgcat

SEQ ID NO: 6514326 - DNA, 13 bp, Homo sapiens
tgctgaggcccct

SEQ ID NO: 6514327 - DNA, 15 bp, Homo sapiens
tgctgaggcctgggc

SEQ ID NO: 6514328 - DNA, 14 bp, Homo sapiens
tgctgagggaccag

SEQ ID NO: 6514329 - DNA, 16 bp, Homo sapiens
tgctgagggaccagcc

SEQ ID NO: 6514330 - DNA, 21 bp, Homo sapiens
tgctgagggaccgagcccagc

SEQ ID NO: 6514331 - DNA, 18 bp, Homo sapiens
tgctgagggaccttggag

SEQ ID NO: 6514332 - DNA, 22 bp, Homo sapiens
tgctgagggccaataccctact

SEQ ID NO: 6514333 - DNA, 21 bp, Homo sapiens
tgctgagggccgtgtctggtg

SEQ ID NO: 6514334 - DNA, 23 bp, Homo sapiens
tgctgagggggctctttccctca

SEQ ID NO: 6514335 - DNA, 11 bp, Homo sapiens
tgctgagggtc

SEQ ID NO: 6514336 - DNA, 22 bp, Homo sapiens
tgctgagggtgtttcttcctgc

SEQ ID NO: 6514337 - DNA, 17 bp, Homo sapiens
tgctgagggtttgaata

SEQ ID NO: 6514338 - DNA, 19 bp, Homo sapiens
tgctgaggtgggccttcca

SEQ ID NO: 6514339 - DNA, 16 bp, Homo sapiens
tgctgagtaaacataa

SEQ ID NO: 6514340 - DNA, 18 bp, Homo sapiens
tgctgagtctgaaggctg

SEQ ID NO: 6514341 - DNA, 22 bp, Homo sapiens
tgctgagtctgaaggctgggtt

SEQ ID NO: 6514342 - DNA, 23 bp, Homo sapiens
tgctgagtctgaaggctgggttc

SEQ ID NO: 6514343 - DNA, 19 bp, Homo sapiens
tgctgagtctgttctggta

SEQ ID NO: 6514344 - DNA, 16 bp, Homo sapiens
tgctgagtgaaggaaa

SEQ ID NO: 6514345 - DNA, 15 bp, Homo sapiens
tgctgagtgacagct

SEQ ID NO: 6514346 - DNA, 18 bp, Homo sapiens
tgctgagtgctgggcact

SEQ ID NO: 6514347 - DNA, 19 bp, Homo sapiens
tgctgagtgctgggcactg

SEQ ID NO: 6514348 - DNA, 16 bp, Homo sapiens
tgctgagttggcctgg

SEQ ID NO: 6514349 - DNA, 19 bp, Homo sapiens
tgctgataattgtgtattt

SEQ ID NO: 6514350 - DNA, 22 bp, Homo sapiens
tgctgataccatatgaatgaaa

SEQ ID NO: 6514351 - DNA, 19 bp, Homo sapiens
tgctgatactatctcttgt

SEQ ID NO: 6514352 - DNA, 20 bp, Homo sapiens
tgctgatactgggtctgcga

SEQ ID NO: 6514353 - DNA, 22 bp, Homo sapiens
tgctgatagctaagtgagtttt

SEQ ID NO: 6514354 - DNA, 22 bp, Homo sapiens
tgctgatatcaacagcttccct

SEQ ID NO: 6514355 - DNA, 19 bp, Homo sapiens
tgctgatcatcgccagagg

SEQ ID NO: 6514356 - DNA, 23 bp, Homo sapiens
tgctgatcatcgccagaggtgct

SEQ ID NO: 6514357 - DNA, 22 bp, Homo sapiens
tgctgatcccggccggccctgg

SEQ ID NO: 6514358 - DNA, 21 bp, Homo sapiens
tgctgatccggctgctcctcc

SEQ ID NO: 6514359 - DNA, 15 bp, Homo sapiens
tgctgatcgccttat

SEQ ID NO: 6514360 - DNA, 16 bp, Homo sapiens
tgctgatcgccttccc

SEQ ID NO: 6514361 - DNA, 18 bp, Homo sapiens
tgctgatcgccttcccca

SEQ ID NO: 6514362 - DNA, 18 bp, Homo sapiens
tgctgatcgtagaaaatt

SEQ ID NO: 6514363 - DNA, 20 bp, Homo sapiens
tgctgatcgtagaaaatttg

SEQ ID NO: 6514364 - DNA, 20 bp, Homo sapiens
tgctgatctctgtagaatct

SEQ ID NO: 6514365 - DNA, 20 bp, Homo sapiens
tgctgatgaatcactgtttt

SEQ ID NO: 6514366 - DNA, 22 bp, Homo sapiens
tgctgatgacccccccagcttc

SEQ ID NO: 6514367 - DNA, 23 bp, Homo sapiens
tgctgatgacccccccagcttca

SEQ ID NO: 6514368 - DNA, 20 bp, Homo sapiens
tgctgatgacctcaagtagc

SEQ ID NO: 6514369 - DNA, 17 bp, Homo sapiens
tgctgatgccacagaga

SEQ ID NO: 6514370 - DNA, 15 bp, Homo sapiens
tgctgatggagcctt

SEQ ID NO: 6514371 - DNA, 17 bp, Homo sapiens
tgctgatggcccctcca

SEQ ID NO: 6514372 - DNA, 15 bp, Homo sapiens
tgctgatggctgcta

SEQ ID NO: 6514373 - DNA, 20 bp, Homo sapiens
tgctgatggctgctagattt

SEQ ID NO: 6514374 - DNA, 13 bp, Homo sapiens
tgctgatggcttg

SEQ ID NO: 6514375 - DNA, 21 bp, Homo sapiens
tgctgatggcttgacatgtgc

SEQ ID NO: 6514376 - DNA, 16 bp, Homo sapiens
tgctgatgggaaggag

SEQ ID NO: 6514377 - DNA, 20 bp, Homo sapiens
tgctgatgggaaggagggga

SEQ ID NO: 6514378 - DNA, 17 bp, Homo sapiens
tgctgatggtgcaatga

SEQ ID NO: 6514379 - DNA, 18 bp, Homo sapiens
tgctgatggtgcaatgac

SEQ ID NO: 6514380 - DNA, 16 bp, Homo sapiens
tgctgatgttcagtgt

SEQ ID NO: 6514381 - DNA, 13 bp, Homo sapiens
tgctgatgtttac

SEQ ID NO: 6514382 - DNA, 14 bp, Homo sapiens
tgctgatgtttcct

SEQ ID NO: 6514383 - DNA, 15 bp, Homo sapiens
tgctgatgtttcctg

SEQ ID NO: 6514384 - DNA, 12 bp, Homo sapiens
tgctgattattt

SEQ ID NO: 6514385 - DNA, 16 bp, Homo sapiens
tgctgattatttatga

SEQ ID NO: 6514386 - DNA, 21 bp, Homo sapiens
tgctgattatttatgacctga

SEQ ID NO: 6514387 - DNA, 15 bp, Homo sapiens
tgctgattcaagaaa

SEQ ID NO: 6514388 - DNA, 16 bp, Homo sapiens
tgctgattcagcctgg

SEQ ID NO: 6514389 - DNA, 19 bp, Homo sapiens
tgctgattcttgtaaatct

SEQ ID NO: 6514390 - DNA, 21 bp, Homo sapiens
tgctgattcttgtaaatcttt

SEQ ID NO: 6514391 - DNA, 18 bp, Homo sapiens
tgctgatttggtgaccaa

SEQ ID NO: 6514392 - DNA, 18 bp, Homo sapiens
tgctgattttattcttga

SEQ ID NO: 6514393 - DNA, 23 bp, Homo sapiens
tgctgattttgaccttgtattga

SEQ ID NO: 6514394 - DNA, 23 bp, Homo sapiens
tgctgcaaaatacattattcttc

SEQ ID NO: 6514395 - DNA, 22 bp, Homo sapiens
tgctgcaaacccatgaagctgg

SEQ ID NO: 6514396 - DNA, 22 bp, Homo sapiens
tgctgcaaaggagaagcacagc

SEQ ID NO: 6514397 - DNA, 20 bp, Homo sapiens
tgctgcaaagtgcaaatact

SEQ ID NO: 6514398 - DNA, 22 bp, Homo sapiens
tgctgcaaatagccttcctgac

SEQ ID NO: 6514399 - DNA, 15 bp, Homo sapiens
tgctgcaacaagctc

SEQ ID NO: 6514400 - DNA, 20 bp, Homo sapiens
tgctgcaaggcctttctgtg

SEQ ID NO: 6514401 - DNA, 14 bp, Homo sapiens
tgctgcaaggtggc

SEQ ID NO: 6514402 - DNA, 22 bp, Homo sapiens
tgctgcacacactcacctctaa

SEQ ID NO: 6514403 - DNA, 16 bp, Homo sapiens
tgctgcacaccaaggc

SEQ ID NO: 6514404 - DNA, 22 bp, Homo sapiens
tgctgcacaccaaggccctgca

SEQ ID NO: 6514405 - DNA, 23 bp, Homo sapiens
tgctgcacaccaaggccctgcat

SEQ ID NO: 6514406 - DNA, 20 bp, Homo sapiens
tgctgcacaccagttactgt

SEQ ID NO: 6514407 - DNA, 21 bp, Homo sapiens
tgctgcacagctggccaccat

SEQ ID NO: 6514408 - DNA, 18 bp, Homo sapiens
tgctgcaccaacccagcc

SEQ ID NO: 6514409 - DNA, 18 bp, Homo sapiens
tgctgcacccaactactg

SEQ ID NO: 6514410 - DNA, 23 bp, Homo sapiens
tgctgcaccctgcgcctccagag

SEQ ID NO: 6514411 - DNA, 18 bp, Homo sapiens
tgctgcactaggacttgg

SEQ ID NO: 6514412 - DNA, 16 bp, Homo sapiens
tgctgcactgccctcc

SEQ ID NO: 6514413 - DNA, 14 bp, Homo sapiens
tgctgcagacaaaa

SEQ ID NO: 6514414 - DNA, 19 bp, Homo sapiens
tgctgcagacaaaaagaac

SEQ ID NO: 6514415 - DNA, 22 bp, Homo sapiens
tgctgcagagaaacttaagcaa

SEQ ID NO: 6514416 - DNA, 21 bp, Homo sapiens
tgctgcagaggggcaggccct

SEQ ID NO: 6514417 - DNA, 22 bp, Homo sapiens
tgctgcagaggggcaggccctg

SEQ ID NO: 6514418 - DNA, 16 bp, Homo sapiens
tgctgcagcagagtga

SEQ ID NO: 6514419 - DNA, 13 bp, Homo sapiens
tgctgcagccagg

SEQ ID NO: 6514420 - DNA, 13 bp, Homo sapiens
tgctgcagcccct

SEQ ID NO: 6514421 - DNA, 18 bp, Homo sapiens
tgctgcagcccctgggac

SEQ ID NO: 6514422 - DNA, 15 bp, Homo sapiens
tgctgcagccctgcc

SEQ ID NO: 6514423 - DNA, 19 bp, Homo sapiens
tgctgcagctccctcctca

SEQ ID NO: 6514424 - DNA, 15 bp, Homo sapiens
tgctgcagcttggca

SEQ ID NO: 6514425 - DNA, 16 bp, Homo sapiens
tgctgcaggatggact

SEQ ID NO: 6514426 - DNA, 16 bp, Homo sapiens
tgctgcaggccctccc

SEQ ID NO: 6514427 - DNA, 17 bp, Homo sapiens
tgctgcaggggctctgg

SEQ ID NO: 6514428 - DNA, 22 bp, Homo sapiens
tgctgcagggtctttttctagg

SEQ ID NO: 6514429 - DNA, 20 bp, Homo sapiens
tgctgcagtcacatcacaat

SEQ ID NO: 6514430 - DNA, 21 bp, Homo sapiens
tgctgcagtcagcacagagag

SEQ ID NO: 6514431 - DNA, 18 bp, Homo sapiens
tgctgcagtcatctactt

SEQ ID NO: 6514432 - DNA, 18 bp, Homo sapiens
tgctgcataaaattctag

SEQ ID NO: 6514433 - DNA, 16 bp, Homo sapiens
tgctgcataaatttgt

SEQ ID NO: 6514434 - DNA, 18 bp, Homo sapiens
tgctgcataaatttgtaa

SEQ ID NO: 6514435 - DNA, 20 bp, Homo sapiens
tgctgcataaatttgtaata

SEQ ID NO: 6514436 - DNA, 13 bp, Homo sapiens
tgctgcatatttg

SEQ ID NO: 6514437 - DNA, 15 bp, Homo sapiens
tgctgcatccccttc

SEQ ID NO: 6514438 - DNA, 18 bp, Homo sapiens
tgctgcatccccttccag

SEQ ID NO: 6514439 - DNA, 22 bp, Homo sapiens
tgctgcatccccttccagctcc

SEQ ID NO: 6514440 - DNA, 12 bp, Homo sapiens
tgctgcatccct

SEQ ID NO: 6514441 - DNA, 22 bp, Homo sapiens
tgctgcatcgctgttctgggca

SEQ ID NO: 6514442 - DNA, 23 bp, Homo sapiens
tgctgcatcttatagcactttga

SEQ ID NO: 6514443 - DNA, 14 bp, Homo sapiens
tgctgcatgaaagc

SEQ ID NO: 6514444 - DNA, 15 bp, Homo sapiens
tgctgcatgccctct

SEQ ID NO: 6514445 - DNA, 21 bp, Homo sapiens
tgctgcatggcagggggctgc

SEQ ID NO: 6514446 - DNA, 22 bp, Homo sapiens
tgctgcatggcagggggctgct

SEQ ID NO: 6514447 - DNA, 14 bp, Homo sapiens
tgctgcatttaaaa

SEQ ID NO: 6514448 - DNA, 17 bp, Homo sapiens
tgctgcatttaaaagat

SEQ ID NO: 6514449 - DNA, 19 bp, Homo sapiens
tgctgcatttaaaagatac

SEQ ID NO: 6514450 - DNA, 19 bp, Homo sapiens
tgctgcattttaagcataa

SEQ ID NO: 6514451 - DNA, 16 bp, Homo sapiens
tgctgcattttacaca

SEQ ID NO: 6514452 - DNA, 19 bp, Homo sapiens
tgctgcattttacacatgt

SEQ ID NO: 6514453 - DNA, 14 bp, Homo sapiens
tgctgccaaaacca

SEQ ID NO: 6514454 - DNA, 15 bp, Homo sapiens
tgctgccaaaaccac

SEQ ID NO: 6514455 - DNA, 18 bp, Homo sapiens
tgctgccaaaaccacatg

SEQ ID NO: 6514456 - DNA, 21 bp, Homo sapiens
tgctgccaaaaccacatgggc

SEQ ID NO: 6514457 - DNA, 23 bp, Homo sapiens
tgctgccaaaaccacatgggctg

SEQ ID NO: 6514458 - DNA, 19 bp, Homo sapiens
tgctgccaagtcctgcctt

SEQ ID NO: 6514459 - DNA, 15 bp, Homo sapiens
tgctgccaatatcct

SEQ ID NO: 6514460 - DNA, 19 bp, Homo sapiens
tgctgccaatatcctaata

SEQ ID NO: 6514461 - DNA, 15 bp, Homo sapiens
tgctgccacacttca

SEQ ID NO: 6514462 - DNA, 16 bp, Homo sapiens
tgctgccacacttcag

SEQ ID NO: 6514463 - DNA, 19 bp, Homo sapiens
tgctgccacacttcaggct

SEQ ID NO: 6514464 - DNA, 22 bp, Homo sapiens
tgctgccacacttcaggctctt

SEQ ID NO: 6514465 - DNA, 17 bp, Homo sapiens
tgctgccacagcaagga

SEQ ID NO: 6514466 - DNA, 12 bp, Homo sapiens
tgctgccacccc

SEQ ID NO: 6514467 - DNA, 18 bp, Homo sapiens
tgctgccactctgctgcc

SEQ ID NO: 6514468 - DNA, 21 bp, Homo sapiens
tgctgccactctgctgcctgt

SEQ ID NO: 6514469 - DNA, 22 bp, Homo sapiens
tgctgccactctgctgcctgta

SEQ ID NO: 6514470 - DNA, 17 bp, Homo sapiens
tgctgccagtgcagcca

SEQ ID NO: 6514471 - DNA, 14 bp, Homo sapiens
tgctgccatccagg

SEQ ID NO: 6514472 - DNA, 16 bp, Homo sapiens
tgctgccatgatgtat

SEQ ID NO: 6514473 - DNA, 12 bp, Homo sapiens
tgctgccatgcc

SEQ ID NO: 6514474 - DNA, 15 bp, Homo sapiens
tgctgccatgccact

SEQ ID NO: 6514475 - DNA, 16 bp, Homo sapiens
tgctgccatgccactg

SEQ ID NO: 6514476 - DNA, 15 bp, Homo sapiens
tgctgccattcttga

SEQ ID NO: 6514477 - DNA, 21 bp, Homo sapiens
tgctgccatttgatttttcta

SEQ ID NO: 6514478 - DNA, 18 bp, Homo sapiens
tgctgccatttttgcaaa

SEQ ID NO: 6514479 - DNA, 13 bp, Homo sapiens
tgctgcccacccc

SEQ ID NO: 6514480 - DNA, 20 bp, Homo sapiens
tgctgcccaccccctgctgg

SEQ ID NO: 6514481 - DNA, 21 bp, Homo sapiens
tgctgcccaccccctgctggt

SEQ ID NO: 6514482 - DNA, 15 bp, Homo sapiens
tgctgcccagccact

SEQ ID NO: 6514483 - DNA, 13 bp, Homo sapiens
tgctgcccaggcc

SEQ ID NO: 6514484 - DNA, 16 bp, Homo sapiens
tgctgcccaggccaca

SEQ ID NO: 6514485 - DNA, 19 bp, Homo sapiens
tgctgcccaggccacagcc

SEQ ID NO: 6514486 - DNA, 20 bp, Homo sapiens
tgctgcccaggccacagccg

SEQ ID NO: 6514487 - DNA, 16 bp, Homo sapiens
tgctgcccaggcccag

SEQ ID NO: 6514488 - DNA, 24 bp, Homo sapiens
tgctgccccacaacacaccttgcc

SEQ ID NO: 6514489 - DNA, 12 bp, Homo sapiens
tgctgccccagc

SEQ ID NO: 6514490 - DNA, 19 bp, Homo sapiens
tgctgccccatcagtgctc

SEQ ID NO: 6514491 - DNA, 24 bp, Homo sapiens
tgctgccccatgaagccacagccc

SEQ ID NO: 6514492 - DNA, 14 bp, Homo sapiens
tgctgcccccaccc

SEQ ID NO: 6514493 - DNA, 20 bp, Homo sapiens
tgctgcccccaccccgggga

SEQ ID NO: 6514494 - DNA, 15 bp, Homo sapiens
tgctgcccccttccc

SEQ ID NO: 6514495 - DNA, 18 bp, Homo sapiens
tgctgcccccttccccag

SEQ ID NO: 6514496 - DNA, 20 bp, Homo sapiens
tgctgcccccttccccagcc

SEQ ID NO: 6514497 - DNA, 23 bp, Homo sapiens
tgctgcccccttccccagccctt

SEQ ID NO: 6514498 - DNA, 21 bp, Homo sapiens
tgctgccccgcttccccacag

SEQ ID NO: 6514499 - DNA, 21 bp, Homo sapiens
tgctgccccgttccctgtcag

SEQ ID NO: 6514500 - DNA, 15 bp, Homo sapiens
tgctgcccctccctg

SEQ ID NO: 6514501 - DNA, 16 bp, Homo sapiens
tgctgcccctccctgc

SEQ ID NO: 6514502 - DNA, 17 bp, Homo sapiens
tgctgcccctccctgcc

SEQ ID NO: 6514503 - DNA, 13 bp, Homo sapiens
tgctgcccctgca

SEQ ID NO: 6514504 - DNA, 20 bp, Homo sapiens
tgctgcccctgcacagcagg

SEQ ID NO: 6514505 - DNA, 15 bp, Homo sapiens
tgctgcccctgcagt

SEQ ID NO: 6514506 - DNA, 14 bp, Homo sapiens
tgctgcccctgtct

SEQ ID NO: 6514507 - DNA, 13 bp, Homo sapiens
tgctgccccttgc

SEQ ID NO: 6514508 - DNA, 19 bp, Homo sapiens
tgctgccccttgcaagcca

SEQ ID NO: 6514509 - DNA, 23 bp, Homo sapiens
tgctgcccgcgggagacagcttc

SEQ ID NO: 6514510 - DNA, 17 bp, Homo sapiens
tgctgcccgctctgcag

SEQ ID NO: 6514511 - DNA, 23 bp, Homo sapiens
tgctgcccggggtggggtgcact

SEQ ID NO: 6514512 - DNA, 21 bp, Homo sapiens
tgctgcccgtcttcagcctag

SEQ ID NO: 6514513 - DNA, 12 bp, Homo sapiens
tgctgccctccc

SEQ ID NO: 6514514 - DNA, 17 bp, Homo sapiens
tgctgccctcccacagc

SEQ ID NO: 6514515 - DNA, 22 bp, Homo sapiens
tgctgccctgaagaatggcgcc

SEQ ID NO: 6514516 - DNA, 18 bp, Homo sapiens
tgctgccctgatgcgtct

SEQ ID NO: 6514517 - DNA, 17 bp, Homo sapiens
tgctgccctgcccacct

SEQ ID NO: 6514518 - DNA, 18 bp, Homo sapiens
tgctgccctgcccacctg

SEQ ID NO: 6514519 - DNA, 15 bp, Homo sapiens
tgctgccctgcccca

SEQ ID NO: 6514520 - DNA, 11 bp, Homo sapiens
tgctgccctgg

SEQ ID NO: 6514521 - DNA, 12 bp, Homo sapiens
tgctgccctggg

SEQ ID NO: 6514522 - DNA, 14 bp, Homo sapiens
tgctgccctggggc

SEQ ID NO: 6514523 - DNA, 12 bp, Homo sapiens
tgctgccctgtg

SEQ ID NO: 6514524 - DNA, 13 bp, Homo sapiens
tgctgccctgtga

SEQ ID NO: 6514525 - DNA, 15 bp, Homo sapiens
tgctgccctgtgagt

SEQ ID NO: 6514526 - DNA, 23 bp, Homo sapiens
tgctgccgagggctggccgggac

SEQ ID NO: 6514527 - DNA, 21 bp, Homo sapiens
tgctgccgccccacccagatg

SEQ ID NO: 6514528 - DNA, 16 bp, Homo sapiens
tgctgccgcctcccag

SEQ ID NO: 6514529 - DNA, 19 bp, Homo sapiens
tgctgccggcacagctggg

SEQ ID NO: 6514530 - DNA, 22 bp, Homo sapiens
tgctgccggcacagctgggata

SEQ ID NO: 6514531 - DNA, 16 bp, Homo sapiens
tgctgccggctctggg

SEQ ID NO: 6514532 - DNA, 17 bp, Homo sapiens
tgctgccggctctgggc

SEQ ID NO: 6514533 - DNA, 14 bp, Homo sapiens
tgctgcctaataaa

SEQ ID NO: 6514534 - DNA, 17 bp, Homo sapiens
tgctgcctaataaagag

SEQ ID NO: 6514535 - DNA, 18 bp, Homo sapiens
tgctgcctaggctgacct

SEQ ID NO: 6514536 - DNA, 11 bp, Homo sapiens
tgctgcctcag

SEQ ID NO: 6514537 - DNA, 14 bp, Homo sapiens
tgctgcctcagctc

SEQ ID NO: 6514538 - DNA, 17 bp, Homo sapiens
tgctgcctcaggaccca

SEQ ID NO: 6514539 - DNA, 13 bp, Homo sapiens
tgctgcctccaag

SEQ ID NO: 6514540 - DNA, 14 bp, Homo sapiens
tgctgcctccaagt

SEQ ID NO: 6514541 - DNA, 22 bp, Homo sapiens
tgctgcctccaagtcatgggag

SEQ ID NO: 6514542 - DNA, 14 bp, Homo sapiens
tgctgcctccagaa

SEQ ID NO: 6514543 - DNA, 12 bp, Homo sapiens
tgctgcctcccc

SEQ ID NO: 6514544 - DNA, 19 bp, Homo sapiens
tgctgcctccccaaccctg

SEQ ID NO: 6514545 - DNA, 16 bp, Homo sapiens
tgctgcctctcttctg

SEQ ID NO: 6514546 - DNA, 19 bp, Homo sapiens
tgctgcctctcttctgtgt

SEQ ID NO: 6514547 - DNA, 14 bp, Homo sapiens
tgctgcctgaatcc

SEQ ID NO: 6514548 - DNA, 22 bp, Homo sapiens
tgctgcctgcctccggccctgc

SEQ ID NO: 6514549 - DNA, 23 bp, Homo sapiens
tgctgcctgcctccggccctgcc

SEQ ID NO: 6514550 - DNA, 16 bp, Homo sapiens
tgctgcctgcctgtct

SEQ ID NO: 6514551 - DNA, 13 bp, Homo sapiens
tgctgcctgctca

SEQ ID NO: 6514552 - DNA, 16 bp, Homo sapiens
tgctgcctgctgagat

SEQ ID NO: 6514553 - DNA, 13 bp, Homo sapiens
tgctgcctgggta

SEQ ID NO: 6514554 - DNA, 13 bp, Homo sapiens
tgctgcctgtccc

SEQ ID NO: 6514555 - DNA, 15 bp, Homo sapiens
tgctgcctgtcccca

SEQ ID NO: 6514556 - DNA, 20 bp, Homo sapiens
tgctgcctgtttggggaggg

SEQ ID NO: 6514557 - DNA, 22 bp, Homo sapiens
tgctgcctgtttggggaggggg

SEQ ID NO: 6514558 - DNA, 19 bp, Homo sapiens
tgctgccttcaccctgaac

SEQ ID NO: 6514559 - DNA, 15 bp, Homo sapiens
tgctgccttcaggga

SEQ ID NO: 6514560 - DNA, 20 bp, Homo sapiens
tgctgccttctgacggccct

SEQ ID NO: 6514561 - DNA, 23 bp, Homo sapiens
tgctgccttctgacggccctgca

SEQ ID NO: 6514562 - DNA, 13 bp, Homo sapiens
tgctgccttctgg

SEQ ID NO: 6514563 - DNA, 18 bp, Homo sapiens
tgctgccttctgtctctt

SEQ ID NO: 6514564 - DNA, 21 bp, Homo sapiens
tgctgccttctgtctcttgca

SEQ ID NO: 6514565 - DNA, 21 bp, Homo sapiens
tgctgcctttattagggtact

SEQ ID NO: 6514566 - DNA, 15 bp, Homo sapiens
tgctgccttttctgg

SEQ ID NO: 6514567 - DNA, 21 bp, Homo sapiens
tgctgccttttctttaacttt

SEQ ID NO: 6514568 - DNA, 17 bp, Homo sapiens
tgctgcgcaccaatgcc

SEQ ID NO: 6514569 - DNA, 18 bp, Homo sapiens
tgctgcgcaccaatgccc

SEQ ID NO: 6514570 - DNA, 23 bp, Homo sapiens
tgctgcgcaccaatgcccagcag

SEQ ID NO: 6514571 - DNA, 13 bp, Homo sapiens
tgctgcgccccag

SEQ ID NO: 6514572 - DNA, 20 bp, Homo sapiens
tgctgcgcccttaccttccc

SEQ ID NO: 6514573 - DNA, 18 bp, Homo sapiens
tgctgcgcctgcaggcag

SEQ ID NO: 6514574 - DNA, 20 bp, Homo sapiens
tgctgcgcctgcaggcagag

SEQ ID NO: 6514575 - DNA, 22 bp, Homo sapiens
tgctgcgcctgcaggcagagct

SEQ ID NO: 6514576 - DNA, 16 bp, Homo sapiens
tgctgcggagcaagag

SEQ ID NO: 6514577 - DNA, 15 bp, Homo sapiens
tgctgcggctgtggg

SEQ ID NO: 6514578 - DNA, 23 bp, Homo sapiens
tgctgcggggccttttgcccgga

SEQ ID NO: 6514579 - DNA, 16 bp, Homo sapiens
tgctgcgggggagcca

SEQ ID NO: 6514580 - DNA, 21 bp, Homo sapiens
tgctgcgggggagccagttct

SEQ ID NO: 6514581 - DNA, 22 bp, Homo sapiens
tgctgcgggtgggtatcccacc

SEQ ID NO: 6514582 - DNA, 15 bp, Homo sapiens
tgctgcgtcagacca

SEQ ID NO: 6514583 - DNA, 14 bp, Homo sapiens
tgctgcgtccccac

SEQ ID NO: 6514584 - DNA, 18 bp, Homo sapiens
tgctgcgtccccactccc

SEQ ID NO: 6514585 - DNA, 22 bp, Homo sapiens
tgctgcgtccccactcccttgg

SEQ ID NO: 6514586 - DNA, 23 bp, Homo sapiens
tgctgctaaagggagaaatgcca

SEQ ID NO: 6514587 - DNA, 15 bp, Homo sapiens
tgctgctaccctccc

SEQ ID NO: 6514588 - DNA, 20 bp, Homo sapiens
tgctgctaccctccctgctg

SEQ ID NO: 6514589 - DNA, 22 bp, Homo sapiens
tgctgctaccctccctgctgtc

SEQ ID NO: 6514590 - DNA, 22 bp, Homo sapiens
tgctgctaccgccctgggctgg

SEQ ID NO: 6514591 - DNA, 14 bp, Homo sapiens
tgctgctactgtct

SEQ ID NO: 6514592 - DNA, 13 bp, Homo sapiens
tgctgctagaact

SEQ ID NO: 6514593 - DNA, 20 bp, Homo sapiens
tgctgctagaacttttttaa

SEQ ID NO: 6514594 - DNA, 16 bp, Homo sapiens
tgctgctagatcttta

SEQ ID NO: 6514595 - DNA, 23 bp, Homo sapiens
tgctgctagcaatgccacgattt

SEQ ID NO: 6514596 - DNA, 21 bp, Homo sapiens
tgctgctatgaaaatgagcat

SEQ ID NO: 6514597 - DNA, 17 bp, Homo sapiens
tgctgctattgctgtct

SEQ ID NO: 6514598 - DNA, 17 bp, Homo sapiens
tgctgctcaccctccta

SEQ ID NO: 6514599 - DNA, 22 bp, Homo sapiens
tgctgctcattccacactgttg

SEQ ID NO: 6514600 - DNA, 17 bp, Homo sapiens
tgctgctccaccctccc

SEQ ID NO: 6514601 - DNA, 21 bp, Homo sapiens
tgctgctcccctaaagccagg

SEQ ID NO: 6514602 - DNA, 22 bp, Homo sapiens
tgctgctcccctaaagccaggc

SEQ ID NO: 6514603 - DNA, 23 bp, Homo sapiens
tgctgctcccgcctgattggggc

SEQ ID NO: 6514604 - DNA, 17 bp, Homo sapiens
tgctgctccctcagact

SEQ ID NO: 6514605 - DNA, 13 bp, Homo sapiens
tgctgctccgccc

SEQ ID NO: 6514606 - DNA, 20 bp, Homo sapiens
tgctgctcctcggccagagc

SEQ ID NO: 6514607 - DNA, 12 bp, Homo sapiens
tgctgctcctct

SEQ ID NO: 6514608 - DNA, 13 bp, Homo sapiens
tgctgctcctctc

SEQ ID NO: 6514609 - DNA, 19 bp, Homo sapiens
tgctgctcctctcttgggt

SEQ ID NO: 6514610 - DNA, 12 bp, Homo sapiens
tgctgctcctgt

SEQ ID NO: 6514611 - DNA, 13 bp, Homo sapiens
tgctgctctccca

SEQ ID NO: 6514612 - DNA, 14 bp, Homo sapiens
tgctgctctcccaa

SEQ ID NO: 6514613 - DNA, 20 bp, Homo sapiens
tgctgctctcccctcccagt

SEQ ID NO: 6514614 - DNA, 13 bp, Homo sapiens
tgctgctctgcgt

SEQ ID NO: 6514615 - DNA, 21 bp, Homo sapiens
tgctgctcttggctggaccca

SEQ ID NO: 6514616 - DNA, 20 bp, Homo sapiens
tgctgctgaactaatttctg

SEQ ID NO: 6514617 - DNA, 15 bp, Homo sapiens
tgctgctgacccctg

SEQ ID NO: 6514618 - DNA, 19 bp, Homo sapiens
tgctgctgacccctgtgtg

SEQ ID NO: 6514619 - DNA, 22 bp, Homo sapiens
tgctgctgagaacctggccttc

SEQ ID NO: 6514620 - DNA, 22 bp, Homo sapiens
tgctgctgagcacatctcttca

SEQ ID NO: 6514621 - DNA, 14 bp, Homo sapiens
tgctgctgcaccca

SEQ ID NO: 6514622 - DNA, 12 bp, Homo sapiens
tgctgctgcccc

SEQ ID NO: 6514623 - DNA, 14 bp, Homo sapiens
tgctgctgccccag

SEQ ID NO: 6514624 - DNA, 15 bp, Homo sapiens
tgctgctgccttcac

SEQ ID NO: 6514625 - DNA, 15 bp, Homo sapiens
tgctgctgcgccctt

SEQ ID NO: 6514626 - DNA, 13 bp, Homo sapiens
tgctgctgctgca

SEQ ID NO: 6514627 - DNA, 16 bp, Homo sapiens
tgctgctgctgcgccc

SEQ ID NO: 6514628 - DNA, 13 bp, Homo sapiens
tgctgctggccaa

SEQ ID NO: 6514629 - DNA, 21 bp, Homo sapiens
tgctgctggccaaatagcaaa

SEQ ID NO: 6514630 - DNA, 14 bp, Homo sapiens
tgctgctggctccc

SEQ ID NO: 6514631 - DNA, 18 bp, Homo sapiens
tgctgctggctcccatct

SEQ ID NO: 6514632 - DNA, 13 bp, Homo sapiens
tgctgctggctgg

SEQ ID NO: 6514633 - DNA, 15 bp, Homo sapiens
tgctgctggggaaga

SEQ ID NO: 6514634 - DNA, 24 bp, Homo sapiens
tgctgctggggaagacagtggccc

SEQ ID NO: 6514635 - DNA, 18 bp, Homo sapiens
tgctgctggtgcacagcc

SEQ ID NO: 6514636 - DNA, 14 bp, Homo sapiens
tgctgctgtaaata

SEQ ID NO: 6514637 - DNA, 21 bp, Homo sapiens
tgctgctgtaactgctgagcc

SEQ ID NO: 6514638 - DNA, 21 bp, Homo sapiens
tgctgctgtccagtgcctaca

SEQ ID NO: 6514639 - DNA, 13 bp, Homo sapiens
tgctgctgtccct

SEQ ID NO: 6514640 - DNA, 17 bp, Homo sapiens
tgctgctgtctgggtgc

SEQ ID NO: 6514641 - DNA, 12 bp, Homo sapiens
tgctgctgtctt

SEQ ID NO: 6514642 - DNA, 16 bp, Homo sapiens
tgctgctgtgcctgcg

SEQ ID NO: 6514643 - DNA, 22 bp, Homo sapiens
tgctgctgtgcttttgatctct

SEQ ID NO: 6514644 - DNA, 14 bp, Homo sapiens
tgctgctgtgtgct

SEQ ID NO: 6514645 - DNA, 18 bp, Homo sapiens
tgctgcttaaaatgcaag

SEQ ID NO: 6514646 - DNA, 20 bp, Homo sapiens
tgctgcttaagtgcatgcat

SEQ ID NO: 6514647 - DNA, 21 bp, Homo sapiens
tgctgcttacactccaggtgt

SEQ ID NO: 6514648 - DNA, 21 bp, Homo sapiens
tgctgcttccctctgcctgtc

SEQ ID NO: 6514649 - DNA, 17 bp, Homo sapiens
tgctgcttcctaactta

SEQ ID NO: 6514650 - DNA, 18 bp, Homo sapiens
tgctgcttctcccaggca

SEQ ID NO: 6514651 - DNA, 14 bp, Homo sapiens
tgctgcttctcctc

SEQ ID NO: 6514652 - DNA, 20 bp, Homo sapiens
tgctgcttctcctcccagcg

SEQ ID NO: 6514653 - DNA, 22 bp, Homo sapiens
tgctgcttctcctcccagcgtg

SEQ ID NO: 6514654 - DNA, 15 bp, Homo sapiens
tgctgcttctgctcc

SEQ ID NO: 6514655 - DNA, 20 bp, Homo sapiens
tgctgcttctgctccagccc

SEQ ID NO: 6514656 - DNA, 22 bp, Homo sapiens
tgctgcttgaaacttcagccct

SEQ ID NO: 6514657 - DNA, 19 bp, Homo sapiens
tgctgcttgaggcaactca

SEQ ID NO: 6514658 - DNA, 18 bp, Homo sapiens
tgctgcttggagtgcccc

SEQ ID NO: 6514659 - DNA, 18 bp, Homo sapiens
tgctgcttggtagcactt

SEQ ID NO: 6514660 - DNA, 14 bp, Homo sapiens
tgctgcttgtgacc

SEQ ID NO: 6514661 - DNA, 14 bp, Homo sapiens
tgctgctttccttc

SEQ ID NO: 6514662 - DNA, 15 bp, Homo sapiens
tgctgctttccttcg

SEQ ID NO: 6514663 - DNA, 16 bp, Homo sapiens
tgctgctttgatatat

SEQ ID NO: 6514664 - DNA, 12 bp, Homo sapiens
tgctgctttgct

SEQ ID NO: 6514665 - DNA, 21 bp, Homo sapiens
tgctgctttgcttttcatcac

SEQ ID NO: 6514666 - DNA, 11 bp, Homo sapiens
tgctgctttgg

SEQ ID NO: 6514667 - DNA, 15 bp, Homo sapiens
tgctgctttgggctg

SEQ ID NO: 6514668 - DNA, 13 bp, Homo sapiens
tgctgctttgggg

SEQ ID NO: 6514669 - DNA, 21 bp, Homo sapiens
tgctgctttgttgttctgcct

SEQ ID NO: 6514670 - DNA, 22 bp, Homo sapiens
tgctgctttgttgttctgcctg

SEQ ID NO: 6514671 - DNA, 20 bp, Homo sapiens
tgctgcttttccttggggca

SEQ ID NO: 6514672 - DNA, 21 bp, Homo sapiens
tgctgctttttctgcgcttca

SEQ ID NO: 6514673 - DNA, 23 bp, Homo sapiens
tgctgctttttgaggtggcactt

SEQ ID NO: 6514674 - DNA, 14 bp, Homo sapiens
tgctggaaaactgc

SEQ ID NO: 6514675 - DNA, 23 bp, Homo sapiens
tgctggaaaatcatattgagaat

SEQ ID NO: 6514676 - DNA, 22 bp, Homo sapiens
tgctggaaaatctgtaaaaaag

SEQ ID NO: 6514677 - DNA, 15 bp, Homo sapiens
tgctggaaataaaac

SEQ ID NO: 6514678 - DNA, 14 bp, Homo sapiens
tgctggaacccagg

SEQ ID NO: 6514679 - DNA, 18 bp, Homo sapiens
tgctggaacccaggaggt

SEQ ID NO: 6514680 - DNA, 22 bp, Homo sapiens
tgctggaacccaggaggtggag

SEQ ID NO: 6514681 - DNA, 19 bp, Homo sapiens
tgctggaacctgcaaaaaa

SEQ ID NO: 6514682 - DNA, 19 bp, Homo sapiens
tgctggaactcttgacagc

SEQ ID NO: 6514683 - DNA, 14 bp, Homo sapiens
tgctggaagaaact

SEQ ID NO: 6514684 - DNA, 17 bp, Homo sapiens
tgctggaagaaactaaa

SEQ ID NO: 6514685 - DNA, 18 bp, Homo sapiens
tgctggaagacagagaaa

SEQ ID NO: 6514686 - DNA, 14 bp, Homo sapiens
tgctggaagaggtg

SEQ ID NO: 6514687 - DNA, 19 bp, Homo sapiens
tgctggaagtctccatgaa

SEQ ID NO: 6514688 - DNA, 18 bp, Homo sapiens
tgctggaatggggacctg

SEQ ID NO: 6514689 - DNA, 18 bp, Homo sapiens
tgctggaattccacaggg

SEQ ID NO: 6514690 - DNA, 22 bp, Homo sapiens
tgctggaattccacagggacca

SEQ ID NO: 6514691 - DNA, 15 bp, Homo sapiens
tgctggacagagact

SEQ ID NO: 6514692 - DNA, 21 bp, Homo sapiens
tgctggaccagctggcctggg

SEQ ID NO: 6514693 - DNA, 14 bp, Homo sapiens
tgctggaccatcaa

SEQ ID NO: 6514694 - DNA, 19 bp, Homo sapiens
tgctggacggcattcctgc

SEQ ID NO: 6514695 - DNA, 16 bp, Homo sapiens
tgctggacgtctttct

SEQ ID NO: 6514696 - DNA, 14 bp, Homo sapiens
tgctggactgagga

SEQ ID NO: 6514697 - DNA, 15 bp, Homo sapiens
tgctggactgaggac

SEQ ID NO: 6514698 - DNA, 19 bp, Homo sapiens
tgctggactgaggaccaca

SEQ ID NO: 6514699 - DNA, 20 bp, Homo sapiens
tgctggactgatggttgctt

SEQ ID NO: 6514700 - DNA, 19 bp, Homo sapiens
tgctggactgtcatagaaa

SEQ ID NO: 6514701 - DNA, 17 bp, Homo sapiens
tgctggactgtggaggg

SEQ ID NO: 6514702 - DNA, 23 bp, Homo sapiens
tgctggactgttccaggccctcc

SEQ ID NO: 6514703 - DNA, 12 bp, Homo sapiens
tgctggagaaat

SEQ ID NO: 6514704 - DNA, 16 bp, Homo sapiens
tgctggagaaatcttg

SEQ ID NO: 6514705 - DNA, 13 bp, Homo sapiens
tgttgagttatga

SEQ ID NO: 6514706 - DNA, 20 bp, Homo sapiens
tgttgagttggacacactgt

SEQ ID NO: 6514707 - DNA, 17 bp, Homo sapiens
tgttgatacaaaccact

SEQ ID NO: 6514708 - DNA, 16 bp, Homo sapiens
tgttgatactgttgca

SEQ ID NO: 6514709 - DNA, 17 bp, Homo sapiens
tgttgatactgttgcac

SEQ ID NO: 6514710 - DNA, 21 bp, Homo sapiens
tgttgatactgttgcacgtgt

SEQ ID NO: 6514711 - DNA, 23 bp, Homo sapiens
tgttgatactgttgcacgtgtgt

SEQ ID NO: 6514712 - DNA, 16 bp, Homo sapiens
tgttgatattgtttgc

SEQ ID NO: 6514713 - DNA, 20 bp, Homo sapiens
tgttgatcagatcttacaag

SEQ ID NO: 6514714 - DNA, 22 bp, Homo sapiens
tgttgatcatgtactttttagt

SEQ ID NO: 6514715 - DNA, 22 bp, Homo sapiens
tgttgatcccacttcactgtga

SEQ ID NO: 6514716 - DNA, 22 bp, Homo sapiens
tgttgatctgcatatttctgta

SEQ ID NO: 6514717 - DNA, 13 bp, Homo sapiens
tgttgatctttca

SEQ ID NO: 6514718 - DNA, 11 bp, Homo sapiens
tgttgatgaaa

SEQ ID NO: 6514719 - DNA, 22 bp, Homo sapiens
tgttgatgaggacccagagctg

SEQ ID NO: 6514720 - DNA, 20 bp, Homo sapiens
tgttgatgcaatccttacaa

SEQ ID NO: 6514721 - DNA, 23 bp, Homo sapiens
tgttgatgcaatccttacaaatg

SEQ ID NO: 6514722 - DNA, 13 bp, Homo sapiens
tgttgattaaaac

SEQ ID NO: 6514723 - DNA, 14 bp, Homo sapiens
tgttgattaaaaca

SEQ ID NO: 6514724 - DNA, 15 bp, Homo sapiens
tgttgattaaagatg

SEQ ID NO: 6514725 - DNA, 22 bp, Homo sapiens
tgttgattacataatcaaagct

SEQ ID NO: 6514726 - DNA, 15 bp, Homo sapiens
tgttgattaggaaca

SEQ ID NO: 6514727 - DNA, 16 bp, Homo sapiens
tgttgattatcttcag

SEQ ID NO: 6514728 - DNA, 11 bp, Homo sapiens
tgttgattatt

SEQ ID NO: 6514729 - DNA, 14 bp, Homo sapiens
tgttgattctctcc

SEQ ID NO: 6514730 - DNA, 14 bp, Homo sapiens
tgttgattctttca

SEQ ID NO: 6514731 - DNA, 16 bp, Homo sapiens
tgttgattctttcaat

SEQ ID NO: 6514732 - DNA, 20 bp, Homo sapiens
tgttgattgcaggaataagg

SEQ ID NO: 6514733 - DNA, 12 bp, Homo sapiens
tgttgattgcta

SEQ ID NO: 6514734 - DNA, 13 bp, Homo sapiens
tgttgattgctaa

SEQ ID NO: 6514735 - DNA, 13 bp, Homo sapiens
tgttgattgtgcc

SEQ ID NO: 6514736 - DNA, 17 bp, Homo sapiens
tgttgatttatgcttta

SEQ ID NO: 6514737 - DNA, 15 bp, Homo sapiens
tgttgatttctagtt

SEQ ID NO: 6514738 - DNA, 18 bp, Homo sapiens
tgttgatttctagttatt

SEQ ID NO: 6514739 - DNA, 20 bp, Homo sapiens
tgttgatttctagttattta

SEQ ID NO: 6514740 - DNA, 19 bp, Homo sapiens
tgttgatttctttccagag

SEQ ID NO: 6514741 - DNA, 20 bp, Homo sapiens
tgttgatttctttccagagg

SEQ ID NO: 6514742 - DNA, 20 bp, Homo sapiens
tgttgatttctttccttccc

SEQ ID NO: 6514743 - DNA, 21 bp, Homo sapiens
tgttgcaaactcagttccaaa

SEQ ID NO: 6514744 - DNA, 15 bp, Homo sapiens
tgttgcaaagcttcc

SEQ ID NO: 6514745 - DNA, 23 bp, Homo sapiens
tgttgcaaagggattactagaga

SEQ ID NO: 6514746 - DNA, 19 bp, Homo sapiens
tgttgcaaatcactctgca

SEQ ID NO: 6514747 - DNA, 16 bp, Homo sapiens
tgttgcaaattattct

SEQ ID NO: 6514748 - DNA, 20 bp, Homo sapiens
tgttgcaaattattctagtc

SEQ ID NO: 6514749 - DNA, 13 bp, Homo sapiens
tgttgcaagtcat

SEQ ID NO: 6514750 - DNA, 22 bp, Homo sapiens
tgttgcacacccactcagctcc

SEQ ID NO: 6514751 - DNA, 23 bp, Homo sapiens
tgttgcacacccactcagctccg

SEQ ID NO: 6514752 - DNA, 15 bp, Homo sapiens
tgttgcacagactgg

SEQ ID NO: 6514753 - DNA, 21 bp, Homo sapiens
tgttgcacagcagcaattgtt

SEQ ID NO: 6514754 - DNA, 19 bp, Homo sapiens
tgttgcacagttcatttaa

SEQ ID NO: 6514755 - DNA, 13 bp, Homo sapiens
tgttgcacatcat

SEQ ID NO: 6514756 - DNA, 14 bp, Homo sapiens
tgttgcacatcatt

SEQ ID NO: 6514757 - DNA, 15 bp, Homo sapiens
tgttgcacatcattc

SEQ ID NO: 6514758 - DNA, 23 bp, Homo sapiens
tgttgcaccaattaagtgttgaa

SEQ ID NO: 6514759 - DNA, 17 bp, Homo sapiens
tgttgcacccagccctg

SEQ ID NO: 6514760 - DNA, 19 bp, Homo sapiens
tgttgcacccagccctggt

SEQ ID NO: 6514761 - DNA, 21 bp, Homo sapiens
tgttgcacgtgtgtttttcta

SEQ ID NO: 6514762 - DNA, 19 bp, Homo sapiens
tgttgcactaaaatgagga

SEQ ID NO: 6514763 - DNA, 23 bp, Homo sapiens
tgttgcactaaaatgaggatcca

SEQ ID NO: 6514764 - DNA, 15 bp, Homo sapiens
tgttgcactgaacag

SEQ ID NO: 6514765 - DNA, 13 bp, Homo sapiens
tgttgcactgaag

SEQ ID NO: 6514766 - DNA, 11 bp, Homo sapiens
tgttgcactgc

SEQ ID NO: 6514767 - DNA, 16 bp, Homo sapiens
tgttgcactgccccct

SEQ ID NO: 6514768 - DNA, 14 bp, Homo sapiens
tgttgcacttttga

SEQ ID NO: 6514769 - DNA, 18 bp, Homo sapiens
tgttgcacttttgaatgt

SEQ ID NO: 6514770 - DNA, 12 bp, Homo sapiens
tgttgcagactg

SEQ ID NO: 6514771 - DNA, 11 bp, Homo sapiens
tgttgcagaga

SEQ ID NO: 6514772 - DNA, 17 bp, Homo sapiens
tgttgcagatgggtgat

SEQ ID NO: 6514773 - DNA, 13 bp, Homo sapiens
tgttgcagccgca

SEQ ID NO: 6514774 - DNA, 15 bp, Homo sapiens
tgttgcagccgcaga

SEQ ID NO: 6514775 - DNA, 17 bp, Homo sapiens
tgttgcagctgtcacca

SEQ ID NO: 6514776 - DNA, 13 bp, Homo sapiens
tgttgcaggcaaa

SEQ ID NO: 6514777 - DNA, 13 bp, Homo sapiens
tgttgcaggcagt

SEQ ID NO: 6514778 - DNA, 14 bp, Homo sapiens
tgttgcaggcagtg

SEQ ID NO: 6514779 - DNA, 18 bp, Homo sapiens
tgttgcagtggcctggcc

SEQ ID NO: 6514780 - DNA, 19 bp, Homo sapiens
tgttgcagtggcctggccg

SEQ ID NO: 6514781 - DNA, 14 bp, Homo sapiens
tgttgcataaacaa

SEQ ID NO: 6514782 - DNA, 18 bp, Homo sapiens
tgttgcataggttagata

SEQ ID NO: 6514783 - DNA, 23 bp, Homo sapiens
tgttgcatatagttaaactgaga

SEQ ID NO: 6514784 - DNA, 17 bp, Homo sapiens
tgttgcatggatgtttt

SEQ ID NO: 6514785 - DNA, 14 bp, Homo sapiens
tgttgcatgggcta

SEQ ID NO: 6514786 - DNA, 11 bp, Homo sapiens
tgttgccaaag

SEQ ID NO: 6514787 - DNA, 17 bp, Homo sapiens
tgttgccaaagctggtc

SEQ ID NO: 6514788 - DNA, 19 bp, Homo sapiens
tgttgccaaatatgtcctg

SEQ ID NO: 6514789 - DNA, 23 bp, Homo sapiens
tgttgccaaatatgtcctggggt

SEQ ID NO: 6514790 - DNA, 18 bp, Homo sapiens
tgttgccaagctccaagc

SEQ ID NO: 6514791 - DNA, 16 bp, Homo sapiens
tgttgccaatttttgt

SEQ ID NO: 6514792 - DNA, 14 bp, Homo sapiens
tgttgccacaggac

SEQ ID NO: 6514793 - DNA, 18 bp, Homo sapiens
tgttgccactttccaagt

SEQ ID NO: 6514794 - DNA, 20 bp, Homo sapiens
tgttgccaggagatggaata

SEQ ID NO: 6514795 - DNA, 21 bp, Homo sapiens
tgttgccaggagatggaatat

SEQ ID NO: 6514796 - DNA, 21 bp, Homo sapiens
tgttgccaggttgcagctgct

SEQ ID NO: 6514797 - DNA, 16 bp, Homo sapiens
tgttgccagtcagcaa

SEQ ID NO: 6514798 - DNA, 19 bp, Homo sapiens
tgttgccatttctctgctt

SEQ ID NO: 6514799 - DNA, 15 bp, Homo sapiens
tgttgcccaggcagg

SEQ ID NO: 6514800 - DNA, 16 bp, Homo sapiens
tgttgcccaggcaggt

SEQ ID NO: 6514801 - DNA, 23 bp, Homo sapiens
tgttgcccaggctggagtacaat

SEQ ID NO: 6514802 - DNA, 20 bp, Homo sapiens
tgttgcccaggctggagtgc

SEQ ID NO: 6514803 - DNA, 20 bp, Homo sapiens
tgttgcccaggctggcgtgc

SEQ ID NO: 6514804 - DNA, 16 bp, Homo sapiens
tgttgcccctttctct

SEQ ID NO: 6514805 - DNA, 17 bp, Homo sapiens
tgttgcccctttctctt

SEQ ID NO: 6514806 - DNA, 19 bp, Homo sapiens
tgttgcccgccctccaccc

SEQ ID NO: 6514807 - DNA, 18 bp, Homo sapiens
tgttgcccgtggatctgg

SEQ ID NO: 6514808 - DNA, 22 bp, Homo sapiens
tgttgcccgtggatctgggcac

SEQ ID NO: 6514809 - DNA, 17 bp, Homo sapiens
tgttgcctaattggaaa

SEQ ID NO: 6514810 - DNA, 18 bp, Homo sapiens
tgttgcctaattggaaag

SEQ ID NO: 6514811 - DNA, 21 bp, Homo sapiens
tgttgcctaattggaaagtgc

SEQ ID NO: 6514812 - DNA, 17 bp, Homo sapiens
tgttgcctataagccaa

SEQ ID NO: 6514813 - DNA, 18 bp, Homo sapiens
tgttgcctataagccaaa

SEQ ID NO: 6514814 - DNA, 15 bp, Homo sapiens
tgttgcctcctccca

SEQ ID NO: 6514815 - DNA, 22 bp, Homo sapiens
tgttgcctgcacccttccctct

SEQ ID NO: 6514816 - DNA, 16 bp, Homo sapiens
tgttgcctttgctctt

SEQ ID NO: 6514817 - DNA, 20 bp, Homo sapiens
tgttgcctttgctcttataa

SEQ ID NO: 6514818 - DNA, 11 bp, Homo sapiens
tgttgctaagc

SEQ ID NO: 6514819 - DNA, 22 bp, Homo sapiens
tgttgctatagtgacatgcagt

SEQ ID NO: 6514820 - DNA, 21 bp, Homo sapiens
tgttgctatcaatccaagaac

SEQ ID NO: 6514821 - DNA, 15 bp, Homo sapiens
tgttgctcagctcct

SEQ ID NO: 6514822 - DNA, 15 bp, Homo sapiens
tgttgctcagtgtgt

SEQ ID NO: 6514823 - DNA, 20 bp, Homo sapiens
tgttgctctaggaagacatt

SEQ ID NO: 6514824 - DNA, 18 bp, Homo sapiens
tgttgctcttggaaagct

SEQ ID NO: 6514825 - DNA, 13 bp, Homo sapiens
tgttgctgaattt

SEQ ID NO: 6514826 - DNA, 15 bp, Homo sapiens
tgttgctgaatttgt

SEQ ID NO: 6514827 - DNA, 15 bp, Homo sapiens
tgttgctgattttga

SEQ ID NO: 6514828 - DNA, 20 bp, Homo sapiens
tgttgctgattttgaccttg

SEQ ID NO: 6514829 - DNA, 13 bp, Homo sapiens
tgttgctgccaac

SEQ ID NO: 6514830 - DNA, 14 bp, Homo sapiens
tgttgctgccaacc

SEQ ID NO: 6514831 - DNA, 14 bp, Homo sapiens
tgttgctgcctcat

SEQ ID NO: 6514832 - DNA, 10 bp, Homo sapiens
tgttgctgct

SEQ ID NO: 6514833 - DNA, 22 bp, Homo sapiens
tgttgctgctactgtcttacta

SEQ ID NO: 6514834 - DNA, 13 bp, Homo sapiens
tgttgctgctgct

SEQ ID NO: 6514835 - DNA, 12 bp, Homo sapiens
tgttgctgctgt

SEQ ID NO: 6514836 - DNA, 16 bp, Homo sapiens
tgttgctggaggggct

SEQ ID NO: 6514837 - DNA, 19 bp, Homo sapiens
tgttgctgtacaaaagcaa

SEQ ID NO: 6514838 - DNA, 13 bp, Homo sapiens
tgttgctgtcctc

SEQ ID NO: 6514839 - DNA, 13 bp, Homo sapiens
tgttgctgtctgg

SEQ ID NO: 6514840 - DNA, 16 bp, Homo sapiens
tgttgctgtctggctt

SEQ ID NO: 6514841 - DNA, 15 bp, Homo sapiens
tgttgctgtggctcc

SEQ ID NO: 6514842 - DNA, 11 bp, Homo sapiens
tgttgctgttg

SEQ ID NO: 6514843 - DNA, 16 bp, Homo sapiens
tgttgctgttgatgtt

SEQ ID NO: 6514844 - DNA, 13 bp, Homo sapiens
tgttgctgttgct

SEQ ID NO: 6514845 - DNA, 14 bp, Homo sapiens
tgttgctgttgctg

SEQ ID NO: 6514846 - DNA, 16 bp, Homo sapiens
tgttgctgttgctgtt

SEQ ID NO: 6514847 - DNA, 20 bp, Homo sapiens
tgttgcttaatctagagcta

SEQ ID NO: 6514848 - DNA, 15 bp, Homo sapiens
tgttgcttacaattt

SEQ ID NO: 6514849 - DNA, 16 bp, Homo sapiens
tgttgcttacaatttt

SEQ ID NO: 6514850 - DNA, 15 bp, Homo sapiens
tgttgcttagatgag

SEQ ID NO: 6514851 - DNA, 23 bp, Homo sapiens
tgttgcttagatgagggtgactg

SEQ ID NO: 6514852 - DNA, 23 bp, Homo sapiens
tgttgcttgaatagcaatagcat

SEQ ID NO: 6514853 - DNA, 18 bp, Homo sapiens
tgttgctttaggtgagtc

SEQ ID NO: 6514854 - DNA, 13 bp, Homo sapiens
tgttgctttctga

SEQ ID NO: 6514855 - DNA, 13 bp, Homo sapiens
tgttgcttttcaa

SEQ ID NO: 6514856 - DNA, 22 bp, Homo sapiens
tgttgcttttcaaatgtttgaa

SEQ ID NO: 6514857 - DNA, 15 bp, Homo sapiens
tgttgcttttgaaaa

SEQ ID NO: 6514858 - DNA, 23 bp, Homo sapiens
tgttggaaattgggtgtgccctg

SEQ ID NO: 6514859 - DNA, 13 bp, Homo sapiens
tgttggaagagca

SEQ ID NO: 6514860 - DNA, 17 bp, Homo sapiens
tgttggaattcacttta

SEQ ID NO: 6514861 - DNA, 23 bp, Homo sapiens
tgttggacaaatgtgaagatgca

SEQ ID NO: 6514862 - DNA, 15 bp, Homo sapiens
tgttggacagctgct

SEQ ID NO: 6514863 - DNA, 16 bp, Homo sapiens
tgttggacagctgctt

SEQ ID NO: 6514864 - DNA, 14 bp, Homo sapiens
tgttggagaagaac

SEQ ID NO: 6514865 - DNA, 16 bp, Homo sapiens
tgttggagatgcagcc

SEQ ID NO: 6514866 - DNA, 18 bp, Homo sapiens
tgttggagatgcagcctt

SEQ ID NO: 6514867 - DNA, 20 bp, Homo sapiens
tgttggagatgcagccttca

SEQ ID NO: 6514868 - DNA, 14 bp, Homo sapiens
tgttggagcaaacc

SEQ ID NO: 6514869 - DNA, 18 bp, Homo sapiens
tgttggagcaaaccatta

SEQ ID NO: 6514870 - DNA, 13 bp, Homo sapiens
tgttggagcagca

SEQ ID NO: 6514871 - DNA, 21 bp, Homo sapiens
tgttggagcagcaggcctctg

SEQ ID NO: 6514872 - DNA, 22 bp, Homo sapiens
tgttggagcagcaggcctctgg

SEQ ID NO: 6514873 - DNA, 14 bp, Homo sapiens
tgttggagcctgca

SEQ ID NO: 6514874 - DNA, 20 bp, Homo sapiens
tgttggaggaccccgagggc

SEQ ID NO: 6514875 - DNA, 13 bp, Homo sapiens
tgttggagtgagg

SEQ ID NO: 6514876 - DNA, 14 bp, Homo sapiens
tgttggagtgagga

SEQ ID NO: 6514877 - DNA, 21 bp, Homo sapiens
tgttggatccgtttgaccaat

SEQ ID NO: 6514878 - DNA, 17 bp, Homo sapiens
tgttggattccatgcta

SEQ ID NO: 6514879 - DNA, 19 bp, Homo sapiens
tgttggatttataaatgct

SEQ ID NO: 6514880 - DNA, 15 bp, Homo sapiens
tgttggcaagctgca

SEQ ID NO: 6514881 - DNA, 17 bp, Homo sapiens
tgttggcaagctgcagg

SEQ ID NO: 6514882 - DNA, 15 bp, Homo sapiens
tgttggcactcacag

SEQ ID NO: 6514883 - DNA, 14 bp, Homo sapiens
tgttggcagcataa

SEQ ID NO: 6514884 - DNA, 14 bp, Homo sapiens
tgttggcagcctct

SEQ ID NO: 6514885 - DNA, 23 bp, Homo sapiens
tgttggcattgatcctagtgtct

SEQ ID NO: 6514886 - DNA, 17 bp, Homo sapiens
tgctggagaattgactg

SEQ ID NO: 6514887 - DNA, 22 bp, Homo sapiens
tgctggagacagtagaggcatg

SEQ ID NO: 6514888 - DNA, 20 bp, Homo sapiens
tgctggagaggccccagccg

SEQ ID NO: 6514889 - DNA, 12 bp, Homo sapiens
tgctggagaggt

SEQ ID NO: 6514890 - DNA, 14 bp, Homo sapiens
tgctggagaggtta

SEQ ID NO: 6514891 - DNA, 18 bp, Homo sapiens
tgctggagagtggcatca

SEQ ID NO: 6514892 - DNA, 22 bp, Homo sapiens
tgctggagatcagcatgcctgt

SEQ ID NO: 6514893 - DNA, 14 bp, Homo sapiens
tgctggagatgttt

SEQ ID NO: 6514894 - DNA, 20 bp, Homo sapiens
tgctggagcactgggctccc

SEQ ID NO: 6514895 - DNA, 18 bp, Homo sapiens
tgctggagccactaacta

SEQ ID NO: 6514896 - DNA, 11 bp, Homo sapiens
tgctggagcct

SEQ ID NO: 6514897 - DNA, 13 bp, Homo sapiens
tgctggagcctgt

SEQ ID NO: 6514898 - DNA, 14 bp, Homo sapiens
tgctggagcctgtg

SEQ ID NO: 6514899 - DNA, 21 bp, Homo sapiens
tgctggagcctgtgtaacagc

SEQ ID NO: 6514900 - DNA, 23 bp, Homo sapiens
tgctggagcctgtgtaacagctc

SEQ ID NO: 6514901 - DNA, 13 bp, Homo sapiens
tgctggagcggct

SEQ ID NO: 6514902 - DNA, 12 bp, Homo sapiens
tgctggagctgg

SEQ ID NO: 6514903 - DNA, 23 bp, Homo sapiens
tgctggaggaggggaagctgggc

SEQ ID NO: 6514904 - DNA, 14 bp, Homo sapiens
tgctggaggcagag

SEQ ID NO: 6514905 - DNA, 16 bp, Homo sapiens
tgctggaggcctcagg

SEQ ID NO: 6514906 - DNA, 20 bp, Homo sapiens
tgctggaggcctcaggtgct

SEQ ID NO: 6514907 - DNA, 21 bp, Homo sapiens
tgctggagggaggctgggcgg

SEQ ID NO: 6514908 - DNA, 14 bp, Homo sapiens
tgctggaggggctg

SEQ ID NO: 6514909 - DNA, 15 bp, Homo sapiens
tgctggaggggctgt

SEQ ID NO: 6514910 - DNA, 17 bp, Homo sapiens
tgctggaggggctgtcc

SEQ ID NO: 6514911 - DNA, 21 bp, Homo sapiens
tgctggaggggctgtcctcct

SEQ ID NO: 6514912 - DNA, 15 bp, Homo sapiens
tgctggaggggtggc

SEQ ID NO: 6514913 - DNA, 21 bp, Homo sapiens
tgctggaggtgacatctctta

SEQ ID NO: 6514914 - DNA, 16 bp, Homo sapiens
tgctggaggtgggagc

SEQ ID NO: 6514915 - DNA, 23 bp, Homo sapiens
tgctggaggtgggagcaggagat

SEQ ID NO: 6514916 - DNA, 18 bp, Homo sapiens
tgctggagtacccagcct

SEQ ID NO: 6514917 - DNA, 19 bp, Homo sapiens
tgctggagtacccagccta

SEQ ID NO: 6514918 - DNA, 18 bp, Homo sapiens
tgctggagtcctgttctc

SEQ ID NO: 6514919 - DNA, 18 bp, Homo sapiens
tgctggagtctcctgagg

SEQ ID NO: 6514920 - DNA, 19 bp, Homo sapiens
tgctggagtgatttatact

SEQ ID NO: 6514921 - DNA, 13 bp, Homo sapiens
tgctggagtgcag

SEQ ID NO: 6514922 - DNA, 18 bp, Homo sapiens
tgctggagttttgttggt

SEQ ID NO: 6514923 - DNA, 17 bp, Homo sapiens
tgctggataaaatgagg

SEQ ID NO: 6514924 - DNA, 17 bp, Homo sapiens
tgctggatactggacac

SEQ ID NO: 6514925 - DNA, 22 bp, Homo sapiens
tgctggatcacagctgctttct

SEQ ID NO: 6514926 - DNA, 19 bp, Homo sapiens
tgctggatctcccagggct

SEQ ID NO: 6514927 - DNA, 20 bp, Homo sapiens
tgctggatctcccagggcta

SEQ ID NO: 6514928 - DNA, 13 bp, Homo sapiens
tgctggatgctgc

SEQ ID NO: 6514929 - DNA, 18 bp, Homo sapiens
tgctggatggagcccagg

SEQ ID NO: 6514930 - DNA, 19 bp, Homo sapiens
tgctggatggagcccaggc

SEQ ID NO: 6514931 - DNA, 15 bp, Homo sapiens
tgctggatgggactc

SEQ ID NO: 6514932 - DNA, 16 bp, Homo sapiens
tgctggattaatgttt

SEQ ID NO: 6514933 - DNA, 15 bp, Homo sapiens
tgctggcacagactt

SEQ ID NO: 6514934 - DNA, 15 bp, Homo sapiens
tgctggcacctcaga

SEQ ID NO: 6514935 - DNA, 15 bp, Homo sapiens
tgctggcagaggcac

SEQ ID NO: 6514936 - DNA, 18 bp, Homo sapiens
tgctggcaggattcttcc

SEQ ID NO: 6514937 - DNA, 19 bp, Homo sapiens
tgctggcaggattcttccc

SEQ ID NO: 6514938 - DNA, 14 bp, Homo sapiens
tgctggcagggcca

SEQ ID NO: 6514939 - DNA, 20 bp, Homo sapiens
tgctggcagggccagggcaa

SEQ ID NO: 6514940 - DNA, 16 bp, Homo sapiens
tgctggcatcaggtct

SEQ ID NO: 6514941 - DNA, 17 bp, Homo sapiens
tgctggcatcaggtctg

SEQ ID NO: 6514942 - DNA, 18 bp, Homo sapiens
tgctggcatcaggtctgg

SEQ ID NO: 6514943 - DNA, 23 bp, Homo sapiens
tgctggcatcaggtctgggcaag

SEQ ID NO: 6514944 - DNA, 14 bp, Homo sapiens
tgctggcatgtctt

SEQ ID NO: 6514945 - DNA, 22 bp, Homo sapiens
tgctggcattaccctctgcaga

SEQ ID NO: 6514946 - DNA, 20 bp, Homo sapiens
tgctggccaaatagcaaaga

SEQ ID NO: 6514947 - DNA, 12 bp, Homo sapiens
tgctggccagca

SEQ ID NO: 6514948 - DNA, 13 bp, Homo sapiens
tgctggccagcac

SEQ ID NO: 6514949 - DNA, 15 bp, Homo sapiens
tgctggccagcaccc

SEQ ID NO: 6514950 - DNA, 15 bp, Homo sapiens
tgctggccagcctgg

SEQ ID NO: 6514951 - DNA, 16 bp, Homo sapiens
tgctggccagcctggg

SEQ ID NO: 6514952 - DNA, 22 bp, Homo sapiens
tgctggcccacagctctgctgg

SEQ ID NO: 6514953 - DNA, 23 bp, Homo sapiens
tgctggcccacagctctgctgga

SEQ ID NO: 6514954 - DNA, 13 bp, Homo sapiens
tgctggcccagca

SEQ ID NO: 6514955 - DNA, 14 bp, Homo sapiens
tgctggcccagcat

SEQ ID NO: 6514956 - DNA, 13 bp, Homo sapiens
tgctggcccaggg

SEQ ID NO: 6514957 - DNA, 14 bp, Homo sapiens
tgctggcccagggc

SEQ ID NO: 6514958 - DNA, 20 bp, Homo sapiens
tgctggcccagggcccagag

SEQ ID NO: 6514959 - DNA, 19 bp, Homo sapiens
tgctggccccagccctgct

SEQ ID NO: 6514960 - DNA, 21 bp, Homo sapiens
tgctggccccagccctgctgg

SEQ ID NO: 6514961 - DNA, 22 bp, Homo sapiens
tgctggccccagccctgctggg

SEQ ID NO: 6514962 - DNA, 13 bp, Homo sapiens
tgctggcccccag

SEQ ID NO: 6514963 - DNA, 22 bp, Homo sapiens
tgctggccccgcccctgccccc

SEQ ID NO: 6514964 - DNA, 22 bp, Homo sapiens
tgctggcccctcacctgggcac

SEQ ID NO: 6514965 - DNA, 18 bp, Homo sapiens
tgctggccgacccactga

SEQ ID NO: 6514966 - DNA, 23 bp, Homo sapiens
tgctggccgcccccagccccctc

SEQ ID NO: 6514967 - DNA, 17 bp, Homo sapiens
tgctggccgcctcaccc

SEQ ID NO: 6514968 - DNA, 19 bp, Homo sapiens
tgctggccgggcacagctg

SEQ ID NO: 6514969 - DNA, 22 bp, Homo sapiens
tgctggcctcccaataaagctg

SEQ ID NO: 6514970 - DNA, 13 bp, Homo sapiens
tgctggcctccct

SEQ ID NO: 6514971 - DNA, 13 bp, Homo sapiens
tgctggcctctgc

SEQ ID NO: 6514972 - DNA, 17 bp, Homo sapiens
tgctggcctcttggcac

SEQ ID NO: 6514973 - DNA, 13 bp, Homo sapiens
tgctggcctgctc

SEQ ID NO: 6514974 - DNA, 14 bp, Homo sapiens
tgctggcctggcag

SEQ ID NO: 6514975 - DNA, 17 bp, Homo sapiens
tgctggcctggcagggg

SEQ ID NO: 6514976 - DNA, 16 bp, Homo sapiens
tgctggcctggccctt

SEQ ID NO: 6514977 - DNA, 17 bp, Homo sapiens
tgctggcctggcccttg

SEQ ID NO: 6514978 - DNA, 15 bp, Homo sapiens
tgctggcctgtggca

SEQ ID NO: 6514979 - DNA, 18 bp, Homo sapiens
tgctggcctgtggcaggc

SEQ ID NO: 6514980 - DNA, 21 bp, Homo sapiens
tgctggcctgtggcaggccta

SEQ ID NO: 6514981 - DNA, 12 bp, Homo sapiens
tgctggccttgg

SEQ ID NO: 6514982 - DNA, 21 bp, Homo sapiens
tgctggccttggtatgtgcca

SEQ ID NO: 6514983 - DNA, 22 bp, Homo sapiens
tgctggccttggtatgtgccag

SEQ ID NO: 6514984 - DNA, 13 bp, Homo sapiens
tgctggcgacact

SEQ ID NO: 6514985 - DNA, 22 bp, Homo sapiens
tgctggcgacactcagggcagc

SEQ ID NO: 6514986 - DNA, 15 bp, Homo sapiens
tgctggcgcctctgc

SEQ ID NO: 6514987 - DNA, 16 bp, Homo sapiens
tgctggcgcctctgca

SEQ ID NO: 6514988 - DNA, 16 bp, Homo sapiens
tgctggcggcgcagag

SEQ ID NO: 6514989 - DNA, 20 bp, Homo sapiens
tgctggctcacgccccgctg

SEQ ID NO: 6514990 - DNA, 16 bp, Homo sapiens
tgctggctccacgccc

SEQ ID NO: 6514991 - DNA, 17 bp, Homo sapiens
tgctggctccacgccct

SEQ ID NO: 6514992 - DNA, 16 bp, Homo sapiens
tgctggctcccagggc

SEQ ID NO: 6514993 - DNA, 17 bp, Homo sapiens
tgctggctgacctgggc

SEQ ID NO: 6514994 - DNA, 15 bp, Homo sapiens
tgctggctgagctga

SEQ ID NO: 6514995 - DNA, 16 bp, Homo sapiens
tgctggctgaggcttg

SEQ ID NO: 6514996 - DNA, 19 bp, Homo sapiens
tgctggctgaggcttgggc

SEQ ID NO: 6514997 - DNA, 14 bp, Homo sapiens
tgctggctgcctta

SEQ ID NO: 6514998 - DNA, 23 bp, Homo sapiens
tgctggctggtgcctgagcccct

SEQ ID NO: 6514999 - DNA, 21 bp, Homo sapiens
tgctggctgttggctgggggc

SEQ ID NO: 6515000 - DNA, 17 bp, Homo sapiens
tgctggcttccgctgtc

SEQ ID NO: 6515001 - DNA, 22 bp, Homo sapiens
tgctggcttccgctgtcaccca

SEQ ID NO: 6515002 - DNA, 16 bp, Homo sapiens
tgctgggaaatgcaga

SEQ ID NO: 6515003 - DNA, 17 bp, Homo sapiens
tgctgggaaatgcagaa

SEQ ID NO: 6515004 - DNA, 18 bp, Homo sapiens
tgctgggaaatgcagaaa

SEQ ID NO: 6515005 - DNA, 19 bp, Homo sapiens
tgctgggaaatgcagaaat

SEQ ID NO: 6515006 - DNA, 20 bp, Homo sapiens
tgctgggaaccccgcagccc

SEQ ID NO: 6515007 - DNA, 21 bp, Homo sapiens
tgctgggaacctcagggtatt

SEQ ID NO: 6515008 - DNA, 16 bp, Homo sapiens
tgctgggaagggaggg

SEQ ID NO: 6515009 - DNA, 16 bp, Homo sapiens
tgctgggacagctagg

SEQ ID NO: 6515010 - DNA, 18 bp, Homo sapiens
tgctgggaccagagccag

SEQ ID NO: 6515011 - DNA, 15 bp, Homo sapiens
tgctgggaccctcgg

SEQ ID NO: 6515012 - DNA, 16 bp, Homo sapiens
tgctgggactcagcct

SEQ ID NO: 6515013 - DNA, 18 bp, Homo sapiens
tgctgggactcagccttc

SEQ ID NO: 6515014 - DNA, 15 bp, Homo sapiens
tgctgggactgagcc

SEQ ID NO: 6515015 - DNA, 16 bp, Homo sapiens
tgctgggactgagcca

SEQ ID NO: 6515016 - DNA, 15 bp, Homo sapiens
tgctgggactggcca

SEQ ID NO: 6515017 - DNA, 17 bp, Homo sapiens
tgctgggagaggcagcc

SEQ ID NO: 6515018 - DNA, 16 bp, Homo sapiens
tgctgggagcaggact

SEQ ID NO: 6515019 - DNA, 16 bp, Homo sapiens
tgctgggagctccact

SEQ ID NO: 6515020 - DNA, 21 bp, Homo sapiens
tgctgggaggtcccagggccc

SEQ ID NO: 6515021 - DNA, 18 bp, Homo sapiens
tgctgggataactggcca

SEQ ID NO: 6515022 - DNA, 16 bp, Homo sapiens
tgctgggatgacaggc

SEQ ID NO: 6515023 - DNA, 19 bp, Homo sapiens
tgctgggatgacaggtgtg

SEQ ID NO: 6515024 - DNA, 13 bp, Homo sapiens
tgctgggatggct

SEQ ID NO: 6515025 - DNA, 21 bp, Homo sapiens
tgctgggatgtgtgctttccc

SEQ ID NO: 6515026 - DNA, 19 bp, Homo sapiens
tgctgggattacaagcgtg

SEQ ID NO: 6515027 - DNA, 14 bp, Homo sapiens
tgctgggatttcca

SEQ ID NO: 6515028 - DNA, 14 bp, Homo sapiens
tgctgggcactgct

SEQ ID NO: 6515029 - DNA, 17 bp, Homo sapiens
tgctgggcactgctcca

SEQ ID NO: 6515030 - DNA, 15 bp, Homo sapiens
tgctgggcagaggga

SEQ ID NO: 6515031 - DNA, 13 bp, Homo sapiens
tgctgggcagccc

SEQ ID NO: 6515032 - DNA, 19 bp, Homo sapiens
tgctgggcattttcccaga

SEQ ID NO: 6515033 - DNA, 20 bp, Homo sapiens
tgctgggccactggggactt

SEQ ID NO: 6515034 - DNA, 11 bp, Homo sapiens
tgctgggccag

SEQ ID NO: 6515035 - DNA, 12 bp, Homo sapiens
tgctgggccagg

SEQ ID NO: 6515036 - DNA, 16 bp, Homo sapiens
tgctgggccagggaaa

SEQ ID NO: 6515037 - DNA, 12 bp, Homo sapiens
tgctgggccagt

SEQ ID NO: 6515038 - DNA, 13 bp, Homo sapiens
tgctgggcccctg

SEQ ID NO: 6515039 - DNA, 18 bp, Homo sapiens
tgctgggcccctgctcaa

SEQ ID NO: 6515040 - DNA, 20 bp, Homo sapiens
tgctgggcgtgtgtgacact

SEQ ID NO: 6515041 - DNA, 21 bp, Homo sapiens
tgctgggcgtgtgtgacactg

SEQ ID NO: 6515042 - DNA, 12 bp, Homo sapiens
tgctgggctcag

SEQ ID NO: 6515043 - DNA, 15 bp, Homo sapiens
tgctgggctcagtga

SEQ ID NO: 6515044 - DNA, 22 bp, Homo sapiens
tgctgggctccccccagtggga

SEQ ID NO: 6515045 - DNA, 15 bp, Homo sapiens
tgctgggctctccac

SEQ ID NO: 6515046 - DNA, 20 bp, Homo sapiens
tgctgggctctccacctcag

SEQ ID NO: 6515047 - DNA, 22 bp, Homo sapiens
tgctgggctcttaactgttgct

SEQ ID NO: 6515048 - DNA, 10 bp, Homo sapiens
tgctgggctg

SEQ ID NO: 6515049 - DNA, 21 bp, Homo sapiens
tgctgggctgacggtgcagtc

SEQ ID NO: 6515050 - DNA, 11 bp, Homo sapiens
tgctgggctgg

SEQ ID NO: 6515051 - DNA, 18 bp, Homo sapiens
tgctgggctggactggcc

SEQ ID NO: 6515052 - DNA, 19 bp, Homo sapiens
tgctgggctggactggcca

SEQ ID NO: 6515053 - DNA, 15 bp, Homo sapiens
tgctgggctgggccc

SEQ ID NO: 6515054 - DNA, 13 bp, Homo sapiens
tgctgggctgggg

SEQ ID NO: 6515055 - DNA, 16 bp, Homo sapiens
tgctgggctgggtgcg

SEQ ID NO: 6515056 - DNA, 22 bp, Homo sapiens
tgctgggcttgtagaccactgt

SEQ ID NO: 6515057 - DNA, 13 bp, Homo sapiens
tgctgggctttgg

SEQ ID NO: 6515058 - DNA, 20 bp, Homo sapiens
tgctggggaagaacagcccc

SEQ ID NO: 6515059 - DNA, 21 bp, Homo sapiens
tgctggggaagaacagccccg

SEQ ID NO: 6515060 - DNA, 22 bp, Homo sapiens
tgctggggaagacagtggcccc

SEQ ID NO: 6515061 - DNA, 13 bp, Homo sapiens
tgctggggaaggg

SEQ ID NO: 6515062 - DNA, 13 bp, Homo sapiens
tgctggggcagag

SEQ ID NO: 6515063 - DNA, 15 bp, Homo sapiens
tgctggggcagagtg

SEQ ID NO: 6515064 - DNA, 19 bp, Homo sapiens
tgctggggcagagtggagc

SEQ ID NO: 6515065 - DNA, 23 bp, Homo sapiens
tgctggggcagagtggagcccag

SEQ ID NO: 6515066 - DNA, 14 bp, Homo sapiens
tgttggccaggctg

SEQ ID NO: 6515067 - DNA, 17 bp, Homo sapiens
tgttggccatcatttca

SEQ ID NO: 6515068 - DNA, 16 bp, Homo sapiens
tgttggcctccggcct

SEQ ID NO: 6515069 - DNA, 14 bp, Homo sapiens
tgttggcctcgcct

SEQ ID NO: 6515070 - DNA, 19 bp, Homo sapiens
tgttggcctcgcctgggcc

SEQ ID NO: 6515071 - DNA, 15 bp, Homo sapiens
tgttggcctctgcaa

SEQ ID NO: 6515072 - DNA, 15 bp, Homo sapiens
tgttggcctgtcaga

SEQ ID NO: 6515073 - DNA, 20 bp, Homo sapiens
tgttggcgagaggaggggcc

SEQ ID NO: 6515074 - DNA, 20 bp, Homo sapiens
tgttggcgtaggctacagag

SEQ ID NO: 6515075 - DNA, 22 bp, Homo sapiens
tgttggcgtaggctacagagaa

SEQ ID NO: 6515076 - DNA, 23 bp, Homo sapiens
tgttggcgtaggctacagagaag

SEQ ID NO: 6515077 - DNA, 16 bp, Homo sapiens
tgttggcgtgtcccag

SEQ ID NO: 6515078 - DNA, 17 bp, Homo sapiens
tgttggcgtgtcccagc

SEQ ID NO: 6515079 - DNA, 22 bp, Homo sapiens
tgttggcgtgtcccagcaccac

SEQ ID NO: 6515080 - DNA, 14 bp, Homo sapiens
tgttggctagcctc

SEQ ID NO: 6515081 - DNA, 14 bp, Homo sapiens
tgttggctatttga

SEQ ID NO: 6515082 - DNA, 17 bp, Homo sapiens
tgttggctatttgaaat

SEQ ID NO: 6515083 - DNA, 15 bp, Homo sapiens
tgttggctcagaaaa

SEQ ID NO: 6515084 - DNA, 13 bp, Homo sapiens
tgttggctgctcc

SEQ ID NO: 6515085 - DNA, 16 bp, Homo sapiens
tgttggctgctcccca

SEQ ID NO: 6515086 - DNA, 22 bp, Homo sapiens
tgttggctgggaactcacctgg

SEQ ID NO: 6515087 - DNA, 16 bp, Homo sapiens
tgttggctgtgtgaca

SEQ ID NO: 6515088 - DNA, 20 bp, Homo sapiens
tgttggcttggggcaacaga

SEQ ID NO: 6515089 - DNA, 22 bp, Homo sapiens
tgttggcttggggcaacagatt

SEQ ID NO: 6515090 - DNA, 21 bp, Homo sapiens
tgttgggaaagataaaactct

SEQ ID NO: 6515091 - DNA, 23 bp, Homo sapiens
tgttgggaaggggtcctgcaggg

SEQ ID NO: 6515092 - DNA, 16 bp, Homo sapiens
tgttgggaattgcatg

SEQ ID NO: 6515093 - DNA, 23 bp, Homo sapiens
tgttgggacagccattttccaac

SEQ ID NO: 6515094 - DNA, 20 bp, Homo sapiens
tgttgggagagggcgcaggc

SEQ ID NO: 6515095 - DNA, 22 bp, Homo sapiens
tgttgggatgcgggcattttga

SEQ ID NO: 6515096 - DNA, 22 bp, Homo sapiens
tgttgggcttgggggaaaagag

SEQ ID NO: 6515097 - DNA, 20 bp, Homo sapiens
tgttggggaagggcctgccc

SEQ ID NO: 6515098 - DNA, 14 bp, Homo sapiens
tgttggggctgggg

SEQ ID NO: 6515099 - DNA, 16 bp, Homo sapiens
tgttggggctgggggc

SEQ ID NO: 6515100 - DNA, 17 bp, Homo sapiens
tgttggggttgacattt

SEQ ID NO: 6515101 - DNA, 16 bp, Homo sapiens
tgttgggtcctctgct

SEQ ID NO: 6515102 - DNA, 20 bp, Homo sapiens
tgttgggtgggtgggccctg

SEQ ID NO: 6515103 - DNA, 17 bp, Homo sapiens
tgttgggtgtcttgcct

SEQ ID NO: 6515104 - DNA, 19 bp, Homo sapiens
tgttgggtttgagacagac

SEQ ID NO: 6515105 - DNA, 15 bp, Homo sapiens
tgttggtaaagcaca

SEQ ID NO: 6515106 - DNA, 15 bp, Homo sapiens
tgttggtatttactg

SEQ ID NO: 6515107 - DNA, 21 bp, Homo sapiens
tgttggtcatctctcctgtgt

SEQ ID NO: 6515108 - DNA, 14 bp, Homo sapiens
tgttggtccactgt

SEQ ID NO: 6515109 - DNA, 18 bp, Homo sapiens
tgttggtcctctctctgt

SEQ ID NO: 6515110 - DNA, 22 bp, Homo sapiens
tgttggtcgcagctacataaga

SEQ ID NO: 6515111 - DNA, 12 bp, Homo sapiens
tgttggtctgcc

SEQ ID NO: 6515112 - DNA, 19 bp, Homo sapiens
tgttggtctgccttctgct

SEQ ID NO: 6515113 - DNA, 16 bp, Homo sapiens
tgttggtctgtactga

SEQ ID NO: 6515114 - DNA, 15 bp, Homo sapiens
tgttggtctgtagca

SEQ ID NO: 6515115 - DNA, 16 bp, Homo sapiens
tgttggtctgtagcaa

SEQ ID NO: 6515116 - DNA, 23 bp, Homo sapiens
tgttggtgaaaataagaaagaat

SEQ ID NO: 6515117 - DNA, 23 bp, Homo sapiens
tgttggtgcaattaactctggac

SEQ ID NO: 6515118 - DNA, 21 bp, Homo sapiens
tgttggtggagagtggaagga

SEQ ID NO: 6515119 - DNA, 13 bp, Homo sapiens
tgttggtggcaaa

SEQ ID NO: 6515120 - DNA, 22 bp, Homo sapiens
tgttggttaccctcctagcttt

SEQ ID NO: 6515121 - DNA, 22 bp, Homo sapiens
tgttggttagccgactgtcttg

SEQ ID NO: 6515122 - DNA, 15 bp, Homo sapiens
tgttggttgcacttt

SEQ ID NO: 6515123 - DNA, 15 bp, Homo sapiens
tgttggttggttttc

SEQ ID NO: 6515124 - DNA, 20 bp, Homo sapiens
tgttggttggttttcttctt

SEQ ID NO: 6515125 - DNA, 20 bp, Homo sapiens
tgttggttgttttttccttt

SEQ ID NO: 6515126 - DNA, 15 bp, Homo sapiens
tgttgtaaaaagaaa

SEQ ID NO: 6515127 - DNA, 13 bp, Homo sapiens
tgttgtaaaacaa

SEQ ID NO: 6515128 - DNA, 17 bp, Homo sapiens
tgttgtaaaacaaaatt

SEQ ID NO: 6515129 - DNA, 13 bp, Homo sapiens
tgttgtaaaatgt

SEQ ID NO: 6515130 - DNA, 15 bp, Homo sapiens
tgttgtaaagagttg

SEQ ID NO: 6515131 - DNA, 13 bp, Homo sapiens
tgttgtaaagcaa

SEQ ID NO: 6515132 - DNA, 13 bp, Homo sapiens
tgttgtaaatgac

SEQ ID NO: 6515133 - DNA, 15 bp, Homo sapiens
tgttgtaaattagga

SEQ ID NO: 6515134 - DNA, 18 bp, Homo sapiens
tgttgtaacctgctgtga

SEQ ID NO: 6515135 - DNA, 19 bp, Homo sapiens
tgttgtaacttatgtagat

SEQ ID NO: 6515136 - DNA, 18 bp, Homo sapiens
tgttgtaataaaacttat

SEQ ID NO: 6515137 - DNA, 17 bp, Homo sapiens
tgttgtaatatcagtta

SEQ ID NO: 6515138 - DNA, 21 bp, Homo sapiens
tgttgtaatatcagttacagt

SEQ ID NO: 6515139 - DNA, 20 bp, Homo sapiens
tgttgtaatattttgctgct

SEQ ID NO: 6515140 - DNA, 13 bp, Homo sapiens
tgttgtaatgctg

SEQ ID NO: 6515141 - DNA, 22 bp, Homo sapiens
tgttgtaatgctgcacttcctg

SEQ ID NO: 6515142 - DNA, 13 bp, Homo sapiens
tgttgtaattctt

SEQ ID NO: 6515143 - DNA, 19 bp, Homo sapiens
tgttgtacaattactgtga

SEQ ID NO: 6515144 - DNA, 21 bp, Homo sapiens
tgttgtacaattactgtgaga

SEQ ID NO: 6515145 - DNA, 18 bp, Homo sapiens
tgttgtacacagtctgtt

SEQ ID NO: 6515146 - DNA, 14 bp, Homo sapiens
tgttgtacatttat

SEQ ID NO: 6515147 - DNA, 20 bp, Homo sapiens
tgttgtacatttatgattta

SEQ ID NO: 6515148 - DNA, 20 bp, Homo sapiens
tgttgtaccatatgtagcat

SEQ ID NO: 6515149 - DNA, 21 bp, Homo sapiens
tgttgtaccatatgtagcatt

SEQ ID NO: 6515150 - DNA, 13 bp, Homo sapiens
tgttgtacccttg

SEQ ID NO: 6515151 - DNA, 17 bp, Homo sapiens
tgttgtacgtaaagctt

SEQ ID NO: 6515152 - DNA, 21 bp, Homo sapiens
tgttgtactcaattttaacaa

SEQ ID NO: 6515153 - DNA, 18 bp, Homo sapiens
tgttgtactttttattca

SEQ ID NO: 6515154 - DNA, 23 bp, Homo sapiens
tgttgtagagaaaacatgcagaa

SEQ ID NO: 6515155 - DNA, 20 bp, Homo sapiens
tgttgtagatacaatcagct

SEQ ID NO: 6515156 - DNA, 21 bp, Homo sapiens
tgttgtagatacaatcagctg

SEQ ID NO: 6515157 - DNA, 21 bp, Homo sapiens
tgttgtagattgattgtattg

SEQ ID NO: 6515158 - DNA, 23 bp, Homo sapiens
tgttgtaggaaaagctgttccca

SEQ ID NO: 6515159 - DNA, 23 bp, Homo sapiens
tgttgtatatcactaaaagcatg

SEQ ID NO: 6515160 - DNA, 24 bp, Homo sapiens
tgttgtatatcactaaaagcatga

SEQ ID NO: 6515161 - DNA, 17 bp, Homo sapiens
tgttgtattaactgggt

SEQ ID NO: 6515162 - DNA, 14 bp, Homo sapiens
tgttgtattcattg

SEQ ID NO: 6515163 - DNA, 14 bp, Homo sapiens
tgttgtatttatgg

SEQ ID NO: 6515164 - DNA, 13 bp, Homo sapiens
tgttgtattttaa

SEQ ID NO: 6515165 - DNA, 14 bp, Homo sapiens
tgttgtcaagtata

SEQ ID NO: 6515166 - DNA, 13 bp, Homo sapiens
tgttgtcaccaga

SEQ ID NO: 6515167 - DNA, 13 bp, Homo sapiens
tgttgtcaccttc

SEQ ID NO: 6515168 - DNA, 15 bp, Homo sapiens
tgttgtcagcaggca

SEQ ID NO: 6515169 - DNA, 17 bp, Homo sapiens
tgttgtcagcatcttct

SEQ ID NO: 6515170 - DNA, 14 bp, Homo sapiens
tgttgtcagctgaa

SEQ ID NO: 6515171 - DNA, 17 bp, Homo sapiens
tgttgtcataacattta

SEQ ID NO: 6515172 - DNA, 17 bp, Homo sapiens
tgttgtcatgcattggt

SEQ ID NO: 6515173 - DNA, 11 bp, Homo sapiens
tgttgtcattg

SEQ ID NO: 6515174 - DNA, 15 bp, Homo sapiens
tgttgtcattgctgt

SEQ ID NO: 6515175 - DNA, 16 bp, Homo sapiens
tgttgtcattgcttta

SEQ ID NO: 6515176 - DNA, 19 bp, Homo sapiens
tgttgtcattgctttactg

SEQ ID NO: 6515177 - DNA, 13 bp, Homo sapiens
tgttgtcattgta

SEQ ID NO: 6515178 - DNA, 19 bp, Homo sapiens
tgttgtcattgtaaacaaa

SEQ ID NO: 6515179 - DNA, 20 bp, Homo sapiens
tgttgtcattgtccagctgg

SEQ ID NO: 6515180 - DNA, 23 bp, Homo sapiens
tgttgtcatttccaaattcctag

SEQ ID NO: 6515181 - DNA, 23 bp, Homo sapiens
tgttgtccctactttctctctct

SEQ ID NO: 6515182 - DNA, 15 bp, Homo sapiens
tgttgtccctgcagg

SEQ ID NO: 6515183 - DNA, 12 bp, Homo sapiens
tgttgtcccttc

SEQ ID NO: 6515184 - DNA, 17 bp, Homo sapiens
tgttgtcctcccaggaa

SEQ ID NO: 6515185 - DNA, 23 bp, Homo sapiens
tgttgtcctcccaggaaccaaaa

SEQ ID NO: 6515186 - DNA, 16 bp, Homo sapiens
tgttgtcctcctgttc

SEQ ID NO: 6515187 - DNA, 15 bp, Homo sapiens
tgttgtcctgaactg

SEQ ID NO: 6515188 - DNA, 22 bp, Homo sapiens
tgttgtcctgtgtcatctgtca

SEQ ID NO: 6515189 - DNA, 18 bp, Homo sapiens
tgttgtcctgttaattta

SEQ ID NO: 6515190 - DNA, 16 bp, Homo sapiens
tgttgtccttttcata

SEQ ID NO: 6515191 - DNA, 22 bp, Homo sapiens
tgttgtccttttcataggtctg

SEQ ID NO: 6515192 - DNA, 18 bp, Homo sapiens
tgttgtcgtaaagatttg

SEQ ID NO: 6515193 - DNA, 21 bp, Homo sapiens
tgttgtctacattaaatcact

SEQ ID NO: 6515194 - DNA, 14 bp, Homo sapiens
tgttgtctcatttt

SEQ ID NO: 6515195 - DNA, 13 bp, Homo sapiens
tgttgtctcttct

SEQ ID NO: 6515196 - DNA, 15 bp, Homo sapiens
tgttgtctcttgagt

SEQ ID NO: 6515197 - DNA, 16 bp, Homo sapiens
tgttgtcttttttatg

SEQ ID NO: 6515198 - DNA, 18 bp, Homo sapiens
tgttgtgaagatgtttgc

SEQ ID NO: 6515199 - DNA, 21 bp, Homo sapiens
tgttgtgagaatggcctggag

SEQ ID NO: 6515200 - DNA, 16 bp, Homo sapiens
tgttgtgatgtacaca

SEQ ID NO: 6515201 - DNA, 20 bp, Homo sapiens
tgttgtgatgtattctagct

SEQ ID NO: 6515202 - DNA, 13 bp, Homo sapiens
tgttgtgattttg

SEQ ID NO: 6515203 - DNA, 13 bp, Homo sapiens
tgttgtgcatttg

SEQ ID NO: 6515204 - DNA, 20 bp, Homo sapiens
tgttgtgccccttcactcat

SEQ ID NO: 6515205 - DNA, 13 bp, Homo sapiens
tgttgtgcctact

SEQ ID NO: 6515206 - DNA, 13 bp, Homo sapiens
tgttgtggctctt

SEQ ID NO: 6515207 - DNA, 14 bp, Homo sapiens
tgttgtggctctta

SEQ ID NO: 6515208 - DNA, 16 bp, Homo sapiens
tgttgtggctcttatt

SEQ ID NO: 6515209 - DNA, 19 bp, Homo sapiens
tgttgtggctcttatttct

SEQ ID NO: 6515210 - DNA, 22 bp, Homo sapiens
tgttgtgggggtgtcacagagg

SEQ ID NO: 6515211 - DNA, 24 bp, Homo sapiens
tgttgtgggggtgtcacagaggca

SEQ ID NO: 6515212 - DNA, 22 bp, Homo sapiens
tgttgtgggttctatgtttact

SEQ ID NO: 6515213 - DNA, 13 bp, Homo sapiens
tgttgtgtataat

SEQ ID NO: 6515214 - DNA, 14 bp, Homo sapiens
tgttgtgtgcctct

SEQ ID NO: 6515215 - DNA, 21 bp, Homo sapiens
tgttgtgtgcctctagctgaa

SEQ ID NO: 6515216 - DNA, 17 bp, Homo sapiens
tgttgtgtgtatatgta

SEQ ID NO: 6515217 - DNA, 20 bp, Homo sapiens
tgttgtgtgtatatgtattt

SEQ ID NO: 6515218 - DNA, 13 bp, Homo sapiens
tgttgtgtgttgc

SEQ ID NO: 6515219 - DNA, 13 bp, Homo sapiens
tgttgtgttacaa

SEQ ID NO: 6515220 - DNA, 20 bp, Homo sapiens
tgttgtgttacaataagtgt

SEQ ID NO: 6515221 - DNA, 14 bp, Homo sapiens
tgttgtgttcacca

SEQ ID NO: 6515222 - DNA, 13 bp, Homo sapiens
tgttgtgttcctg

SEQ ID NO: 6515223 - DNA, 13 bp, Homo sapiens
tgttgttaaaaca

SEQ ID NO: 6515224 - DNA, 13 bp, Homo sapiens
tgttgttaaatgc

SEQ ID NO: 6515225 - DNA, 16 bp, Homo sapiens
tgttgttaaatgctat

SEQ ID NO: 6515226 - DNA, 18 bp, Homo sapiens
tgttgttaatgaaaatgt

SEQ ID NO: 6515227 - DNA, 12 bp, Homo sapiens
tgttgttagaga

SEQ ID NO: 6515228 - DNA, 14 bp, Homo sapiens
tgttgttatgatgt

SEQ ID NO: 6515229 - DNA, 17 bp, Homo sapiens
tgttgttatgatgtgct

SEQ ID NO: 6515230 - DNA, 14 bp, Homo sapiens
tgttgttatgctat

SEQ ID NO: 6515231 - DNA, 11 bp, Homo sapiens
tgttgttattt

SEQ ID NO: 6515232 - DNA, 13 bp, Homo sapiens
tgttgttatttaa

SEQ ID NO: 6515233 - DNA, 23 bp, Homo sapiens
tgttgttcaaatgcattttgggg

SEQ ID NO: 6515234 - DNA, 23 bp, Homo sapiens
tgttgttccaaatactaatgaaa

SEQ ID NO: 6515235 - DNA, 17 bp, Homo sapiens
tgttgttccattttatg

SEQ ID NO: 6515236 - DNA, 13 bp, Homo sapiens
tgttgttcctcta

SEQ ID NO: 6515237 - DNA, 22 bp, Homo sapiens
tgttgttcctctatactttgtt

SEQ ID NO: 6515238 - DNA, 19 bp, Homo sapiens
tgttgttccttcacattta

SEQ ID NO: 6515239 - DNA, 23 bp, Homo sapiens
tgttgttcgatcgtttcacatct

SEQ ID NO: 6515240 - DNA, 14 bp, Homo sapiens
tgttgttctcattg

SEQ ID NO: 6515241 - DNA, 22 bp, Homo sapiens
tgttgttctcctccattgctgt

SEQ ID NO: 6515242 - DNA, 13 bp, Homo sapiens
tgttgttctgtta

SEQ ID NO: 6515243 - DNA, 18 bp, Homo sapiens
tgttgttctgttaactga

SEQ ID NO: 6515244 - DNA, 19 bp, Homo sapiens
tgttgttcttggcaataaa

SEQ ID NO: 6515245 - DNA, 20 bp, Homo sapiens
tgctggggcagggcccaggg

SEQ ID NO: 6515246 - DNA, 20 bp, Homo sapiens
tgctggggcatgtgtgcctg

SEQ ID NO: 6515247 - DNA, 13 bp, Homo sapiens
tgctggggccagc

SEQ ID NO: 6515248 - DNA, 14 bp, Homo sapiens
tgctggggccaggg

SEQ ID NO: 6515249 - DNA, 15 bp, Homo sapiens
tgctggggccagggc

SEQ ID NO: 6515250 - DNA, 15 bp, Homo sapiens
tgctggggcctcaga

SEQ ID NO: 6515251 - DNA, 17 bp, Homo sapiens
tgctggggcctcagacg

SEQ ID NO: 6515252 - DNA, 18 bp, Homo sapiens
tgctggggcctggttccc

SEQ ID NO: 6515253 - DNA, 16 bp, Homo sapiens
tgctggggctgaacat

SEQ ID NO: 6515254 - DNA, 13 bp, Homo sapiens
tgctggggctgca

SEQ ID NO: 6515255 - DNA, 19 bp, Homo sapiens
tgctggggctggtgaggcc

SEQ ID NO: 6515256 - DNA, 21 bp, Homo sapiens
tgctgggggagccctgggttc

SEQ ID NO: 6515257 - DNA, 12 bp, Homo sapiens
tgctgggggctc

SEQ ID NO: 6515258 - DNA, 14 bp, Homo sapiens
tgctgggggctccc

SEQ ID NO: 6515259 - DNA, 15 bp, Homo sapiens
tgctgggggctcccc

SEQ ID NO: 6515260 - DNA, 23 bp, Homo sapiens
tgctggggggcagggcccatctg

SEQ ID NO: 6515261 - DNA, 21 bp, Homo sapiens
tgctggggtacacagtgagag

SEQ ID NO: 6515262 - DNA, 19 bp, Homo sapiens
tgctgggtatgctctgtga

SEQ ID NO: 6515263 - DNA, 13 bp, Homo sapiens
tgctgggtctgag

SEQ ID NO: 6515264 - DNA, 19 bp, Homo sapiens
tgctgggtctgaggcccct

SEQ ID NO: 6515265 - DNA, 17 bp, Homo sapiens
tgctgggtgccaggtgc

SEQ ID NO: 6515266 - DNA, 18 bp, Homo sapiens
tgctgggtgcgaaggcag

SEQ ID NO: 6515267 - DNA, 14 bp, Homo sapiens
tgctgggtggcagg

SEQ ID NO: 6515268 - DNA, 16 bp, Homo sapiens
tgctgggtggcccatc

SEQ ID NO: 6515269 - DNA, 14 bp, Homo sapiens
tgctgggtgggaat

SEQ ID NO: 6515270 - DNA, 15 bp, Homo sapiens
tgctgggtgggaatg

SEQ ID NO: 6515271 - DNA, 21 bp, Homo sapiens
tgctgggtggttctctgggcc

SEQ ID NO: 6515272 - DNA, 16 bp, Homo sapiens
tgctgggttggtgcac

SEQ ID NO: 6515273 - DNA, 17 bp, Homo sapiens
tgctgggttggtgcaca

SEQ ID NO: 6515274 - DNA, 19 bp, Homo sapiens
tgctgggttggtgcacagt

SEQ ID NO: 6515275 - DNA, 23 bp, Homo sapiens
tgctgggtttccacacagcctgt

SEQ ID NO: 6515276 - DNA, 16 bp, Homo sapiens
tgctggtaaaatgaag

SEQ ID NO: 6515277 - DNA, 17 bp, Homo sapiens
tgctggtaacagtggct

SEQ ID NO: 6515278 - DNA, 22 bp, Homo sapiens
tgctggtaatttgtatctgaag

SEQ ID NO: 6515279 - DNA, 18 bp, Homo sapiens
tgctggtaccactggaat

SEQ ID NO: 6515280 - DNA, 13 bp, Homo sapiens
tgctggtacctgc

SEQ ID NO: 6515281 - DNA, 19 bp, Homo sapiens
tgctggtagagacccccag

SEQ ID NO: 6515282 - DNA, 17 bp, Homo sapiens
tgctggtagatgctgag

SEQ ID NO: 6515283 - DNA, 16 bp, Homo sapiens
tgctggtcacagcctc

SEQ ID NO: 6515284 - DNA, 17 bp, Homo sapiens
tgctggtcacagcctcc

SEQ ID NO: 6515285 - DNA, 21 bp, Homo sapiens
tgctggtcagagacggcagaa

SEQ ID NO: 6515286 - DNA, 23 bp, Homo sapiens
tgctggtcaggtccccatggctt

SEQ ID NO: 6515287 - DNA, 18 bp, Homo sapiens
tgctggtcctgcacatga

SEQ ID NO: 6515288 - DNA, 19 bp, Homo sapiens
tgctggtcctgcacatgag

SEQ ID NO: 6515289 - DNA, 20 bp, Homo sapiens
tgctggtctaggagctgtct

SEQ ID NO: 6515290 - DNA, 19 bp, Homo sapiens
tgctggtctttagccccac

SEQ ID NO: 6515291 - DNA, 14 bp, Homo sapiens
tgctggtgagtgcc

SEQ ID NO: 6515292 - DNA, 14 bp, Homo sapiens
tgctggtgattttt

SEQ ID NO: 6515293 - DNA, 16 bp, Homo sapiens
tgctggtgcccaccct

SEQ ID NO: 6515294 - DNA, 13 bp, Homo sapiens
tgctggtgcctct

SEQ ID NO: 6515295 - DNA, 19 bp, Homo sapiens
tgctggtggaggaagggct

SEQ ID NO: 6515296 - DNA, 21 bp, Homo sapiens
tgctggtggaggaagggctgg

SEQ ID NO: 6515297 - DNA, 22 bp, Homo sapiens
tgctggtggaggaagggctggg

SEQ ID NO: 6515298 - DNA, 13 bp, Homo sapiens
tgctggtggggca

SEQ ID NO: 6515299 - DNA, 23 bp, Homo sapiens
tgctggtgggttagctaaaccaa

SEQ ID NO: 6515300 - DNA, 21 bp, Homo sapiens
tgctggtggtttttcagctcc

SEQ ID NO: 6515301 - DNA, 17 bp, Homo sapiens
tgctggtgtactctagg

SEQ ID NO: 6515302 - DNA, 17 bp, Homo sapiens
tgctggtgtcctgacca

SEQ ID NO: 6515303 - DNA, 18 bp, Homo sapiens
tgctggttctgttttcta

SEQ ID NO: 6515304 - DNA, 18 bp, Homo sapiens
tgctggttgttgccaggt

SEQ ID NO: 6515305 - DNA, 20 bp, Homo sapiens
tgctggttgttgccaggttg

SEQ ID NO: 6515306 - DNA, 17 bp, Homo sapiens
tgctggtttgaaagatt

SEQ ID NO: 6515307 - DNA, 15 bp, Homo sapiens
tgctggttttcctaa

SEQ ID NO: 6515308 - DNA, 17 bp, Homo sapiens
tgctgtaaaaactgtgg

SEQ ID NO: 6515309 - DNA, 15 bp, Homo sapiens
tgctgtaaaagcaag

SEQ ID NO: 6515310 - DNA, 16 bp, Homo sapiens
tgctgtaaaatttgtg

SEQ ID NO: 6515311 - DNA, 20 bp, Homo sapiens
tgctgtaaagagttgctttt

SEQ ID NO: 6515312 - DNA, 21 bp, Homo sapiens
tgctgtaaagcaaaatatttg

SEQ ID NO: 6515313 - DNA, 18 bp, Homo sapiens
tgctgtaaataaaaatag

SEQ ID NO: 6515314 - DNA, 14 bp, Homo sapiens
tgctgtaaataagc

SEQ ID NO: 6515315 - DNA, 13 bp, Homo sapiens
tgctgtaaatatt

SEQ ID NO: 6515316 - DNA, 20 bp, Homo sapiens
tgctgtaaatatttcataaa

SEQ ID NO: 6515317 - DNA, 23 bp, Homo sapiens
tgctgtaaatatttcataaatta

SEQ ID NO: 6515318 - DNA, 18 bp, Homo sapiens
tgctgtaactgctgagcc

SEQ ID NO: 6515319 - DNA, 19 bp, Homo sapiens
tgctgtaactgctgagcca

SEQ ID NO: 6515320 - DNA, 12 bp, Homo sapiens
tgctgtaactgg

SEQ ID NO: 6515321 - DNA, 15 bp, Homo sapiens
tgctgtaagacggcc

SEQ ID NO: 6515322 - DNA, 17 bp, Homo sapiens
tgctgtaagatgtctgt

SEQ ID NO: 6515323 - DNA, 22 bp, Homo sapiens
tgctgtaagatgtctgtttgct

SEQ ID NO: 6515324 - DNA, 19 bp, Homo sapiens
tgctgtaagcacctgggct

SEQ ID NO: 6515325 - DNA, 15 bp, Homo sapiens
tgctgtacatacttt

SEQ ID NO: 6515326 - DNA, 21 bp, Homo sapiens
tgctgtacatctattttggat

SEQ ID NO: 6515327 - DNA, 15 bp, Homo sapiens
tgctgtacccttcca

SEQ ID NO: 6515328 - DNA, 20 bp, Homo sapiens
tgctgtacgtactgcatttg

SEQ ID NO: 6515329 - DNA, 19 bp, Homo sapiens
tgctgtactaacccagtct

SEQ ID NO: 6515330 - DNA, 21 bp, Homo sapiens
tgctgtactagagatctggtt

SEQ ID NO: 6515331 - DNA, 14 bp, Homo sapiens
tgctgtacttgtgg

SEQ ID NO: 6515332 - DNA, 13 bp, Homo sapiens
tgctgtagagact

SEQ ID NO: 6515333 - DNA, 14 bp, Homo sapiens
tgctgtagagactt

SEQ ID NO: 6515334 - DNA, 14 bp, Homo sapiens
tgctgtagatgctg

SEQ ID NO: 6515335 - DNA, 17 bp, Homo sapiens
tgctgtagctgaaagag

SEQ ID NO: 6515336 - DNA, 16 bp, Homo sapiens
tgctgtagtcctttct

SEQ ID NO: 6515337 - DNA, 23 bp, Homo sapiens
tgctgtagtgttgtctttgataa

SEQ ID NO: 6515338 - DNA, 16 bp, Homo sapiens
tgctgtataaaatcag

SEQ ID NO: 6515339 - DNA, 16 bp, Homo sapiens
tgctgtatacaaacag

SEQ ID NO: 6515340 - DNA, 22 bp, Homo sapiens
tgctgtatacaaacaggtgcta

SEQ ID NO: 6515341 - DNA, 23 bp, Homo sapiens
tgctgtatccatccatggggctg

SEQ ID NO: 6515342 - DNA, 23 bp, Homo sapiens
tgctgtatgacccctggccacag

SEQ ID NO: 6515343 - DNA, 22 bp, Homo sapiens
tgctgtatgctgatcatcgcca

SEQ ID NO: 6515344 - DNA, 18 bp, Homo sapiens
tgctgtatggcccaggca

SEQ ID NO: 6515345 - DNA, 20 bp, Homo sapiens
tgctgtatggcccaggcagc

SEQ ID NO: 6515346 - DNA, 16 bp, Homo sapiens
tgctgtatgtgagctg

SEQ ID NO: 6515347 - DNA, 16 bp, Homo sapiens
tgctgtattgccccca

SEQ ID NO: 6515348 - DNA, 18 bp, Homo sapiens
tgctgtatttatagtaac

SEQ ID NO: 6515349 - DNA, 13 bp, Homo sapiens
tgctgtatttctt

SEQ ID NO: 6515350 - DNA, 19 bp, Homo sapiens
tgctgtatttgaggaaact

SEQ ID NO: 6515351 - DNA, 15 bp, Homo sapiens
tgctgtattttaaag

SEQ ID NO: 6515352 - DNA, 17 bp, Homo sapiens
tgctgtattttaacact

SEQ ID NO: 6515353 - DNA, 16 bp, Homo sapiens
tgctgtattttgatat

SEQ ID NO: 6515354 - DNA, 14 bp, Homo sapiens
tgctgtatttttac

SEQ ID NO: 6515355 - DNA, 16 bp, Homo sapiens
tgctgtatttttacag

SEQ ID NO: 6515356 - DNA, 22 bp, Homo sapiens
tgctgtatttttacagctactt

SEQ ID NO: 6515357 - DNA, 22 bp, Homo sapiens
tgctgtcaacttcccatctggc

SEQ ID NO: 6515358 - DNA, 24 bp, Homo sapiens
tgctgtcaataaatgacacccaga

SEQ ID NO: 6515359 - DNA, 20 bp, Homo sapiens
tgctgtcacctcgctgggct

SEQ ID NO: 6515360 - DNA, 22 bp, Homo sapiens
tgctgtcacctcgctgggctct

SEQ ID NO: 6515361 - DNA, 15 bp, Homo sapiens
tgctgtcacctctcc

SEQ ID NO: 6515362 - DNA, 17 bp, Homo sapiens
tgctgtcaccttgctca

SEQ ID NO: 6515363 - DNA, 18 bp, Homo sapiens
tgctgtcactggcagagc

SEQ ID NO: 6515364 - DNA, 13 bp, Homo sapiens
tgctgtcactgtt

SEQ ID NO: 6515365 - DNA, 18 bp, Homo sapiens
tgctgtcacttcttcacc

SEQ ID NO: 6515366 - DNA, 13 bp, Homo sapiens
tgctgtcagccaa

SEQ ID NO: 6515367 - DNA, 22 bp, Homo sapiens
tgctgtcaggagatggaagagt

SEQ ID NO: 6515368 - DNA, 17 bp, Homo sapiens
tgctgtcatgtggaaac

SEQ ID NO: 6515369 - DNA, 24 bp, Homo sapiens
tgctgtcattgcttcttctgaggc

SEQ ID NO: 6515370 - DNA, 17 bp, Homo sapiens
tgctgtcattgtccatg

SEQ ID NO: 6515371 - DNA, 19 bp, Homo sapiens
tgctgtccacatgacctcc

SEQ ID NO: 6515372 - DNA, 14 bp, Homo sapiens
tgctgtccaggcag

SEQ ID NO: 6515373 - DNA, 15 bp, Homo sapiens
tgctgtccaggcagc

SEQ ID NO: 6515374 - DNA, 10 bp, Homo sapiens
tgctgtcccc

SEQ ID NO: 6515375 - DNA, 15 bp, Homo sapiens
tgctgtccccactgc

SEQ ID NO: 6515376 - DNA, 18 bp, Homo sapiens
tgctgtccccactgcccc

SEQ ID NO: 6515377 - DNA, 13 bp, Homo sapiens
tgctgtcccctct

SEQ ID NO: 6515378 - DNA, 20 bp, Homo sapiens
tgctgtcccctcttgcccca

SEQ ID NO: 6515379 - DNA, 16 bp, Homo sapiens
tgctgtccctccccct

SEQ ID NO: 6515380 - DNA, 16 bp, Homo sapiens
tgctgtccctcctgag

SEQ ID NO: 6515381 - DNA, 16 bp, Homo sapiens
tgctgtccctgcactg

SEQ ID NO: 6515382 - DNA, 21 bp, Homo sapiens
tgctgtccctgcactgtgccc

SEQ ID NO: 6515383 - DNA, 13 bp, Homo sapiens
tgctgtccctgtc

SEQ ID NO: 6515384 - DNA, 15 bp, Homo sapiens
tgctgtccctgtggg

SEQ ID NO: 6515385 - DNA, 17 bp, Homo sapiens
tgctgtccctgtgggct

SEQ ID NO: 6515386 - DNA, 20 bp, Homo sapiens
tgctgtccctgtgggctcac

SEQ ID NO: 6515387 - DNA, 21 bp, Homo sapiens
tgctgtccctgtgggctcaca

SEQ ID NO: 6515388 - DNA, 23 bp, Homo sapiens
tgctgtccctgtgggctcacacc

SEQ ID NO: 6515389 - DNA, 19 bp, Homo sapiens
tgctgtcccttacgtgagt

SEQ ID NO: 6515390 - DNA, 15 bp, Homo sapiens
tgctgtcccttttcc

SEQ ID NO: 6515391 - DNA, 19 bp, Homo sapiens
tgctgtcctctcccccttc

SEQ ID NO: 6515392 - DNA, 20 bp, Homo sapiens
tgctgtcctctcccccttca

SEQ ID NO: 6515393 - DNA, 15 bp, Homo sapiens
tgctgtcctggtggc

SEQ ID NO: 6515394 - DNA, 22 bp, Homo sapiens
tgctgtcctgtttctgtcaagc

SEQ ID NO: 6515395 - DNA, 18 bp, Homo sapiens
tgctgtcgggaccacatc

SEQ ID NO: 6515396 - DNA, 17 bp, Homo sapiens
tgctgtctaacctgtga

SEQ ID NO: 6515397 - DNA, 20 bp, Homo sapiens
tgctgtctacagtagctgct

SEQ ID NO: 6515398 - DNA, 15 bp, Homo sapiens
tgctgtctagcctta

SEQ ID NO: 6515399 - DNA, 22 bp, Homo sapiens
tgctgtctccataatgccactg

SEQ ID NO: 6515400 - DNA, 23 bp, Homo sapiens
tgctgtctccataatgccactgg

SEQ ID NO: 6515401 - DNA, 22 bp, Homo sapiens
tgctgtctccatgctggatact

SEQ ID NO: 6515402 - DNA, 14 bp, Homo sapiens
tgctgtctctagaa

SEQ ID NO: 6515403 - DNA, 16 bp, Homo sapiens
tgctgtctctctgggc

SEQ ID NO: 6515404 - DNA, 18 bp, Homo sapiens
tgctgtctcttaaatctc

SEQ ID NO: 6515405 - DNA, 14 bp, Homo sapiens
tgctgtctgaaaaa

SEQ ID NO: 6515406 - DNA, 23 bp, Homo sapiens
tgctgtctgagtagtggccactg

SEQ ID NO: 6515407 - DNA, 19 bp, Homo sapiens
tgctgtctgatctgtgctt

SEQ ID NO: 6515408 - DNA, 12 bp, Homo sapiens
tgctgtctgcag

SEQ ID NO: 6515409 - DNA, 13 bp, Homo sapiens
tgctgtctgcagc

SEQ ID NO: 6515410 - DNA, 23 bp, Homo sapiens
tgctgtctggtgaggtggcccag

SEQ ID NO: 6515411 - DNA, 15 bp, Homo sapiens
tgctgtctgtcctat

SEQ ID NO: 6515412 - DNA, 21 bp, Homo sapiens
tgctgtctgtgtgaggctccc

SEQ ID NO: 6515413 - DNA, 13 bp, Homo sapiens
tgctgtcttaaac

SEQ ID NO: 6515414 - DNA, 14 bp, Homo sapiens
tgctgtcttaaact

SEQ ID NO: 6515415 - DNA, 21 bp, Homo sapiens
tgctgtcttaaactaaatgtg

SEQ ID NO: 6515416 - DNA, 21 bp, Homo sapiens
tgctgtcttactaataggtct

SEQ ID NO: 6515417 - DNA, 21 bp, Homo sapiens
tgctgtcttctccctcctcct

SEQ ID NO: 6515418 - DNA, 17 bp, Homo sapiens
tgctgtcttctggtctg

SEQ ID NO: 6515419 - DNA, 15 bp, Homo sapiens
tgctgtctttctcta

SEQ ID NO: 6515420 - DNA, 13 bp, Homo sapiens
tgctgtctttctt

SEQ ID NO: 6515421 - DNA, 21 bp, Homo sapiens
tgctgtctttcttgctccctg

SEQ ID NO: 6515422 - DNA, 13 bp, Homo sapiens
tgctgtctttgtg

SEQ ID NO: 6515423 - DNA, 19 bp, Homo sapiens
tgttgttgaaaggtttttt

SEQ ID NO: 6515424 - DNA, 19 bp, Homo sapiens
tgttgttgataaggaacat

SEQ ID NO: 6515425 - DNA, 15 bp, Homo sapiens
tgttgttgctgctgt

SEQ ID NO: 6515426 - DNA, 13 bp, Homo sapiens
tgttgttggttgt

SEQ ID NO: 6515427 - DNA, 15 bp, Homo sapiens
tgttgttgtctattt

SEQ ID NO: 6515428 - DNA, 11 bp, Homo sapiens
tgttgttgtgt

SEQ ID NO: 6515429 - DNA, 22 bp, Homo sapiens
tgttgttgtgtgtatatgtatt

SEQ ID NO: 6515430 - DNA, 12 bp, Homo sapiens
tgttgttgttgt

SEQ ID NO: 6515431 - DNA, 20 bp, Homo sapiens
tgttgtttataataaaaata

SEQ ID NO: 6515432 - DNA, 17 bp, Homo sapiens
tgttgtttatatgaaaa

SEQ ID NO: 6515433 - DNA, 23 bp, Homo sapiens
tgttgtttatatgaaaacactca

SEQ ID NO: 6515434 - DNA, 21 bp, Homo sapiens
tgttgtttcctaatatcaaat

SEQ ID NO: 6515435 - DNA, 17 bp, Homo sapiens
tgttgtttcttaaataa

SEQ ID NO: 6515436 - DNA, 21 bp, Homo sapiens
tgttgtttcttaaataagaaa

SEQ ID NO: 6515437 - DNA, 14 bp, Homo sapiens
tgttgtttctttct

SEQ ID NO: 6515438 - DNA, 15 bp, Homo sapiens
tgttgtttgaagaac

SEQ ID NO: 6515439 - DNA, 15 bp, Homo sapiens
tgttgtttgatgtgt

SEQ ID NO: 6515440 - DNA, 21 bp, Homo sapiens
tgttgtttgtaaataagagat

SEQ ID NO: 6515441 - DNA, 18 bp, Homo sapiens
tgttgttttactaaagaa

SEQ ID NO: 6515442 - DNA, 22 bp, Homo sapiens
tgttgttttccatgatttagca

SEQ ID NO: 6515443 - DNA, 15 bp, Homo sapiens
tgttgttttctgggg

SEQ ID NO: 6515444 - DNA, 11 bp, Homo sapiens
tgttgttttgt

SEQ ID NO: 6515445 - DNA, 19 bp, Homo sapiens
tgttgttttgtacagatgt

SEQ ID NO: 6515446 - DNA, 19 bp, Homo sapiens
tgttgttttgtagcaacca

SEQ ID NO: 6515447 - DNA, 15 bp, Homo sapiens
tgttgttttgtatga

SEQ ID NO: 6515448 - DNA, 23 bp, Homo sapiens
tgttgtttttagagacagggtct

SEQ ID NO: 6515449 - DNA, 18 bp, Homo sapiens
tgttgtttttttcttttc

SEQ ID NO: 6515450 - DNA, 18 bp, Homo sapiens
tgtttaaaaaaacattat

SEQ ID NO: 6515451 - DNA, 15 bp, Homo sapiens
tgtttaaaaaaagaa

SEQ ID NO: 6515452 - DNA, 19 bp, Homo sapiens
tgtttaaaaaaataacatc

SEQ ID NO: 6515453 - DNA, 20 bp, Homo sapiens
tgtttaaaaaaataacatct

SEQ ID NO: 6515454 - DNA, 19 bp, Homo sapiens
tgtttaaaaaagtttaaaa

SEQ ID NO: 6515455 - DNA, 18 bp, Homo sapiens
tgtttaaaaacaggaaaa

SEQ ID NO: 6515456 - DNA, 19 bp, Homo sapiens
tgtttaaaaacaggaaaaa

SEQ ID NO: 6515457 - DNA, 20 bp, Homo sapiens
tgtttaaaaacattccccaa

SEQ ID NO: 6515458 - DNA, 20 bp, Homo sapiens
tgtttaaaaaccgaataaat

SEQ ID NO: 6515459 - DNA, 18 bp, Homo sapiens
tgtttaaaaatacacatg

SEQ ID NO: 6515460 - DNA, 15 bp, Homo sapiens
tgtttaaaacatcat

SEQ ID NO: 6515461 - DNA, 18 bp, Homo sapiens
tgtttaaaataaaatgaa

SEQ ID NO: 6515462 - DNA, 13 bp, Homo sapiens
tgtttaaaatcat

SEQ ID NO: 6515463 - DNA, 17 bp, Homo sapiens
tgtttaaaatcatttct

SEQ ID NO: 6515464 - DNA, 18 bp, Homo sapiens
tgtttaaaatcatttctg

SEQ ID NO: 6515465 - DNA, 18 bp, Homo sapiens
tgtttaaaatggcattta

SEQ ID NO: 6515466 - DNA, 20 bp, Homo sapiens
tgtttaaaatgtaatttaaa

SEQ ID NO: 6515467 - DNA, 12 bp, Homo sapiens
tgtttaaaattc

SEQ ID NO: 6515468 - DNA, 22 bp, Homo sapiens
tgtttaaacaatctttcatgtc

SEQ ID NO: 6515469 - DNA, 24 bp, Homo sapiens
tgtttaaacacttatcttctggat

SEQ ID NO: 6515470 - DNA, 23 bp, Homo sapiens
tgtttaaaccactagttgatgta

SEQ ID NO: 6515471 - DNA, 14 bp, Homo sapiens
tgtttaaacctttt

SEQ ID NO: 6515472 - DNA, 14 bp, Homo sapiens
tgtttaaagaataa

SEQ ID NO: 6515473 - DNA, 12 bp, Homo sapiens
tgtttaaataaa

SEQ ID NO: 6515474 - DNA, 15 bp, Homo sapiens
tgtttaaataaaatt

SEQ ID NO: 6515475 - DNA, 16 bp, Homo sapiens
tgtttaaatagcctaa

SEQ ID NO: 6515476 - DNA, 20 bp, Homo sapiens
tgtttaaatagcctaaatga

SEQ ID NO: 6515477 - DNA, 23 bp, Homo sapiens
tgtttaaatagcctaaatgatgg

SEQ ID NO: 6515478 - DNA, 16 bp, Homo sapiens
tgtttaaatataaatg

SEQ ID NO: 6515479 - DNA, 13 bp, Homo sapiens
tgtttaaatcatg

SEQ ID NO: 6515480 - DNA, 14 bp, Homo sapiens
tgtttaaatcatgt

SEQ ID NO: 6515481 - DNA, 18 bp, Homo sapiens
tgtttaaatcatgtatgt

SEQ ID NO: 6515482 - DNA, 22 bp, Homo sapiens
tgtttaacaaatctaatctctt

SEQ ID NO: 6515483 - DNA, 18 bp, Homo sapiens
tgtttaacattcacagcc

SEQ ID NO: 6515484 - DNA, 17 bp, Homo sapiens
tgtttaacgtgaggttt

SEQ ID NO: 6515485 - DNA, 14 bp, Homo sapiens
tgtttaactcccta

SEQ ID NO: 6515486 - DNA, 18 bp, Homo sapiens
tgtttaactgctgcaggg

SEQ ID NO: 6515487 - DNA, 14 bp, Homo sapiens
tgtttaactgtgca

SEQ ID NO: 6515488 - DNA, 16 bp, Homo sapiens
tgtttaactgtgcatg

SEQ ID NO: 6515489 - DNA, 21 bp, Homo sapiens
tgtttaactgtgcatgtgcgt

SEQ ID NO: 6515490 - DNA, 16 bp, Homo sapiens
tgtttaacttcttata

SEQ ID NO: 6515491 - DNA, 14 bp, Homo sapiens
tgtttaagaaaagt

SEQ ID NO: 6515492 - DNA, 22 bp, Homo sapiens
tgtttaagaaaagtattttgaa

SEQ ID NO: 6515493 - DNA, 19 bp, Homo sapiens
tgtttaagaaatgagaaat

SEQ ID NO: 6515494 - DNA, 15 bp, Homo sapiens
tgtttaagaatcatg

SEQ ID NO: 6515495 - DNA, 16 bp, Homo sapiens
tgtttaagaatcatgg

SEQ ID NO: 6515496 - DNA, 14 bp, Homo sapiens
tgtttaagatgggc

SEQ ID NO: 6515497 - DNA, 18 bp, Homo sapiens
tgtttaagatttaatttg

SEQ ID NO: 6515498 - DNA, 13 bp, Homo sapiens
tgtttaagcacca

SEQ ID NO: 6515499 - DNA, 14 bp, Homo sapiens
tgtttaagcagaat

SEQ ID NO: 6515500 - DNA, 18 bp, Homo sapiens
tgtttaagcagaattgga

SEQ ID NO: 6515501 - DNA, 13 bp, Homo sapiens
tgtttaagctgag

SEQ ID NO: 6515502 - DNA, 16 bp, Homo sapiens
tgtttaaggttcttgc

SEQ ID NO: 6515503 - DNA, 14 bp, Homo sapiens
tgtttaagtcattt

SEQ ID NO: 6515504 - DNA, 20 bp, Homo sapiens
tgtttaagtgcttggttgaa

SEQ ID NO: 6515505 - DNA, 21 bp, Homo sapiens
tgtttaagtgttgtaaatatt

SEQ ID NO: 6515506 - DNA, 11 bp, Homo sapiens
tgtttaataaa

SEQ ID NO: 6515507 - DNA, 17 bp, Homo sapiens
tgtttaataaagcgaaa

SEQ ID NO: 6515508 - DNA, 15 bp, Homo sapiens
tgtttaataaagctt

SEQ ID NO: 6515509 - DNA, 15 bp, Homo sapiens
tgtttaataagtata

SEQ ID NO: 6515510 - DNA, 23 bp, Homo sapiens
tgtttaataagtatatcttaaga

SEQ ID NO: 6515511 - DNA, 18 bp, Homo sapiens
tgtttaataatgtaccta

SEQ ID NO: 6515512 - DNA, 17 bp, Homo sapiens
tgtttaatacgcttgag

SEQ ID NO: 6515513 - DNA, 23 bp, Homo sapiens
tgtttaatactcatccttgtata

SEQ ID NO: 6515514 - DNA, 22 bp, Homo sapiens
tgtttaatagaaaattaaaata

SEQ ID NO: 6515515 - DNA, 14 bp, Homo sapiens
tgtttaatatttaa

SEQ ID NO: 6515516 - DNA, 15 bp, Homo sapiens
tgtttaatatttaaa

SEQ ID NO: 6515517 - DNA, 19 bp, Homo sapiens
tgtttaatcagttctgtgt

SEQ ID NO: 6515518 - DNA, 14 bp, Homo sapiens
tgtttaatcatata

SEQ ID NO: 6515519 - DNA, 22 bp, Homo sapiens
tgtttaatctacattataataa

SEQ ID NO: 6515520 - DNA, 20 bp, Homo sapiens
tgtttaatctgttatgtact

SEQ ID NO: 6515521 - DNA, 12 bp, Homo sapiens
tgtttaatgaag

SEQ ID NO: 6515522 - DNA, 13 bp, Homo sapiens
tgtttaatgcaaa

SEQ ID NO: 6515523 - DNA, 17 bp, Homo sapiens
tgtttaatgggtatgct

SEQ ID NO: 6515524 - DNA, 21 bp, Homo sapiens
tgtttaatgtgaactctcccc

SEQ ID NO: 6515525 - DNA, 18 bp, Homo sapiens
tgtttaatgtgaacttgt

SEQ ID NO: 6515526 - DNA, 13 bp, Homo sapiens
tgtttaatgttaa

SEQ ID NO: 6515527 - DNA, 14 bp, Homo sapiens
tgtttaatgttaat

SEQ ID NO: 6515528 - DNA, 14 bp, Homo sapiens
tgtttaatgttcat

SEQ ID NO: 6515529 - DNA, 21 bp, Homo sapiens
tgtttaatttcttcaaaatgt

SEQ ID NO: 6515530 - DNA, 15 bp, Homo sapiens
tgtttaatttgcttc

SEQ ID NO: 6515531 - DNA, 21 bp, Homo sapiens
tgtttaatttttatttcttcc

SEQ ID NO: 6515532 - DNA, 23 bp, Homo sapiens
tgtttacaaaaggcagccctttg

SEQ ID NO: 6515533 - DNA, 15 bp, Homo sapiens
tgtttacaaacatgg

SEQ ID NO: 6515534 - DNA, 22 bp, Homo sapiens
tgtttacaaacatggaaaacag

SEQ ID NO: 6515535 - DNA, 23 bp, Homo sapiens
tgtttacaacatcaccagtgcca

SEQ ID NO: 6515536 - DNA, 14 bp, Homo sapiens
tgtttacactgtca

SEQ ID NO: 6515537 - DNA, 21 bp, Homo sapiens
tgtttacagaggacagtattt

SEQ ID NO: 6515538 - DNA, 16 bp, Homo sapiens
tgtttacagataatta

SEQ ID NO: 6515539 - DNA, 22 bp, Homo sapiens
tgtttacagcactactctgtgc

SEQ ID NO: 6515540 - DNA, 17 bp, Homo sapiens
tgtttacagggagcctc

SEQ ID NO: 6515541 - DNA, 22 bp, Homo sapiens
tgtttacagggagcctcctgcc

SEQ ID NO: 6515542 - DNA, 18 bp, Homo sapiens
tgtttacagtatgatgaa

SEQ ID NO: 6515543 - DNA, 12 bp, Homo sapiens
tgtttacagtgt

SEQ ID NO: 6515544 - DNA, 12 bp, Homo sapiens
tgtttacatatc

SEQ ID NO: 6515545 - DNA, 13 bp, Homo sapiens
tgtttacatgctt

SEQ ID NO: 6515546 - DNA, 21 bp, Homo sapiens
tgtttacatgcttattccatg

SEQ ID NO: 6515547 - DNA, 23 bp, Homo sapiens
tgtttacatggcgccctgcctcc

SEQ ID NO: 6515548 - DNA, 21 bp, Homo sapiens
tgtttacatttactgaaatgc

SEQ ID NO: 6515549 - DNA, 22 bp, Homo sapiens
tgtttacatttgatgcatgtct

SEQ ID NO: 6515550 - DNA, 17 bp, Homo sapiens
tgtttacatttttaaag

SEQ ID NO: 6515551 - DNA, 15 bp, Homo sapiens
tgtttaccaaagaag

SEQ ID NO: 6515552 - DNA, 17 bp, Homo sapiens
tgtttaccgtgtgttat

SEQ ID NO: 6515553 - DNA, 12 bp, Homo sapiens
tgtttacctcac

SEQ ID NO: 6515554 - DNA, 20 bp, Homo sapiens
tgtttacctcactggtgcat

SEQ ID NO: 6515555 - DNA, 15 bp, Homo sapiens
tgtttacctttctct

SEQ ID NO: 6515556 - DNA, 16 bp, Homo sapiens
tgtttacgatttcact

SEQ ID NO: 6515557 - DNA, 20 bp, Homo sapiens
tgtttacgatttcactagga

SEQ ID NO: 6515558 - DNA, 21 bp, Homo sapiens
tgtttacgatttcactaggac

SEQ ID NO: 6515559 - DNA, 14 bp, Homo sapiens
tgtttacgtttgat

SEQ ID NO: 6515560 - DNA, 19 bp, Homo sapiens
tgtttactagggatccctc

SEQ ID NO: 6515561 - DNA, 21 bp, Homo sapiens
tgtttactatagaccaaaagg

SEQ ID NO: 6515562 - DNA, 15 bp, Homo sapiens
tgtttactatataga

SEQ ID NO: 6515563 - DNA, 21 bp, Homo sapiens
tgtttactcccttctgtagtt

SEQ ID NO: 6515564 - DNA, 15 bp, Homo sapiens
tgtttactgcaaggt

SEQ ID NO: 6515565 - DNA, 14 bp, Homo sapiens
tgtttactgtaaat

SEQ ID NO: 6515566 - DNA, 12 bp, Homo sapiens
tgtttactgtat

SEQ ID NO: 6515567 - DNA, 22 bp, Homo sapiens
tgtttactgtatcaatttctaa

SEQ ID NO: 6515568 - DNA, 16 bp, Homo sapiens
tgtttacttaaagatt

SEQ ID NO: 6515569 - DNA, 17 bp, Homo sapiens
tgtttacttaaagattt

SEQ ID NO: 6515570 - DNA, 18 bp, Homo sapiens
tgtttacttaaagattta

SEQ ID NO: 6515571 - DNA, 15 bp, Homo sapiens
tgtttacttgaatag

SEQ ID NO: 6515572 - DNA, 18 bp, Homo sapiens
tgtttactttaaacttgt

SEQ ID NO: 6515573 - DNA, 22 bp, Homo sapiens
tgtttactttatccaatcctca

SEQ ID NO: 6515574 - DNA, 18 bp, Homo sapiens
tgtttagaaacagaaata

SEQ ID NO: 6515575 - DNA, 15 bp, Homo sapiens
tgtttagaaataaat

SEQ ID NO: 6515576 - DNA, 16 bp, Homo sapiens
tgtttagaactactga

SEQ ID NO: 6515577 - DNA, 19 bp, Homo sapiens
tgtttagaagaagtgtgtc

SEQ ID NO: 6515578 - DNA, 17 bp, Homo sapiens
tgtttagaagagcctga

SEQ ID NO: 6515579 - DNA, 17 bp, Homo sapiens
tgtttagaattgaaggt

SEQ ID NO: 6515580 - DNA, 20 bp, Homo sapiens
tgtttagacttcctctcatt

SEQ ID NO: 6515581 - DNA, 13 bp, Homo sapiens
tgtttagacttta

SEQ ID NO: 6515582 - DNA, 13 bp, Homo sapiens
tgtttagagagcc

SEQ ID NO: 6515583 - DNA, 15 bp, Homo sapiens
tgtttagagagcctg

SEQ ID NO: 6515584 - DNA, 20 bp, Homo sapiens
tgtttagagagcctgtcacc

SEQ ID NO: 6515585 - DNA, 23 bp, Homo sapiens
tgtttagagagcctgtcaccaga

SEQ ID NO: 6515586 - DNA, 21 bp, Homo sapiens
tgtttagagcagttaacatct

SEQ ID NO: 6515587 - DNA, 14 bp, Homo sapiens
tgtttagatgaggc

SEQ ID NO: 6515588 - DNA, 16 bp, Homo sapiens
tgtttagattccagga

SEQ ID NO: 6515589 - DNA, 15 bp, Homo sapiens
tgtttagattttgtg

SEQ ID NO: 6515590 - DNA, 18 bp, Homo sapiens
tgtttagcaatgtgtttc

SEQ ID NO: 6515591 - DNA, 20 bp, Homo sapiens
tgtttagcagatttaagata

SEQ ID NO: 6515592 - DNA, 19 bp, Homo sapiens
tgtttagcctgaaaacctt

SEQ ID NO: 6515593 - DNA, 20 bp, Homo sapiens
tgtttagctacctttttata

SEQ ID NO: 6515594 - DNA, 13 bp, Homo sapiens
tgtttagctattt

SEQ ID NO: 6515595 - DNA, 20 bp, Homo sapiens
tgtttagctatttaatacta

SEQ ID NO: 6515596 - DNA, 13 bp, Homo sapiens
tgtttagcttcct

SEQ ID NO: 6515597 - DNA, 22 bp, Homo sapiens
tgtttaggaaatttatacaaag

SEQ ID NO: 6515598 - DNA, 13 bp, Homo sapiens
tgtttaggaagaa

SEQ ID NO: 6515599 - DNA, 20 bp, Homo sapiens
tgtttaggcctcatttcttt

SEQ ID NO: 6515600 - DNA, 18 bp, Homo sapiens
tgtttaggggatctggaa

SEQ ID NO: 6515601 - DNA, 16 bp, Homo sapiens
tgtttagtaaatacat

SEQ ID NO: 6515602 - DNA, 14 bp, Homo sapiens
tgctgtgaaaaaaa

SEQ ID NO: 6515603 - DNA, 18 bp, Homo sapiens
tgctgtgaaaactctggt

SEQ ID NO: 6515604 - DNA, 16 bp, Homo sapiens
tgctgtgaaacagtgt

SEQ ID NO: 6515605 - DNA, 17 bp, Homo sapiens
tgctgtgaaacagtgtg

SEQ ID NO: 6515606 - DNA, 23 bp, Homo sapiens
tgctgtgaacaagtgaacacatt

SEQ ID NO: 6515607 - DNA, 18 bp, Homo sapiens
tgctgtgaacatgcctcc

SEQ ID NO: 6515608 - DNA, 19 bp, Homo sapiens
tgctgtgaacatgcctcct

SEQ ID NO: 6515609 - DNA, 21 bp, Homo sapiens
tgctgtgaaccctggggcctg

SEQ ID NO: 6515610 - DNA, 22 bp, Homo sapiens
tgctgtgacaataagtttgaac

SEQ ID NO: 6515611 - DNA, 22 bp, Homo sapiens
tgctgtgacaggcagtgttctt

SEQ ID NO: 6515612 - DNA, 23 bp, Homo sapiens
tgctgtgagtctttggttctaag

SEQ ID NO: 6515613 - DNA, 22 bp, Homo sapiens
tgctgtgcaaacagtgtaagct

SEQ ID NO: 6515614 - DNA, 13 bp, Homo sapiens
tgctgtgcaaatg

SEQ ID NO: 6515615 - DNA, 13 bp, Homo sapiens
tgctgtgcatttt

SEQ ID NO: 6515616 - DNA, 20 bp, Homo sapiens
tgctgtgccatgctgggcca

SEQ ID NO: 6515617 - DNA, 15 bp, Homo sapiens
tgctgtgcccctggc

SEQ ID NO: 6515618 - DNA, 16 bp, Homo sapiens
tgctgtgcccctggcc

SEQ ID NO: 6515619 - DNA, 18 bp, Homo sapiens
tgctgtgccgtgtccaag

SEQ ID NO: 6515620 - DNA, 13 bp, Homo sapiens
tgctgtgcctgct

SEQ ID NO: 6515621 - DNA, 18 bp, Homo sapiens
tgctgtgcctgctagagc

SEQ ID NO: 6515622 - DNA, 14 bp, Homo sapiens
tgctgtgcgtggaa

SEQ ID NO: 6515623 - DNA, 18 bp, Homo sapiens
tgctgtgcgtggaaaaag

SEQ ID NO: 6515624 - DNA, 16 bp, Homo sapiens
tgctgtgctacgtgtg

SEQ ID NO: 6515625 - DNA, 13 bp, Homo sapiens
tgctgtgctctgg

SEQ ID NO: 6515626 - DNA, 16 bp, Homo sapiens
tgctgtgctctgggga

SEQ ID NO: 6515627 - DNA, 23 bp, Homo sapiens
tgctgtgctctggggatttctgg

SEQ ID NO: 6515628 - DNA, 12 bp, Homo sapiens
tgctgtgctgct

SEQ ID NO: 6515629 - DNA, 13 bp, Homo sapiens
tgctgtgctttgg

SEQ ID NO: 6515630 - DNA, 12 bp, Homo sapiens
tgctgtggccag

SEQ ID NO: 6515631 - DNA, 14 bp, Homo sapiens
tgctgtggccaggg

SEQ ID NO: 6515632 - DNA, 12 bp, Homo sapiens
tgctgtggcccc

SEQ ID NO: 6515633 - DNA, 12 bp, Homo sapiens
tgctgtggcctc

SEQ ID NO: 6515634 - DNA, 13 bp, Homo sapiens
tgctgtggcctca

SEQ ID NO: 6515635 - DNA, 23 bp, Homo sapiens
tgctgtggcctcacttccctggg

SEQ ID NO: 6515636 - DNA, 10 bp, Homo sapiens
tgctgtggga

SEQ ID NO: 6515637 - DNA, 15 bp, Homo sapiens
tgctgtgggaaaaat

SEQ ID NO: 6515638 - DNA, 12 bp, Homo sapiens
tgctgtgggaac

SEQ ID NO: 6515639 - DNA, 14 bp, Homo sapiens
tgctgtgggaacga

SEQ ID NO: 6515640 - DNA, 23 bp, Homo sapiens
tgctgtgggaaggcaatttctct

SEQ ID NO: 6515641 - DNA, 11 bp, Homo sapiens
tgctgtgggca

SEQ ID NO: 6515642 - DNA, 14 bp, Homo sapiens
tgctgtgggcagca

SEQ ID NO: 6515643 - DNA, 16 bp, Homo sapiens
tgctgtgggcagcacc

SEQ ID NO: 6515644 - DNA, 18 bp, Homo sapiens
tgctgtgggcagcaccct

SEQ ID NO: 6515645 - DNA, 17 bp, Homo sapiens
tgctgtggtctctttgt

SEQ ID NO: 6515646 - DNA, 17 bp, Homo sapiens
tgctgtggtgtgtcccc

SEQ ID NO: 6515647 - DNA, 21 bp, Homo sapiens
tgctgtggttcactgcactgt

SEQ ID NO: 6515648 - DNA, 17 bp, Homo sapiens
tgctgtggttcctgggg

SEQ ID NO: 6515649 - DNA, 19 bp, Homo sapiens
tgctgtgtaatggttacac

SEQ ID NO: 6515650 - DNA, 16 bp, Homo sapiens
tgctgtgtagttccct

SEQ ID NO: 6515651 - DNA, 23 bp, Homo sapiens
tgctgtgtagttccctctgcctg

SEQ ID NO: 6515652 - DNA, 19 bp, Homo sapiens
tgctgtgtccaactccagt

SEQ ID NO: 6515653 - DNA, 20 bp, Homo sapiens
tgctgtgtccaactccagta

SEQ ID NO: 6515654 - DNA, 15 bp, Homo sapiens
tgctgtgtctcacag

SEQ ID NO: 6515655 - DNA, 16 bp, Homo sapiens
tgctgtgtgaaatctt

SEQ ID NO: 6515656 - DNA, 17 bp, Homo sapiens
tgctgtgtgaccctggg

SEQ ID NO: 6515657 - DNA, 19 bp, Homo sapiens
tgctgtgtgaccctgggca

SEQ ID NO: 6515658 - DNA, 17 bp, Homo sapiens
tgctgtgtgccccactc

SEQ ID NO: 6515659 - DNA, 22 bp, Homo sapiens
tgctgtgtgccccactccagcc

SEQ ID NO: 6515660 - DNA, 13 bp, Homo sapiens
tgctgtgtgcctt

SEQ ID NO: 6515661 - DNA, 20 bp, Homo sapiens
tgctgtgtggacggcgctgc

SEQ ID NO: 6515662 - DNA, 15 bp, Homo sapiens
tgctgtgtttgagct

SEQ ID NO: 6515663 - DNA, 18 bp, Homo sapiens
tgctgttaacagctgtca

SEQ ID NO: 6515664 - DNA, 19 bp, Homo sapiens
tgctgttaacagctgtcaa

SEQ ID NO: 6515665 - DNA, 16 bp, Homo sapiens
tgctgttaatatttct

SEQ ID NO: 6515666 - DNA, 22 bp, Homo sapiens
tgctgttaatctgatgtataat

SEQ ID NO: 6515667 - DNA, 18 bp, Homo sapiens
tgctgttatatttcatca

SEQ ID NO: 6515668 - DNA, 14 bp, Homo sapiens
tgctgttatgtttt

SEQ ID NO: 6515669 - DNA, 21 bp, Homo sapiens
tgctgttccaacagacagggc

SEQ ID NO: 6515670 - DNA, 22 bp, Homo sapiens
tgctgttcgttcaaaagtggag

SEQ ID NO: 6515671 - DNA, 16 bp, Homo sapiens
tgctgttctcaatcat

SEQ ID NO: 6515672 - DNA, 22 bp, Homo sapiens
tgctgttctcttgggaactgaa

SEQ ID NO: 6515673 - DNA, 16 bp, Homo sapiens
tgctgttctctttgct

SEQ ID NO: 6515674 - DNA, 15 bp, Homo sapiens
tgctgttctgtgtac

SEQ ID NO: 6515675 - DNA, 16 bp, Homo sapiens
tgctgttcttcagtcc

SEQ ID NO: 6515676 - DNA, 19 bp, Homo sapiens
tgctgttcttcagtccttt

SEQ ID NO: 6515677 - DNA, 16 bp, Homo sapiens
tgctgttgaaagcaaa

SEQ ID NO: 6515678 - DNA, 14 bp, Homo sapiens
tgctgttgaagaaa

SEQ ID NO: 6515679 - DNA, 22 bp, Homo sapiens
tgctgttgaagatttgaggact

SEQ ID NO: 6515680 - DNA, 12 bp, Homo sapiens
tgctgttgacgt

SEQ ID NO: 6515681 - DNA, 17 bp, Homo sapiens
tgctgttgatgttttgt

SEQ ID NO: 6515682 - DNA, 15 bp, Homo sapiens
tgctgttgattgcta

SEQ ID NO: 6515683 - DNA, 18 bp, Homo sapiens
tgctgttgctgttgctgt

SEQ ID NO: 6515684 - DNA, 13 bp, Homo sapiens
tgctgttgcttga

SEQ ID NO: 6515685 - DNA, 21 bp, Homo sapiens
tgctgttgggtttttgctgtt

SEQ ID NO: 6515686 - DNA, 14 bp, Homo sapiens
tgctgttggtcatg

SEQ ID NO: 6515687 - DNA, 20 bp, Homo sapiens
tgctgttggtcctctctctg

SEQ ID NO: 6515688 - DNA, 14 bp, Homo sapiens
tgctgttgtaaaca

SEQ ID NO: 6515689 - DNA, 16 bp, Homo sapiens
tgctgttgtgaagcta

SEQ ID NO: 6515690 - DNA, 18 bp, Homo sapiens
tgctgttgttatgatgtg

SEQ ID NO: 6515691 - DNA, 23 bp, Homo sapiens
tgctgttgttatgatgtgcttaa

SEQ ID NO: 6515692 - DNA, 15 bp, Homo sapiens
tgctgttgttgcagg

SEQ ID NO: 6515693 - DNA, 17 bp, Homo sapiens
tgctgttgtttaaaata

SEQ ID NO: 6515694 - DNA, 22 bp, Homo sapiens
tgctgttgtttaaaataaaagt

SEQ ID NO: 6515695 - DNA, 13 bp, Homo sapiens
tgctgttgtttct

SEQ ID NO: 6515696 - DNA, 18 bp, Homo sapiens
tgctgttgtttctataaa

SEQ ID NO: 6515697 - DNA, 20 bp, Homo sapiens
tgctgttgtttctataaatg

SEQ ID NO: 6515698 - DNA, 21 bp, Homo sapiens
tgctgttgtttctataaatga

SEQ ID NO: 6515699 - DNA, 23 bp, Homo sapiens
tgctgtttaaagtcacatccctg

SEQ ID NO: 6515700 - DNA, 23 bp, Homo sapiens
tgctgtttaccgcccacccagca

SEQ ID NO: 6515701 - DNA, 14 bp, Homo sapiens
tgctgtttagattt

SEQ ID NO: 6515702 - DNA, 20 bp, Homo sapiens
tgctgtttagatttattaga

SEQ ID NO: 6515703 - DNA, 18 bp, Homo sapiens
tgctgtttagcttcctcc

SEQ ID NO: 6515704 - DNA, 20 bp, Homo sapiens
tgctgtttagcttcctccag

SEQ ID NO: 6515705 - DNA, 22 bp, Homo sapiens
tgctgtttatcccttaagaatg

SEQ ID NO: 6515706 - DNA, 13 bp, Homo sapiens
tgctgtttatgat

SEQ ID NO: 6515707 - DNA, 16 bp, Homo sapiens
tgctgtttcaaagttc

SEQ ID NO: 6515708 - DNA, 18 bp, Homo sapiens
tgctgtttcacaatacct

SEQ ID NO: 6515709 - DNA, 14 bp, Homo sapiens
tgctgtttcctagc

SEQ ID NO: 6515710 - DNA, 15 bp, Homo sapiens
tgctgtttcctagct

SEQ ID NO: 6515711 - DNA, 14 bp, Homo sapiens
tgctgtttgaaaat

SEQ ID NO: 6515712 - DNA, 13 bp, Homo sapiens
tgctgtttgacaa

SEQ ID NO: 6515713 - DNA, 23 bp, Homo sapiens
tgctgtttgggttgttggtctgt

SEQ ID NO: 6515714 - DNA, 14 bp, Homo sapiens
tgctgtttgtacaa

SEQ ID NO: 6515715 - DNA, 21 bp, Homo sapiens
tgctgtttgtagtgaaataat

SEQ ID NO: 6515716 - DNA, 20 bp, Homo sapiens
tgctgtttgttccaggctca

SEQ ID NO: 6515717 - DNA, 12 bp, Homo sapiens
tgctgttttatg

SEQ ID NO: 6515718 - DNA, 15 bp, Homo sapiens
tgctgttttatgtca

SEQ ID NO: 6515719 - DNA, 16 bp, Homo sapiens
tgctgttttatgtcat

SEQ ID NO: 6515720 - DNA, 22 bp, Homo sapiens
tgctgttttatgtcatactctg

SEQ ID NO: 6515721 - DNA, 18 bp, Homo sapiens
tgctgttttattactgtt

SEQ ID NO: 6515722 - DNA, 14 bp, Homo sapiens
tgctgttttcctcc

SEQ ID NO: 6515723 - DNA, 17 bp, Homo sapiens
tgctgttttcctccctt

SEQ ID NO: 6515724 - DNA, 22 bp, Homo sapiens
tgctgttttcctcccttctgct

SEQ ID NO: 6515725 - DNA, 14 bp, Homo sapiens
tgctgttttctgta

SEQ ID NO: 6515726 - DNA, 17 bp, Homo sapiens
tgctgttttctgtaaat

SEQ ID NO: 6515727 - DNA, 21 bp, Homo sapiens
tgctgttttctgtaaattcat

SEQ ID NO: 6515728 - DNA, 22 bp, Homo sapiens
tgctgttttgccagcccatttg

SEQ ID NO: 6515729 - DNA, 12 bp, Homo sapiens
tgctgttttgtt

SEQ ID NO: 6515730 - DNA, 17 bp, Homo sapiens
tgctgttttttgttttt

SEQ ID NO: 6515731 - DNA, 16 bp, Homo sapiens
tgcttaaaaaagagtt

SEQ ID NO: 6515732 - DNA, 15 bp, Homo sapiens
tgcttaaaaaataat

SEQ ID NO: 6515733 - DNA, 17 bp, Homo sapiens
tgcttaaaaatcattga

SEQ ID NO: 6515734 - DNA, 19 bp, Homo sapiens
tgcttaaaaatcattgatt

SEQ ID NO: 6515735 - DNA, 12 bp, Homo sapiens
tgcttaaaagaa

SEQ ID NO: 6515736 - DNA, 16 bp, Homo sapiens
tgcttaaaagaaagtt

SEQ ID NO: 6515737 - DNA, 14 bp, Homo sapiens
tgcttaaaagacat

SEQ ID NO: 6515738 - DNA, 23 bp, Homo sapiens
tgcttaaaagcatttttattata

SEQ ID NO: 6515739 - DNA, 19 bp, Homo sapiens
tgcttaaaaggtataatta

SEQ ID NO: 6515740 - DNA, 18 bp, Homo sapiens
tgcttaaaaggttgcata

SEQ ID NO: 6515741 - DNA, 19 bp, Homo sapiens
tgcttaaaataagcaggtg

SEQ ID NO: 6515742 - DNA, 12 bp, Homo sapiens
tgcttaaaatat

SEQ ID NO: 6515743 - DNA, 23 bp, Homo sapiens
tgcttaaaatatgtatgtctaat

SEQ ID NO: 6515744 - DNA, 14 bp, Homo sapiens
tgcttaaacaaaac

SEQ ID NO: 6515745 - DNA, 18 bp, Homo sapiens
tgcttaaagaattcaaat

SEQ ID NO: 6515746 - DNA, 22 bp, Homo sapiens
tgcttaaagttggtattaataa

SEQ ID NO: 6515747 - DNA, 17 bp, Homo sapiens
tgcttaaataaaaatta

SEQ ID NO: 6515748 - DNA, 21 bp, Homo sapiens
tgcttaaatcagttggagttt

SEQ ID NO: 6515749 - DNA, 12 bp, Homo sapiens
tgcttaaatgtg

SEQ ID NO: 6515750 - DNA, 13 bp, Homo sapiens
tgcttaaatttta

SEQ ID NO: 6515751 - DNA, 17 bp, Homo sapiens
tgcttaacagttgcttt

SEQ ID NO: 6515752 - DNA, 13 bp, Homo sapiens
tgcttaacataaa

SEQ ID NO: 6515753 - DNA, 13 bp, Homo sapiens
tgcttaagaatca

SEQ ID NO: 6515754 - DNA, 22 bp, Homo sapiens
tgcttaagatgctaatagaaaa

SEQ ID NO: 6515755 - DNA, 20 bp, Homo sapiens
tgcttaaggaaaagagaaac

SEQ ID NO: 6515756 - DNA, 17 bp, Homo sapiens
tgcttaagtggatctgt

SEQ ID NO: 6515757 - DNA, 14 bp, Homo sapiens
tgcttaagttccag

SEQ ID NO: 6515758 - DNA, 18 bp, Homo sapiens
tgcttaataaaagaacat

SEQ ID NO: 6515759 - DNA, 15 bp, Homo sapiens
tgcttaataaacatg

SEQ ID NO: 6515760 - DNA, 15 bp, Homo sapiens
tgcttaataaattgt

SEQ ID NO: 6515761 - DNA, 21 bp, Homo sapiens
tgcttaataataattgaagaa

SEQ ID NO: 6515762 - DNA, 12 bp, Homo sapiens
tgcttaatgaaa

SEQ ID NO: 6515763 - DNA, 15 bp, Homo sapiens
tgcttaattgctgat

SEQ ID NO: 6515764 - DNA, 18 bp, Homo sapiens
tgcttaattgtgaacagc

SEQ ID NO: 6515765 - DNA, 15 bp, Homo sapiens
tgcttaatttctaaa

SEQ ID NO: 6515766 - DNA, 19 bp, Homo sapiens
tgcttaatttctaaagata

SEQ ID NO: 6515767 - DNA, 22 bp, Homo sapiens
tgcttaattttaattggaggaa

SEQ ID NO: 6515768 - DNA, 14 bp, Homo sapiens
tgcttacaatcttt

SEQ ID NO: 6515769 - DNA, 16 bp, Homo sapiens
tgcttacaatctttat

SEQ ID NO: 6515770 - DNA, 20 bp, Homo sapiens
tgcttacaattccctgctgt

SEQ ID NO: 6515771 - DNA, 22 bp, Homo sapiens
tgcttacaattccctgctgtcg

SEQ ID NO: 6515772 - DNA, 22 bp, Homo sapiens
tgcttacaatttttttaatttt

SEQ ID NO: 6515773 - DNA, 21 bp, Homo sapiens
tgcttacagtttattttctgt

SEQ ID NO: 6515774 - DNA, 23 bp, Homo sapiens
tgcttacagtttattttctgtgt

SEQ ID NO: 6515775 - DNA, 12 bp, Homo sapiens
tgcttacatctg

SEQ ID NO: 6515776 - DNA, 23 bp, Homo sapiens
tgcttacattttaatagagatga

SEQ ID NO: 6515777 - DNA, 14 bp, Homo sapiens
tgcttacattttta

SEQ ID NO: 6515778 - DNA, 15 bp, Homo sapiens
tgcttacatttttac

SEQ ID NO: 6515779 - DNA, 20 bp, Homo sapiens
tgcttacatttttacaataa

SEQ ID NO: 6515780 - DNA, 19 bp, Homo sapiens
tgcttaccaaaagctcagg

SEQ ID NO: 6515781 - DNA, 20 bp, Homo sapiens
tgtttagtaaatacatcact

SEQ ID NO: 6515782 - DNA, 13 bp, Homo sapiens
tgtttagtaatca

SEQ ID NO: 6515783 - DNA, 18 bp, Homo sapiens
tgtttagtagcagtgatt

SEQ ID NO: 6515784 - DNA, 12 bp, Homo sapiens
tgtttagtagct

SEQ ID NO: 6515785 - DNA, 18 bp, Homo sapiens
tgtttagtcttgtctcag

SEQ ID NO: 6515786 - DNA, 19 bp, Homo sapiens
tgtttagtttgttaattga

SEQ ID NO: 6515787 - DNA, 15 bp, Homo sapiens
tgtttataaaacaat

SEQ ID NO: 6515788 - DNA, 23 bp, Homo sapiens
tgtttataaaatataaacaaaga

SEQ ID NO: 6515789 - DNA, 23 bp, Homo sapiens
tgtttataaacatgtccccttcc

SEQ ID NO: 6515790 - DNA, 16 bp, Homo sapiens
tgtttataaacattgt

SEQ ID NO: 6515791 - DNA, 17 bp, Homo sapiens
tgtttataaatagcatt

SEQ ID NO: 6515792 - DNA, 23 bp, Homo sapiens
tgtttataaatagcatttggaaa

SEQ ID NO: 6515793 - DNA, 13 bp, Homo sapiens
tgtttataaatgt

SEQ ID NO: 6515794 - DNA, 20 bp, Homo sapiens
tgtttataactattcagttg

SEQ ID NO: 6515795 - DNA, 22 bp, Homo sapiens
tgtttataactattcagttgtg

SEQ ID NO: 6515796 - DNA, 16 bp, Homo sapiens
tgtttataataaaaat

SEQ ID NO: 6515797 - DNA, 14 bp, Homo sapiens
tgtttataatctga

SEQ ID NO: 6515798 - DNA, 17 bp, Homo sapiens
tgtttataatctgaaga

SEQ ID NO: 6515799 - DNA, 20 bp, Homo sapiens
tgtttatacacaactttgca

SEQ ID NO: 6515800 - DNA, 21 bp, Homo sapiens
tgtttatacacaactttgcaa

SEQ ID NO: 6515801 - DNA, 16 bp, Homo sapiens
tgtttatacagagtaa

SEQ ID NO: 6515802 - DNA, 16 bp, Homo sapiens
tgtttatacctttgcc

SEQ ID NO: 6515803 - DNA, 10 bp, Homo sapiens
tgtttatata

SEQ ID NO: 6515804 - DNA, 16 bp, Homo sapiens
tgtttatataaatgct

SEQ ID NO: 6515805 - DNA, 20 bp, Homo sapiens
tgtttatataaatgctttta

SEQ ID NO: 6515806 - DNA, 18 bp, Homo sapiens
tgtttatataattttgca

SEQ ID NO: 6515807 - DNA, 21 bp, Homo sapiens
tgtttatatacagtacacaga

SEQ ID NO: 6515808 - DNA, 14 bp, Homo sapiens
tgtttatatcaaat

SEQ ID NO: 6515809 - DNA, 15 bp, Homo sapiens
tgtttatatgaaaac

SEQ ID NO: 6515810 - DNA, 20 bp, Homo sapiens
tgtttatatggataatctga

SEQ ID NO: 6515811 - DNA, 14 bp, Homo sapiens
tgtttatatggcgt

SEQ ID NO: 6515812 - DNA, 15 bp, Homo sapiens
tgtttatatgtgttg

SEQ ID NO: 6515813 - DNA, 21 bp, Homo sapiens
tgtttatattgtttttatata

SEQ ID NO: 6515814 - DNA, 15 bp, Homo sapiens
tgtttatattttcaa

SEQ ID NO: 6515815 - DNA, 19 bp, Homo sapiens
tgtttatcacctttattga

SEQ ID NO: 6515816 - DNA, 18 bp, Homo sapiens
tgtttatcctttcatata

SEQ ID NO: 6515817 - DNA, 17 bp, Homo sapiens
tgtttatctagatgtaa

SEQ ID NO: 6515818 - DNA, 12 bp, Homo sapiens
tgtttatctctg

SEQ ID NO: 6515819 - DNA, 22 bp, Homo sapiens
tgtttatgacacaatgacacat

SEQ ID NO: 6515820 - DNA, 14 bp, Homo sapiens
tgtttatgagccag

SEQ ID NO: 6515821 - DNA, 22 bp, Homo sapiens
tgtttatgatctatttgtagat

SEQ ID NO: 6515822 - DNA, 21 bp, Homo sapiens
tgtttatgcaaggaaggaaag

SEQ ID NO: 6515823 - DNA, 12 bp, Homo sapiens
tgtttatgcata

SEQ ID NO: 6515824 - DNA, 21 bp, Homo sapiens
tgtttatgcatttcaatttca

SEQ ID NO: 6515825 - DNA, 17 bp, Homo sapiens
tgtttatgccacagaat

SEQ ID NO: 6515826 - DNA, 22 bp, Homo sapiens
tgtttatggcaatttaacatgt

SEQ ID NO: 6515827 - DNA, 19 bp, Homo sapiens
tgtttatggcatttagtac

SEQ ID NO: 6515828 - DNA, 23 bp, Homo sapiens
tgtttatggcctcagctgcctca

SEQ ID NO: 6515829 - DNA, 19 bp, Homo sapiens
tgtttatgggtttcttcca

SEQ ID NO: 6515830 - DNA, 16 bp, Homo sapiens
tgtttatggtaaaaaa

SEQ ID NO: 6515831 - DNA, 11 bp, Homo sapiens
tgtttatgtaa

SEQ ID NO: 6515832 - DNA, 14 bp, Homo sapiens
tgtttatgtaatag

SEQ ID NO: 6515833 - DNA, 20 bp, Homo sapiens
tgtttatgtgaacattccta

SEQ ID NO: 6515834 - DNA, 21 bp, Homo sapiens
tgtttatgttgcaatctggtt

SEQ ID NO: 6515835 - DNA, 14 bp, Homo sapiens
tgtttattaaatag

SEQ ID NO: 6515836 - DNA, 15 bp, Homo sapiens
tgtttattaaatgct

SEQ ID NO: 6515837 - DNA, 16 bp, Homo sapiens
tgtttattaactactg

SEQ ID NO: 6515838 - DNA, 15 bp, Homo sapiens
tgtttattaatctta

SEQ ID NO: 6515839 - DNA, 19 bp, Homo sapiens
tgtttattacaagtggctc

SEQ ID NO: 6515840 - DNA, 13 bp, Homo sapiens
tgtttattacaat

SEQ ID NO: 6515841 - DNA, 15 bp, Homo sapiens
tgtttattacttcca

SEQ ID NO: 6515842 - DNA, 14 bp, Homo sapiens
tgtttattagatga

SEQ ID NO: 6515843 - DNA, 18 bp, Homo sapiens
tgtttattataaagctta

SEQ ID NO: 6515844 - DNA, 15 bp, Homo sapiens
tgtttattcaaaata

SEQ ID NO: 6515845 - DNA, 17 bp, Homo sapiens
tgtttattcaaaatatt

SEQ ID NO: 6515846 - DNA, 13 bp, Homo sapiens
tgtttattcaaac

SEQ ID NO: 6515847 - DNA, 13 bp, Homo sapiens
tgtttattcatat

SEQ ID NO: 6515848 - DNA, 17 bp, Homo sapiens
tgtttattcatatgcat

SEQ ID NO: 6515849 - DNA, 19 bp, Homo sapiens
tgtttattcatatgcatat

SEQ ID NO: 6515850 - DNA, 16 bp, Homo sapiens
tgtttattcatccagc

SEQ ID NO: 6515851 - DNA, 20 bp, Homo sapiens
tgtttattcatccagcagtg

SEQ ID NO: 6515852 - DNA, 13 bp, Homo sapiens
tgtttattcctga

SEQ ID NO: 6515853 - DNA, 18 bp, Homo sapiens
tgtttattctaatatcca

SEQ ID NO: 6515854 - DNA, 19 bp, Homo sapiens
tgtttattctctgctgcat

SEQ ID NO: 6515855 - DNA, 18 bp, Homo sapiens
tgtttattcttccagaat

SEQ ID NO: 6515856 - DNA, 23 bp, Homo sapiens
tgtttattcttccagaatgctga

SEQ ID NO: 6515857 - DNA, 21 bp, Homo sapiens
tgtttattcttgatgaaaagc

SEQ ID NO: 6515858 - DNA, 14 bp, Homo sapiens
tgtttattgaagaa

SEQ ID NO: 6515859 - DNA, 12 bp, Homo sapiens
tgtttattgcca

SEQ ID NO: 6515860 - DNA, 13 bp, Homo sapiens
tgtttattgccat

SEQ ID NO: 6515861 - DNA, 19 bp, Homo sapiens
tgtttattgggcaataaaa

SEQ ID NO: 6515862 - DNA, 14 bp, Homo sapiens
tgtttattgtaaaa

SEQ ID NO: 6515863 - DNA, 20 bp, Homo sapiens
tgtttattgttgctggttat

SEQ ID NO: 6515864 - DNA, 21 bp, Homo sapiens
tgtttatttaaggatggatgg

SEQ ID NO: 6515865 - DNA, 23 bp, Homo sapiens
tgtttatttaaggatggatggca

SEQ ID NO: 6515866 - DNA, 13 bp, Homo sapiens
tgtttatttacaa

SEQ ID NO: 6515867 - DNA, 24 bp, Homo sapiens
tgtttatttatagagtgtacttaa

SEQ ID NO: 6515868 - DNA, 20 bp, Homo sapiens
tgtttatttatttccagtgg

SEQ ID NO: 6515869 - DNA, 16 bp, Homo sapiens
tgtttatttcatttta

SEQ ID NO: 6515870 - DNA, 14 bp, Homo sapiens
tgtttatttctgtt

SEQ ID NO: 6515871 - DNA, 13 bp, Homo sapiens
tgtttatttgcaa

SEQ ID NO: 6515872 - DNA, 12 bp, Homo sapiens
tgtttattttct

SEQ ID NO: 6515873 - DNA, 12 bp, Homo sapiens
tgtttattttga

SEQ ID NO: 6515874 - DNA, 15 bp, Homo sapiens
tgtttatttttatat

SEQ ID NO: 6515875 - DNA, 12 bp, Homo sapiens
tgtttatttttc

SEQ ID NO: 6515876 - DNA, 15 bp, Homo sapiens
tgtttatttttcata

SEQ ID NO: 6515877 - DNA, 16 bp, Homo sapiens
tgtttatttttcatat

SEQ ID NO: 6515878 - DNA, 24 bp, Homo sapiens
tgtttatttttctatgaattccta

SEQ ID NO: 6515879 - DNA, 19 bp, Homo sapiens
tgtttatttttcttgtctt

SEQ ID NO: 6515880 - DNA, 23 bp, Homo sapiens
tgtttatttttgctctccctccc

SEQ ID NO: 6515881 - DNA, 14 bp, Homo sapiens
tgtttcaaaaaaat

SEQ ID NO: 6515882 - DNA, 19 bp, Homo sapiens
tgtttcaaaaccatgcctg

SEQ ID NO: 6515883 - DNA, 16 bp, Homo sapiens
tgtttcaaaataaaaa

SEQ ID NO: 6515884 - DNA, 22 bp, Homo sapiens
tgtttcaaaatagacaagtttt

SEQ ID NO: 6515885 - DNA, 17 bp, Homo sapiens
tgtttcaaacacaaatg

SEQ ID NO: 6515886 - DNA, 13 bp, Homo sapiens
tgtttcaaacata

SEQ ID NO: 6515887 - DNA, 16 bp, Homo sapiens
tgtttcaaactgaatt

SEQ ID NO: 6515888 - DNA, 17 bp, Homo sapiens
tgtttcaaactgaattt

SEQ ID NO: 6515889 - DNA, 14 bp, Homo sapiens
tgtttcaaagcaca

SEQ ID NO: 6515890 - DNA, 13 bp, Homo sapiens
tgtttcaaagttc

SEQ ID NO: 6515891 - DNA, 21 bp, Homo sapiens
tgtttcaaatgtgcattttgt

SEQ ID NO: 6515892 - DNA, 16 bp, Homo sapiens
tgtttcaatcactgtc

SEQ ID NO: 6515893 - DNA, 19 bp, Homo sapiens
tgtttcaatgacctgtatt

SEQ ID NO: 6515894 - DNA, 22 bp, Homo sapiens
tgtttcaattagaaaaggaaat

SEQ ID NO: 6515895 - DNA, 16 bp, Homo sapiens
tgtttcaattgcatct

SEQ ID NO: 6515896 - DNA, 18 bp, Homo sapiens
tgtttcacaacaggcatt

SEQ ID NO: 6515897 - DNA, 17 bp, Homo sapiens
tgtttcacagtttgaaa

SEQ ID NO: 6515898 - DNA, 15 bp, Homo sapiens
tgtttcaccagtgtt

SEQ ID NO: 6515899 - DNA, 18 bp, Homo sapiens
tgtttcaccctgtccctc

SEQ ID NO: 6515900 - DNA, 17 bp, Homo sapiens
tgtttcactatgatttt

SEQ ID NO: 6515901 - DNA, 15 bp, Homo sapiens
tgtttcagaaaacat

SEQ ID NO: 6515902 - DNA, 14 bp, Homo sapiens
tgtttcagagcata

SEQ ID NO: 6515903 - DNA, 16 bp, Homo sapiens
tgtttcagagcataaa

SEQ ID NO: 6515904 - DNA, 19 bp, Homo sapiens
tgtttcagcttctctgcta

SEQ ID NO: 6515905 - DNA, 22 bp, Homo sapiens
tgtttcaggtggaacaggagga

SEQ ID NO: 6515906 - DNA, 21 bp, Homo sapiens
tgtttcagtgaatatgcctgt

SEQ ID NO: 6515907 - DNA, 21 bp, Homo sapiens
tgtttcagtgccatttgttaa

SEQ ID NO: 6515908 - DNA, 13 bp, Homo sapiens
tgtttcagtgtga

SEQ ID NO: 6515909 - DNA, 12 bp, Homo sapiens
tgtttcatcctt

SEQ ID NO: 6515910 - DNA, 15 bp, Homo sapiens
tgtttcatccttccc

SEQ ID NO: 6515911 - DNA, 23 bp, Homo sapiens
tgtttcatgaagaaaaaatttta

SEQ ID NO: 6515912 - DNA, 16 bp, Homo sapiens
tgtttcatgagcccaa

SEQ ID NO: 6515913 - DNA, 18 bp, Homo sapiens
tgtttcatgttctgtgtc

SEQ ID NO: 6515914 - DNA, 18 bp, Homo sapiens
tgtttcattcactgtgca

SEQ ID NO: 6515915 - DNA, 11 bp, Homo sapiens
tgtttcatttg

SEQ ID NO: 6515916 - DNA, 18 bp, Homo sapiens
tgtttccaacctggagta

SEQ ID NO: 6515917 - DNA, 22 bp, Homo sapiens
tgtttccaacttgtctgggaat

SEQ ID NO: 6515918 - DNA, 21 bp, Homo sapiens
tgtttccaatgtttagcaaat

SEQ ID NO: 6515919 - DNA, 15 bp, Homo sapiens
tgtttccaccaaatg

SEQ ID NO: 6515920 - DNA, 14 bp, Homo sapiens
tgtttccagaaaat

SEQ ID NO: 6515921 - DNA, 22 bp, Homo sapiens
tgtttccagaaattcttcaatt

SEQ ID NO: 6515922 - DNA, 20 bp, Homo sapiens
tgtttccagacttccttgag

SEQ ID NO: 6515923 - DNA, 23 bp, Homo sapiens
tgtttccagacttccttgagaca

SEQ ID NO: 6515924 - DNA, 21 bp, Homo sapiens
tgtttccaggcatgaccctgg

SEQ ID NO: 6515925 - DNA, 21 bp, Homo sapiens
tgtttccagtacacctttcag

SEQ ID NO: 6515926 - DNA, 12 bp, Homo sapiens
tgtttccagtga

SEQ ID NO: 6515927 - DNA, 19 bp, Homo sapiens
tgtttccatcctttgcatt

SEQ ID NO: 6515928 - DNA, 13 bp, Homo sapiens
tgtttcccaagct

SEQ ID NO: 6515929 - DNA, 22 bp, Homo sapiens
tgtttcccataattttcttcat

SEQ ID NO: 6515930 - DNA, 12 bp, Homo sapiens
tgtttcccccac

SEQ ID NO: 6515931 - DNA, 13 bp, Homo sapiens
tgtttcccccact

SEQ ID NO: 6515932 - DNA, 20 bp, Homo sapiens
tgtttccctacttgataata

SEQ ID NO: 6515933 - DNA, 21 bp, Homo sapiens
tgtttccctcaagaacaaaca

SEQ ID NO: 6515934 - DNA, 14 bp, Homo sapiens
tgtttccctcgtcc

SEQ ID NO: 6515935 - DNA, 19 bp, Homo sapiens
tgtttccctcgtccgtctg

SEQ ID NO: 6515936 - DNA, 20 bp, Homo sapiens
tgtttccctcgtccgtctgt

SEQ ID NO: 6515937 - DNA, 13 bp, Homo sapiens
tgtttccctgctg

SEQ ID NO: 6515938 - DNA, 14 bp, Homo sapiens
tgtttccctgctga

SEQ ID NO: 6515939 - DNA, 18 bp, Homo sapiens
tgtttcccttcccttcca

SEQ ID NO: 6515940 - DNA, 20 bp, Homo sapiens
tgtttccctttcactggcat

SEQ ID NO: 6515941 - DNA, 20 bp, Homo sapiens
tgtttcctaaatcagcattt

SEQ ID NO: 6515942 - DNA, 20 bp, Homo sapiens
tgtttcctaactgtgatttg

SEQ ID NO: 6515943 - DNA, 18 bp, Homo sapiens
tgtttcctatttaataca

SEQ ID NO: 6515944 - DNA, 15 bp, Homo sapiens
tgtttcctcatctat

SEQ ID NO: 6515945 - DNA, 13 bp, Homo sapiens
tgtttcctgaaat

SEQ ID NO: 6515946 - DNA, 12 bp, Homo sapiens
tgtttcctgaca

SEQ ID NO: 6515947 - DNA, 15 bp, Homo sapiens
tgtttcctgctgctt

SEQ ID NO: 6515948 - DNA, 15 bp, Homo sapiens
tgtttcctggcactg

SEQ ID NO: 6515949 - DNA, 21 bp, Homo sapiens
tgtttcctggcactgcttcca

SEQ ID NO: 6515950 - DNA, 23 bp, Homo sapiens
tgtttcctggcctcagagcttcc

SEQ ID NO: 6515951 - DNA, 16 bp, Homo sapiens
tgtttcctgtggaaat

SEQ ID NO: 6515952 - DNA, 18 bp, Homo sapiens
tgtttcctgtggaaatat

SEQ ID NO: 6515953 - DNA, 22 bp, Homo sapiens
tgtttcctgtggaaatatgcaa

SEQ ID NO: 6515954 - DNA, 12 bp, Homo sapiens
tgtttcctgtgt

SEQ ID NO: 6515955 - DNA, 13 bp, Homo sapiens
tgtttcctgttct

SEQ ID NO: 6515956 - DNA, 15 bp, Homo sapiens
tgtttccttcagtgc

SEQ ID NO: 6515957 - DNA, 23 bp, Homo sapiens
tgtttccttttggcctcctgcaa

SEQ ID NO: 6515958 - DNA, 18 bp, Homo sapiens
tgtttcctttttcagata

SEQ ID NO: 6515959 - DNA, 19 bp, Homo sapiens
tgtttcgcattaagcacac

SEQ ID NO: 6515960 - DNA, 13 bp, Homo sapiens
tgcttacccttca

SEQ ID NO: 6515961 - DNA, 15 bp, Homo sapiens
tgcttacctaatttc

SEQ ID NO: 6515962 - DNA, 16 bp, Homo sapiens
tgcttacctaatttca

SEQ ID NO: 6515963 - DNA, 15 bp, Homo sapiens
tgcttacctctgttt

SEQ ID NO: 6515964 - DNA, 19 bp, Homo sapiens
tgcttaccttgactgttga

SEQ ID NO: 6515965 - DNA, 23 bp, Homo sapiens
tgcttaccttgactgttgatgta

SEQ ID NO: 6515966 - DNA, 20 bp, Homo sapiens
tgcttaccttggttggaagg

SEQ ID NO: 6515967 - DNA, 12 bp, Homo sapiens
tgcttaccttgt

SEQ ID NO: 6515968 - DNA, 18 bp, Homo sapiens
tgcttactaatgtgcccc

SEQ ID NO: 6515969 - DNA, 22 bp, Homo sapiens
tgcttactttggaatacatttc

SEQ ID NO: 6515970 - DNA, 19 bp, Homo sapiens
tgcttactttttaattttt

SEQ ID NO: 6515971 - DNA, 20 bp, Homo sapiens
tgcttactttttatatagca

SEQ ID NO: 6515972 - DNA, 13 bp, Homo sapiens
tgcttagaaagtt

SEQ ID NO: 6515973 - DNA, 18 bp, Homo sapiens
tgcttagaaagttattgt

SEQ ID NO: 6515974 - DNA, 20 bp, Homo sapiens
tgcttagaacccttctgctt

SEQ ID NO: 6515975 - DNA, 22 bp, Homo sapiens
tgcttagaacccttctgctttc

SEQ ID NO: 6515976 - DNA, 19 bp, Homo sapiens
tgcttagaatccaaacttg

SEQ ID NO: 6515977 - DNA, 16 bp, Homo sapiens
tgcttagagactatca

SEQ ID NO: 6515978 - DNA, 17 bp, Homo sapiens
tgcttagagactatcaa

SEQ ID NO: 6515979 - DNA, 22 bp, Homo sapiens
tgcttagagggatttctttgct

SEQ ID NO: 6515980 - DNA, 16 bp, Homo sapiens
tgcttagagtgcccag

SEQ ID NO: 6515981 - DNA, 21 bp, Homo sapiens
tgcttagatgagggtgactgt

SEQ ID NO: 6515982 - DNA, 13 bp, Homo sapiens
tgcttagatttct

SEQ ID NO: 6515983 - DNA, 13 bp, Homo sapiens
tgcttagcaaaaa

SEQ ID NO: 6515984 - DNA, 15 bp, Homo sapiens
tgcttagcctcctga

SEQ ID NO: 6515985 - DNA, 19 bp, Homo sapiens
tgcttagcctcctgacctg

SEQ ID NO: 6515986 - DNA, 15 bp, Homo sapiens
tgcttagcctgtgct

SEQ ID NO: 6515987 - DNA, 18 bp, Homo sapiens
tgcttagctcatcttaga

SEQ ID NO: 6515988 - DNA, 19 bp, Homo sapiens
tgcttaggaaacctcacga

SEQ ID NO: 6515989 - DNA, 15 bp, Homo sapiens
tgcttaggagacaga

SEQ ID NO: 6515990 - DNA, 14 bp, Homo sapiens
tgcttaggtgaagg

SEQ ID NO: 6515991 - DNA, 14 bp, Homo sapiens
tgcttagtaatgct

SEQ ID NO: 6515992 - DNA, 14 bp, Homo sapiens
tgcttagtcactgc

SEQ ID NO: 6515993 - DNA, 15 bp, Homo sapiens
tgcttagtcactgcc

SEQ ID NO: 6515994 - DNA, 16 bp, Homo sapiens
tgcttagtcactgcct

SEQ ID NO: 6515995 - DNA, 19 bp, Homo sapiens
tgcttagtcactgcctgca

SEQ ID NO: 6515996 - DNA, 18 bp, Homo sapiens
tgcttagtgaaaatacta

SEQ ID NO: 6515997 - DNA, 20 bp, Homo sapiens
tgcttagtgtacttggagta

SEQ ID NO: 6515998 - DNA, 15 bp, Homo sapiens
tgcttagtgtccctt

SEQ ID NO: 6515999 - DNA, 20 bp, Homo sapiens
tgcttagtgtcccttacctg

SEQ ID NO: 6516000 - DNA, 14 bp, Homo sapiens
tgcttagtgtgaag

SEQ ID NO: 6516001 - DNA, 21 bp, Homo sapiens
tgcttagttggtgaaacccag

SEQ ID NO: 6516002 - DNA, 23 bp, Homo sapiens
tgcttagttggtgaaacccagat

SEQ ID NO: 6516003 - DNA, 14 bp, Homo sapiens
tgcttataaacatt

SEQ ID NO: 6516004 - DNA, 20 bp, Homo sapiens
tgcttataacattaagaaaa

SEQ ID NO: 6516005 - DNA, 23 bp, Homo sapiens
tgcttataagcaacatgaattaa

SEQ ID NO: 6516006 - DNA, 17 bp, Homo sapiens
tgcttatacactgttgg

SEQ ID NO: 6516007 - DNA, 18 bp, Homo sapiens
tgcttatgaatatttata

SEQ ID NO: 6516008 - DNA, 21 bp, Homo sapiens
tgcttatgatgggctccccag

SEQ ID NO: 6516009 - DNA, 12 bp, Homo sapiens
tgcttatggaaa

SEQ ID NO: 6516010 - DNA, 21 bp, Homo sapiens
tgcttatggtaccagatgcag

SEQ ID NO: 6516011 - DNA, 19 bp, Homo sapiens
tgcttatgttgttttgtac

SEQ ID NO: 6516012 - DNA, 19 bp, Homo sapiens
tgcttattaagaccaaaga

SEQ ID NO: 6516013 - DNA, 22 bp, Homo sapiens
tgcttattaagaccaaagactt

SEQ ID NO: 6516014 - DNA, 16 bp, Homo sapiens
tgcttattacatttaa

SEQ ID NO: 6516015 - DNA, 17 bp, Homo sapiens
tgcttattatgtaggta

SEQ ID NO: 6516016 - DNA, 20 bp, Homo sapiens
tgcttattcttaacttatta

SEQ ID NO: 6516017 - DNA, 13 bp, Homo sapiens
tgcttattgatat

SEQ ID NO: 6516018 - DNA, 14 bp, Homo sapiens
tgcttattgcttag

SEQ ID NO: 6516019 - DNA, 13 bp, Homo sapiens
tgcttattgtact

SEQ ID NO: 6516020 - DNA, 14 bp, Homo sapiens
tgcttattgttcca

SEQ ID NO: 6516021 - DNA, 17 bp, Homo sapiens
tgcttattgttccaaga

SEQ ID NO: 6516022 - DNA, 15 bp, Homo sapiens
tgcttattgtttgca

SEQ ID NO: 6516023 - DNA, 14 bp, Homo sapiens
tgcttatttatatt

SEQ ID NO: 6516024 - DNA, 19 bp, Homo sapiens
tgcttatttatattcagag

SEQ ID NO: 6516025 - DNA, 20 bp, Homo sapiens
tgcttatttatattcagaga

SEQ ID NO: 6516026 - DNA, 20 bp, Homo sapiens
tgcttattttacaaatatta

SEQ ID NO: 6516027 - DNA, 16 bp, Homo sapiens
tgcttattttatgata

SEQ ID NO: 6516028 - DNA, 13 bp, Homo sapiens
tgcttcaaactga

SEQ ID NO: 6516029 - DNA, 19 bp, Homo sapiens
tgcttcaaatccatccaga

SEQ ID NO: 6516030 - DNA, 16 bp, Homo sapiens
tgcttcaaggcttcca

SEQ ID NO: 6516031 - DNA, 23 bp, Homo sapiens
tgcttcaagtgttacctaacaat

SEQ ID NO: 6516032 - DNA, 22 bp, Homo sapiens
tgcttcaataaatctttggaaa

SEQ ID NO: 6516033 - DNA, 21 bp, Homo sapiens
tgcttcaatagttcaaggaac

SEQ ID NO: 6516034 - DNA, 22 bp, Homo sapiens
tgcttcaatagttcaaggaact

SEQ ID NO: 6516035 - DNA, 14 bp, Homo sapiens
tgcttcaattaaaa

SEQ ID NO: 6516036 - DNA, 19 bp, Homo sapiens
tgcttcaattaaaattaca

SEQ ID NO: 6516037 - DNA, 14 bp, Homo sapiens
tgcttcacaatgtt

SEQ ID NO: 6516038 - DNA, 11 bp, Homo sapiens
tgcttcacaca

SEQ ID NO: 6516039 - DNA, 18 bp, Homo sapiens
tgcttcacacaaagtgaa

SEQ ID NO: 6516040 - DNA, 13 bp, Homo sapiens
tgcttcacagtag

SEQ ID NO: 6516041 - DNA, 14 bp, Homo sapiens
tgcttcacatagca

SEQ ID NO: 6516042 - DNA, 13 bp, Homo sapiens
tgcttcacatttg

SEQ ID NO: 6516043 - DNA, 19 bp, Homo sapiens
tgcttcaccagacttttct

SEQ ID NO: 6516044 - DNA, 21 bp, Homo sapiens
tgcttcaccatggccttatga

SEQ ID NO: 6516045 - DNA, 20 bp, Homo sapiens
tgcttcactcatgcaaactg

SEQ ID NO: 6516046 - DNA, 21 bp, Homo sapiens
tgcttcactcatgcaaactgc

SEQ ID NO: 6516047 - DNA, 22 bp, Homo sapiens
tgcttcactcatgcaaactgct

SEQ ID NO: 6516048 - DNA, 23 bp, Homo sapiens
tgcttcactcatgcaaactgctt

SEQ ID NO: 6516049 - DNA, 18 bp, Homo sapiens
tgcttcactttgccttct

SEQ ID NO: 6516050 - DNA, 18 bp, Homo sapiens
tgcttcagacctgacacc

SEQ ID NO: 6516051 - DNA, 19 bp, Homo sapiens
tgcttcagagtttgtgtgt

SEQ ID NO: 6516052 - DNA, 20 bp, Homo sapiens
tgcttcagatattattgctt

SEQ ID NO: 6516053 - DNA, 16 bp, Homo sapiens
tgcttcagccctggcc

SEQ ID NO: 6516054 - DNA, 14 bp, Homo sapiens
tgcttcagcctccc

SEQ ID NO: 6516055 - DNA, 14 bp, Homo sapiens
tgcttcagcctgag

SEQ ID NO: 6516056 - DNA, 15 bp, Homo sapiens
tgcttcagcctgagg

SEQ ID NO: 6516057 - DNA, 14 bp, Homo sapiens
tgcttcagcttgct

SEQ ID NO: 6516058 - DNA, 21 bp, Homo sapiens
tgcttcagggaggtagtttca

SEQ ID NO: 6516059 - DNA, 16 bp, Homo sapiens
tgcttcagtaaaagga

SEQ ID NO: 6516060 - DNA, 16 bp, Homo sapiens
tgcttcagtgaaataa

SEQ ID NO: 6516061 - DNA, 18 bp, Homo sapiens
tgcttcagtggagaatta

SEQ ID NO: 6516062 - DNA, 18 bp, Homo sapiens
tgcttcataaatgaagca

SEQ ID NO: 6516063 - DNA, 11 bp, Homo sapiens
tgcttcataca

SEQ ID NO: 6516064 - DNA, 18 bp, Homo sapiens
tgcttcatagtattggag

SEQ ID NO: 6516065 - DNA, 20 bp, Homo sapiens
tgcttcatatattgctttat

SEQ ID NO: 6516066 - DNA, 15 bp, Homo sapiens
tgcttcatatctctc

SEQ ID NO: 6516067 - DNA, 22 bp, Homo sapiens
tgcttcatatctctcccttctt

SEQ ID NO: 6516068 - DNA, 14 bp, Homo sapiens
tgcttcatcccttt

SEQ ID NO: 6516069 - DNA, 16 bp, Homo sapiens
tgcttcatgaaaatcc

SEQ ID NO: 6516070 - DNA, 17 bp, Homo sapiens
tgcttcatgaaaatcct

SEQ ID NO: 6516071 - DNA, 17 bp, Homo sapiens
tgcttcatgctcagccc

SEQ ID NO: 6516072 - DNA, 15 bp, Homo sapiens
tgcttcatgtgaaca

SEQ ID NO: 6516073 - DNA, 17 bp, Homo sapiens
tgcttcatgtgtcccag

SEQ ID NO: 6516074 - DNA, 15 bp, Homo sapiens
tgcttcattaaaaca

SEQ ID NO: 6516075 - DNA, 16 bp, Homo sapiens
tgcttcattaaaacaa

SEQ ID NO: 6516076 - DNA, 19 bp, Homo sapiens
tgcttcattcaatattgac

SEQ ID NO: 6516077 - DNA, 15 bp, Homo sapiens
tgcttcattgacctc

SEQ ID NO: 6516078 - DNA, 19 bp, Homo sapiens
tgcttcattgttacatgta

SEQ ID NO: 6516079 - DNA, 20 bp, Homo sapiens
tgcttcatttgtatgtcaaa

SEQ ID NO: 6516080 - DNA, 18 bp, Homo sapiens
tgcttcatttttgtaata

SEQ ID NO: 6516081 - DNA, 21 bp, Homo sapiens
tgcttcatttttgtaataaca

SEQ ID NO: 6516082 - DNA, 19 bp, Homo sapiens
tgcttccaacaaggacagc

SEQ ID NO: 6516083 - DNA, 20 bp, Homo sapiens
tgcttccaacaaggacagcc

SEQ ID NO: 6516084 - DNA, 20 bp, Homo sapiens
tgcttccaagaccatttgta

SEQ ID NO: 6516085 - DNA, 18 bp, Homo sapiens
tgcttccaatcttgcttt

SEQ ID NO: 6516086 - DNA, 15 bp, Homo sapiens
tgcttccaattttct

SEQ ID NO: 6516087 - DNA, 16 bp, Homo sapiens
tgcttccacatgtgcc

SEQ ID NO: 6516088 - DNA, 17 bp, Homo sapiens
tgcttccacatgtgcca

SEQ ID NO: 6516089 - DNA, 15 bp, Homo sapiens
tgcttccacctcacc

SEQ ID NO: 6516090 - DNA, 21 bp, Homo sapiens
tgcttccactaccaaaagaca

SEQ ID NO: 6516091 - DNA, 22 bp, Homo sapiens
tgcttccactaccaaaagacat

SEQ ID NO: 6516092 - DNA, 12 bp, Homo sapiens
tgcttccagaaa

SEQ ID NO: 6516093 - DNA, 20 bp, Homo sapiens
tgcttccagtgaggctctgc

SEQ ID NO: 6516094 - DNA, 12 bp, Homo sapiens
tgcttccagtgt

SEQ ID NO: 6516095 - DNA, 23 bp, Homo sapiens
tgcttccatggccgtgtagaagc

SEQ ID NO: 6516096 - DNA, 11 bp, Homo sapiens
tgcttccatta

SEQ ID NO: 6516097 - DNA, 19 bp, Homo sapiens
tgcttccattaacaaatgc

SEQ ID NO: 6516098 - DNA, 19 bp, Homo sapiens
tgcttcccaaactcccagg

SEQ ID NO: 6516099 - DNA, 23 bp, Homo sapiens
tgcttcccaaactcccaggacct

SEQ ID NO: 6516100 - DNA, 14 bp, Homo sapiens
tgcttcccacctcc

SEQ ID NO: 6516101 - DNA, 19 bp, Homo sapiens
tgcttcccacctccctgcc

SEQ ID NO: 6516102 - DNA, 14 bp, Homo sapiens
tgcttcccagaggg

SEQ ID NO: 6516103 - DNA, 14 bp, Homo sapiens
tgcttcccaggttc

SEQ ID NO: 6516104 - DNA, 23 bp, Homo sapiens
tgcttcccatcctaccctcgggc

SEQ ID NO: 6516105 - DNA, 20 bp, Homo sapiens
tgcttcccattgtggctcct

SEQ ID NO: 6516106 - DNA, 23 bp, Homo sapiens
tgcttcccattgtggctcctatc

SEQ ID NO: 6516107 - DNA, 20 bp, Homo sapiens
tgcttcccccacccctccac

SEQ ID NO: 6516108 - DNA, 14 bp, Homo sapiens
tgcttcccccactt

SEQ ID NO: 6516109 - DNA, 14 bp, Homo sapiens
tgcttccccgtgca

SEQ ID NO: 6516110 - DNA, 12 bp, Homo sapiens
tgcttcccctcc

SEQ ID NO: 6516111 - DNA, 16 bp, Homo sapiens
tgcttcccctccagga

SEQ ID NO: 6516112 - DNA, 14 bp, Homo sapiens
tgcttccccttcct

SEQ ID NO: 6516113 - DNA, 16 bp, Homo sapiens
tgcttcccgctgcaca

SEQ ID NO: 6516114 - DNA, 22 bp, Homo sapiens
tgcttcccgctgcacatggaca

SEQ ID NO: 6516115 - DNA, 20 bp, Homo sapiens
tgcttccctaggctgagctg

SEQ ID NO: 6516116 - DNA, 15 bp, Homo sapiens
tgcttccctctgcct

SEQ ID NO: 6516117 - DNA, 21 bp, Homo sapiens
tgcttccctctgcctgtccct

SEQ ID NO: 6516118 - DNA, 15 bp, Homo sapiens
tgcttcccttacttt

SEQ ID NO: 6516119 - DNA, 20 bp, Homo sapiens
tgcttcccttttttcctttc

SEQ ID NO: 6516120 - DNA, 22 bp, Homo sapiens
tgcttccgagattcagactgct

SEQ ID NO: 6516121 - DNA, 21 bp, Homo sapiens
tgcttccggtagggaggcagc

SEQ ID NO: 6516122 - DNA, 20 bp, Homo sapiens
tgcttcctagaagttactga

SEQ ID NO: 6516123 - DNA, 21 bp, Homo sapiens
tgcttcctagaagttactgaa

SEQ ID NO: 6516124 - DNA, 19 bp, Homo sapiens
tgcttcctaggccccagag

SEQ ID NO: 6516125 - DNA, 23 bp, Homo sapiens
tgcttcctcccaacaagcagctg

SEQ ID NO: 6516126 - DNA, 12 bp, Homo sapiens
tgcttcctgaaa

SEQ ID NO: 6516127 - DNA, 21 bp, Homo sapiens
tgcttcctgaaataaacactg

SEQ ID NO: 6516128 - DNA, 23 bp, Homo sapiens
tgcttcctgaaataaacactggt

SEQ ID NO: 6516129 - DNA, 15 bp, Homo sapiens
tgcttcctgatgctg

SEQ ID NO: 6516130 - DNA, 16 bp, Homo sapiens
tgcttcctgctgtatg

SEQ ID NO: 6516131 - DNA, 12 bp, Homo sapiens
tgcttccttcag

SEQ ID NO: 6516132 - DNA, 13 bp, Homo sapiens
tgcttccttctca

SEQ ID NO: 6516133 - DNA, 13 bp, Homo sapiens
tgcttccttctgc

SEQ ID NO: 6516134 - DNA, 17 bp, Homo sapiens
tgcttccttctgcaccc

SEQ ID NO: 6516135 - DNA, 22 bp, Homo sapiens
tgcttccttggttcatgcttct

SEQ ID NO: 6516136 - DNA, 14 bp, Homo sapiens
tgcttcctttctct

SEQ ID NO: 6516137 - DNA, 18 bp, Homo sapiens
tgcttcctttctctcctg

SEQ ID NO: 6516138 - DNA, 20 bp, Homo sapiens
tgtttcgcattaagcacaca

SEQ ID NO: 6516139 - DNA, 14 bp, Homo sapiens
tgtttcgctctttg

SEQ ID NO: 6516140 - DNA, 16 bp, Homo sapiens
tgtttcggtgccctgt

SEQ ID NO: 6516141 - DNA, 14 bp, Homo sapiens
tgtttcgtgaactg

SEQ ID NO: 6516142 - DNA, 15 bp, Homo sapiens
tgtttcgtgaagtat

SEQ ID NO: 6516143 - DNA, 19 bp, Homo sapiens
tgtttcgtgaagtatactg

SEQ ID NO: 6516144 - DNA, 17 bp, Homo sapiens
tgtttcgttaagcagta

SEQ ID NO: 6516145 - DNA, 21 bp, Homo sapiens
tgtttctaataaagaaagcag

SEQ ID NO: 6516146 - DNA, 18 bp, Homo sapiens
tgtttctaatttgctgct

SEQ ID NO: 6516147 - DNA, 20 bp, Homo sapiens
tgtttctaccggagagagaa

SEQ ID NO: 6516148 - DNA, 20 bp, Homo sapiens
tgtttctagagcctgctgga

SEQ ID NO: 6516149 - DNA, 16 bp, Homo sapiens
tgtttctagagttcct

SEQ ID NO: 6516150 - DNA, 21 bp, Homo sapiens
tgtttctagcactggcctgca

SEQ ID NO: 6516151 - DNA, 19 bp, Homo sapiens
tgtttctagctaaataaat

SEQ ID NO: 6516152 - DNA, 22 bp, Homo sapiens
tgtttctatactgtttgtaata

SEQ ID NO: 6516153 - DNA, 24 bp, Homo sapiens
tgtttctattctctcctcagactg

SEQ ID NO: 6516154 - DNA, 19 bp, Homo sapiens
tgtttctattgacttcaat

SEQ ID NO: 6516155 - DNA, 19 bp, Homo sapiens
tgtttctatttccataagg

SEQ ID NO: 6516156 - DNA, 22 bp, Homo sapiens
tgtttctattttttgaaaagca

SEQ ID NO: 6516157 - DNA, 14 bp, Homo sapiens
tgtttctcaaaaga

SEQ ID NO: 6516158 - DNA, 21 bp, Homo sapiens
tgtttctcccccatgttctgt

SEQ ID NO: 6516159 - DNA, 16 bp, Homo sapiens
tgtttctcccgtgctt

SEQ ID NO: 6516160 - DNA, 15 bp, Homo sapiens
tgtttctcctgagct

SEQ ID NO: 6516161 - DNA, 12 bp, Homo sapiens
tgtttctcctta

SEQ ID NO: 6516162 - DNA, 21 bp, Homo sapiens
tgtttctccttagttggctgg

SEQ ID NO: 6516163 - DNA, 18 bp, Homo sapiens
tgtttctctaaggaatta

SEQ ID NO: 6516164 - DNA, 14 bp, Homo sapiens
tgtttctctgagct

SEQ ID NO: 6516165 - DNA, 24 bp, Homo sapiens
tgtttctctgagctttgttactga

SEQ ID NO: 6516166 - DNA, 16 bp, Homo sapiens
tgtttctctgctgtca

SEQ ID NO: 6516167 - DNA, 17 bp, Homo sapiens
tgtttctctgctgtcaa

SEQ ID NO: 6516168 - DNA, 16 bp, Homo sapiens
tgtttctgaaaagaaa

SEQ ID NO: 6516169 - DNA, 14 bp, Homo sapiens
tgtttctgaaaatt

SEQ ID NO: 6516170 - DNA, 21 bp, Homo sapiens
tgtttctgaaaattccagaaa

SEQ ID NO: 6516171 - DNA, 13 bp, Homo sapiens
tgtttctgaatgt

SEQ ID NO: 6516172 - DNA, 18 bp, Homo sapiens
tgtttctgagaccacagt

SEQ ID NO: 6516173 - DNA, 12 bp, Homo sapiens
tgtttctgattt

SEQ ID NO: 6516174 - DNA, 16 bp, Homo sapiens
tgtttctgcagaggca

SEQ ID NO: 6516175 - DNA, 18 bp, Homo sapiens
tgtttctgcagaggcagc

SEQ ID NO: 6516176 - DNA, 21 bp, Homo sapiens
tgtttctgcagaggcagcagg

SEQ ID NO: 6516177 - DNA, 20 bp, Homo sapiens
tgtttctgcagcccttgggc

SEQ ID NO: 6516178 - DNA, 22 bp, Homo sapiens
tgtttctgcatagcgaaataaa

SEQ ID NO: 6516179 - DNA, 15 bp, Homo sapiens
tgtttctgcatcttt

SEQ ID NO: 6516180 - DNA, 19 bp, Homo sapiens
tgtttctggaaatgttctt

SEQ ID NO: 6516181 - DNA, 19 bp, Homo sapiens
tgtttctggaagactgctc

SEQ ID NO: 6516182 - DNA, 21 bp, Homo sapiens
tgtttctggacattctctttg

SEQ ID NO: 6516183 - DNA, 21 bp, Homo sapiens
tgtttctggagtgattctaga

SEQ ID NO: 6516184 - DNA, 11 bp, Homo sapiens
tgtttctgggg

SEQ ID NO: 6516185 - DNA, 18 bp, Homo sapiens
tgtttctgggtccctgct

SEQ ID NO: 6516186 - DNA, 21 bp, Homo sapiens
tgtttctgggtccctgctccc

SEQ ID NO: 6516187 - DNA, 22 bp, Homo sapiens
tgtttctgggtccctgctcccc

SEQ ID NO: 6516188 - DNA, 13 bp, Homo sapiens
tgtttctgtaaca

SEQ ID NO: 6516189 - DNA, 16 bp, Homo sapiens
tgtttctgtaagaaac

SEQ ID NO: 6516190 - DNA, 11 bp, Homo sapiens
tgtttctgtac

SEQ ID NO: 6516191 - DNA, 13 bp, Homo sapiens
tgtttctgtagaa

SEQ ID NO: 6516192 - DNA, 17 bp, Homo sapiens
tgtttctgtgaaattct

SEQ ID NO: 6516193 - DNA, 19 bp, Homo sapiens
tgtttctgtgaaattctca

SEQ ID NO: 6516194 - DNA, 21 bp, Homo sapiens
tgtttctgtgaaattctcaga

SEQ ID NO: 6516195 - DNA, 13 bp, Homo sapiens
tgtttctgtgccc

SEQ ID NO: 6516196 - DNA, 17 bp, Homo sapiens
tgtttctgtgccccggc

SEQ ID NO: 6516197 - DNA, 13 bp, Homo sapiens
tgtttctgtgtca

SEQ ID NO: 6516198 - DNA, 19 bp, Homo sapiens
tgtttctgtgtcattaacc

SEQ ID NO: 6516199 - DNA, 14 bp, Homo sapiens
tgtttctgttatta

SEQ ID NO: 6516200 - DNA, 15 bp, Homo sapiens
tgtttctgttattaa

SEQ ID NO: 6516201 - DNA, 19 bp, Homo sapiens
tgtttctgttgttcccgtg

SEQ ID NO: 6516202 - DNA, 15 bp, Homo sapiens
tgtttctgtttataa

SEQ ID NO: 6516203 - DNA, 19 bp, Homo sapiens
tgtttctgtttcttgctct

SEQ ID NO: 6516204 - DNA, 15 bp, Homo sapiens
tgtttcttaatttgg

SEQ ID NO: 6516205 - DNA, 23 bp, Homo sapiens
tgtttcttaatttggaaactaat

SEQ ID NO: 6516206 - DNA, 18 bp, Homo sapiens
tgtttcttattctctgtt

SEQ ID NO: 6516207 - DNA, 17 bp, Homo sapiens
tgtttcttcatttctct

SEQ ID NO: 6516208 - DNA, 19 bp, Homo sapiens
tgtttcttcatttctctgc

SEQ ID NO: 6516209 - DNA, 17 bp, Homo sapiens
tgtttcttccaaagcac

SEQ ID NO: 6516210 - DNA, 18 bp, Homo sapiens
tgtttcttccaaagcaca

SEQ ID NO: 6516211 - DNA, 17 bp, Homo sapiens
tgtttcttcctgttaat

SEQ ID NO: 6516212 - DNA, 18 bp, Homo sapiens
tgtttcttcctgttaatg

SEQ ID NO: 6516213 - DNA, 18 bp, Homo sapiens
tgtttcttctttctttta

SEQ ID NO: 6516214 - DNA, 14 bp, Homo sapiens
tgtttcttgcctca

SEQ ID NO: 6516215 - DNA, 12 bp, Homo sapiens
tgtttcttgctt

SEQ ID NO: 6516216 - DNA, 15 bp, Homo sapiens
tgtttcttgggaaaa

SEQ ID NO: 6516217 - DNA, 23 bp, Homo sapiens
tgtttcttgggaaaatatcactt

SEQ ID NO: 6516218 - DNA, 11 bp, Homo sapiens
tgtttcttggt

SEQ ID NO: 6516219 - DNA, 13 bp, Homo sapiens
tgtttctttaaat

SEQ ID NO: 6516220 - DNA, 20 bp, Homo sapiens
tgtttctttaaatttcaaat

SEQ ID NO: 6516221 - DNA, 17 bp, Homo sapiens
tgtttctttccttctga

SEQ ID NO: 6516222 - DNA, 20 bp, Homo sapiens
tgtttctttctctgaggaca

SEQ ID NO: 6516223 - DNA, 21 bp, Homo sapiens
tgtttctttctctgaggacaa

SEQ ID NO: 6516224 - DNA, 17 bp, Homo sapiens
tgtttctttctgaagtg

SEQ ID NO: 6516225 - DNA, 20 bp, Homo sapiens
tgtttctttctgtctctctc

SEQ ID NO: 6516226 - DNA, 21 bp, Homo sapiens
tgtttctttctgtctctctct

SEQ ID NO: 6516227 - DNA, 17 bp, Homo sapiens
tgtttctttcttcctct

SEQ ID NO: 6516228 - DNA, 12 bp, Homo sapiens
tgtttctttgaa

SEQ ID NO: 6516229 - DNA, 13 bp, Homo sapiens
tgtttctttgaat

SEQ ID NO: 6516230 - DNA, 23 bp, Homo sapiens
tgtttctttgaattttcatttta

SEQ ID NO: 6516231 - DNA, 15 bp, Homo sapiens
tgtttctttgatcat

SEQ ID NO: 6516232 - DNA, 20 bp, Homo sapiens
tgtttcttttgtatgtaaat

SEQ ID NO: 6516233 - DNA, 17 bp, Homo sapiens
tgtttctttttacagca

SEQ ID NO: 6516234 - DNA, 23 bp, Homo sapiens
tgtttcttttttttttttttaca

SEQ ID NO: 6516235 - DNA, 12 bp, Homo sapiens
tgtttgaaaact

SEQ ID NO: 6516236 - DNA, 17 bp, Homo sapiens
tgtttgaaaatagttta

SEQ ID NO: 6516237 - DNA, 18 bp, Homo sapiens
tgtttgaaaatagtttat

SEQ ID NO: 6516238 - DNA, 16 bp, Homo sapiens
tgtttgaaaatattat

SEQ ID NO: 6516239 - DNA, 23 bp, Homo sapiens
tgtttgaaacactcgtgtgcatg

SEQ ID NO: 6516240 - DNA, 16 bp, Homo sapiens
tgtttgaaacttttca

SEQ ID NO: 6516241 - DNA, 14 bp, Homo sapiens
tgtttgaaatatca

SEQ ID NO: 6516242 - DNA, 16 bp, Homo sapiens
tgtttgaaatcatcgg

SEQ ID NO: 6516243 - DNA, 22 bp, Homo sapiens
tgtttgaaatgaggtctgttta

SEQ ID NO: 6516244 - DNA, 13 bp, Homo sapiens
tgtttgaaatgtc

SEQ ID NO: 6516245 - DNA, 14 bp, Homo sapiens
tgtttgaaatgtcg

SEQ ID NO: 6516246 - DNA, 15 bp, Homo sapiens
tgtttgaaatgttta

SEQ ID NO: 6516247 - DNA, 16 bp, Homo sapiens
tgtttgaaatgtttaa

SEQ ID NO: 6516248 - DNA, 19 bp, Homo sapiens
tgtttgaaatgtttaataa

SEQ ID NO: 6516249 - DNA, 22 bp, Homo sapiens
tgtttgaagattatatgaagtt

SEQ ID NO: 6516250 - DNA, 13 bp, Homo sapiens
tgtttgaagattg

SEQ ID NO: 6516251 - DNA, 16 bp, Homo sapiens
tgtttgaagttacaaa

SEQ ID NO: 6516252 - DNA, 12 bp, Homo sapiens
tgtttgaatatt

SEQ ID NO: 6516253 - DNA, 14 bp, Homo sapiens
tgtttgaatgtttt

SEQ ID NO: 6516254 - DNA, 21 bp, Homo sapiens
tgtttgacaaagaaacccaag

SEQ ID NO: 6516255 - DNA, 13 bp, Homo sapiens
tgtttgactgtaa

SEQ ID NO: 6516256 - DNA, 15 bp, Homo sapiens
tgtttgactgtaatg

SEQ ID NO: 6516257 - DNA, 16 bp, Homo sapiens
tgtttgactttaaaga

SEQ ID NO: 6516258 - DNA, 19 bp, Homo sapiens
tgtttgagacagggtctca

SEQ ID NO: 6516259 - DNA, 17 bp, Homo sapiens
tgtttgagagagaatga

SEQ ID NO: 6516260 - DNA, 13 bp, Homo sapiens
tgtttgagctcag

SEQ ID NO: 6516261 - DNA, 18 bp, Homo sapiens
tgtttgagctctgcagcc

SEQ ID NO: 6516262 - DNA, 22 bp, Homo sapiens
tgtttgaggatatattttcact

SEQ ID NO: 6516263 - DNA, 23 bp, Homo sapiens
tgtttgaggcaaattaactgtat

SEQ ID NO: 6516264 - DNA, 22 bp, Homo sapiens
tgtttgagggattttattaaat

SEQ ID NO: 6516265 - DNA, 22 bp, Homo sapiens
tgtttgaggtttttaagcctta

SEQ ID NO: 6516266 - DNA, 14 bp, Homo sapiens
tgtttgagtttctg

SEQ ID NO: 6516267 - DNA, 22 bp, Homo sapiens
tgtttgagtttctggctgaaaa

SEQ ID NO: 6516268 - DNA, 23 bp, Homo sapiens
tgtttgatgcgcttttaactttg

SEQ ID NO: 6516269 - DNA, 19 bp, Homo sapiens
tgtttgatgctatttatgc

SEQ ID NO: 6516270 - DNA, 21 bp, Homo sapiens
tgtttgatgctatttatgcaa

SEQ ID NO: 6516271 - DNA, 15 bp, Homo sapiens
tgtttgatgtatgtg

SEQ ID NO: 6516272 - DNA, 16 bp, Homo sapiens
tgtttgatgtatgtgt

SEQ ID NO: 6516273 - DNA, 19 bp, Homo sapiens
tgtttgatgtatgtgtgaa

SEQ ID NO: 6516274 - DNA, 19 bp, Homo sapiens
tgtttgatgtccccaaagt

SEQ ID NO: 6516275 - DNA, 12 bp, Homo sapiens
tgtttgatgtgt

SEQ ID NO: 6516276 - DNA, 13 bp, Homo sapiens
tgtttgattggct

SEQ ID NO: 6516277 - DNA, 15 bp, Homo sapiens
tgtttgattggcttt

SEQ ID NO: 6516278 - DNA, 18 bp, Homo sapiens
tgtttgattttcatatcc

SEQ ID NO: 6516279 - DNA, 14 bp, Homo sapiens
tgtttgcaagcagg

SEQ ID NO: 6516280 - DNA, 16 bp, Homo sapiens
tgtttgcaatatcgat

SEQ ID NO: 6516281 - DNA, 18 bp, Homo sapiens
tgtttgcacagagggcgc

SEQ ID NO: 6516282 - DNA, 18 bp, Homo sapiens
tgtttgcacctttctagt

SEQ ID NO: 6516283 - DNA, 20 bp, Homo sapiens
tgtttgcacctttctagttg

SEQ ID NO: 6516284 - DNA, 22 bp, Homo sapiens
tgtttgcacctttctagttgaa

SEQ ID NO: 6516285 - DNA, 13 bp, Homo sapiens
tgtttgcactgtg

SEQ ID NO: 6516286 - DNA, 18 bp, Homo sapiens
tgtttgcactgtgtgctg

SEQ ID NO: 6516287 - DNA, 12 bp, Homo sapiens
tgtttgcagtgt

SEQ ID NO: 6516288 - DNA, 22 bp, Homo sapiens
tgtttgcataaacattctttta

SEQ ID NO: 6516289 - DNA, 16 bp, Homo sapiens
tgtttgcatgagaaaa

SEQ ID NO: 6516290 - DNA, 19 bp, Homo sapiens
tgtttgcattgtctaatga

SEQ ID NO: 6516291 - DNA, 12 bp, Homo sapiens
tgtttgccaaat

SEQ ID NO: 6516292 - DNA, 20 bp, Homo sapiens
tgtttgccaaataaaaaaca

SEQ ID NO: 6516293 - DNA, 15 bp, Homo sapiens
tgtttgccatacttt

SEQ ID NO: 6516294 - DNA, 16 bp, Homo sapiens
tgtttgcccattttca

SEQ ID NO: 6516295 - DNA, 16 bp, Homo sapiens
tgtttgcctctgcctc

SEQ ID NO: 6516296 - DNA, 18 bp, Homo sapiens
tgtttgcctttaggcagg

SEQ ID NO: 6516297 - DNA, 15 bp, Homo sapiens
tgtttgctaagcatt

SEQ ID NO: 6516298 - DNA, 19 bp, Homo sapiens
tgtttgctaagcattccaa

SEQ ID NO: 6516299 - DNA, 19 bp, Homo sapiens
tgtttgctatgactacatt

SEQ ID NO: 6516300 - DNA, 21 bp, Homo sapiens
tgtttgctatgactacatttt

SEQ ID NO: 6516301 - DNA, 23 bp, Homo sapiens
tgtttgctcagaacacattcttt

SEQ ID NO: 6516302 - DNA, 20 bp, Homo sapiens
tgtttgctcagcttctccaa

SEQ ID NO: 6516303 - DNA, 23 bp, Homo sapiens
tgtttgctctcccggttcttcca

SEQ ID NO: 6516304 - DNA, 24 bp, Homo sapiens
tgtttgctctcccggttcttccag

SEQ ID NO: 6516305 - DNA, 15 bp, Homo sapiens
tgtttgctgaaattt

SEQ ID NO: 6516306 - DNA, 20 bp, Homo sapiens
tgtttgctgaacattggaga

SEQ ID NO: 6516307 - DNA, 15 bp, Homo sapiens
tgtttgctgcttttg

SEQ ID NO: 6516308 - DNA, 14 bp, Homo sapiens
tgtttgctgtgaac

SEQ ID NO: 6516309 - DNA, 12 bp, Homo sapiens
tgtttgctgttt

SEQ ID NO: 6516310 - DNA, 15 bp, Homo sapiens
tgtttgcttaaaata

SEQ ID NO: 6516311 - DNA, 14 bp, Homo sapiens
tgtttgcttaaaca

SEQ ID NO: 6516312 - DNA, 15 bp, Homo sapiens
tgtttgcttaaacaa

SEQ ID NO: 6516313 - DNA, 20 bp, Homo sapiens
tgtttgcttattgttccaag

SEQ ID NO: 6516314 - DNA, 21 bp, Homo sapiens
tgtttgcttattgttccaaga

SEQ ID NO: 6516315 - DNA, 23 bp, Homo sapiens
tgtttgcttattgttccaagaca

SEQ ID NO: 6516316 - DNA, 13 bp, Homo sapiens
tgcttccttttca

SEQ ID NO: 6516317 - DNA, 15 bp, Homo sapiens
tgcttcgagccatgg

SEQ ID NO: 6516318 - DNA, 13 bp, Homo sapiens
tgcttcgggccct

SEQ ID NO: 6516319 - DNA, 15 bp, Homo sapiens
tgcttctaaaacaat

SEQ ID NO: 6516320 - DNA, 18 bp, Homo sapiens
tgcttctaaaacaataaa

SEQ ID NO: 6516321 - DNA, 18 bp, Homo sapiens
tgcttctaaatgcccagt

SEQ ID NO: 6516322 - DNA, 21 bp, Homo sapiens
tgcttctaagggatccagaga

SEQ ID NO: 6516323 - DNA, 19 bp, Homo sapiens
tgcttctaatgttccccta

SEQ ID NO: 6516324 - DNA, 22 bp, Homo sapiens
tgcttctacacatttcatctaa

SEQ ID NO: 6516325 - DNA, 18 bp, Homo sapiens
tgcttctactgtgacact

SEQ ID NO: 6516326 - DNA, 19 bp, Homo sapiens
tgcttctactgtgacactt

SEQ ID NO: 6516327 - DNA, 14 bp, Homo sapiens
tgcttctactttca

SEQ ID NO: 6516328 - DNA, 20 bp, Homo sapiens
tgcttctagaaactctggct

SEQ ID NO: 6516329 - DNA, 14 bp, Homo sapiens
tgcttctagagctt

SEQ ID NO: 6516330 - DNA, 12 bp, Homo sapiens
tgcttctagctt

SEQ ID NO: 6516331 - DNA, 22 bp, Homo sapiens
tgcttctaggagtcaactggct

SEQ ID NO: 6516332 - DNA, 20 bp, Homo sapiens
tgcttctagttctgccagga

SEQ ID NO: 6516333 - DNA, 21 bp, Homo sapiens
tgcttctataattttgccttt

SEQ ID NO: 6516334 - DNA, 18 bp, Homo sapiens
tgcttctcaactaaagaa

SEQ ID NO: 6516335 - DNA, 22 bp, Homo sapiens
tgcttctcaactaaagaatagt

SEQ ID NO: 6516336 - DNA, 22 bp, Homo sapiens
tgcttctcaccgtgcagagctg

SEQ ID NO: 6516337 - DNA, 15 bp, Homo sapiens
tgcttctcacttttt

SEQ ID NO: 6516338 - DNA, 22 bp, Homo sapiens
tgcttctcagatttctgaggaa

SEQ ID NO: 6516339 - DNA, 20 bp, Homo sapiens
tgcttctcagttgcagaaaa

SEQ ID NO: 6516340 - DNA, 17 bp, Homo sapiens
tgcttctcatcttgtga

SEQ ID NO: 6516341 - DNA, 16 bp, Homo sapiens
tgcttctccacctccc

SEQ ID NO: 6516342 - DNA, 15 bp, Homo sapiens
tgcttctccagcctg

SEQ ID NO: 6516343 - DNA, 20 bp, Homo sapiens
tgcttctcccaggcaaggct

SEQ ID NO: 6516344 - DNA, 22 bp, Homo sapiens
tgcttctcccaggcaaggctgt

SEQ ID NO: 6516345 - DNA, 18 bp, Homo sapiens
tgcttctcccatttcctg

SEQ ID NO: 6516346 - DNA, 19 bp, Homo sapiens
tgcttctcccatttcctga

SEQ ID NO: 6516347 - DNA, 20 bp, Homo sapiens
tgcttctcccatttcctgat

SEQ ID NO: 6516348 - DNA, 19 bp, Homo sapiens
tgcttctccccagaattca

SEQ ID NO: 6516349 - DNA, 13 bp, Homo sapiens
tgcttctcccccc

SEQ ID NO: 6516350 - DNA, 22 bp, Homo sapiens
tgcttctccccccatcccaggg

SEQ ID NO: 6516351 - DNA, 11 bp, Homo sapiens
tgcttctcccg

SEQ ID NO: 6516352 - DNA, 18 bp, Homo sapiens
tgcttctcccgccattgg

SEQ ID NO: 6516353 - DNA, 13 bp, Homo sapiens
tgcttctccctgg

SEQ ID NO: 6516354 - DNA, 14 bp, Homo sapiens
tgcttctccctggg

SEQ ID NO: 6516355 - DNA, 15 bp, Homo sapiens
tgcttctccctgggg

SEQ ID NO: 6516356 - DNA, 16 bp, Homo sapiens
tgcttctccctgggga

SEQ ID NO: 6516357 - DNA, 19 bp, Homo sapiens
tgcttctcctcccagcgtg

SEQ ID NO: 6516358 - DNA, 19 bp, Homo sapiens
tgcttctcggaggccaggc

SEQ ID NO: 6516359 - DNA, 17 bp, Homo sapiens
tgcttctcggccagccc

SEQ ID NO: 6516360 - DNA, 17 bp, Homo sapiens
tgcttctcggggtccag

SEQ ID NO: 6516361 - DNA, 20 bp, Homo sapiens
tgcttctcggggtccagtgc

SEQ ID NO: 6516362 - DNA, 15 bp, Homo sapiens
tgcttctctccttgc

SEQ ID NO: 6516363 - DNA, 12 bp, Homo sapiens
tgcttctctgac

SEQ ID NO: 6516364 - DNA, 12 bp, Homo sapiens
tgcttctcttaa

SEQ ID NO: 6516365 - DNA, 15 bp, Homo sapiens
tgcttctcttcttta

SEQ ID NO: 6516366 - DNA, 18 bp, Homo sapiens
tgcttctcttctttccat

SEQ ID NO: 6516367 - DNA, 22 bp, Homo sapiens
tgcttctcttgggaactccact

SEQ ID NO: 6516368 - DNA, 12 bp, Homo sapiens
tgcttctcttta

SEQ ID NO: 6516369 - DNA, 15 bp, Homo sapiens
tgcttctctttcaca

SEQ ID NO: 6516370 - DNA, 13 bp, Homo sapiens
tgcttctctttgt

SEQ ID NO: 6516371 - DNA, 17 bp, Homo sapiens
tgcttctctttgtgcag

SEQ ID NO: 6516372 - DNA, 18 bp, Homo sapiens
tgcttctctttgtgcagt

SEQ ID NO: 6516373 - DNA, 22 bp, Homo sapiens
tgcttctgatttagcaatgctg

SEQ ID NO: 6516374 - DNA, 16 bp, Homo sapiens
tgcttctgcagcaact

SEQ ID NO: 6516375 - DNA, 17 bp, Homo sapiens
tgcttctgcagcaactc

SEQ ID NO: 6516376 - DNA, 20 bp, Homo sapiens
tgcttctgcagcaactccca

SEQ ID NO: 6516377 - DNA, 12 bp, Homo sapiens
tgcttctgccac

SEQ ID NO: 6516378 - DNA, 12 bp, Homo sapiens
tgcttctgccca

SEQ ID NO: 6516379 - DNA, 15 bp, Homo sapiens
tgcttctgcccaccc

SEQ ID NO: 6516380 - DNA, 21 bp, Homo sapiens
tgcttctgcccaccccgcctc

SEQ ID NO: 6516381 - DNA, 13 bp, Homo sapiens
tgcttctgctcca

SEQ ID NO: 6516382 - DNA, 20 bp, Homo sapiens
tgcttctggctcctccttcc

SEQ ID NO: 6516383 - DNA, 22 bp, Homo sapiens
tgcttctggctttgttcttgtc

SEQ ID NO: 6516384 - DNA, 13 bp, Homo sapiens
tgcttctgtagct

SEQ ID NO: 6516385 - DNA, 16 bp, Homo sapiens
tgcttctgtatttcct

SEQ ID NO: 6516386 - DNA, 21 bp, Homo sapiens
tgcttctgtccaggacatgat

SEQ ID NO: 6516387 - DNA, 15 bp, Homo sapiens
tgcttctgtctggtt

SEQ ID NO: 6516388 - DNA, 17 bp, Homo sapiens
tgcttctgttttataat

SEQ ID NO: 6516389 - DNA, 17 bp, Homo sapiens
tgcttcttaaccccagt

SEQ ID NO: 6516390 - DNA, 19 bp, Homo sapiens
tgcttcttacgaacgccac

SEQ ID NO: 6516391 - DNA, 22 bp, Homo sapiens
tgcttcttcaagcacctgcaga

SEQ ID NO: 6516392 - DNA, 15 bp, Homo sapiens
tgcttcttcagctga

SEQ ID NO: 6516393 - DNA, 23 bp, Homo sapiens
tgcttcttccccagggttctgta

SEQ ID NO: 6516394 - DNA, 23 bp, Homo sapiens
tgcttcttctcctatgtgtaagg

SEQ ID NO: 6516395 - DNA, 11 bp, Homo sapiens
tgcttcttgct

SEQ ID NO: 6516396 - DNA, 12 bp, Homo sapiens
tgcttcttgctt

SEQ ID NO: 6516397 - DNA, 14 bp, Homo sapiens
tgcttcttggagtc

SEQ ID NO: 6516398 - DNA, 11 bp, Homo sapiens
tgcttcttgta

SEQ ID NO: 6516399 - DNA, 14 bp, Homo sapiens
tgcttcttgtaata

SEQ ID NO: 6516400 - DNA, 12 bp, Homo sapiens
tgcttcttgtga

SEQ ID NO: 6516401 - DNA, 14 bp, Homo sapiens
tgcttcttgtgaag

SEQ ID NO: 6516402 - DNA, 15 bp, Homo sapiens
tgcttcttgtgaagg

SEQ ID NO: 6516403 - DNA, 17 bp, Homo sapiens
tgcttctttcattttct

SEQ ID NO: 6516404 - DNA, 14 bp, Homo sapiens
tgcttctttctaga

SEQ ID NO: 6516405 - DNA, 19 bp, Homo sapiens
tgcttctttgcctccctca

SEQ ID NO: 6516406 - DNA, 15 bp, Homo sapiens
tgcttcttttagtca

SEQ ID NO: 6516407 - DNA, 18 bp, Homo sapiens
tgcttctttttcttaccc

SEQ ID NO: 6516408 - DNA, 13 bp, Homo sapiens
tgcttgaacacag

SEQ ID NO: 6516409 - DNA, 16 bp, Homo sapiens
tgcttgaacccaggag

SEQ ID NO: 6516410 - DNA, 17 bp, Homo sapiens
tgcttgaacttacaggt

SEQ ID NO: 6516411 - DNA, 20 bp, Homo sapiens
tgcttgaagattcaggcttg

SEQ ID NO: 6516412 - DNA, 20 bp, Homo sapiens
tgcttgaagcaaacagttga

SEQ ID NO: 6516413 - DNA, 20 bp, Homo sapiens
tgcttgaaggaacagtgctg

SEQ ID NO: 6516414 - DNA, 16 bp, Homo sapiens
tgcttgaaggccctgc

SEQ ID NO: 6516415 - DNA, 19 bp, Homo sapiens
tgcttgaaggccctgctga

SEQ ID NO: 6516416 - DNA, 20 bp, Homo sapiens
tgcttgaataaacaccactg

SEQ ID NO: 6516417 - DNA, 12 bp, Homo sapiens
tgcttgaatagc

SEQ ID NO: 6516418 - DNA, 12 bp, Homo sapiens
tgcttgaatgct

SEQ ID NO: 6516419 - DNA, 16 bp, Homo sapiens
tgcttgacaacatctg

SEQ ID NO: 6516420 - DNA, 14 bp, Homo sapiens
tgcttgacatacct

SEQ ID NO: 6516421 - DNA, 15 bp, Homo sapiens
tgcttgacataccta

SEQ ID NO: 6516422 - DNA, 22 bp, Homo sapiens
tgcttgacatacctaccagtat

SEQ ID NO: 6516423 - DNA, 15 bp, Homo sapiens
tgcttgactatcaca

SEQ ID NO: 6516424 - DNA, 17 bp, Homo sapiens
tgcttgactatcacata

SEQ ID NO: 6516425 - DNA, 19 bp, Homo sapiens
tgcttgactttccagaatg

SEQ ID NO: 6516426 - DNA, 18 bp, Homo sapiens
tgcttgagaatcctctcc

SEQ ID NO: 6516427 - DNA, 20 bp, Homo sapiens
tgcttgagcaataaagtgga

SEQ ID NO: 6516428 - DNA, 21 bp, Homo sapiens
tgcttgagccaggaggcctgc

SEQ ID NO: 6516429 - DNA, 15 bp, Homo sapiens
tgcttgagcctggct

SEQ ID NO: 6516430 - DNA, 15 bp, Homo sapiens
tgcttgagctcagga

SEQ ID NO: 6516431 - DNA, 22 bp, Homo sapiens
tgcttgagctttctgtgcatgt

SEQ ID NO: 6516432 - DNA, 13 bp, Homo sapiens
tgcttgaggaaaa

SEQ ID NO: 6516433 - DNA, 21 bp, Homo sapiens
tgcttgaggaggggcacctgc

SEQ ID NO: 6516434 - DNA, 23 bp, Homo sapiens
tgcttgagtcaggtttgagtaga

SEQ ID NO: 6516435 - DNA, 16 bp, Homo sapiens
tgcttgagtggacagc

SEQ ID NO: 6516436 - DNA, 13 bp, Homo sapiens
tgcttgatacagg

SEQ ID NO: 6516437 - DNA, 13 bp, Homo sapiens
tgcttgatataat

SEQ ID NO: 6516438 - DNA, 15 bp, Homo sapiens
tgcttgatataataa

SEQ ID NO: 6516439 - DNA, 20 bp, Homo sapiens
tgcttgatataataattact

SEQ ID NO: 6516440 - DNA, 22 bp, Homo sapiens
tgcttgatataataattactta

SEQ ID NO: 6516441 - DNA, 21 bp, Homo sapiens
tgcttgatatgtaagtacttc

SEQ ID NO: 6516442 - DNA, 12 bp, Homo sapiens
tgcttgatctat

SEQ ID NO: 6516443 - DNA, 13 bp, Homo sapiens
tgcttgatctatc

SEQ ID NO: 6516444 - DNA, 19 bp, Homo sapiens
tgcttgatctatctacaaa

SEQ ID NO: 6516445 - DNA, 18 bp, Homo sapiens
tgcttgatgaagcaagga

SEQ ID NO: 6516446 - DNA, 19 bp, Homo sapiens
tgcttgatgaagcaaggaa

SEQ ID NO: 6516447 - DNA, 20 bp, Homo sapiens
tgcttgatgggattctggac

SEQ ID NO: 6516448 - DNA, 14 bp, Homo sapiens
tgcttgattaaaca

SEQ ID NO: 6516449 - DNA, 15 bp, Homo sapiens
tgcttgattaaacag

SEQ ID NO: 6516450 - DNA, 17 bp, Homo sapiens
tgcttgatttgaccact

SEQ ID NO: 6516451 - DNA, 22 bp, Homo sapiens
tgcttgatttgaccactgacag

SEQ ID NO: 6516452 - DNA, 20 bp, Homo sapiens
tgcttgcaatctaatctgaa

SEQ ID NO: 6516453 - DNA, 18 bp, Homo sapiens
tgcttgcacacttcccca

SEQ ID NO: 6516454 - DNA, 16 bp, Homo sapiens
tgcttgcataagagct

SEQ ID NO: 6516455 - DNA, 17 bp, Homo sapiens
tgcttgcataagagctt

SEQ ID NO: 6516456 - DNA, 14 bp, Homo sapiens
tgcttgcatggaga

SEQ ID NO: 6516457 - DNA, 14 bp, Homo sapiens
tgcttgccaaagta

SEQ ID NO: 6516458 - DNA, 21 bp, Homo sapiens
tgcttgccaaggcagaggcct

SEQ ID NO: 6516459 - DNA, 22 bp, Homo sapiens
tgcttgcccaagtcacacagct

SEQ ID NO: 6516460 - DNA, 17 bp, Homo sapiens
tgcttgccgactggctg

SEQ ID NO: 6516461 - DNA, 11 bp, Homo sapiens
tgcttgcctct

SEQ ID NO: 6516462 - DNA, 14 bp, Homo sapiens
tgcttgcctgaagc

SEQ ID NO: 6516463 - DNA, 15 bp, Homo sapiens
tgcttgcctgatata

SEQ ID NO: 6516464 - DNA, 16 bp, Homo sapiens
tgcttgcgtgctggga

SEQ ID NO: 6516465 - DNA, 20 bp, Homo sapiens
tgcttgctaccaatctgtga

SEQ ID NO: 6516466 - DNA, 17 bp, Homo sapiens
tgcttgctcccaagccc

SEQ ID NO: 6516467 - DNA, 20 bp, Homo sapiens
tgcttgctcccaagcccctg

SEQ ID NO: 6516468 - DNA, 21 bp, Homo sapiens
tgcttgctcccaagcccctga

SEQ ID NO: 6516469 - DNA, 12 bp, Homo sapiens
tgcttgctccta

SEQ ID NO: 6516470 - DNA, 19 bp, Homo sapiens
tgcttgctgccttctggat

SEQ ID NO: 6516471 - DNA, 19 bp, Homo sapiens
tgcttgctggaaaactgcc

SEQ ID NO: 6516472 - DNA, 21 bp, Homo sapiens
tgcttgctggaaaactgccac

SEQ ID NO: 6516473 - DNA, 18 bp, Homo sapiens
tgcttgctgtgtgacctt

SEQ ID NO: 6516474 - DNA, 16 bp, Homo sapiens
tgcttgcttgccctcc

SEQ ID NO: 6516475 - DNA, 19 bp, Homo sapiens
tgcttgctttcttttttaa

SEQ ID NO: 6516476 - DNA, 14 bp, Homo sapiens
tgcttgcttttgcc

SEQ ID NO: 6516477 - DNA, 18 bp, Homo sapiens
tgcttggaaattccttgc

SEQ ID NO: 6516478 - DNA, 17 bp, Homo sapiens
tgcttggaacatactgt

SEQ ID NO: 6516479 - DNA, 19 bp, Homo sapiens
tgcttggacctcgtgcttt

SEQ ID NO: 6516480 - DNA, 21 bp, Homo sapiens
tgcttggacctcgtgctttaa

SEQ ID NO: 6516481 - DNA, 18 bp, Homo sapiens
tgcttggagcaatcagaa

SEQ ID NO: 6516482 - DNA, 21 bp, Homo sapiens
tgcttggaggaaggaaaccca

SEQ ID NO: 6516483 - DNA, 18 bp, Homo sapiens
tgcttggaggcctcagat

SEQ ID NO: 6516484 - DNA, 22 bp, Homo sapiens
tgcttggatgcgagcttggcct

SEQ ID NO: 6516485 - DNA, 12 bp, Homo sapiens
tgcttggcagag

SEQ ID NO: 6516486 - DNA, 16 bp, Homo sapiens
tgcttggcccaggagt

SEQ ID NO: 6516487 - DNA, 19 bp, Homo sapiens
tgcttggccttgggcttca

SEQ ID NO: 6516488 - DNA, 14 bp, Homo sapiens
tgcttggctgcccc

SEQ ID NO: 6516489 - DNA, 15 bp, Homo sapiens
tgcttgggaaggggc

SEQ ID NO: 6516490 - DNA, 23 bp, Homo sapiens
tgcttgggaatgaaattaacaca

SEQ ID NO: 6516491 - DNA, 17 bp, Homo sapiens
tgcttgggccactgccc

SEQ ID NO: 6516492 - DNA, 14 bp, Homo sapiens
tgcttggggcctgg

SEQ ID NO: 6516493 - DNA, 16 bp, Homo sapiens
tgcttggggcctggcg

SEQ ID NO: 6516494 - DNA, 15 bp, Homo sapiens
tgcttggggctattt

SEQ ID NO: 6516495 - DNA, 17 bp, Homo sapiens
tgcttgggtcctactcc

SEQ ID NO: 6516496 - DNA, 16 bp, Homo sapiens
tgtttgcttcaccgtg

SEQ ID NO: 6516497 - DNA, 16 bp, Homo sapiens
tgtttgcttgaatgct

SEQ ID NO: 6516498 - DNA, 21 bp, Homo sapiens
tgtttgcttggtgctggttta

SEQ ID NO: 6516499 - DNA, 13 bp, Homo sapiens
tgtttgctttctg

SEQ ID NO: 6516500 - DNA, 14 bp, Homo sapiens
tgtttgcttttgaa

SEQ ID NO: 6516501 - DNA, 16 bp, Homo sapiens
tgtttgcttttgaacg

SEQ ID NO: 6516502 - DNA, 22 bp, Homo sapiens
tgtttggaaaaaactctgaagg

SEQ ID NO: 6516503 - DNA, 14 bp, Homo sapiens
tgtttggaaacatt

SEQ ID NO: 6516504 - DNA, 16 bp, Homo sapiens
tgtttggaaaccacag

SEQ ID NO: 6516505 - DNA, 17 bp, Homo sapiens
tgtttggaaaccacagt

SEQ ID NO: 6516506 - DNA, 16 bp, Homo sapiens
tgtttggaatattcca

SEQ ID NO: 6516507 - DNA, 20 bp, Homo sapiens
tgtttggaatgttagaatga

SEQ ID NO: 6516508 - DNA, 17 bp, Homo sapiens
tgtttggaatttaagaa

SEQ ID NO: 6516509 - DNA, 15 bp, Homo sapiens
tgtttggacagctga

SEQ ID NO: 6516510 - DNA, 14 bp, Homo sapiens
tgtttggactgttt

SEQ ID NO: 6516511 - DNA, 19 bp, Homo sapiens
tgtttggactgttttcaat

SEQ ID NO: 6516512 - DNA, 17 bp, Homo sapiens
tgtttggactttgtata

SEQ ID NO: 6516513 - DNA, 12 bp, Homo sapiens
tgtttggagagc

SEQ ID NO: 6516514 - DNA, 15 bp, Homo sapiens
tgtttggatacatct

SEQ ID NO: 6516515 - DNA, 19 bp, Homo sapiens
tgtttggatacatctgctg

SEQ ID NO: 6516516 - DNA, 19 bp, Homo sapiens
tgtttggatgtaatttagg

SEQ ID NO: 6516517 - DNA, 15 bp, Homo sapiens
tgtttggattgatat

SEQ ID NO: 6516518 - DNA, 21 bp, Homo sapiens
tgtttggatttcctttatact

SEQ ID NO: 6516519 - DNA, 14 bp, Homo sapiens
tgtttggcaagaaa

SEQ ID NO: 6516520 - DNA, 16 bp, Homo sapiens
tgtttggcaaggaaag

SEQ ID NO: 6516521 - DNA, 15 bp, Homo sapiens
tgtttggcaatgcta

SEQ ID NO: 6516522 - DNA, 22 bp, Homo sapiens
tgtttggcgtagcagagttaaa

SEQ ID NO: 6516523 - DNA, 12 bp, Homo sapiens
tgtttggctggg

SEQ ID NO: 6516524 - DNA, 19 bp, Homo sapiens
tgtttggcttataaacaca

SEQ ID NO: 6516525 - DNA, 13 bp, Homo sapiens
tgtttggctttca

SEQ ID NO: 6516526 - DNA, 20 bp, Homo sapiens
tgtttgggaagagcttagaa

SEQ ID NO: 6516527 - DNA, 20 bp, Homo sapiens
tgtttgggatattaaaacac

SEQ ID NO: 6516528 - DNA, 21 bp, Homo sapiens
tgtttgggatattaaaacaca

SEQ ID NO: 6516529 - DNA, 18 bp, Homo sapiens
tgtttgggatcagcttct

SEQ ID NO: 6516530 - DNA, 16 bp, Homo sapiens
tgtttgggctttaaca

SEQ ID NO: 6516531 - DNA, 19 bp, Homo sapiens
tgtttggggatgagaaagg

SEQ ID NO: 6516532 - DNA, 20 bp, Homo sapiens
tgtttgggggacgtttctca

SEQ ID NO: 6516533 - DNA, 20 bp, Homo sapiens
tgtttgggtgggttaagtgg

SEQ ID NO: 6516534 - DNA, 22 bp, Homo sapiens
tgtttgggttgttggtctgtgt

SEQ ID NO: 6516535 - DNA, 18 bp, Homo sapiens
tgtttgggtttttttcct

SEQ ID NO: 6516536 - DNA, 12 bp, Homo sapiens
tgtttggtaaat

SEQ ID NO: 6516537 - DNA, 13 bp, Homo sapiens
tgtttggtataaa

SEQ ID NO: 6516538 - DNA, 15 bp, Homo sapiens
tgtttggtataaatt

SEQ ID NO: 6516539 - DNA, 15 bp, Homo sapiens
tgtttggtcactgct

SEQ ID NO: 6516540 - DNA, 14 bp, Homo sapiens
tgtttggtgaggac

SEQ ID NO: 6516541 - DNA, 19 bp, Homo sapiens
tgtttggtgcatagaactg

SEQ ID NO: 6516542 - DNA, 20 bp, Homo sapiens
tgtttggtgtttgtctgtgt

SEQ ID NO: 6516543 - DNA, 18 bp, Homo sapiens
tgtttggttatagtgcaa

SEQ ID NO: 6516544 - DNA, 14 bp, Homo sapiens
tgtttggttcaatt

SEQ ID NO: 6516545 - DNA, 15 bp, Homo sapiens
tgtttggttcaattt

SEQ ID NO: 6516546 - DNA, 16 bp, Homo sapiens
tgtttggtttacattt

SEQ ID NO: 6516547 - DNA, 21 bp, Homo sapiens
tgtttggttttaaaatactgt

SEQ ID NO: 6516548 - DNA, 22 bp, Homo sapiens
tgtttggttttaaaatactgta

SEQ ID NO: 6516549 - DNA, 15 bp, Homo sapiens
tgtttggttttacat

SEQ ID NO: 6516550 - DNA, 14 bp, Homo sapiens
tgtttgtaaaagag

SEQ ID NO: 6516551 - DNA, 19 bp, Homo sapiens
tgtttgtaaaagagctgtt

SEQ ID NO: 6516552 - DNA, 22 bp, Homo sapiens
tgtttgtaaaagcttgatgaaa

SEQ ID NO: 6516553 - DNA, 16 bp, Homo sapiens
tgtttgtaaataagag

SEQ ID NO: 6516554 - DNA, 13 bp, Homo sapiens
tgtttgtaaatta

SEQ ID NO: 6516555 - DNA, 18 bp, Homo sapiens
tgtttgtaactttttaca

SEQ ID NO: 6516556 - DNA, 19 bp, Homo sapiens
tgtttgtaagtttgaattt

SEQ ID NO: 6516557 - DNA, 21 bp, Homo sapiens
tgtttgtacaaactatttcag

SEQ ID NO: 6516558 - DNA, 20 bp, Homo sapiens
tgtttgtacaagattgtcat

SEQ ID NO: 6516559 - DNA, 21 bp, Homo sapiens
tgtttgtacacaacacctaaa

SEQ ID NO: 6516560 - DNA, 14 bp, Homo sapiens
tgtttgtagctttc

SEQ ID NO: 6516561 - DNA, 15 bp, Homo sapiens
tgtttgtagctttcc

SEQ ID NO: 6516562 - DNA, 18 bp, Homo sapiens
tgtttgtagctttcctgg

SEQ ID NO: 6516563 - DNA, 16 bp, Homo sapiens
tgtttgtatataaatg

SEQ ID NO: 6516564 - DNA, 15 bp, Homo sapiens
tgtttgtatgtataa

SEQ ID NO: 6516565 - DNA, 15 bp, Homo sapiens
tgtttgtattgtaaa

SEQ ID NO: 6516566 - DNA, 19 bp, Homo sapiens
tgtttgtattgtaaaaaat

SEQ ID NO: 6516567 - DNA, 18 bp, Homo sapiens
tgtttgtcacaagtggtg

SEQ ID NO: 6516568 - DNA, 11 bp, Homo sapiens
tgtttgtcagc

SEQ ID NO: 6516569 - DNA, 13 bp, Homo sapiens
tgtttgtcagcat

SEQ ID NO: 6516570 - DNA, 14 bp, Homo sapiens
tgtttgtcagcatc

SEQ ID NO: 6516571 - DNA, 18 bp, Homo sapiens
tgtttgtcagcatctgac

SEQ ID NO: 6516572 - DNA, 15 bp, Homo sapiens
tgtttgtcagtaaat

SEQ ID NO: 6516573 - DNA, 15 bp, Homo sapiens
tgtttgtcatggtga

SEQ ID NO: 6516574 - DNA, 15 bp, Homo sapiens
tgtttgtcattttga

SEQ ID NO: 6516575 - DNA, 15 bp, Homo sapiens
tgtttgtcccttcta

SEQ ID NO: 6516576 - DNA, 14 bp, Homo sapiens
tgtttgtcctttat

SEQ ID NO: 6516577 - DNA, 19 bp, Homo sapiens
tgtttgtcctttatgtatt

SEQ ID NO: 6516578 - DNA, 21 bp, Homo sapiens
tgtttgtcctttatgtattct

SEQ ID NO: 6516579 - DNA, 23 bp, Homo sapiens
tgtttgtcctttatgtattctct

SEQ ID NO: 6516580 - DNA, 19 bp, Homo sapiens
tgtttgtctctccttttct

SEQ ID NO: 6516581 - DNA, 14 bp, Homo sapiens
tgtttgtctcttct

SEQ ID NO: 6516582 - DNA, 17 bp, Homo sapiens
tgtttgtctgtcttcat

SEQ ID NO: 6516583 - DNA, 19 bp, Homo sapiens
tgtttgtctgtgtgctgta

SEQ ID NO: 6516584 - DNA, 19 bp, Homo sapiens
tgtttgtctgtttgtttca

SEQ ID NO: 6516585 - DNA, 19 bp, Homo sapiens
tgtttgtcttttaatgctt

SEQ ID NO: 6516586 - DNA, 16 bp, Homo sapiens
tgtttgtgagtatgtg

SEQ ID NO: 6516587 - DNA, 21 bp, Homo sapiens
tgtttgtgcaaacataatacc

SEQ ID NO: 6516588 - DNA, 23 bp, Homo sapiens
tgtttgtgcagtaacttgggagt

SEQ ID NO: 6516589 - DNA, 13 bp, Homo sapiens
tgtttgtgctgtg

SEQ ID NO: 6516590 - DNA, 12 bp, Homo sapiens
tgtttgtgcttc

SEQ ID NO: 6516591 - DNA, 19 bp, Homo sapiens
tgtttgtgcttcaaatgat

SEQ ID NO: 6516592 - DNA, 14 bp, Homo sapiens
tgtttgtgcttcta

SEQ ID NO: 6516593 - DNA, 15 bp, Homo sapiens
tgtttgtggcctcag

SEQ ID NO: 6516594 - DNA, 12 bp, Homo sapiens
tgtttgtgggac

SEQ ID NO: 6516595 - DNA, 17 bp, Homo sapiens
tgtttgtgggtatttct

SEQ ID NO: 6516596 - DNA, 18 bp, Homo sapiens
tgtttgtggttttgggaa

SEQ ID NO: 6516597 - DNA, 12 bp, Homo sapiens
tgtttgtgtatt

SEQ ID NO: 6516598 - DNA, 14 bp, Homo sapiens
tgtttgtgtccata

SEQ ID NO: 6516599 - DNA, 16 bp, Homo sapiens
tgtttgtgtctgtggt

SEQ ID NO: 6516600 - DNA, 17 bp, Homo sapiens
tgtttgtgtgatttcct

SEQ ID NO: 6516601 - DNA, 11 bp, Homo sapiens
tgtttgtgtgt

SEQ ID NO: 6516602 - DNA, 16 bp, Homo sapiens
tgtttgtgtgtcaagt

SEQ ID NO: 6516603 - DNA, 13 bp, Homo sapiens
tgtttgtgtgttt

SEQ ID NO: 6516604 - DNA, 22 bp, Homo sapiens
tgtttgttggttgattgtttaa

SEQ ID NO: 6516605 - DNA, 12 bp, Homo sapiens
tgtttgtttaag

SEQ ID NO: 6516606 - DNA, 21 bp, Homo sapiens
tgtttgtttagtcttgtctca

SEQ ID NO: 6516607 - DNA, 13 bp, Homo sapiens
tgtttgtttatta

SEQ ID NO: 6516608 - DNA, 21 bp, Homo sapiens
tgtttgtttcttcttttcctt

SEQ ID NO: 6516609 - DNA, 12 bp, Homo sapiens
tgtttgtttgag

SEQ ID NO: 6516610 - DNA, 12 bp, Homo sapiens
tgtttgttttgt

SEQ ID NO: 6516611 - DNA, 18 bp, Homo sapiens
tgtttgtttttgctttct

SEQ ID NO: 6516612 - DNA, 21 bp, Homo sapiens
tgttttaaaaaaactgaaggt

SEQ ID NO: 6516613 - DNA, 20 bp, Homo sapiens
tgttttaaaaagaaacaaga

SEQ ID NO: 6516614 - DNA, 23 bp, Homo sapiens
tgttttaaaaaggaactgcagca

SEQ ID NO: 6516615 - DNA, 19 bp, Homo sapiens
tgttttaaaacgtgtaaat

SEQ ID NO: 6516616 - DNA, 19 bp, Homo sapiens
tgttttaaaataagttaaa

SEQ ID NO: 6516617 - DNA, 20 bp, Homo sapiens
tgttttaaaataatatgtaa

SEQ ID NO: 6516618 - DNA, 17 bp, Homo sapiens
tgttttaaaatctataa

SEQ ID NO: 6516619 - DNA, 18 bp, Homo sapiens
tgttttaaaatgagaaat

SEQ ID NO: 6516620 - DNA, 15 bp, Homo sapiens
tgttttaaaatgtga

SEQ ID NO: 6516621 - DNA, 22 bp, Homo sapiens
tgttttaaacattaatagcagc

SEQ ID NO: 6516622 - DNA, 13 bp, Homo sapiens
tgttttaaactgt

SEQ ID NO: 6516623 - DNA, 14 bp, Homo sapiens
tgttttaaactgtg

SEQ ID NO: 6516624 - DNA, 12 bp, Homo sapiens
tgttttaaagaa

SEQ ID NO: 6516625 - DNA, 19 bp, Homo sapiens
tgttttaaatatagaattt

SEQ ID NO: 6516626 - DNA, 14 bp, Homo sapiens
tgttttaaatgtac

SEQ ID NO: 6516627 - DNA, 13 bp, Homo sapiens
tgttttaaattct

SEQ ID NO: 6516628 - DNA, 17 bp, Homo sapiens
tgttttaaattctgaga

SEQ ID NO: 6516629 - DNA, 11 bp, Homo sapiens
tgttttaacaa

SEQ ID NO: 6516630 - DNA, 22 bp, Homo sapiens
tgttttaacctcccctctcccc

SEQ ID NO: 6516631 - DNA, 19 bp, Homo sapiens
tgttttaacggcctgcatc

SEQ ID NO: 6516632 - DNA, 16 bp, Homo sapiens
tgttttaagactgaat

SEQ ID NO: 6516633 - DNA, 18 bp, Homo sapiens
tgttttaagcaaatgcat

SEQ ID NO: 6516634 - DNA, 15 bp, Homo sapiens
tgttttaagtgtttg

SEQ ID NO: 6516635 - DNA, 17 bp, Homo sapiens
tgttttaataaacagta

SEQ ID NO: 6516636 - DNA, 20 bp, Homo sapiens
tgttttaataaacgtttgaa

SEQ ID NO: 6516637 - DNA, 15 bp, Homo sapiens
tgttttaatatccta

SEQ ID NO: 6516638 - DNA, 13 bp, Homo sapiens
tgttttaatctta

SEQ ID NO: 6516639 - DNA, 17 bp, Homo sapiens
tgttttacaactcctga

SEQ ID NO: 6516640 - DNA, 17 bp, Homo sapiens
tgttttacaatagttct

SEQ ID NO: 6516641 - DNA, 17 bp, Homo sapiens
tgttttacaatggctgg

SEQ ID NO: 6516642 - DNA, 13 bp, Homo sapiens
tgttttacaatgt

SEQ ID NO: 6516643 - DNA, 15 bp, Homo sapiens
tgttttacactgtac

SEQ ID NO: 6516644 - DNA, 17 bp, Homo sapiens
tgttttacagctgcctt

SEQ ID NO: 6516645 - DNA, 14 bp, Homo sapiens
tgttttacagtata

SEQ ID NO: 6516646 - DNA, 17 bp, Homo sapiens
tgttttacattccattt

SEQ ID NO: 6516647 - DNA, 20 bp, Homo sapiens
tgttttacgcaaggaaggac

SEQ ID NO: 6516648 - DNA, 16 bp, Homo sapiens
tgttttacgtgcaaac

SEQ ID NO: 6516649 - DNA, 21 bp, Homo sapiens
tgttttactaaagaaagatta

SEQ ID NO: 6516650 - DNA, 18 bp, Homo sapiens
tgttttactatctcactg

SEQ ID NO: 6516651 - DNA, 13 bp, Homo sapiens
tgttttactcttt

SEQ ID NO: 6516652 - DNA, 16 bp, Homo sapiens
tgttttactctttttc

SEQ ID NO: 6516653 - DNA, 15 bp, Homo sapiens
tgttttactgtcaga

SEQ ID NO: 6516654 - DNA, 18 bp, Homo sapiens
tgttttactgtgaaactg

SEQ ID NO: 6516655 - DNA, 21 bp, Homo sapiens
tgttttagaagattctatgtt

SEQ ID NO: 6516656 - DNA, 19 bp, Homo sapiens
tgttttagacaaatactca

SEQ ID NO: 6516657 - DNA, 19 bp, Homo sapiens
tgttttagagataaatatt

SEQ ID NO: 6516658 - DNA, 16 bp, Homo sapiens
tgttttagatgttact

SEQ ID NO: 6516659 - DNA, 16 bp, Homo sapiens
tgttttagcacagcgt

SEQ ID NO: 6516660 - DNA, 17 bp, Homo sapiens
tgttttagcattaccta

SEQ ID NO: 6516661 - DNA, 14 bp, Homo sapiens
tgttttaggagcat

SEQ ID NO: 6516662 - DNA, 18 bp, Homo sapiens
tgttttagtgtaaaattg

SEQ ID NO: 6516663 - DNA, 22 bp, Homo sapiens
tgttttagtttctgaactctga

SEQ ID NO: 6516664 - DNA, 12 bp, Homo sapiens
tgttttatagta

SEQ ID NO: 6516665 - DNA, 21 bp, Homo sapiens
tgttttatagtattaagtgaa

SEQ ID NO: 6516666 - DNA, 15 bp, Homo sapiens
tgttttatatacctg

SEQ ID NO: 6516667 - DNA, 21 bp, Homo sapiens
tgttttatatattatgtgaag

SEQ ID NO: 6516668 - DNA, 13 bp, Homo sapiens
tgttttatctggt

SEQ ID NO: 6516669 - DNA, 17 bp, Homo sapiens
tgttttatcttttaagt

SEQ ID NO: 6516670 - DNA, 16 bp, Homo sapiens
tgttttatgagaaagc

SEQ ID NO: 6516671 - DNA, 11 bp, Homo sapiens
tgttttatgct

SEQ ID NO: 6516672 - DNA, 16 bp, Homo sapiens
tgttttattactgttt

SEQ ID NO: 6516673 - DNA, 14 bp, Homo sapiens
tgttttattcagct

SEQ ID NO: 6516674 - DNA, 22 bp, Homo sapiens
tgttttattgagttctgaaggt

SEQ ID NO: 6516675 - DNA, 18 bp, Homo sapiens
tgttttatttaaatgctt

SEQ ID NO: 6516676 - DNA, 19 bp, Homo sapiens
tgttttatttaaatgcttt

SEQ ID NO: 6516677 - DNA, 21 bp, Homo sapiens
tgcttgggtctctctccattt

SEQ ID NO: 6516678 - DNA, 16 bp, Homo sapiens
tgcttgggtggagaag

SEQ ID NO: 6516679 - DNA, 17 bp, Homo sapiens
tgcttgggtggagaagc

SEQ ID NO: 6516680 - DNA, 19 bp, Homo sapiens
tgcttgggtggagaagcca

SEQ ID NO: 6516681 - DNA, 21 bp, Homo sapiens
tgcttgggtggagaagccatt

SEQ ID NO: 6516682 - DNA, 22 bp, Homo sapiens
tgcttgggtggagaagccattg

SEQ ID NO: 6516683 - DNA, 13 bp, Homo sapiens
tgcttggtctgtt

SEQ ID NO: 6516684 - DNA, 15 bp, Homo sapiens
tgcttggtctgtttg

SEQ ID NO: 6516685 - DNA, 15 bp, Homo sapiens
tgcttggtgcacaga

SEQ ID NO: 6516686 - DNA, 15 bp, Homo sapiens
tgcttggtgctggtt

SEQ ID NO: 6516687 - DNA, 18 bp, Homo sapiens
tgcttggtgctggtttat

SEQ ID NO: 6516688 - DNA, 20 bp, Homo sapiens
tgcttggtggggctcgtggc

SEQ ID NO: 6516689 - DNA, 18 bp, Homo sapiens
tgcttggttggctggcag

SEQ ID NO: 6516690 - DNA, 12 bp, Homo sapiens
tgcttgtaaaaa

SEQ ID NO: 6516691 - DNA, 20 bp, Homo sapiens
tgcttgtaacaagaaaacat

SEQ ID NO: 6516692 - DNA, 15 bp, Homo sapiens
tgcttgtaactaaaa

SEQ ID NO: 6516693 - DNA, 16 bp, Homo sapiens
tgcttgtacactcatt

SEQ ID NO: 6516694 - DNA, 12 bp, Homo sapiens
tgcttgtacata

SEQ ID NO: 6516695 - DNA, 14 bp, Homo sapiens
tgcttgtacctctg

SEQ ID NO: 6516696 - DNA, 16 bp, Homo sapiens
tgcttgtactaagcca

SEQ ID NO: 6516697 - DNA, 19 bp, Homo sapiens
tgcttgtactaagccagga

SEQ ID NO: 6516698 - DNA, 22 bp, Homo sapiens
tgcttgtaggtatgtctgtgcc

SEQ ID NO: 6516699 - DNA, 13 bp, Homo sapiens
tgcttgtcagtgg

SEQ ID NO: 6516700 - DNA, 16 bp, Homo sapiens
tgcttgtcattccaga

SEQ ID NO: 6516701 - DNA, 17 bp, Homo sapiens
tgcttgtcattccagag

SEQ ID NO: 6516702 - DNA, 18 bp, Homo sapiens
tgcttgtcattctgctaa

SEQ ID NO: 6516703 - DNA, 17 bp, Homo sapiens
tgcttgtcattgactct

SEQ ID NO: 6516704 - DNA, 22 bp, Homo sapiens
tgcttgtcattgactcttgcgt

SEQ ID NO: 6516705 - DNA, 13 bp, Homo sapiens
tgcttgtcctgct

SEQ ID NO: 6516706 - DNA, 20 bp, Homo sapiens
tgcttgtcctgctctcttca

SEQ ID NO: 6516707 - DNA, 22 bp, Homo sapiens
tgcttgtcgctttctcagtgtg

SEQ ID NO: 6516708 - DNA, 16 bp, Homo sapiens
tgcttgtgacattaaa

SEQ ID NO: 6516709 - DNA, 17 bp, Homo sapiens
tgcttgtgcctacctgg

SEQ ID NO: 6516710 - DNA, 14 bp, Homo sapiens
tgcttgtgcctccc

SEQ ID NO: 6516711 - DNA, 18 bp, Homo sapiens
tgcttgtgcctcccttcc

SEQ ID NO: 6516712 - DNA, 20 bp, Homo sapiens
tgcttgtgtaatttatgtga

SEQ ID NO: 6516713 - DNA, 17 bp, Homo sapiens
tgcttgtgtgtatgtct

SEQ ID NO: 6516714 - DNA, 12 bp, Homo sapiens
tgcttgtgttat

SEQ ID NO: 6516715 - DNA, 21 bp, Homo sapiens
tgcttgtgttgggccccaggg

SEQ ID NO: 6516716 - DNA, 20 bp, Homo sapiens
tgcttgttaatgctttctga

SEQ ID NO: 6516717 - DNA, 19 bp, Homo sapiens
tgcttgttagagagaaaga

SEQ ID NO: 6516718 - DNA, 19 bp, Homo sapiens
tgcttgttccctctccctg

SEQ ID NO: 6516719 - DNA, 20 bp, Homo sapiens
tgcttgttgaaaatatttct

SEQ ID NO: 6516720 - DNA, 20 bp, Homo sapiens
tgcttgttgtcaagtataaa

SEQ ID NO: 6516721 - DNA, 22 bp, Homo sapiens
tgcttgttgtttgttgacagct

SEQ ID NO: 6516722 - DNA, 19 bp, Homo sapiens
tgcttgtttactaagcatg

SEQ ID NO: 6516723 - DNA, 20 bp, Homo sapiens
tgcttgtttatgatatttct

SEQ ID NO: 6516724 - DNA, 21 bp, Homo sapiens
tgctttaaaaatgcaatatct

SEQ ID NO: 6516725 - DNA, 14 bp, Homo sapiens
tgctttaaaacaag

SEQ ID NO: 6516726 - DNA, 12 bp, Homo sapiens
tgctttaaacat

SEQ ID NO: 6516727 - DNA, 21 bp, Homo sapiens
tgctttaaagtacctgtagtg

SEQ ID NO: 6516728 - DNA, 23 bp, Homo sapiens
tgctttaaagtgtaataatatga

SEQ ID NO: 6516729 - DNA, 17 bp, Homo sapiens
tgctttaaatctatcta

SEQ ID NO: 6516730 - DNA, 17 bp, Homo sapiens
tgctttaaattaaaatt

SEQ ID NO: 6516731 - DNA, 23 bp, Homo sapiens
tgctttaagaaactgttactgtc

SEQ ID NO: 6516732 - DNA, 15 bp, Homo sapiens
tgctttaagaatgaa

SEQ ID NO: 6516733 - DNA, 15 bp, Homo sapiens
tgctttaagacagaa

SEQ ID NO: 6516734 - DNA, 13 bp, Homo sapiens
tgctttaatataa

SEQ ID NO: 6516735 - DNA, 14 bp, Homo sapiens
tgctttaatataaa

SEQ ID NO: 6516736 - DNA, 20 bp, Homo sapiens
tgctttaatataaatgcaaa

SEQ ID NO: 6516737 - DNA, 13 bp, Homo sapiens
tgctttaatatca

SEQ ID NO: 6516738 - DNA, 15 bp, Homo sapiens
tgctttaatatcatc

SEQ ID NO: 6516739 - DNA, 18 bp, Homo sapiens
tgctttaatatcatcagt

SEQ ID NO: 6516740 - DNA, 20 bp, Homo sapiens
tgctttaatatcatcagtat

SEQ ID NO: 6516741 - DNA, 20 bp, Homo sapiens
tgctttaatatgagcttcaa

SEQ ID NO: 6516742 - DNA, 23 bp, Homo sapiens
tgctttaatatgagcttcaatat

SEQ ID NO: 6516743 - DNA, 20 bp, Homo sapiens
tgctttaattgctttaaatc

SEQ ID NO: 6516744 - DNA, 20 bp, Homo sapiens
tgctttacaggatcatgtaa

SEQ ID NO: 6516745 - DNA, 17 bp, Homo sapiens
tgctttaccaaacagca

SEQ ID NO: 6516746 - DNA, 11 bp, Homo sapiens
tgctttactgg

SEQ ID NO: 6516747 - DNA, 15 bp, Homo sapiens
tgctttagaaaacat

SEQ ID NO: 6516748 - DNA, 15 bp, Homo sapiens
tgctttagacaaatt

SEQ ID NO: 6516749 - DNA, 20 bp, Homo sapiens
tgctttagagataattgctt

SEQ ID NO: 6516750 - DNA, 22 bp, Homo sapiens
tgctttagcttgaaaaggtgac

SEQ ID NO: 6516751 - DNA, 15 bp, Homo sapiens
tgctttaggattgaa

SEQ ID NO: 6516752 - DNA, 17 bp, Homo sapiens
tgctttaggattgaagt

SEQ ID NO: 6516753 - DNA, 23 bp, Homo sapiens
tgctttaggttgcttcagctgat

SEQ ID NO: 6516754 - DNA, 19 bp, Homo sapiens
tgctttagtacatggagct

SEQ ID NO: 6516755 - DNA, 12 bp, Homo sapiens
tgctttataaat

SEQ ID NO: 6516756 - DNA, 15 bp, Homo sapiens
tgctttatccacatt

SEQ ID NO: 6516757 - DNA, 13 bp, Homo sapiens
tgctttatgcaac

SEQ ID NO: 6516758 - DNA, 15 bp, Homo sapiens
tgctttatgccttct

SEQ ID NO: 6516759 - DNA, 13 bp, Homo sapiens
tgctttatgctga

SEQ ID NO: 6516760 - DNA, 17 bp, Homo sapiens
tgctttattaatgtttt

SEQ ID NO: 6516761 - DNA, 19 bp, Homo sapiens
tgctttattgaattagaaa

SEQ ID NO: 6516762 - DNA, 22 bp, Homo sapiens
tgctttattgaattagaaaatt

SEQ ID NO: 6516763 - DNA, 12 bp, Homo sapiens
tgctttattgcc

SEQ ID NO: 6516764 - DNA, 16 bp, Homo sapiens
tgctttattgcctctg

SEQ ID NO: 6516765 - DNA, 16 bp, Homo sapiens
tgctttattgcttttt

SEQ ID NO: 6516766 - DNA, 15 bp, Homo sapiens
tgctttatttatggc

SEQ ID NO: 6516767 - DNA, 23 bp, Homo sapiens
tgctttatttgtaaatttagtgt

SEQ ID NO: 6516768 - DNA, 18 bp, Homo sapiens
tgctttatttgtgaaact

SEQ ID NO: 6516769 - DNA, 15 bp, Homo sapiens
tgctttatttttcat

SEQ ID NO: 6516770 - DNA, 17 bp, Homo sapiens
tgctttcaacttaaatc

SEQ ID NO: 6516771 - DNA, 22 bp, Homo sapiens
tgctttcaacttaaatcactga

SEQ ID NO: 6516772 - DNA, 19 bp, Homo sapiens
tgctttcacaaatatagtt

SEQ ID NO: 6516773 - DNA, 16 bp, Homo sapiens
tgctttcagaagtgcc

SEQ ID NO: 6516774 - DNA, 23 bp, Homo sapiens
tgctttcagaagtgcccttcctg

SEQ ID NO: 6516775 - DNA, 20 bp, Homo sapiens
tgctttcagatgcagttttc

SEQ ID NO: 6516776 - DNA, 14 bp, Homo sapiens
tgctttcagtgcct

SEQ ID NO: 6516777 - DNA, 19 bp, Homo sapiens
tgctttcagtgcctgctgt

SEQ ID NO: 6516778 - DNA, 19 bp, Homo sapiens
tgctttcatccaactggaa

SEQ ID NO: 6516779 - DNA, 18 bp, Homo sapiens
tgctttcatgtttaagaa

SEQ ID NO: 6516780 - DNA, 16 bp, Homo sapiens
tgctttccaacacaca

SEQ ID NO: 6516781 - DNA, 12 bp, Homo sapiens
tgctttccaagc

SEQ ID NO: 6516782 - DNA, 20 bp, Homo sapiens
tgctttccagaataatatga

SEQ ID NO: 6516783 - DNA, 14 bp, Homo sapiens
tgctttccatattt

SEQ ID NO: 6516784 - DNA, 21 bp, Homo sapiens
tgctttccatatttttttcct

SEQ ID NO: 6516785 - DNA, 16 bp, Homo sapiens
tgctttcccatatctt

SEQ ID NO: 6516786 - DNA, 20 bp, Homo sapiens
tgctttcccctgtggggatc

SEQ ID NO: 6516787 - DNA, 12 bp, Homo sapiens
tgctttccctcc

SEQ ID NO: 6516788 - DNA, 16 bp, Homo sapiens
tgctttccctgaactg

SEQ ID NO: 6516789 - DNA, 18 bp, Homo sapiens
tgctttccctgaggaatg

SEQ ID NO: 6516790 - DNA, 17 bp, Homo sapiens
tgctttccgtggcactg

SEQ ID NO: 6516791 - DNA, 20 bp, Homo sapiens
tgctttccgtggcactgcat

SEQ ID NO: 6516792 - DNA, 21 bp, Homo sapiens
tgctttccgtggcactgcata

SEQ ID NO: 6516793 - DNA, 21 bp, Homo sapiens
tgctttcctaaagtctctgct

SEQ ID NO: 6516794 - DNA, 14 bp, Homo sapiens
tgctttcctccctg

SEQ ID NO: 6516795 - DNA, 16 bp, Homo sapiens
tgctttccttcatctc

SEQ ID NO: 6516796 - DNA, 23 bp, Homo sapiens
tgctttccttcggaatccagtgc

SEQ ID NO: 6516797 - DNA, 13 bp, Homo sapiens
tgctttcctttcc

SEQ ID NO: 6516798 - DNA, 20 bp, Homo sapiens
tgctttcctttctttactat

SEQ ID NO: 6516799 - DNA, 17 bp, Homo sapiens
tgctttcggagctcctg

SEQ ID NO: 6516800 - DNA, 15 bp, Homo sapiens
tgctttcgtagcccc

SEQ ID NO: 6516801 - DNA, 23 bp, Homo sapiens
tgctttcgtagcccctgctaagt

SEQ ID NO: 6516802 - DNA, 20 bp, Homo sapiens
tgctttcgtccatgtttctc

SEQ ID NO: 6516803 - DNA, 19 bp, Homo sapiens
tgctttctatgctgtttgt

SEQ ID NO: 6516804 - DNA, 21 bp, Homo sapiens
tgctttctattacccctcatt

SEQ ID NO: 6516805 - DNA, 13 bp, Homo sapiens
tgctttctattgt

SEQ ID NO: 6516806 - DNA, 18 bp, Homo sapiens
tgctttctccattgtaaa

SEQ ID NO: 6516807 - DNA, 17 bp, Homo sapiens
tgctttctcctcgttct

SEQ ID NO: 6516808 - DNA, 13 bp, Homo sapiens
tgctttctcctgg

SEQ ID NO: 6516809 - DNA, 23 bp, Homo sapiens
tgctttctcctttcaccaccccc

SEQ ID NO: 6516810 - DNA, 17 bp, Homo sapiens
tgctttctcgtgggtcc

SEQ ID NO: 6516811 - DNA, 15 bp, Homo sapiens
tgctttctctttcag

SEQ ID NO: 6516812 - DNA, 18 bp, Homo sapiens
tgctttctctttcagtat

SEQ ID NO: 6516813 - DNA, 12 bp, Homo sapiens
tgctttctgaaa

SEQ ID NO: 6516814 - DNA, 13 bp, Homo sapiens
tgctttctgaaat

SEQ ID NO: 6516815 - DNA, 23 bp, Homo sapiens
tgctttctgaaattcacagaagc

SEQ ID NO: 6516816 - DNA, 15 bp, Homo sapiens
tgctttctgaatgta

SEQ ID NO: 6516817 - DNA, 13 bp, Homo sapiens
tgctttctgactg

SEQ ID NO: 6516818 - DNA, 14 bp, Homo sapiens
tgctttctgactga

SEQ ID NO: 6516819 - DNA, 16 bp, Homo sapiens
tgctttctgcatgctt

SEQ ID NO: 6516820 - DNA, 15 bp, Homo sapiens
tgctttctgcctctc

SEQ ID NO: 6516821 - DNA, 13 bp, Homo sapiens
tgctttctgctca

SEQ ID NO: 6516822 - DNA, 18 bp, Homo sapiens
tgctttctgctctttaca

SEQ ID NO: 6516823 - DNA, 19 bp, Homo sapiens
tgctttctggtataaagct

SEQ ID NO: 6516824 - DNA, 14 bp, Homo sapiens
tgctttctgtgaaa

SEQ ID NO: 6516825 - DNA, 15 bp, Homo sapiens
tgctttctgtgaaag

SEQ ID NO: 6516826 - DNA, 16 bp, Homo sapiens
tgctttctgtgaaagc

SEQ ID NO: 6516827 - DNA, 14 bp, Homo sapiens
tgctttctgttcat

SEQ ID NO: 6516828 - DNA, 14 bp, Homo sapiens
tgctttctgttcca

SEQ ID NO: 6516829 - DNA, 15 bp, Homo sapiens
tgctttctgttccaa

SEQ ID NO: 6516830 - DNA, 15 bp, Homo sapiens
tgctttcttcctgca

SEQ ID NO: 6516831 - DNA, 12 bp, Homo sapiens
tgctttcttctc

SEQ ID NO: 6516832 - DNA, 15 bp, Homo sapiens
tgctttcttctctgc

SEQ ID NO: 6516833 - DNA, 16 bp, Homo sapiens
tgctttcttctttcct

SEQ ID NO: 6516834 - DNA, 13 bp, Homo sapiens
tgctttcttgtct

SEQ ID NO: 6516835 - DNA, 20 bp, Homo sapiens
tgctttctttagaattttta

SEQ ID NO: 6516836 - DNA, 12 bp, Homo sapiens
tgctttgaaaaa

SEQ ID NO: 6516837 - DNA, 17 bp, Homo sapiens
tgctttgaaaaatctca

SEQ ID NO: 6516838 - DNA, 14 bp, Homo sapiens
tgctttgaaaatgt

SEQ ID NO: 6516839 - DNA, 16 bp, Homo sapiens
tgctttgaaacagaaa

SEQ ID NO: 6516840 - DNA, 20 bp, Homo sapiens
tgctttgaaactagacttga

SEQ ID NO: 6516841 - DNA, 23 bp, Homo sapiens
tgctttgaaattgaacctttgtg

SEQ ID NO: 6516842 - DNA, 13 bp, Homo sapiens
tgctttgaacttt

SEQ ID NO: 6516843 - DNA, 20 bp, Homo sapiens
tgctttgacgggccaggccc

SEQ ID NO: 6516844 - DNA, 22 bp, Homo sapiens
tgctttgacgggccaggccctg

SEQ ID NO: 6516845 - DNA, 20 bp, Homo sapiens
tgctttgactgagcagactg

SEQ ID NO: 6516846 - DNA, 22 bp, Homo sapiens
tgctttgactgagcagactggt

SEQ ID NO: 6516847 - DNA, 23 bp, Homo sapiens
tgctttgagaccagaagaaaaga

SEQ ID NO: 6516848 - DNA, 15 bp, Homo sapiens
tgctttgagaccttt

SEQ ID NO: 6516849 - DNA, 19 bp, Homo sapiens
tgctttgagactcctcagc

SEQ ID NO: 6516850 - DNA, 21 bp, Homo sapiens
tgctttgagcccacaggagct

SEQ ID NO: 6516851 - DNA, 21 bp, Homo sapiens
tgctttgataaaatattttaa

SEQ ID NO: 6516852 - DNA, 22 bp, Homo sapiens
tgctttgatttacagcaagtag

SEQ ID NO: 6516853 - DNA, 16 bp, Homo sapiens
tgctttgcattttgat

SEQ ID NO: 6516854 - DNA, 17 bp, Homo sapiens
tgctttgccaaaatacc

SEQ ID NO: 6516855 - DNA, 20 bp, Homo sapiens
tgctttgccaagttgctgtc

SEQ ID NO: 6516856 - DNA, 16 bp, Homo sapiens
tgttttatttatcaaa

SEQ ID NO: 6516857 - DNA, 16 bp, Homo sapiens
tgttttatttcattgg

SEQ ID NO: 6516858 - DNA, 16 bp, Homo sapiens
tgttttattttaatag

SEQ ID NO: 6516859 - DNA, 21 bp, Homo sapiens
tgttttattttcaaaaccagg

SEQ ID NO: 6516860 - DNA, 18 bp, Homo sapiens
tgttttattttttattgt

SEQ ID NO: 6516861 - DNA, 23 bp, Homo sapiens
tgttttcaaaccagtatacaaga

SEQ ID NO: 6516862 - DNA, 18 bp, Homo sapiens
tgttttcaaagggacttt

SEQ ID NO: 6516863 - DNA, 14 bp, Homo sapiens
tgttttcaaatgga

SEQ ID NO: 6516864 - DNA, 13 bp, Homo sapiens
tgttttcaaatgt

SEQ ID NO: 6516865 - DNA, 22 bp, Homo sapiens
tgttttcaagcacaacccacca

SEQ ID NO: 6516866 - DNA, 20 bp, Homo sapiens
tgttttcaaggaagaaaacg

SEQ ID NO: 6516867 - DNA, 21 bp, Homo sapiens
tgttttcaatgtgttggaaac

SEQ ID NO: 6516868 - DNA, 16 bp, Homo sapiens
tgttttcacttgtatt

SEQ ID NO: 6516869 - DNA, 17 bp, Homo sapiens
tgttttcatattgcttc

SEQ ID NO: 6516870 - DNA, 14 bp, Homo sapiens
tgttttcatcattt

SEQ ID NO: 6516871 - DNA, 17 bp, Homo sapiens
tgttttcatcatttcag

SEQ ID NO: 6516872 - DNA, 20 bp, Homo sapiens
tgttttcatggacagctgag

SEQ ID NO: 6516873 - DNA, 20 bp, Homo sapiens
tgttttcatgtaaataaata

SEQ ID NO: 6516874 - DNA, 17 bp, Homo sapiens
tgttttcattccccctt

SEQ ID NO: 6516875 - DNA, 20 bp, Homo sapiens
tgttttcattcccccttcct

SEQ ID NO: 6516876 - DNA, 23 bp, Homo sapiens
tgttttcattcccccttcctagt

SEQ ID NO: 6516877 - DNA, 16 bp, Homo sapiens
tgttttcatttgtata

SEQ ID NO: 6516878 - DNA, 12 bp, Homo sapiens
tgttttcatttt

SEQ ID NO: 6516879 - DNA, 13 bp, Homo sapiens
tgttttcatttta

SEQ ID NO: 6516880 - DNA, 19 bp, Homo sapiens
tgttttcattttagacatt

SEQ ID NO: 6516881 - DNA, 11 bp, Homo sapiens
tgttttccaca

SEQ ID NO: 6516882 - DNA, 12 bp, Homo sapiens
tgttttccacac

SEQ ID NO: 6516883 - DNA, 15 bp, Homo sapiens
tgttttccactgtgc

SEQ ID NO: 6516884 - DNA, 15 bp, Homo sapiens
tgttttccagctcct

SEQ ID NO: 6516885 - DNA, 19 bp, Homo sapiens
tgttttcccaacctcctgt

SEQ ID NO: 6516886 - DNA, 17 bp, Homo sapiens
tgttttcccacacatat

SEQ ID NO: 6516887 - DNA, 19 bp, Homo sapiens
tgttttcccctaattttcc

SEQ ID NO: 6516888 - DNA, 22 bp, Homo sapiens
tgttttcccgagcaaagtctaa

SEQ ID NO: 6516889 - DNA, 19 bp, Homo sapiens
tgttttccctctgctgctt

SEQ ID NO: 6516890 - DNA, 12 bp, Homo sapiens
tgttttccctga

SEQ ID NO: 6516891 - DNA, 16 bp, Homo sapiens
tgttttccgtgaaaac

SEQ ID NO: 6516892 - DNA, 14 bp, Homo sapiens
tgttttccttcaca

SEQ ID NO: 6516893 - DNA, 16 bp, Homo sapiens
tgttttcgatgatgat

SEQ ID NO: 6516894 - DNA, 23 bp, Homo sapiens
tgttttctaaagttgttcacata

SEQ ID NO: 6516895 - DNA, 23 bp, Homo sapiens
tgttttctaatctctttattaaa

SEQ ID NO: 6516896 - DNA, 14 bp, Homo sapiens
tgttttctagtgta

SEQ ID NO: 6516897 - DNA, 16 bp, Homo sapiens
tgttttctatatgaac

SEQ ID NO: 6516898 - DNA, 17 bp, Homo sapiens
tgttttctgaaacacac

SEQ ID NO: 6516899 - DNA, 12 bp, Homo sapiens
tgttttctgaat

SEQ ID NO: 6516900 - DNA, 17 bp, Homo sapiens
tgttttctgactaatta

SEQ ID NO: 6516901 - DNA, 23 bp, Homo sapiens
tgttttctgagcccgggctgcct

SEQ ID NO: 6516902 - DNA, 17 bp, Homo sapiens
tgttttctgatgacata

SEQ ID NO: 6516903 - DNA, 20 bp, Homo sapiens
tgttttctgatgacataata

SEQ ID NO: 6516904 - DNA, 18 bp, Homo sapiens
tgttttctgatggccaaa

SEQ ID NO: 6516905 - DNA, 14 bp, Homo sapiens
tgttttctgcttta

SEQ ID NO: 6516906 - DNA, 17 bp, Homo sapiens
tgttttctgtaaataac

SEQ ID NO: 6516907 - DNA, 14 bp, Homo sapiens
tgttttctgtgcac

SEQ ID NO: 6516908 - DNA, 12 bp, Homo sapiens
tgttttctgtgt

SEQ ID NO: 6516909 - DNA, 20 bp, Homo sapiens
tgttttctgtttgtaaatta

SEQ ID NO: 6516910 - DNA, 12 bp, Homo sapiens
tgttttcttcaa

SEQ ID NO: 6516911 - DNA, 23 bp, Homo sapiens
tgttttcttcttcagtgaagcag

SEQ ID NO: 6516912 - DNA, 17 bp, Homo sapiens
tgttttcttgtaaatgt

SEQ ID NO: 6516913 - DNA, 21 bp, Homo sapiens
tgttttcttgtaaatgtttct

SEQ ID NO: 6516914 - DNA, 22 bp, Homo sapiens
tgttttcttgtaaatgtttctt

SEQ ID NO: 6516915 - DNA, 21 bp, Homo sapiens
tgttttctttctttaaatgtt

SEQ ID NO: 6516916 - DNA, 20 bp, Homo sapiens
tgttttctttgtttctttgt

SEQ ID NO: 6516917 - DNA, 20 bp, Homo sapiens
tgttttgaaaagtttcctag

SEQ ID NO: 6516918 - DNA, 12 bp, Homo sapiens
tgttttgaaact

SEQ ID NO: 6516919 - DNA, 22 bp, Homo sapiens
tgttttgaaatcaatgcaagag

SEQ ID NO: 6516920 - DNA, 18 bp, Homo sapiens
tgttttgaccagtttaag

SEQ ID NO: 6516921 - DNA, 12 bp, Homo sapiens
tgttttgagaaa

SEQ ID NO: 6516922 - DNA, 14 bp, Homo sapiens
tgttttgagaaaaa

SEQ ID NO: 6516923 - DNA, 13 bp, Homo sapiens
tgttttgagacat

SEQ ID NO: 6516924 - DNA, 16 bp, Homo sapiens
tgttttgagagtaatg

SEQ ID NO: 6516925 - DNA, 13 bp, Homo sapiens
tgttttgaggaat

SEQ ID NO: 6516926 - DNA, 22 bp, Homo sapiens
tgttttgaggaattcagaagtg

SEQ ID NO: 6516927 - DNA, 12 bp, Homo sapiens
tgttttgataaa

SEQ ID NO: 6516928 - DNA, 18 bp, Homo sapiens
tgttttgataaagtagta

SEQ ID NO: 6516929 - DNA, 15 bp, Homo sapiens
tgttttgatgataaa

SEQ ID NO: 6516930 - DNA, 20 bp, Homo sapiens
tgttttgatgtttgtggcct

SEQ ID NO: 6516931 - DNA, 20 bp, Homo sapiens
tgttttgcaaaggaaaataa

SEQ ID NO: 6516932 - DNA, 20 bp, Homo sapiens
tgttttgcacgtcttgctat

SEQ ID NO: 6516933 - DNA, 13 bp, Homo sapiens
tgttttgcactga

SEQ ID NO: 6516934 - DNA, 14 bp, Homo sapiens
tgttttgcactgac

SEQ ID NO: 6516935 - DNA, 18 bp, Homo sapiens
tgttttgcacttctgtaa

SEQ ID NO: 6516936 - DNA, 20 bp, Homo sapiens
tgttttgcacttctgtaaac

SEQ ID NO: 6516937 - DNA, 15 bp, Homo sapiens
tgttttgcattgtct

SEQ ID NO: 6516938 - DNA, 16 bp, Homo sapiens
tgttttgccaacattg

SEQ ID NO: 6516939 - DNA, 17 bp, Homo sapiens
tgttttgccaatttgca

SEQ ID NO: 6516940 - DNA, 22 bp, Homo sapiens
tgttttgccaatttgcacatta

SEQ ID NO: 6516941 - DNA, 16 bp, Homo sapiens
tgttttgccagcccat

SEQ ID NO: 6516942 - DNA, 17 bp, Homo sapiens
tgttttgccagcccatt

SEQ ID NO: 6516943 - DNA, 15 bp, Homo sapiens
tgttttgctaatgct

SEQ ID NO: 6516944 - DNA, 23 bp, Homo sapiens
tgttttgcttaaactaatgaaca

SEQ ID NO: 6516945 - DNA, 12 bp, Homo sapiens
tgttttgcttac

SEQ ID NO: 6516946 - DNA, 15 bp, Homo sapiens
tgttttgcttttgtt

SEQ ID NO: 6516947 - DNA, 18 bp, Homo sapiens
tgttttgctttttctgac

SEQ ID NO: 6516948 - DNA, 20 bp, Homo sapiens
tgttttgctttttctgactc

SEQ ID NO: 6516949 - DNA, 19 bp, Homo sapiens
tgttttggactttgttaca

SEQ ID NO: 6516950 - DNA, 14 bp, Homo sapiens
tgttttggagaaaa

SEQ ID NO: 6516951 - DNA, 16 bp, Homo sapiens
tgttttggattcttta

SEQ ID NO: 6516952 - DNA, 23 bp, Homo sapiens
tgttttggctgaaattctcctgg

SEQ ID NO: 6516953 - DNA, 17 bp, Homo sapiens
tgttttggctgctctcc

SEQ ID NO: 6516954 - DNA, 20 bp, Homo sapiens
tgttttgggatcaggagccc

SEQ ID NO: 6516955 - DNA, 24 bp, Homo sapiens
tgttttggggctttcccaggagaa

SEQ ID NO: 6516956 - DNA, 19 bp, Homo sapiens
tgttttggtagattaaata

SEQ ID NO: 6516957 - DNA, 19 bp, Homo sapiens
tgttttggtcccctccctc

SEQ ID NO: 6516958 - DNA, 20 bp, Homo sapiens
tgttttggtctgaaaagctg

SEQ ID NO: 6516959 - DNA, 15 bp, Homo sapiens
tgttttggttaataa

SEQ ID NO: 6516960 - DNA, 17 bp, Homo sapiens
tgttttgtacaattact

SEQ ID NO: 6516961 - DNA, 13 bp, Homo sapiens
tgttttgtaccag

SEQ ID NO: 6516962 - DNA, 19 bp, Homo sapiens
tgttttgtagcaaccattt

SEQ ID NO: 6516963 - DNA, 15 bp, Homo sapiens
tgttttgtataaaat

SEQ ID NO: 6516964 - DNA, 22 bp, Homo sapiens
tgttttgtatacaaatatattg

SEQ ID NO: 6516965 - DNA, 18 bp, Homo sapiens
tgttttgtatatacagtt

SEQ ID NO: 6516966 - DNA, 20 bp, Homo sapiens
tgttttgtatatacagttat

SEQ ID NO: 6516967 - DNA, 15 bp, Homo sapiens
tgttttgtatatgat

SEQ ID NO: 6516968 - DNA, 13 bp, Homo sapiens
tgttttgtatgag

SEQ ID NO: 6516969 - DNA, 23 bp, Homo sapiens
tgttttgtcctgcctcttgtttc

SEQ ID NO: 6516970 - DNA, 13 bp, Homo sapiens
tgttttgtgactt

SEQ ID NO: 6516971 - DNA, 18 bp, Homo sapiens
tgttttgtggataagaaa

SEQ ID NO: 6516972 - DNA, 22 bp, Homo sapiens
tgttttgtgtctggtgcagaat

SEQ ID NO: 6516973 - DNA, 16 bp, Homo sapiens
tgttttgtgtgtaagg

SEQ ID NO: 6516974 - DNA, 12 bp, Homo sapiens
tgttttgttaat

SEQ ID NO: 6516975 - DNA, 11 bp, Homo sapiens
tgttttgttct

SEQ ID NO: 6516976 - DNA, 18 bp, Homo sapiens
tgttttgttgcactgaag

SEQ ID NO: 6516977 - DNA, 14 bp, Homo sapiens
tgttttgttggccc

SEQ ID NO: 6516978 - DNA, 16 bp, Homo sapiens
tgttttgttgtttgat

SEQ ID NO: 6516979 - DNA, 14 bp, Homo sapiens
tgttttgtttatta

SEQ ID NO: 6516980 - DNA, 16 bp, Homo sapiens
tgttttgtttcttgac

SEQ ID NO: 6516981 - DNA, 19 bp, Homo sapiens
tgttttgtttggttttaca

SEQ ID NO: 6516982 - DNA, 13 bp, Homo sapiens
tgttttgtttgtc

SEQ ID NO: 6516983 - DNA, 23 bp, Homo sapiens
tgttttgtttgtctctccttttc

SEQ ID NO: 6516984 - DNA, 13 bp, Homo sapiens
tgttttgttttaa

SEQ ID NO: 6516985 - DNA, 17 bp, Homo sapiens
tgttttgttttaatctt

SEQ ID NO: 6516986 - DNA, 18 bp, Homo sapiens
tgttttgttttggactct

SEQ ID NO: 6516987 - DNA, 16 bp, Homo sapiens
tgttttgtttttttga

SEQ ID NO: 6516988 - DNA, 15 bp, Homo sapiens
tgtttttaaaaacct

SEQ ID NO: 6516989 - DNA, 18 bp, Homo sapiens
tgtttttaaaaagaaaat

SEQ ID NO: 6516990 - DNA, 16 bp, Homo sapiens
tgtttttaaaaatcat

SEQ ID NO: 6516991 - DNA, 20 bp, Homo sapiens
tgtttttaaaaatcataaac

SEQ ID NO: 6516992 - DNA, 19 bp, Homo sapiens
tgtttttaaaagtttcaat

SEQ ID NO: 6516993 - DNA, 16 bp, Homo sapiens
tgtttttaaaatctta

SEQ ID NO: 6516994 - DNA, 21 bp, Homo sapiens
tgtttttaaaatcttattaaa

SEQ ID NO: 6516995 - DNA, 15 bp, Homo sapiens
tgtttttaaactgta

SEQ ID NO: 6516996 - DNA, 13 bp, Homo sapiens
tgtttttaaagtg

SEQ ID NO: 6516997 - DNA, 19 bp, Homo sapiens
tgtttttaaagtgtacatt

SEQ ID NO: 6516998 - DNA, 23 bp, Homo sapiens
tgtttttaagaaaaacatgtcat

SEQ ID NO: 6516999 - DNA, 15 bp, Homo sapiens
tgtttttaagctgtt

SEQ ID NO: 6517000 - DNA, 19 bp, Homo sapiens
tgtttttaagtaacttaag

SEQ ID NO: 6517001 - DNA, 16 bp, Homo sapiens
tgtttttaagtttgca

SEQ ID NO: 6517002 - DNA, 13 bp, Homo sapiens
tgtttttaatgac

SEQ ID NO: 6517003 - DNA, 14 bp, Homo sapiens
tgtttttacagagg

SEQ ID NO: 6517004 - DNA, 12 bp, Homo sapiens
tgtttttacata

SEQ ID NO: 6517005 - DNA, 20 bp, Homo sapiens
tgtttttacattatgcaaat

SEQ ID NO: 6517006 - DNA, 13 bp, Homo sapiens
tgtttttacccat

SEQ ID NO: 6517007 - DNA, 22 bp, Homo sapiens
tgtttttacccatatcccctct

SEQ ID NO: 6517008 - DNA, 11 bp, Homo sapiens
tgtttttactg

SEQ ID NO: 6517009 - DNA, 13 bp, Homo sapiens
tgtttttactgaa

SEQ ID NO: 6517010 - DNA, 13 bp, Homo sapiens
tgtttttactgtc

SEQ ID NO: 6517011 - DNA, 22 bp, Homo sapiens
tgtttttagagcttccaaatgt

SEQ ID NO: 6517012 - DNA, 20 bp, Homo sapiens
tgtttttagttctgactttg

SEQ ID NO: 6517013 - DNA, 17 bp, Homo sapiens
tgtttttataaaaacat

SEQ ID NO: 6517014 - DNA, 21 bp, Homo sapiens
tgtttttatacaaaataagaa

SEQ ID NO: 6517015 - DNA, 21 bp, Homo sapiens
tgtttttatatttctgttaaa

SEQ ID NO: 6517016 - DNA, 16 bp, Homo sapiens
tgtttttatcttttta

SEQ ID NO: 6517017 - DNA, 18 bp, Homo sapiens
tgtttttattattaacaa

SEQ ID NO: 6517018 - DNA, 14 bp, Homo sapiens
tgtttttatttcaa

SEQ ID NO: 6517019 - DNA, 15 bp, Homo sapiens
tgtttttatttcaat

SEQ ID NO: 6517020 - DNA, 14 bp, Homo sapiens
tgtttttatttcct

SEQ ID NO: 6517021 - DNA, 13 bp, Homo sapiens
tgtttttcacatt

SEQ ID NO: 6517022 - DNA, 13 bp, Homo sapiens
tgtttttcagttc

SEQ ID NO: 6517023 - DNA, 15 bp, Homo sapiens
tgtttttcagttcaa

SEQ ID NO: 6517024 - DNA, 17 bp, Homo sapiens
tgtttttcagttcaaag

SEQ ID NO: 6517025 - DNA, 13 bp, Homo sapiens
tgtttttcatgaa

SEQ ID NO: 6517026 - DNA, 15 bp, Homo sapiens
tgtttttcatgtttt

SEQ ID NO: 6517027 - DNA, 20 bp, Homo sapiens
tgtttttcatgttttagcat

SEQ ID NO: 6517028 - DNA, 21 bp, Homo sapiens
tgtttttcatgttttagcatt

SEQ ID NO: 6517029 - DNA, 11 bp, Homo sapiens
tgtttttcatt

SEQ ID NO: 6517030 - DNA, 17 bp, Homo sapiens
tgtttttccagttccag

SEQ ID NO: 6517031 - DNA, 13 bp, Homo sapiens
tgtttttccctaa

SEQ ID NO: 6517032 - DNA, 13 bp, Homo sapiens
tgtttttctatta

SEQ ID NO: 6517033 - DNA, 14 bp, Homo sapiens
tgtttttctattaa

SEQ ID NO: 6517034 - DNA, 16 bp, Homo sapiens
tgtttttctattaaaa

SEQ ID NO: 6517035 - DNA, 13 bp, Homo sapiens
tgtttttctcaaa

SEQ ID NO: 6517036 - DNA, 15 bp, Homo sapiens
tgtttttctcaaata

SEQ ID NO: 6517037 - DNA, 12 bp, Homo sapiens
tgtttttctcca

SEQ ID NO: 6517038 - DNA, 11 bp, Homo sapiens
tgtttttctct

SEQ ID NO: 6517039 - DNA, 15 bp, Homo sapiens
tgtttttctctctgg

SEQ ID NO: 6517040 - DNA, 22 bp, Homo sapiens
tgtttttctcttttcacagcaa

SEQ ID NO: 6517041 - DNA, 14 bp, Homo sapiens
tgtttttctgcttt

SEQ ID NO: 6517042 - DNA, 15 bp, Homo sapiens
tgtttttctgcttta

SEQ ID NO: 6517043 - DNA, 18 bp, Homo sapiens
tgtttttctgctttagac

SEQ ID NO: 6517044 - DNA, 12 bp, Homo sapiens
tgtttttcttca

SEQ ID NO: 6517045 - DNA, 14 bp, Homo sapiens
tgtttttcttcagc

SEQ ID NO: 6517046 - DNA, 15 bp, Homo sapiens
tgtttttcttcagca

SEQ ID NO: 6517047 - DNA, 20 bp, Homo sapiens
tgtttttgaaacccacagtt

SEQ ID NO: 6517048 - DNA, 19 bp, Homo sapiens
tgtttttgcactgtctgta

SEQ ID NO: 6517049 - DNA, 16 bp, Homo sapiens
tgtttttgcatgaaat

SEQ ID NO: 6517050 - DNA, 15 bp, Homo sapiens
tgtttttgcattttt

SEQ ID NO: 6517051 - DNA, 16 bp, Homo sapiens
tgtttttgccactgat

SEQ ID NO: 6517052 - DNA, 23 bp, Homo sapiens
tgtttttgcgtgggagtgtgtgc

SEQ ID NO: 6517053 - DNA, 19 bp, Homo sapiens
tgtttttgctattacatgt

SEQ ID NO: 6517054 - DNA, 14 bp, Homo sapiens
tgtttttgctttct

SEQ ID NO: 6517055 - DNA, 17 bp, Homo sapiens
tgtttttgctttctgaa

SEQ ID NO: 6517056 - DNA, 16 bp, Homo sapiens
tgtttttggaaagaaa

SEQ ID NO: 6517057 - DNA, 17 bp, Homo sapiens
tgtttttggatggctta

SEQ ID NO: 6517058 - DNA, 10 bp, Homo sapiens
tgtttttggg

SEQ ID NO: 6517059 - DNA, 17 bp, Homo sapiens
tgtttttgggatgtctt

SEQ ID NO: 6517060 - DNA, 20 bp, Homo sapiens
tgtttttggttttctccttc

SEQ ID NO: 6517061 - DNA, 14 bp, Homo sapiens
tgtttttgtaaaga

SEQ ID NO: 6517062 - DNA, 17 bp, Homo sapiens
tgtttttgtaatgcact

SEQ ID NO: 6517063 - DNA, 14 bp, Homo sapiens
tgtttttgtatatt

SEQ ID NO: 6517064 - DNA, 12 bp, Homo sapiens
tgtttttgtatc

SEQ ID NO: 6517065 - DNA, 16 bp, Homo sapiens
tgtttttgtatcttta

SEQ ID NO: 6517066 - DNA, 14 bp, Homo sapiens
tgtttttgtgtaga

SEQ ID NO: 6517067 - DNA, 14 bp, Homo sapiens
tgtttttgttgtgt

SEQ ID NO: 6517068 - DNA, 18 bp, Homo sapiens
tgtttttgttttgttgca

SEQ ID NO: 6517069 - DNA, 15 bp, Homo sapiens
tgttttttaaagcaa

SEQ ID NO: 6517070 - DNA, 14 bp, Homo sapiens
tgttttttaagata

SEQ ID NO: 6517071 - DNA, 22 bp, Homo sapiens
tgttttttaattctctgttcct

SEQ ID NO: 6517072 - DNA, 21 bp, Homo sapiens
tgttttttaatttaaaaaaag

SEQ ID NO: 6517073 - DNA, 20 bp, Homo sapiens
tgttttttacttttttacac

SEQ ID NO: 6517074 - DNA, 13 bp, Homo sapiens
tgttttttagaac

SEQ ID NO: 6517075 - DNA, 19 bp, Homo sapiens
tgttttttaggaaaagcat

SEQ ID NO: 6517076 - DNA, 16 bp, Homo sapiens
tgttttttcaaaatag

SEQ ID NO: 6517077 - DNA, 18 bp, Homo sapiens
tgttttttcaagaaaatt

SEQ ID NO: 6517078 - DNA, 13 bp, Homo sapiens
tgttttttcatgc

SEQ ID NO: 6517079 - DNA, 17 bp, Homo sapiens
tgttttttcctgagctt

SEQ ID NO: 6517080 - DNA, 23 bp, Homo sapiens
tgttttttcggacatgcttttct

SEQ ID NO: 6517081 - DNA, 12 bp, Homo sapiens
tgttttttctaa

SEQ ID NO: 6517082 - DNA, 13 bp, Homo sapiens
tgttttttctgca

SEQ ID NO: 6517083 - DNA, 15 bp, Homo sapiens
tgttttttctgccac

SEQ ID NO: 6517084 - DNA, 15 bp, Homo sapiens
tgttttttgccacag

SEQ ID NO: 6517085 - DNA, 19 bp, Homo sapiens
tgttttttgccacagcttt

SEQ ID NO: 6517086 - DNA, 18 bp, Homo sapiens
tgttttttgtaactacaa

SEQ ID NO: 6517087 - DNA, 19 bp, Homo sapiens
tgttttttgttactgtttt

SEQ ID NO: 6517088 - DNA, 22 bp, Homo sapiens
tgtttttttccctctcctgtcc

SEQ ID NO: 6517089 - DNA, 22 bp, Homo sapiens
tgtttttttcctcatgtaacat

SEQ ID NO: 6517090 - DNA, 14 bp, Homo sapiens
tgtttttttctaaa

SEQ ID NO: 6517091 - DNA, 14 bp, Homo sapiens
tgtttttttgagat

SEQ ID NO: 6517092 - DNA, 15 bp, Homo sapiens
tgtttttttgtttgt

SEQ ID NO: 6517093 - DNA, 15 bp, Homo sapiens
tgttttttttccttt

SEQ ID NO: 6517094 - DNA, 18 bp, Homo sapiens
tgtttttttttttgagat

SEQ ID NO: 6517095 - DNA, 19 bp, Homo sapiens
tgttttttttttttgtatt

SEQ ID NO: 6517096 - DNA, 21 bp, Homo sapiens
tgttttttttttttgtatttc

SEQ ID NO: 6517097 - DNA, 21 bp, Homo sapiens
tgtttttttttttttaaataa

SEQ ID NO: 6517098 - DNA, 22 bp, Homo sapiens
ttaaaaaaaaaaaaaaaagact

SEQ ID NO: 6517099 - DNA, 22 bp, Homo sapiens
ttaaaaaaaaaaaaaagcttta

SEQ ID NO: 6517100 - DNA, 20 bp, Homo sapiens
ttaaaaaaaaaaaaaggaaa

SEQ ID NO: 6517101 - DNA, 21 bp, Homo sapiens
ttaaaaaaaaaaaaaggaaaa

SEQ ID NO: 6517102 - DNA, 19 bp, Homo sapiens
ttaaaaaaaaaaaactaga

SEQ ID NO: 6517103 - DNA, 17 bp, Homo sapiens
ttaaaaaaaaaaaatca

SEQ ID NO: 6517104 - DNA, 16 bp, Homo sapiens
ttaaaaaaaaaaatga

SEQ ID NO: 6517105 - DNA, 23 bp, Homo sapiens
ttaaaaaaaaaagcctgtattta

SEQ ID NO: 6517106 - DNA, 15 bp, Homo sapiens
ttaaaaaaaaaagtc

SEQ ID NO: 6517107 - DNA, 21 bp, Homo sapiens
ttaaaaaaaaaagtcaccaaa

SEQ ID NO: 6517108 - DNA, 16 bp, Homo sapiens
ttaaaaaaaaacacaa

SEQ ID NO: 6517109 - DNA, 22 bp, Homo sapiens
ttaaaaaaaaagtcagagacag

SEQ ID NO: 6517110 - DNA, 22 bp, Homo sapiens
ttaaaaaaaaagttggtatttt

SEQ ID NO: 6517111 - DNA, 20 bp, Homo sapiens
ttaaaaaaaaatcttgtgtt

SEQ ID NO: 6517112 - DNA, 19 bp, Homo sapiens
ttaaaaaaaaattgtatct

SEQ ID NO: 6517113 - DNA, 21 bp, Homo sapiens
ttaaaaaaaacaaaaagaaca

SEQ ID NO: 6517114 - DNA, 17 bp, Homo sapiens
ttaaaaaaaactcttta

SEQ ID NO: 6517115 - DNA, 13 bp, Homo sapiens
ttaaaaaaaagaa

SEQ ID NO: 6517116 - DNA, 16 bp, Homo sapiens
ttaaaaaaaagaaact

SEQ ID NO: 6517117 - DNA, 12 bp, Homo sapiens
ttaaaaaaaata

SEQ ID NO: 6517118 - DNA, 17 bp, Homo sapiens
ttaaaaaaaataataaa

SEQ ID NO: 6517119 - DNA, 19 bp, Homo sapiens
ttaaaaaaaataataaatt

SEQ ID NO: 6517120 - DNA, 20 bp, Homo sapiens
ttaaaaaaaatattctgtca

SEQ ID NO: 6517121 - DNA, 19 bp, Homo sapiens
ttaaaaaaaatccttctaa

SEQ ID NO: 6517122 - DNA, 20 bp, Homo sapiens
ttaaaaaaaatccttctaat

SEQ ID NO: 6517123 - DNA, 17 bp, Homo sapiens
ttaaaaaaaatgtgaaa

SEQ ID NO: 6517124 - DNA, 19 bp, Homo sapiens
ttaaaaaaaatttgctcat

SEQ ID NO: 6517125 - DNA, 19 bp, Homo sapiens
ttaaaaaaaatttgtgtgc

SEQ ID NO: 6517126 - DNA, 13 bp, Homo sapiens
ttaaaaaaacaca

SEQ ID NO: 6517127 - DNA, 14 bp, Homo sapiens
ttaaaaaaactgaa

SEQ ID NO: 6517128 - DNA, 12 bp, Homo sapiens
ttaaaaaaagaa

SEQ ID NO: 6517129 - DNA, 23 bp, Homo sapiens
ttaaaaaaataaaacagtatctc

SEQ ID NO: 6517130 - DNA, 17 bp, Homo sapiens
ttaaaaaaataaaacat

SEQ ID NO: 6517131 - DNA, 20 bp, Homo sapiens
ttaaaaaaattggttggaga

SEQ ID NO: 6517132 - DNA, 19 bp, Homo sapiens
ttaaaaaaatttttgcaaa

SEQ ID NO: 6517133 - DNA, 20 bp, Homo sapiens
ttaaaaaaatttttgcaaat

SEQ ID NO: 6517134 - DNA, 21 bp, Homo sapiens
ttaaaaaacaaaaaaagacaa

SEQ ID NO: 6517135 - DNA, 12 bp, Homo sapiens
ttaaaaaacagc

SEQ ID NO: 6517136 - DNA, 15 bp, Homo sapiens
ttaaaaaactctttg

SEQ ID NO: 6517137 - DNA, 20 bp, Homo sapiens
ttaaaaaacttcatgtaatt

SEQ ID NO: 6517138 - DNA, 13 bp, Homo sapiens
ttaaaaaacttgt

SEQ ID NO: 6517139 - DNA, 16 bp, Homo sapiens
ttaaaaaagaaagatt

SEQ ID NO: 6517140 - DNA, 21 bp, Homo sapiens
ttaaaaaagaaagattttatg

SEQ ID NO: 6517141 - DNA, 19 bp, Homo sapiens
ttaaaaaagactgaacatg

SEQ ID NO: 6517142 - DNA, 12 bp, Homo sapiens
ttaaaaaagata

SEQ ID NO: 6517143 - DNA, 21 bp, Homo sapiens
ttaaaaaagataaacacaaga

SEQ ID NO: 6517144 - DNA, 20 bp, Homo sapiens
ttaaaaaagatggatttgac

SEQ ID NO: 6517145 - DNA, 10 bp, Homo sapiens
ttaaaaaagc

SEQ ID NO: 6517146 - DNA, 19 bp, Homo sapiens
ttaaaaaagcttaaaactt

SEQ ID NO: 6517147 - DNA, 12 bp, Homo sapiens
ttaaaaaataaa

SEQ ID NO: 6517148 - DNA, 16 bp, Homo sapiens
ttaaaaaataaatata

SEQ ID NO: 6517149 - DNA, 19 bp, Homo sapiens
ttaaaaaataaatataatt

SEQ ID NO: 6517150 - DNA, 19 bp, Homo sapiens
ttaaaaaataacatattct

SEQ ID NO: 6517151 - DNA, 15 bp, Homo sapiens
ttaaaaaataataca

SEQ ID NO: 6517152 - DNA, 13 bp, Homo sapiens
ttaaaaaatacag

SEQ ID NO: 6517153 - DNA, 19 bp, Homo sapiens
ttaaaaaatacagtattat

SEQ ID NO: 6517154 - DNA, 20 bp, Homo sapiens
ttaaaaaataccattgaaat

SEQ ID NO: 6517155 - DNA, 15 bp, Homo sapiens
ttaaaaaatatatat

SEQ ID NO: 6517156 - DNA, 19 bp, Homo sapiens
ttaaaaaatatttattaaa

SEQ ID NO: 6517157 - DNA, 21 bp, Homo sapiens
ttaaaaaatatttattaaata

SEQ ID NO: 6517158 - DNA, 20 bp, Homo sapiens
ttaaaaaatattttaagaaa

SEQ ID NO: 6517159 - DNA, 16 bp, Homo sapiens
ttaaaaaatcaaaagg

SEQ ID NO: 6517160 - DNA, 14 bp, Homo sapiens
ttaaaaaatcaatc

SEQ ID NO: 6517161 - DNA, 16 bp, Homo sapiens
ttaaaaaatcaatcaa

SEQ ID NO: 6517162 - DNA, 20 bp, Homo sapiens
ttaaaaaatcaatcaatggt

SEQ ID NO: 6517163 - DNA, 22 bp, Homo sapiens
ttaaaaaatcagaacaaaactt

SEQ ID NO: 6517164 - DNA, 13 bp, Homo sapiens
ttaaaaaatctgt

SEQ ID NO: 6517165 - DNA, 12 bp, Homo sapiens
ttaaaaaatgaa

SEQ ID NO: 6517166 - DNA, 16 bp, Homo sapiens
ttaaaaaatgctgggt

SEQ ID NO: 6517167 - DNA, 16 bp, Homo sapiens
ttaaaaaatgtatatt

SEQ ID NO: 6517168 - DNA, 12 bp, Homo sapiens
ttaaaaaatgtc

SEQ ID NO: 6517169 - DNA, 16 bp, Homo sapiens
ttaaaaaatgtccatg

SEQ ID NO: 6517170 - DNA, 21 bp, Homo sapiens
ttaaaaaatgtgaaatgcttt

SEQ ID NO: 6517171 - DNA, 14 bp, Homo sapiens
ttaaaaaatgtttc

SEQ ID NO: 6517172 - DNA, 19 bp, Homo sapiens
ttaaaaaattatggaatat

SEQ ID NO: 6517173 - DNA, 21 bp, Homo sapiens
ttaaaaaattctcttaaataa

SEQ ID NO: 6517174 - DNA, 17 bp, Homo sapiens
ttaaaaaatttttgaaa

SEQ ID NO: 6517175 - DNA, 22 bp, Homo sapiens
ttaaaaacaacgaaagaaggca

SEQ ID NO: 6517176 - DNA, 14 bp, Homo sapiens
ttaaaaacacctaa

SEQ ID NO: 6517177 - DNA, 15 bp, Homo sapiens
ttaaaaacagaaaat

SEQ ID NO: 6517178 - DNA, 19 bp, Homo sapiens
ttaaaaacagctgtaacta

SEQ ID NO: 6517179 - DNA, 18 bp, Homo sapiens
ttaaaaacatgagaaatg

SEQ ID NO: 6517180 - DNA, 14 bp, Homo sapiens
ttaaaaacattttc

SEQ ID NO: 6517181 - DNA, 21 bp, Homo sapiens
ttaaaaacattttttatacat

SEQ ID NO: 6517182 - DNA, 23 bp, Homo sapiens
ttaaaaacattttttatacattt

SEQ ID NO: 6517183 - DNA, 18 bp, Homo sapiens
ttaaaaaccgaataaatg

SEQ ID NO: 6517184 - DNA, 12 bp, Homo sapiens
ttaaaaacctgc

SEQ ID NO: 6517185 - DNA, 14 bp, Homo sapiens
ttaaaaacctgcct

SEQ ID NO: 6517186 - DNA, 16 bp, Homo sapiens
ttaaaaacctgtatct

SEQ ID NO: 6517187 - DNA, 21 bp, Homo sapiens
ttaaaaacctgttcaagtcta

SEQ ID NO: 6517188 - DNA, 13 bp, Homo sapiens
ttaaaaactagta

SEQ ID NO: 6517189 - DNA, 22 bp, Homo sapiens
ttaaaaactagtagttctcttg

SEQ ID NO: 6517190 - DNA, 12 bp, Homo sapiens
ttaaaaactctt

SEQ ID NO: 6517191 - DNA, 16 bp, Homo sapiens
ttaaaaactcttcagt

SEQ ID NO: 6517192 - DNA, 19 bp, Homo sapiens
ttaaaaactgacttaatgc

SEQ ID NO: 6517193 - DNA, 14 bp, Homo sapiens
ttaaaaactgagtg

SEQ ID NO: 6517194 - DNA, 13 bp, Homo sapiens
ttaaaaactggaa

SEQ ID NO: 6517195 - DNA, 15 bp, Homo sapiens
ttaaaaactgtgtat

SEQ ID NO: 6517196 - DNA, 12 bp, Homo sapiens
ttaaaaacttaa

SEQ ID NO: 6517197 - DNA, 15 bp, Homo sapiens
ttaaaaacttccatc

SEQ ID NO: 6517198 - DNA, 12 bp, Homo sapiens
ttaaaaacttta

SEQ ID NO: 6517199 - DNA, 14 bp, Homo sapiens
ttaaaaagaaatct

SEQ ID NO: 6517200 - DNA, 13 bp, Homo sapiens
ttaaaaagaaatt

SEQ ID NO: 6517201 - DNA, 14 bp, Homo sapiens
ttaaaaagaaatta

SEQ ID NO: 6517202 - DNA, 17 bp, Homo sapiens
ttaaaaagacactttta

SEQ ID NO: 6517203 - DNA, 18 bp, Homo sapiens
ttaaaaagaccatgcatt

SEQ ID NO: 6517204 - DNA, 12 bp, Homo sapiens
ttaaaaagactt

SEQ ID NO: 6517205 - DNA, 23 bp, Homo sapiens
ttaaaaagataaaaaaacagctt

SEQ ID NO: 6517206 - DNA, 13 bp, Homo sapiens
ttaaaaagatgaa

SEQ ID NO: 6517207 - DNA, 20 bp, Homo sapiens
ttaaaaagatggaatgtagt

SEQ ID NO: 6517208 - DNA, 13 bp, Homo sapiens
ttaaaaagcaaat

SEQ ID NO: 6517209 - DNA, 19 bp, Homo sapiens
ttaaaaagcatcattacaa

SEQ ID NO: 6517210 - DNA, 12 bp, Homo sapiens
ttaaaaaggaaa

SEQ ID NO: 6517211 - DNA, 15 bp, Homo sapiens
ttaaaaaggaactgc

SEQ ID NO: 6517212 - DNA, 13 bp, Homo sapiens
ttaaaaaggccaa

SEQ ID NO: 6517213 - DNA, 14 bp, Homo sapiens
ttaaaaaggccaaa

SEQ ID NO: 6517214 - DNA, 19 bp, Homo sapiens
ttaaaaaggccaaagataa

SEQ ID NO: 6517215 - DNA, 20 bp, Homo sapiens
ttaaaaagggagaaagaaaa

SEQ ID NO: 6517216 - DNA, 23 bp, Homo sapiens
ttaaaaagggagaaagaaaactg

SEQ ID NO: 6517217 - DNA, 17 bp, Homo sapiens
ttaaaaaggtaaatggt

SEQ ID NO: 6517218 - DNA, 24 bp, Homo sapiens
tgctttgccaagttgctgtcactg

SEQ ID NO: 6517219 - DNA, 15 bp, Homo sapiens
tgctttgccccactg

SEQ ID NO: 6517220 - DNA, 20 bp, Homo sapiens
tgctttgccccactgggaga

SEQ ID NO: 6517221 - DNA, 19 bp, Homo sapiens
tgctttgcccttgaattct

SEQ ID NO: 6517222 - DNA, 17 bp, Homo sapiens
tgctttgcctcgaaagt

SEQ ID NO: 6517223 - DNA, 21 bp, Homo sapiens
tgctttgcctcgaaagtgtca

SEQ ID NO: 6517224 - DNA, 22 bp, Homo sapiens
tgctttgcctcgaaagtgtcat

SEQ ID NO: 6517225 - DNA, 23 bp, Homo sapiens
tgctttgcggcatctccatttca

SEQ ID NO: 6517226 - DNA, 12 bp, Homo sapiens
tgctttgctctt

SEQ ID NO: 6517227 - DNA, 13 bp, Homo sapiens
tgctttgctcttg

SEQ ID NO: 6517228 - DNA, 16 bp, Homo sapiens
tgctttgctgcacaaa

SEQ ID NO: 6517229 - DNA, 18 bp, Homo sapiens
tgctttgctgcacagcag

SEQ ID NO: 6517230 - DNA, 16 bp, Homo sapiens
tgctttgctgctatga

SEQ ID NO: 6517231 - DNA, 20 bp, Homo sapiens
tgctttgctggagtcctgtt

SEQ ID NO: 6517232 - DNA, 13 bp, Homo sapiens
tgctttgcttttt

SEQ ID NO: 6517233 - DNA, 22 bp, Homo sapiens
tgctttggaaaaatgggtcttt

SEQ ID NO: 6517234 - DNA, 21 bp, Homo sapiens
tgctttggaagatgcagaagc

SEQ ID NO: 6517235 - DNA, 18 bp, Homo sapiens
tgctttggacctaaatgg

SEQ ID NO: 6517236 - DNA, 23 bp, Homo sapiens
tgctttggacctaaatggcctca

SEQ ID NO: 6517237 - DNA, 16 bp, Homo sapiens
tgctttggatacacac

SEQ ID NO: 6517238 - DNA, 19 bp, Homo sapiens
tgctttggatagtctccta

SEQ ID NO: 6517239 - DNA, 16 bp, Homo sapiens
tgctttggatgatttt

SEQ ID NO: 6517240 - DNA, 17 bp, Homo sapiens
tgctttggcctttcctt

SEQ ID NO: 6517241 - DNA, 17 bp, Homo sapiens
tgctttggcggcccggc

SEQ ID NO: 6517242 - DNA, 16 bp, Homo sapiens
tgctttggctgactgg

SEQ ID NO: 6517243 - DNA, 16 bp, Homo sapiens
tgctttggctgagggg

SEQ ID NO: 6517244 - DNA, 16 bp, Homo sapiens
tgctttgggaactgtg

SEQ ID NO: 6517245 - DNA, 22 bp, Homo sapiens
tgctttgggagacagtctagga

SEQ ID NO: 6517246 - DNA, 19 bp, Homo sapiens
tgctttgggctgccctggt

SEQ ID NO: 6517247 - DNA, 20 bp, Homo sapiens
tgctttgggctgccctggtg

SEQ ID NO: 6517248 - DNA, 12 bp, Homo sapiens
tgctttgggctt

SEQ ID NO: 6517249 - DNA, 15 bp, Homo sapiens
tgctttgggctttgc

SEQ ID NO: 6517250 - DNA, 21 bp, Homo sapiens
tgctttgggctttgcaggctc

SEQ ID NO: 6517251 - DNA, 17 bp, Homo sapiens
tgctttggggaaaaaga

SEQ ID NO: 6517252 - DNA, 13 bp, Homo sapiens
tgctttggggata

SEQ ID NO: 6517253 - DNA, 23 bp, Homo sapiens
tgctttggggcttatcagaactc

SEQ ID NO: 6517254 - DNA, 22 bp, Homo sapiens
tgctttggggggtgtgctgaca

SEQ ID NO: 6517255 - DNA, 16 bp, Homo sapiens
tgctttggttaatctc

SEQ ID NO: 6517256 - DNA, 16 bp, Homo sapiens
tgctttgtaaattgtg

SEQ ID NO: 6517257 - DNA, 22 bp, Homo sapiens
tgctttgtaagatccaccccct

SEQ ID NO: 6517258 - DNA, 16 bp, Homo sapiens
tgctttgtagagtttt

SEQ ID NO: 6517259 - DNA, 20 bp, Homo sapiens
tgctttgtagtttgcccaga

SEQ ID NO: 6517260 - DNA, 14 bp, Homo sapiens
tgctttgtctcctc

SEQ ID NO: 6517261 - DNA, 15 bp, Homo sapiens
tgctttgtctcctct

SEQ ID NO: 6517262 - DNA, 21 bp, Homo sapiens
tgctttgtctggaagaaagat

SEQ ID NO: 6517263 - DNA, 17 bp, Homo sapiens
tgctttgtgactattaa

SEQ ID NO: 6517264 - DNA, 20 bp, Homo sapiens
tgctttgtgcatatgttaaa

SEQ ID NO: 6517265 - DNA, 22 bp, Homo sapiens
tgctttgtgcctttgggcacgg

SEQ ID NO: 6517266 - DNA, 15 bp, Homo sapiens
tgctttgtggcttct

SEQ ID NO: 6517267 - DNA, 13 bp, Homo sapiens
tgctttgtgtcta

SEQ ID NO: 6517268 - DNA, 19 bp, Homo sapiens
tgctttgtgtctagggcag

SEQ ID NO: 6517269 - DNA, 17 bp, Homo sapiens
tgctttgtgtgattgaa

SEQ ID NO: 6517270 - DNA, 14 bp, Homo sapiens
tgctttgtgttctt

SEQ ID NO: 6517271 - DNA, 16 bp, Homo sapiens
tgctttgttaatgaaa

SEQ ID NO: 6517272 - DNA, 18 bp, Homo sapiens
tgctttgttacaataaaa

SEQ ID NO: 6517273 - DNA, 18 bp, Homo sapiens
tgctttgttaccttaaaa

SEQ ID NO: 6517274 - DNA, 15 bp, Homo sapiens
tgctttgttgaataa

SEQ ID NO: 6517275 - DNA, 20 bp, Homo sapiens
tgctttgttgtgtgcctcta

SEQ ID NO: 6517276 - DNA, 13 bp, Homo sapiens
tgctttgttgttc

SEQ ID NO: 6517277 - DNA, 15 bp, Homo sapiens
tgctttgttgttctg

SEQ ID NO: 6517278 - DNA, 20 bp, Homo sapiens
tgcttttaaaagtgcacatt

SEQ ID NO: 6517279 - DNA, 16 bp, Homo sapiens
tgcttttaaatctgca

SEQ ID NO: 6517280 - DNA, 13 bp, Homo sapiens
tgcttttaatgaa

SEQ ID NO: 6517281 - DNA, 16 bp, Homo sapiens
tgcttttaattaaata

SEQ ID NO: 6517282 - DNA, 17 bp, Homo sapiens
tgcttttaccatgcccc

SEQ ID NO: 6517283 - DNA, 15 bp, Homo sapiens
tgcttttatatctgt

SEQ ID NO: 6517284 - DNA, 17 bp, Homo sapiens
tgcttttatattctaat

SEQ ID NO: 6517285 - DNA, 19 bp, Homo sapiens
tgcttttatattctaatag

SEQ ID NO: 6517286 - DNA, 16 bp, Homo sapiens
tgcttttatgacaaat

SEQ ID NO: 6517287 - DNA, 17 bp, Homo sapiens
tgcttttatgtttgtac

SEQ ID NO: 6517288 - DNA, 12 bp, Homo sapiens
tgcttttcaaac

SEQ ID NO: 6517289 - DNA, 17 bp, Homo sapiens
tgcttttcaaaccagag

SEQ ID NO: 6517290 - DNA, 14 bp, Homo sapiens
tgcttttcaaatgt

SEQ ID NO: 6517291 - DNA, 17 bp, Homo sapiens
tgcttttcactgctgca

SEQ ID NO: 6517292 - DNA, 22 bp, Homo sapiens
tgcttttcactgctgcaaggcc

SEQ ID NO: 6517293 - DNA, 16 bp, Homo sapiens
tgcttttcactggcat

SEQ ID NO: 6517294 - DNA, 21 bp, Homo sapiens
tgcttttcactttctgtctag

SEQ ID NO: 6517295 - DNA, 23 bp, Homo sapiens
tgcttttcatcaccgtcccgcac

SEQ ID NO: 6517296 - DNA, 14 bp, Homo sapiens
tgcttttcatcctt

SEQ ID NO: 6517297 - DNA, 16 bp, Homo sapiens
tgcttttcatgcaaac

SEQ ID NO: 6517298 - DNA, 17 bp, Homo sapiens
tgcttttcatgcaaact

SEQ ID NO: 6517299 - DNA, 14 bp, Homo sapiens
tgcttttcatgtag

SEQ ID NO: 6517300 - DNA, 22 bp, Homo sapiens
tgcttttccaggatcctgcagg

SEQ ID NO: 6517301 - DNA, 14 bp, Homo sapiens
tgcttttccatata

SEQ ID NO: 6517302 - DNA, 12 bp, Homo sapiens
tgcttttccatc

SEQ ID NO: 6517303 - DNA, 20 bp, Homo sapiens
tgcttttccattctgggtgt

SEQ ID NO: 6517304 - DNA, 17 bp, Homo sapiens
tgcttttccctatccac

SEQ ID NO: 6517305 - DNA, 13 bp, Homo sapiens
tgcttttccctct

SEQ ID NO: 6517306 - DNA, 18 bp, Homo sapiens
tgcttttccctttgtgag

SEQ ID NO: 6517307 - DNA, 20 bp, Homo sapiens
tgcttttctaagatacatat

SEQ ID NO: 6517308 - DNA, 18 bp, Homo sapiens
tgcttttctctcagcata

SEQ ID NO: 6517309 - DNA, 17 bp, Homo sapiens
tgcttttctgtatttta

SEQ ID NO: 6517310 - DNA, 14 bp, Homo sapiens
tgcttttctgtcct

SEQ ID NO: 6517311 - DNA, 19 bp, Homo sapiens
tgcttttctgtcctgggca

SEQ ID NO: 6517312 - DNA, 20 bp, Homo sapiens
tgcttttgaacgtatgtgct

SEQ ID NO: 6517313 - DNA, 20 bp, Homo sapiens
tgcttttgaaggaatacaat

SEQ ID NO: 6517314 - DNA, 17 bp, Homo sapiens
tgcttttgatgatgtct

SEQ ID NO: 6517315 - DNA, 13 bp, Homo sapiens
tgcttttgcaaat

SEQ ID NO: 6517316 - DNA, 18 bp, Homo sapiens
tgcttttgcataatgcaa

SEQ ID NO: 6517317 - DNA, 19 bp, Homo sapiens
tgcttttgcataatgcaat

SEQ ID NO: 6517318 - DNA, 21 bp, Homo sapiens
tgcttttgccactttggcttc

SEQ ID NO: 6517319 - DNA, 18 bp, Homo sapiens
tgcttttgcccatataaa

SEQ ID NO: 6517320 - DNA, 15 bp, Homo sapiens
tgcttttgcctctgc

SEQ ID NO: 6517321 - DNA, 15 bp, Homo sapiens
tgcttttgctgctgc

SEQ ID NO: 6517322 - DNA, 16 bp, Homo sapiens
tgcttttgctgctgct

SEQ ID NO: 6517323 - DNA, 18 bp, Homo sapiens
tgcttttgctgctgctta

SEQ ID NO: 6517324 - DNA, 22 bp, Homo sapiens
tgcttttgctgctgcttaatcc

SEQ ID NO: 6517325 - DNA, 14 bp, Homo sapiens
tgcttttgctgggg

SEQ ID NO: 6517326 - DNA, 14 bp, Homo sapiens
tgcttttgcttcta

SEQ ID NO: 6517327 - DNA, 21 bp, Homo sapiens
tgcttttggggggcatatatt

SEQ ID NO: 6517328 - DNA, 17 bp, Homo sapiens
tgcttttggtctgtgtg

SEQ ID NO: 6517329 - DNA, 13 bp, Homo sapiens
tgcttttgtaact

SEQ ID NO: 6517330 - DNA, 14 bp, Homo sapiens
tgcttttgtaactt

SEQ ID NO: 6517331 - DNA, 15 bp, Homo sapiens
tgcttttgtgagaaa

SEQ ID NO: 6517332 - DNA, 16 bp, Homo sapiens
tgcttttgtgtcccat

SEQ ID NO: 6517333 - DNA, 17 bp, Homo sapiens
tgctttttaagtgttaa

SEQ ID NO: 6517334 - DNA, 13 bp, Homo sapiens
tgctttttaccta

SEQ ID NO: 6517335 - DNA, 14 bp, Homo sapiens
tgctttttcaggtt

SEQ ID NO: 6517336 - DNA, 14 bp, Homo sapiens
tgctttttccaact

SEQ ID NO: 6517337 - DNA, 21 bp, Homo sapiens
tgctttttccccattggaact

SEQ ID NO: 6517338 - DNA, 16 bp, Homo sapiens
tgctttttccttagct

SEQ ID NO: 6517339 - DNA, 17 bp, Homo sapiens
tgctttttccttttcat

SEQ ID NO: 6517340 - DNA, 14 bp, Homo sapiens
tgctttttctaatg

SEQ ID NO: 6517341 - DNA, 15 bp, Homo sapiens
tgctttttctcagat

SEQ ID NO: 6517342 - DNA, 22 bp, Homo sapiens
tgctttttcttgtttgtttaaa

SEQ ID NO: 6517343 - DNA, 17 bp, Homo sapiens
tgctttttgaaatgaaa

SEQ ID NO: 6517344 - DNA, 20 bp, Homo sapiens
tgctttttgaggtggcactt

SEQ ID NO: 6517345 - DNA, 19 bp, Homo sapiens
tgctttttgcgtacacaga

SEQ ID NO: 6517346 - DNA, 20 bp, Homo sapiens
tgctttttgcgtacacagag

SEQ ID NO: 6517347 - DNA, 13 bp, Homo sapiens
tgctttttggaaa

SEQ ID NO: 6517348 - DNA, 14 bp, Homo sapiens
tgctttttgtcatg

SEQ ID NO: 6517349 - DNA, 19 bp, Homo sapiens
tgctttttgtcatgttatg

SEQ ID NO: 6517350 - DNA, 19 bp, Homo sapiens
tgcttttttgaaagatgct

SEQ ID NO: 6517351 - DNA, 21 bp, Homo sapiens
tgcttttttgcaataaggatt

SEQ ID NO: 6517352 - DNA, 16 bp, Homo sapiens
tgcttttttgttttgt

SEQ ID NO: 6517353 - DNA, 15 bp, Homo sapiens
tgctttttttggcct

SEQ ID NO: 6517354 - DNA, 17 bp, Homo sapiens
tgctttttttgtgtgta

SEQ ID NO: 6517355 - DNA, 21 bp, Homo sapiens
tggaaaaaaaaaaaagaggaa

SEQ ID NO: 6517356 - DNA, 23 bp, Homo sapiens
tggaaaaaaaaaaaagaggaaaa

SEQ ID NO: 6517357 - DNA, 16 bp, Homo sapiens
tggaaaaaaaaaagac

SEQ ID NO: 6517358 - DNA, 15 bp, Homo sapiens
tggaaaaaaaaagaa

SEQ ID NO: 6517359 - DNA, 14 bp, Homo sapiens
tggaaaaaaacatc

SEQ ID NO: 6517360 - DNA, 17 bp, Homo sapiens
tggaaaaaaatacaaaa

SEQ ID NO: 6517361 - DNA, 19 bp, Homo sapiens
tggaaaaaaatacaaaaag

SEQ ID NO: 6517362 - DNA, 13 bp, Homo sapiens
tggaaaaaacatt

SEQ ID NO: 6517363 - DNA, 13 bp, Homo sapiens
tggaaaaaactct

SEQ ID NO: 6517364 - DNA, 15 bp, Homo sapiens
tggaaaaaagagaaa

SEQ ID NO: 6517365 - DNA, 23 bp, Homo sapiens
tggaaaaaagagaaaaaccaatg

SEQ ID NO: 6517366 - DNA, 15 bp, Homo sapiens
tggaaaaaatatttt

SEQ ID NO: 6517367 - DNA, 22 bp, Homo sapiens
tggaaaaacaattcctgtaacc

SEQ ID NO: 6517368 - DNA, 19 bp, Homo sapiens
tggaaaaacaggaaaggag

SEQ ID NO: 6517369 - DNA, 22 bp, Homo sapiens
tggaaaaactgagacaggcagt

SEQ ID NO: 6517370 - DNA, 17 bp, Homo sapiens
tggaaaaagaaattctg

SEQ ID NO: 6517371 - DNA, 23 bp, Homo sapiens
tggaaaaagaatatattgccaaa

SEQ ID NO: 6517372 - DNA, 22 bp, Homo sapiens
tggaaaaagtaagaggactact

SEQ ID NO: 6517373 - DNA, 16 bp, Homo sapiens
tggaaaaataaacact

SEQ ID NO: 6517374 - DNA, 20 bp, Homo sapiens
tggaaaaatagcctgcctct

SEQ ID NO: 6517375 - DNA, 12 bp, Homo sapiens
tggaaaaatatt

SEQ ID NO: 6517376 - DNA, 15 bp, Homo sapiens
tggaaaaatatttca

SEQ ID NO: 6517377 - DNA, 18 bp, Homo sapiens
tggaaaaatccagaaaga

SEQ ID NO: 6517378 - DNA, 19 bp, Homo sapiens
tggaaaaatccagaaagaa

SEQ ID NO: 6517379 - DNA, 19 bp, Homo sapiens
tggaaaaatcttgggcaag

SEQ ID NO: 6517380 - DNA, 17 bp, Homo sapiens
tggaaaaatgaactgta

SEQ ID NO: 6517381 - DNA, 19 bp, Homo sapiens
tggaaaaatgccatcaaat

SEQ ID NO: 6517382 - DNA, 13 bp, Homo sapiens
tggaaaaatgccc

SEQ ID NO: 6517383 - DNA, 14 bp, Homo sapiens
tggaaaaatggttg

SEQ ID NO: 6517384 - DNA, 16 bp, Homo sapiens
tggaaaaatgtatcca

SEQ ID NO: 6517385 - DNA, 16 bp, Homo sapiens
tggaaaaatgtcactg

SEQ ID NO: 6517386 - DNA, 15 bp, Homo sapiens
tggaaaaatgtttgt

SEQ ID NO: 6517387 - DNA, 16 bp, Homo sapiens
tggaaaacaaaagttt

SEQ ID NO: 6517388 - DNA, 23 bp, Homo sapiens
tggaaaacaaagccaaacaaaac

SEQ ID NO: 6517389 - DNA, 14 bp, Homo sapiens
tggaaaacagaaac

SEQ ID NO: 6517390 - DNA, 17 bp, Homo sapiens
tggaaaacagaacactt

SEQ ID NO: 6517391 - DNA, 18 bp, Homo sapiens
tggaaaacatcctgactt

SEQ ID NO: 6517392 - DNA, 19 bp, Homo sapiens
tggaaaacatcctgacttc

SEQ ID NO: 6517393 - DNA, 15 bp, Homo sapiens
tggaaaacatttcaa

SEQ ID NO: 6517394 - DNA, 14 bp, Homo sapiens
tggaaaacctcctt

SEQ ID NO: 6517395 - DNA, 19 bp, Homo sapiens
tggaaaacctgaggccaaa

SEQ ID NO: 6517396 - DNA, 15 bp, Homo sapiens
tggaaaacgaagctc

SEQ ID NO: 6517397 - DNA, 19 bp, Homo sapiens
ttaaaaaggtaaatggtta

SEQ ID NO: 6517398 - DNA, 17 bp, Homo sapiens
ttaaaaagtatgttcta

SEQ ID NO: 6517399 - DNA, 21 bp, Homo sapiens
ttaaaaagtctgcattacatt

SEQ ID NO: 6517400 - DNA, 15 bp, Homo sapiens
ttaaaaagtgagaaa

SEQ ID NO: 6517401 - DNA, 18 bp, Homo sapiens
ttaaaaagtggaaaaata

SEQ ID NO: 6517402 - DNA, 20 bp, Homo sapiens
ttaaaaagttaatcttcatg

SEQ ID NO: 6517403 - DNA, 20 bp, Homo sapiens
ttaaaaagttataaccaact

SEQ ID NO: 6517404 - DNA, 19 bp, Homo sapiens
ttaaaaagttgttctttgt

SEQ ID NO: 6517405 - DNA, 11 bp, Homo sapiens
ttaaaaataaa

SEQ ID NO: 6517406 - DNA, 16 bp, Homo sapiens
ttaaaaataaaattac

SEQ ID NO: 6517407 - DNA, 21 bp, Homo sapiens
ttaaaaataaagctactgaat

SEQ ID NO: 6517408 - DNA, 18 bp, Homo sapiens
ttaaaaataaagtaactt

SEQ ID NO: 6517409 - DNA, 17 bp, Homo sapiens
ttaaaaataagttttat

SEQ ID NO: 6517410 - DNA, 20 bp, Homo sapiens
ttaaaaataatagagcccca

SEQ ID NO: 6517411 - DNA, 20 bp, Homo sapiens
ttaaaaataccaatcacaag

SEQ ID NO: 6517412 - DNA, 23 bp, Homo sapiens
ttaaaaataccaatcacaaggat

SEQ ID NO: 6517413 - DNA, 19 bp, Homo sapiens
ttaaaaatactatgtatgt

SEQ ID NO: 6517414 - DNA, 17 bp, Homo sapiens
ttaaaaatacttctatg

SEQ ID NO: 6517415 - DNA, 15 bp, Homo sapiens
ttaaaaatagaaaca

SEQ ID NO: 6517416 - DNA, 22 bp, Homo sapiens
ttaaaaatagaatacattttgt

SEQ ID NO: 6517417 - DNA, 12 bp, Homo sapiens
ttaaaaatataa

SEQ ID NO: 6517418 - DNA, 15 bp, Homo sapiens
ttaaaaatataaaac

SEQ ID NO: 6517419 - DNA, 13 bp, Homo sapiens
ttaaaaatatcaa

SEQ ID NO: 6517420 - DNA, 13 bp, Homo sapiens
ttaaaaatatttc

SEQ ID NO: 6517421 - DNA, 17 bp, Homo sapiens
ttaaaaatatttcagat

SEQ ID NO: 6517422 - DNA, 23 bp, Homo sapiens
ttaaaaatcaactttttattgcc

SEQ ID NO: 6517423 - DNA, 18 bp, Homo sapiens
ttaaaaatctacgtcttt

SEQ ID NO: 6517424 - DNA, 14 bp, Homo sapiens
ttaaaaatctcaaa

SEQ ID NO: 6517425 - DNA, 15 bp, Homo sapiens
ttaaaaatctcaaat

SEQ ID NO: 6517426 - DNA, 20 bp, Homo sapiens
ttaaaaatctcaaatttcta

SEQ ID NO: 6517427 - DNA, 15 bp, Homo sapiens
ttaaaaatctgccac

SEQ ID NO: 6517428 - DNA, 14 bp, Homo sapiens
ttaaaaatctttca

SEQ ID NO: 6517429 - DNA, 16 bp, Homo sapiens
ttaaaaatgatctgta

SEQ ID NO: 6517430 - DNA, 12 bp, Homo sapiens
ttaaaaatgcaa

SEQ ID NO: 6517431 - DNA, 14 bp, Homo sapiens
ttaaaaatggtaaa

SEQ ID NO: 6517432 - DNA, 22 bp, Homo sapiens
ttaaaaatggtatcaaaattac

SEQ ID NO: 6517433 - DNA, 22 bp, Homo sapiens
ttaaaaatggtggcttcagctc

SEQ ID NO: 6517434 - DNA, 12 bp, Homo sapiens
ttaaaaatgtat

SEQ ID NO: 6517435 - DNA, 21 bp, Homo sapiens
ttaaaaatgttaaaatgtatt

SEQ ID NO: 6517436 - DNA, 13 bp, Homo sapiens
ttaaaaatgttct

SEQ ID NO: 6517437 - DNA, 18 bp, Homo sapiens
ttaaaaatgttctcaaat

SEQ ID NO: 6517438 - DNA, 13 bp, Homo sapiens
ttaaaaatgtttg

SEQ ID NO: 6517439 - DNA, 24 bp, Homo sapiens
ttaaaaatgttttttcatgtgttt

SEQ ID NO: 6517440 - DNA, 15 bp, Homo sapiens
ttaaaaattaaatat

SEQ ID NO: 6517441 - DNA, 16 bp, Homo sapiens
ttaaaaattaaatatt

SEQ ID NO: 6517442 - DNA, 13 bp, Homo sapiens
ttaaaaattaatt

SEQ ID NO: 6517443 - DNA, 17 bp, Homo sapiens
ttaaaaattacctttaa

SEQ ID NO: 6517444 - DNA, 20 bp, Homo sapiens
ttaaaaattacctttaattt

SEQ ID NO: 6517445 - DNA, 12 bp, Homo sapiens
ttaaaaattaga

SEQ ID NO: 6517446 - DNA, 16 bp, Homo sapiens
ttaaaaattggcattt

SEQ ID NO: 6517447 - DNA, 19 bp, Homo sapiens
ttaaaaattgtcttcatgt

SEQ ID NO: 6517448 - DNA, 15 bp, Homo sapiens
ttaaaaatttactac

SEQ ID NO: 6517449 - DNA, 20 bp, Homo sapiens
ttaaaaatttttttaaggaa

SEQ ID NO: 6517450 - DNA, 15 bp, Homo sapiens
ttaaaacaaaagggt

SEQ ID NO: 6517451 - DNA, 22 bp, Homo sapiens
ttaaaacaaaagggtgtatagt

SEQ ID NO: 6517452 - DNA, 12 bp, Homo sapiens
ttaaaacaaaca

SEQ ID NO: 6517453 - DNA, 18 bp, Homo sapiens
ttaaaacaaaggaactaa

SEQ ID NO: 6517454 - DNA, 20 bp, Homo sapiens
ttaaaacaaaggaactaact

SEQ ID NO: 6517455 - DNA, 17 bp, Homo sapiens
ttaaaacaacactcaca

SEQ ID NO: 6517456 - DNA, 14 bp, Homo sapiens
ttaaaacaaccagt

SEQ ID NO: 6517457 - DNA, 19 bp, Homo sapiens
ttaaaacaagaaagtttcc

SEQ ID NO: 6517458 - DNA, 23 bp, Homo sapiens
ttaaaacaagagaccacttcctt

SEQ ID NO: 6517459 - DNA, 20 bp, Homo sapiens
ttaaaacaaggcttaaaaga

SEQ ID NO: 6517460 - DNA, 22 bp, Homo sapiens
ttaaaacaaggcttaaaagagt

SEQ ID NO: 6517461 - DNA, 24 bp, Homo sapiens
ttaaaacaaggggttactttacat

SEQ ID NO: 6517462 - DNA, 18 bp, Homo sapiens
ttaaaacaatccttacta

SEQ ID NO: 6517463 - DNA, 13 bp, Homo sapiens
ttaaaacaatttt

SEQ ID NO: 6517464 - DNA, 15 bp, Homo sapiens
ttaaaacacaaaatg

SEQ ID NO: 6517465 - DNA, 19 bp, Homo sapiens
ttaaaacacagtattgtag

SEQ ID NO: 6517466 - DNA, 21 bp, Homo sapiens
ttaaaacacagtattgtagaa

SEQ ID NO: 6517467 - DNA, 21 bp, Homo sapiens
ttaaaacacgttttaaggact

SEQ ID NO: 6517468 - DNA, 22 bp, Homo sapiens
ttaaaacacgttttaaggactg

SEQ ID NO: 6517469 - DNA, 17 bp, Homo sapiens
ttaaaacacttctgtcc

SEQ ID NO: 6517470 - DNA, 12 bp, Homo sapiens
ttaaaacacttt

SEQ ID NO: 6517471 - DNA, 14 bp, Homo sapiens
ttaaaacagacact

SEQ ID NO: 6517472 - DNA, 15 bp, Homo sapiens
ttaaaacagctattt

SEQ ID NO: 6517473 - DNA, 12 bp, Homo sapiens
ttaaaacagctg

SEQ ID NO: 6517474 - DNA, 22 bp, Homo sapiens
ttaaaacagtatttattttgta

SEQ ID NO: 6517475 - DNA, 21 bp, Homo sapiens
ttaaaacagtgtatttggaaa

SEQ ID NO: 6517476 - DNA, 18 bp, Homo sapiens
ttaaaacatactctgccg

SEQ ID NO: 6517477 - DNA, 17 bp, Homo sapiens
ttaaaacatatttcatt

SEQ ID NO: 6517478 - DNA, 19 bp, Homo sapiens
ttaaaacatatttcatttt

SEQ ID NO: 6517479 - DNA, 15 bp, Homo sapiens
ttaaaacatcaaaat

SEQ ID NO: 6517480 - DNA, 14 bp, Homo sapiens
ttaaaacatgcacg

SEQ ID NO: 6517481 - DNA, 15 bp, Homo sapiens
ttaaaacattaaaat

SEQ ID NO: 6517482 - DNA, 16 bp, Homo sapiens
ttaaaacatttcatgt

SEQ ID NO: 6517483 - DNA, 20 bp, Homo sapiens
ttaaaacatttcatgtattt

SEQ ID NO: 6517484 - DNA, 17 bp, Homo sapiens
ttaaaaccacagaacag

SEQ ID NO: 6517485 - DNA, 20 bp, Homo sapiens
ttaaaaccacagaacagttt

SEQ ID NO: 6517486 - DNA, 15 bp, Homo sapiens
ttaaaaccacagctg

SEQ ID NO: 6517487 - DNA, 16 bp, Homo sapiens
ttaaaaccacagctgg

SEQ ID NO: 6517488 - DNA, 16 bp, Homo sapiens
ttaaaaccatgcagct

SEQ ID NO: 6517489 - DNA, 19 bp, Homo sapiens
ttaaaaccattaccttaaa

SEQ ID NO: 6517490 - DNA, 16 bp, Homo sapiens
ttaaaaccattattta

SEQ ID NO: 6517491 - DNA, 16 bp, Homo sapiens
ttaaaacgaaaataaa

SEQ ID NO: 6517492 - DNA, 16 bp, Homo sapiens
ttaaaactaaatttca

SEQ ID NO: 6517493 - DNA, 16 bp, Homo sapiens
ttaaaactaagcacaa

SEQ ID NO: 6517494 - DNA, 22 bp, Homo sapiens
ttaaaactaggcatttgtaaat

SEQ ID NO: 6517495 - DNA, 23 bp, Homo sapiens
ttaaaactaggcatttgtaaata

SEQ ID NO: 6517496 - DNA, 15 bp, Homo sapiens
ttaaaactatccaat

SEQ ID NO: 6517497 - DNA, 13 bp, Homo sapiens
ttaaaactcagat

SEQ ID NO: 6517498 - DNA, 21 bp, Homo sapiens
ttaaaactcagatttaaaaca

SEQ ID NO: 6517499 - DNA, 19 bp, Homo sapiens
ttaaaactcagcctgggac

SEQ ID NO: 6517500 - DNA, 19 bp, Homo sapiens
ttaaaactcatcacataaa

SEQ ID NO: 6517501 - DNA, 15 bp, Homo sapiens
ttaaaactcatttag

SEQ ID NO: 6517502 - DNA, 18 bp, Homo sapiens
ttaaaactcgaaaataag

SEQ ID NO: 6517503 - DNA, 13 bp, Homo sapiens
ttaaaactgagtc

SEQ ID NO: 6517504 - DNA, 20 bp, Homo sapiens
ttaaaactgagtccatgaaa

SEQ ID NO: 6517505 - DNA, 21 bp, Homo sapiens
ttaaaactgagtccatgaaaa

SEQ ID NO: 6517506 - DNA, 22 bp, Homo sapiens
ttaaaactgcttttttttttcc

SEQ ID NO: 6517507 - DNA, 14 bp, Homo sapiens
ttaaaactggacct

SEQ ID NO: 6517508 - DNA, 15 bp, Homo sapiens
ttaaaactgtacctt

SEQ ID NO: 6517509 - DNA, 19 bp, Homo sapiens
ttaaaactgtatttaagga

SEQ ID NO: 6517510 - DNA, 15 bp, Homo sapiens
ttaaaactgttattt

SEQ ID NO: 6517511 - DNA, 23 bp, Homo sapiens
ttaaaacttaaccgcatcagaag

SEQ ID NO: 6517512 - DNA, 19 bp, Homo sapiens
ttaaaacttcttaaatatc

SEQ ID NO: 6517513 - DNA, 14 bp, Homo sapiens
ttaaaactttaatc

SEQ ID NO: 6517514 - DNA, 13 bp, Homo sapiens
ttaaaactttgta

SEQ ID NO: 6517515 - DNA, 14 bp, Homo sapiens
ttaaaagaaaaaat

SEQ ID NO: 6517516 - DNA, 17 bp, Homo sapiens
ttaaaagaaaacaaagc

SEQ ID NO: 6517517 - DNA, 20 bp, Homo sapiens
ttaaaagaaagcctcagaga

SEQ ID NO: 6517518 - DNA, 19 bp, Homo sapiens
ttaaaagaaatatacagtt

SEQ ID NO: 6517519 - DNA, 16 bp, Homo sapiens
ttaaaagaaatctcta

SEQ ID NO: 6517520 - DNA, 13 bp, Homo sapiens
ttaaaagaatgac

SEQ ID NO: 6517521 - DNA, 20 bp, Homo sapiens
ttaaaagaatgggcagttac

SEQ ID NO: 6517522 - DNA, 22 bp, Homo sapiens
ttaaaagaatgggcagttacat

SEQ ID NO: 6517523 - DNA, 14 bp, Homo sapiens
ttaaaagactcatc

SEQ ID NO: 6517524 - DNA, 18 bp, Homo sapiens
ttaaaagactgttttcag

SEQ ID NO: 6517525 - DNA, 11 bp, Homo sapiens
ttaaaagagag

SEQ ID NO: 6517526 - DNA, 23 bp, Homo sapiens
ttaaaagagagagagagaaaaaa

SEQ ID NO: 6517527 - DNA, 15 bp, Homo sapiens
ttaaaagagctcaga

SEQ ID NO: 6517528 - DNA, 21 bp, Homo sapiens
ttaaaagaggaaattaaataa

SEQ ID NO: 6517529 - DNA, 12 bp, Homo sapiens
ttaaaagagtag

SEQ ID NO: 6517530 - DNA, 14 bp, Homo sapiens
ttaaaagataagtt

SEQ ID NO: 6517531 - DNA, 16 bp, Homo sapiens
ttaaaagattcatttt

SEQ ID NO: 6517532 - DNA, 15 bp, Homo sapiens
ttaaaagattttatg

SEQ ID NO: 6517533 - DNA, 15 bp, Homo sapiens
ttaaaagcaaaaaga

SEQ ID NO: 6517534 - DNA, 22 bp, Homo sapiens
ttaaaagcaattatattgtcct

SEQ ID NO: 6517535 - DNA, 20 bp, Homo sapiens
ttaaaagcacaagcgtgttt

SEQ ID NO: 6517536 - DNA, 12 bp, Homo sapiens
ttaaaagcatac

SEQ ID NO: 6517537 - DNA, 12 bp, Homo sapiens
ttaaaagccatc

SEQ ID NO: 6517538 - DNA, 19 bp, Homo sapiens
ttaaaagccatcatgtaaa

SEQ ID NO: 6517539 - DNA, 17 bp, Homo sapiens
ttaaaagccatgtataa

SEQ ID NO: 6517540 - DNA, 19 bp, Homo sapiens
ttaaaagccttccagtttt

SEQ ID NO: 6517541 - DNA, 21 bp, Homo sapiens
ttaaaagccttggcctcagag

SEQ ID NO: 6517542 - DNA, 11 bp, Homo sapiens
ttaaaaggaaa

SEQ ID NO: 6517543 - DNA, 20 bp, Homo sapiens
ttaaaaggatgtataaattt

SEQ ID NO: 6517544 - DNA, 17 bp, Homo sapiens
ttaaaaggatttttatc

SEQ ID NO: 6517545 - DNA, 22 bp, Homo sapiens
ttaaaaggatttttatctttcg

SEQ ID NO: 6517546 - DNA, 16 bp, Homo sapiens
ttaaaaggcaactcaa

SEQ ID NO: 6517547 - DNA, 16 bp, Homo sapiens
ttaaaaggtataatta

SEQ ID NO: 6517548 - DNA, 18 bp, Homo sapiens
ttaaaaggtcaaaactga

SEQ ID NO: 6517549 - DNA, 15 bp, Homo sapiens
ttaaaagtaaaatgt

SEQ ID NO: 6517550 - DNA, 18 bp, Homo sapiens
ttaaaagtaaaatgtctt

SEQ ID NO: 6517551 - DNA, 18 bp, Homo sapiens
ttaaaagtaataaagaga

SEQ ID NO: 6517552 - DNA, 23 bp, Homo sapiens
ttaaaagtaataaagagaaatat

SEQ ID NO: 6517553 - DNA, 14 bp, Homo sapiens
ttaaaagtaggaaa

SEQ ID NO: 6517554 - DNA, 20 bp, Homo sapiens
ttaaaagtcacaatgttctt

SEQ ID NO: 6517555 - DNA, 13 bp, Homo sapiens
ttaaaagtgtaca

SEQ ID NO: 6517556 - DNA, 14 bp, Homo sapiens
ttaaaagtgtacaa

SEQ ID NO: 6517557 - DNA, 16 bp, Homo sapiens
ttaaaagtgtcaagct

SEQ ID NO: 6517558 - DNA, 23 bp, Homo sapiens
ttaaaagtgttgattacataatc

SEQ ID NO: 6517559 - DNA, 21 bp, Homo sapiens
ttaaaagttgggaaaagtgtt

SEQ ID NO: 6517560 - DNA, 16 bp, Homo sapiens
ttaaaagtttgtcctt

SEQ ID NO: 6517561 - DNA, 15 bp, Homo sapiens
ttaaaataaaaatat

SEQ ID NO: 6517562 - DNA, 13 bp, Homo sapiens
ttaaaataaaaca

SEQ ID NO: 6517563 - DNA, 20 bp, Homo sapiens
ttaaaataaaataagttctt

SEQ ID NO: 6517564 - DNA, 22 bp, Homo sapiens
ttaaaataaaataagttcttaa

SEQ ID NO: 6517565 - DNA, 16 bp, Homo sapiens
ttaaaataaaataatt

SEQ ID NO: 6517566 - DNA, 14 bp, Homo sapiens
ttaaaataaaatga

SEQ ID NO: 6517567 - DNA, 16 bp, Homo sapiens
ttaaaataaaattttt

SEQ ID NO: 6517568 - DNA, 15 bp, Homo sapiens
ttaaaataaactgta

SEQ ID NO: 6517569 - DNA, 20 bp, Homo sapiens
ttaaaataaactgtaaacta

SEQ ID NO: 6517570 - DNA, 21 bp, Homo sapiens
ttaaaataaactgtaaactaa

SEQ ID NO: 6517571 - DNA, 22 bp, Homo sapiens
ttaaaataaactgtaaactaat

SEQ ID NO: 6517572 - DNA, 18 bp, Homo sapiens
ttaaaataaataaacttt

SEQ ID NO: 6517573 - DNA, 13 bp, Homo sapiens
ttaaaataactat

SEQ ID NO: 6517574 - DNA, 21 bp, Homo sapiens
ttaaaataactatcaggcaga

SEQ ID NO: 6517575 - DNA, 14 bp, Homo sapiens
ttaaaataagtgaa

SEQ ID NO: 6517576 - DNA, 19 bp, Homo sapiens
aagagtgaagcgtttttct

SEQ ID NO: 6517577 - DNA, 18 bp, Homo sapiens
aagagtgactctccaggg

SEQ ID NO: 6517578 - DNA, 18 bp, Homo sapiens
aagagtgacttattttgt

SEQ ID NO: 6517579 - DNA, 21 bp, Homo sapiens
aagagtgacttattttgtctt

SEQ ID NO: 6517580 - DNA, 21 bp, Homo sapiens
aagagtgagactccacctcaa

SEQ ID NO: 6517581 - DNA, 16 bp, Homo sapiens
aagagtgatgcctggg

SEQ ID NO: 6517582 - DNA, 20 bp, Homo sapiens
aagagtgattgcagctttat

SEQ ID NO: 6517583 - DNA, 16 bp, Homo sapiens
aagagtgccctgcttt

SEQ ID NO: 6517584 - DNA, 20 bp, Homo sapiens
aagagtgccctgctttgcaa

SEQ ID NO: 6517585 - DNA, 21 bp, Homo sapiens
aagagtgccctgctttgcaaa

SEQ ID NO: 6517586 - DNA, 23 bp, Homo sapiens
aagagtgccctgctttgcaaaca

SEQ ID NO: 6517587 - DNA, 20 bp, Homo sapiens
aagagtgcgccgagtctgtc

SEQ ID NO: 6517588 - DNA, 17 bp, Homo sapiens
aagagtgctaagcatta

SEQ ID NO: 6517589 - DNA, 17 bp, Homo sapiens
aagagtggagagaagct

SEQ ID NO: 6517590 - DNA, 15 bp, Homo sapiens
aagagtggccccacc

SEQ ID NO: 6517591 - DNA, 19 bp, Homo sapiens
aagagtggccccacctggc

SEQ ID NO: 6517592 - DNA, 16 bp, Homo sapiens
aagagtgggctgcatc

SEQ ID NO: 6517593 - DNA, 15 bp, Homo sapiens
aagagtggtggccta

SEQ ID NO: 6517594 - DNA, 15 bp, Homo sapiens
aagagtgtaacatcc

SEQ ID NO: 6517595 - DNA, 15 bp, Homo sapiens
aagagtgtagaagca

SEQ ID NO: 6517596 - DNA, 16 bp, Homo sapiens
aagagtgtagaagcat

SEQ ID NO: 6517597 - DNA, 15 bp, Homo sapiens
aagagtgtgctcggg

SEQ ID NO: 6517598 - DNA, 12 bp, Homo sapiens
aagagtgtgtgt

SEQ ID NO: 6517599 - DNA, 19 bp, Homo sapiens
aagagtgtgttataaaata

SEQ ID NO: 6517600 - DNA, 21 bp, Homo sapiens
aagagtgtgttataaaataat

SEQ ID NO: 6517601 - DNA, 17 bp, Homo sapiens
aagagtgttatcatatt

SEQ ID NO: 6517602 - DNA, 15 bp, Homo sapiens
aagagttaaagagta

SEQ ID NO: 6517603 - DNA, 15 bp, Homo sapiens
aagagttaagaatgt

SEQ ID NO: 6517604 - DNA, 15 bp, Homo sapiens
aagagttatatgact

SEQ ID NO: 6517605 - DNA, 20 bp, Homo sapiens
aagagttattcaaatgaagg

SEQ ID NO: 6517606 - DNA, 16 bp, Homo sapiens
aagagttccctgcaac

SEQ ID NO: 6517607 - DNA, 20 bp, Homo sapiens
aagagttcccttgaaacttt

SEQ ID NO: 6517608 - DNA, 17 bp, Homo sapiens
aagagttctatccccaa

SEQ ID NO: 6517609 - DNA, 16 bp, Homo sapiens
aagagttgagcacagg

SEQ ID NO: 6517610 - DNA, 19 bp, Homo sapiens
aagagttgagtgatagagc

SEQ ID NO: 6517611 - DNA, 21 bp, Homo sapiens
aagagttgctttgccagagca

SEQ ID NO: 6517612 - DNA, 23 bp, Homo sapiens
aagagttgctttgccagagcagg

SEQ ID NO: 6517613 - DNA, 20 bp, Homo sapiens
aagagttgtcctgatgtttt

SEQ ID NO: 6517614 - DNA, 18 bp, Homo sapiens
aagagtttaaacaaaaaa

SEQ ID NO: 6517615 - DNA, 23 bp, Homo sapiens
aagagtttaactttgggcccaga

SEQ ID NO: 6517616 - DNA, 12 bp, Homo sapiens
aagagtttacaa

SEQ ID NO: 6517617 - DNA, 15 bp, Homo sapiens
aagagtttacaagaa

SEQ ID NO: 6517618 - DNA, 16 bp, Homo sapiens
aagagtttacaagaaa

SEQ ID NO: 6517619 - DNA, 13 bp, Homo sapiens
aagagtttcttgt

SEQ ID NO: 6517620 - DNA, 22 bp, Homo sapiens
aagagtttgatgaggccctcca

SEQ ID NO: 6517621 - DNA, 20 bp, Homo sapiens
aagagtttgcaaatgcaaca

SEQ ID NO: 6517622 - DNA, 13 bp, Homo sapiens
aagagtttgtaaa

SEQ ID NO: 6517623 - DNA, 23 bp, Homo sapiens
aagagtttgttctgttctggggg

SEQ ID NO: 6517624 - DNA, 24 bp, Homo sapiens
aagataaaaaaactgttaccagat

SEQ ID NO: 6517625 - DNA, 21 bp, Homo sapiens
aagataaaaactgcccattgt

SEQ ID NO: 6517626 - DNA, 14 bp, Homo sapiens
aagataaaagaatg

SEQ ID NO: 6517627 - DNA, 19 bp, Homo sapiens
aagataaaatatcctcagg

SEQ ID NO: 6517628 - DNA, 15 bp, Homo sapiens
aagataaaatgatgt

SEQ ID NO: 6517629 - DNA, 22 bp, Homo sapiens
aagataaacacaagattggtgt

SEQ ID NO: 6517630 - DNA, 13 bp, Homo sapiens
aagataaacatta

SEQ ID NO: 6517631 - DNA, 17 bp, Homo sapiens
aagataaacctggagat

SEQ ID NO: 6517632 - DNA, 11 bp, Homo sapiens
aagataaagga

SEQ ID NO: 6517633 - DNA, 14 bp, Homo sapiens
aagataaaggacag

SEQ ID NO: 6517634 - DNA, 13 bp, Homo sapiens
aagataaatgatg

SEQ ID NO: 6517635 - DNA, 13 bp, Homo sapiens
aagataaatgctt

SEQ ID NO: 6517636 - DNA, 15 bp, Homo sapiens
aagataaatgcttta

SEQ ID NO: 6517637 - DNA, 20 bp, Homo sapiens
aagataaatgctttaaatag

SEQ ID NO: 6517638 - DNA, 12 bp, Homo sapiens
aagataaatgtg

SEQ ID NO: 6517639 - DNA, 14 bp, Homo sapiens
aagataaatgtgct

SEQ ID NO: 6517640 - DNA, 21 bp, Homo sapiens
aagataacaagatctttcagg

SEQ ID NO: 6517641 - DNA, 22 bp, Homo sapiens
aagataacaagatctttcagga

SEQ ID NO: 6517642 - DNA, 16 bp, Homo sapiens
aagataacgcaggaga

SEQ ID NO: 6517643 - DNA, 20 bp, Homo sapiens
aagataacgcaggagagaga

SEQ ID NO: 6517644 - DNA, 15 bp, Homo sapiens
aagataacttactgt

SEQ ID NO: 6517645 - DNA, 16 bp, Homo sapiens
aagataacttactgta

SEQ ID NO: 6517646 - DNA, 17 bp, Homo sapiens
aagataacttactgtat

SEQ ID NO: 6517647 - DNA, 22 bp, Homo sapiens
aagataagatttctgtctacta

SEQ ID NO: 6517648 - DNA, 18 bp, Homo sapiens
aagataagcctgagcctt

SEQ ID NO: 6517649 - DNA, 19 bp, Homo sapiens
aagataaggactagatact

SEQ ID NO: 6517650 - DNA, 13 bp, Homo sapiens
aagataagttgga

SEQ ID NO: 6517651 - DNA, 15 bp, Homo sapiens
aagataataatatat

SEQ ID NO: 6517652 - DNA, 19 bp, Homo sapiens
aagataatattaaggaaga

SEQ ID NO: 6517653 - DNA, 21 bp, Homo sapiens
aagataatattaaggaagaca

SEQ ID NO: 6517654 - DNA, 15 bp, Homo sapiens
aagataatatttaaa

SEQ ID NO: 6517655 - DNA, 16 bp, Homo sapiens
aagataatcattgctt

SEQ ID NO: 6517656 - DNA, 22 bp, Homo sapiens
aagataatctcagtgctttcct

SEQ ID NO: 6517657 - DNA, 22 bp, Homo sapiens
aagataatgcatatttttgcac

SEQ ID NO: 6517658 - DNA, 17 bp, Homo sapiens
aagataatgttatacat

SEQ ID NO: 6517659 - DNA, 20 bp, Homo sapiens
aagataatgttctttaatgt

SEQ ID NO: 6517660 - DNA, 19 bp, Homo sapiens
aagataattaaatgaaata

SEQ ID NO: 6517661 - DNA, 22 bp, Homo sapiens
aagataattaaatgaaatactt

SEQ ID NO: 6517662 - DNA, 12 bp, Homo sapiens
aagataattata

SEQ ID NO: 6517663 - DNA, 15 bp, Homo sapiens
aagataattcactgt

SEQ ID NO: 6517664 - DNA, 13 bp, Homo sapiens
aagataattgcta

SEQ ID NO: 6517665 - DNA, 18 bp, Homo sapiens
aagataattgtactttga

SEQ ID NO: 6517666 - DNA, 19 bp, Homo sapiens
aagataattgttgaaattt

SEQ ID NO: 6517667 - DNA, 16 bp, Homo sapiens
aagataatttatttca

SEQ ID NO: 6517668 - DNA, 14 bp, Homo sapiens
aagataatttgcat

SEQ ID NO: 6517669 - DNA, 22 bp, Homo sapiens
aagataattttcagctgcaagg

SEQ ID NO: 6517670 - DNA, 15 bp, Homo sapiens
aagatacaaaagctt

SEQ ID NO: 6517671 - DNA, 14 bp, Homo sapiens
aagatacaaataag

SEQ ID NO: 6517672 - DNA, 18 bp, Homo sapiens
aagatacaaattaatttt

SEQ ID NO: 6517673 - DNA, 18 bp, Homo sapiens
aagatacaagaaaaagta

SEQ ID NO: 6517674 - DNA, 16 bp, Homo sapiens
aagatacaataaaaca

SEQ ID NO: 6517675 - DNA, 21 bp, Homo sapiens
aagatacactcaagcatgaag

SEQ ID NO: 6517676 - DNA, 14 bp, Homo sapiens
aagatacactcctg

SEQ ID NO: 6517677 - DNA, 18 bp, Homo sapiens
aagatacactcctgctgt

SEQ ID NO: 6517678 - DNA, 17 bp, Homo sapiens
aagatacagttactcag

SEQ ID NO: 6517679 - DNA, 23 bp, Homo sapiens
aagatacagttactcagaattct

SEQ ID NO: 6517680 - DNA, 13 bp, Homo sapiens
aagatacatgatt

SEQ ID NO: 6517681 - DNA, 14 bp, Homo sapiens
aagatacatgctaa

SEQ ID NO: 6517682 - DNA, 18 bp, Homo sapiens
aagatacatgctaagaaa

SEQ ID NO: 6517683 - DNA, 22 bp, Homo sapiens
aagataccggtgcttctggaaa

SEQ ID NO: 6517684 - DNA, 14 bp, Homo sapiens
aagataccttaaaa

SEQ ID NO: 6517685 - DNA, 17 bp, Homo sapiens
aagataccttaaaattt

SEQ ID NO: 6517686 - DNA, 18 bp, Homo sapiens
aagataccttaaaatttg

SEQ ID NO: 6517687 - DNA, 14 bp, Homo sapiens
aagatacgacttta

SEQ ID NO: 6517688 - DNA, 18 bp, Homo sapiens
aagatacgactttatttt

SEQ ID NO: 6517689 - DNA, 21 bp, Homo sapiens
aagatacgactttattttctg

SEQ ID NO: 6517690 - DNA, 17 bp, Homo sapiens
aagatactcaagcaggt

SEQ ID NO: 6517691 - DNA, 16 bp, Homo sapiens
aagatactgaaataaa

SEQ ID NO: 6517692 - DNA, 17 bp, Homo sapiens
aagatactgctgatgct

SEQ ID NO: 6517693 - DNA, 17 bp, Homo sapiens
aagatactggactaagt

SEQ ID NO: 6517694 - DNA, 17 bp, Homo sapiens
aagatacttgatgcact

SEQ ID NO: 6517695 - DNA, 16 bp, Homo sapiens
aagatactttgtattg

SEQ ID NO: 6517696 - DNA, 13 bp, Homo sapiens
aagatagaaagct

SEQ ID NO: 6517697 - DNA, 14 bp, Homo sapiens
aagatagaaagctg

SEQ ID NO: 6517698 - DNA, 18 bp, Homo sapiens
aagatagaaagctggact

SEQ ID NO: 6517699 - DNA, 22 bp, Homo sapiens
aagatagaaagctggactgacc

SEQ ID NO: 6517700 - DNA, 13 bp, Homo sapiens
aagatagaacaca

SEQ ID NO: 6517701 - DNA, 16 bp, Homo sapiens
aagatagacaggtcct

SEQ ID NO: 6517702 - DNA, 18 bp, Homo sapiens
aagatagcatcccatctc

SEQ ID NO: 6517703 - DNA, 17 bp, Homo sapiens
aagatagcgcatatatt

SEQ ID NO: 6517704 - DNA, 15 bp, Homo sapiens
aagatagctctctga

SEQ ID NO: 6517705 - DNA, 16 bp, Homo sapiens
aagataggaagaaaat

SEQ ID NO: 6517706 - DNA, 20 bp, Homo sapiens
aagataggacgtatttataa

SEQ ID NO: 6517707 - DNA, 17 bp, Homo sapiens
aagataggagttctctg

SEQ ID NO: 6517708 - DNA, 17 bp, Homo sapiens
aagataggctctcagta

SEQ ID NO: 6517709 - DNA, 13 bp, Homo sapiens
aagataggctctg

SEQ ID NO: 6517710 - DNA, 20 bp, Homo sapiens
aagatagtcttggaagctgt

SEQ ID NO: 6517711 - DNA, 24 bp, Homo sapiens
aagatagttacatttatgtgctgt

SEQ ID NO: 6517712 - DNA, 13 bp, Homo sapiens
aagatagttgtaa

SEQ ID NO: 6517713 - DNA, 16 bp, Homo sapiens
aagatagttgtaaaga

SEQ ID NO: 6517714 - DNA, 18 bp, Homo sapiens
aagatagttgtaaagata

SEQ ID NO: 6517715 - DNA, 23 bp, Homo sapiens
aagatagttgtaaagatattgta

SEQ ID NO: 6517716 - DNA, 15 bp, Homo sapiens
aagatagtttattat

SEQ ID NO: 6517717 - DNA, 15 bp, Homo sapiens
aagatataagtgctg

SEQ ID NO: 6517718 - DNA, 19 bp, Homo sapiens
aagatataagtgctgtata

SEQ ID NO: 6517719 - DNA, 20 bp, Homo sapiens
aagatataagtgctgtataa

SEQ ID NO: 6517720 - DNA, 21 bp, Homo sapiens
aagatataagtgctgtataaa

SEQ ID NO: 6517721 - DNA, 16 bp, Homo sapiens
aagatatacttgtttt

SEQ ID NO: 6517722 - DNA, 19 bp, Homo sapiens
aagatatacttgtttttgt

SEQ ID NO: 6517723 - DNA, 21 bp, Homo sapiens
aagatatatacacaggatcct

SEQ ID NO: 6517724 - DNA, 14 bp, Homo sapiens
aagatatatgtgta

SEQ ID NO: 6517725 - DNA, 14 bp, Homo sapiens
aagatatattaaaa

SEQ ID NO: 6517726 - DNA, 19 bp, Homo sapiens
aagatatcttttctttaga

SEQ ID NO: 6517727 - DNA, 17 bp, Homo sapiens
aagatatgaagaactat

SEQ ID NO: 6517728 - DNA, 22 bp, Homo sapiens
aagatatgccactaacttctaa

SEQ ID NO: 6517729 - DNA, 13 bp, Homo sapiens
aagatatggagaa

SEQ ID NO: 6517730 - DNA, 16 bp, Homo sapiens
aagatatggcacttct

SEQ ID NO: 6517731 - DNA, 16 bp, Homo sapiens
aagatatgggacattt

SEQ ID NO: 6517732 - DNA, 12 bp, Homo sapiens
aagatatgtata

SEQ ID NO: 6517733 - DNA, 19 bp, Homo sapiens
aagatatgtatatttttga

SEQ ID NO: 6517734 - DNA, 18 bp, Homo sapiens
aagatatgtattctaatt

SEQ ID NO: 6517735 - DNA, 14 bp, Homo sapiens
aagatattatttgt

SEQ ID NO: 6517736 - DNA, 20 bp, Homo sapiens
aagatattatttgtcttaaa

SEQ ID NO: 6517737 - DNA, 13 bp, Homo sapiens
aagatattccttt

SEQ ID NO: 6517738 - DNA, 15 bp, Homo sapiens
aagatattctttaca

SEQ ID NO: 6517739 - DNA, 16 bp, Homo sapiens
aagatattctttacaa

SEQ ID NO: 6517740 - DNA, 16 bp, Homo sapiens
aagatattgtacataa

SEQ ID NO: 6517741 - DNA, 15 bp, Homo sapiens
aagatattgtattat

SEQ ID NO: 6517742 - DNA, 18 bp, Homo sapiens
aagatatttatatatatt

SEQ ID NO: 6517743 - DNA, 20 bp, Homo sapiens
aagatatttgcagtttttca

SEQ ID NO: 6517744 - DNA, 19 bp, Homo sapiens
aagatattttaaaatctgt

SEQ ID NO: 6517745 - DNA, 15 bp, Homo sapiens
aagatattttatttc

SEQ ID NO: 6517746 - DNA, 20 bp, Homo sapiens
aagatattttatttctgatg

SEQ ID NO: 6517747 - DNA, 17 bp, Homo sapiens
aagatattttgctttgt

SEQ ID NO: 6517748 - DNA, 16 bp, Homo sapiens
aagatatttttattca

SEQ ID NO: 6517749 - DNA, 20 bp, Homo sapiens
aagatatttttattcaaact

SEQ ID NO: 6517750 - DNA, 13 bp, Homo sapiens
aagatatttttga

SEQ ID NO: 6517751 - DNA, 22 bp, Homo sapiens
aagatcaaaagcttattcatct

SEQ ID NO: 6517752 - DNA, 21 bp, Homo sapiens
aagatcaaaataaaaagtgac

SEQ ID NO: 6517753 - DNA, 20 bp, Homo sapiens
aagatcaattccctctctca

SEQ ID NO: 6517754 - DNA, 15 bp, Homo sapiens
aagatcacagagcag

SEQ ID NO: 6517755 - DNA, 21 bp, Homo sapiens
tggaaaactaagaaaattgct

SEQ ID NO: 6517756 - DNA, 14 bp, Homo sapiens
tggaaaactcacag

SEQ ID NO: 6517757 - DNA, 14 bp, Homo sapiens
tggaaaactgccac

SEQ ID NO: 6517758 - DNA, 19 bp, Homo sapiens
tggaaaactgccacaagca

SEQ ID NO: 6517759 - DNA, 14 bp, Homo sapiens
tggaaaacttagtt

SEQ ID NO: 6517760 - DNA, 19 bp, Homo sapiens
tggaaaagaaatcaatttt

SEQ ID NO: 6517761 - DNA, 12 bp, Homo sapiens
tggaaaagaaga

SEQ ID NO: 6517762 - DNA, 14 bp, Homo sapiens
tggaaaagaataaa

SEQ ID NO: 6517763 - DNA, 18 bp, Homo sapiens
tggaaaagcaacttcatt

SEQ ID NO: 6517764 - DNA, 13 bp, Homo sapiens
tggaaaagcccag

SEQ ID NO: 6517765 - DNA, 22 bp, Homo sapiens
tggaaaaggaagactagaggct

SEQ ID NO: 6517766 - DNA, 16 bp, Homo sapiens
tggaaaagggctcaga

SEQ ID NO: 6517767 - DNA, 22 bp, Homo sapiens
tggaaaagtatgttagtgcaaa

SEQ ID NO: 6517768 - DNA, 16 bp, Homo sapiens
tggaaaagtcacacag

SEQ ID NO: 6517769 - DNA, 22 bp, Homo sapiens
tggaaaagtcacacagacacac

SEQ ID NO: 6517770 - DNA, 15 bp, Homo sapiens
tggaaaagtttgaaa

SEQ ID NO: 6517771 - DNA, 16 bp, Homo sapiens
tggaaaataaattata

SEQ ID NO: 6517772 - DNA, 16 bp, Homo sapiens
tggaaaataataaaag

SEQ ID NO: 6517773 - DNA, 17 bp, Homo sapiens
tggaaaataataaaaga

SEQ ID NO: 6517774 - DNA, 16 bp, Homo sapiens
tggaaaataccagtgt

SEQ ID NO: 6517775 - DNA, 22 bp, Homo sapiens
tggaaaatacctaattgtggat

SEQ ID NO: 6517776 - DNA, 24 bp, Homo sapiens
tggaaaatacctaattgtggatga

SEQ ID NO: 6517777 - DNA, 19 bp, Homo sapiens
tggaaaatcatattgagaa

SEQ ID NO: 6517778 - DNA, 22 bp, Homo sapiens
tggaaaatctgtaaaaaagaaa

SEQ ID NO: 6517779 - DNA, 22 bp, Homo sapiens
tggaaaatgctatcaaataact

SEQ ID NO: 6517780 - DNA, 13 bp, Homo sapiens
tggaaaatgcttc

SEQ ID NO: 6517781 - DNA, 19 bp, Homo sapiens
tggaaaatgcttcttggct

SEQ ID NO: 6517782 - DNA, 12 bp, Homo sapiens
tggaaaatgtat

SEQ ID NO: 6517783 - DNA, 22 bp, Homo sapiens
tggaaaatttcagtccagaaga

SEQ ID NO: 6517784 - DNA, 16 bp, Homo sapiens
tggaaaattttctcct

SEQ ID NO: 6517785 - DNA, 17 bp, Homo sapiens
tggaaacaaaacagaag

SEQ ID NO: 6517786 - DNA, 16 bp, Homo sapiens
tggaaacaaagtggaa

SEQ ID NO: 6517787 - DNA, 13 bp, Homo sapiens
tggaaacaatgtg

SEQ ID NO: 6517788 - DNA, 23 bp, Homo sapiens
tggaaacactaaatgttaaagat

SEQ ID NO: 6517789 - DNA, 13 bp, Homo sapiens
tggaaacagaaga

SEQ ID NO: 6517790 - DNA, 17 bp, Homo sapiens
tggaaacagaggtaaaa

SEQ ID NO: 6517791 - DNA, 23 bp, Homo sapiens
tggaaacagaggtaaaaaaaaga

SEQ ID NO: 6517792 - DNA, 15 bp, Homo sapiens
tggaaacagggcagt

SEQ ID NO: 6517793 - DNA, 18 bp, Homo sapiens
tggaaacagttggcactg

SEQ ID NO: 6517794 - DNA, 17 bp, Homo sapiens
tggaaacatcactgggg

SEQ ID NO: 6517795 - DNA, 13 bp, Homo sapiens
tggaaacatctga

SEQ ID NO: 6517796 - DNA, 18 bp, Homo sapiens
tggaaacattacagttca

SEQ ID NO: 6517797 - DNA, 22 bp, Homo sapiens
tggaaaccaagtcaggccaggt

SEQ ID NO: 6517798 - DNA, 20 bp, Homo sapiens
tggaaaccacacttcttgaa

SEQ ID NO: 6517799 - DNA, 15 bp, Homo sapiens
tggaaaccacagtca

SEQ ID NO: 6517800 - DNA, 16 bp, Homo sapiens
tggaaaccacagtcag

SEQ ID NO: 6517801 - DNA, 15 bp, Homo sapiens
tggaaaccatttctg

SEQ ID NO: 6517802 - DNA, 17 bp, Homo sapiens
tggaaaccctgagagtc

SEQ ID NO: 6517803 - DNA, 21 bp, Homo sapiens
tggaaacccttaggacagggt

SEQ ID NO: 6517804 - DNA, 17 bp, Homo sapiens
tggaaacctaactgcaa

SEQ ID NO: 6517805 - DNA, 19 bp, Homo sapiens
tggaaacctctacatattt

SEQ ID NO: 6517806 - DNA, 19 bp, Homo sapiens
tggaaacctgccctgcctg

SEQ ID NO: 6517807 - DNA, 21 bp, Homo sapiens
tggaaacctgccctgcctgag

SEQ ID NO: 6517808 - DNA, 14 bp, Homo sapiens
tggaaacctgttat

SEQ ID NO: 6517809 - DNA, 19 bp, Homo sapiens
tggaaacctgttatgccaa

SEQ ID NO: 6517810 - DNA, 18 bp, Homo sapiens
tggaaacggtatcctccc

SEQ ID NO: 6517811 - DNA, 15 bp, Homo sapiens
tggaaactaataaaa

SEQ ID NO: 6517812 - DNA, 17 bp, Homo sapiens
tggaaactaataaaata

SEQ ID NO: 6517813 - DNA, 22 bp, Homo sapiens
tggaaactaataaaatattttc

SEQ ID NO: 6517814 - DNA, 23 bp, Homo sapiens
tggaaactaattgttttttttct

SEQ ID NO: 6517815 - DNA, 19 bp, Homo sapiens
tggaaactaccagtgggca

SEQ ID NO: 6517816 - DNA, 13 bp, Homo sapiens
tggaaactcagcc

SEQ ID NO: 6517817 - DNA, 14 bp, Homo sapiens
tggaaactcagccg

SEQ ID NO: 6517818 - DNA, 15 bp, Homo sapiens
tggaaactcagccgt

SEQ ID NO: 6517819 - DNA, 18 bp, Homo sapiens
tggaaactctttaacttc

SEQ ID NO: 6517820 - DNA, 19 bp, Homo sapiens
tggaaactctttaacttct

SEQ ID NO: 6517821 - DNA, 15 bp, Homo sapiens
tggaaactgccaaac

SEQ ID NO: 6517822 - DNA, 14 bp, Homo sapiens
tggaaactgctaaa

SEQ ID NO: 6517823 - DNA, 15 bp, Homo sapiens
tggaaactgctcaga

SEQ ID NO: 6517824 - DNA, 14 bp, Homo sapiens
tggaaactgctccc

SEQ ID NO: 6517825 - DNA, 19 bp, Homo sapiens
tggaaacttagagtcatga

SEQ ID NO: 6517826 - DNA, 23 bp, Homo sapiens
tggaaacttcagcggtttatata

SEQ ID NO: 6517827 - DNA, 14 bp, Homo sapiens
tggaaacttttctt

SEQ ID NO: 6517828 - DNA, 22 bp, Homo sapiens
tggaaacttttcttaaaaagtt

SEQ ID NO: 6517829 - DNA, 22 bp, Homo sapiens
tggaaagaaaagaatgtacatt

SEQ ID NO: 6517830 - DNA, 14 bp, Homo sapiens
tggaaagaacattt

SEQ ID NO: 6517831 - DNA, 12 bp, Homo sapiens
tggaaagaagga

SEQ ID NO: 6517832 - DNA, 14 bp, Homo sapiens
tggaaagaaggaaa

SEQ ID NO: 6517833 - DNA, 16 bp, Homo sapiens
tggaaagaaggaaaaa

SEQ ID NO: 6517834 - DNA, 17 bp, Homo sapiens
tggaaagaaggaaaaaa

SEQ ID NO: 6517835 - DNA, 12 bp, Homo sapiens
tggaaagacagg

SEQ ID NO: 6517836 - DNA, 19 bp, Homo sapiens
tggaaagacctgtgagggg

SEQ ID NO: 6517837 - DNA, 12 bp, Homo sapiens
tggaaagacttc

SEQ ID NO: 6517838 - DNA, 18 bp, Homo sapiens
tggaaagacttctcaaag

SEQ ID NO: 6517839 - DNA, 22 bp, Homo sapiens
tggaaagacttctcaaagagaa

SEQ ID NO: 6517840 - DNA, 13 bp, Homo sapiens
tggaaagagacca

SEQ ID NO: 6517841 - DNA, 21 bp, Homo sapiens
tggaaagagctgttttggatg

SEQ ID NO: 6517842 - DNA, 19 bp, Homo sapiens
tggaaagaggagaaggaga

SEQ ID NO: 6517843 - DNA, 14 bp, Homo sapiens
tggaaagaggctct

SEQ ID NO: 6517844 - DNA, 19 bp, Homo sapiens
tggaaagaggtgaaaatga

SEQ ID NO: 6517845 - DNA, 21 bp, Homo sapiens
tggaaagatagagattgtttt

SEQ ID NO: 6517846 - DNA, 21 bp, Homo sapiens
tggaaagatgttaagcattta

SEQ ID NO: 6517847 - DNA, 12 bp, Homo sapiens
tggaaagcaaag

SEQ ID NO: 6517848 - DNA, 22 bp, Homo sapiens
tggaaagcagagcctcctggga

SEQ ID NO: 6517849 - DNA, 19 bp, Homo sapiens
tggaaagcagagttttcat

SEQ ID NO: 6517850 - DNA, 18 bp, Homo sapiens
tggaaagcagcagcttgt

SEQ ID NO: 6517851 - DNA, 11 bp, Homo sapiens
tggaaagccag

SEQ ID NO: 6517852 - DNA, 12 bp, Homo sapiens
tggaaagcctct

SEQ ID NO: 6517853 - DNA, 15 bp, Homo sapiens
tggaaagcctctgct

SEQ ID NO: 6517854 - DNA, 20 bp, Homo sapiens
tggaaagctcctagcagaga

SEQ ID NO: 6517855 - DNA, 14 bp, Homo sapiens
tggaaaggaaaaaa

SEQ ID NO: 6517856 - DNA, 15 bp, Homo sapiens
tggaaaggaaaaaag

SEQ ID NO: 6517857 - DNA, 22 bp, Homo sapiens
tggaaaggaaagatgatgctca

SEQ ID NO: 6517858 - DNA, 15 bp, Homo sapiens
tggaaaggactttgt

SEQ ID NO: 6517859 - DNA, 15 bp, Homo sapiens
tggaaaggagaggaa

SEQ ID NO: 6517860 - DNA, 23 bp, Homo sapiens
tggaaaggagaggaaagaactca

SEQ ID NO: 6517861 - DNA, 21 bp, Homo sapiens
tggaaaggagcctaggccagg

SEQ ID NO: 6517862 - DNA, 23 bp, Homo sapiens
tggaaaggatgcttctgctcaca

SEQ ID NO: 6517863 - DNA, 18 bp, Homo sapiens
tggaaaggattctaaaca

SEQ ID NO: 6517864 - DNA, 21 bp, Homo sapiens
tggaaaggattctaaacagat

SEQ ID NO: 6517865 - DNA, 15 bp, Homo sapiens
tggaaaggccagcag

SEQ ID NO: 6517866 - DNA, 18 bp, Homo sapiens
tggaaaggcctcttctca

SEQ ID NO: 6517867 - DNA, 21 bp, Homo sapiens
tggaaaggctcagtctcagga

SEQ ID NO: 6517868 - DNA, 23 bp, Homo sapiens
tggaaaggctcagtctcaggagc

SEQ ID NO: 6517869 - DNA, 17 bp, Homo sapiens
tggaaagggagggagga

SEQ ID NO: 6517870 - DNA, 14 bp, Homo sapiens
tggaaaggggagag

SEQ ID NO: 6517871 - DNA, 15 bp, Homo sapiens
tggaaaggggagagc

SEQ ID NO: 6517872 - DNA, 17 bp, Homo sapiens
tggaaaggggagttgag

SEQ ID NO: 6517873 - DNA, 19 bp, Homo sapiens
tggaaaggggggagctggg

SEQ ID NO: 6517874 - DNA, 18 bp, Homo sapiens
tggaaaggtcctgctgtg

SEQ ID NO: 6517875 - DNA, 19 bp, Homo sapiens
tggaaaggtgtgagactgg

SEQ ID NO: 6517876 - DNA, 16 bp, Homo sapiens
tggaaagtagctgcta

SEQ ID NO: 6517877 - DNA, 18 bp, Homo sapiens
tggaaagtcaggctagct

SEQ ID NO: 6517878 - DNA, 23 bp, Homo sapiens
tggaaagtcaggctagctgtgct

SEQ ID NO: 6517879 - DNA, 15 bp, Homo sapiens
tggaaagtcctccta

SEQ ID NO: 6517880 - DNA, 23 bp, Homo sapiens
tggaaagtgaatttgaatgaaaa

SEQ ID NO: 6517881 - DNA, 20 bp, Homo sapiens
tggaaagtgatttgtaatat

SEQ ID NO: 6517882 - DNA, 21 bp, Homo sapiens
tggaaagtgccagcattccag

SEQ ID NO: 6517883 - DNA, 14 bp, Homo sapiens
tggaaagtgttcat

SEQ ID NO: 6517884 - DNA, 21 bp, Homo sapiens
tggaaagttaatgtcaaggaa

SEQ ID NO: 6517885 - DNA, 18 bp, Homo sapiens
tggaaagttactgtaaat

SEQ ID NO: 6517886 - DNA, 19 bp, Homo sapiens
tggaaagttactgtaaatg

SEQ ID NO: 6517887 - DNA, 22 bp, Homo sapiens
tggaaagttgggcccctgagga

SEQ ID NO: 6517888 - DNA, 13 bp, Homo sapiens
tggaaagtttgta

SEQ ID NO: 6517889 - DNA, 15 bp, Homo sapiens
tggaaataaaaatgt

SEQ ID NO: 6517890 - DNA, 17 bp, Homo sapiens
tggaaataaactgtgca

SEQ ID NO: 6517891 - DNA, 16 bp, Homo sapiens
tggaaataaagtcaga

SEQ ID NO: 6517892 - DNA, 16 bp, Homo sapiens
tggaaatacactcatg

SEQ ID NO: 6517893 - DNA, 15 bp, Homo sapiens
tggaaatacagttat

SEQ ID NO: 6517894 - DNA, 15 bp, Homo sapiens
tggaaatacatttag

SEQ ID NO: 6517895 - DNA, 16 bp, Homo sapiens
tggaaatacatttaga

SEQ ID NO: 6517896 - DNA, 18 bp, Homo sapiens
tggaaatacatttagaac

SEQ ID NO: 6517897 - DNA, 16 bp, Homo sapiens
tggaaatactgatgga

SEQ ID NO: 6517898 - DNA, 16 bp, Homo sapiens
tggaaatagcatgaca

SEQ ID NO: 6517899 - DNA, 18 bp, Homo sapiens
tggaaataggcaattaga

SEQ ID NO: 6517900 - DNA, 13 bp, Homo sapiens
tggaaatatatat

SEQ ID NO: 6517901 - DNA, 14 bp, Homo sapiens
tggaaatatatatt

SEQ ID NO: 6517902 - DNA, 17 bp, Homo sapiens
tggaaatatatattata

SEQ ID NO: 6517903 - DNA, 19 bp, Homo sapiens
tggaaatatatattatact

SEQ ID NO: 6517904 - DNA, 18 bp, Homo sapiens
tggaaatatgcaacctgt

SEQ ID NO: 6517905 - DNA, 19 bp, Homo sapiens
tggaaatatgcaacctgtg

SEQ ID NO: 6517906 - DNA, 16 bp, Homo sapiens
tggaaatatgttctaa

SEQ ID NO: 6517907 - DNA, 16 bp, Homo sapiens
tggaaatattaaaaga

SEQ ID NO: 6517908 - DNA, 19 bp, Homo sapiens
tggaaatattatgcaaatt

SEQ ID NO: 6517909 - DNA, 23 bp, Homo sapiens
tggaaatattatgcaaattccca

SEQ ID NO: 6517910 - DNA, 13 bp, Homo sapiens
tggaaatcaatac

SEQ ID NO: 6517911 - DNA, 21 bp, Homo sapiens
tggaaatcaatactgcacact

SEQ ID NO: 6517912 - DNA, 16 bp, Homo sapiens
tggaaatcagccaagt

SEQ ID NO: 6517913 - DNA, 20 bp, Homo sapiens
tggaaatcagtagaaagcta

SEQ ID NO: 6517914 - DNA, 22 bp, Homo sapiens
tggaaatcagtagaaagctaaa

SEQ ID NO: 6517915 - DNA, 22 bp, Homo sapiens
tggaaatcagttgtgaatacat

SEQ ID NO: 6517916 - DNA, 14 bp, Homo sapiens
tggaaatcatacca

SEQ ID NO: 6517917 - DNA, 18 bp, Homo sapiens
tggaaatcatcgaaaatt

SEQ ID NO: 6517918 - DNA, 16 bp, Homo sapiens
tggaaatcattgtgtg

SEQ ID NO: 6517919 - DNA, 16 bp, Homo sapiens
tggaaatccctttctg

SEQ ID NO: 6517920 - DNA, 19 bp, Homo sapiens
tggaaatcctagtttcctc

SEQ ID NO: 6517921 - DNA, 20 bp, Homo sapiens
tggaaatctggattttcagc

SEQ ID NO: 6517922 - DNA, 15 bp, Homo sapiens
tggaaatctttaaaa

SEQ ID NO: 6517923 - DNA, 15 bp, Homo sapiens
tggaaatcttttaca

SEQ ID NO: 6517924 - DNA, 13 bp, Homo sapiens
tggaaatgatgtt

SEQ ID NO: 6517925 - DNA, 15 bp, Homo sapiens
tggaaatgatgttgg

SEQ ID NO: 6517926 - DNA, 20 bp, Homo sapiens
tggaaatgctgggctgacgg

SEQ ID NO: 6517927 - DNA, 17 bp, Homo sapiens
tggaaatggatgcaaag

SEQ ID NO: 6517928 - DNA, 16 bp, Homo sapiens
tggaaatggggagctg

SEQ ID NO: 6517929 - DNA, 20 bp, Homo sapiens
tggaaatggggagctggcct

SEQ ID NO: 6517930 - DNA, 14 bp, Homo sapiens
tggaaatgtacttt

SEQ ID NO: 6517931 - DNA, 11 bp, Homo sapiens
tggaaatgtag

SEQ ID NO: 6517932 - DNA, 20 bp, Homo sapiens
tggaaatgtcctccaacaat

SEQ ID NO: 6517933 - DNA, 12 bp, Homo sapiens
tggaaatgtctg

SEQ ID NO: 6517934 - DNA, 12 bp, Homo sapiens
ttaaaataatat

SEQ ID NO: 6517935 - DNA, 19 bp, Homo sapiens
ttaaaataattcatatcta

SEQ ID NO: 6517936 - DNA, 18 bp, Homo sapiens
ttaaaatacacactcaaa

SEQ ID NO: 6517937 - DNA, 19 bp, Homo sapiens
ttaaaatacacactcaaat

SEQ ID NO: 6517938 - DNA, 15 bp, Homo sapiens
ttaaaatacataact

SEQ ID NO: 6517939 - DNA, 23 bp, Homo sapiens
ttaaaatacataacttcagtgca

SEQ ID NO: 6517940 - DNA, 15 bp, Homo sapiens
ttaaaataccactgt

SEQ ID NO: 6517941 - DNA, 18 bp, Homo sapiens
ttaaaatactatattaaa

SEQ ID NO: 6517942 - DNA, 11 bp, Homo sapiens
ttaaaatactg

SEQ ID NO: 6517943 - DNA, 12 bp, Homo sapiens
ttaaaatactgt

SEQ ID NO: 6517944 - DNA, 13 bp, Homo sapiens
ttaaaatactgtt

SEQ ID NO: 6517945 - DNA, 14 bp, Homo sapiens
ttaaaatacttatt

SEQ ID NO: 6517946 - DNA, 23 bp, Homo sapiens
ttaaaatacttgtttcagcttct

SEQ ID NO: 6517947 - DNA, 12 bp, Homo sapiens
ttaaaatagaaa

SEQ ID NO: 6517948 - DNA, 20 bp, Homo sapiens
ttaaaatagaaattttgtaa

SEQ ID NO: 6517949 - DNA, 16 bp, Homo sapiens
ttaaaatagaggcttt

SEQ ID NO: 6517950 - DNA, 23 bp, Homo sapiens
ttaaaatagcaaaagaagaagtt

SEQ ID NO: 6517951 - DNA, 22 bp, Homo sapiens
ttaaaatagcatactgtgtatg

SEQ ID NO: 6517952 - DNA, 20 bp, Homo sapiens
ttaaaatagcgttcttgtaa

SEQ ID NO: 6517953 - DNA, 23 bp, Homo sapiens
ttaaaataggggatatttaaggt

SEQ ID NO: 6517954 - DNA, 17 bp, Homo sapiens
ttaaaatataaattaag

SEQ ID NO: 6517955 - DNA, 17 bp, Homo sapiens
ttaaaatatatataaat

SEQ ID NO: 6517956 - DNA, 18 bp, Homo sapiens
ttaaaatatatataaata

SEQ ID NO: 6517957 - DNA, 21 bp, Homo sapiens
ttaaaatatatataaatatat

SEQ ID NO: 6517958 - DNA, 16 bp, Homo sapiens
ttaaaatatatgaaga

SEQ ID NO: 6517959 - DNA, 20 bp, Homo sapiens
ttaaaatatatgaagacaat

SEQ ID NO: 6517960 - DNA, 18 bp, Homo sapiens
ttaaaatatcctgtaact

SEQ ID NO: 6517961 - DNA, 14 bp, Homo sapiens
ttaaaatatcttcc

SEQ ID NO: 6517962 - DNA, 19 bp, Homo sapiens
ttaaaatatcttttgacct

SEQ ID NO: 6517963 - DNA, 14 bp, Homo sapiens
ttaaaatatgcact

SEQ ID NO: 6517964 - DNA, 14 bp, Homo sapiens
ttaaaatatggcta

SEQ ID NO: 6517965 - DNA, 20 bp, Homo sapiens
ttaaaatatgtatgtctaat

SEQ ID NO: 6517966 - DNA, 13 bp, Homo sapiens
ttaaaatatgtga

SEQ ID NO: 6517967 - DNA, 12 bp, Homo sapiens
ttaaaatattaa

SEQ ID NO: 6517968 - DNA, 16 bp, Homo sapiens
ttaaaatattatttga

SEQ ID NO: 6517969 - DNA, 16 bp, Homo sapiens
ttaaaatattcctgca

SEQ ID NO: 6517970 - DNA, 19 bp, Homo sapiens
ttaaaatattcctgcattt

SEQ ID NO: 6517971 - DNA, 12 bp, Homo sapiens
ttaaaatattta

SEQ ID NO: 6517972 - DNA, 12 bp, Homo sapiens
ttaaaatatttc

SEQ ID NO: 6517973 - DNA, 21 bp, Homo sapiens
ttaaaatatttgtctttaaac

SEQ ID NO: 6517974 - DNA, 22 bp, Homo sapiens
ttaaaatatttgtctttaaaca

SEQ ID NO: 6517975 - DNA, 18 bp, Homo sapiens
ttaaaatattttcttaat

SEQ ID NO: 6517976 - DNA, 14 bp, Homo sapiens
ttaaaatattttgg

SEQ ID NO: 6517977 - DNA, 17 bp, Homo sapiens
ttaaaatcacaaactca

SEQ ID NO: 6517978 - DNA, 22 bp, Homo sapiens
ttaaaatcacaaactcatccat

SEQ ID NO: 6517979 - DNA, 17 bp, Homo sapiens
ttaaaatcactaacatt

SEQ ID NO: 6517980 - DNA, 15 bp, Homo sapiens
ttaaaatcattcaat

SEQ ID NO: 6517981 - DNA, 23 bp, Homo sapiens
ttaaaatcccaaatctatagcat

SEQ ID NO: 6517982 - DNA, 18 bp, Homo sapiens
ttaaaatctattctgtgt

SEQ ID NO: 6517983 - DNA, 22 bp, Homo sapiens
ttaaaatctgctgatctctgta

SEQ ID NO: 6517984 - DNA, 16 bp, Homo sapiens
ttaaaatctggaaatc

SEQ ID NO: 6517985 - DNA, 13 bp, Homo sapiens
ttaaaatctgttc

SEQ ID NO: 6517986 - DNA, 14 bp, Homo sapiens
ttaaaatcttgaaa

SEQ ID NO: 6517987 - DNA, 15 bp, Homo sapiens
ttaaaatgaaatgca

SEQ ID NO: 6517988 - DNA, 20 bp, Homo sapiens
ttaaaatgaaatgcattttg

SEQ ID NO: 6517989 - DNA, 21 bp, Homo sapiens
ttaaaatgaacctgctactta

SEQ ID NO: 6517990 - DNA, 14 bp, Homo sapiens
ttaaaatgaataat

SEQ ID NO: 6517991 - DNA, 18 bp, Homo sapiens
ttaaaatgcaaaataatg

SEQ ID NO: 6517992 - DNA, 18 bp, Homo sapiens
ttaaaatgcattgaaaga

SEQ ID NO: 6517993 - DNA, 11 bp, Homo sapiens
ttaaaatgctg

SEQ ID NO: 6517994 - DNA, 22 bp, Homo sapiens
ttaaaatggaaaattttctcct

SEQ ID NO: 6517995 - DNA, 21 bp, Homo sapiens
ttaaaatggatgccttgaata

SEQ ID NO: 6517996 - DNA, 20 bp, Homo sapiens
ttaaaatggatttaatccat

SEQ ID NO: 6517997 - DNA, 22 bp, Homo sapiens
ttaaaatggatttaatccattt

SEQ ID NO: 6517998 - DNA, 23 bp, Homo sapiens
ttaaaatggatttaatccatttt

SEQ ID NO: 6517999 - DNA, 19 bp, Homo sapiens
ttaaaatggtttgtcctga

SEQ ID NO: 6518000 - DNA, 13 bp, Homo sapiens
ttaaaatggtttt

SEQ ID NO: 6518001 - DNA, 18 bp, Homo sapiens
ttaaaatggtttttgttt

SEQ ID NO: 6518002 - DNA, 11 bp, Homo sapiens
ttaaaatgtaa

SEQ ID NO: 6518003 - DNA, 16 bp, Homo sapiens
ttaaaatgtaaagcca

SEQ ID NO: 6518004 - DNA, 17 bp, Homo sapiens
ttaaaatgtaaagccat

SEQ ID NO: 6518005 - DNA, 13 bp, Homo sapiens
ttaaaatgtaatt

SEQ ID NO: 6518006 - DNA, 19 bp, Homo sapiens
ttaaaatgtacatgtatta

SEQ ID NO: 6518007 - DNA, 17 bp, Homo sapiens
ttaaaatgtaggaagaa

SEQ ID NO: 6518008 - DNA, 13 bp, Homo sapiens
ttaaaatgtagtt

SEQ ID NO: 6518009 - DNA, 22 bp, Homo sapiens
ttaaaatgtataagttgaggca

SEQ ID NO: 6518010 - DNA, 19 bp, Homo sapiens
ttaaaatgtatgcatgttg

SEQ ID NO: 6518011 - DNA, 21 bp, Homo sapiens
ttaaaatgtcggatttatctt

SEQ ID NO: 6518012 - DNA, 15 bp, Homo sapiens
ttaaaatgtgatttt

SEQ ID NO: 6518013 - DNA, 20 bp, Homo sapiens
ttaaaatgtgtatttttcaa

SEQ ID NO: 6518014 - DNA, 18 bp, Homo sapiens
ttaaaatgtgtttttcag

SEQ ID NO: 6518015 - DNA, 20 bp, Homo sapiens
ttaaaatgtgtttttcagtt

SEQ ID NO: 6518016 - DNA, 13 bp, Homo sapiens
ttaaaatgttcac

SEQ ID NO: 6518017 - DNA, 18 bp, Homo sapiens
ttaaaatgttggtgcaat

SEQ ID NO: 6518018 - DNA, 12 bp, Homo sapiens
ttaaaatgttta

SEQ ID NO: 6518019 - DNA, 17 bp, Homo sapiens
ttaaaatgtttactgta

SEQ ID NO: 6518020 - DNA, 22 bp, Homo sapiens
ttaaaatgtttactgtaaattt

SEQ ID NO: 6518021 - DNA, 17 bp, Homo sapiens
ttaaaatgtttggatgg

SEQ ID NO: 6518022 - DNA, 16 bp, Homo sapiens
ttaaaattaaataaat

SEQ ID NO: 6518023 - DNA, 19 bp, Homo sapiens
ttaaaattaaataaatttt

SEQ ID NO: 6518024 - DNA, 17 bp, Homo sapiens
ttaaaattaagttgaaa

SEQ ID NO: 6518025 - DNA, 20 bp, Homo sapiens
ttaaaattaagttgaaaaag

SEQ ID NO: 6518026 - DNA, 16 bp, Homo sapiens
ttaaaattacaactaa

SEQ ID NO: 6518027 - DNA, 18 bp, Homo sapiens
ttaaaattacagatgtga

SEQ ID NO: 6518028 - DNA, 15 bp, Homo sapiens
ttaaaattagtgaga

SEQ ID NO: 6518029 - DNA, 13 bp, Homo sapiens
ttaaaattatata

SEQ ID NO: 6518030 - DNA, 16 bp, Homo sapiens
ttaaaattatatagca

SEQ ID NO: 6518031 - DNA, 17 bp, Homo sapiens
ttaaaattatatagcaa

SEQ ID NO: 6518032 - DNA, 13 bp, Homo sapiens
ttaaaattattaa

SEQ ID NO: 6518033 - DNA, 13 bp, Homo sapiens
ttaaaattcagtt

SEQ ID NO: 6518034 - DNA, 14 bp, Homo sapiens
ttaaaattcagttt

SEQ ID NO: 6518035 - DNA, 13 bp, Homo sapiens
ttaaaattcatgt

SEQ ID NO: 6518036 - DNA, 12 bp, Homo sapiens
ttaaaattctct

SEQ ID NO: 6518037 - DNA, 21 bp, Homo sapiens
ttaaaattctgatgtttctgt

SEQ ID NO: 6518038 - DNA, 22 bp, Homo sapiens
ttaaaattgatttttctcttca

SEQ ID NO: 6518039 - DNA, 15 bp, Homo sapiens
ttaaaattgccattt

SEQ ID NO: 6518040 - DNA, 13 bp, Homo sapiens
ttaaaattggcac

SEQ ID NO: 6518041 - DNA, 19 bp, Homo sapiens
ttaaaattggtaaaaataa

SEQ ID NO: 6518042 - DNA, 22 bp, Homo sapiens
ttaaaattggttaatgaaaaat

SEQ ID NO: 6518043 - DNA, 12 bp, Homo sapiens
ttaaaatttaac

SEQ ID NO: 6518044 - DNA, 13 bp, Homo sapiens
ttaaaatttatat

SEQ ID NO: 6518045 - DNA, 16 bp, Homo sapiens
ttaaaatttatcttaa

SEQ ID NO: 6518046 - DNA, 14 bp, Homo sapiens
ttaaaatttattct

SEQ ID NO: 6518047 - DNA, 13 bp, Homo sapiens
ttaaaatttctta

SEQ ID NO: 6518048 - DNA, 15 bp, Homo sapiens
ttaaaatttgaaaca

SEQ ID NO: 6518049 - DNA, 22 bp, Homo sapiens
ttaaaatttggtgcttataaga

SEQ ID NO: 6518050 - DNA, 13 bp, Homo sapiens
ttaaaatttgtag

SEQ ID NO: 6518051 - DNA, 19 bp, Homo sapiens
ttaaaatttgttcttgtat

SEQ ID NO: 6518052 - DNA, 21 bp, Homo sapiens
ttaaaattttaagctaggaaa

SEQ ID NO: 6518053 - DNA, 18 bp, Homo sapiens
ttaaaattttcattctga

SEQ ID NO: 6518054 - DNA, 23 bp, Homo sapiens
ttaaaattttcctttatgattct

SEQ ID NO: 6518055 - DNA, 20 bp, Homo sapiens
ttaaaattttggaatatttg

SEQ ID NO: 6518056 - DNA, 21 bp, Homo sapiens
ttaaacaaaatttcacagttc

SEQ ID NO: 6518057 - DNA, 20 bp, Homo sapiens
ttaaacaaacattgtgttga

SEQ ID NO: 6518058 - DNA, 21 bp, Homo sapiens
ttaaacaaagcagtatataat

SEQ ID NO: 6518059 - DNA, 23 bp, Homo sapiens
ttaaacaaagcagtatataataa

SEQ ID NO: 6518060 - DNA, 13 bp, Homo sapiens
ttaaacaaagtga

SEQ ID NO: 6518061 - DNA, 12 bp, Homo sapiens
ttaaacaaataa

SEQ ID NO: 6518062 - DNA, 16 bp, Homo sapiens
ttaaacaaatatgaaa

SEQ ID NO: 6518063 - DNA, 23 bp, Homo sapiens
ttaaacaaatatgaaaaatgtaa

SEQ ID NO: 6518064 - DNA, 12 bp, Homo sapiens
ttaaacaaatga

SEQ ID NO: 6518065 - DNA, 13 bp, Homo sapiens
ttaaacaaatgat

SEQ ID NO: 6518066 - DNA, 19 bp, Homo sapiens
ttaaacaacacctcctcct

SEQ ID NO: 6518067 - DNA, 15 bp, Homo sapiens
ttaaacaactttcca

SEQ ID NO: 6518068 - DNA, 17 bp, Homo sapiens
ttaaacaatctttcatg

SEQ ID NO: 6518069 - DNA, 21 bp, Homo sapiens
ttaaacaatctttcatgtctt

SEQ ID NO: 6518070 - DNA, 16 bp, Homo sapiens
ttaaacaatgtataaa

SEQ ID NO: 6518071 - DNA, 18 bp, Homo sapiens
ttaaacaatgtataaaga

SEQ ID NO: 6518072 - DNA, 19 bp, Homo sapiens
ttaaacaatgtataaagat

SEQ ID NO: 6518073 - DNA, 12 bp, Homo sapiens
ttaaacacacag

SEQ ID NO: 6518074 - DNA, 21 bp, Homo sapiens
ttaaacacaggctgtccttaa

SEQ ID NO: 6518075 - DNA, 19 bp, Homo sapiens
ttaaacacatgccttaaat

SEQ ID NO: 6518076 - DNA, 16 bp, Homo sapiens
ttaaacacctcctcat

SEQ ID NO: 6518077 - DNA, 16 bp, Homo sapiens
ttaaacacgtgtctat

SEQ ID NO: 6518078 - DNA, 17 bp, Homo sapiens
ttaaacactgtaatctt

SEQ ID NO: 6518079 - DNA, 22 bp, Homo sapiens
ttaaacagaagcagcaaatgaa

SEQ ID NO: 6518080 - DNA, 19 bp, Homo sapiens
ttaaacagatatcttcagt

SEQ ID NO: 6518081 - DNA, 11 bp, Homo sapiens
ttaaacagatg

SEQ ID NO: 6518082 - DNA, 22 bp, Homo sapiens
ttaaacagatgatgagaatttc

SEQ ID NO: 6518083 - DNA, 16 bp, Homo sapiens
ttaaacagatttttac

SEQ ID NO: 6518084 - DNA, 23 bp, Homo sapiens
ttaaacagcaccaccatttaatt

SEQ ID NO: 6518085 - DNA, 20 bp, Homo sapiens
ttaaacagcagcacttttta

SEQ ID NO: 6518086 - DNA, 15 bp, Homo sapiens
ttaaacaggcccagc

SEQ ID NO: 6518087 - DNA, 21 bp, Homo sapiens
ttaaacagggtctcactctgt

SEQ ID NO: 6518088 - DNA, 23 bp, Homo sapiens
ttaaacagggtctcactctgttg

SEQ ID NO: 6518089 - DNA, 21 bp, Homo sapiens
ttaaacagtagttgtattctt

SEQ ID NO: 6518090 - DNA, 23 bp, Homo sapiens
ttaaacagtgagcctgaattttg

SEQ ID NO: 6518091 - DNA, 13 bp, Homo sapiens
ttaaacagttgca

SEQ ID NO: 6518092 - DNA, 21 bp, Homo sapiens
ttaaacagttgcacagcatct

SEQ ID NO: 6518093 - DNA, 16 bp, Homo sapiens
ttaaacataaagaatt

SEQ ID NO: 6518094 - DNA, 19 bp, Homo sapiens
ttaaacataataaatcaca

SEQ ID NO: 6518095 - DNA, 19 bp, Homo sapiens
ttaaacatacataatacaa

SEQ ID NO: 6518096 - DNA, 19 bp, Homo sapiens
ttaaacatcaatctttaaa

SEQ ID NO: 6518097 - DNA, 13 bp, Homo sapiens
ttaaacatgatta

SEQ ID NO: 6518098 - DNA, 21 bp, Homo sapiens
ttaaacatgctgtacatactt

SEQ ID NO: 6518099 - DNA, 10 bp, Homo sapiens
ttaaacatta

SEQ ID NO: 6518100 - DNA, 23 bp, Homo sapiens
ttaaacattaatagcagcctttc

SEQ ID NO: 6518101 - DNA, 22 bp, Homo sapiens
ttaaacattaatatttaccaaa

SEQ ID NO: 6518102 - DNA, 12 bp, Homo sapiens
ttaaacatttca

SEQ ID NO: 6518103 - DNA, 17 bp, Homo sapiens
ttaaacatttgttcctg

SEQ ID NO: 6518104 - DNA, 18 bp, Homo sapiens
ttaaacatttgttcctgg

SEQ ID NO: 6518105 - DNA, 19 bp, Homo sapiens
ttaaacatttgttcctgga

SEQ ID NO: 6518106 - DNA, 23 bp, Homo sapiens
ttaaaccaatgaagaagacaaag

SEQ ID NO: 6518107 - DNA, 12 bp, Homo sapiens
ttaaaccagaac

SEQ ID NO: 6518108 - DNA, 16 bp, Homo sapiens
ttaaaccagcagaaaa

SEQ ID NO: 6518109 - DNA, 22 bp, Homo sapiens
ttaaaccagcagaaaagtgctt

SEQ ID NO: 6518110 - DNA, 17 bp, Homo sapiens
ttaaaccatctccctgg

SEQ ID NO: 6518111 - DNA, 22 bp, Homo sapiens
ttaaaccatgggataaatgcca

SEQ ID NO: 6518112 - DNA, 21 bp, Homo sapiens
ttaaaccatttttgctgaatt

SEQ ID NO: 6518113 - DNA, 13 bp, Homo sapiens
tggaaatgtctgc

SEQ ID NO: 6518114 - DNA, 19 bp, Homo sapiens
tggaaatgtgaatcgcagc

SEQ ID NO: 6518115 - DNA, 16 bp, Homo sapiens
tggaaatgttaagaaa

SEQ ID NO: 6518116 - DNA, 17 bp, Homo sapiens
tggaaatgttctttaga

SEQ ID NO: 6518117 - DNA, 12 bp, Homo sapiens
tggaaattaatt

SEQ ID NO: 6518118 - DNA, 22 bp, Homo sapiens
tggaaattaggttgaaacatat

SEQ ID NO: 6518119 - DNA, 21 bp, Homo sapiens
tggaaattcaggtgaaaatgt

SEQ ID NO: 6518120 - DNA, 22 bp, Homo sapiens
tggaaattccttgccccacagt

SEQ ID NO: 6518121 - DNA, 17 bp, Homo sapiens
tggaaattctgaaaact

SEQ ID NO: 6518122 - DNA, 18 bp, Homo sapiens
tggaaattctgaaaactg

SEQ ID NO: 6518123 - DNA, 17 bp, Homo sapiens
tggaaattcttccctgg

SEQ ID NO: 6518124 - DNA, 16 bp, Homo sapiens
tggaaattgaaataaa

SEQ ID NO: 6518125 - DNA, 16 bp, Homo sapiens
tggaaattgacgaggg

SEQ ID NO: 6518126 - DNA, 17 bp, Homo sapiens
tggaaattgattttgaa

SEQ ID NO: 6518127 - DNA, 16 bp, Homo sapiens
tggaaattggaagagc

SEQ ID NO: 6518128 - DNA, 22 bp, Homo sapiens
tggaaattgggtgtgccctggc

SEQ ID NO: 6518129 - DNA, 22 bp, Homo sapiens
tggaaatttaaagcaggttctt

SEQ ID NO: 6518130 - DNA, 18 bp, Homo sapiens
tggaaatttaaatgacat

SEQ ID NO: 6518131 - DNA, 18 bp, Homo sapiens
tggaaatttagagttcta

SEQ ID NO: 6518132 - DNA, 18 bp, Homo sapiens
tggaaatttagcattgta

SEQ ID NO: 6518133 - DNA, 16 bp, Homo sapiens
tggaaatttataatat

SEQ ID NO: 6518134 - DNA, 19 bp, Homo sapiens
tggaaatttgtgtgcttca

SEQ ID NO: 6518135 - DNA, 23 bp, Homo sapiens
tggaaatttgtgtgcttcacaca

SEQ ID NO: 6518136 - DNA, 15 bp, Homo sapiens
tggaacaacttgtag

SEQ ID NO: 6518137 - DNA, 21 bp, Homo sapiens
tggaacaagatggttctagca

SEQ ID NO: 6518138 - DNA, 18 bp, Homo sapiens
tggaacaatattttatgg

SEQ ID NO: 6518139 - DNA, 21 bp, Homo sapiens
tggaacaattattttattgtc

SEQ ID NO: 6518140 - DNA, 20 bp, Homo sapiens
tggaacacaaacacattgtt

SEQ ID NO: 6518141 - DNA, 15 bp, Homo sapiens
tggaacacacacaca

SEQ ID NO: 6518142 - DNA, 20 bp, Homo sapiens
tggaacacagaactgaactg

SEQ ID NO: 6518143 - DNA, 14 bp, Homo sapiens
tggaacacaggggc

SEQ ID NO: 6518144 - DNA, 15 bp, Homo sapiens
tggaacacaggggcc

SEQ ID NO: 6518145 - DNA, 20 bp, Homo sapiens
tggaacaccagcagcactgg

SEQ ID NO: 6518146 - DNA, 14 bp, Homo sapiens
tggaacaccaggct

SEQ ID NO: 6518147 - DNA, 13 bp, Homo sapiens
tggaacaccctgg

SEQ ID NO: 6518148 - DNA, 23 bp, Homo sapiens
tggaacacctgatggtgaaacca

SEQ ID NO: 6518149 - DNA, 18 bp, Homo sapiens
tggaacactatagagaac

SEQ ID NO: 6518150 - DNA, 15 bp, Homo sapiens
tggaacactctgaga

SEQ ID NO: 6518151 - DNA, 13 bp, Homo sapiens
tggaacacttcga

SEQ ID NO: 6518152 - DNA, 20 bp, Homo sapiens
tggaacagattcacactgtc

SEQ ID NO: 6518153 - DNA, 15 bp, Homo sapiens
tggaacagatttcaa

SEQ ID NO: 6518154 - DNA, 16 bp, Homo sapiens
tggaacaggaggaact

SEQ ID NO: 6518155 - DNA, 17 bp, Homo sapiens
tggaacaggaggaactg

SEQ ID NO: 6518156 - DNA, 17 bp, Homo sapiens
tggaacagtaagaacat

SEQ ID NO: 6518157 - DNA, 13 bp, Homo sapiens
tggaacagtgaaa

SEQ ID NO: 6518158 - DNA, 19 bp, Homo sapiens
tggaacagtgctactgaaa

SEQ ID NO: 6518159 - DNA, 18 bp, Homo sapiens
tggaacagtgtttacttt

SEQ ID NO: 6518160 - DNA, 21 bp, Homo sapiens
tggaacagtgtttactttaaa

SEQ ID NO: 6518161 - DNA, 18 bp, Homo sapiens
tggaacataaaaaggaca

SEQ ID NO: 6518162 - DNA, 15 bp, Homo sapiens
tggaacataaagttg

SEQ ID NO: 6518163 - DNA, 14 bp, Homo sapiens
tggaacatactgtt

SEQ ID NO: 6518164 - DNA, 15 bp, Homo sapiens
tggaacatatgcaca

SEQ ID NO: 6518165 - DNA, 14 bp, Homo sapiens
tggaacatccttgg

SEQ ID NO: 6518166 - DNA, 22 bp, Homo sapiens
tggaacatcctttgcagggcag

SEQ ID NO: 6518167 - DNA, 19 bp, Homo sapiens
tggaacatggactttcttg

SEQ ID NO: 6518168 - DNA, 19 bp, Homo sapiens
tggaacatggctagccttt

SEQ ID NO: 6518169 - DNA, 17 bp, Homo sapiens
tggaacattggaatgtt

SEQ ID NO: 6518170 - DNA, 12 bp, Homo sapiens
tggaacatttct

SEQ ID NO: 6518171 - DNA, 13 bp, Homo sapiens
tggaaccaaagtc

SEQ ID NO: 6518172 - DNA, 21 bp, Homo sapiens
tggaaccacggagatctcctt

SEQ ID NO: 6518173 - DNA, 19 bp, Homo sapiens
tggaaccagactcttgcct

SEQ ID NO: 6518174 - DNA, 13 bp, Homo sapiens
tggaaccagaggg

SEQ ID NO: 6518175 - DNA, 17 bp, Homo sapiens
tggaaccagggaggaga

SEQ ID NO: 6518176 - DNA, 21 bp, Homo sapiens
tggaaccagtgtaactggctg

SEQ ID NO: 6518177 - DNA, 23 bp, Homo sapiens
tggaaccagtgtaactggctgct

SEQ ID NO: 6518178 - DNA, 17 bp, Homo sapiens
tggaaccatcctctgtt

SEQ ID NO: 6518179 - DNA, 19 bp, Homo sapiens
tggaacccaatggacatat

SEQ ID NO: 6518180 - DNA, 12 bp, Homo sapiens
tggaacccagac

SEQ ID NO: 6518181 - DNA, 14 bp, Homo sapiens
tggaacccagactc

SEQ ID NO: 6518182 - DNA, 16 bp, Homo sapiens
tggaacccagactcag

SEQ ID NO: 6518183 - DNA, 21 bp, Homo sapiens
tggaacccagcagttctgtta

SEQ ID NO: 6518184 - DNA, 18 bp, Homo sapiens
tggaacccaggaggtgga

SEQ ID NO: 6518185 - DNA, 14 bp, Homo sapiens
tggaaccccccagg

SEQ ID NO: 6518186 - DNA, 16 bp, Homo sapiens
tggaaccgcaggaagc

SEQ ID NO: 6518187 - DNA, 20 bp, Homo sapiens
tggaaccgtgtccagcacag

SEQ ID NO: 6518188 - DNA, 23 bp, Homo sapiens
tggaacctcagcctggccagaca

SEQ ID NO: 6518189 - DNA, 22 bp, Homo sapiens
tggaacctccctgggcctgtct

SEQ ID NO: 6518190 - DNA, 12 bp, Homo sapiens
tggaacctcctt

SEQ ID NO: 6518191 - DNA, 16 bp, Homo sapiens
tggaacctctgtctca

SEQ ID NO: 6518192 - DNA, 16 bp, Homo sapiens
tggaacctgcaaaaaa

SEQ ID NO: 6518193 - DNA, 19 bp, Homo sapiens
tggaacctgcaaaaaatac

SEQ ID NO: 6518194 - DNA, 23 bp, Homo sapiens
tggaacctggaccccagccttgg

SEQ ID NO: 6518195 - DNA, 13 bp, Homo sapiens
tggaacctggcag

SEQ ID NO: 6518196 - DNA, 14 bp, Homo sapiens
tggaaccttccctc

SEQ ID NO: 6518197 - DNA, 13 bp, Homo sapiens
tggaaccttgctg

SEQ ID NO: 6518198 - DNA, 14 bp, Homo sapiens
tggaacgcattttg

SEQ ID NO: 6518199 - DNA, 18 bp, Homo sapiens
tggaacgcgttgaaattg

SEQ ID NO: 6518200 - DNA, 19 bp, Homo sapiens
tggaacgcgttgaaattgt

SEQ ID NO: 6518201 - DNA, 17 bp, Homo sapiens
tggaacgctaatgaaac

SEQ ID NO: 6518202 - DNA, 16 bp, Homo sapiens
tggaacgctctaggca

SEQ ID NO: 6518203 - DNA, 18 bp, Homo sapiens
tggaacgctctaggcaga

SEQ ID NO: 6518204 - DNA, 20 bp, Homo sapiens
tggaacgggcatgggcctct

SEQ ID NO: 6518205 - DNA, 17 bp, Homo sapiens
tggaacgttctctacct

SEQ ID NO: 6518206 - DNA, 19 bp, Homo sapiens
tggaacgtttcactgcaaa

SEQ ID NO: 6518207 - DNA, 17 bp, Homo sapiens
tggaactaataaataca

SEQ ID NO: 6518208 - DNA, 14 bp, Homo sapiens
tggaactactgtac

SEQ ID NO: 6518209 - DNA, 16 bp, Homo sapiens
tggaactactgtactt

SEQ ID NO: 6518210 - DNA, 18 bp, Homo sapiens
tggaactactgtactttg

SEQ ID NO: 6518211 - DNA, 18 bp, Homo sapiens
tggaactaggttttaata

SEQ ID NO: 6518212 - DNA, 16 bp, Homo sapiens
tggaactatgaagact

SEQ ID NO: 6518213 - DNA, 20 bp, Homo sapiens
tggaactatgcagtgtgctc

SEQ ID NO: 6518214 - DNA, 19 bp, Homo sapiens
tggaactcaatatatagtt

SEQ ID NO: 6518215 - DNA, 21 bp, Homo sapiens
tggaactcattcctgcctgtc

SEQ ID NO: 6518216 - DNA, 19 bp, Homo sapiens
tggaactccccagggcctc

SEQ ID NO: 6518217 - DNA, 20 bp, Homo sapiens
tggaactcctaaataaacta

SEQ ID NO: 6518218 - DNA, 20 bp, Homo sapiens
tggaactcgcccccctaccc

SEQ ID NO: 6518219 - DNA, 15 bp, Homo sapiens
tggaactctaaacct

SEQ ID NO: 6518220 - DNA, 18 bp, Homo sapiens
tggaactctaccctggta

SEQ ID NO: 6518221 - DNA, 19 bp, Homo sapiens
tggaactctactcaaccca

SEQ ID NO: 6518222 - DNA, 22 bp, Homo sapiens
tggaactctcctgctcctcagg

SEQ ID NO: 6518223 - DNA, 14 bp, Homo sapiens
tggaactctgtgca

SEQ ID NO: 6518224 - DNA, 23 bp, Homo sapiens
tggaactctgtgcaggtgctgcc

SEQ ID NO: 6518225 - DNA, 16 bp, Homo sapiens
tggaactgaagggggc

SEQ ID NO: 6518226 - DNA, 21 bp, Homo sapiens
tggaactgaagtccaaattgt

SEQ ID NO: 6518227 - DNA, 18 bp, Homo sapiens
tggaactgcaactccagc

SEQ ID NO: 6518228 - DNA, 15 bp, Homo sapiens
tggaactgcaatgaa

SEQ ID NO: 6518229 - DNA, 13 bp, Homo sapiens
tggaactgcacca

SEQ ID NO: 6518230 - DNA, 12 bp, Homo sapiens
tggaactgccac

SEQ ID NO: 6518231 - DNA, 23 bp, Homo sapiens
tggaactgcgataactgagaaac

SEQ ID NO: 6518232 - DNA, 20 bp, Homo sapiens
tggaactgctgccactgagg

SEQ ID NO: 6518233 - DNA, 16 bp, Homo sapiens
tggaactgctgccatg

SEQ ID NO: 6518234 - DNA, 16 bp, Homo sapiens
tggaactgctgctgac

SEQ ID NO: 6518235 - DNA, 19 bp, Homo sapiens
tggaactgctgctgacccc

SEQ ID NO: 6518236 - DNA, 16 bp, Homo sapiens
tggaactggaggcagg

SEQ ID NO: 6518237 - DNA, 17 bp, Homo sapiens
tggaactggaggcaggg

SEQ ID NO: 6518238 - DNA, 13 bp, Homo sapiens
tggaactgtccca

SEQ ID NO: 6518239 - DNA, 23 bp, Homo sapiens
tggaactgtctctcatgaacctc

SEQ ID NO: 6518240 - DNA, 14 bp, Homo sapiens
tggaactgtgtatt

SEQ ID NO: 6518241 - DNA, 21 bp, Homo sapiens
tggaactgtgtatttatttaa

SEQ ID NO: 6518242 - DNA, 16 bp, Homo sapiens
tggaactgtgtttcaa

SEQ ID NO: 6518243 - DNA, 15 bp, Homo sapiens
tggaacttccctccc

SEQ ID NO: 6518244 - DNA, 18 bp, Homo sapiens
tggaacttctaatatatt

SEQ ID NO: 6518245 - DNA, 15 bp, Homo sapiens
tggaacttgcctgcc

SEQ ID NO: 6518246 - DNA, 22 bp, Homo sapiens
tggaacttgcctgcctttccat

SEQ ID NO: 6518247 - DNA, 17 bp, Homo sapiens
tggaactttagggggtg

SEQ ID NO: 6518248 - DNA, 18 bp, Homo sapiens
tggaactttagggggtgg

SEQ ID NO: 6518249 - DNA, 21 bp, Homo sapiens
tggaactttctgttccctatg

SEQ ID NO: 6518250 - DNA, 21 bp, Homo sapiens
tggaagaaaaggattttggaa

SEQ ID NO: 6518251 - DNA, 22 bp, Homo sapiens
tggaagaaaatggaattactcc

SEQ ID NO: 6518252 - DNA, 11 bp, Homo sapiens
tggaagaaaga

SEQ ID NO: 6518253 - DNA, 20 bp, Homo sapiens
tggaagaaagccctgtgctt

SEQ ID NO: 6518254 - DNA, 21 bp, Homo sapiens
tggaagaaagccctgtgcttt

SEQ ID NO: 6518255 - DNA, 22 bp, Homo sapiens
tggaagaaagccctgtgctttg

SEQ ID NO: 6518256 - DNA, 17 bp, Homo sapiens
tggaagaaattcctgta

SEQ ID NO: 6518257 - DNA, 17 bp, Homo sapiens
tggaagaaatttaggaa

SEQ ID NO: 6518258 - DNA, 23 bp, Homo sapiens
tggaagaagaaccaggcatggaa

SEQ ID NO: 6518259 - DNA, 18 bp, Homo sapiens
tggaagaaggaaacggaa

SEQ ID NO: 6518260 - DNA, 12 bp, Homo sapiens
tggaagaaggga

SEQ ID NO: 6518261 - DNA, 19 bp, Homo sapiens
tggaagaagggccaccctg

SEQ ID NO: 6518262 - DNA, 20 bp, Homo sapiens
tggaagaagttttaactatg

SEQ ID NO: 6518263 - DNA, 15 bp, Homo sapiens
tggaagaagtttttt

SEQ ID NO: 6518264 - DNA, 22 bp, Homo sapiens
tggaagaataaaattgcctctc

SEQ ID NO: 6518265 - DNA, 18 bp, Homo sapiens
tggaagacaaaatgtttt

SEQ ID NO: 6518266 - DNA, 16 bp, Homo sapiens
tggaagacaaatacac

SEQ ID NO: 6518267 - DNA, 18 bp, Homo sapiens
tggaagacaaatacacat

SEQ ID NO: 6518268 - DNA, 20 bp, Homo sapiens
tggaagacacttcagatctg

SEQ ID NO: 6518269 - DNA, 23 bp, Homo sapiens
tggaagacacttcagatctgagg

SEQ ID NO: 6518270 - DNA, 16 bp, Homo sapiens
tggaagacacttgctg

SEQ ID NO: 6518271 - DNA, 20 bp, Homo sapiens
tggaagacacttgctgagtg

SEQ ID NO: 6518272 - DNA, 20 bp, Homo sapiens
tggaagacagagacctcctg

SEQ ID NO: 6518273 - DNA, 11 bp, Homo sapiens
tggaagacagc

SEQ ID NO: 6518274 - DNA, 15 bp, Homo sapiens
tggaagacagctctt

SEQ ID NO: 6518275 - DNA, 17 bp, Homo sapiens
tggaagaccccacccaa

SEQ ID NO: 6518276 - DNA, 20 bp, Homo sapiens
tggaagacctaaggcagaca

SEQ ID NO: 6518277 - DNA, 18 bp, Homo sapiens
tggaagactgtgcagaag

SEQ ID NO: 6518278 - DNA, 14 bp, Homo sapiens
tggaagacttgggt

SEQ ID NO: 6518279 - DNA, 14 bp, Homo sapiens
tggaagagaaatct

SEQ ID NO: 6518280 - DNA, 18 bp, Homo sapiens
tggaagagaagagaaagg

SEQ ID NO: 6518281 - DNA, 16 bp, Homo sapiens
tggaagagagaaagca

SEQ ID NO: 6518282 - DNA, 22 bp, Homo sapiens
tggaagagagagccatgaagca

SEQ ID NO: 6518283 - DNA, 14 bp, Homo sapiens
tggaagagaggcac

SEQ ID NO: 6518284 - DNA, 16 bp, Homo sapiens
tggaagagaggcacct

SEQ ID NO: 6518285 - DNA, 17 bp, Homo sapiens
tggaagagaggcacctg

SEQ ID NO: 6518286 - DNA, 23 bp, Homo sapiens
tggaagagaggcacctgctggaa

SEQ ID NO: 6518287 - DNA, 16 bp, Homo sapiens
tggaagagcagcacct

SEQ ID NO: 6518288 - DNA, 15 bp, Homo sapiens
tggaagagcagcctg

SEQ ID NO: 6518289 - DNA, 21 bp, Homo sapiens
tggaagagcccagtctgttga

SEQ ID NO: 6518290 - DNA, 19 bp, Homo sapiens
tggaagagccgagcacctg

SEQ ID NO: 6518291 - DNA, 16 bp, Homo sapiens
ttaaacccatacaatg

SEQ ID NO: 6518292 - DNA, 13 bp, Homo sapiens
ttaaacccatttt

SEQ ID NO: 6518293 - DNA, 16 bp, Homo sapiens
ttaaaccgctaaaaga

SEQ ID NO: 6518294 - DNA, 19 bp, Homo sapiens
ttaaaccgctaaaagaaac

SEQ ID NO: 6518295 - DNA, 15 bp, Homo sapiens
ttaaacctggatact

SEQ ID NO: 6518296 - DNA, 21 bp, Homo sapiens
ttaaacctgtctccactgtgc

SEQ ID NO: 6518297 - DNA, 16 bp, Homo sapiens
ttaaacctgtgctttc

SEQ ID NO: 6518298 - DNA, 18 bp, Homo sapiens
ttaaacctgtgctttcat

SEQ ID NO: 6518299 - DNA, 22 bp, Homo sapiens
ttaaacctgtttttttttcatt

SEQ ID NO: 6518300 - DNA, 12 bp, Homo sapiens
ttaaaccttttt

SEQ ID NO: 6518301 - DNA, 21 bp, Homo sapiens
ttaaacggattattttttcag

SEQ ID NO: 6518302 - DNA, 22 bp, Homo sapiens
ttaaacggattattttttcaga

SEQ ID NO: 6518303 - DNA, 22 bp, Homo sapiens
ttaaacggtgcccatcctgcca

SEQ ID NO: 6518304 - DNA, 22 bp, Homo sapiens
ttaaactaaaaaaaaaaaggcc

SEQ ID NO: 6518305 - DNA, 15 bp, Homo sapiens
ttaaactaaataatg

SEQ ID NO: 6518306 - DNA, 20 bp, Homo sapiens
ttaaactaaataatgaataa

SEQ ID NO: 6518307 - DNA, 21 bp, Homo sapiens
ttaaactaaataatgaataaa

SEQ ID NO: 6518308 - DNA, 12 bp, Homo sapiens
ttaaactaaatt

SEQ ID NO: 6518309 - DNA, 15 bp, Homo sapiens
ttaaactaacctttt

SEQ ID NO: 6518310 - DNA, 18 bp, Homo sapiens
ttaaactaagatctgtta

SEQ ID NO: 6518311 - DNA, 20 bp, Homo sapiens
ttaaactaatgaacaaatat

SEQ ID NO: 6518312 - DNA, 18 bp, Homo sapiens
ttaaactaattaaactga

SEQ ID NO: 6518313 - DNA, 14 bp, Homo sapiens
ttaaactagatgac

SEQ ID NO: 6518314 - DNA, 18 bp, Homo sapiens
ttaaactagatgacctca

SEQ ID NO: 6518315 - DNA, 19 bp, Homo sapiens
ttaaactagcatatctgcc

SEQ ID NO: 6518316 - DNA, 23 bp, Homo sapiens
ttaaactagcatatctgccttta

SEQ ID NO: 6518317 - DNA, 16 bp, Homo sapiens
ttaaactatcttgtgt

SEQ ID NO: 6518318 - DNA, 21 bp, Homo sapiens
ttaaactatgttcctaacaaa

SEQ ID NO: 6518319 - DNA, 18 bp, Homo sapiens
ttaaactattcagaggaa

SEQ ID NO: 6518320 - DNA, 14 bp, Homo sapiens
ttaaactcaagaca

SEQ ID NO: 6518321 - DNA, 22 bp, Homo sapiens
ttaaactctcttcttccattag

SEQ ID NO: 6518322 - DNA, 13 bp, Homo sapiens
ttaaactctgaat

SEQ ID NO: 6518323 - DNA, 13 bp, Homo sapiens
ttaaactctgcca

SEQ ID NO: 6518324 - DNA, 19 bp, Homo sapiens
ttaaactctggacactcta

SEQ ID NO: 6518325 - DNA, 15 bp, Homo sapiens
ttaaactcttgaata

SEQ ID NO: 6518326 - DNA, 14 bp, Homo sapiens
ttaaactgaagaag

SEQ ID NO: 6518327 - DNA, 21 bp, Homo sapiens
ttaaactgatgtatagcttta

SEQ ID NO: 6518328 - DNA, 22 bp, Homo sapiens
ttaaactgatgtatagctttaa

SEQ ID NO: 6518329 - DNA, 20 bp, Homo sapiens
ttaaactgattagtattcag

SEQ ID NO: 6518330 - DNA, 16 bp, Homo sapiens
ttaaactgggaaatga

SEQ ID NO: 6518331 - DNA, 19 bp, Homo sapiens
ttaaactggtattttatct

SEQ ID NO: 6518332 - DNA, 15 bp, Homo sapiens
ttaaactgtaaatca

SEQ ID NO: 6518333 - DNA, 20 bp, Homo sapiens
ttaaactgtaaatcataatg

SEQ ID NO: 6518334 - DNA, 13 bp, Homo sapiens
ttaaactgtacag

SEQ ID NO: 6518335 - DNA, 16 bp, Homo sapiens
ttaaactgtacagaat

SEQ ID NO: 6518336 - DNA, 19 bp, Homo sapiens
ttaaactgtacagaatttc

SEQ ID NO: 6518337 - DNA, 16 bp, Homo sapiens
ttaaactgtacagtgt

SEQ ID NO: 6518338 - DNA, 22 bp, Homo sapiens
ttaaactgtattttatgttatt

SEQ ID NO: 6518339 - DNA, 20 bp, Homo sapiens
ttaaactgtcgtgtcatact

SEQ ID NO: 6518340 - DNA, 23 bp, Homo sapiens
ttaaactgtgaagctattggaat

SEQ ID NO: 6518341 - DNA, 20 bp, Homo sapiens
ttaaactgtgtggactgtga

SEQ ID NO: 6518342 - DNA, 18 bp, Homo sapiens
ttaaactgttagcactgt

SEQ ID NO: 6518343 - DNA, 21 bp, Homo sapiens
ttaaactgttagcactgttga

SEQ ID NO: 6518344 - DNA, 12 bp, Homo sapiens
ttaaacttacaa

SEQ ID NO: 6518345 - DNA, 14 bp, Homo sapiens
ttaaacttatgaat

SEQ ID NO: 6518346 - DNA, 17 bp, Homo sapiens
ttaaacttccaaagctt

SEQ ID NO: 6518347 - DNA, 13 bp, Homo sapiens
ttaaacttctact

SEQ ID NO: 6518348 - DNA, 17 bp, Homo sapiens
ttaaacttctactgagc

SEQ ID NO: 6518349 - DNA, 18 bp, Homo sapiens
ttaaacttctactgagca

SEQ ID NO: 6518350 - DNA, 14 bp, Homo sapiens
ttaaacttctctga

SEQ ID NO: 6518351 - DNA, 18 bp, Homo sapiens
ttaaacttctctgaaggg

SEQ ID NO: 6518352 - DNA, 20 bp, Homo sapiens
ttaaacttctctgaagggag

SEQ ID NO: 6518353 - DNA, 12 bp, Homo sapiens
ttaaacttcttt

SEQ ID NO: 6518354 - DNA, 12 bp, Homo sapiens
ttaaacttgcaa

SEQ ID NO: 6518355 - DNA, 15 bp, Homo sapiens
ttaaacttgcaatga

SEQ ID NO: 6518356 - DNA, 17 bp, Homo sapiens
ttaaacttgcatcactt

SEQ ID NO: 6518357 - DNA, 17 bp, Homo sapiens
ttaaacttgtcagaatt

SEQ ID NO: 6518358 - DNA, 20 bp, Homo sapiens
ttaaactttcaatatcttta

SEQ ID NO: 6518359 - DNA, 13 bp, Homo sapiens
ttaaactttgtgc

SEQ ID NO: 6518360 - DNA, 20 bp, Homo sapiens
ttaaactttgtgcctttgac

SEQ ID NO: 6518361 - DNA, 18 bp, Homo sapiens
ttaaacttttaattcatt

SEQ ID NO: 6518362 - DNA, 16 bp, Homo sapiens
ttaaacttttcattac

SEQ ID NO: 6518363 - DNA, 20 bp, Homo sapiens
ttaaactttttaaaatactt

SEQ ID NO: 6518364 - DNA, 19 bp, Homo sapiens
ttaaagaaaaaaatgtatt

SEQ ID NO: 6518365 - DNA, 17 bp, Homo sapiens
ttaaagaaaaactttaa

SEQ ID NO: 6518366 - DNA, 15 bp, Homo sapiens
ttaaagaaaacccac

SEQ ID NO: 6518367 - DNA, 16 bp, Homo sapiens
ttaaagaaaagatgaa

SEQ ID NO: 6518368 - DNA, 15 bp, Homo sapiens
ttaaagaaaattgca

SEQ ID NO: 6518369 - DNA, 17 bp, Homo sapiens
ttaaagaaaattgccaa

SEQ ID NO: 6518370 - DNA, 15 bp, Homo sapiens
ttaaagaaacactaa

SEQ ID NO: 6518371 - DNA, 19 bp, Homo sapiens
ttaaagaaacactaaatta

SEQ ID NO: 6518372 - DNA, 16 bp, Homo sapiens
ttaaagaaaggcagag

SEQ ID NO: 6518373 - DNA, 17 bp, Homo sapiens
ttaaagaaagtgtattt

SEQ ID NO: 6518374 - DNA, 23 bp, Homo sapiens
ttaaagaaatgtttatacaataa

SEQ ID NO: 6518375 - DNA, 14 bp, Homo sapiens
ttaaagaaatttta

SEQ ID NO: 6518376 - DNA, 22 bp, Homo sapiens
ttaaagaagaaaagcgcgttgt

SEQ ID NO: 6518377 - DNA, 12 bp, Homo sapiens
ttaaagaaggag

SEQ ID NO: 6518378 - DNA, 19 bp, Homo sapiens
ttaaagaagtatttttaga

SEQ ID NO: 6518379 - DNA, 23 bp, Homo sapiens
ttaaagaagtccatgtgataatt

SEQ ID NO: 6518380 - DNA, 18 bp, Homo sapiens
ttaaagaagtctcttaat

SEQ ID NO: 6518381 - DNA, 20 bp, Homo sapiens
ttaaagaatatgacttttta

SEQ ID NO: 6518382 - DNA, 13 bp, Homo sapiens
ttaaagaatccaa

SEQ ID NO: 6518383 - DNA, 19 bp, Homo sapiens
ttaaagaattcaaatttta

SEQ ID NO: 6518384 - DNA, 14 bp, Homo sapiens
ttaaagaatttgaa

SEQ ID NO: 6518385 - DNA, 10 bp, Homo sapiens
ttaaagacag

SEQ ID NO: 6518386 - DNA, 19 bp, Homo sapiens
ttaaagacttaagattaaa

SEQ ID NO: 6518387 - DNA, 18 bp, Homo sapiens
ttaaagacttgatgaata

SEQ ID NO: 6518388 - DNA, 22 bp, Homo sapiens
ttaaagacttgatgaataaaca

SEQ ID NO: 6518389 - DNA, 14 bp, Homo sapiens
ttaaagagaatgag

SEQ ID NO: 6518390 - DNA, 15 bp, Homo sapiens
ttaaagagaatgagt

SEQ ID NO: 6518391 - DNA, 14 bp, Homo sapiens
ttaaagagataaag

SEQ ID NO: 6518392 - DNA, 14 bp, Homo sapiens
ttaaagaggaatgg

SEQ ID NO: 6518393 - DNA, 19 bp, Homo sapiens
ttaaagaggcgtcttgtat

SEQ ID NO: 6518394 - DNA, 18 bp, Homo sapiens
ttaaagataagtctacat

SEQ ID NO: 6518395 - DNA, 22 bp, Homo sapiens
ttaaagataagtctacattaaa

SEQ ID NO: 6518396 - DNA, 17 bp, Homo sapiens
ttaaagatattgttcaa

SEQ ID NO: 6518397 - DNA, 19 bp, Homo sapiens
ttaaagatattgttcaaac

SEQ ID NO: 6518398 - DNA, 22 bp, Homo sapiens
ttaaagatatttttattcaaac

SEQ ID NO: 6518399 - DNA, 20 bp, Homo sapiens
ttaaagatgcaggttttcta

SEQ ID NO: 6518400 - DNA, 14 bp, Homo sapiens
ttaaagatgccata

SEQ ID NO: 6518401 - DNA, 23 bp, Homo sapiens
ttaaagatgctatggaacataaa

SEQ ID NO: 6518402 - DNA, 21 bp, Homo sapiens
ttaaagatgtagcaaaccctg

SEQ ID NO: 6518403 - DNA, 17 bp, Homo sapiens
ttaaagatttatcaaat

SEQ ID NO: 6518404 - DNA, 16 bp, Homo sapiens
ttaaagcaaaaaactt

SEQ ID NO: 6518405 - DNA, 17 bp, Homo sapiens
ttaaagcaaaaaatgaa

SEQ ID NO: 6518406 - DNA, 22 bp, Homo sapiens
ttaaagcaaaatagtattgctg

SEQ ID NO: 6518407 - DNA, 22 bp, Homo sapiens
ttaaagcaaactatgatttatt

SEQ ID NO: 6518408 - DNA, 22 bp, Homo sapiens
ttaaagcaaagtcacttctcca

SEQ ID NO: 6518409 - DNA, 17 bp, Homo sapiens
ttaaagcaatcttggca

SEQ ID NO: 6518410 - DNA, 16 bp, Homo sapiens
ttaaagcaattgcata

SEQ ID NO: 6518411 - DNA, 18 bp, Homo sapiens
ttaaagcagacagtcaca

SEQ ID NO: 6518412 - DNA, 22 bp, Homo sapiens
ttaaagcagagggactttgtat

SEQ ID NO: 6518413 - DNA, 14 bp, Homo sapiens
ttaaagcagtcact

SEQ ID NO: 6518414 - DNA, 16 bp, Homo sapiens
ttaaagcatatgctat

SEQ ID NO: 6518415 - DNA, 20 bp, Homo sapiens
ttaaagcatctgtaaatttg

SEQ ID NO: 6518416 - DNA, 14 bp, Homo sapiens
ttaaagcattgctg

SEQ ID NO: 6518417 - DNA, 20 bp, Homo sapiens
ttaaagcattgctgttatgt

SEQ ID NO: 6518418 - DNA, 22 bp, Homo sapiens
ttaaagcattgctgttatgtct

SEQ ID NO: 6518419 - DNA, 22 bp, Homo sapiens
ttaaagcattgcttttattttg

SEQ ID NO: 6518420 - DNA, 15 bp, Homo sapiens
ttaaagcatttactt

SEQ ID NO: 6518421 - DNA, 15 bp, Homo sapiens
ttaaagccaaatgta

SEQ ID NO: 6518422 - DNA, 20 bp, Homo sapiens
ttaaagccatgtttattaca

SEQ ID NO: 6518423 - DNA, 14 bp, Homo sapiens
ttaaagcctcctca

SEQ ID NO: 6518424 - DNA, 11 bp, Homo sapiens
ttaaagcctgg

SEQ ID NO: 6518425 - DNA, 14 bp, Homo sapiens
ttaaagcctggctt

SEQ ID NO: 6518426 - DNA, 18 bp, Homo sapiens
ttaaagcctttagtatca

SEQ ID NO: 6518427 - DNA, 13 bp, Homo sapiens
ttaaagctaaact

SEQ ID NO: 6518428 - DNA, 14 bp, Homo sapiens
ttaaagctaaattt

SEQ ID NO: 6518429 - DNA, 15 bp, Homo sapiens
ttaaagctgcctgta

SEQ ID NO: 6518430 - DNA, 14 bp, Homo sapiens
ttaaagctgtacac

SEQ ID NO: 6518431 - DNA, 14 bp, Homo sapiens
ttaaagctgttatt

SEQ ID NO: 6518432 - DNA, 13 bp, Homo sapiens
ttaaagctgtttc

SEQ ID NO: 6518433 - DNA, 14 bp, Homo sapiens
ttaaagcttatttt

SEQ ID NO: 6518434 - DNA, 14 bp, Homo sapiens
ttaaagcttgattt

SEQ ID NO: 6518435 - DNA, 13 bp, Homo sapiens
ttaaagctttcaa

SEQ ID NO: 6518436 - DNA, 12 bp, Homo sapiens
ttaaaggaaaaa

SEQ ID NO: 6518437 - DNA, 15 bp, Homo sapiens
ttaaaggaaacacta

SEQ ID NO: 6518438 - DNA, 20 bp, Homo sapiens
ttaaaggaaacactaaggct

SEQ ID NO: 6518439 - DNA, 23 bp, Homo sapiens
ttaaaggaaacgtggcaggactt

SEQ ID NO: 6518440 - DNA, 15 bp, Homo sapiens
ttaaaggaacacgtg

SEQ ID NO: 6518441 - DNA, 12 bp, Homo sapiens
ttaaaggaagga

SEQ ID NO: 6518442 - DNA, 14 bp, Homo sapiens
ttaaaggacaaaca

SEQ ID NO: 6518443 - DNA, 17 bp, Homo sapiens
ttaaaggacaaacagtg

SEQ ID NO: 6518444 - DNA, 19 bp, Homo sapiens
ttaaaggacaaacagtgaa

SEQ ID NO: 6518445 - DNA, 20 bp, Homo sapiens
ttaaaggacaaacagtgaat

SEQ ID NO: 6518446 - DNA, 12 bp, Homo sapiens
ttaaaggagtta

SEQ ID NO: 6518447 - DNA, 20 bp, Homo sapiens
ttaaaggatatgaaactcta

SEQ ID NO: 6518448 - DNA, 18 bp, Homo sapiens
ttaaaggcagtccagagc

SEQ ID NO: 6518449 - DNA, 22 bp, Homo sapiens
ttaaaggcagtccagagctttt

SEQ ID NO: 6518450 - DNA, 16 bp, Homo sapiens
ttaaaggccgtcattt

SEQ ID NO: 6518451 - DNA, 15 bp, Homo sapiens
ttaaaggcttctctc

SEQ ID NO: 6518452 - DNA, 19 bp, Homo sapiens
ttaaaggcttctctctcac

SEQ ID NO: 6518453 - DNA, 20 bp, Homo sapiens
ttaaaggcttctctctcacc

SEQ ID NO: 6518454 - DNA, 15 bp, Homo sapiens
ttaaagggaaattga

SEQ ID NO: 6518455 - DNA, 15 bp, Homo sapiens
ttaaagggaagaaaa

SEQ ID NO: 6518456 - DNA, 18 bp, Homo sapiens
ttaaagggaagaaaacac

SEQ ID NO: 6518457 - DNA, 23 bp, Homo sapiens
ttaaagggaagaaaacactgtta

SEQ ID NO: 6518458 - DNA, 18 bp, Homo sapiens
ttaaagggaatcattttt

SEQ ID NO: 6518459 - DNA, 21 bp, Homo sapiens
ttaaagggaatcatttttgta

SEQ ID NO: 6518460 - DNA, 20 bp, Homo sapiens
ttaaagggagatggtaagaa

SEQ ID NO: 6518461 - DNA, 18 bp, Homo sapiens
ttaaagggtttgagatgt

SEQ ID NO: 6518462 - DNA, 16 bp, Homo sapiens
ttaaaggtagagatgt

SEQ ID NO: 6518463 - DNA, 20 bp, Homo sapiens
ttaaaggtctcccacaagac

SEQ ID NO: 6518464 - DNA, 16 bp, Homo sapiens
ttaaaggtggaaaatc

SEQ ID NO: 6518465 - DNA, 17 bp, Homo sapiens
ttaaaggtgtcttcctc

SEQ ID NO: 6518466 - DNA, 15 bp, Homo sapiens
ttaaaggttactgtt

SEQ ID NO: 6518467 - DNA, 21 bp, Homo sapiens
ttaaaggtttttaaattgttt

SEQ ID NO: 6518468 - DNA, 20 bp, Homo sapiens
ttaaaggtttttgaaatcca

SEQ ID NO: 6518469 - DNA, 14 bp, Homo sapiens
ttaaagtaaacttg

SEQ ID NO: 6518470 - DNA, 15 bp, Homo sapiens
tggaagagcctgcag

SEQ ID NO: 6518471 - DNA, 13 bp, Homo sapiens
tggaagagctggg

SEQ ID NO: 6518472 - DNA, 23 bp, Homo sapiens
tggaagagctgggtaccaggcca

SEQ ID NO: 6518473 - DNA, 23 bp, Homo sapiens
tggaagaggaacagcactgggga

SEQ ID NO: 6518474 - DNA, 23 bp, Homo sapiens
tggaagagggagggtcagtgcca

SEQ ID NO: 6518475 - DNA, 16 bp, Homo sapiens
tggaagaggggacagg

SEQ ID NO: 6518476 - DNA, 16 bp, Homo sapiens
tggaagagtgtgtgtg

SEQ ID NO: 6518477 - DNA, 22 bp, Homo sapiens
tggaagataattttatgtgtta

SEQ ID NO: 6518478 - DNA, 15 bp, Homo sapiens
tggaagatattcctt

SEQ ID NO: 6518479 - DNA, 17 bp, Homo sapiens
tggaagatattcctttt

SEQ ID NO: 6518480 - DNA, 18 bp, Homo sapiens
tggaagatcctgtgagga

SEQ ID NO: 6518481 - DNA, 22 bp, Homo sapiens
tggaagattggtttaaaaagaa

SEQ ID NO: 6518482 - DNA, 16 bp, Homo sapiens
tggaagattttaaatt

SEQ ID NO: 6518483 - DNA, 17 bp, Homo sapiens
tggaagattttcattga

SEQ ID NO: 6518484 - DNA, 15 bp, Homo sapiens
tggaagcaaagacaa

SEQ ID NO: 6518485 - DNA, 16 bp, Homo sapiens
tggaagcaaagacaaa

SEQ ID NO: 6518486 - DNA, 22 bp, Homo sapiens
tggaagcaaagacaaaagaaac

SEQ ID NO: 6518487 - DNA, 23 bp, Homo sapiens
tggaagcaaagacaaaagaaact

SEQ ID NO: 6518488 - DNA, 18 bp, Homo sapiens
tggaagcaattgctcatg

SEQ ID NO: 6518489 - DNA, 11 bp, Homo sapiens
tggaagcacag

SEQ ID NO: 6518490 - DNA, 20 bp, Homo sapiens
tggaagcacagcctcgggga

SEQ ID NO: 6518491 - DNA, 14 bp, Homo sapiens
tggaagcagaaaca

SEQ ID NO: 6518492 - DNA, 17 bp, Homo sapiens
tggaagcagaggccctg

SEQ ID NO: 6518493 - DNA, 16 bp, Homo sapiens
tggaagcagtgcccag

SEQ ID NO: 6518494 - DNA, 19 bp, Homo sapiens
tggaagcagtgcccaggtg

SEQ ID NO: 6518495 - DNA, 20 bp, Homo sapiens
tggaagcagtgcccaggtgg

SEQ ID NO: 6518496 - DNA, 16 bp, Homo sapiens
tggaagcatcaataaa

SEQ ID NO: 6518497 - DNA, 16 bp, Homo sapiens
tggaagcatggctgtc

SEQ ID NO: 6518498 - DNA, 17 bp, Homo sapiens
tggaagcatggctgtct

SEQ ID NO: 6518499 - DNA, 19 bp, Homo sapiens
tggaagcatggctgtctgc

SEQ ID NO: 6518500 - DNA, 16 bp, Homo sapiens
tggaagccatcctgcc

SEQ ID NO: 6518501 - DNA, 19 bp, Homo sapiens
tggaagcccaactggggtt

SEQ ID NO: 6518502 - DNA, 13 bp, Homo sapiens
tggaagcccccca

SEQ ID NO: 6518503 - DNA, 20 bp, Homo sapiens
tggaagcccctgggcccagt

SEQ ID NO: 6518504 - DNA, 20 bp, Homo sapiens
tggaagccctcaaagaagtc

SEQ ID NO: 6518505 - DNA, 12 bp, Homo sapiens
tggaagccctcc

SEQ ID NO: 6518506 - DNA, 15 bp, Homo sapiens
tggaagccctccttc

SEQ ID NO: 6518507 - DNA, 19 bp, Homo sapiens
tggaagccctccttccacg

SEQ ID NO: 6518508 - DNA, 16 bp, Homo sapiens
tggaagccctggagac

SEQ ID NO: 6518509 - DNA, 15 bp, Homo sapiens
tggaagccgcgcggc

SEQ ID NO: 6518510 - DNA, 17 bp, Homo sapiens
tggaagccggagggtgt

SEQ ID NO: 6518511 - DNA, 16 bp, Homo sapiens
tggaagcctccacctg

SEQ ID NO: 6518512 - DNA, 17 bp, Homo sapiens
tggaagcctgaactgag

SEQ ID NO: 6518513 - DNA, 12 bp, Homo sapiens
tggaagcctgct

SEQ ID NO: 6518514 - DNA, 14 bp, Homo sapiens
tggaagcctgctga

SEQ ID NO: 6518515 - DNA, 18 bp, Homo sapiens
tggaagcggtttgcattt

SEQ ID NO: 6518516 - DNA, 16 bp, Homo sapiens
tggaagctaatttgca

SEQ ID NO: 6518517 - DNA, 12 bp, Homo sapiens
tggaagctctgt

SEQ ID NO: 6518518 - DNA, 17 bp, Homo sapiens
tggaagctgccctgccc

SEQ ID NO: 6518519 - DNA, 19 bp, Homo sapiens
tggaagctggagggtgcta

SEQ ID NO: 6518520 - DNA, 19 bp, Homo sapiens
tggaagctgtcaggctggg

SEQ ID NO: 6518521 - DNA, 20 bp, Homo sapiens
tggaagctgtcaggctggga

SEQ ID NO: 6518522 - DNA, 15 bp, Homo sapiens
tggaagctgtgtcct

SEQ ID NO: 6518523 - DNA, 19 bp, Homo sapiens
tggaagctgttcagggcat

SEQ ID NO: 6518524 - DNA, 17 bp, Homo sapiens
tggaagctgtttggaaa

SEQ ID NO: 6518525 - DNA, 19 bp, Homo sapiens
tggaagcttactctctgct

SEQ ID NO: 6518526 - DNA, 14 bp, Homo sapiens
tggaagcttccagt

SEQ ID NO: 6518527 - DNA, 20 bp, Homo sapiens
tggaagcttgttttccagtc

SEQ ID NO: 6518528 - DNA, 19 bp, Homo sapiens
tggaagctttgagttgact

SEQ ID NO: 6518529 - DNA, 17 bp, Homo sapiens
tggaagctttgtcccct

SEQ ID NO: 6518530 - DNA, 11 bp, Homo sapiens
tggaaggaaag

SEQ ID NO: 6518531 - DNA, 15 bp, Homo sapiens
tggaaggaaagatgc

SEQ ID NO: 6518532 - DNA, 16 bp, Homo sapiens
tggaaggaaaggaata

SEQ ID NO: 6518533 - DNA, 12 bp, Homo sapiens
tggaaggaacat

SEQ ID NO: 6518534 - DNA, 17 bp, Homo sapiens
tggaaggacacagtgat

SEQ ID NO: 6518535 - DNA, 15 bp, Homo sapiens
tggaaggaccctgtg

SEQ ID NO: 6518536 - DNA, 19 bp, Homo sapiens
tggaaggactgtggctgca

SEQ ID NO: 6518537 - DNA, 16 bp, Homo sapiens
tggaaggagacacaga

SEQ ID NO: 6518538 - DNA, 17 bp, Homo sapiens
tggaaggagacacagat

SEQ ID NO: 6518539 - DNA, 15 bp, Homo sapiens
tggaaggagagaggt

SEQ ID NO: 6518540 - DNA, 15 bp, Homo sapiens
tggaaggagcacata

SEQ ID NO: 6518541 - DNA, 12 bp, Homo sapiens
tggaaggagcag

SEQ ID NO: 6518542 - DNA, 13 bp, Homo sapiens
tggaaggagcaga

SEQ ID NO: 6518543 - DNA, 21 bp, Homo sapiens
tggaaggatctgctgaggccc

SEQ ID NO: 6518544 - DNA, 23 bp, Homo sapiens
tggaaggcacccgccctttcctt

SEQ ID NO: 6518545 - DNA, 14 bp, Homo sapiens
tggaaggcagagaa

SEQ ID NO: 6518546 - DNA, 18 bp, Homo sapiens
tggaaggcagagaaatct

SEQ ID NO: 6518547 - DNA, 20 bp, Homo sapiens
tggaaggcagagaaatctaa

SEQ ID NO: 6518548 - DNA, 17 bp, Homo sapiens
tggaaggcagggacaga

SEQ ID NO: 6518549 - DNA, 18 bp, Homo sapiens
tggaaggcagggcagagg

SEQ ID NO: 6518550 - DNA, 11 bp, Homo sapiens
tggaaggcatg

SEQ ID NO: 6518551 - DNA, 13 bp, Homo sapiens
tggaaggcccagc

SEQ ID NO: 6518552 - DNA, 17 bp, Homo sapiens
tggaaggccttccactg

SEQ ID NO: 6518553 - DNA, 22 bp, Homo sapiens
tggaagggaaaaaaaatgtagc

SEQ ID NO: 6518554 - DNA, 17 bp, Homo sapiens
tggaagggaagttcagg

SEQ ID NO: 6518555 - DNA, 19 bp, Homo sapiens
tggaagggactcccaggac

SEQ ID NO: 6518556 - DNA, 13 bp, Homo sapiens
tggaagggagggg

SEQ ID NO: 6518557 - DNA, 16 bp, Homo sapiens
tggaagggaggtgggc

SEQ ID NO: 6518558 - DNA, 19 bp, Homo sapiens
tggaagggatggggtgcca

SEQ ID NO: 6518559 - DNA, 18 bp, Homo sapiens
tggaagggccttctccac

SEQ ID NO: 6518560 - DNA, 12 bp, Homo sapiens
tggaagggctgg

SEQ ID NO: 6518561 - DNA, 15 bp, Homo sapiens
tggaaggggcagcag

SEQ ID NO: 6518562 - DNA, 16 bp, Homo sapiens
tggaaggggcagccct

SEQ ID NO: 6518563 - DNA, 23 bp, Homo sapiens
tggaaggggccacgtggatgggc

SEQ ID NO: 6518564 - DNA, 22 bp, Homo sapiens
tggaaggggccttgctgagtgg

SEQ ID NO: 6518565 - DNA, 18 bp, Homo sapiens
tggaagggggtgtgcgtg

SEQ ID NO: 6518566 - DNA, 15 bp, Homo sapiens
tggaaggtgctgtta

SEQ ID NO: 6518567 - DNA, 20 bp, Homo sapiens
tggaaggtttggtgtgtgga

SEQ ID NO: 6518568 - DNA, 21 bp, Homo sapiens
tggaagtaaaggcattccaca

SEQ ID NO: 6518569 - DNA, 23 bp, Homo sapiens
tggaagtaattaaggtacatcat

SEQ ID NO: 6518570 - DNA, 13 bp, Homo sapiens
tggaagtacttgg

SEQ ID NO: 6518571 - DNA, 22 bp, Homo sapiens
tggaagtatgtatattaaaaaa

SEQ ID NO: 6518572 - DNA, 13 bp, Homo sapiens
tggaagtatttga

SEQ ID NO: 6518573 - DNA, 16 bp, Homo sapiens
tggaagtattttcctc

SEQ ID NO: 6518574 - DNA, 18 bp, Homo sapiens
tggaagtcaaataaatgt

SEQ ID NO: 6518575 - DNA, 23 bp, Homo sapiens
tggaagtcaaataaatgtttccc

SEQ ID NO: 6518576 - DNA, 19 bp, Homo sapiens
tggaagtcacctttctggg

SEQ ID NO: 6518577 - DNA, 20 bp, Homo sapiens
tggaagtccctcagaggcct

SEQ ID NO: 6518578 - DNA, 22 bp, Homo sapiens
tggaagtcgtttcaggacatgg

SEQ ID NO: 6518579 - DNA, 17 bp, Homo sapiens
tggaagtctacctgctg

SEQ ID NO: 6518580 - DNA, 20 bp, Homo sapiens
tggaagtctacctgctggac

SEQ ID NO: 6518581 - DNA, 15 bp, Homo sapiens
tggaagtctgtctca

SEQ ID NO: 6518582 - DNA, 19 bp, Homo sapiens
tggaagtgaaaactttgta

SEQ ID NO: 6518583 - DNA, 19 bp, Homo sapiens
tggaagtgatgtatgttat

SEQ ID NO: 6518584 - DNA, 19 bp, Homo sapiens
tggaagtgcagtcagcaga

SEQ ID NO: 6518585 - DNA, 18 bp, Homo sapiens
tggaagtgcccagcccct

SEQ ID NO: 6518586 - DNA, 17 bp, Homo sapiens
tggaagtggattgtttt

SEQ ID NO: 6518587 - DNA, 19 bp, Homo sapiens
tggaagtgggccagtcctg

SEQ ID NO: 6518588 - DNA, 18 bp, Homo sapiens
tggaagtgtctgccagct

SEQ ID NO: 6518589 - DNA, 21 bp, Homo sapiens
tggaagtgttccctgagaaac

SEQ ID NO: 6518590 - DNA, 16 bp, Homo sapiens
tggaagtgttcctgtc

SEQ ID NO: 6518591 - DNA, 19 bp, Homo sapiens
tggaagtgttcctgtctca

SEQ ID NO: 6518592 - DNA, 18 bp, Homo sapiens
tggaagttcatacctaag

SEQ ID NO: 6518593 - DNA, 20 bp, Homo sapiens
tggaagttctgaattaaaag

SEQ ID NO: 6518594 - DNA, 20 bp, Homo sapiens
tggaagttcttcaagaggaa

SEQ ID NO: 6518595 - DNA, 21 bp, Homo sapiens
tggaagttcttcaagaggaaa

SEQ ID NO: 6518596 - DNA, 16 bp, Homo sapiens
tggaagttgagactta

SEQ ID NO: 6518597 - DNA, 11 bp, Homo sapiens
tggaagttgca

SEQ ID NO: 6518598 - DNA, 13 bp, Homo sapiens
tggaagttggggc

SEQ ID NO: 6518599 - DNA, 14 bp, Homo sapiens
tggaagttgtcctt

SEQ ID NO: 6518600 - DNA, 20 bp, Homo sapiens
tggaagtttagctctgagaa

SEQ ID NO: 6518601 - DNA, 16 bp, Homo sapiens
tggaagtttatttcca

SEQ ID NO: 6518602 - DNA, 21 bp, Homo sapiens
tggaagttttacttgattaag

SEQ ID NO: 6518603 - DNA, 18 bp, Homo sapiens
tggaataaaaattccaga

SEQ ID NO: 6518604 - DNA, 18 bp, Homo sapiens
tggaataaaaggcttgaa

SEQ ID NO: 6518605 - DNA, 22 bp, Homo sapiens
tggaataaaaggcttgaagctg

SEQ ID NO: 6518606 - DNA, 15 bp, Homo sapiens
tggaataaaatacta

SEQ ID NO: 6518607 - DNA, 18 bp, Homo sapiens
tggaataaaatactattt

SEQ ID NO: 6518608 - DNA, 20 bp, Homo sapiens
tggaataaacagtgagcata

SEQ ID NO: 6518609 - DNA, 22 bp, Homo sapiens
tggaataaacatctgtgtctgt

SEQ ID NO: 6518610 - DNA, 15 bp, Homo sapiens
tggaataaacattaa

SEQ ID NO: 6518611 - DNA, 19 bp, Homo sapiens
tggaataaacattaatttt

SEQ ID NO: 6518612 - DNA, 21 bp, Homo sapiens
tggaataaacattaattttgt

SEQ ID NO: 6518613 - DNA, 14 bp, Homo sapiens
tggaataaagaggg

SEQ ID NO: 6518614 - DNA, 19 bp, Homo sapiens
tggaataaagatggtccaa

SEQ ID NO: 6518615 - DNA, 21 bp, Homo sapiens
tggaataaagttctgttttct

SEQ ID NO: 6518616 - DNA, 16 bp, Homo sapiens
tggaataaagttgcag

SEQ ID NO: 6518617 - DNA, 14 bp, Homo sapiens
tggaataacatgta

SEQ ID NO: 6518618 - DNA, 15 bp, Homo sapiens
tggaataacatgtaa

SEQ ID NO: 6518619 - DNA, 14 bp, Homo sapiens
tggaataagacaga

SEQ ID NO: 6518620 - DNA, 17 bp, Homo sapiens
tggaataagccttcgaa

SEQ ID NO: 6518621 - DNA, 11 bp, Homo sapiens
tggaataagtg

SEQ ID NO: 6518622 - DNA, 14 bp, Homo sapiens
tggaataagtgtac

SEQ ID NO: 6518623 - DNA, 17 bp, Homo sapiens
tggaataagtgtacata

SEQ ID NO: 6518624 - DNA, 18 bp, Homo sapiens
tggaataataattttcct

SEQ ID NO: 6518625 - DNA, 14 bp, Homo sapiens
tggaataatgtaaa

SEQ ID NO: 6518626 - DNA, 16 bp, Homo sapiens
tggaataatttctatt

SEQ ID NO: 6518627 - DNA, 19 bp, Homo sapiens
tggaataatttgtaaatga

SEQ ID NO: 6518628 - DNA, 17 bp, Homo sapiens
tggaatacacatgcagg

SEQ ID NO: 6518629 - DNA, 13 bp, Homo sapiens
tggaatacagtca

SEQ ID NO: 6518630 - DNA, 16 bp, Homo sapiens
tggaatacagtcattc

SEQ ID NO: 6518631 - DNA, 20 bp, Homo sapiens
tggaatacgatcctgcaggg

SEQ ID NO: 6518632 - DNA, 16 bp, Homo sapiens
tggaatactcttatat

SEQ ID NO: 6518633 - DNA, 13 bp, Homo sapiens
tggaatacttttt

SEQ ID NO: 6518634 - DNA, 18 bp, Homo sapiens
tggaatactttttgttat

SEQ ID NO: 6518635 - DNA, 15 bp, Homo sapiens
tggaatagatgtctc

SEQ ID NO: 6518636 - DNA, 19 bp, Homo sapiens
tggaatagtaaactaaagt

SEQ ID NO: 6518637 - DNA, 17 bp, Homo sapiens
tggaatagtatcctcca

SEQ ID NO: 6518638 - DNA, 16 bp, Homo sapiens
tggaatagtgaatact

SEQ ID NO: 6518639 - DNA, 15 bp, Homo sapiens
tggaatagttacttt

SEQ ID NO: 6518640 - DNA, 17 bp, Homo sapiens
tggaatagttctgtata

SEQ ID NO: 6518641 - DNA, 13 bp, Homo sapiens
tggaatataaaga

SEQ ID NO: 6518642 - DNA, 23 bp, Homo sapiens
tggaatataaatagctgaaaact

SEQ ID NO: 6518643 - DNA, 16 bp, Homo sapiens
tggaatataaatatca

SEQ ID NO: 6518644 - DNA, 19 bp, Homo sapiens
tggaatataaatatcacaa

SEQ ID NO: 6518645 - DNA, 22 bp, Homo sapiens
tggaatatcatctgtcattata

SEQ ID NO: 6518646 - DNA, 16 bp, Homo sapiens
tggaatatctccgtca

SEQ ID NO: 6518647 - DNA, 22 bp, Homo sapiens
tggaatatctgctgtatgtcaa

SEQ ID NO: 6518648 - DNA, 23 bp, Homo sapiens
tggaatatcttatattgggcgat

SEQ ID NO: 6518649 - DNA, 18 bp, Homo sapiens
ttaaagtaaacttgtgta

SEQ ID NO: 6518650 - DNA, 16 bp, Homo sapiens
ttaaagtactttctta

SEQ ID NO: 6518651 - DNA, 16 bp, Homo sapiens
ttaaagtatatattta

SEQ ID NO: 6518652 - DNA, 15 bp, Homo sapiens
ttaaagtatgaatct

SEQ ID NO: 6518653 - DNA, 23 bp, Homo sapiens
ttaaagtatgttattgcataatt

SEQ ID NO: 6518654 - DNA, 23 bp, Homo sapiens
ttaaagtatttataaaaatataa

SEQ ID NO: 6518655 - DNA, 19 bp, Homo sapiens
ttaaagtcacatccctgta

SEQ ID NO: 6518656 - DNA, 18 bp, Homo sapiens
ttaaagtctaaacaaaat

SEQ ID NO: 6518657 - DNA, 16 bp, Homo sapiens
ttaaagtctacactgc

SEQ ID NO: 6518658 - DNA, 15 bp, Homo sapiens
ttaaagtctgagaaa

SEQ ID NO: 6518659 - DNA, 15 bp, Homo sapiens
ttaaagtgaaggaaa

SEQ ID NO: 6518660 - DNA, 16 bp, Homo sapiens
ttaaagtgaaggaaat

SEQ ID NO: 6518661 - DNA, 19 bp, Homo sapiens
ttaaagtgaatctcaaaac

SEQ ID NO: 6518662 - DNA, 12 bp, Homo sapiens
ttaaagtgatta

SEQ ID NO: 6518663 - DNA, 21 bp, Homo sapiens
ttaaagtgccatttcctgtct

SEQ ID NO: 6518664 - DNA, 12 bp, Homo sapiens
ttaaagtgcctt

SEQ ID NO: 6518665 - DNA, 19 bp, Homo sapiens
ttaaagtgctaaggttcta

SEQ ID NO: 6518666 - DNA, 20 bp, Homo sapiens
ttaaagtgctgtttagattt

SEQ ID NO: 6518667 - DNA, 17 bp, Homo sapiens
ttaaagtggcaatctca

SEQ ID NO: 6518668 - DNA, 22 bp, Homo sapiens
ttaaagtggctttcaacttcaa

SEQ ID NO: 6518669 - DNA, 19 bp, Homo sapiens
ttaaagtgtacttataaac

SEQ ID NO: 6518670 - DNA, 16 bp, Homo sapiens
ttaaagtgtggaaagc

SEQ ID NO: 6518671 - DNA, 13 bp, Homo sapiens
ttaaagttaaaac

SEQ ID NO: 6518672 - DNA, 20 bp, Homo sapiens
ttaaagttagtatcttttga

SEQ ID NO: 6518673 - DNA, 15 bp, Homo sapiens
ttaaagttctgtaaa

SEQ ID NO: 6518674 - DNA, 20 bp, Homo sapiens
ttaaagttcttattttagta

SEQ ID NO: 6518675 - DNA, 13 bp, Homo sapiens
ttaaagttgaatt

SEQ ID NO: 6518676 - DNA, 22 bp, Homo sapiens
ttaaagttgaatttattggctt

SEQ ID NO: 6518677 - DNA, 15 bp, Homo sapiens
ttaaagttgcacatg

SEQ ID NO: 6518678 - DNA, 19 bp, Homo sapiens
ttaaagttggaatttacca

SEQ ID NO: 6518679 - DNA, 17 bp, Homo sapiens
ttaaagttgtttcccac

SEQ ID NO: 6518680 - DNA, 14 bp, Homo sapiens
ttaaagtttaaata

SEQ ID NO: 6518681 - DNA, 18 bp, Homo sapiens
ttaaagtttaaataccag

SEQ ID NO: 6518682 - DNA, 19 bp, Homo sapiens
ttaaagttttgtcagaaaa

SEQ ID NO: 6518683 - DNA, 22 bp, Homo sapiens
ttaaataaaagaaatgcacaat

SEQ ID NO: 6518684 - DNA, 13 bp, Homo sapiens
ttaaataaaagag

SEQ ID NO: 6518685 - DNA, 23 bp, Homo sapiens
ttaaataaaagaggtccattaat

SEQ ID NO: 6518686 - DNA, 16 bp, Homo sapiens
ttaaataaaagcacaa

SEQ ID NO: 6518687 - DNA, 20 bp, Homo sapiens
ttaaataaaattgaaagtaa

SEQ ID NO: 6518688 - DNA, 13 bp, Homo sapiens
ttaaataaaccta

SEQ ID NO: 6518689 - DNA, 16 bp, Homo sapiens
ttaaataaactgtttt

SEQ ID NO: 6518690 - DNA, 22 bp, Homo sapiens
ttaaataaactttttttagatt

SEQ ID NO: 6518691 - DNA, 19 bp, Homo sapiens
ttaaataaactttttttca

SEQ ID NO: 6518692 - DNA, 20 bp, Homo sapiens
ttaaataaactttttttcaa

SEQ ID NO: 6518693 - DNA, 22 bp, Homo sapiens
ttaaataaactttttttcaatg

SEQ ID NO: 6518694 - DNA, 17 bp, Homo sapiens
ttaaataaagtatcatg

SEQ ID NO: 6518695 - DNA, 21 bp, Homo sapiens
ttaaataaagtatcatgcatt

SEQ ID NO: 6518696 - DNA, 13 bp, Homo sapiens
ttaaataaagtta

SEQ ID NO: 6518697 - DNA, 12 bp, Homo sapiens
ttaaataaatga

SEQ ID NO: 6518698 - DNA, 18 bp, Homo sapiens
ttaaataaatgtcattaa

SEQ ID NO: 6518699 - DNA, 11 bp, Homo sapiens
ttaaataaatt

SEQ ID NO: 6518700 - DNA, 14 bp, Homo sapiens
ttaaataaattatg

SEQ ID NO: 6518701 - DNA, 13 bp, Homo sapiens
ttaaataaattca

SEQ ID NO: 6518702 - DNA, 21 bp, Homo sapiens
ttaaataaattcaaaccattt

SEQ ID NO: 6518703 - DNA, 20 bp, Homo sapiens
ttaaataaattgtatattca

SEQ ID NO: 6518704 - DNA, 13 bp, Homo sapiens
ttaaataaatttg

SEQ ID NO: 6518705 - DNA, 17 bp, Homo sapiens
ttaaataaatttgactt

SEQ ID NO: 6518706 - DNA, 13 bp, Homo sapiens
ttaaataacatgt

SEQ ID NO: 6518707 - DNA, 16 bp, Homo sapiens
ttaaataacctctggc

SEQ ID NO: 6518708 - DNA, 23 bp, Homo sapiens
ttaaataagatggagaataaatt

SEQ ID NO: 6518709 - DNA, 14 bp, Homo sapiens
ttaaataagattct

SEQ ID NO: 6518710 - DNA, 17 bp, Homo sapiens
ttaaataagattctaac

SEQ ID NO: 6518711 - DNA, 18 bp, Homo sapiens
ttaaataagattctaacg

SEQ ID NO: 6518712 - DNA, 12 bp, Homo sapiens
ttaaataagcaa

SEQ ID NO: 6518713 - DNA, 20 bp, Homo sapiens
ttaaataagtgcgatcacac

SEQ ID NO: 6518714 - DNA, 16 bp, Homo sapiens
ttaaataatgtgaaac

SEQ ID NO: 6518715 - DNA, 19 bp, Homo sapiens
ttaaataatgtgaaactgg

SEQ ID NO: 6518716 - DNA, 20 bp, Homo sapiens
ttaaataatgtgaaactgga

SEQ ID NO: 6518717 - DNA, 10 bp, Homo sapiens
ttaaataatt

SEQ ID NO: 6518718 - DNA, 15 bp, Homo sapiens
ttaaataatttccta

SEQ ID NO: 6518719 - DNA, 15 bp, Homo sapiens
ttaaataattttaca

SEQ ID NO: 6518720 - DNA, 22 bp, Homo sapiens
ttaaataattttacatgtctca

SEQ ID NO: 6518721 - DNA, 18 bp, Homo sapiens
ttaaatacaaaacttcca

SEQ ID NO: 6518722 - DNA, 21 bp, Homo sapiens
ttaaatacactgaattgaatc

SEQ ID NO: 6518723 - DNA, 23 bp, Homo sapiens
ttaaatacactgaattgaatcta

SEQ ID NO: 6518724 - DNA, 17 bp, Homo sapiens
ttaaatacagacactaa

SEQ ID NO: 6518725 - DNA, 18 bp, Homo sapiens
ttaaatacagacactaag

SEQ ID NO: 6518726 - DNA, 19 bp, Homo sapiens
ttaaatacagacactaagt

SEQ ID NO: 6518727 - DNA, 14 bp, Homo sapiens
ttaaatacaggaaa

SEQ ID NO: 6518728 - DNA, 17 bp, Homo sapiens
ttaaatacaggaaacag

SEQ ID NO: 6518729 - DNA, 15 bp, Homo sapiens
ttaaatacataaata

SEQ ID NO: 6518730 - DNA, 19 bp, Homo sapiens
ttaaatacatatggatgtt

SEQ ID NO: 6518731 - DNA, 20 bp, Homo sapiens
ttaaatactgtgcagaataa

SEQ ID NO: 6518732 - DNA, 15 bp, Homo sapiens
ttaaatactttttca

SEQ ID NO: 6518733 - DNA, 13 bp, Homo sapiens
ttaaatagataca

SEQ ID NO: 6518734 - DNA, 14 bp, Homo sapiens
ttaaatagcctaaa

SEQ ID NO: 6518735 - DNA, 15 bp, Homo sapiens
ttaaatagcttttgt

SEQ ID NO: 6518736 - DNA, 12 bp, Homo sapiens
ttaaatataatt

SEQ ID NO: 6518737 - DNA, 17 bp, Homo sapiens
ttaaatataattctgta

SEQ ID NO: 6518738 - DNA, 18 bp, Homo sapiens
ttaaatataattctgtaa

SEQ ID NO: 6518739 - DNA, 20 bp, Homo sapiens
ttaaatataattctgtaaat

SEQ ID NO: 6518740 - DNA, 13 bp, Homo sapiens
ttaaatatacact

SEQ ID NO: 6518741 - DNA, 17 bp, Homo sapiens
ttaaatatagattagaa

SEQ ID NO: 6518742 - DNA, 12 bp, Homo sapiens
ttaaatatagtt

SEQ ID NO: 6518743 - DNA, 23 bp, Homo sapiens
ttaaatatagttcctaagaagct

SEQ ID NO: 6518744 - DNA, 17 bp, Homo sapiens
ttaaatatataaacaaa

SEQ ID NO: 6518745 - DNA, 22 bp, Homo sapiens
ttaaatatatattattctcatt

SEQ ID NO: 6518746 - DNA, 14 bp, Homo sapiens
ttaaatatatcact

SEQ ID NO: 6518747 - DNA, 18 bp, Homo sapiens
ttaaatatatctttgtaa

SEQ ID NO: 6518748 - DNA, 16 bp, Homo sapiens
ttaaatatatgtatgt

SEQ ID NO: 6518749 - DNA, 13 bp, Homo sapiens
ttaaatatatttt

SEQ ID NO: 6518750 - DNA, 23 bp, Homo sapiens
ttaaatatattttcaaagtacat

SEQ ID NO: 6518751 - DNA, 12 bp, Homo sapiens
ttaaatatcaat

SEQ ID NO: 6518752 - DNA, 18 bp, Homo sapiens
ttaaatatcaatcatttt

SEQ ID NO: 6518753 - DNA, 22 bp, Homo sapiens
ttaaatatcagtagaaactcta

SEQ ID NO: 6518754 - DNA, 17 bp, Homo sapiens
ttaaatatcattctttg

SEQ ID NO: 6518755 - DNA, 23 bp, Homo sapiens
ttaaatatcattctttgtatctt

SEQ ID NO: 6518756 - DNA, 18 bp, Homo sapiens
ttaaatatcttttatgtt

SEQ ID NO: 6518757 - DNA, 20 bp, Homo sapiens
ttaaatatcttttatgtttg

SEQ ID NO: 6518758 - DNA, 22 bp, Homo sapiens
ttaaatatcttttatgtttgaa

SEQ ID NO: 6518759 - DNA, 15 bp, Homo sapiens
ttaaatatgaacaaa

SEQ ID NO: 6518760 - DNA, 16 bp, Homo sapiens
ttaaatatgaatgaac

SEQ ID NO: 6518761 - DNA, 13 bp, Homo sapiens
ttaaatatgtata

SEQ ID NO: 6518762 - DNA, 20 bp, Homo sapiens
ttaaatatgtatatgacatt

SEQ ID NO: 6518763 - DNA, 17 bp, Homo sapiens
ttaaatattcagaaaaa

SEQ ID NO: 6518764 - DNA, 18 bp, Homo sapiens
ttaaatattctgtacatt

SEQ ID NO: 6518765 - DNA, 15 bp, Homo sapiens
ttaaatattgtaata

SEQ ID NO: 6518766 - DNA, 18 bp, Homo sapiens
ttaaatattgtaatatga

SEQ ID NO: 6518767 - DNA, 22 bp, Homo sapiens
ttaaatattgtaatatgacaga

SEQ ID NO: 6518768 - DNA, 23 bp, Homo sapiens
ttaaatattgtaatatgacagat

SEQ ID NO: 6518769 - DNA, 13 bp, Homo sapiens
ttaaatatttaat

SEQ ID NO: 6518770 - DNA, 15 bp, Homo sapiens
ttaaatatttaatga

SEQ ID NO: 6518771 - DNA, 17 bp, Homo sapiens
ttaaatatttacatatg

SEQ ID NO: 6518772 - DNA, 18 bp, Homo sapiens
ttaaatatttacatatga

SEQ ID NO: 6518773 - DNA, 15 bp, Homo sapiens
ttaaatatttgaaga

SEQ ID NO: 6518774 - DNA, 22 bp, Homo sapiens
ttaaatatttgtgactctttcc

SEQ ID NO: 6518775 - DNA, 17 bp, Homo sapiens
ttaaatattttgctaac

SEQ ID NO: 6518776 - DNA, 13 bp, Homo sapiens
ttaaatatttttg

SEQ ID NO: 6518777 - DNA, 15 bp, Homo sapiens
ttaaatcaaaaactt

SEQ ID NO: 6518778 - DNA, 17 bp, Homo sapiens
ttaaatcaaaaactttt

SEQ ID NO: 6518779 - DNA, 18 bp, Homo sapiens
ttaaatcaaaaacttttc

SEQ ID NO: 6518780 - DNA, 18 bp, Homo sapiens
ttaaatcaaaagctgctt

SEQ ID NO: 6518781 - DNA, 13 bp, Homo sapiens
ttaaatcaaggaa

SEQ ID NO: 6518782 - DNA, 22 bp, Homo sapiens
ttaaatcacagaaaaaaatggt

SEQ ID NO: 6518783 - DNA, 23 bp, Homo sapiens
ttaaatcacagcccaaaatttga

SEQ ID NO: 6518784 - DNA, 12 bp, Homo sapiens
ttaaatcactga

SEQ ID NO: 6518785 - DNA, 15 bp, Homo sapiens
ttaaatcagaataaa

SEQ ID NO: 6518786 - DNA, 14 bp, Homo sapiens
ttaaatcagaatct

SEQ ID NO: 6518787 - DNA, 14 bp, Homo sapiens
ttaaatcagttttg

SEQ ID NO: 6518788 - DNA, 13 bp, Homo sapiens
ttaaatcatgtat

SEQ ID NO: 6518789 - DNA, 15 bp, Homo sapiens
ttaaatcattcattc

SEQ ID NO: 6518790 - DNA, 15 bp, Homo sapiens
ttaaatcatttatct

SEQ ID NO: 6518791 - DNA, 12 bp, Homo sapiens
ttaaatcatttt

SEQ ID NO: 6518792 - DNA, 13 bp, Homo sapiens
ttaaatcatttta

SEQ ID NO: 6518793 - DNA, 21 bp, Homo sapiens
ttaaatcattttaggaaagga

SEQ ID NO: 6518794 - DNA, 15 bp, Homo sapiens
ttaaatcatttttat

SEQ ID NO: 6518795 - DNA, 14 bp, Homo sapiens
ttaaatccaataaa

SEQ ID NO: 6518796 - DNA, 15 bp, Homo sapiens
ttaaatccaataaaa

SEQ ID NO: 6518797 - DNA, 17 bp, Homo sapiens
ttaaatcctaccaaagt

SEQ ID NO: 6518798 - DNA, 18 bp, Homo sapiens
ttaaatcctaccaaagta

SEQ ID NO: 6518799 - DNA, 16 bp, Homo sapiens
ttaaatcctgttgaaa

SEQ ID NO: 6518800 - DNA, 16 bp, Homo sapiens
ttaaatccttgtgtaa

SEQ ID NO: 6518801 - DNA, 23 bp, Homo sapiens
ttaaatcgaggcagaaagataca

SEQ ID NO: 6518802 - DNA, 13 bp, Homo sapiens
ttaaatcgttaga

SEQ ID NO: 6518803 - DNA, 17 bp, Homo sapiens
ttaaatcgtttaatgtt

SEQ ID NO: 6518804 - DNA, 20 bp, Homo sapiens
ttaaatctaaatctatttat

SEQ ID NO: 6518805 - DNA, 12 bp, Homo sapiens
ttaaatctagac

SEQ ID NO: 6518806 - DNA, 16 bp, Homo sapiens
ttaaatctatgaagta

SEQ ID NO: 6518807 - DNA, 22 bp, Homo sapiens
ttaaatctccagcttactataa

SEQ ID NO: 6518808 - DNA, 15 bp, Homo sapiens
ttaaatctcctgtgg

SEQ ID NO: 6518809 - DNA, 16 bp, Homo sapiens
ttaaatctgaatttta

SEQ ID NO: 6518810 - DNA, 14 bp, Homo sapiens
ttaaatctgacagt

SEQ ID NO: 6518811 - DNA, 13 bp, Homo sapiens
ttaaatctgcctt

SEQ ID NO: 6518812 - DNA, 15 bp, Homo sapiens
ttaaatctgtgatga

SEQ ID NO: 6518813 - DNA, 17 bp, Homo sapiens
ttaaatctttcttcaaa

SEQ ID NO: 6518814 - DNA, 12 bp, Homo sapiens
ttaaatgaaagg

SEQ ID NO: 6518815 - DNA, 12 bp, Homo sapiens
ttaaatgaaata

SEQ ID NO: 6518816 - DNA, 14 bp, Homo sapiens
ttaaatgaaattgt

SEQ ID NO: 6518817 - DNA, 17 bp, Homo sapiens
ttaaatgaacaagagaa

SEQ ID NO: 6518818 - DNA, 22 bp, Homo sapiens
ttaaatgaacaagagaagcatt

SEQ ID NO: 6518819 - DNA, 14 bp, Homo sapiens
ttaaatgaactact

SEQ ID NO: 6518820 - DNA, 15 bp, Homo sapiens
ttaaatgaagataca

SEQ ID NO: 6518821 - DNA, 21 bp, Homo sapiens
ttaaatgacagcacctgagaa

SEQ ID NO: 6518822 - DNA, 15 bp, Homo sapiens
ttaaatgacattttt

SEQ ID NO: 6518823 - DNA, 20 bp, Homo sapiens
ttaaatgacctcagatcttt

SEQ ID NO: 6518824 - DNA, 16 bp, Homo sapiens
ttaaatgacttgattg

SEQ ID NO: 6518825 - DNA, 15 bp, Homo sapiens
ttaaatgacttttct

SEQ ID NO: 6518826 - DNA, 18 bp, Homo sapiens
ttaaatgacttttcttaa

SEQ ID NO: 6518827 - DNA, 23 bp, Homo sapiens
ttaaatgagaaggaatttgagtt

SEQ ID NO: 6518828 - DNA, 15 bp, Homo sapiens
ttaaatgatcatgaa

SEQ ID NO: 6518829 - DNA, 20 bp, Homo sapiens
ttaaatgatcatgaaaccaa

SEQ ID NO: 6518830 - DNA, 16 bp, Homo sapiens
tggaatattcatttta

SEQ ID NO: 6518831 - DNA, 20 bp, Homo sapiens
tggaatcaaggaatcctgag

SEQ ID NO: 6518832 - DNA, 14 bp, Homo sapiens
tggaatcacagcca

SEQ ID NO: 6518833 - DNA, 19 bp, Homo sapiens
tggaatcacctggagggct

SEQ ID NO: 6518834 - DNA, 21 bp, Homo sapiens
tggaatcagattttaacagct

SEQ ID NO: 6518835 - DNA, 16 bp, Homo sapiens
tggaatcagctcagga

SEQ ID NO: 6518836 - DNA, 19 bp, Homo sapiens
tggaatcagtatttccttc

SEQ ID NO: 6518837 - DNA, 16 bp, Homo sapiens
tggaatcatactgcct

SEQ ID NO: 6518838 - DNA, 17 bp, Homo sapiens
tggaatccagaaggaag

SEQ ID NO: 6518839 - DNA, 18 bp, Homo sapiens
tggaatccagaaggaagc

SEQ ID NO: 6518840 - DNA, 22 bp, Homo sapiens
tggaatcgaagtgtttatgtaa

SEQ ID NO: 6518841 - DNA, 19 bp, Homo sapiens
tggaatcgatctgtactgt

SEQ ID NO: 6518842 - DNA, 22 bp, Homo sapiens
tggaatcgatctgtactgtaat

SEQ ID NO: 6518843 - DNA, 23 bp, Homo sapiens
tggaatcgatttcctcccacctc

SEQ ID NO: 6518844 - DNA, 17 bp, Homo sapiens
tggaatctaagctgttt

SEQ ID NO: 6518845 - DNA, 22 bp, Homo sapiens
tggaatctaagctgtttgccaa

SEQ ID NO: 6518846 - DNA, 18 bp, Homo sapiens
tggaatctacaagccaaa

SEQ ID NO: 6518847 - DNA, 18 bp, Homo sapiens
tggaatctacatgtgttt

SEQ ID NO: 6518848 - DNA, 22 bp, Homo sapiens
tggaatctagccgatggaaaat

SEQ ID NO: 6518849 - DNA, 17 bp, Homo sapiens
tggaatctgaggcatcc

SEQ ID NO: 6518850 - DNA, 15 bp, Homo sapiens
tggaatctgatgaaa

SEQ ID NO: 6518851 - DNA, 13 bp, Homo sapiens
tggaatcttctcc

SEQ ID NO: 6518852 - DNA, 21 bp, Homo sapiens
tggaatcttctctttgacaat

SEQ ID NO: 6518853 - DNA, 22 bp, Homo sapiens
tggaatcttctctttgacaatt

SEQ ID NO: 6518854 - DNA, 13 bp, Homo sapiens
tggaatcttgctg

SEQ ID NO: 6518855 - DNA, 22 bp, Homo sapiens
tggaatcttgctgcaggccctc

SEQ ID NO: 6518856 - DNA, 13 bp, Homo sapiens
tggaatcttttat

SEQ ID NO: 6518857 - DNA, 16 bp, Homo sapiens
tggaatgaagaaattg

SEQ ID NO: 6518858 - DNA, 13 bp, Homo sapiens
tggaatgaagcat

SEQ ID NO: 6518859 - DNA, 14 bp, Homo sapiens
tggaatgactgaaa

SEQ ID NO: 6518860 - DNA, 14 bp, Homo sapiens
tggaatgagggagg

SEQ ID NO: 6518861 - DNA, 18 bp, Homo sapiens
tggaatgagtgtgcatgg

SEQ ID NO: 6518862 - DNA, 19 bp, Homo sapiens
tggaatgcaatttgacttg

SEQ ID NO: 6518863 - DNA, 15 bp, Homo sapiens
tggaatgcacacagc

SEQ ID NO: 6518864 - DNA, 22 bp, Homo sapiens
tggaatgcacacagcggctgcc

SEQ ID NO: 6518865 - DNA, 23 bp, Homo sapiens
tggaatgcacacagcggctgcct

SEQ ID NO: 6518866 - DNA, 15 bp, Homo sapiens
tggaatgcactcaga

SEQ ID NO: 6518867 - DNA, 20 bp, Homo sapiens
tggaatgcagaggtctccaa

SEQ ID NO: 6518868 - DNA, 22 bp, Homo sapiens
tggaatgcatatcgctgggctc

SEQ ID NO: 6518869 - DNA, 21 bp, Homo sapiens
tggaatgcatggggcgggtcc

SEQ ID NO: 6518870 - DNA, 13 bp, Homo sapiens
tggaatgccttgg

SEQ ID NO: 6518871 - DNA, 23 bp, Homo sapiens
tggaatgcgggggagcaggcagt

SEQ ID NO: 6518872 - DNA, 16 bp, Homo sapiens
tggaatgcttcctaga

SEQ ID NO: 6518873 - DNA, 20 bp, Homo sapiens
tggaatggaactactgtact

SEQ ID NO: 6518874 - DNA, 21 bp, Homo sapiens
tggaatggaactactgtactt

SEQ ID NO: 6518875 - DNA, 22 bp, Homo sapiens
tggaatgggagaggcaataaat

SEQ ID NO: 6518876 - DNA, 17 bp, Homo sapiens
tggaatgggcagctcat

SEQ ID NO: 6518877 - DNA, 22 bp, Homo sapiens
tggaatggtacatgtcttccat

SEQ ID NO: 6518878 - DNA, 21 bp, Homo sapiens
tggaatggttataaaagtgat

SEQ ID NO: 6518879 - DNA, 23 bp, Homo sapiens
tggaatgtaactatatcatcctt

SEQ ID NO: 6518880 - DNA, 20 bp, Homo sapiens
tggaatgtacctatgtgagt

SEQ ID NO: 6518881 - DNA, 15 bp, Homo sapiens
tggaatgtcagtgtt

SEQ ID NO: 6518882 - DNA, 19 bp, Homo sapiens
tggaatgtcagtgttcagc

SEQ ID NO: 6518883 - DNA, 15 bp, Homo sapiens
tggaatgtgagtgtg

SEQ ID NO: 6518884 - DNA, 17 bp, Homo sapiens
tggaatgtgccacagag

SEQ ID NO: 6518885 - DNA, 23 bp, Homo sapiens
tggaatgtggcccctgaacaaga

SEQ ID NO: 6518886 - DNA, 15 bp, Homo sapiens
tggaatgttacatct

SEQ ID NO: 6518887 - DNA, 21 bp, Homo sapiens
tggaatgttgggtctcactct

SEQ ID NO: 6518888 - DNA, 16 bp, Homo sapiens
tggaatgttgttaaat

SEQ ID NO: 6518889 - DNA, 16 bp, Homo sapiens
tggaattaaaacaatg

SEQ ID NO: 6518890 - DNA, 18 bp, Homo sapiens
tggaattaaccatttaat

SEQ ID NO: 6518891 - DNA, 22 bp, Homo sapiens
tggaattacaaccattgtattt

SEQ ID NO: 6518892 - DNA, 18 bp, Homo sapiens
tggaattacaagccctgg

SEQ ID NO: 6518893 - DNA, 18 bp, Homo sapiens
tggaattacataacaggc

SEQ ID NO: 6518894 - DNA, 20 bp, Homo sapiens
tggaattacataacaggcat

SEQ ID NO: 6518895 - DNA, 23 bp, Homo sapiens
tggaattacttaaattttaaagc

SEQ ID NO: 6518896 - DNA, 13 bp, Homo sapiens
tggaattagatgt

SEQ ID NO: 6518897 - DNA, 20 bp, Homo sapiens
tggaattagcttggggccag

SEQ ID NO: 6518898 - DNA, 23 bp, Homo sapiens
tggaattagttggcagagaaaat

SEQ ID NO: 6518899 - DNA, 14 bp, Homo sapiens
tggaattataaata

SEQ ID NO: 6518900 - DNA, 16 bp, Homo sapiens
tggaattatgtataac

SEQ ID NO: 6518901 - DNA, 21 bp, Homo sapiens
tggaattattagcaccagctt

SEQ ID NO: 6518902 - DNA, 23 bp, Homo sapiens
tggaattattttgaatgtcacaa

SEQ ID NO: 6518903 - DNA, 20 bp, Homo sapiens
tggaattcagcaccctgggt

SEQ ID NO: 6518904 - DNA, 21 bp, Homo sapiens
tggaattcagcaccctgggtg

SEQ ID NO: 6518905 - DNA, 16 bp, Homo sapiens
tggaattcagcagttt

SEQ ID NO: 6518906 - DNA, 17 bp, Homo sapiens
tggaattccctcctgag

SEQ ID NO: 6518907 - DNA, 22 bp, Homo sapiens
tggaattccctcctgagtgccc

SEQ ID NO: 6518908 - DNA, 16 bp, Homo sapiens
tggaattcgtgttatg

SEQ ID NO: 6518909 - DNA, 21 bp, Homo sapiens
tggaattcgtgttatgaatct

SEQ ID NO: 6518910 - DNA, 13 bp, Homo sapiens
tggaattctaaca

SEQ ID NO: 6518911 - DNA, 15 bp, Homo sapiens
tggaattcttcctcc

SEQ ID NO: 6518912 - DNA, 22 bp, Homo sapiens
tggaattgatgtttacatgtct

SEQ ID NO: 6518913 - DNA, 19 bp, Homo sapiens
tggaattgcaatacattgt

SEQ ID NO: 6518914 - DNA, 15 bp, Homo sapiens
tggaattgccagctg

SEQ ID NO: 6518915 - DNA, 14 bp, Homo sapiens
tggaattggtgtat

SEQ ID NO: 6518916 - DNA, 16 bp, Homo sapiens
tggaattggtgtatat

SEQ ID NO: 6518917 - DNA, 22 bp, Homo sapiens
tggaattgtgctccaaatgtct

SEQ ID NO: 6518918 - DNA, 13 bp, Homo sapiens
tggaattgtggct

SEQ ID NO: 6518919 - DNA, 20 bp, Homo sapiens
tggaattgtggctatcctga

SEQ ID NO: 6518920 - DNA, 17 bp, Homo sapiens
tggaatttatatacaac

SEQ ID NO: 6518921 - DNA, 21 bp, Homo sapiens
tggaatttccattgacatttg

SEQ ID NO: 6518922 - DNA, 21 bp, Homo sapiens
tggaatttctagtatgagact

SEQ ID NO: 6518923 - DNA, 14 bp, Homo sapiens
tggaatttctgctg

SEQ ID NO: 6518924 - DNA, 15 bp, Homo sapiens
tggaatttctggcct

SEQ ID NO: 6518925 - DNA, 16 bp, Homo sapiens
tggaatttctggcctc

SEQ ID NO: 6518926 - DNA, 19 bp, Homo sapiens
tggaatttctggcctccta

SEQ ID NO: 6518927 - DNA, 13 bp, Homo sapiens
tggaatttcttgt

SEQ ID NO: 6518928 - DNA, 14 bp, Homo sapiens
tggaatttcttgtt

SEQ ID NO: 6518929 - DNA, 23 bp, Homo sapiens
tggaatttgaggtctagagagaa

SEQ ID NO: 6518930 - DNA, 17 bp, Homo sapiens
tggaatttgcctgctgg

SEQ ID NO: 6518931 - DNA, 18 bp, Homo sapiens
tggaatttgtaacctcag

SEQ ID NO: 6518932 - DNA, 16 bp, Homo sapiens
tggaatttgtaagttt

SEQ ID NO: 6518933 - DNA, 13 bp, Homo sapiens
tggaattttaagt

SEQ ID NO: 6518934 - DNA, 18 bp, Homo sapiens
tggaattttctaatataa

SEQ ID NO: 6518935 - DNA, 16 bp, Homo sapiens
tggaattttctgttca

SEQ ID NO: 6518936 - DNA, 12 bp, Homo sapiens
tggaattttctt

SEQ ID NO: 6518937 - DNA, 13 bp, Homo sapiens
tggaattttctta

SEQ ID NO: 6518938 - DNA, 22 bp, Homo sapiens
tggaattttctttcatacatta

SEQ ID NO: 6518939 - DNA, 14 bp, Homo sapiens
tggaattttgtaaa

SEQ ID NO: 6518940 - DNA, 20 bp, Homo sapiens
tggaatttttattatgcata

SEQ ID NO: 6518941 - DNA, 17 bp, Homo sapiens
tggaatttttgaatcta

SEQ ID NO: 6518942 - DNA, 20 bp, Homo sapiens
tggaatttttgaatctattt

SEQ ID NO: 6518943 - DNA, 19 bp, Homo sapiens
tggaatttttgcttgactt

SEQ ID NO: 6518944 - DNA, 21 bp, Homo sapiens
tggaatttttgcttgacttca

SEQ ID NO: 6518945 - DNA, 14 bp, Homo sapiens
tggaattttttatt

SEQ ID NO: 6518946 - DNA, 15 bp, Homo sapiens
tggaattttttattc

SEQ ID NO: 6518947 - DNA, 16 bp, Homo sapiens
tggaattttttattct

SEQ ID NO: 6518948 - DNA, 14 bp, Homo sapiens
tggaattttttcct

SEQ ID NO: 6518949 - DNA, 16 bp, Homo sapiens
tggacaaaaaaaaaag

SEQ ID NO: 6518950 - DNA, 22 bp, Homo sapiens
tggacaaaaaaaaaagaagcag

SEQ ID NO: 6518951 - DNA, 19 bp, Homo sapiens
tggacaaacccttctttta

SEQ ID NO: 6518952 - DNA, 23 bp, Homo sapiens
tggacaaagaattccaaagcaaa

SEQ ID NO: 6518953 - DNA, 15 bp, Homo sapiens
tggacaaagttctgt

SEQ ID NO: 6518954 - DNA, 16 bp, Homo sapiens
tggacaaataagtttt

SEQ ID NO: 6518955 - DNA, 21 bp, Homo sapiens
tggacaaatgtatagaataaa

SEQ ID NO: 6518956 - DNA, 19 bp, Homo sapiens
tggacaaatgtgaagatgc

SEQ ID NO: 6518957 - DNA, 14 bp, Homo sapiens
tggacaacactgat

SEQ ID NO: 6518958 - DNA, 22 bp, Homo sapiens
tggacaacactgattcctggag

SEQ ID NO: 6518959 - DNA, 23 bp, Homo sapiens
tggacaacactgattcctggaga

SEQ ID NO: 6518960 - DNA, 14 bp, Homo sapiens
tggacaacagctct

SEQ ID NO: 6518961 - DNA, 18 bp, Homo sapiens
tggacaacagctctcgtt

SEQ ID NO: 6518962 - DNA, 14 bp, Homo sapiens
tggacaacccagaa

SEQ ID NO: 6518963 - DNA, 16 bp, Homo sapiens
tggacaagaagagtcc

SEQ ID NO: 6518964 - DNA, 15 bp, Homo sapiens
tggacaagaagctgc

SEQ ID NO: 6518965 - DNA, 22 bp, Homo sapiens
tggacaagcagaggtggccaga

SEQ ID NO: 6518966 - DNA, 17 bp, Homo sapiens
tggacaagcttctgaga

SEQ ID NO: 6518967 - DNA, 13 bp, Homo sapiens
tggacaaggaggt

SEQ ID NO: 6518968 - DNA, 15 bp, Homo sapiens
tggacaagtcatgga

SEQ ID NO: 6518969 - DNA, 16 bp, Homo sapiens
tggacaatcatgaaat

SEQ ID NO: 6518970 - DNA, 14 bp, Homo sapiens
tggacacaaggcac

SEQ ID NO: 6518971 - DNA, 15 bp, Homo sapiens
tggacacacacagct

SEQ ID NO: 6518972 - DNA, 23 bp, Homo sapiens
tggacacactaaactctggggct

SEQ ID NO: 6518973 - DNA, 16 bp, Homo sapiens
tggacacagctcttca

SEQ ID NO: 6518974 - DNA, 17 bp, Homo sapiens
tggacacagctcttcat

SEQ ID NO: 6518975 - DNA, 18 bp, Homo sapiens
tggacacagctcttcatt

SEQ ID NO: 6518976 - DNA, 18 bp, Homo sapiens
tggacacagctcttctcc

SEQ ID NO: 6518977 - DNA, 15 bp, Homo sapiens
tggacacaggcctgc

SEQ ID NO: 6518978 - DNA, 23 bp, Homo sapiens
tggacacagtcagggcggggctg

SEQ ID NO: 6518979 - DNA, 23 bp, Homo sapiens
tggacaccacccagagcaccctc

SEQ ID NO: 6518980 - DNA, 18 bp, Homo sapiens
tggacaccaggagtccct

SEQ ID NO: 6518981 - DNA, 13 bp, Homo sapiens
tggacaccccaga

SEQ ID NO: 6518982 - DNA, 15 bp, Homo sapiens
tggacacccccttgg

SEQ ID NO: 6518983 - DNA, 15 bp, Homo sapiens
tggacaccctctgcc

SEQ ID NO: 6518984 - DNA, 18 bp, Homo sapiens
tggacaccctctgccgag

SEQ ID NO: 6518985 - DNA, 19 bp, Homo sapiens
tggacaccgctcagtatta

SEQ ID NO: 6518986 - DNA, 18 bp, Homo sapiens
tggacacctacagcagca

SEQ ID NO: 6518987 - DNA, 13 bp, Homo sapiens
tggacacctccca

SEQ ID NO: 6518988 - DNA, 15 bp, Homo sapiens
tggacacctcccagg

SEQ ID NO: 6518989 - DNA, 10 bp, Homo sapiens
tggacacctg

SEQ ID NO: 6518990 - DNA, 12 bp, Homo sapiens
tggacacctgcc

SEQ ID NO: 6518991 - DNA, 15 bp, Homo sapiens
tggacacctgccctg

SEQ ID NO: 6518992 - DNA, 16 bp, Homo sapiens
tggacacctgccctgc

SEQ ID NO: 6518993 - DNA, 18 bp, Homo sapiens
tggacacctttaggttct

SEQ ID NO: 6518994 - DNA, 22 bp, Homo sapiens
tggacacgagccacaagctgca

SEQ ID NO: 6518995 - DNA, 23 bp, Homo sapiens
tggacacgagccacaagctgcac

SEQ ID NO: 6518996 - DNA, 18 bp, Homo sapiens
tggacactacacccagca

SEQ ID NO: 6518997 - DNA, 22 bp, Homo sapiens
tggacactacacgtttcaacct

SEQ ID NO: 6518998 - DNA, 17 bp, Homo sapiens
tggacactccagtgcca

SEQ ID NO: 6518999 - DNA, 19 bp, Homo sapiens
tggacactccagtgccagc

SEQ ID NO: 6519000 - DNA, 21 bp, Homo sapiens
tggacactgccttagcctctt

SEQ ID NO: 6519001 - DNA, 13 bp, Homo sapiens
tggacactgtgaa

SEQ ID NO: 6519002 - DNA, 14 bp, Homo sapiens
tggacactgtgaca

SEQ ID NO: 6519003 - DNA, 13 bp, Homo sapiens
tggacactgtgga

SEQ ID NO: 6519004 - DNA, 14 bp, Homo sapiens
tggacactgtggaa

SEQ ID NO: 6519005 - DNA, 14 bp, Homo sapiens
tggacacttcttta

SEQ ID NO: 6519006 - DNA, 14 bp, Homo sapiens
tggacactttgaaa

SEQ ID NO: 6519007 - DNA, 14 bp, Homo sapiens
ttaaatgattccaa

SEQ ID NO: 6519008 - DNA, 11 bp, Homo sapiens
ttaaatgattg

SEQ ID NO: 6519009 - DNA, 19 bp, Homo sapiens
ttaaatgcaaattaaaggg

SEQ ID NO: 6519010 - DNA, 20 bp, Homo sapiens
ttaaatgcaagtgcctagat

SEQ ID NO: 6519011 - DNA, 23 bp, Homo sapiens
ttaaatgcacagttctatttgct

SEQ ID NO: 6519012 - DNA, 18 bp, Homo sapiens
ttaaatgcacctggaata

SEQ ID NO: 6519013 - DNA, 14 bp, Homo sapiens
ttaaatgcatgtct

SEQ ID NO: 6519014 - DNA, 20 bp, Homo sapiens
ttaaatgcatgtcttaaatg

SEQ ID NO: 6519015 - DNA, 12 bp, Homo sapiens
ttaaatgccaaa

SEQ ID NO: 6519016 - DNA, 16 bp, Homo sapiens
ttaaatgcccagcccc

SEQ ID NO: 6519017 - DNA, 18 bp, Homo sapiens
ttaaatgcccagcccctt

SEQ ID NO: 6519018 - DNA, 21 bp, Homo sapiens
ttaaatgccttggtttgattt

SEQ ID NO: 6519019 - DNA, 13 bp, Homo sapiens
ttaaatgccttgt

SEQ ID NO: 6519020 - DNA, 15 bp, Homo sapiens
ttaaatgctactgaa

SEQ ID NO: 6519021 - DNA, 13 bp, Homo sapiens
ttaaatgctcata

SEQ ID NO: 6519022 - DNA, 18 bp, Homo sapiens
ttaaatgctcataaagat

SEQ ID NO: 6519023 - DNA, 22 bp, Homo sapiens
ttaaatgctcattttctggttt

SEQ ID NO: 6519024 - DNA, 15 bp, Homo sapiens
ttaaatgctctctca

SEQ ID NO: 6519025 - DNA, 15 bp, Homo sapiens
ttaaatgctgtatgt

SEQ ID NO: 6519026 - DNA, 20 bp, Homo sapiens
ttaaatgctttgttttccca

SEQ ID NO: 6519027 - DNA, 18 bp, Homo sapiens
ttaaatgcttttaaatct

SEQ ID NO: 6519028 - DNA, 16 bp, Homo sapiens
ttaaatggcacctgta

SEQ ID NO: 6519029 - DNA, 19 bp, Homo sapiens
ttaaatggcagtatttcat

SEQ ID NO: 6519030 - DNA, 11 bp, Homo sapiens
ttaaatggcat

SEQ ID NO: 6519031 - DNA, 12 bp, Homo sapiens
ttaaatggcatg

SEQ ID NO: 6519032 - DNA, 13 bp, Homo sapiens
ttaaatggcatga

SEQ ID NO: 6519033 - DNA, 17 bp, Homo sapiens
ttaaatggggacgcaga

SEQ ID NO: 6519034 - DNA, 21 bp, Homo sapiens
ttaaatgggtagagaaacact

SEQ ID NO: 6519035 - DNA, 22 bp, Homo sapiens
ttaaatggtgggaaccctcccc

SEQ ID NO: 6519036 - DNA, 14 bp, Homo sapiens
ttaaatggttctgt

SEQ ID NO: 6519037 - DNA, 12 bp, Homo sapiens
ttaaatgtaaaa

SEQ ID NO: 6519038 - DNA, 23 bp, Homo sapiens
ttaaatgtaatataatgtatttt

SEQ ID NO: 6519039 - DNA, 12 bp, Homo sapiens
ttaaatgtactt

SEQ ID NO: 6519040 - DNA, 13 bp, Homo sapiens
ttaaatgtataca

SEQ ID NO: 6519041 - DNA, 17 bp, Homo sapiens
ttaaatgtatcacattg

SEQ ID NO: 6519042 - DNA, 13 bp, Homo sapiens
ttaaatgtattta

SEQ ID NO: 6519043 - DNA, 16 bp, Homo sapiens
ttaaatgtatttaatt

SEQ ID NO: 6519044 - DNA, 18 bp, Homo sapiens
ttaaatgtattttacata

SEQ ID NO: 6519045 - DNA, 19 bp, Homo sapiens
ttaaatgtcaaatgtgaat

SEQ ID NO: 6519046 - DNA, 17 bp, Homo sapiens
ttaaatgtcagttgaaa

SEQ ID NO: 6519047 - DNA, 22 bp, Homo sapiens
ttaaatgtctaatgtattttat

SEQ ID NO: 6519048 - DNA, 16 bp, Homo sapiens
ttaaatgtgaattttt

SEQ ID NO: 6519049 - DNA, 15 bp, Homo sapiens
ttaaatgtgagcaaa

SEQ ID NO: 6519050 - DNA, 12 bp, Homo sapiens
ttaaatgtgctt

SEQ ID NO: 6519051 - DNA, 14 bp, Homo sapiens
ttaaatgtgcttca

SEQ ID NO: 6519052 - DNA, 16 bp, Homo sapiens
ttaaatgtgcttcatt

SEQ ID NO: 6519053 - DNA, 14 bp, Homo sapiens
ttaaatgtgtattt

SEQ ID NO: 6519054 - DNA, 16 bp, Homo sapiens
ttaaatgtgtatttct

SEQ ID NO: 6519055 - DNA, 11 bp, Homo sapiens
ttaaatgtgtt

SEQ ID NO: 6519056 - DNA, 17 bp, Homo sapiens
ttaaatgttacctctga

SEQ ID NO: 6519057 - DNA, 19 bp, Homo sapiens
ttaaatgttgcacatcatt

SEQ ID NO: 6519058 - DNA, 20 bp, Homo sapiens
ttaaatgttgcacatcattc

SEQ ID NO: 6519059 - DNA, 11 bp, Homo sapiens
ttaaatgttta

SEQ ID NO: 6519060 - DNA, 14 bp, Homo sapiens
ttaaatgtttacta

SEQ ID NO: 6519061 - DNA, 15 bp, Homo sapiens
ttaaatgtttactat

SEQ ID NO: 6519062 - DNA, 18 bp, Homo sapiens
ttaaatgtttatactgta

SEQ ID NO: 6519063 - DNA, 19 bp, Homo sapiens
ttaaatgtttatactgtat

SEQ ID NO: 6519064 - DNA, 12 bp, Homo sapiens
ttaaatgtttca

SEQ ID NO: 6519065 - DNA, 22 bp, Homo sapiens
ttaaatgttttataagttcaca

SEQ ID NO: 6519066 - DNA, 16 bp, Homo sapiens
ttaaatgttttcctgc

SEQ ID NO: 6519067 - DNA, 12 bp, Homo sapiens
ttaaatgttttg

SEQ ID NO: 6519068 - DNA, 19 bp, Homo sapiens
ttaaatgttttgtaaactt

SEQ ID NO: 6519069 - DNA, 23 bp, Homo sapiens
ttaaatgtttttttttaaagact

SEQ ID NO: 6519070 - DNA, 19 bp, Homo sapiens
ttaaattaaacaatttatt

SEQ ID NO: 6519071 - DNA, 14 bp, Homo sapiens
ttaaattaaagcaa

SEQ ID NO: 6519072 - DNA, 16 bp, Homo sapiens
ttaaattaagtcattt

SEQ ID NO: 6519073 - DNA, 16 bp, Homo sapiens
ttaaattaatatcttt

SEQ ID NO: 6519074 - DNA, 16 bp, Homo sapiens
ttaaattacaatttta

SEQ ID NO: 6519075 - DNA, 12 bp, Homo sapiens
ttaaattataag

SEQ ID NO: 6519076 - DNA, 16 bp, Homo sapiens
ttaaattataagatgt

SEQ ID NO: 6519077 - DNA, 17 bp, Homo sapiens
ttaaattataaggactg

SEQ ID NO: 6519078 - DNA, 18 bp, Homo sapiens
ttaaattatactgtagct

SEQ ID NO: 6519079 - DNA, 18 bp, Homo sapiens
ttaaattatatatttatt

SEQ ID NO: 6519080 - DNA, 13 bp, Homo sapiens
ttaaattatgaag

SEQ ID NO: 6519081 - DNA, 19 bp, Homo sapiens
ttaaattatgaagctcata

SEQ ID NO: 6519082 - DNA, 19 bp, Homo sapiens
ttaaattatgaatgagttt

SEQ ID NO: 6519083 - DNA, 16 bp, Homo sapiens
ttaaattatgtataaa

SEQ ID NO: 6519084 - DNA, 23 bp, Homo sapiens
ttaaattatgttttaaacacatg

SEQ ID NO: 6519085 - DNA, 22 bp, Homo sapiens
ttaaattcatttctagactcaa

SEQ ID NO: 6519086 - DNA, 16 bp, Homo sapiens
ttaaattccactgaaa

SEQ ID NO: 6519087 - DNA, 19 bp, Homo sapiens
ttaaattcccgttttgtca

SEQ ID NO: 6519088 - DNA, 15 bp, Homo sapiens
ttaaattctcagtca

SEQ ID NO: 6519089 - DNA, 14 bp, Homo sapiens
ttaaattctccaac

SEQ ID NO: 6519090 - DNA, 14 bp, Homo sapiens
ttaaattctctcta

SEQ ID NO: 6519091 - DNA, 17 bp, Homo sapiens
ttaaattctctctaaca

SEQ ID NO: 6519092 - DNA, 14 bp, Homo sapiens
ttaaattctgagac

SEQ ID NO: 6519093 - DNA, 16 bp, Homo sapiens
ttaaattcttgcaaag

SEQ ID NO: 6519094 - DNA, 20 bp, Homo sapiens
ttaaattcttgcaaagtatc

SEQ ID NO: 6519095 - DNA, 15 bp, Homo sapiens
ttaaattcttttgag

SEQ ID NO: 6519096 - DNA, 22 bp, Homo sapiens
ttaaattctttttcaaaaatta

SEQ ID NO: 6519097 - DNA, 22 bp, Homo sapiens
ttaaattcttttttaaattttc

SEQ ID NO: 6519098 - DNA, 17 bp, Homo sapiens
ttaaattgcctttgtaa

SEQ ID NO: 6519099 - DNA, 18 bp, Homo sapiens
ttaaattgcctttgtaat

SEQ ID NO: 6519100 - DNA, 15 bp, Homo sapiens
ttaaattgctttcta

SEQ ID NO: 6519101 - DNA, 16 bp, Homo sapiens
ttaaattgcttttgtt

SEQ ID NO: 6519102 - DNA, 16 bp, Homo sapiens
ttaaattggaaagcag

SEQ ID NO: 6519103 - DNA, 18 bp, Homo sapiens
ttaaattggagaaaagca

SEQ ID NO: 6519104 - DNA, 21 bp, Homo sapiens
ttaaattggagaaaagcactt

SEQ ID NO: 6519105 - DNA, 21 bp, Homo sapiens
ttaaattgtgattgttttatt

SEQ ID NO: 6519106 - DNA, 13 bp, Homo sapiens
ttaaattgtggat

SEQ ID NO: 6519107 - DNA, 17 bp, Homo sapiens
ttaaattgttataactt

SEQ ID NO: 6519108 - DNA, 18 bp, Homo sapiens
ttaaattgtttcatatct

SEQ ID NO: 6519109 - DNA, 16 bp, Homo sapiens
ttaaatttaatatact

SEQ ID NO: 6519110 - DNA, 12 bp, Homo sapiens
ttaaatttagtg

SEQ ID NO: 6519111 - DNA, 21 bp, Homo sapiens
ttaaatttatcacattgaata

SEQ ID NO: 6519112 - DNA, 19 bp, Homo sapiens
ttaaatttattaaatgttg

SEQ ID NO: 6519113 - DNA, 14 bp, Homo sapiens
ttaaatttcaaatg

SEQ ID NO: 6519114 - DNA, 15 bp, Homo sapiens
ttaaatttcaaatgt

SEQ ID NO: 6519115 - DNA, 14 bp, Homo sapiens
ttaaatttcttatg

SEQ ID NO: 6519116 - DNA, 17 bp, Homo sapiens
ttaaatttcttatgtga

SEQ ID NO: 6519117 - DNA, 22 bp, Homo sapiens
ttaaatttcttatgtgacatta

SEQ ID NO: 6519118 - DNA, 12 bp, Homo sapiens
ttaaatttgaat

SEQ ID NO: 6519119 - DNA, 20 bp, Homo sapiens
ttaaatttgatggttgaata

SEQ ID NO: 6519120 - DNA, 12 bp, Homo sapiens
ttaaatttgcca

SEQ ID NO: 6519121 - DNA, 21 bp, Homo sapiens
ttaaatttgggttgcaaagct

SEQ ID NO: 6519122 - DNA, 13 bp, Homo sapiens
ttaaatttgtaag

SEQ ID NO: 6519123 - DNA, 16 bp, Homo sapiens
ttaaattttaaggtag

SEQ ID NO: 6519124 - DNA, 20 bp, Homo sapiens
ttaaattttagtacattttc

SEQ ID NO: 6519125 - DNA, 12 bp, Homo sapiens
ttaaattttatt

SEQ ID NO: 6519126 - DNA, 20 bp, Homo sapiens
ttaaattttctccagtccct

SEQ ID NO: 6519127 - DNA, 15 bp, Homo sapiens
ttaaattttcttcag

SEQ ID NO: 6519128 - DNA, 16 bp, Homo sapiens
ttaaattttcttcagt

SEQ ID NO: 6519129 - DNA, 17 bp, Homo sapiens
ttaaattttcttcagtt

SEQ ID NO: 6519130 - DNA, 14 bp, Homo sapiens
ttaaattttgtaat

SEQ ID NO: 6519131 - DNA, 17 bp, Homo sapiens
ttaaatttttagccatt

SEQ ID NO: 6519132 - DNA, 16 bp, Homo sapiens
ttaaattttttgttga

SEQ ID NO: 6519133 - DNA, 17 bp, Homo sapiens
ttaaatttttttgtatg

SEQ ID NO: 6519134 - DNA, 20 bp, Homo sapiens
ttaaatttttttgtatgaaa

SEQ ID NO: 6519135 - DNA, 21 bp, Homo sapiens
ttaacaaaaaatgtaattaac

SEQ ID NO: 6519136 - DNA, 20 bp, Homo sapiens
ttaacaaaacaagaaagaaa

SEQ ID NO: 6519137 - DNA, 21 bp, Homo sapiens
ttaacaaaacaagaaagaaac

SEQ ID NO: 6519138 - DNA, 15 bp, Homo sapiens
ttaacaaaagatttg

SEQ ID NO: 6519139 - DNA, 15 bp, Homo sapiens
ttaacaaaagcaaga

SEQ ID NO: 6519140 - DNA, 18 bp, Homo sapiens
ttaacaaaatattctgta

SEQ ID NO: 6519141 - DNA, 13 bp, Homo sapiens
ttaacaaacagga

SEQ ID NO: 6519142 - DNA, 22 bp, Homo sapiens
ttaacaaacatcactctgctgc

SEQ ID NO: 6519143 - DNA, 23 bp, Homo sapiens
ttaacaaaccctcgtttctgatt

SEQ ID NO: 6519144 - DNA, 14 bp, Homo sapiens
ttaacaaactaaaa

SEQ ID NO: 6519145 - DNA, 18 bp, Homo sapiens
ttaacaaactaaaaatat

SEQ ID NO: 6519146 - DNA, 18 bp, Homo sapiens
ttaacaaactcttcagtt

SEQ ID NO: 6519147 - DNA, 17 bp, Homo sapiens
ttaacaaagcaaccttt

SEQ ID NO: 6519148 - DNA, 18 bp, Homo sapiens
ttaacaaagtaaaattaa

SEQ ID NO: 6519149 - DNA, 15 bp, Homo sapiens
ttaacaaagttactg

SEQ ID NO: 6519150 - DNA, 17 bp, Homo sapiens
ttaacaaataacaactt

SEQ ID NO: 6519151 - DNA, 18 bp, Homo sapiens
ttaacaaatgtatcacta

SEQ ID NO: 6519152 - DNA, 16 bp, Homo sapiens
ttaacaaatgttttca

SEQ ID NO: 6519153 - DNA, 17 bp, Homo sapiens
ttaacaaattgcatttg

SEQ ID NO: 6519154 - DNA, 21 bp, Homo sapiens
ttaacaacaataacactgtct

SEQ ID NO: 6519155 - DNA, 14 bp, Homo sapiens
ttaacaacagctgg

SEQ ID NO: 6519156 - DNA, 14 bp, Homo sapiens
ttaacaacatgttt

SEQ ID NO: 6519157 - DNA, 19 bp, Homo sapiens
ttaacaacatgtttccagc

SEQ ID NO: 6519158 - DNA, 18 bp, Homo sapiens
ttaacaactgctcttact

SEQ ID NO: 6519159 - DNA, 20 bp, Homo sapiens
ttaacaacttgaattacaac

SEQ ID NO: 6519160 - DNA, 20 bp, Homo sapiens
ttaacaagatgtttcatttt

SEQ ID NO: 6519161 - DNA, 17 bp, Homo sapiens
ttaacaagatttcagct

SEQ ID NO: 6519162 - DNA, 22 bp, Homo sapiens
ttaacaaggaatgcctgtgcca

SEQ ID NO: 6519163 - DNA, 19 bp, Homo sapiens
ttaacaataaagtgacaaa

SEQ ID NO: 6519164 - DNA, 18 bp, Homo sapiens
ttaacaataactactgtg

SEQ ID NO: 6519165 - DNA, 16 bp, Homo sapiens
ttaacaataataaaaa

SEQ ID NO: 6519166 - DNA, 15 bp, Homo sapiens
ttaacaatattttat

SEQ ID NO: 6519167 - DNA, 13 bp, Homo sapiens
ttaacaatgcaac

SEQ ID NO: 6519168 - DNA, 18 bp, Homo sapiens
ttaacaatgcaactttta

SEQ ID NO: 6519169 - DNA, 20 bp, Homo sapiens
ttaacaatgcctattgtaat

SEQ ID NO: 6519170 - DNA, 18 bp, Homo sapiens
ttaacaatgcgaatggta

SEQ ID NO: 6519171 - DNA, 15 bp, Homo sapiens
ttaacaattgtctta

SEQ ID NO: 6519172 - DNA, 23 bp, Homo sapiens
ttaacaatttctgtccttcagat

SEQ ID NO: 6519173 - DNA, 16 bp, Homo sapiens
ttaacacaagtcctgt

SEQ ID NO: 6519174 - DNA, 21 bp, Homo sapiens
ttaacacactggccattctta

SEQ ID NO: 6519175 - DNA, 16 bp, Homo sapiens
ttaacacagccttcct

SEQ ID NO: 6519176 - DNA, 21 bp, Homo sapiens
ttaacacagccttccttctgc

SEQ ID NO: 6519177 - DNA, 22 bp, Homo sapiens
ttaacacagtacctaagactaa

SEQ ID NO: 6519178 - DNA, 14 bp, Homo sapiens
ttaacacagtgtct

SEQ ID NO: 6519179 - DNA, 17 bp, Homo sapiens
ttaacacagtgtttcaa

SEQ ID NO: 6519180 - DNA, 20 bp, Homo sapiens
ttaacacagtgtttcaattc

SEQ ID NO: 6519181 - DNA, 22 bp, Homo sapiens
ttaacacatgaatttctgccat

SEQ ID NO: 6519182 - DNA, 11 bp, Homo sapiens
ttaacacattt

SEQ ID NO: 6519183 - DNA, 15 bp, Homo sapiens
ttaacacctgatgtg

SEQ ID NO: 6519184 - DNA, 15 bp, Homo sapiens
ttaacactatactct

SEQ ID NO: 6519185 - DNA, 19 bp, Homo sapiens
ttaacactgaaattgcctg

SEQ ID NO: 6519186 - DNA, 21 bp, Homo sapiens
ttaacactgaaattgcctgaa

SEQ ID NO: 6519187 - DNA, 12 bp, Homo sapiens
ttaacagaaatg

SEQ ID NO: 6519188 - DNA, 22 bp, Homo sapiens
tggacactttgaaatgtgtttc

SEQ ID NO: 6519189 - DNA, 14 bp, Homo sapiens
tggacacttttcac

SEQ ID NO: 6519190 - DNA, 23 bp, Homo sapiens
tggacacttttcacctccttcaa

SEQ ID NO: 6519191 - DNA, 15 bp, Homo sapiens
tggacagaaaatgca

SEQ ID NO: 6519192 - DNA, 15 bp, Homo sapiens
tggacagacacctcc

SEQ ID NO: 6519193 - DNA, 20 bp, Homo sapiens
tggacagacacctcccccta

SEQ ID NO: 6519194 - DNA, 13 bp, Homo sapiens
tggacagacactg

SEQ ID NO: 6519195 - DNA, 18 bp, Homo sapiens
tggacagacactgttgca

SEQ ID NO: 6519196 - DNA, 12 bp, Homo sapiens
tggacagacaga

SEQ ID NO: 6519197 - DNA, 23 bp, Homo sapiens
tggacagacagacaccacagcct

SEQ ID NO: 6519198 - DNA, 22 bp, Homo sapiens
tggacagacagaggatgagctc

SEQ ID NO: 6519199 - DNA, 12 bp, Homo sapiens
tggacagaccca

SEQ ID NO: 6519200 - DNA, 13 bp, Homo sapiens
tggacagacccag

SEQ ID NO: 6519201 - DNA, 16 bp, Homo sapiens
tggacagacccagggt

SEQ ID NO: 6519202 - DNA, 15 bp, Homo sapiens
tggacagacccaggt

SEQ ID NO: 6519203 - DNA, 18 bp, Homo sapiens
tggacagacccaggtctt

SEQ ID NO: 6519204 - DNA, 19 bp, Homo sapiens
tggacagacccaggtcttc

SEQ ID NO: 6519205 - DNA, 20 bp, Homo sapiens
tggacagacttcacagcgtc

SEQ ID NO: 6519206 - DNA, 20 bp, Homo sapiens
tggacagagactcagcgctc

SEQ ID NO: 6519207 - DNA, 16 bp, Homo sapiens
tggacagaggcggggc

SEQ ID NO: 6519208 - DNA, 18 bp, Homo sapiens
tggacagagggagaaggg

SEQ ID NO: 6519209 - DNA, 12 bp, Homo sapiens
tggacagagggg

SEQ ID NO: 6519210 - DNA, 20 bp, Homo sapiens
tggacagaggggactctggg

SEQ ID NO: 6519211 - DNA, 14 bp, Homo sapiens
tggacagaggggca

SEQ ID NO: 6519212 - DNA, 15 bp, Homo sapiens
tggacagatggacca

SEQ ID NO: 6519213 - DNA, 19 bp, Homo sapiens
tggacagatggaccaaaag

SEQ ID NO: 6519214 - DNA, 20 bp, Homo sapiens
tggacagatggaccaaaaga

SEQ ID NO: 6519215 - DNA, 20 bp, Homo sapiens
tggacagatggcccaaggga

SEQ ID NO: 6519216 - DNA, 16 bp, Homo sapiens
tggacagattaatatt

SEQ ID NO: 6519217 - DNA, 13 bp, Homo sapiens
tggacagatttaa

SEQ ID NO: 6519218 - DNA, 15 bp, Homo sapiens
tggacagatttcagt

SEQ ID NO: 6519219 - DNA, 17 bp, Homo sapiens
tggacagcaaaaccatt

SEQ ID NO: 6519220 - DNA, 12 bp, Homo sapiens
tggacagcagaa

SEQ ID NO: 6519221 - DNA, 15 bp, Homo sapiens
tggacagcagaagcc

SEQ ID NO: 6519222 - DNA, 19 bp, Homo sapiens
tggacagcagaagcctcca

SEQ ID NO: 6519223 - DNA, 19 bp, Homo sapiens
tggacagcagacaagaggg

SEQ ID NO: 6519224 - DNA, 15 bp, Homo sapiens
tggacagcagctgga

SEQ ID NO: 6519225 - DNA, 20 bp, Homo sapiens
tggacagcatcagaaatcct

SEQ ID NO: 6519226 - DNA, 18 bp, Homo sapiens
tggacagccaagggcaga

SEQ ID NO: 6519227 - DNA, 12 bp, Homo sapiens
tggacagcccgg

SEQ ID NO: 6519228 - DNA, 16 bp, Homo sapiens
tggacagccggagcag

SEQ ID NO: 6519229 - DNA, 17 bp, Homo sapiens
tggacagccggagcagt

SEQ ID NO: 6519230 - DNA, 13 bp, Homo sapiens
tggacagcctccg

SEQ ID NO: 6519231 - DNA, 19 bp, Homo sapiens
tggacagcggttgtaaata

SEQ ID NO: 6519232 - DNA, 18 bp, Homo sapiens
tggacagctgataaattt

SEQ ID NO: 6519233 - DNA, 20 bp, Homo sapiens
tggacagctgataaatttaa

SEQ ID NO: 6519234 - DNA, 14 bp, Homo sapiens
tggacagctgcttg

SEQ ID NO: 6519235 - DNA, 19 bp, Homo sapiens
tggacagctgtgcctcgct

SEQ ID NO: 6519236 - DNA, 11 bp, Homo sapiens
tggacagctta

SEQ ID NO: 6519237 - DNA, 17 bp, Homo sapiens
tggacagcttgacttgt

SEQ ID NO: 6519238 - DNA, 13 bp, Homo sapiens
tggacagcttgtg

SEQ ID NO: 6519239 - DNA, 21 bp, Homo sapiens
tggacagctttattttaaatg

SEQ ID NO: 6519240 - DNA, 22 bp, Homo sapiens
tggacagctttgctccgctccc

SEQ ID NO: 6519241 - DNA, 18 bp, Homo sapiens
tggacaggatgaggacag

SEQ ID NO: 6519242 - DNA, 20 bp, Homo sapiens
tggacaggatgaggacagag

SEQ ID NO: 6519243 - DNA, 18 bp, Homo sapiens
tggacaggatgtgtttgc

SEQ ID NO: 6519244 - DNA, 12 bp, Homo sapiens
tggacaggcatg

SEQ ID NO: 6519245 - DNA, 16 bp, Homo sapiens
tggacaggcatgttct

SEQ ID NO: 6519246 - DNA, 12 bp, Homo sapiens
tggacaggccca

SEQ ID NO: 6519247 - DNA, 15 bp, Homo sapiens
tggacaggcgggctc

SEQ ID NO: 6519248 - DNA, 21 bp, Homo sapiens
tggacaggcgggctcggaggc

SEQ ID NO: 6519249 - DNA, 21 bp, Homo sapiens
tggacaggcttcgtctcagaa

SEQ ID NO: 6519250 - DNA, 15 bp, Homo sapiens
tggacagggccaggg

SEQ ID NO: 6519251 - DNA, 17 bp, Homo sapiens
tggacagggccagggtt

SEQ ID NO: 6519252 - DNA, 19 bp, Homo sapiens
tggacaggggattggcgcc

SEQ ID NO: 6519253 - DNA, 21 bp, Homo sapiens
tggacaggggattggcgcccc

SEQ ID NO: 6519254 - DNA, 17 bp, Homo sapiens
tggacaggtctgggaga

SEQ ID NO: 6519255 - DNA, 20 bp, Homo sapiens
tggacaggtctgggagaggc

SEQ ID NO: 6519256 - DNA, 13 bp, Homo sapiens
tggacagtcactg

SEQ ID NO: 6519257 - DNA, 16 bp, Homo sapiens
tggacagtctccctga

SEQ ID NO: 6519258 - DNA, 15 bp, Homo sapiens
tggacagtctggcca

SEQ ID NO: 6519259 - DNA, 11 bp, Homo sapiens
tggacagtgag

SEQ ID NO: 6519260 - DNA, 21 bp, Homo sapiens
tggacagtgagagcagggctg

SEQ ID NO: 6519261 - DNA, 20 bp, Homo sapiens
tggacagtgctgttgaagat

SEQ ID NO: 6519262 - DNA, 21 bp, Homo sapiens
tggacagtgctgttgaagatt

SEQ ID NO: 6519263 - DNA, 19 bp, Homo sapiens
tggacagttcacaccctgc

SEQ ID NO: 6519264 - DNA, 23 bp, Homo sapiens
tggacagtttaccagttgccttt

SEQ ID NO: 6519265 - DNA, 23 bp, Homo sapiens
tggacagtttgtttcctgtctga

SEQ ID NO: 6519266 - DNA, 20 bp, Homo sapiens
tggacataactgacttagtt

SEQ ID NO: 6519267 - DNA, 19 bp, Homo sapiens
tggacatactgctggagtc

SEQ ID NO: 6519268 - DNA, 17 bp, Homo sapiens
tggacatatgtatactt

SEQ ID NO: 6519269 - DNA, 18 bp, Homo sapiens
tggacatcagtgtttgtt

SEQ ID NO: 6519270 - DNA, 20 bp, Homo sapiens
tggacatcctcctcccaccc

SEQ ID NO: 6519271 - DNA, 13 bp, Homo sapiens
tggacatgaagga

SEQ ID NO: 6519272 - DNA, 13 bp, Homo sapiens
tggacatgagagt

SEQ ID NO: 6519273 - DNA, 22 bp, Homo sapiens
tggacatgagagtagggccctg

SEQ ID NO: 6519274 - DNA, 19 bp, Homo sapiens
tggacatgagatggagagg

SEQ ID NO: 6519275 - DNA, 22 bp, Homo sapiens
tggacatgagatggagaggctg

SEQ ID NO: 6519276 - DNA, 17 bp, Homo sapiens
tggacatgagtttaaag

SEQ ID NO: 6519277 - DNA, 12 bp, Homo sapiens
tggacatgcacc

SEQ ID NO: 6519278 - DNA, 22 bp, Homo sapiens
tggacatgcataaaaattaaat

SEQ ID NO: 6519279 - DNA, 14 bp, Homo sapiens
tggacatgcctgtc

SEQ ID NO: 6519280 - DNA, 18 bp, Homo sapiens
tggacatgcctgtcctga

SEQ ID NO: 6519281 - DNA, 19 bp, Homo sapiens
tggacatgcctgtcctgaa

SEQ ID NO: 6519282 - DNA, 16 bp, Homo sapiens
tggacatggaaagaaa

SEQ ID NO: 6519283 - DNA, 17 bp, Homo sapiens
tggacatggcccctgtg

SEQ ID NO: 6519284 - DNA, 12 bp, Homo sapiens
tggacatggtca

SEQ ID NO: 6519285 - DNA, 16 bp, Homo sapiens
tggacatggtcacagt

SEQ ID NO: 6519286 - DNA, 16 bp, Homo sapiens
tggacatggtctcctc

SEQ ID NO: 6519287 - DNA, 13 bp, Homo sapiens
tggacatgtaaaa

SEQ ID NO: 6519288 - DNA, 19 bp, Homo sapiens
tggacatgtaaaaagacaa

SEQ ID NO: 6519289 - DNA, 23 bp, Homo sapiens
tggacatgtaaaaagacaaaaac

SEQ ID NO: 6519290 - DNA, 17 bp, Homo sapiens
tggacatgtgggtggag

SEQ ID NO: 6519291 - DNA, 21 bp, Homo sapiens
tggacatgtgggtggagaagg

SEQ ID NO: 6519292 - DNA, 17 bp, Homo sapiens
tggacattctctttgat

SEQ ID NO: 6519293 - DNA, 20 bp, Homo sapiens
tggacattctctttgataac

SEQ ID NO: 6519294 - DNA, 21 bp, Homo sapiens
tggacattctctttgataaca

SEQ ID NO: 6519295 - DNA, 22 bp, Homo sapiens
tggacattgttggcagcataaa

SEQ ID NO: 6519296 - DNA, 18 bp, Homo sapiens
tggacatttaacttttct

SEQ ID NO: 6519297 - DNA, 14 bp, Homo sapiens
tggacatttacctt

SEQ ID NO: 6519298 - DNA, 17 bp, Homo sapiens
tggacatttatgtacaa

SEQ ID NO: 6519299 - DNA, 18 bp, Homo sapiens
tggacatttatgtacaaa

SEQ ID NO: 6519300 - DNA, 19 bp, Homo sapiens
tggacatttatgtacaaaa

SEQ ID NO: 6519301 - DNA, 22 bp, Homo sapiens
tggacatttcatataaatggaa

SEQ ID NO: 6519302 - DNA, 18 bp, Homo sapiens
tggacatttgccttgctg

SEQ ID NO: 6519303 - DNA, 11 bp, Homo sapiens
tggacatttta

SEQ ID NO: 6519304 - DNA, 16 bp, Homo sapiens
tggacattttatgtct

SEQ ID NO: 6519305 - DNA, 22 bp, Homo sapiens
tggaccaaacccttagcagccc

SEQ ID NO: 6519306 - DNA, 23 bp, Homo sapiens
tggaccaaacccttagcagccca

SEQ ID NO: 6519307 - DNA, 14 bp, Homo sapiens
tggaccaaagctga

SEQ ID NO: 6519308 - DNA, 11 bp, Homo sapiens
tggaccaaatg

SEQ ID NO: 6519309 - DNA, 16 bp, Homo sapiens
tggaccaacctgctct

SEQ ID NO: 6519310 - DNA, 18 bp, Homo sapiens
tggaccaacctgctctgt

SEQ ID NO: 6519311 - DNA, 19 bp, Homo sapiens
tggaccaattattgatata

SEQ ID NO: 6519312 - DNA, 20 bp, Homo sapiens
tggaccaattattgatatat

SEQ ID NO: 6519313 - DNA, 15 bp, Homo sapiens
tggaccaccagcccc

SEQ ID NO: 6519314 - DNA, 16 bp, Homo sapiens
tggaccaccagcccca

SEQ ID NO: 6519315 - DNA, 21 bp, Homo sapiens
tggaccaccgttcagtcattt

SEQ ID NO: 6519316 - DNA, 20 bp, Homo sapiens
tggaccacgccgccctccat

SEQ ID NO: 6519317 - DNA, 16 bp, Homo sapiens
tggaccactcctgtcc

SEQ ID NO: 6519318 - DNA, 19 bp, Homo sapiens
tggaccactcctgtccctg

SEQ ID NO: 6519319 - DNA, 12 bp, Homo sapiens
tggaccactgca

SEQ ID NO: 6519320 - DNA, 20 bp, Homo sapiens
tggaccactgcatgagcttt

SEQ ID NO: 6519321 - DNA, 19 bp, Homo sapiens
tggaccactgggcaatgat

SEQ ID NO: 6519322 - DNA, 23 bp, Homo sapiens
tggaccactgtttcttgcttgta

SEQ ID NO: 6519323 - DNA, 16 bp, Homo sapiens
tggaccacttggaaat

SEQ ID NO: 6519324 - DNA, 14 bp, Homo sapiens
tggaccagaggaag

SEQ ID NO: 6519325 - DNA, 19 bp, Homo sapiens
tggaccagaggaagcccct

SEQ ID NO: 6519326 - DNA, 14 bp, Homo sapiens
tggaccagatgctg

SEQ ID NO: 6519327 - DNA, 12 bp, Homo sapiens
tggaccagcctc

SEQ ID NO: 6519328 - DNA, 15 bp, Homo sapiens
tggaccagcctcctg

SEQ ID NO: 6519329 - DNA, 16 bp, Homo sapiens
tggaccagcctctcca

SEQ ID NO: 6519330 - DNA, 13 bp, Homo sapiens
tggaccaggacag

SEQ ID NO: 6519331 - DNA, 14 bp, Homo sapiens
tggaccaggacagg

SEQ ID NO: 6519332 - DNA, 13 bp, Homo sapiens
tggaccaggcctg

SEQ ID NO: 6519333 - DNA, 14 bp, Homo sapiens
tggaccaggcctgg

SEQ ID NO: 6519334 - DNA, 15 bp, Homo sapiens
tggaccaggcctgga

SEQ ID NO: 6519335 - DNA, 21 bp, Homo sapiens
tggaccaggcctggagggcac

SEQ ID NO: 6519336 - DNA, 19 bp, Homo sapiens
tggaccaggtcctgctccg

SEQ ID NO: 6519337 - DNA, 17 bp, Homo sapiens
tggaccagtagacaact

SEQ ID NO: 6519338 - DNA, 15 bp, Homo sapiens
tggaccagtggctgg

SEQ ID NO: 6519339 - DNA, 18 bp, Homo sapiens
tggaccagtggctggtct

SEQ ID NO: 6519340 - DNA, 17 bp, Homo sapiens
tggaccagtggtgcctt

SEQ ID NO: 6519341 - DNA, 17 bp, Homo sapiens
tggaccagtttgcagag

SEQ ID NO: 6519342 - DNA, 18 bp, Homo sapiens
tggaccagtttgcagagt

SEQ ID NO: 6519343 - DNA, 22 bp, Homo sapiens
tggaccatcaagggtcatggca

SEQ ID NO: 6519344 - DNA, 23 bp, Homo sapiens
tggaccatgccagattctgcctc

SEQ ID NO: 6519345 - DNA, 20 bp, Homo sapiens
tggaccatggagtggcagcc

SEQ ID NO: 6519346 - DNA, 16 bp, Homo sapiens
tggacccagggaacag

SEQ ID NO: 6519347 - DNA, 14 bp, Homo sapiens
tggacccagggcct

SEQ ID NO: 6519348 - DNA, 18 bp, Homo sapiens
tggacccagggcctgact

SEQ ID NO: 6519349 - DNA, 19 bp, Homo sapiens
tggacccagggcctgactt

SEQ ID NO: 6519350 - DNA, 16 bp, Homo sapiens
tggacccatttgccag

SEQ ID NO: 6519351 - DNA, 14 bp, Homo sapiens
tggaccccagcctc

SEQ ID NO: 6519352 - DNA, 15 bp, Homo sapiens
tggaccccagcctca

SEQ ID NO: 6519353 - DNA, 14 bp, Homo sapiens
tggaccccagcctt

SEQ ID NO: 6519354 - DNA, 17 bp, Homo sapiens
tggaccccagccttggt

SEQ ID NO: 6519355 - DNA, 13 bp, Homo sapiens
tggaccccagctg

SEQ ID NO: 6519356 - DNA, 14 bp, Homo sapiens
tggaccccagctgg

SEQ ID NO: 6519357 - DNA, 20 bp, Homo sapiens
tggaccccagctgggaggca

SEQ ID NO: 6519358 - DNA, 23 bp, Homo sapiens
tggaccccagctgggaggcaaga

SEQ ID NO: 6519359 - DNA, 21 bp, Homo sapiens
tggaccccatctgtgaataag

SEQ ID NO: 6519360 - DNA, 17 bp, Homo sapiens
tggacccccctttcaca

SEQ ID NO: 6519361 - DNA, 15 bp, Homo sapiens
tggacccctcccttg

SEQ ID NO: 6519362 - DNA, 18 bp, Homo sapiens
tggacccctcccttgctc

SEQ ID NO: 6519363 - DNA, 19 bp, Homo sapiens
tggacccctgaattcaatg

SEQ ID NO: 6519364 - DNA, 15 bp, Homo sapiens
tggacccctggaccg

SEQ ID NO: 6519365 - DNA, 16 bp, Homo sapiens
tggacccctggggtgg

SEQ ID NO: 6519366 - DNA, 21 bp, Homo sapiens
tggacccctggggtggccagg

SEQ ID NO: 6519367 - DNA, 13 bp, Homo sapiens
ttaacagaaatgt

SEQ ID NO: 6519368 - DNA, 14 bp, Homo sapiens
ttaacagaaatgta

SEQ ID NO: 6519369 - DNA, 13 bp, Homo sapiens
ttaacagaaattg

SEQ ID NO: 6519370 - DNA, 15 bp, Homo sapiens
ttaacagaaattgta

SEQ ID NO: 6519371 - DNA, 14 bp, Homo sapiens
ttaacagagtctga

SEQ ID NO: 6519372 - DNA, 23 bp, Homo sapiens
ttaacagagttttctgttgcatt

SEQ ID NO: 6519373 - DNA, 20 bp, Homo sapiens
ttaacagatatttaaattta

SEQ ID NO: 6519374 - DNA, 22 bp, Homo sapiens
ttaacagatgatccatttgaac

SEQ ID NO: 6519375 - DNA, 13 bp, Homo sapiens
ttaacagatttat

SEQ ID NO: 6519376 - DNA, 18 bp, Homo sapiens
ttaacagcagtcctttgt

SEQ ID NO: 6519377 - DNA, 23 bp, Homo sapiens
ttaacagcatgacaaaaattatt

SEQ ID NO: 6519378 - DNA, 13 bp, Homo sapiens
ttaacaggacagt

SEQ ID NO: 6519379 - DNA, 13 bp, Homo sapiens
ttaacagggaggg

SEQ ID NO: 6519380 - DNA, 17 bp, Homo sapiens
ttaacaggtattttcac

SEQ ID NO: 6519381 - DNA, 17 bp, Homo sapiens
ttaacagtaaaaatttc

SEQ ID NO: 6519382 - DNA, 22 bp, Homo sapiens
ttaacagtaaaaatttcttcca

SEQ ID NO: 6519383 - DNA, 14 bp, Homo sapiens
ttaacagtaaatat

SEQ ID NO: 6519384 - DNA, 14 bp, Homo sapiens
ttaacagtatttct

SEQ ID NO: 6519385 - DNA, 21 bp, Homo sapiens
ttaacagtcaccactgtgctc

SEQ ID NO: 6519386 - DNA, 17 bp, Homo sapiens
ttaacagtcatttaaaa

SEQ ID NO: 6519387 - DNA, 20 bp, Homo sapiens
ttaacagtgcccttttcatc

SEQ ID NO: 6519388 - DNA, 20 bp, Homo sapiens
ttaacagttttccatgaaaa

SEQ ID NO: 6519389 - DNA, 19 bp, Homo sapiens
ttaacataaacttgtactt

SEQ ID NO: 6519390 - DNA, 13 bp, Homo sapiens
ttaacataagcta

SEQ ID NO: 6519391 - DNA, 15 bp, Homo sapiens
ttaacataagctatt

SEQ ID NO: 6519392 - DNA, 18 bp, Homo sapiens
ttaacataagctattttt

SEQ ID NO: 6519393 - DNA, 21 bp, Homo sapiens
ttaacataagctatttttcta

SEQ ID NO: 6519394 - DNA, 16 bp, Homo sapiens
ttaacatacaagaaaa

SEQ ID NO: 6519395 - DNA, 20 bp, Homo sapiens
ttaacatacaagaaaatgta

SEQ ID NO: 6519396 - DNA, 17 bp, Homo sapiens
ttaacatacctaagaag

SEQ ID NO: 6519397 - DNA, 20 bp, Homo sapiens
ttaacatagtaagttcagca

SEQ ID NO: 6519398 - DNA, 19 bp, Homo sapiens
ttaacatatattgttattt

SEQ ID NO: 6519399 - DNA, 21 bp, Homo sapiens
ttaacatattatttcattggt

SEQ ID NO: 6519400 - DNA, 15 bp, Homo sapiens
ttaacatcaaagact

SEQ ID NO: 6519401 - DNA, 23 bp, Homo sapiens
ttaacatcaaagactccgagaag

SEQ ID NO: 6519402 - DNA, 14 bp, Homo sapiens
ttaacatcaagcca

SEQ ID NO: 6519403 - DNA, 21 bp, Homo sapiens
ttaacatcactacaaaaagaa

SEQ ID NO: 6519404 - DNA, 23 bp, Homo sapiens
ttaacatcactacaaaaagaaga

SEQ ID NO: 6519405 - DNA, 14 bp, Homo sapiens
ttaacatccctcct

SEQ ID NO: 6519406 - DNA, 22 bp, Homo sapiens
ttaacatctagcctaaagtata

SEQ ID NO: 6519407 - DNA, 24 bp, Homo sapiens
ttaacatctgcagtgttctgtgaa

SEQ ID NO: 6519408 - DNA, 18 bp, Homo sapiens
ttaacatctttgttttta

SEQ ID NO: 6519409 - DNA, 19 bp, Homo sapiens
ttaacatctttgtttttaa

SEQ ID NO: 6519410 - DNA, 17 bp, Homo sapiens
ttaacatgatgtactaa

SEQ ID NO: 6519411 - DNA, 15 bp, Homo sapiens
ttaacatgatttcaa

SEQ ID NO: 6519412 - DNA, 14 bp, Homo sapiens
ttaacatgctgtgt

SEQ ID NO: 6519413 - DNA, 20 bp, Homo sapiens
ttaacatggaagatattcct

SEQ ID NO: 6519414 - DNA, 18 bp, Homo sapiens
ttaacatggaatttaatt

SEQ ID NO: 6519415 - DNA, 23 bp, Homo sapiens
ttaacatggaatttaatttatgt

SEQ ID NO: 6519416 - DNA, 19 bp, Homo sapiens
ttaacatgggctcttcact

SEQ ID NO: 6519417 - DNA, 11 bp, Homo sapiens
ttaacatgtga

SEQ ID NO: 6519418 - DNA, 15 bp, Homo sapiens
ttaacatgtgttaaa

SEQ ID NO: 6519419 - DNA, 23 bp, Homo sapiens
ttaacattaaagcaatctgttga

SEQ ID NO: 6519420 - DNA, 17 bp, Homo sapiens
ttaacattaacatctat

SEQ ID NO: 6519421 - DNA, 15 bp, Homo sapiens
ttaacattcacagcc

SEQ ID NO: 6519422 - DNA, 16 bp, Homo sapiens
ttaacattcacagccc

SEQ ID NO: 6519423 - DNA, 19 bp, Homo sapiens
ttaacattcacagcccaga

SEQ ID NO: 6519424 - DNA, 22 bp, Homo sapiens
ttaacattcctaaaatgcttca

SEQ ID NO: 6519425 - DNA, 13 bp, Homo sapiens
ttaacattctcaa

SEQ ID NO: 6519426 - DNA, 14 bp, Homo sapiens
ttaacattctgtaa

SEQ ID NO: 6519427 - DNA, 18 bp, Homo sapiens
ttaacattcttttgttta

SEQ ID NO: 6519428 - DNA, 19 bp, Homo sapiens
ttaacatttatctaaaaga

SEQ ID NO: 6519429 - DNA, 17 bp, Homo sapiens
ttaacatttcattgtac

SEQ ID NO: 6519430 - DNA, 18 bp, Homo sapiens
ttaacatttcattgtaca

SEQ ID NO: 6519431 - DNA, 19 bp, Homo sapiens
ttaacatttcattgtacaa

SEQ ID NO: 6519432 - DNA, 12 bp, Homo sapiens
ttaacatttctc

SEQ ID NO: 6519433 - DNA, 19 bp, Homo sapiens
ttaacatttgatgtctaga

SEQ ID NO: 6519434 - DNA, 22 bp, Homo sapiens
ttaacattttacagtaaatgtt

SEQ ID NO: 6519435 - DNA, 12 bp, Homo sapiens
ttaacattttcc

SEQ ID NO: 6519436 - DNA, 14 bp, Homo sapiens
ttaacattttgttc

SEQ ID NO: 6519437 - DNA, 17 bp, Homo sapiens
ttaacattttgtttcca

SEQ ID NO: 6519438 - DNA, 18 bp, Homo sapiens
ttaacattttgtttccaa

SEQ ID NO: 6519439 - DNA, 21 bp, Homo sapiens
ttaaccaaacaattatttaaa

SEQ ID NO: 6519440 - DNA, 15 bp, Homo sapiens
ttaaccaaagaaagt

SEQ ID NO: 6519441 - DNA, 13 bp, Homo sapiens
ttaaccaaaggtg

SEQ ID NO: 6519442 - DNA, 14 bp, Homo sapiens
ttaaccaaaggtga

SEQ ID NO: 6519443 - DNA, 19 bp, Homo sapiens
ttaaccaatcgcaaagcaa

SEQ ID NO: 6519444 - DNA, 14 bp, Homo sapiens
ttaaccacattaat

SEQ ID NO: 6519445 - DNA, 13 bp, Homo sapiens
ttaaccagaataa

SEQ ID NO: 6519446 - DNA, 19 bp, Homo sapiens
ttaaccagatggttgtgta

SEQ ID NO: 6519447 - DNA, 17 bp, Homo sapiens
ttaaccagcacatttct

SEQ ID NO: 6519448 - DNA, 17 bp, Homo sapiens
ttaaccagtacttctaa

SEQ ID NO: 6519449 - DNA, 16 bp, Homo sapiens
ttaaccagtctgaagt

SEQ ID NO: 6519450 - DNA, 18 bp, Homo sapiens
ttaaccagttatttttat

SEQ ID NO: 6519451 - DNA, 16 bp, Homo sapiens
ttaaccatccttaaat

SEQ ID NO: 6519452 - DNA, 19 bp, Homo sapiens
ttaaccattgtcttgttct

SEQ ID NO: 6519453 - DNA, 14 bp, Homo sapiens
ttaaccatttaagt

SEQ ID NO: 6519454 - DNA, 19 bp, Homo sapiens
ttaaccatttaataaagaa

SEQ ID NO: 6519455 - DNA, 18 bp, Homo sapiens
ttaacccaaggagcacag

SEQ ID NO: 6519456 - DNA, 16 bp, Homo sapiens
ttaacccacctctcct

SEQ ID NO: 6519457 - DNA, 22 bp, Homo sapiens
ttaacccagtgttcagcataga

SEQ ID NO: 6519458 - DNA, 17 bp, Homo sapiens
ttaaccccatgtcctca

SEQ ID NO: 6519459 - DNA, 19 bp, Homo sapiens
ttaaccccgtcaacaaatc

SEQ ID NO: 6519460 - DNA, 14 bp, Homo sapiens
ttaacccctccact

SEQ ID NO: 6519461 - DNA, 21 bp, Homo sapiens
ttaaccctagaaggtggggac

SEQ ID NO: 6519462 - DNA, 16 bp, Homo sapiens
ttaaccctcactggga

SEQ ID NO: 6519463 - DNA, 17 bp, Homo sapiens
ttaaccctctcttccct

SEQ ID NO: 6519464 - DNA, 21 bp, Homo sapiens
ttaacccttcatcttcctgtg

SEQ ID NO: 6519465 - DNA, 20 bp, Homo sapiens
ttaaccgatgctttaccaaa

SEQ ID NO: 6519466 - DNA, 21 bp, Homo sapiens
ttaaccggtaagagtttcagt

SEQ ID NO: 6519467 - DNA, 15 bp, Homo sapiens
ttaaccgtttttcaa

SEQ ID NO: 6519468 - DNA, 18 bp, Homo sapiens
ttaaccgtttttcaagaa

SEQ ID NO: 6519469 - DNA, 20 bp, Homo sapiens
ttaacctactaatagtttgt

SEQ ID NO: 6519470 - DNA, 16 bp, Homo sapiens
ttaacctagatgttta

SEQ ID NO: 6519471 - DNA, 15 bp, Homo sapiens
ttaacctcagaaaat

SEQ ID NO: 6519472 - DNA, 17 bp, Homo sapiens
ttaacctcccctctccc

SEQ ID NO: 6519473 - DNA, 15 bp, Homo sapiens
ttaacctctgcacta

SEQ ID NO: 6519474 - DNA, 21 bp, Homo sapiens
ttaacctctttttaaggacac

SEQ ID NO: 6519475 - DNA, 18 bp, Homo sapiens
ttaacctgaattattcca

SEQ ID NO: 6519476 - DNA, 14 bp, Homo sapiens
ttaacctgcataaa

SEQ ID NO: 6519477 - DNA, 19 bp, Homo sapiens
ttaacctgggaccaacctg

SEQ ID NO: 6519478 - DNA, 17 bp, Homo sapiens
ttaacctgttatttcta

SEQ ID NO: 6519479 - DNA, 15 bp, Homo sapiens
ttaaccttaaaatta

SEQ ID NO: 6519480 - DNA, 23 bp, Homo sapiens
ttaaccttaaaattaagatttcc

SEQ ID NO: 6519481 - DNA, 19 bp, Homo sapiens
ttaaccttaaatacactga

SEQ ID NO: 6519482 - DNA, 21 bp, Homo sapiens
ttaaccttagagcttggacag

SEQ ID NO: 6519483 - DNA, 23 bp, Homo sapiens
ttaaccttccaagactgaagact

SEQ ID NO: 6519484 - DNA, 11 bp, Homo sapiens
ttaaccttgaa

SEQ ID NO: 6519485 - DNA, 15 bp, Homo sapiens
ttaaccttgtataaa

SEQ ID NO: 6519486 - DNA, 17 bp, Homo sapiens
ttaacctttccgctgtc

SEQ ID NO: 6519487 - DNA, 14 bp, Homo sapiens
ttaacctttgctat

SEQ ID NO: 6519488 - DNA, 15 bp, Homo sapiens
ttaaccttttcaaat

SEQ ID NO: 6519489 - DNA, 19 bp, Homo sapiens
ttaaccttttcaaattaat

SEQ ID NO: 6519490 - DNA, 14 bp, Homo sapiens
ttaacctttttgta

SEQ ID NO: 6519491 - DNA, 14 bp, Homo sapiens
ttaacgaggaagac

SEQ ID NO: 6519492 - DNA, 13 bp, Homo sapiens
ttaacgctgccta

SEQ ID NO: 6519493 - DNA, 19 bp, Homo sapiens
ttaacggctccaggatttt

SEQ ID NO: 6519494 - DNA, 17 bp, Homo sapiens
ttaacgggcatgtatta

SEQ ID NO: 6519495 - DNA, 13 bp, Homo sapiens
ttaacggtgctaa

SEQ ID NO: 6519496 - DNA, 17 bp, Homo sapiens
ttaacgtatgtatttca

SEQ ID NO: 6519497 - DNA, 19 bp, Homo sapiens
ttaacgtggcttgtagaat

SEQ ID NO: 6519498 - DNA, 15 bp, Homo sapiens
ttaacgttttcttaa

SEQ ID NO: 6519499 - DNA, 16 bp, Homo sapiens
ttaactaaagaagagg

SEQ ID NO: 6519500 - DNA, 17 bp, Homo sapiens
ttaactaaataaacaga

SEQ ID NO: 6519501 - DNA, 14 bp, Homo sapiens
ttaactaatgtaaa

SEQ ID NO: 6519502 - DNA, 15 bp, Homo sapiens
ttaactaatgtaaat

SEQ ID NO: 6519503 - DNA, 13 bp, Homo sapiens
ttaactaatttaa

SEQ ID NO: 6519504 - DNA, 19 bp, Homo sapiens
ttaactactatattgattg

SEQ ID NO: 6519505 - DNA, 19 bp, Homo sapiens
ttaactacttatctctaaa

SEQ ID NO: 6519506 - DNA, 12 bp, Homo sapiens
ttaactagaatt

SEQ ID NO: 6519507 - DNA, 17 bp, Homo sapiens
ttaactagacacagata

SEQ ID NO: 6519508 - DNA, 20 bp, Homo sapiens
ttaactagtgtttctgcaga

SEQ ID NO: 6519509 - DNA, 19 bp, Homo sapiens
ttaactataaggtgcctca

SEQ ID NO: 6519510 - DNA, 20 bp, Homo sapiens
ttaactatcttctttggact

SEQ ID NO: 6519511 - DNA, 23 bp, Homo sapiens
ttaactatgtaataatgtacaga

SEQ ID NO: 6519512 - DNA, 18 bp, Homo sapiens
ttaactatgtacaatatt

SEQ ID NO: 6519513 - DNA, 19 bp, Homo sapiens
ttaactatgtgatgttaac

SEQ ID NO: 6519514 - DNA, 13 bp, Homo sapiens
ttaactattatta

SEQ ID NO: 6519515 - DNA, 14 bp, Homo sapiens
ttaactattgcatt

SEQ ID NO: 6519516 - DNA, 18 bp, Homo sapiens
ttaactatttttttcaaa

SEQ ID NO: 6519517 - DNA, 18 bp, Homo sapiens
ttaactcaccagatttac

SEQ ID NO: 6519518 - DNA, 14 bp, Homo sapiens
ttaactcagatcac

SEQ ID NO: 6519519 - DNA, 15 bp, Homo sapiens
ttaactcagatcact

SEQ ID NO: 6519520 - DNA, 22 bp, Homo sapiens
ttaactcagatcactactgcag

SEQ ID NO: 6519521 - DNA, 22 bp, Homo sapiens
ttaactcaggactccagcccat

SEQ ID NO: 6519522 - DNA, 12 bp, Homo sapiens
ttaactcagtct

SEQ ID NO: 6519523 - DNA, 17 bp, Homo sapiens
ttaactcattagactgg

SEQ ID NO: 6519524 - DNA, 15 bp, Homo sapiens
ttaactccactgctt

SEQ ID NO: 6519525 - DNA, 20 bp, Homo sapiens
ttaactccactgcttaccta

SEQ ID NO: 6519526 - DNA, 22 bp, Homo sapiens
ttaactcccattaccatgtaat

SEQ ID NO: 6519527 - DNA, 22 bp, Homo sapiens
ttaactccccctcattcacaaa

SEQ ID NO: 6519528 - DNA, 22 bp, Homo sapiens
ttaactccctagttacccaccc

SEQ ID NO: 6519529 - DNA, 15 bp, Homo sapiens
ttaactccctccacc

SEQ ID NO: 6519530 - DNA, 18 bp, Homo sapiens
ttaactccctccaccagc

SEQ ID NO: 6519531 - DNA, 22 bp, Homo sapiens
ttaactccctccaccagcctgc

SEQ ID NO: 6519532 - DNA, 17 bp, Homo sapiens
ttaactccctttttaca

SEQ ID NO: 6519533 - DNA, 21 bp, Homo sapiens
ttaactccctttttacacttt

SEQ ID NO: 6519534 - DNA, 22 bp, Homo sapiens
ttaactccctttttacacttta

SEQ ID NO: 6519535 - DNA, 16 bp, Homo sapiens
ttaactccgtttccaa

SEQ ID NO: 6519536 - DNA, 16 bp, Homo sapiens
ttaactctaaccctgt

SEQ ID NO: 6519537 - DNA, 19 bp, Homo sapiens
ttaactctaaccctgtgga

SEQ ID NO: 6519538 - DNA, 20 bp, Homo sapiens
ttaactctaaccctgtggaa

SEQ ID NO: 6519539 - DNA, 17 bp, Homo sapiens
ttaactctactgtgtaa

SEQ ID NO: 6519540 - DNA, 14 bp, Homo sapiens
ttaactctgcagga

SEQ ID NO: 6519541 - DNA, 16 bp, Homo sapiens
ttaactctgcaggaaa

SEQ ID NO: 6519542 - DNA, 23 bp, Homo sapiens
ttaactctgtaaaagtgtctgta

SEQ ID NO: 6519543 - DNA, 12 bp, Homo sapiens
ttaactctgtct

SEQ ID NO: 6519544 - DNA, 13 bp, Homo sapiens
ttaactctgtctt

SEQ ID NO: 6519545 - DNA, 21 bp, Homo sapiens
ttaactcttagaagtgttgta

SEQ ID NO: 6519546 - DNA, 15 bp, Homo sapiens
tggacccgctctgga

SEQ ID NO: 6519547 - DNA, 19 bp, Homo sapiens
tggacccgctctggaccaa

SEQ ID NO: 6519548 - DNA, 16 bp, Homo sapiens
tggaccctccacttca

SEQ ID NO: 6519549 - DNA, 16 bp, Homo sapiens
tggaccctcgcagcag

SEQ ID NO: 6519550 - DNA, 14 bp, Homo sapiens
tggaccctgaaatg

SEQ ID NO: 6519551 - DNA, 19 bp, Homo sapiens
tggaccctgaccagctccc

SEQ ID NO: 6519552 - DNA, 14 bp, Homo sapiens
tggaccctgaggcc

SEQ ID NO: 6519553 - DNA, 16 bp, Homo sapiens
tggaccctgaggccca

SEQ ID NO: 6519554 - DNA, 13 bp, Homo sapiens
tggaccctggcct

SEQ ID NO: 6519555 - DNA, 23 bp, Homo sapiens
tggaccctgtggatgataaaaca

SEQ ID NO: 6519556 - DNA, 15 bp, Homo sapiens
tggaccctgttgcta

SEQ ID NO: 6519557 - DNA, 12 bp, Homo sapiens
tggacccttctg

SEQ ID NO: 6519558 - DNA, 20 bp, Homo sapiens
tggacccttggcctccattt

SEQ ID NO: 6519559 - DNA, 19 bp, Homo sapiens
tggaccgcttcccagaggc

SEQ ID NO: 6519560 - DNA, 18 bp, Homo sapiens
tggaccggagagtggggg

SEQ ID NO: 6519561 - DNA, 20 bp, Homo sapiens
tggaccggccgcagccccca

SEQ ID NO: 6519562 - DNA, 21 bp, Homo sapiens
tggaccggccgcagcccccac

SEQ ID NO: 6519563 - DNA, 14 bp, Homo sapiens
tggaccgggtgggc

SEQ ID NO: 6519564 - DNA, 17 bp, Homo sapiens
tggaccgggtgggcctg

SEQ ID NO: 6519565 - DNA, 18 bp, Homo sapiens
tggaccgtcccctgccca

SEQ ID NO: 6519566 - DNA, 17 bp, Homo sapiens
tggaccgtggacaggcc

SEQ ID NO: 6519567 - DNA, 14 bp, Homo sapiens
tggaccgtttccaa

SEQ ID NO: 6519568 - DNA, 15 bp, Homo sapiens
tggacctaacattcg

SEQ ID NO: 6519569 - DNA, 17 bp, Homo sapiens
tggacctaacattcgat

SEQ ID NO: 6519570 - DNA, 22 bp, Homo sapiens
tggacctaatccaagcatccct

SEQ ID NO: 6519571 - DNA, 21 bp, Homo sapiens
tggacctatgcagggaggcca

SEQ ID NO: 6519572 - DNA, 15 bp, Homo sapiens
tggacctcaccaagc

SEQ ID NO: 6519573 - DNA, 12 bp, Homo sapiens
tggacctcagca

SEQ ID NO: 6519574 - DNA, 15 bp, Homo sapiens
tggacctcaggaggg

SEQ ID NO: 6519575 - DNA, 18 bp, Homo sapiens
tggacctcaggagggcag

SEQ ID NO: 6519576 - DNA, 18 bp, Homo sapiens
tggacctccaggggctcc

SEQ ID NO: 6519577 - DNA, 19 bp, Homo sapiens
tggacctccaggggctcct

SEQ ID NO: 6519578 - DNA, 21 bp, Homo sapiens
tggacctccaggggctcctgg

SEQ ID NO: 6519579 - DNA, 22 bp, Homo sapiens
tggacctccaggggctcctggg

SEQ ID NO: 6519580 - DNA, 17 bp, Homo sapiens
tggacctccatccctgc

SEQ ID NO: 6519581 - DNA, 18 bp, Homo sapiens
tggacctccatccctgct

SEQ ID NO: 6519582 - DNA, 22 bp, Homo sapiens
tggacctcgtcccatcttcact

SEQ ID NO: 6519583 - DNA, 16 bp, Homo sapiens
tggacctctcagcaga

SEQ ID NO: 6519584 - DNA, 15 bp, Homo sapiens
tggacctctcttgtg

SEQ ID NO: 6519585 - DNA, 16 bp, Homo sapiens
tggacctctgacagca

SEQ ID NO: 6519586 - DNA, 19 bp, Homo sapiens
tggacctctgacagcagca

SEQ ID NO: 6519587 - DNA, 13 bp, Homo sapiens
tggacctgcccac

SEQ ID NO: 6519588 - DNA, 22 bp, Homo sapiens
tggacctgccccggacctacct

SEQ ID NO: 6519589 - DNA, 16 bp, Homo sapiens
tggacctgcctcctgc

SEQ ID NO: 6519590 - DNA, 20 bp, Homo sapiens
tggacctgctgacatagtgg

SEQ ID NO: 6519591 - DNA, 16 bp, Homo sapiens
tggacctggcagtggt

SEQ ID NO: 6519592 - DNA, 20 bp, Homo sapiens
tggacctggcggcaggaagc

SEQ ID NO: 6519593 - DNA, 18 bp, Homo sapiens
tggacctggtgcccctgc

SEQ ID NO: 6519594 - DNA, 13 bp, Homo sapiens
tggacctgtgctg

SEQ ID NO: 6519595 - DNA, 23 bp, Homo sapiens
tggacctgtgtatggtgacctct

SEQ ID NO: 6519596 - DNA, 22 bp, Homo sapiens
tggaccttacgatcaggcacag

SEQ ID NO: 6519597 - DNA, 15 bp, Homo sapiens
tggaccttaggcctt

SEQ ID NO: 6519598 - DNA, 17 bp, Homo sapiens
tggaccttaggccttcc

SEQ ID NO: 6519599 - DNA, 12 bp, Homo sapiens
tggaccttcctg

SEQ ID NO: 6519600 - DNA, 13 bp, Homo sapiens
tggaccttcctgc

SEQ ID NO: 6519601 - DNA, 20 bp, Homo sapiens
tggaccttgaactgggtact

SEQ ID NO: 6519602 - DNA, 21 bp, Homo sapiens
tggaccttttaaagtgtttca

SEQ ID NO: 6519603 - DNA, 21 bp, Homo sapiens
tggaccttttcccttgctgta

SEQ ID NO: 6519604 - DNA, 14 bp, Homo sapiens
tggacgaatatgaa

SEQ ID NO: 6519605 - DNA, 17 bp, Homo sapiens
tggacgaatatgaatgt

SEQ ID NO: 6519606 - DNA, 15 bp, Homo sapiens
tggacgacctccagc

SEQ ID NO: 6519607 - DNA, 21 bp, Homo sapiens
tggacgacctccagctctcag

SEQ ID NO: 6519608 - DNA, 18 bp, Homo sapiens
tggacgagaaaacaataa

SEQ ID NO: 6519609 - DNA, 19 bp, Homo sapiens
tggacgagtgagctaccag

SEQ ID NO: 6519610 - DNA, 21 bp, Homo sapiens
tggacgagtgagctaccagga

SEQ ID NO: 6519611 - DNA, 15 bp, Homo sapiens
tggacgcacacagct

SEQ ID NO: 6519612 - DNA, 20 bp, Homo sapiens
tggacgcaggccctgtccag

SEQ ID NO: 6519613 - DNA, 22 bp, Homo sapiens
tggacgcccagctgaggctggg

SEQ ID NO: 6519614 - DNA, 16 bp, Homo sapiens
tggacgccgagggcag

SEQ ID NO: 6519615 - DNA, 17 bp, Homo sapiens
tggacgccgagggcagc

SEQ ID NO: 6519616 - DNA, 21 bp, Homo sapiens
tggacgcctggctccaggctc

SEQ ID NO: 6519617 - DNA, 16 bp, Homo sapiens
tggacgctgcagaccc

SEQ ID NO: 6519618 - DNA, 14 bp, Homo sapiens
tggacgctgccctg

SEQ ID NO: 6519619 - DNA, 13 bp, Homo sapiens
tggacgctgtcca

SEQ ID NO: 6519620 - DNA, 12 bp, Homo sapiens
tggacgctgtgc

SEQ ID NO: 6519621 - DNA, 14 bp, Homo sapiens
tggacggaggtccc

SEQ ID NO: 6519622 - DNA, 23 bp, Homo sapiens
tggacggattccttggcagccgg

SEQ ID NO: 6519623 - DNA, 13 bp, Homo sapiens
tggacggcagacc

SEQ ID NO: 6519624 - DNA, 15 bp, Homo sapiens
tggacggcaggctca

SEQ ID NO: 6519625 - DNA, 20 bp, Homo sapiens
tggacggcaggctcactgcc

SEQ ID NO: 6519626 - DNA, 15 bp, Homo sapiens
tggacggctgggcac

SEQ ID NO: 6519627 - DNA, 20 bp, Homo sapiens
tggacgggatgacctccaga

SEQ ID NO: 6519628 - DNA, 19 bp, Homo sapiens
tggacggggacacggcctc

SEQ ID NO: 6519629 - DNA, 21 bp, Homo sapiens
tggacggggacacggcctctg

SEQ ID NO: 6519630 - DNA, 21 bp, Homo sapiens
tggacggggcgggccctgcct

SEQ ID NO: 6519631 - DNA, 18 bp, Homo sapiens
tggacggtttctagcctc

SEQ ID NO: 6519632 - DNA, 18 bp, Homo sapiens
tggacgtcacgctccctg

SEQ ID NO: 6519633 - DNA, 19 bp, Homo sapiens
tggacgtcagcctgtggat

SEQ ID NO: 6519634 - DNA, 17 bp, Homo sapiens
tggacgtgcactgacag

SEQ ID NO: 6519635 - DNA, 17 bp, Homo sapiens
tggacgtgggctccagg

SEQ ID NO: 6519636 - DNA, 14 bp, Homo sapiens
tggacgtgtgagga

SEQ ID NO: 6519637 - DNA, 23 bp, Homo sapiens
tggacgtgttatgactccagaat

SEQ ID NO: 6519638 - DNA, 23 bp, Homo sapiens
tggactaaaagatataagtgctg

SEQ ID NO: 6519639 - DNA, 22 bp, Homo sapiens
tggactaagatgaaatgcactg

SEQ ID NO: 6519640 - DNA, 19 bp, Homo sapiens
tggactacctataaatgga

SEQ ID NO: 6519641 - DNA, 14 bp, Homo sapiens
tggactagaaaatc

SEQ ID NO: 6519642 - DNA, 21 bp, Homo sapiens
tggactagagggacctctccc

SEQ ID NO: 6519643 - DNA, 21 bp, Homo sapiens
tggactagccagaattctacc

SEQ ID NO: 6519644 - DNA, 15 bp, Homo sapiens
tggactagggcctcg

SEQ ID NO: 6519645 - DNA, 17 bp, Homo sapiens
tggactatattgggact

SEQ ID NO: 6519646 - DNA, 15 bp, Homo sapiens
tggactatctgtctg

SEQ ID NO: 6519647 - DNA, 20 bp, Homo sapiens
tggactatctgtctggtggc

SEQ ID NO: 6519648 - DNA, 22 bp, Homo sapiens
tggactatggagtgcaccaaag

SEQ ID NO: 6519649 - DNA, 17 bp, Homo sapiens
tggactcaatccctagg

SEQ ID NO: 6519650 - DNA, 22 bp, Homo sapiens
tggactcagcccacctgcaccc

SEQ ID NO: 6519651 - DNA, 13 bp, Homo sapiens
tggactcagcctt

SEQ ID NO: 6519652 - DNA, 17 bp, Homo sapiens
tggactcagctctgtct

SEQ ID NO: 6519653 - DNA, 16 bp, Homo sapiens
tggactcaggatgccc

SEQ ID NO: 6519654 - DNA, 15 bp, Homo sapiens
tggactcagggcagc

SEQ ID NO: 6519655 - DNA, 20 bp, Homo sapiens
tggactcagggcagcgccag

SEQ ID NO: 6519656 - DNA, 18 bp, Homo sapiens
tggactccacgatgcctt

SEQ ID NO: 6519657 - DNA, 21 bp, Homo sapiens
tggactccagcctgcctggca

SEQ ID NO: 6519658 - DNA, 12 bp, Homo sapiens
tggactccagct

SEQ ID NO: 6519659 - DNA, 13 bp, Homo sapiens
tggactccagctc

SEQ ID NO: 6519660 - DNA, 20 bp, Homo sapiens
tggactccaggatcctcctg

SEQ ID NO: 6519661 - DNA, 16 bp, Homo sapiens
tggactccaggcctga

SEQ ID NO: 6519662 - DNA, 18 bp, Homo sapiens
tggactccaggcctgacc

SEQ ID NO: 6519663 - DNA, 18 bp, Homo sapiens
tggactcccactctttga

SEQ ID NO: 6519664 - DNA, 13 bp, Homo sapiens
tggactcccctcc

SEQ ID NO: 6519665 - DNA, 18 bp, Homo sapiens
tggactccctccccaccc

SEQ ID NO: 6519666 - DNA, 20 bp, Homo sapiens
tggactccggaggactgagc

SEQ ID NO: 6519667 - DNA, 14 bp, Homo sapiens
tggactcctcccac

SEQ ID NO: 6519668 - DNA, 12 bp, Homo sapiens
tggactcctgac

SEQ ID NO: 6519669 - DNA, 17 bp, Homo sapiens
tggactcgcgagagggt

SEQ ID NO: 6519670 - DNA, 18 bp, Homo sapiens
tggactcgcgagagggtg

SEQ ID NO: 6519671 - DNA, 12 bp, Homo sapiens
tggactctcagg

SEQ ID NO: 6519672 - DNA, 14 bp, Homo sapiens
tggactctcaggga

SEQ ID NO: 6519673 - DNA, 12 bp, Homo sapiens
tggactctctga

SEQ ID NO: 6519674 - DNA, 16 bp, Homo sapiens
tggactctctgacaaa

SEQ ID NO: 6519675 - DNA, 18 bp, Homo sapiens
tggactctctgcctgctt

SEQ ID NO: 6519676 - DNA, 18 bp, Homo sapiens
tggactctctgtggtccc

SEQ ID NO: 6519677 - DNA, 21 bp, Homo sapiens
tggactctgaaatatcccggg

SEQ ID NO: 6519678 - DNA, 14 bp, Homo sapiens
tggactctgcacat

SEQ ID NO: 6519679 - DNA, 17 bp, Homo sapiens
tggactctgcacatgtc

SEQ ID NO: 6519680 - DNA, 22 bp, Homo sapiens
tggactctgcacatgtcttgta

SEQ ID NO: 6519681 - DNA, 20 bp, Homo sapiens
tggactctgcatcccagcac

SEQ ID NO: 6519682 - DNA, 14 bp, Homo sapiens
tggactctgcccca

SEQ ID NO: 6519683 - DNA, 20 bp, Homo sapiens
tggactctggactgggaagg

SEQ ID NO: 6519684 - DNA, 22 bp, Homo sapiens
tggactctggtgcctccagagg

SEQ ID NO: 6519685 - DNA, 15 bp, Homo sapiens
tggactctgtcctga

SEQ ID NO: 6519686 - DNA, 14 bp, Homo sapiens
tggactctgtgctc

SEQ ID NO: 6519687 - DNA, 17 bp, Homo sapiens
tggactctgtggggcca

SEQ ID NO: 6519688 - DNA, 20 bp, Homo sapiens
tggactcttcaaaaactgtt

SEQ ID NO: 6519689 - DNA, 14 bp, Homo sapiens
tggactcttccctc

SEQ ID NO: 6519690 - DNA, 15 bp, Homo sapiens
tggactcttgctctt

SEQ ID NO: 6519691 - DNA, 19 bp, Homo sapiens
tggactgaagcctgcagga

SEQ ID NO: 6519692 - DNA, 21 bp, Homo sapiens
tggactgacagcatgtgccct

SEQ ID NO: 6519693 - DNA, 13 bp, Homo sapiens
tggactgacattt

SEQ ID NO: 6519694 - DNA, 14 bp, Homo sapiens
tggactgaccaaag

SEQ ID NO: 6519695 - DNA, 22 bp, Homo sapiens
tggactgaccaaagactgcaga

SEQ ID NO: 6519696 - DNA, 23 bp, Homo sapiens
tggactgaccacaccaaccaggc

SEQ ID NO: 6519697 - DNA, 19 bp, Homo sapiens
tggactgactgcagccccc

SEQ ID NO: 6519698 - DNA, 14 bp, Homo sapiens
tggactgactgtgt

SEQ ID NO: 6519699 - DNA, 16 bp, Homo sapiens
tggactgactgtgttg

SEQ ID NO: 6519700 - DNA, 18 bp, Homo sapiens
tggactgagaaattatac

SEQ ID NO: 6519701 - DNA, 19 bp, Homo sapiens
tggactgagaaattatact

SEQ ID NO: 6519702 - DNA, 16 bp, Homo sapiens
tggactgagcgaggaa

SEQ ID NO: 6519703 - DNA, 11 bp, Homo sapiens
tggactgaggc

SEQ ID NO: 6519704 - DNA, 17 bp, Homo sapiens
tggactgagggctgggt

SEQ ID NO: 6519705 - DNA, 19 bp, Homo sapiens
tggactgagggggcctgga

SEQ ID NO: 6519706 - DNA, 21 bp, Homo sapiens
tggactgagtttgggttctct

SEQ ID NO: 6519707 - DNA, 20 bp, Homo sapiens
tggactgatggttgctttga

SEQ ID NO: 6519708 - DNA, 16 bp, Homo sapiens
tggactgatttgtgga

SEQ ID NO: 6519709 - DNA, 17 bp, Homo sapiens
tggactgcacaggcagc

SEQ ID NO: 6519710 - DNA, 18 bp, Homo sapiens
tggactgcacaggcagca

SEQ ID NO: 6519711 - DNA, 18 bp, Homo sapiens
tggactgcagtcggcatg

SEQ ID NO: 6519712 - DNA, 12 bp, Homo sapiens
tggactgcatgg

SEQ ID NO: 6519713 - DNA, 20 bp, Homo sapiens
tggactgcatggggaggcag

SEQ ID NO: 6519714 - DNA, 21 bp, Homo sapiens
tggactgcatggggaggcagc

SEQ ID NO: 6519715 - DNA, 22 bp, Homo sapiens
tggactgctacctttcaaagct

SEQ ID NO: 6519716 - DNA, 22 bp, Homo sapiens
tggactgctattctagagcttt

SEQ ID NO: 6519717 - DNA, 14 bp, Homo sapiens
tggactggaaagca

SEQ ID NO: 6519718 - DNA, 17 bp, Homo sapiens
tggactggaggcccctg

SEQ ID NO: 6519719 - DNA, 17 bp, Homo sapiens
tggactggaggctgggt

SEQ ID NO: 6519720 - DNA, 16 bp, Homo sapiens
tggactggagtggagc

SEQ ID NO: 6519721 - DNA, 19 bp, Homo sapiens
tggactggcccttgcccaa

SEQ ID NO: 6519722 - DNA, 21 bp, Homo sapiens
tggactggcgttcacctccct

SEQ ID NO: 6519723 - DNA, 20 bp, Homo sapiens
tggactggctagagtcctca

SEQ ID NO: 6519724 - DNA, 18 bp, Homo sapiens
ttaactctttgaaactgt

SEQ ID NO: 6519725 - DNA, 20 bp, Homo sapiens
ttaactctttgcctttgcca

SEQ ID NO: 6519726 - DNA, 15 bp, Homo sapiens
ttaactcttttggac

SEQ ID NO: 6519727 - DNA, 16 bp, Homo sapiens
ttaactcttttggaca

SEQ ID NO: 6519728 - DNA, 15 bp, Homo sapiens
ttaactgaaaatgta

SEQ ID NO: 6519729 - DNA, 16 bp, Homo sapiens
ttaactgaactgtgaa

SEQ ID NO: 6519730 - DNA, 15 bp, Homo sapiens
ttaactgaagaaaga

SEQ ID NO: 6519731 - DNA, 20 bp, Homo sapiens
ttaactgaagaaagagaagt

SEQ ID NO: 6519732 - DNA, 21 bp, Homo sapiens
ttaactgaagatgttgagaaa

SEQ ID NO: 6519733 - DNA, 20 bp, Homo sapiens
ttaactgaataccactctgt

SEQ ID NO: 6519734 - DNA, 21 bp, Homo sapiens
ttaactgaataccactctgta

SEQ ID NO: 6519735 - DNA, 20 bp, Homo sapiens
ttaactgacaagctccattt

SEQ ID NO: 6519736 - DNA, 15 bp, Homo sapiens
ttaactgacgaagaa

SEQ ID NO: 6519737 - DNA, 19 bp, Homo sapiens
ttaactgatttaacacttt

SEQ ID NO: 6519738 - DNA, 20 bp, Homo sapiens
ttaactgcattttacacatt

SEQ ID NO: 6519739 - DNA, 16 bp, Homo sapiens
ttaactgccaaaacaa

SEQ ID NO: 6519740 - DNA, 17 bp, Homo sapiens
ttaactgctcagtgttt

SEQ ID NO: 6519741 - DNA, 15 bp, Homo sapiens
ttaactgcttcctat

SEQ ID NO: 6519742 - DNA, 14 bp, Homo sapiens
ttaactgcttttgc

SEQ ID NO: 6519743 - DNA, 20 bp, Homo sapiens
ttaactggaaggctgctttc

SEQ ID NO: 6519744 - DNA, 24 bp, Homo sapiens
ttaactggcatggattaatagagt

SEQ ID NO: 6519745 - DNA, 17 bp, Homo sapiens
ttaactggcatgtcatt

SEQ ID NO: 6519746 - DNA, 18 bp, Homo sapiens
ttaactggcatgtcattt

SEQ ID NO: 6519747 - DNA, 22 bp, Homo sapiens
ttaactggcatgtcatttgcac

SEQ ID NO: 6519748 - DNA, 14 bp, Homo sapiens
ttaactggcccaga

SEQ ID NO: 6519749 - DNA, 17 bp, Homo sapiens
ttaactgggtaatgaaa

SEQ ID NO: 6519750 - DNA, 22 bp, Homo sapiens
ttaactgggtacccaaaacaca

SEQ ID NO: 6519751 - DNA, 20 bp, Homo sapiens
ttaactggtgcactttgtaa

SEQ ID NO: 6519752 - DNA, 21 bp, Homo sapiens
ttaactggtgcactttgtaaa

SEQ ID NO: 6519753 - DNA, 14 bp, Homo sapiens
ttaactgtatttca

SEQ ID NO: 6519754 - DNA, 22 bp, Homo sapiens
ttaactgtccgtaagcagtata

SEQ ID NO: 6519755 - DNA, 16 bp, Homo sapiens
ttaactgtgaaatacc

SEQ ID NO: 6519756 - DNA, 18 bp, Homo sapiens
ttaactgtgaaatgtacg

SEQ ID NO: 6519757 - DNA, 15 bp, Homo sapiens
ttaactgtgcagtga

SEQ ID NO: 6519758 - DNA, 22 bp, Homo sapiens
ttaactgtgtgaagaaatggaa

SEQ ID NO: 6519759 - DNA, 16 bp, Homo sapiens
ttaactgttcagtatt

SEQ ID NO: 6519760 - DNA, 19 bp, Homo sapiens
ttaactgttccccttggta

SEQ ID NO: 6519761 - DNA, 17 bp, Homo sapiens
ttaactgttcttggaaa

SEQ ID NO: 6519762 - DNA, 21 bp, Homo sapiens
ttaactgttgcacttttgaat

SEQ ID NO: 6519763 - DNA, 11 bp, Homo sapiens
ttaactgtttt

SEQ ID NO: 6519764 - DNA, 15 bp, Homo sapiens
ttaactgttttaggt

SEQ ID NO: 6519765 - DNA, 16 bp, Homo sapiens
ttaacttaaaagaaca

SEQ ID NO: 6519766 - DNA, 15 bp, Homo sapiens
ttaacttaaatagta

SEQ ID NO: 6519767 - DNA, 17 bp, Homo sapiens
ttaacttaactgaagaa

SEQ ID NO: 6519768 - DNA, 14 bp, Homo sapiens
ttaacttaatggca

SEQ ID NO: 6519769 - DNA, 15 bp, Homo sapiens
ttaacttacatgact

SEQ ID NO: 6519770 - DNA, 16 bp, Homo sapiens
ttaacttacatttgta

SEQ ID NO: 6519771 - DNA, 14 bp, Homo sapiens
ttaacttagttttt

SEQ ID NO: 6519772 - DNA, 16 bp, Homo sapiens
ttaacttatgtatgtg

SEQ ID NO: 6519773 - DNA, 17 bp, Homo sapiens
ttaacttatttagagat

SEQ ID NO: 6519774 - DNA, 17 bp, Homo sapiens
ttaacttatttatatga

SEQ ID NO: 6519775 - DNA, 22 bp, Homo sapiens
ttaacttatttatatgaagcaa

SEQ ID NO: 6519776 - DNA, 16 bp, Homo sapiens
ttaacttcacatattg

SEQ ID NO: 6519777 - DNA, 14 bp, Homo sapiens
ttaacttcacctta

SEQ ID NO: 6519778 - DNA, 17 bp, Homo sapiens
ttaacttctattttcaa

SEQ ID NO: 6519779 - DNA, 12 bp, Homo sapiens
ttaacttctgcc

SEQ ID NO: 6519780 - DNA, 21 bp, Homo sapiens
ttaacttcttgcttctttcta

SEQ ID NO: 6519781 - DNA, 13 bp, Homo sapiens
ttaacttgaaaag

SEQ ID NO: 6519782 - DNA, 23 bp, Homo sapiens
ttaacttgaaaagattgcaaagg

SEQ ID NO: 6519783 - DNA, 15 bp, Homo sapiens
ttaacttgagtttta

SEQ ID NO: 6519784 - DNA, 23 bp, Homo sapiens
ttaacttgcctccatctttttct

SEQ ID NO: 6519785 - DNA, 13 bp, Homo sapiens
ttaacttggaaat

SEQ ID NO: 6519786 - DNA, 17 bp, Homo sapiens
ttaacttggtcagagcc

SEQ ID NO: 6519787 - DNA, 16 bp, Homo sapiens
ttaacttgtcaaaaaa

SEQ ID NO: 6519788 - DNA, 17 bp, Homo sapiens
ttaacttgtctttttgt

SEQ ID NO: 6519789 - DNA, 19 bp, Homo sapiens
ttaacttgtttggtagtta

SEQ ID NO: 6519790 - DNA, 14 bp, Homo sapiens
ttaactttaatgtt

SEQ ID NO: 6519791 - DNA, 23 bp, Homo sapiens
ttaactttgtggtctaaagtgtt

SEQ ID NO: 6519792 - DNA, 12 bp, Homo sapiens
ttaacttttaaa

SEQ ID NO: 6519793 - DNA, 14 bp, Homo sapiens
ttaacttttaatgg

SEQ ID NO: 6519794 - DNA, 15 bp, Homo sapiens
ttaacttttaatggt

SEQ ID NO: 6519795 - DNA, 19 bp, Homo sapiens
ttaacttttaatggtgatg

SEQ ID NO: 6519796 - DNA, 13 bp, Homo sapiens
ttaacttttataa

SEQ ID NO: 6519797 - DNA, 14 bp, Homo sapiens
ttaacttttataaa

SEQ ID NO: 6519798 - DNA, 17 bp, Homo sapiens
ttaacttttataaactt

SEQ ID NO: 6519799 - DNA, 18 bp, Homo sapiens
ttaacttttataaacttt

SEQ ID NO: 6519800 - DNA, 14 bp, Homo sapiens
ttaactttttaacc

SEQ ID NO: 6519801 - DNA, 23 bp, Homo sapiens
ttaactttttgtttttatttctt

SEQ ID NO: 6519802 - DNA, 16 bp, Homo sapiens
ttaacttttttcttta

SEQ ID NO: 6519803 - DNA, 14 bp, Homo sapiens
ttaagaaaaaaata

SEQ ID NO: 6519804 - DNA, 18 bp, Homo sapiens
ttaagaaaaaagtgttga

SEQ ID NO: 6519805 - DNA, 20 bp, Homo sapiens
ttaagaaaaaataacacaca

SEQ ID NO: 6519806 - DNA, 21 bp, Homo sapiens
ttaagaaaaaataacacacat

SEQ ID NO: 6519807 - DNA, 13 bp, Homo sapiens
ttaagaaaaacaa

SEQ ID NO: 6519808 - DNA, 16 bp, Homo sapiens
ttaagaaaaacaaagt

SEQ ID NO: 6519809 - DNA, 17 bp, Homo sapiens
ttaagaaaaacaataaa

SEQ ID NO: 6519810 - DNA, 22 bp, Homo sapiens
ttaagaaaaatgaaaacttttg

SEQ ID NO: 6519811 - DNA, 16 bp, Homo sapiens
ttaagaaaaattcaca

SEQ ID NO: 6519812 - DNA, 14 bp, Homo sapiens
ttaagaaaacattt

SEQ ID NO: 6519813 - DNA, 21 bp, Homo sapiens
ttaagaaaacccgacaacatt

SEQ ID NO: 6519814 - DNA, 23 bp, Homo sapiens
ttaagaaaacccgacaacatttc

SEQ ID NO: 6519815 - DNA, 14 bp, Homo sapiens
ttaagaaaagagat

SEQ ID NO: 6519816 - DNA, 16 bp, Homo sapiens
ttaagaaaagcacttt

SEQ ID NO: 6519817 - DNA, 18 bp, Homo sapiens
ttaagaaaagcacttttg

SEQ ID NO: 6519818 - DNA, 23 bp, Homo sapiens
ttaagaaaagcacttttgttatt

SEQ ID NO: 6519819 - DNA, 20 bp, Homo sapiens
ttaagaaaatattctaacat

SEQ ID NO: 6519820 - DNA, 23 bp, Homo sapiens
ttaagaaaatattctaacatttg

SEQ ID NO: 6519821 - DNA, 22 bp, Homo sapiens
ttaagaaaatcatattgcttct

SEQ ID NO: 6519822 - DNA, 20 bp, Homo sapiens
ttaagaaacaatttaaattg

SEQ ID NO: 6519823 - DNA, 21 bp, Homo sapiens
ttaagaaacacggctgatatc

SEQ ID NO: 6519824 - DNA, 12 bp, Homo sapiens
ttaagaaacctt

SEQ ID NO: 6519825 - DNA, 18 bp, Homo sapiens
ttaagaaactgttactgt

SEQ ID NO: 6519826 - DNA, 11 bp, Homo sapiens
ttaagaaagag

SEQ ID NO: 6519827 - DNA, 21 bp, Homo sapiens
ttaagaaagagaatgaactgt

SEQ ID NO: 6519828 - DNA, 23 bp, Homo sapiens
ttaagaaagagaatgaactgtgg

SEQ ID NO: 6519829 - DNA, 22 bp, Homo sapiens
ttaagaaagattaaatatatct

SEQ ID NO: 6519830 - DNA, 14 bp, Homo sapiens
ttaagaaagctata

SEQ ID NO: 6519831 - DNA, 15 bp, Homo sapiens
ttaagaaagctatat

SEQ ID NO: 6519832 - DNA, 17 bp, Homo sapiens
ttaagaaagcttcttgt

SEQ ID NO: 6519833 - DNA, 15 bp, Homo sapiens
ttaagaaaggaagca

SEQ ID NO: 6519834 - DNA, 18 bp, Homo sapiens
ttaagaaagtaatttaat

SEQ ID NO: 6519835 - DNA, 17 bp, Homo sapiens
ttaagaaagtgtctctg

SEQ ID NO: 6519836 - DNA, 23 bp, Homo sapiens
ttaagaaataacttgtgttacta

SEQ ID NO: 6519837 - DNA, 22 bp, Homo sapiens
ttaagaaatctggcccagggtg

SEQ ID NO: 6519838 - DNA, 17 bp, Homo sapiens
ttaagaaatgagaaatt

SEQ ID NO: 6519839 - DNA, 23 bp, Homo sapiens
ttaagaaatgagaaattgtgcca

SEQ ID NO: 6519840 - DNA, 14 bp, Homo sapiens
ttaagaaatgtagt

SEQ ID NO: 6519841 - DNA, 13 bp, Homo sapiens
ttaagaaattcct

SEQ ID NO: 6519842 - DNA, 19 bp, Homo sapiens
ttaagaactaaaatgttct

SEQ ID NO: 6519843 - DNA, 15 bp, Homo sapiens
ttaagaactgacaca

SEQ ID NO: 6519844 - DNA, 14 bp, Homo sapiens
ttaagaactgctgt

SEQ ID NO: 6519845 - DNA, 18 bp, Homo sapiens
ttaagaactgctgtttca

SEQ ID NO: 6519846 - DNA, 18 bp, Homo sapiens
ttaagaactgcttcatgt

SEQ ID NO: 6519847 - DNA, 13 bp, Homo sapiens
ttaagaagaaaat

SEQ ID NO: 6519848 - DNA, 13 bp, Homo sapiens
ttaagaagaaact

SEQ ID NO: 6519849 - DNA, 20 bp, Homo sapiens
ttaagaagccctgcagagca

SEQ ID NO: 6519850 - DNA, 16 bp, Homo sapiens
ttaagaagctgttgta

SEQ ID NO: 6519851 - DNA, 20 bp, Homo sapiens
ttaagaagctgttgtacatt

SEQ ID NO: 6519852 - DNA, 23 bp, Homo sapiens
ttaagaagctgttgtacatttat

SEQ ID NO: 6519853 - DNA, 23 bp, Homo sapiens
ttaagaataatttttaattgctt

SEQ ID NO: 6519854 - DNA, 10 bp, Homo sapiens
ttaagaatat

SEQ ID NO: 6519855 - DNA, 20 bp, Homo sapiens
ttaagaatatctgtaatggt

SEQ ID NO: 6519856 - DNA, 16 bp, Homo sapiens
ttaagaatatgtttcc

SEQ ID NO: 6519857 - DNA, 19 bp, Homo sapiens
ttaagaatatgtttccttg

SEQ ID NO: 6519858 - DNA, 11 bp, Homo sapiens
ttaagaatcat

SEQ ID NO: 6519859 - DNA, 13 bp, Homo sapiens
ttaagaatcatgg

SEQ ID NO: 6519860 - DNA, 14 bp, Homo sapiens
ttaagaatcatgga

SEQ ID NO: 6519861 - DNA, 18 bp, Homo sapiens
ttaagaatgaagttctgc

SEQ ID NO: 6519862 - DNA, 22 bp, Homo sapiens
ttaagaatgagtttcttagact

SEQ ID NO: 6519863 - DNA, 23 bp, Homo sapiens
ttaagaatgtatatcagggttta

SEQ ID NO: 6519864 - DNA, 19 bp, Homo sapiens
ttaagaatgtgctagagtt

SEQ ID NO: 6519865 - DNA, 22 bp, Homo sapiens
ttaagaatgttggtttactttc

SEQ ID NO: 6519866 - DNA, 18 bp, Homo sapiens
ttaagaattcaaatttgt

SEQ ID NO: 6519867 - DNA, 15 bp, Homo sapiens
ttaagaattgaagat

SEQ ID NO: 6519868 - DNA, 14 bp, Homo sapiens
ttaagacagagtct

SEQ ID NO: 6519869 - DNA, 23 bp, Homo sapiens
ttaagacagtgtacaaaactgta

SEQ ID NO: 6519870 - DNA, 20 bp, Homo sapiens
ttaagacataaacaaagaca

SEQ ID NO: 6519871 - DNA, 18 bp, Homo sapiens
ttaagacatgatttcctt

SEQ ID NO: 6519872 - DNA, 14 bp, Homo sapiens
ttaagacctggcag

SEQ ID NO: 6519873 - DNA, 22 bp, Homo sapiens
ttaagacgaaacatttgttcta

SEQ ID NO: 6519874 - DNA, 20 bp, Homo sapiens
ttaagacgtgaatgtctcag

SEQ ID NO: 6519875 - DNA, 16 bp, Homo sapiens
ttaagacgtgtttgtg

SEQ ID NO: 6519876 - DNA, 13 bp, Homo sapiens
ttaagactagata

SEQ ID NO: 6519877 - DNA, 20 bp, Homo sapiens
ttaagactgataattttaca

SEQ ID NO: 6519878 - DNA, 17 bp, Homo sapiens
ttaagactgtaatgtgt

SEQ ID NO: 6519879 - DNA, 13 bp, Homo sapiens
ttaagacttgaca

SEQ ID NO: 6519880 - DNA, 19 bp, Homo sapiens
ttaagactttggttatttt

SEQ ID NO: 6519881 - DNA, 19 bp, Homo sapiens
ttaagagaaactttataca

SEQ ID NO: 6519882 - DNA, 21 bp, Homo sapiens
ttaagagaaactttatacatt

SEQ ID NO: 6519883 - DNA, 23 bp, Homo sapiens
ttaagagaacaaagagtgaaata

SEQ ID NO: 6519884 - DNA, 16 bp, Homo sapiens
ttaagagaagaaatgt

SEQ ID NO: 6519885 - DNA, 17 bp, Homo sapiens
ttaagagaagaaatgtt

SEQ ID NO: 6519886 - DNA, 15 bp, Homo sapiens
ttaagagactcttta

SEQ ID NO: 6519887 - DNA, 13 bp, Homo sapiens
ttaagagagaaat

SEQ ID NO: 6519888 - DNA, 16 bp, Homo sapiens
ttaagagagagagcct

SEQ ID NO: 6519889 - DNA, 14 bp, Homo sapiens
ttaagagcaataaa

SEQ ID NO: 6519890 - DNA, 23 bp, Homo sapiens
ttaagagcagaacagatctttta

SEQ ID NO: 6519891 - DNA, 23 bp, Homo sapiens
ttaagagccatataagtttgaag

SEQ ID NO: 6519892 - DNA, 15 bp, Homo sapiens
ttaagagctatttgt

SEQ ID NO: 6519893 - DNA, 22 bp, Homo sapiens
ttaagagcttgatctgtgattt

SEQ ID NO: 6519894 - DNA, 16 bp, Homo sapiens
ttaagaggcagggtct

SEQ ID NO: 6519895 - DNA, 16 bp, Homo sapiens
ttaagagtgaaataat

SEQ ID NO: 6519896 - DNA, 18 bp, Homo sapiens
ttaagagtgaatgtgtac

SEQ ID NO: 6519897 - DNA, 13 bp, Homo sapiens
ttaagataactta

SEQ ID NO: 6519898 - DNA, 17 bp, Homo sapiens
ttaagataacttactgt

SEQ ID NO: 6519899 - DNA, 19 bp, Homo sapiens
ttaagataacttactgtat

SEQ ID NO: 6519900 - DNA, 17 bp, Homo sapiens
ttaagatacactcctgc

SEQ ID NO: 6519901 - DNA, 22 bp, Homo sapiens
ttaagatacagtgtaggcattt

SEQ ID NO: 6519902 - DNA, 16 bp, Homo sapiens
tggactgggaagcatt

SEQ ID NO: 6519903 - DNA, 22 bp, Homo sapiens
tggactgggaagggggcaggcc

SEQ ID NO: 6519904 - DNA, 14 bp, Homo sapiens
tggactggttttca

SEQ ID NO: 6519905 - DNA, 21 bp, Homo sapiens
tggactgtcacggggttccct

SEQ ID NO: 6519906 - DNA, 16 bp, Homo sapiens
tggactgtgaatttca

SEQ ID NO: 6519907 - DNA, 19 bp, Homo sapiens
tggactgtgaatttcaaaa

SEQ ID NO: 6519908 - DNA, 20 bp, Homo sapiens
tggactgtgatgccacacag

SEQ ID NO: 6519909 - DNA, 21 bp, Homo sapiens
tggactgtgatgccacacaga

SEQ ID NO: 6519910 - DNA, 15 bp, Homo sapiens
tggactgtgccatct

SEQ ID NO: 6519911 - DNA, 16 bp, Homo sapiens
tggactgtgccatctg

SEQ ID NO: 6519912 - DNA, 16 bp, Homo sapiens
tggactgtgcctcagg

SEQ ID NO: 6519913 - DNA, 20 bp, Homo sapiens
tggactgtgcctcaggccag

SEQ ID NO: 6519914 - DNA, 22 bp, Homo sapiens
tggactgtgcctcaggccaggg

SEQ ID NO: 6519915 - DNA, 17 bp, Homo sapiens
tggactgtgctggtgca

SEQ ID NO: 6519916 - DNA, 17 bp, Homo sapiens
tggactgtggagggtca

SEQ ID NO: 6519917 - DNA, 12 bp, Homo sapiens
tggactgtggca

SEQ ID NO: 6519918 - DNA, 22 bp, Homo sapiens
tggactgtggcacttgcctggg

SEQ ID NO: 6519919 - DNA, 15 bp, Homo sapiens
tggactgtggcctca

SEQ ID NO: 6519920 - DNA, 16 bp, Homo sapiens
tggactgtggcctcag

SEQ ID NO: 6519921 - DNA, 15 bp, Homo sapiens
tggactgtggtgact

SEQ ID NO: 6519922 - DNA, 17 bp, Homo sapiens
tggactgtggtgacttt

SEQ ID NO: 6519923 - DNA, 22 bp, Homo sapiens
tggactgtggtgactttggata

SEQ ID NO: 6519924 - DNA, 15 bp, Homo sapiens
tggactgttccaggc

SEQ ID NO: 6519925 - DNA, 16 bp, Homo sapiens
tggactgttctgtaga

SEQ ID NO: 6519926 - DNA, 22 bp, Homo sapiens
tggactgttctgtagattcatg

SEQ ID NO: 6519927 - DNA, 16 bp, Homo sapiens
tggactgttttcaata

SEQ ID NO: 6519928 - DNA, 17 bp, Homo sapiens
tggactgttttctctcg

SEQ ID NO: 6519929 - DNA, 20 bp, Homo sapiens
tggactgttttctctcggct

SEQ ID NO: 6519930 - DNA, 22 bp, Homo sapiens
tggactgttttctctcggctcc

SEQ ID NO: 6519931 - DNA, 15 bp, Homo sapiens
tggacttaaagaaaa

SEQ ID NO: 6519932 - DNA, 16 bp, Homo sapiens
tggacttaattatgct

SEQ ID NO: 6519933 - DNA, 16 bp, Homo sapiens
tggacttacctggcag

SEQ ID NO: 6519934 - DNA, 18 bp, Homo sapiens
tggacttagaaagcaggg

SEQ ID NO: 6519935 - DNA, 20 bp, Homo sapiens
tggacttagaaagcaggggc

SEQ ID NO: 6519936 - DNA, 13 bp, Homo sapiens
tggacttatttaa

SEQ ID NO: 6519937 - DNA, 18 bp, Homo sapiens
tggacttcacataagctc

SEQ ID NO: 6519938 - DNA, 14 bp, Homo sapiens
tggacttccatttg

SEQ ID NO: 6519939 - DNA, 12 bp, Homo sapiens
tggacttctgaa

SEQ ID NO: 6519940 - DNA, 21 bp, Homo sapiens
tggacttctgaaaaatgaatg

SEQ ID NO: 6519941 - DNA, 15 bp, Homo sapiens
tggacttctggggta

SEQ ID NO: 6519942 - DNA, 16 bp, Homo sapiens
tggacttctgtgggcc

SEQ ID NO: 6519943 - DNA, 17 bp, Homo sapiens
tggacttgagcttggca

SEQ ID NO: 6519944 - DNA, 14 bp, Homo sapiens
tggacttggagctg

SEQ ID NO: 6519945 - DNA, 18 bp, Homo sapiens
tggacttggtcaccagct

SEQ ID NO: 6519946 - DNA, 20 bp, Homo sapiens
tggacttggtcaccagctcc

SEQ ID NO: 6519947 - DNA, 18 bp, Homo sapiens
tggacttgtatagtgaga

SEQ ID NO: 6519948 - DNA, 15 bp, Homo sapiens
tggacttgtatattt

SEQ ID NO: 6519949 - DNA, 22 bp, Homo sapiens
tggacttgtatatttgtacaaa

SEQ ID NO: 6519950 - DNA, 22 bp, Homo sapiens
tggacttgtgattggctgcagg

SEQ ID NO: 6519951 - DNA, 16 bp, Homo sapiens
tggactttcaaaatta

SEQ ID NO: 6519952 - DNA, 18 bp, Homo sapiens
tggactttccaccccctc

SEQ ID NO: 6519953 - DNA, 19 bp, Homo sapiens
tggactttccaccccctcc

SEQ ID NO: 6519954 - DNA, 13 bp, Homo sapiens
tggactttcctgc

SEQ ID NO: 6519955 - DNA, 14 bp, Homo sapiens
tggactttcctgca

SEQ ID NO: 6519956 - DNA, 18 bp, Homo sapiens
tggactttctctaataat

SEQ ID NO: 6519957 - DNA, 15 bp, Homo sapiens
tggactttcttgcaa

SEQ ID NO: 6519958 - DNA, 16 bp, Homo sapiens
tggactttgcttcccc

SEQ ID NO: 6519959 - DNA, 15 bp, Homo sapiens
tggactttggaaaat

SEQ ID NO: 6519960 - DNA, 23 bp, Homo sapiens
tggactttggttctctccaggaa

SEQ ID NO: 6519961 - DNA, 11 bp, Homo sapiens
tggactttgtt

SEQ ID NO: 6519962 - DNA, 15 bp, Homo sapiens
tggactttgttacac

SEQ ID NO: 6519963 - DNA, 24 bp, Homo sapiens
tggactttgttagtttctccaagc

SEQ ID NO: 6519964 - DNA, 14 bp, Homo sapiens
tggactttgttcac

SEQ ID NO: 6519965 - DNA, 19 bp, Homo sapiens
tggacttttgcagcttcct

SEQ ID NO: 6519966 - DNA, 17 bp, Homo sapiens
tggagaaaaatatctgt

SEQ ID NO: 6519967 - DNA, 17 bp, Homo sapiens
tggagaaaatgaagaaa

SEQ ID NO: 6519968 - DNA, 19 bp, Homo sapiens
tggagaaaattggaactct

SEQ ID NO: 6519969 - DNA, 17 bp, Homo sapiens
tggagaaacaagagacc

SEQ ID NO: 6519970 - DNA, 16 bp, Homo sapiens
tggagaaacaggccca

SEQ ID NO: 6519971 - DNA, 14 bp, Homo sapiens
tggagaaaccctgt

SEQ ID NO: 6519972 - DNA, 21 bp, Homo sapiens
tggagaaaccttcactccaga

SEQ ID NO: 6519973 - DNA, 22 bp, Homo sapiens
tggagaaaccttcactccagac

SEQ ID NO: 6519974 - DNA, 17 bp, Homo sapiens
tggagaaactgtagtct

SEQ ID NO: 6519975 - DNA, 13 bp, Homo sapiens
tggagaaagaagt

SEQ ID NO: 6519976 - DNA, 17 bp, Homo sapiens
tggagaaagcactgacc

SEQ ID NO: 6519977 - DNA, 19 bp, Homo sapiens
tggagaaagcactgacctg

SEQ ID NO: 6519978 - DNA, 22 bp, Homo sapiens
tggagaaagccacgccctccct

SEQ ID NO: 6519979 - DNA, 15 bp, Homo sapiens
tggagaaagctcatg

SEQ ID NO: 6519980 - DNA, 13 bp, Homo sapiens
tggagaaagctga

SEQ ID NO: 6519981 - DNA, 15 bp, Homo sapiens
tggagaaagctgact

SEQ ID NO: 6519982 - DNA, 23 bp, Homo sapiens
tggagaaagctgacttggctggt

SEQ ID NO: 6519983 - DNA, 13 bp, Homo sapiens
tggagaaaggatg

SEQ ID NO: 6519984 - DNA, 20 bp, Homo sapiens
tggagaaaggatggcagcct

SEQ ID NO: 6519985 - DNA, 13 bp, Homo sapiens
tggagaaagggcc

SEQ ID NO: 6519986 - DNA, 23 bp, Homo sapiens
tggagaaatggtccgctttcctg

SEQ ID NO: 6519987 - DNA, 15 bp, Homo sapiens
tggagaaatgtcata

SEQ ID NO: 6519988 - DNA, 15 bp, Homo sapiens
tggagaaattattta

SEQ ID NO: 6519989 - DNA, 17 bp, Homo sapiens
tggagaaattatttaat

SEQ ID NO: 6519990 - DNA, 21 bp, Homo sapiens
tggagaaattatttaataaaa

SEQ ID NO: 6519991 - DNA, 21 bp, Homo sapiens
tggagaacagtggttgcctgg

SEQ ID NO: 6519992 - DNA, 22 bp, Homo sapiens
tggagaacagtggttgcctggg

SEQ ID NO: 6519993 - DNA, 14 bp, Homo sapiens
tggagaacatgttt

SEQ ID NO: 6519994 - DNA, 23 bp, Homo sapiens
tggagaacgccagtctcccaggc

SEQ ID NO: 6519995 - DNA, 13 bp, Homo sapiens
tggagaactaggt

SEQ ID NO: 6519996 - DNA, 22 bp, Homo sapiens
tggagaactaggtttaaaacag

SEQ ID NO: 6519997 - DNA, 23 bp, Homo sapiens
tggagaactaggtttaaaacagc

SEQ ID NO: 6519998 - DNA, 15 bp, Homo sapiens
tggagaactcagtgc

SEQ ID NO: 6519999 - DNA, 17 bp, Homo sapiens
tggagaactcctagggt

SEQ ID NO: 6520000 - DNA, 22 bp, Homo sapiens
tggagaactgggatttgaaccc

SEQ ID NO: 6520001 - DNA, 14 bp, Homo sapiens
tggagaagaactga

SEQ ID NO: 6520002 - DNA, 16 bp, Homo sapiens
tggagaagaatatcaa

SEQ ID NO: 6520003 - DNA, 12 bp, Homo sapiens
tggagaagagag

SEQ ID NO: 6520004 - DNA, 20 bp, Homo sapiens
tggagaagagagaggaaagg

SEQ ID NO: 6520005 - DNA, 19 bp, Homo sapiens
tggagaagagaggagagga

SEQ ID NO: 6520006 - DNA, 22 bp, Homo sapiens
tggagaagcacactctggtctt

SEQ ID NO: 6520007 - DNA, 21 bp, Homo sapiens
tggagaagccacaggcctgag

SEQ ID NO: 6520008 - DNA, 22 bp, Homo sapiens
tggagaagccacaggcctgaga

SEQ ID NO: 6520009 - DNA, 23 bp, Homo sapiens
tggagaagccacaggcctgagat

SEQ ID NO: 6520010 - DNA, 18 bp, Homo sapiens
tggagaagccattgtctt

SEQ ID NO: 6520011 - DNA, 19 bp, Homo sapiens
tggagaagccattgtcttc

SEQ ID NO: 6520012 - DNA, 13 bp, Homo sapiens
tggagaagcggct

SEQ ID NO: 6520013 - DNA, 16 bp, Homo sapiens
tggagaagctcaccca

SEQ ID NO: 6520014 - DNA, 19 bp, Homo sapiens
tggagaagctcccaggaac

SEQ ID NO: 6520015 - DNA, 13 bp, Homo sapiens
tggagaagctgca

SEQ ID NO: 6520016 - DNA, 15 bp, Homo sapiens
tggagaagctgcagg

SEQ ID NO: 6520017 - DNA, 18 bp, Homo sapiens
tggagaagctgcaggctt

SEQ ID NO: 6520018 - DNA, 13 bp, Homo sapiens
tggagaagcttgt

SEQ ID NO: 6520019 - DNA, 21 bp, Homo sapiens
tggagaaggaaaaggctggca

SEQ ID NO: 6520020 - DNA, 13 bp, Homo sapiens
tggagaaggaagg

SEQ ID NO: 6520021 - DNA, 14 bp, Homo sapiens
tggagaaggaaggc

SEQ ID NO: 6520022 - DNA, 13 bp, Homo sapiens
tggagaaggcctg

SEQ ID NO: 6520023 - DNA, 17 bp, Homo sapiens
tggagaaggcctggaag

SEQ ID NO: 6520024 - DNA, 14 bp, Homo sapiens
tggagaagggaggg

SEQ ID NO: 6520025 - DNA, 16 bp, Homo sapiens
tggagaagggagggtg

SEQ ID NO: 6520026 - DNA, 21 bp, Homo sapiens
tggagaagggagggtggccag

SEQ ID NO: 6520027 - DNA, 15 bp, Homo sapiens
tggagaaggtctgtg

SEQ ID NO: 6520028 - DNA, 16 bp, Homo sapiens
tggagaataattcttt

SEQ ID NO: 6520029 - DNA, 17 bp, Homo sapiens
tggagaatactgccaaa

SEQ ID NO: 6520030 - DNA, 17 bp, Homo sapiens
tggagaatactttgctt

SEQ ID NO: 6520031 - DNA, 17 bp, Homo sapiens
tggagaatcacaggctg

SEQ ID NO: 6520032 - DNA, 19 bp, Homo sapiens
tggagaatcacaggctggg

SEQ ID NO: 6520033 - DNA, 20 bp, Homo sapiens
tggagaatcacaggctgggc

SEQ ID NO: 6520034 - DNA, 21 bp, Homo sapiens
tggagaatgcaccatactcat

SEQ ID NO: 6520035 - DNA, 18 bp, Homo sapiens
tggagaatgccagcccaa

SEQ ID NO: 6520036 - DNA, 15 bp, Homo sapiens
tggagaatgtacaca

SEQ ID NO: 6520037 - DNA, 17 bp, Homo sapiens
tggagaatgtacacagt

SEQ ID NO: 6520038 - DNA, 23 bp, Homo sapiens
tggagaattgactgaagcacagc

SEQ ID NO: 6520039 - DNA, 20 bp, Homo sapiens
tggagaatttttactgggga

SEQ ID NO: 6520040 - DNA, 23 bp, Homo sapiens
tggagaatttttactggggattc

SEQ ID NO: 6520041 - DNA, 15 bp, Homo sapiens
tggagacaataaaca

SEQ ID NO: 6520042 - DNA, 20 bp, Homo sapiens
tggagacaatgcagatgcca

SEQ ID NO: 6520043 - DNA, 16 bp, Homo sapiens
tggagacaatgtctgc

SEQ ID NO: 6520044 - DNA, 17 bp, Homo sapiens
tggagacacaactattt

SEQ ID NO: 6520045 - DNA, 18 bp, Homo sapiens
tggagacaccctctgggg

SEQ ID NO: 6520046 - DNA, 20 bp, Homo sapiens
tggagacagaaccagcagaa

SEQ ID NO: 6520047 - DNA, 13 bp, Homo sapiens
tggagacagcccc

SEQ ID NO: 6520048 - DNA, 22 bp, Homo sapiens
tggagacagccccagagcaggg

SEQ ID NO: 6520049 - DNA, 15 bp, Homo sapiens
tggagacagccctgc

SEQ ID NO: 6520050 - DNA, 18 bp, Homo sapiens
tggagacaggattctgac

SEQ ID NO: 6520051 - DNA, 19 bp, Homo sapiens
tggagacagtagaggcatg

SEQ ID NO: 6520052 - DNA, 22 bp, Homo sapiens
tggagacattcctgggcacagt

SEQ ID NO: 6520053 - DNA, 14 bp, Homo sapiens
tggagaccacactg

SEQ ID NO: 6520054 - DNA, 17 bp, Homo sapiens
tggagaccagaaacctt

SEQ ID NO: 6520055 - DNA, 15 bp, Homo sapiens
tggagaccaggactc

SEQ ID NO: 6520056 - DNA, 17 bp, Homo sapiens
tggagaccaggactctg

SEQ ID NO: 6520057 - DNA, 13 bp, Homo sapiens
tggagaccaggct

SEQ ID NO: 6520058 - DNA, 16 bp, Homo sapiens
tggagaccaggctcct

SEQ ID NO: 6520059 - DNA, 18 bp, Homo sapiens
tggagaccagggagcctt

SEQ ID NO: 6520060 - DNA, 19 bp, Homo sapiens
tggagaccagggagccttt

SEQ ID NO: 6520061 - DNA, 18 bp, Homo sapiens
tggagaccatgcagagcg

SEQ ID NO: 6520062 - DNA, 19 bp, Homo sapiens
tggagaccatgcagagcgc

SEQ ID NO: 6520063 - DNA, 22 bp, Homo sapiens
tggagaccctgccacagccaga

SEQ ID NO: 6520064 - DNA, 20 bp, Homo sapiens
tggagaccctgcgcccctgc

SEQ ID NO: 6520065 - DNA, 22 bp, Homo sapiens
tggagaccctgcgcccctgccc

SEQ ID NO: 6520066 - DNA, 22 bp, Homo sapiens
tggagaccgcttcacccctgca

SEQ ID NO: 6520067 - DNA, 23 bp, Homo sapiens
tggagaccgcttcacccctgcac

SEQ ID NO: 6520068 - DNA, 22 bp, Homo sapiens
tggagacgatcttgctggcagg

SEQ ID NO: 6520069 - DNA, 20 bp, Homo sapiens
tggagacgtggaacctctgt

SEQ ID NO: 6520070 - DNA, 22 bp, Homo sapiens
tggagacgtttataaacagaaa

SEQ ID NO: 6520071 - DNA, 19 bp, Homo sapiens
tggagactcctaggcagga

SEQ ID NO: 6520072 - DNA, 19 bp, Homo sapiens
tggagactcctgccctgtt

SEQ ID NO: 6520073 - DNA, 20 bp, Homo sapiens
tggagactcctggtctgtga

SEQ ID NO: 6520074 - DNA, 16 bp, Homo sapiens
tggagactctgagagc

SEQ ID NO: 6520075 - DNA, 14 bp, Homo sapiens
tggagactctgtgg

SEQ ID NO: 6520076 - DNA, 18 bp, Homo sapiens
tggagactgatggccagg

SEQ ID NO: 6520077 - DNA, 13 bp, Homo sapiens
tggagactgcaag

SEQ ID NO: 6520078 - DNA, 23 bp, Homo sapiens
tggagactgctcctgagccccca

SEQ ID NO: 6520079 - DNA, 17 bp, Homo sapiens
ttaagatagtgtaactt

SEQ ID NO: 6520080 - DNA, 13 bp, Homo sapiens
ttaagatattgaa

SEQ ID NO: 6520081 - DNA, 18 bp, Homo sapiens
ttaagatccagaaatact

SEQ ID NO: 6520082 - DNA, 22 bp, Homo sapiens
ttaagatctgtgttttagttta

SEQ ID NO: 6520083 - DNA, 22 bp, Homo sapiens
ttaagatgagcaaccacattta

SEQ ID NO: 6520084 - DNA, 11 bp, Homo sapiens
ttaagatgcta

SEQ ID NO: 6520085 - DNA, 13 bp, Homo sapiens
ttaagatggcaat

SEQ ID NO: 6520086 - DNA, 21 bp, Homo sapiens
ttaagatggcaattactttgg

SEQ ID NO: 6520087 - DNA, 19 bp, Homo sapiens
ttaagatggtaagacctct

SEQ ID NO: 6520088 - DNA, 20 bp, Homo sapiens
ttaagatggtaagacctctg

SEQ ID NO: 6520089 - DNA, 15 bp, Homo sapiens
ttaagatgtacattt

SEQ ID NO: 6520090 - DNA, 15 bp, Homo sapiens
ttaagatgtgaaaat

SEQ ID NO: 6520091 - DNA, 23 bp, Homo sapiens
ttaagattaaattatatctgagg

SEQ ID NO: 6520092 - DNA, 14 bp, Homo sapiens
ttaagattcagttt

SEQ ID NO: 6520093 - DNA, 19 bp, Homo sapiens
ttaagattcagttttccca

SEQ ID NO: 6520094 - DNA, 18 bp, Homo sapiens
ttaagattctctgcccag

SEQ ID NO: 6520095 - DNA, 12 bp, Homo sapiens
ttaagattgaag

SEQ ID NO: 6520096 - DNA, 18 bp, Homo sapiens
ttaagattgtaaaaataa

SEQ ID NO: 6520097 - DNA, 15 bp, Homo sapiens
ttaagattgtaattc

SEQ ID NO: 6520098 - DNA, 19 bp, Homo sapiens
ttaagattgtaattcagaa

SEQ ID NO: 6520099 - DNA, 13 bp, Homo sapiens
ttaagatttaatt

SEQ ID NO: 6520100 - DNA, 16 bp, Homo sapiens
ttaagattttacaaaa

SEQ ID NO: 6520101 - DNA, 14 bp, Homo sapiens
ttaagatttttctc

SEQ ID NO: 6520102 - DNA, 15 bp, Homo sapiens
ttaagatttttctca

SEQ ID NO: 6520103 - DNA, 22 bp, Homo sapiens
ttaagatttttctcaaagtttt

SEQ ID NO: 6520104 - DNA, 19 bp, Homo sapiens
ttaagcaaaagaaaaagat

SEQ ID NO: 6520105 - DNA, 22 bp, Homo sapiens
ttaagcaaacgtctattttgta

SEQ ID NO: 6520106 - DNA, 16 bp, Homo sapiens
ttaagcaaatttcatt

SEQ ID NO: 6520107 - DNA, 23 bp, Homo sapiens
ttaagcaacacttggaacagtgt

SEQ ID NO: 6520108 - DNA, 14 bp, Homo sapiens
ttaagcaacatctt

SEQ ID NO: 6520109 - DNA, 21 bp, Homo sapiens
ttaagcacaaaaaatttaaga

SEQ ID NO: 6520110 - DNA, 23 bp, Homo sapiens
ttaagcacacacatctggccctg

SEQ ID NO: 6520111 - DNA, 11 bp, Homo sapiens
ttaagcacatt

SEQ ID NO: 6520112 - DNA, 20 bp, Homo sapiens
ttaagcactacataaactga

SEQ ID NO: 6520113 - DNA, 18 bp, Homo sapiens
ttaagcactttgaaaata

SEQ ID NO: 6520114 - DNA, 22 bp, Homo sapiens
ttaagcagaattggaaaagact

SEQ ID NO: 6520115 - DNA, 21 bp, Homo sapiens
ttaagcagatggaatgctgtg

SEQ ID NO: 6520116 - DNA, 16 bp, Homo sapiens
ttaagcagcctttctg

SEQ ID NO: 6520117 - DNA, 11 bp, Homo sapiens
ttaagcagctt

SEQ ID NO: 6520118 - DNA, 17 bp, Homo sapiens
ttaagcaggcattgctt

SEQ ID NO: 6520119 - DNA, 13 bp, Homo sapiens
ttaagcagtacat

SEQ ID NO: 6520120 - DNA, 19 bp, Homo sapiens
ttaagcatatatttttata

SEQ ID NO: 6520121 - DNA, 11 bp, Homo sapiens
ttaagcatcac

SEQ ID NO: 6520122 - DNA, 14 bp, Homo sapiens
ttaagcatcacaaa

SEQ ID NO: 6520123 - DNA, 18 bp, Homo sapiens
ttaagcatcacaaatgat

SEQ ID NO: 6520124 - DNA, 22 bp, Homo sapiens
ttaagcatctggctctaattca

SEQ ID NO: 6520125 - DNA, 12 bp, Homo sapiens
ttaagcatgagt

SEQ ID NO: 6520126 - DNA, 18 bp, Homo sapiens
ttaagcatgtcaattcat

SEQ ID NO: 6520127 - DNA, 20 bp, Homo sapiens
ttaagcattactcttgtaag

SEQ ID NO: 6520128 - DNA, 12 bp, Homo sapiens
ttaagcattgtt

SEQ ID NO: 6520129 - DNA, 14 bp, Homo sapiens
ttaagcattgtttg

SEQ ID NO: 6520130 - DNA, 20 bp, Homo sapiens
ttaagccaaactcaggccca

SEQ ID NO: 6520131 - DNA, 12 bp, Homo sapiens
ttaagccaagag

SEQ ID NO: 6520132 - DNA, 15 bp, Homo sapiens
ttaagccaatataat

SEQ ID NO: 6520133 - DNA, 13 bp, Homo sapiens
ttaagccactgcc

SEQ ID NO: 6520134 - DNA, 16 bp, Homo sapiens
ttaagccagagtgtat

SEQ ID NO: 6520135 - DNA, 16 bp, Homo sapiens
ttaagccatcttggta

SEQ ID NO: 6520136 - DNA, 18 bp, Homo sapiens
ttaagccatcttggtaaa

SEQ ID NO: 6520137 - DNA, 12 bp, Homo sapiens
ttaagcccagga

SEQ ID NO: 6520138 - DNA, 23 bp, Homo sapiens
ttaagccccctcttgagaggggt

SEQ ID NO: 6520139 - DNA, 14 bp, Homo sapiens
ttaagccctgctct

SEQ ID NO: 6520140 - DNA, 18 bp, Homo sapiens
ttaagccctttgctctgg

SEQ ID NO: 6520141 - DNA, 20 bp, Homo sapiens
ttaagcctaccgtatttcag

SEQ ID NO: 6520142 - DNA, 21 bp, Homo sapiens
ttaagccttataaaccaatct

SEQ ID NO: 6520143 - DNA, 14 bp, Homo sapiens
ttaagccttgacac

SEQ ID NO: 6520144 - DNA, 19 bp, Homo sapiens
ttaagccttgacacactgt

SEQ ID NO: 6520145 - DNA, 13 bp, Homo sapiens
ttaagcctttgaa

SEQ ID NO: 6520146 - DNA, 15 bp, Homo sapiens
ttaagcctttggaaa

SEQ ID NO: 6520147 - DNA, 18 bp, Homo sapiens
ttaagcctttgttgaact

SEQ ID NO: 6520148 - DNA, 15 bp, Homo sapiens
ttaagctaaaatgtt

SEQ ID NO: 6520149 - DNA, 14 bp, Homo sapiens
ttaagctacttatt

SEQ ID NO: 6520150 - DNA, 14 bp, Homo sapiens
ttaagctccagctt

SEQ ID NO: 6520151 - DNA, 13 bp, Homo sapiens
ttaagctccagtg

SEQ ID NO: 6520152 - DNA, 17 bp, Homo sapiens
ttaagctccatgtgcat

SEQ ID NO: 6520153 - DNA, 20 bp, Homo sapiens
ttaagctccatgtgcatata

SEQ ID NO: 6520154 - DNA, 15 bp, Homo sapiens
ttaagctcccctgcc

SEQ ID NO: 6520155 - DNA, 16 bp, Homo sapiens
ttaagctcccctgcct

SEQ ID NO: 6520156 - DNA, 19 bp, Homo sapiens
ttaagctgcaaatctgatg

SEQ ID NO: 6520157 - DNA, 11 bp, Homo sapiens
ttaagctgcag

SEQ ID NO: 6520158 - DNA, 17 bp, Homo sapiens
ttaagctgtggtcaagg

SEQ ID NO: 6520159 - DNA, 14 bp, Homo sapiens
ttaagctgtttcca

SEQ ID NO: 6520160 - DNA, 22 bp, Homo sapiens
ttaagcttaaaaaagaaagatt

SEQ ID NO: 6520161 - DNA, 16 bp, Homo sapiens
ttaagctttattgtga

SEQ ID NO: 6520162 - DNA, 22 bp, Homo sapiens
ttaagctttggacccaaggaaa

SEQ ID NO: 6520163 - DNA, 17 bp, Homo sapiens
ttaagctttgtgaaaga

SEQ ID NO: 6520164 - DNA, 18 bp, Homo sapiens
ttaaggaaaaaagatttt

SEQ ID NO: 6520165 - DNA, 15 bp, Homo sapiens
ttaaggaaacttttt

SEQ ID NO: 6520166 - DNA, 23 bp, Homo sapiens
ttaaggaaagttggacttgagaa

SEQ ID NO: 6520167 - DNA, 15 bp, Homo sapiens
ttaaggaagaataaa

SEQ ID NO: 6520168 - DNA, 20 bp, Homo sapiens
ttaaggaagaataaaaaaga

SEQ ID NO: 6520169 - DNA, 20 bp, Homo sapiens
ttaaggaagatcctgaagca

SEQ ID NO: 6520170 - DNA, 13 bp, Homo sapiens
ttaaggaattttg

SEQ ID NO: 6520171 - DNA, 19 bp, Homo sapiens
ttaaggacaaaaatgaact

SEQ ID NO: 6520172 - DNA, 16 bp, Homo sapiens
ttaaggagaaatagct

SEQ ID NO: 6520173 - DNA, 21 bp, Homo sapiens
ttaaggagaatcatgtttctt

SEQ ID NO: 6520174 - DNA, 22 bp, Homo sapiens
ttaaggagaatcatgtttcttt

SEQ ID NO: 6520175 - DNA, 21 bp, Homo sapiens
ttaaggagaggagaaactgag

SEQ ID NO: 6520176 - DNA, 22 bp, Homo sapiens
ttaaggagcaaaaatctgagaa

SEQ ID NO: 6520177 - DNA, 23 bp, Homo sapiens
ttaaggataaatcataaagtcag

SEQ ID NO: 6520178 - DNA, 17 bp, Homo sapiens
ttaaggatgcttgtaca

SEQ ID NO: 6520179 - DNA, 22 bp, Homo sapiens
ttaaggatgcttgtacataatg

SEQ ID NO: 6520180 - DNA, 19 bp, Homo sapiens
ttaaggattaatattcttc

SEQ ID NO: 6520181 - DNA, 18 bp, Homo sapiens
ttaaggattctgcagaaa

SEQ ID NO: 6520182 - DNA, 13 bp, Homo sapiens
ttaaggcaaatca

SEQ ID NO: 6520183 - DNA, 20 bp, Homo sapiens
ttaaggcacagtgggagctg

SEQ ID NO: 6520184 - DNA, 21 bp, Homo sapiens
ttaaggcacagtgggagctga

SEQ ID NO: 6520185 - DNA, 19 bp, Homo sapiens
ttaaggcatttgtttaatt

SEQ ID NO: 6520186 - DNA, 23 bp, Homo sapiens
ttaaggcatttgtttaatttata

SEQ ID NO: 6520187 - DNA, 19 bp, Homo sapiens
ttaaggccaggcatggtgg

SEQ ID NO: 6520188 - DNA, 15 bp, Homo sapiens
ttaaggccctcattc

SEQ ID NO: 6520189 - DNA, 11 bp, Homo sapiens
ttaaggcctga

SEQ ID NO: 6520190 - DNA, 15 bp, Homo sapiens
ttaaggcctgaatca

SEQ ID NO: 6520191 - DNA, 16 bp, Homo sapiens
ttaaggctaaaaagta

SEQ ID NO: 6520192 - DNA, 16 bp, Homo sapiens
ttaaggctgaggctgc

SEQ ID NO: 6520193 - DNA, 13 bp, Homo sapiens
ttaaggcttcccc

SEQ ID NO: 6520194 - DNA, 15 bp, Homo sapiens
ttaagggaaaaatat

SEQ ID NO: 6520195 - DNA, 16 bp, Homo sapiens
ttaagggaaaaatata

SEQ ID NO: 6520196 - DNA, 16 bp, Homo sapiens
ttaagggaagctgata

SEQ ID NO: 6520197 - DNA, 19 bp, Homo sapiens
ttaagggacgggggtggga

SEQ ID NO: 6520198 - DNA, 20 bp, Homo sapiens
ttaagggaggtttaaaaaaa

SEQ ID NO: 6520199 - DNA, 22 bp, Homo sapiens
ttaagggagtgtactcccaggg

SEQ ID NO: 6520200 - DNA, 12 bp, Homo sapiens
ttaagggcagag

SEQ ID NO: 6520201 - DNA, 13 bp, Homo sapiens
ttaagggcagagt

SEQ ID NO: 6520202 - DNA, 21 bp, Homo sapiens
ttaagggccggggatggatct

SEQ ID NO: 6520203 - DNA, 17 bp, Homo sapiens
ttaaggggaagaatgaa

SEQ ID NO: 6520204 - DNA, 18 bp, Homo sapiens
ttaaggggaagaatgaaa

SEQ ID NO: 6520205 - DNA, 24 bp, Homo sapiens
ttaaggggaggaaccagagtgctg

SEQ ID NO: 6520206 - DNA, 17 bp, Homo sapiens
ttaaggggatcagaagt

SEQ ID NO: 6520207 - DNA, 19 bp, Homo sapiens
ttaagggggaaaactgttc

SEQ ID NO: 6520208 - DNA, 16 bp, Homo sapiens
ttaagggggtgtaatg

SEQ ID NO: 6520209 - DNA, 19 bp, Homo sapiens
ttaagggtaggatgttgct

SEQ ID NO: 6520210 - DNA, 18 bp, Homo sapiens
ttaaggtacatcattatt

SEQ ID NO: 6520211 - DNA, 20 bp, Homo sapiens
ttaaggtatctttttattca

SEQ ID NO: 6520212 - DNA, 21 bp, Homo sapiens
ttaaggtatttcgaaactgcc

SEQ ID NO: 6520213 - DNA, 17 bp, Homo sapiens
ttaaggtcaaacacaag

SEQ ID NO: 6520214 - DNA, 17 bp, Homo sapiens
ttaaggtcccccgacca

SEQ ID NO: 6520215 - DNA, 13 bp, Homo sapiens
ttaaggtctaact

SEQ ID NO: 6520216 - DNA, 21 bp, Homo sapiens
ttaaggtctaatcagtgatta

SEQ ID NO: 6520217 - DNA, 15 bp, Homo sapiens
ttaaggtctttattt

SEQ ID NO: 6520218 - DNA, 16 bp, Homo sapiens
ttaaggtctttcagta

SEQ ID NO: 6520219 - DNA, 19 bp, Homo sapiens
ttaaggtgagcataaatca

SEQ ID NO: 6520220 - DNA, 20 bp, Homo sapiens
ttaaggtgaggcctgtctgt

SEQ ID NO: 6520221 - DNA, 17 bp, Homo sapiens
ttaaggtgggtccagga

SEQ ID NO: 6520222 - DNA, 17 bp, Homo sapiens
ttaaggtgtagccacac

SEQ ID NO: 6520223 - DNA, 19 bp, Homo sapiens
ttaaggtgtgcaaagatct

SEQ ID NO: 6520224 - DNA, 14 bp, Homo sapiens
ttaaggttatttat

SEQ ID NO: 6520225 - DNA, 18 bp, Homo sapiens
ttaaggtttcaacaaatt

SEQ ID NO: 6520226 - DNA, 14 bp, Homo sapiens
ttaaggtttgcaaa

SEQ ID NO: 6520227 - DNA, 15 bp, Homo sapiens
ttaagtaaaccaaaa

SEQ ID NO: 6520228 - DNA, 16 bp, Homo sapiens
ttaagtaacttaagga

SEQ ID NO: 6520229 - DNA, 14 bp, Homo sapiens
ttaagtaagacttt

SEQ ID NO: 6520230 - DNA, 22 bp, Homo sapiens
ttaagtaagtaagtttcattct

SEQ ID NO: 6520231 - DNA, 18 bp, Homo sapiens
ttaagtaatgataactgg

SEQ ID NO: 6520232 - DNA, 21 bp, Homo sapiens
ttaagtaatgtggaagaaaat

SEQ ID NO: 6520233 - DNA, 18 bp, Homo sapiens
ttaagtacaagcacattt

SEQ ID NO: 6520234 - DNA, 20 bp, Homo sapiens
ttaagtaccaatgggaagca

SEQ ID NO: 6520235 - DNA, 13 bp, Homo sapiens
ttaagtaccagaa

SEQ ID NO: 6520236 - DNA, 16 bp, Homo sapiens
ttaagtactatctttg

SEQ ID NO: 6520237 - DNA, 13 bp, Homo sapiens
ttaagtagatgaa

SEQ ID NO: 6520238 - DNA, 23 bp, Homo sapiens
ttaagtagtttctccaagtactt

SEQ ID NO: 6520239 - DNA, 16 bp, Homo sapiens
ttaagtataaacctta

SEQ ID NO: 6520240 - DNA, 18 bp, Homo sapiens
ttaagtatacaacaggag

SEQ ID NO: 6520241 - DNA, 17 bp, Homo sapiens
ttaagtatatagtatat

SEQ ID NO: 6520242 - DNA, 21 bp, Homo sapiens
ttaagtatatagtatatttat

SEQ ID NO: 6520243 - DNA, 14 bp, Homo sapiens
ttaagtatatctat

SEQ ID NO: 6520244 - DNA, 15 bp, Homo sapiens
ttaagtatatttgta

SEQ ID NO: 6520245 - DNA, 19 bp, Homo sapiens
ttaagtattgcatctgtat

SEQ ID NO: 6520246 - DNA, 20 bp, Homo sapiens
ttaagtattgcatctgtata

SEQ ID NO: 6520247 - DNA, 11 bp, Homo sapiens
ttaagtattta

SEQ ID NO: 6520248 - DNA, 14 bp, Homo sapiens
ttaagtcagatttt

SEQ ID NO: 6520249 - DNA, 19 bp, Homo sapiens
ttaagtcagtggctttgca

SEQ ID NO: 6520250 - DNA, 15 bp, Homo sapiens
ttaagtcatcatctc

SEQ ID NO: 6520251 - DNA, 21 bp, Homo sapiens
ttaagtcattttcatgtgtgt

SEQ ID NO: 6520252 - DNA, 22 bp, Homo sapiens
ttaagtcattttgtaatatttg

SEQ ID NO: 6520253 - DNA, 21 bp, Homo sapiens
ttaagtcattttttacttgaa

SEQ ID NO: 6520254 - DNA, 11 bp, Homo sapiens
ttaagtcccag

SEQ ID NO: 6520255 - DNA, 21 bp, Homo sapiens
ttaagtcccagtatacctcat

SEQ ID NO: 6520256 - DNA, 19 bp, Homo sapiens
ttaagtccctgtcacctct

SEQ ID NO: 6520257 - DNA, 16 bp, Homo sapiens
ttaagtcgctgaacaa

SEQ ID NO: 6520258 - DNA, 14 bp, Homo sapiens
tggagactggcagg

SEQ ID NO: 6520259 - DNA, 15 bp, Homo sapiens
tggagactggggtgg

SEQ ID NO: 6520260 - DNA, 21 bp, Homo sapiens
tggagactggggtggcctcaa

SEQ ID NO: 6520261 - DNA, 20 bp, Homo sapiens
tggagactgtctggcccccc

SEQ ID NO: 6520262 - DNA, 21 bp, Homo sapiens
tggagactgtctggcccccct

SEQ ID NO: 6520263 - DNA, 18 bp, Homo sapiens
tggagactgtgtgtgccc

SEQ ID NO: 6520264 - DNA, 20 bp, Homo sapiens
tggagactgtgtgtgccctc

SEQ ID NO: 6520265 - DNA, 21 bp, Homo sapiens
tggagactgtgtgtgccctct

SEQ ID NO: 6520266 - DNA, 23 bp, Homo sapiens
tggagactgtgtgtgccctctgg

SEQ ID NO: 6520267 - DNA, 19 bp, Homo sapiens
tggagacttaatagacatt

SEQ ID NO: 6520268 - DNA, 17 bp, Homo sapiens
tggagacttggaagagt

SEQ ID NO: 6520269 - DNA, 18 bp, Homo sapiens
tggagactttctttaaat

SEQ ID NO: 6520270 - DNA, 18 bp, Homo sapiens
tggagagaaaaaattaac

SEQ ID NO: 6520271 - DNA, 22 bp, Homo sapiens
tggagagaactgattgtgagct

SEQ ID NO: 6520272 - DNA, 15 bp, Homo sapiens
tggagagaagctctt

SEQ ID NO: 6520273 - DNA, 18 bp, Homo sapiens
tggagagaagttgccctc

SEQ ID NO: 6520274 - DNA, 13 bp, Homo sapiens
tggagagaatcat

SEQ ID NO: 6520275 - DNA, 18 bp, Homo sapiens
tggagagaccagcctttc

SEQ ID NO: 6520276 - DNA, 15 bp, Homo sapiens
tggagagagaggctg

SEQ ID NO: 6520277 - DNA, 21 bp, Homo sapiens
tggagagagaggctgcctcag

SEQ ID NO: 6520278 - DNA, 13 bp, Homo sapiens
tggagagagcagg

SEQ ID NO: 6520279 - DNA, 12 bp, Homo sapiens
tggagagagggg

SEQ ID NO: 6520280 - DNA, 13 bp, Homo sapiens
tggagagagggga

SEQ ID NO: 6520281 - DNA, 23 bp, Homo sapiens
tggagagagtggtaaaaaagaaa

SEQ ID NO: 6520282 - DNA, 15 bp, Homo sapiens
tggagagcaaaggcc

SEQ ID NO: 6520283 - DNA, 17 bp, Homo sapiens
tggagagcaaaggccca

SEQ ID NO: 6520284 - DNA, 18 bp, Homo sapiens
tggagagcaaaggcccat

SEQ ID NO: 6520285 - DNA, 20 bp, Homo sapiens
tggagagcagctggctctcc

SEQ ID NO: 6520286 - DNA, 16 bp, Homo sapiens
tggagagcccagagtc

SEQ ID NO: 6520287 - DNA, 21 bp, Homo sapiens
tggagagcccggcgcccctgc

SEQ ID NO: 6520288 - DNA, 14 bp, Homo sapiens
tggagagccctggg

SEQ ID NO: 6520289 - DNA, 12 bp, Homo sapiens
tggagagcctgc

SEQ ID NO: 6520290 - DNA, 13 bp, Homo sapiens
tggagagcctgca

SEQ ID NO: 6520291 - DNA, 16 bp, Homo sapiens
tggagagcgaggaggc

SEQ ID NO: 6520292 - DNA, 19 bp, Homo sapiens
tggagagctagaacctgga

SEQ ID NO: 6520293 - DNA, 20 bp, Homo sapiens
tggagagctagaacctggag

SEQ ID NO: 6520294 - DNA, 22 bp, Homo sapiens
tggagagctagaacctggagag

SEQ ID NO: 6520295 - DNA, 23 bp, Homo sapiens
tggagagctagaacctggagagc

SEQ ID NO: 6520296 - DNA, 15 bp, Homo sapiens
tggagagctaggagc

SEQ ID NO: 6520297 - DNA, 23 bp, Homo sapiens
tggagagctaggagcaaagcctg

SEQ ID NO: 6520298 - DNA, 14 bp, Homo sapiens
tggagagctcagga

SEQ ID NO: 6520299 - DNA, 13 bp, Homo sapiens
tggagagctggag

SEQ ID NO: 6520300 - DNA, 19 bp, Homo sapiens
tggagagctggtgcccgga

SEQ ID NO: 6520301 - DNA, 12 bp, Homo sapiens
tggagaggaaga

SEQ ID NO: 6520302 - DNA, 14 bp, Homo sapiens
tggagaggagaaca

SEQ ID NO: 6520303 - DNA, 13 bp, Homo sapiens
tggagaggcctgg

SEQ ID NO: 6520304 - DNA, 14 bp, Homo sapiens
tggagaggcctggg

SEQ ID NO: 6520305 - DNA, 23 bp, Homo sapiens
tggagaggcctggggtgggacag

SEQ ID NO: 6520306 - DNA, 15 bp, Homo sapiens
tggagaggcgagagg

SEQ ID NO: 6520307 - DNA, 16 bp, Homo sapiens
tggagagggaatgtga

SEQ ID NO: 6520308 - DNA, 17 bp, Homo sapiens
tggagagggacgaagaa

SEQ ID NO: 6520309 - DNA, 20 bp, Homo sapiens
tggagagggagactcctggg

SEQ ID NO: 6520310 - DNA, 19 bp, Homo sapiens
tggagagggagatgtgtga

SEQ ID NO: 6520311 - DNA, 19 bp, Homo sapiens
tggagagggatgaggtgct

SEQ ID NO: 6520312 - DNA, 21 bp, Homo sapiens
tggagagggatggaaataacg

SEQ ID NO: 6520313 - DNA, 19 bp, Homo sapiens
tggagagggctctgtgctg

SEQ ID NO: 6520314 - DNA, 21 bp, Homo sapiens
tggagaggggcctgggaaagg

SEQ ID NO: 6520315 - DNA, 16 bp, Homo sapiens
tggagagggggcctgg

SEQ ID NO: 6520316 - DNA, 22 bp, Homo sapiens
tggagagggtctcgctgtcact

SEQ ID NO: 6520317 - DNA, 17 bp, Homo sapiens
tggagaggtatgtgccc

SEQ ID NO: 6520318 - DNA, 19 bp, Homo sapiens
tggagaggtggaaagaaaa

SEQ ID NO: 6520319 - DNA, 23 bp, Homo sapiens
tggagaggtggctgcgcccccag

SEQ ID NO: 6520320 - DNA, 23 bp, Homo sapiens
tggagaggtttgtcaacacaaag

SEQ ID NO: 6520321 - DNA, 15 bp, Homo sapiens
tggagagtaaaaact

SEQ ID NO: 6520322 - DNA, 13 bp, Homo sapiens
tggagagtgagag

SEQ ID NO: 6520323 - DNA, 20 bp, Homo sapiens
tggagagtgcaacagtagca

SEQ ID NO: 6520324 - DNA, 18 bp, Homo sapiens
tggagagtgcggcgtggg

SEQ ID NO: 6520325 - DNA, 15 bp, Homo sapiens
tggagagtggaagga

SEQ ID NO: 6520326 - DNA, 14 bp, Homo sapiens
tggagagtggggag

SEQ ID NO: 6520327 - DNA, 16 bp, Homo sapiens
tggagagtggggagag

SEQ ID NO: 6520328 - DNA, 19 bp, Homo sapiens
tggagagttcaatggctgc

SEQ ID NO: 6520329 - DNA, 19 bp, Homo sapiens
tggagagttgggggccagc

SEQ ID NO: 6520330 - DNA, 20 bp, Homo sapiens
tggagagttgggggccagca

SEQ ID NO: 6520331 - DNA, 16 bp, Homo sapiens
tggagagtttcctgaa

SEQ ID NO: 6520332 - DNA, 17 bp, Homo sapiens
tggagagtttcctgaaa

SEQ ID NO: 6520333 - DNA, 20 bp, Homo sapiens
tggagataaagatttcttga

SEQ ID NO: 6520334 - DNA, 19 bp, Homo sapiens
tggagataacagcctcttg

SEQ ID NO: 6520335 - DNA, 16 bp, Homo sapiens
tggagatactggtgga

SEQ ID NO: 6520336 - DNA, 14 bp, Homo sapiens
tggagatagctggg

SEQ ID NO: 6520337 - DNA, 15 bp, Homo sapiens
tggagatagctgggg

SEQ ID NO: 6520338 - DNA, 13 bp, Homo sapiens
tggagatagtgcc

SEQ ID NO: 6520339 - DNA, 20 bp, Homo sapiens
tggagatagtgccaggtggc

SEQ ID NO: 6520340 - DNA, 13 bp, Homo sapiens
tggagatcacagc

SEQ ID NO: 6520341 - DNA, 20 bp, Homo sapiens
tggagatcacagccccaccc

SEQ ID NO: 6520342 - DNA, 22 bp, Homo sapiens
tggagatcacagccccaccctt

SEQ ID NO: 6520343 - DNA, 14 bp, Homo sapiens
tggagatcctcctg

SEQ ID NO: 6520344 - DNA, 16 bp, Homo sapiens
tggagatcctcctgca

SEQ ID NO: 6520345 - DNA, 15 bp, Homo sapiens
tggagatctttgctt

SEQ ID NO: 6520346 - DNA, 18 bp, Homo sapiens
tggagatgacagaaatat

SEQ ID NO: 6520347 - DNA, 19 bp, Homo sapiens
tggagatgacagaaatatg

SEQ ID NO: 6520348 - DNA, 19 bp, Homo sapiens
tggagatgaggccagacca

SEQ ID NO: 6520349 - DNA, 22 bp, Homo sapiens
tggagatgaggccagaccatgg

SEQ ID NO: 6520350 - DNA, 13 bp, Homo sapiens
tggagatgcagag

SEQ ID NO: 6520351 - DNA, 14 bp, Homo sapiens
tggagatgcagcct

SEQ ID NO: 6520352 - DNA, 20 bp, Homo sapiens
tggagatgcagctactggaa

SEQ ID NO: 6520353 - DNA, 13 bp, Homo sapiens
tggagatggactc

SEQ ID NO: 6520354 - DNA, 17 bp, Homo sapiens
tggagatggctgctgct

SEQ ID NO: 6520355 - DNA, 16 bp, Homo sapiens
tggagatgggatgctt

SEQ ID NO: 6520356 - DNA, 13 bp, Homo sapiens
tggagatggggag

SEQ ID NO: 6520357 - DNA, 17 bp, Homo sapiens
tggagatggggagaaac

SEQ ID NO: 6520358 - DNA, 17 bp, Homo sapiens
tggagatggtctgcatc

SEQ ID NO: 6520359 - DNA, 14 bp, Homo sapiens
tggagatggtggat

SEQ ID NO: 6520360 - DNA, 20 bp, Homo sapiens
tggagatgtaaaatgagttt

SEQ ID NO: 6520361 - DNA, 15 bp, Homo sapiens
tggagatgtaggaac

SEQ ID NO: 6520362 - DNA, 19 bp, Homo sapiens
tggagatgtcagtctgtcc

SEQ ID NO: 6520363 - DNA, 22 bp, Homo sapiens
tggagatgtcttcgtacagttc

SEQ ID NO: 6520364 - DNA, 13 bp, Homo sapiens
tggagatgtttag

SEQ ID NO: 6520365 - DNA, 21 bp, Homo sapiens
tggagattgggatactgtaat

SEQ ID NO: 6520366 - DNA, 20 bp, Homo sapiens
tggagattttgctaatacat

SEQ ID NO: 6520367 - DNA, 20 bp, Homo sapiens
tggagcaaaaggcagctcac

SEQ ID NO: 6520368 - DNA, 15 bp, Homo sapiens
tggagcaaagctgat

SEQ ID NO: 6520369 - DNA, 20 bp, Homo sapiens
tggagcaacctactgtctaa

SEQ ID NO: 6520370 - DNA, 22 bp, Homo sapiens
tggagcaagaaggaaggaggca

SEQ ID NO: 6520371 - DNA, 23 bp, Homo sapiens
tggagcaagaaggaaggaggcag

SEQ ID NO: 6520372 - DNA, 15 bp, Homo sapiens
tggagcaagagagag

SEQ ID NO: 6520373 - DNA, 16 bp, Homo sapiens
tggagcaagctctgcc

SEQ ID NO: 6520374 - DNA, 17 bp, Homo sapiens
tggagcaagctctgccc

SEQ ID NO: 6520375 - DNA, 19 bp, Homo sapiens
tggagcaagctctgccctg

SEQ ID NO: 6520376 - DNA, 14 bp, Homo sapiens
tggagcaagctctt

SEQ ID NO: 6520377 - DNA, 15 bp, Homo sapiens
tggagcaagctcttc

SEQ ID NO: 6520378 - DNA, 17 bp, Homo sapiens
tggagcaagctcttccc

SEQ ID NO: 6520379 - DNA, 21 bp, Homo sapiens
tggagcaagtgacatgccatc

SEQ ID NO: 6520380 - DNA, 13 bp, Homo sapiens
tggagcaatcaga

SEQ ID NO: 6520381 - DNA, 15 bp, Homo sapiens
tggagcacaaaattc

SEQ ID NO: 6520382 - DNA, 22 bp, Homo sapiens
tggagcacaataaatggctgta

SEQ ID NO: 6520383 - DNA, 15 bp, Homo sapiens
tggagcacatgttac

SEQ ID NO: 6520384 - DNA, 21 bp, Homo sapiens
tggagcacatgttactgcttc

SEQ ID NO: 6520385 - DNA, 16 bp, Homo sapiens
tggagcacctgggccc

SEQ ID NO: 6520386 - DNA, 23 bp, Homo sapiens
tggagcacgaggccttcagaaaa

SEQ ID NO: 6520387 - DNA, 14 bp, Homo sapiens
tggagcactggact

SEQ ID NO: 6520388 - DNA, 12 bp, Homo sapiens
tggagcactggg

SEQ ID NO: 6520389 - DNA, 15 bp, Homo sapiens
tggagcactgggctc

SEQ ID NO: 6520390 - DNA, 19 bp, Homo sapiens
tggagcactgggctcccgg

SEQ ID NO: 6520391 - DNA, 22 bp, Homo sapiens
tggagcactgtaaaaagagctg

SEQ ID NO: 6520392 - DNA, 17 bp, Homo sapiens
tggagcacttgttttaa

SEQ ID NO: 6520393 - DNA, 20 bp, Homo sapiens
tggagcacttgttttaaaat

SEQ ID NO: 6520394 - DNA, 17 bp, Homo sapiens
tggagcagagacggcag

SEQ ID NO: 6520395 - DNA, 13 bp, Homo sapiens
tggagcagcagcc

SEQ ID NO: 6520396 - DNA, 12 bp, Homo sapiens
tggagcagcagg

SEQ ID NO: 6520397 - DNA, 15 bp, Homo sapiens
tggagcagcaggcct

SEQ ID NO: 6520398 - DNA, 21 bp, Homo sapiens
tggagcagcaggcctctggga

SEQ ID NO: 6520399 - DNA, 22 bp, Homo sapiens
tggagcagccaaggccgccagc

SEQ ID NO: 6520400 - DNA, 13 bp, Homo sapiens
tggagcagccacc

SEQ ID NO: 6520401 - DNA, 16 bp, Homo sapiens
tggagcagccacccca

SEQ ID NO: 6520402 - DNA, 12 bp, Homo sapiens
tggagcagccag

SEQ ID NO: 6520403 - DNA, 17 bp, Homo sapiens
tggagcagccagagctg

SEQ ID NO: 6520404 - DNA, 20 bp, Homo sapiens
tggagcagccagagctgtgc

SEQ ID NO: 6520405 - DNA, 13 bp, Homo sapiens
tggagcagccccc

SEQ ID NO: 6520406 - DNA, 22 bp, Homo sapiens
tggagcagcccccaaagagctg

SEQ ID NO: 6520407 - DNA, 12 bp, Homo sapiens
tggagcagccgg

SEQ ID NO: 6520408 - DNA, 15 bp, Homo sapiens
tggagcagccggaag

SEQ ID NO: 6520409 - DNA, 19 bp, Homo sapiens
tggagcagcctggagaccc

SEQ ID NO: 6520410 - DNA, 18 bp, Homo sapiens
tggagcaggactctattt

SEQ ID NO: 6520411 - DNA, 13 bp, Homo sapiens
tggagcaggccca

SEQ ID NO: 6520412 - DNA, 16 bp, Homo sapiens
tggagcaggcccaatg

SEQ ID NO: 6520413 - DNA, 18 bp, Homo sapiens
tggagcaggcccaatgct

SEQ ID NO: 6520414 - DNA, 19 bp, Homo sapiens
tggagcaggcccaatgctg

SEQ ID NO: 6520415 - DNA, 22 bp, Homo sapiens
tggagcaggcccaatgctgctt

SEQ ID NO: 6520416 - DNA, 16 bp, Homo sapiens
tggagcaggggttggt

SEQ ID NO: 6520417 - DNA, 22 bp, Homo sapiens
tggagcagtacatgggaaagga

SEQ ID NO: 6520418 - DNA, 20 bp, Homo sapiens
tggagcagtttggggcaggg

SEQ ID NO: 6520419 - DNA, 21 bp, Homo sapiens
tggagcagtttggggcagggg

SEQ ID NO: 6520420 - DNA, 22 bp, Homo sapiens
tggagcataactggagggtggg

SEQ ID NO: 6520421 - DNA, 16 bp, Homo sapiens
tggagcatctgactca

SEQ ID NO: 6520422 - DNA, 19 bp, Homo sapiens
tggagcatgagccagctct

SEQ ID NO: 6520423 - DNA, 15 bp, Homo sapiens
tggagcatgcagagg

SEQ ID NO: 6520424 - DNA, 14 bp, Homo sapiens
tggagcatggacag

SEQ ID NO: 6520425 - DNA, 20 bp, Homo sapiens
tggagcattaactaaatgct

SEQ ID NO: 6520426 - DNA, 23 bp, Homo sapiens
tggagcattaactaaatgctcat

SEQ ID NO: 6520427 - DNA, 21 bp, Homo sapiens
tggagcatttatgtagacatt

SEQ ID NO: 6520428 - DNA, 17 bp, Homo sapiens
tggagcatttttcagag

SEQ ID NO: 6520429 - DNA, 16 bp, Homo sapiens
tggagccaactgctgc

SEQ ID NO: 6520430 - DNA, 20 bp, Homo sapiens
tggagccaaggcagagggga

SEQ ID NO: 6520431 - DNA, 15 bp, Homo sapiens
tggagccaagtccag

SEQ ID NO: 6520432 - DNA, 23 bp, Homo sapiens
tggagccaagtggtccagcgtca

SEQ ID NO: 6520433 - DNA, 18 bp, Homo sapiens
tggagccaatggtgaggg

SEQ ID NO: 6520434 - DNA, 23 bp, Homo sapiens
tggagccaatggtgagggctgag

SEQ ID NO: 6520435 - DNA, 15 bp, Homo sapiens
tggagccacaggcag

SEQ ID NO: 6520436 - DNA, 17 bp, Homo sapiens
ttaagtcgctgaacaat

SEQ ID NO: 6520437 - DNA, 18 bp, Homo sapiens
ttaagtcgggaaattctg

SEQ ID NO: 6520438 - DNA, 24 bp, Homo sapiens
ttaagtcgggaaattctgctgctt

SEQ ID NO: 6520439 - DNA, 17 bp, Homo sapiens
ttaagtctcaattctga

SEQ ID NO: 6520440 - DNA, 23 bp, Homo sapiens
ttaagtctcagactgatttcttg

SEQ ID NO: 6520441 - DNA, 14 bp, Homo sapiens
ttaagtctgtttta

SEQ ID NO: 6520442 - DNA, 17 bp, Homo sapiens
ttaagtctgttttatga

SEQ ID NO: 6520443 - DNA, 18 bp, Homo sapiens
ttaagtctgttttatgac

SEQ ID NO: 6520444 - DNA, 15 bp, Homo sapiens
ttaagtcttccttaa

SEQ ID NO: 6520445 - DNA, 17 bp, Homo sapiens
ttaagtgaaaatatagc

SEQ ID NO: 6520446 - DNA, 14 bp, Homo sapiens
ttaagtgaaattta

SEQ ID NO: 6520447 - DNA, 15 bp, Homo sapiens
ttaagtgaaatttta

SEQ ID NO: 6520448 - DNA, 16 bp, Homo sapiens
ttaagtgaaattttaa

SEQ ID NO: 6520449 - DNA, 21 bp, Homo sapiens
ttaagtgaaattttaaatgca

SEQ ID NO: 6520450 - DNA, 19 bp, Homo sapiens
ttaagtgaatacattaacg

SEQ ID NO: 6520451 - DNA, 16 bp, Homo sapiens
ttaagtgacacagaca

SEQ ID NO: 6520452 - DNA, 11 bp, Homo sapiens
ttaagtgactg

SEQ ID NO: 6520453 - DNA, 16 bp, Homo sapiens
ttaagtgaggaaatca

SEQ ID NO: 6520454 - DNA, 17 bp, Homo sapiens
ttaagtgaggaaatcaa

SEQ ID NO: 6520455 - DNA, 16 bp, Homo sapiens
ttaagtgatgtcattt

SEQ ID NO: 6520456 - DNA, 16 bp, Homo sapiens
ttaagtgcaacatttc

SEQ ID NO: 6520457 - DNA, 20 bp, Homo sapiens
ttaagtgcaacatttctgta

SEQ ID NO: 6520458 - DNA, 21 bp, Homo sapiens
ttaagtgcaacatttctgtat

SEQ ID NO: 6520459 - DNA, 13 bp, Homo sapiens
ttaagtgcagctt

SEQ ID NO: 6520460 - DNA, 17 bp, Homo sapiens
ttaagtgcgtgtgtaga

SEQ ID NO: 6520461 - DNA, 22 bp, Homo sapiens
ttaagtgctgcatttaaaagat

SEQ ID NO: 6520462 - DNA, 19 bp, Homo sapiens
ttaagtgcttcacatttgt

SEQ ID NO: 6520463 - DNA, 17 bp, Homo sapiens
ttaagtggactctctga

SEQ ID NO: 6520464 - DNA, 16 bp, Homo sapiens
ttaagtggactgtatt

SEQ ID NO: 6520465 - DNA, 14 bp, Homo sapiens
ttaagtgggctcct

SEQ ID NO: 6520466 - DNA, 18 bp, Homo sapiens
ttaagtggttactttgtg

SEQ ID NO: 6520467 - DNA, 19 bp, Homo sapiens
ttaagtggttactttgtgt

SEQ ID NO: 6520468 - DNA, 16 bp, Homo sapiens
ttaagtggtttgatca

SEQ ID NO: 6520469 - DNA, 19 bp, Homo sapiens
ttaagtgtaaatgaagtac

SEQ ID NO: 6520470 - DNA, 15 bp, Homo sapiens
ttaagtgtgcagcca

SEQ ID NO: 6520471 - DNA, 21 bp, Homo sapiens
ttaagtgtgtgtatactgtaa

SEQ ID NO: 6520472 - DNA, 16 bp, Homo sapiens
ttaagtgttcatttta

SEQ ID NO: 6520473 - DNA, 22 bp, Homo sapiens
ttaagtgttctgtggctgattt

SEQ ID NO: 6520474 - DNA, 18 bp, Homo sapiens
ttaagtgttggaaaaaat

SEQ ID NO: 6520475 - DNA, 21 bp, Homo sapiens
ttaagtgttgtaaatatttat

SEQ ID NO: 6520476 - DNA, 16 bp, Homo sapiens
ttaagtgttgttcatt

SEQ ID NO: 6520477 - DNA, 13 bp, Homo sapiens
ttaagttaatgaa

SEQ ID NO: 6520478 - DNA, 21 bp, Homo sapiens
ttaagttacaattacatctct

SEQ ID NO: 6520479 - DNA, 15 bp, Homo sapiens
ttaagttacagtttg

SEQ ID NO: 6520480 - DNA, 18 bp, Homo sapiens
ttaagttagggaatggca

SEQ ID NO: 6520481 - DNA, 20 bp, Homo sapiens
ttaagttagttccactgaga

SEQ ID NO: 6520482 - DNA, 11 bp, Homo sapiens
ttaagttattg

SEQ ID NO: 6520483 - DNA, 11 bp, Homo sapiens
ttaagttcaat

SEQ ID NO: 6520484 - DNA, 14 bp, Homo sapiens
ttaagttcactttt

SEQ ID NO: 6520485 - DNA, 14 bp, Homo sapiens
ttaagttcctgctg

SEQ ID NO: 6520486 - DNA, 18 bp, Homo sapiens
ttaagttcctgctgcctg

SEQ ID NO: 6520487 - DNA, 20 bp, Homo sapiens
ttaagttcgaacatgtttca

SEQ ID NO: 6520488 - DNA, 19 bp, Homo sapiens
ttaagttctatcagtgact

SEQ ID NO: 6520489 - DNA, 19 bp, Homo sapiens
ttaagttctcaatgtgaaa

SEQ ID NO: 6520490 - DNA, 22 bp, Homo sapiens
ttaagttctttgatttgtacca

SEQ ID NO: 6520491 - DNA, 14 bp, Homo sapiens
ttaagttgaaaaag

SEQ ID NO: 6520492 - DNA, 11 bp, Homo sapiens
ttaagttgaga

SEQ ID NO: 6520493 - DNA, 22 bp, Homo sapiens
ttaagttgagatagttttcatc

SEQ ID NO: 6520494 - DNA, 18 bp, Homo sapiens
ttaagttgctgatgaact

SEQ ID NO: 6520495 - DNA, 17 bp, Homo sapiens
ttaagttgtaaacgtct

SEQ ID NO: 6520496 - DNA, 16 bp, Homo sapiens
ttaagttgtcaaagaa

SEQ ID NO: 6520497 - DNA, 17 bp, Homo sapiens
ttaagttgttgaaagta

SEQ ID NO: 6520498 - DNA, 18 bp, Homo sapiens
ttaagtttagaaattaca

SEQ ID NO: 6520499 - DNA, 21 bp, Homo sapiens
ttaagtttccttccagcccag

SEQ ID NO: 6520500 - DNA, 15 bp, Homo sapiens
ttaagtttgactaca

SEQ ID NO: 6520501 - DNA, 18 bp, Homo sapiens
ttaagtttgtagtaaaag

SEQ ID NO: 6520502 - DNA, 14 bp, Homo sapiens
ttaagttttcttgt

SEQ ID NO: 6520503 - DNA, 19 bp, Homo sapiens
ttaagttttcttgtttctg

SEQ ID NO: 6520504 - DNA, 21 bp, Homo sapiens
ttaagttttcttgtttctgca

SEQ ID NO: 6520505 - DNA, 23 bp, Homo sapiens
ttaagtttttattcaaagcagct

SEQ ID NO: 6520506 - DNA, 12 bp, Homo sapiens
ttaagtttttca

SEQ ID NO: 6520507 - DNA, 20 bp, Homo sapiens
ttaagtttttctctttttca

SEQ ID NO: 6520508 - DNA, 18 bp, Homo sapiens
ttaagttttttatagaga

SEQ ID NO: 6520509 - DNA, 20 bp, Homo sapiens
ttaataaaaaaacaatcatt

SEQ ID NO: 6520510 - DNA, 21 bp, Homo sapiens
ttaataaaaacttacactctt

SEQ ID NO: 6520511 - DNA, 15 bp, Homo sapiens
ttaataaaaaggcac

SEQ ID NO: 6520512 - DNA, 13 bp, Homo sapiens
ttaataaaaatac

SEQ ID NO: 6520513 - DNA, 19 bp, Homo sapiens
ttaataaaaatacacatga

SEQ ID NO: 6520514 - DNA, 22 bp, Homo sapiens
ttaataaaaatacacatgaaaa

SEQ ID NO: 6520515 - DNA, 14 bp, Homo sapiens
ttaataaaaatcaa

SEQ ID NO: 6520516 - DNA, 19 bp, Homo sapiens
ttaataaaaatgacagact

SEQ ID NO: 6520517 - DNA, 21 bp, Homo sapiens
ttaataaaactgcacagtgct

SEQ ID NO: 6520518 - DNA, 11 bp, Homo sapiens
ttaataaaaga

SEQ ID NO: 6520519 - DNA, 17 bp, Homo sapiens
ttaataaaagaaaatta

SEQ ID NO: 6520520 - DNA, 19 bp, Homo sapiens
ttaataaaagatttacatt

SEQ ID NO: 6520521 - DNA, 20 bp, Homo sapiens
ttaataaaataattctaaag

SEQ ID NO: 6520522 - DNA, 13 bp, Homo sapiens
ttaataaaatgaa

SEQ ID NO: 6520523 - DNA, 13 bp, Homo sapiens
ttaataaacactc

SEQ ID NO: 6520524 - DNA, 18 bp, Homo sapiens
ttaataaacgaagataaa

SEQ ID NO: 6520525 - DNA, 22 bp, Homo sapiens
ttaataaacgaagataaatcat

SEQ ID NO: 6520526 - DNA, 17 bp, Homo sapiens
ttaataaacgtttgaaa

SEQ ID NO: 6520527 - DNA, 16 bp, Homo sapiens
ttaataaactgcaaat

SEQ ID NO: 6520528 - DNA, 22 bp, Homo sapiens
ttaataaacttttttttgagaa

SEQ ID NO: 6520529 - DNA, 14 bp, Homo sapiens
ttaataaagacagg

SEQ ID NO: 6520530 - DNA, 14 bp, Homo sapiens
ttaataaagcattc

SEQ ID NO: 6520531 - DNA, 16 bp, Homo sapiens
ttaataaagcattctt

SEQ ID NO: 6520532 - DNA, 20 bp, Homo sapiens
ttaataaagcgaaaaactca

SEQ ID NO: 6520533 - DNA, 11 bp, Homo sapiens
ttaataaagta

SEQ ID NO: 6520534 - DNA, 15 bp, Homo sapiens
ttaataaagtatatt

SEQ ID NO: 6520535 - DNA, 19 bp, Homo sapiens
ttaataaagtatattgaaa

SEQ ID NO: 6520536 - DNA, 15 bp, Homo sapiens
ttaataaatagagca

SEQ ID NO: 6520537 - DNA, 16 bp, Homo sapiens
ttaataaatagagcaa

SEQ ID NO: 6520538 - DNA, 17 bp, Homo sapiens
ttaataaatatgtaata

SEQ ID NO: 6520539 - DNA, 19 bp, Homo sapiens
ttaataaatcctacagtat

SEQ ID NO: 6520540 - DNA, 11 bp, Homo sapiens
ttaataaatgg

SEQ ID NO: 6520541 - DNA, 18 bp, Homo sapiens
ttaataaatggatactta

SEQ ID NO: 6520542 - DNA, 13 bp, Homo sapiens
ttaataaattgct

SEQ ID NO: 6520543 - DNA, 15 bp, Homo sapiens
ttaataaattgctta

SEQ ID NO: 6520544 - DNA, 22 bp, Homo sapiens
ttaataacaaggagatttctta

SEQ ID NO: 6520545 - DNA, 20 bp, Homo sapiens
ttaataacaatatatagaat

SEQ ID NO: 6520546 - DNA, 12 bp, Homo sapiens
ttaataacaatt

SEQ ID NO: 6520547 - DNA, 13 bp, Homo sapiens
ttaataacagaaa

SEQ ID NO: 6520548 - DNA, 16 bp, Homo sapiens
ttaataacagctcctt

SEQ ID NO: 6520549 - DNA, 19 bp, Homo sapiens
ttaataacataacaaataa

SEQ ID NO: 6520550 - DNA, 15 bp, Homo sapiens
ttaataacattacct

SEQ ID NO: 6520551 - DNA, 20 bp, Homo sapiens
ttaataacccttgaaagtca

SEQ ID NO: 6520552 - DNA, 21 bp, Homo sapiens
ttaataacctgccagtcccag

SEQ ID NO: 6520553 - DNA, 18 bp, Homo sapiens
ttaataactatggtaaat

SEQ ID NO: 6520554 - DNA, 19 bp, Homo sapiens
ttaataactatggtaaata

SEQ ID NO: 6520555 - DNA, 23 bp, Homo sapiens
ttaataactatggtaaataactg

SEQ ID NO: 6520556 - DNA, 19 bp, Homo sapiens
ttaataactgaataaaaaa

SEQ ID NO: 6520557 - DNA, 21 bp, Homo sapiens
ttaataactgaataaaaaata

SEQ ID NO: 6520558 - DNA, 16 bp, Homo sapiens
ttaataacttgtccta

SEQ ID NO: 6520559 - DNA, 19 bp, Homo sapiens
ttaataactttctctgtga

SEQ ID NO: 6520560 - DNA, 20 bp, Homo sapiens
ttaataactttgctggaaaa

SEQ ID NO: 6520561 - DNA, 15 bp, Homo sapiens
ttaataagaacagat

SEQ ID NO: 6520562 - DNA, 18 bp, Homo sapiens
ttaataagatttttcaaa

SEQ ID NO: 6520563 - DNA, 21 bp, Homo sapiens
ttaataagatttttcaaaatc

SEQ ID NO: 6520564 - DNA, 21 bp, Homo sapiens
ttaataagtaattccttctct

SEQ ID NO: 6520565 - DNA, 13 bp, Homo sapiens
ttaataagtctct

SEQ ID NO: 6520566 - DNA, 20 bp, Homo sapiens
ttaataagttgatgttttct

SEQ ID NO: 6520567 - DNA, 21 bp, Homo sapiens
ttaataagttgatgttttcta

SEQ ID NO: 6520568 - DNA, 22 bp, Homo sapiens
ttaataagttgatgttttctaa

SEQ ID NO: 6520569 - DNA, 15 bp, Homo sapiens
ttaataagtttcact

SEQ ID NO: 6520570 - DNA, 17 bp, Homo sapiens
ttaataagtttcactga

SEQ ID NO: 6520571 - DNA, 16 bp, Homo sapiens
ttaataataaagctac

SEQ ID NO: 6520572 - DNA, 16 bp, Homo sapiens
ttaataataagataat

SEQ ID NO: 6520573 - DNA, 13 bp, Homo sapiens
ttaataataatta

SEQ ID NO: 6520574 - DNA, 18 bp, Homo sapiens
ttaataatatacttgtgg

SEQ ID NO: 6520575 - DNA, 14 bp, Homo sapiens
ttaataatatgtac

SEQ ID NO: 6520576 - DNA, 16 bp, Homo sapiens
ttaataatatgtacaa

SEQ ID NO: 6520577 - DNA, 20 bp, Homo sapiens
ttaataatatgtacaaataa

SEQ ID NO: 6520578 - DNA, 20 bp, Homo sapiens
ttaataatcaagagccttaa

SEQ ID NO: 6520579 - DNA, 20 bp, Homo sapiens
ttaataatctcacatataca

SEQ ID NO: 6520580 - DNA, 14 bp, Homo sapiens
ttaataatgcttta

SEQ ID NO: 6520581 - DNA, 18 bp, Homo sapiens
ttaataatgtttcaaaca

SEQ ID NO: 6520582 - DNA, 21 bp, Homo sapiens
ttaataattagaaacaccaaa

SEQ ID NO: 6520583 - DNA, 20 bp, Homo sapiens
ttaataatttttacctaatc

SEQ ID NO: 6520584 - DNA, 19 bp, Homo sapiens
ttaatacaaggtataataa

SEQ ID NO: 6520585 - DNA, 19 bp, Homo sapiens
ttaatacaagtaatattat

SEQ ID NO: 6520586 - DNA, 17 bp, Homo sapiens
ttaatacaatattaatt

SEQ ID NO: 6520587 - DNA, 21 bp, Homo sapiens
ttaatacaatattaattataa

SEQ ID NO: 6520588 - DNA, 21 bp, Homo sapiens
ttaatacaatgatgctatttg

SEQ ID NO: 6520589 - DNA, 16 bp, Homo sapiens
ttaatacacaatgcat

SEQ ID NO: 6520590 - DNA, 21 bp, Homo sapiens
ttaatacagataagtgttctt

SEQ ID NO: 6520591 - DNA, 18 bp, Homo sapiens
ttaatacagattgaaagg

SEQ ID NO: 6520592 - DNA, 16 bp, Homo sapiens
ttaatacaggaacaca

SEQ ID NO: 6520593 - DNA, 14 bp, Homo sapiens
ttaatacatcacat

SEQ ID NO: 6520594 - DNA, 21 bp, Homo sapiens
ttaatacatgcaacagaagtg

SEQ ID NO: 6520595 - DNA, 19 bp, Homo sapiens
ttaataccacaaacactgt

SEQ ID NO: 6520596 - DNA, 21 bp, Homo sapiens
ttaataccatacccagatgtt

SEQ ID NO: 6520597 - DNA, 19 bp, Homo sapiens
ttaataccctgcaatgtaa

SEQ ID NO: 6520598 - DNA, 19 bp, Homo sapiens
ttaatacctttggaaaaat

SEQ ID NO: 6520599 - DNA, 15 bp, Homo sapiens
ttaatactaattttc

SEQ ID NO: 6520600 - DNA, 19 bp, Homo sapiens
ttaatactataaataatat

SEQ ID NO: 6520601 - DNA, 22 bp, Homo sapiens
ttaatactcatccttgtataaa

SEQ ID NO: 6520602 - DNA, 21 bp, Homo sapiens
ttaatactgaatttctttgat

SEQ ID NO: 6520603 - DNA, 14 bp, Homo sapiens
ttaatactgtgtta

SEQ ID NO: 6520604 - DNA, 23 bp, Homo sapiens
ttaatactgttattctttgcact

SEQ ID NO: 6520605 - DNA, 22 bp, Homo sapiens
ttaatacttaacattgatttat

SEQ ID NO: 6520606 - DNA, 21 bp, Homo sapiens
ttaatacttccttataaaaat

SEQ ID NO: 6520607 - DNA, 23 bp, Homo sapiens
ttaatactttttacccaaatatg

SEQ ID NO: 6520608 - DNA, 17 bp, Homo sapiens
ttaatagaaaattaaaa

SEQ ID NO: 6520609 - DNA, 21 bp, Homo sapiens
ttaatagaaaattaaaataac

SEQ ID NO: 6520610 - DNA, 15 bp, Homo sapiens
ttaatagaatatact

SEQ ID NO: 6520611 - DNA, 21 bp, Homo sapiens
ttaatagacttctcttacatt

SEQ ID NO: 6520612 - DNA, 20 bp, Homo sapiens
ttaatagagaaggaaagctt

SEQ ID NO: 6520613 - DNA, 16 bp, Homo sapiens
tggagccacaggcaga

SEQ ID NO: 6520614 - DNA, 17 bp, Homo sapiens
tggagccacctgtccca

SEQ ID NO: 6520615 - DNA, 17 bp, Homo sapiens
tggagccactcctgtcc

SEQ ID NO: 6520616 - DNA, 23 bp, Homo sapiens
tggagccactcctgtcccgcctt

SEQ ID NO: 6520617 - DNA, 15 bp, Homo sapiens
tggagccagcagggc

SEQ ID NO: 6520618 - DNA, 16 bp, Homo sapiens
tggagccagcagggct

SEQ ID NO: 6520619 - DNA, 18 bp, Homo sapiens
tggagccaggatgggtct

SEQ ID NO: 6520620 - DNA, 15 bp, Homo sapiens
tggagccagggcaga

SEQ ID NO: 6520621 - DNA, 19 bp, Homo sapiens
tggagccagggcagaggaa

SEQ ID NO: 6520622 - DNA, 13 bp, Homo sapiens
tggagccagggcc

SEQ ID NO: 6520623 - DNA, 22 bp, Homo sapiens
tggagccatcccttcggagcca

SEQ ID NO: 6520624 - DNA, 16 bp, Homo sapiens
tggagcccactgtact

SEQ ID NO: 6520625 - DNA, 15 bp, Homo sapiens
tggagcccagaggag

SEQ ID NO: 6520626 - DNA, 21 bp, Homo sapiens
tggagcccagcgtcagaagtc

SEQ ID NO: 6520627 - DNA, 22 bp, Homo sapiens
tggagcccaggcgggagcggtg

SEQ ID NO: 6520628 - DNA, 15 bp, Homo sapiens
tggagcccagggagc

SEQ ID NO: 6520629 - DNA, 22 bp, Homo sapiens
tggagcccagggcatcttgctg

SEQ ID NO: 6520630 - DNA, 13 bp, Homo sapiens
tggagccccacct

SEQ ID NO: 6520631 - DNA, 16 bp, Homo sapiens
tggagccccactgccc

SEQ ID NO: 6520632 - DNA, 22 bp, Homo sapiens
tggagccccactgcccttctca

SEQ ID NO: 6520633 - DNA, 14 bp, Homo sapiens
tggagccccagccc

SEQ ID NO: 6520634 - DNA, 12 bp, Homo sapiens
tggagccccagg

SEQ ID NO: 6520635 - DNA, 14 bp, Homo sapiens
tggagccccatcag

SEQ ID NO: 6520636 - DNA, 14 bp, Homo sapiens
tggagccccatcgc

SEQ ID NO: 6520637 - DNA, 12 bp, Homo sapiens
tggagcccccag

SEQ ID NO: 6520638 - DNA, 21 bp, Homo sapiens
tggagcccccagcagaggcag

SEQ ID NO: 6520639 - DNA, 12 bp, Homo sapiens
tggagccccctg

SEQ ID NO: 6520640 - DNA, 14 bp, Homo sapiens
tggagccccctggc

SEQ ID NO: 6520641 - DNA, 15 bp, Homo sapiens
tggagccccctggcg

SEQ ID NO: 6520642 - DNA, 17 bp, Homo sapiens
tggagccccctggcggc

SEQ ID NO: 6520643 - DNA, 15 bp, Homo sapiens
tggagcccctcctcc

SEQ ID NO: 6520644 - DNA, 13 bp, Homo sapiens
tggagcccctggg

SEQ ID NO: 6520645 - DNA, 14 bp, Homo sapiens
tggagcccctgggt

SEQ ID NO: 6520646 - DNA, 16 bp, Homo sapiens
tggagcccctgtgtgg

SEQ ID NO: 6520647 - DNA, 13 bp, Homo sapiens
tggagccccttcg

SEQ ID NO: 6520648 - DNA, 17 bp, Homo sapiens
tggagcccgaggcacca

SEQ ID NO: 6520649 - DNA, 16 bp, Homo sapiens
tggagcccgcaccccc

SEQ ID NO: 6520650 - DNA, 23 bp, Homo sapiens
tggagcccgcctgcgccccccag

SEQ ID NO: 6520651 - DNA, 18 bp, Homo sapiens
tggagcccggcagtgcac

SEQ ID NO: 6520652 - DNA, 13 bp, Homo sapiens
tggagcccgtgca

SEQ ID NO: 6520653 - DNA, 15 bp, Homo sapiens
tggagcccgtgcagt

SEQ ID NO: 6520654 - DNA, 15 bp, Homo sapiens
tggagccctccgcct

SEQ ID NO: 6520655 - DNA, 19 bp, Homo sapiens
tggagccctccgccttcac

SEQ ID NO: 6520656 - DNA, 11 bp, Homo sapiens
tggagccctgt

SEQ ID NO: 6520657 - DNA, 21 bp, Homo sapiens
tggagccctgttggcagctct

SEQ ID NO: 6520658 - DNA, 20 bp, Homo sapiens
tggagccgcttccccagctc

SEQ ID NO: 6520659 - DNA, 22 bp, Homo sapiens
tggagccggactttcggagttg

SEQ ID NO: 6520660 - DNA, 18 bp, Homo sapiens
tggagccgggaaagctgt

SEQ ID NO: 6520661 - DNA, 18 bp, Homo sapiens
tggagcctacattccttg

SEQ ID NO: 6520662 - DNA, 19 bp, Homo sapiens
tggagcctacctctgtctg

SEQ ID NO: 6520663 - DNA, 17 bp, Homo sapiens
tggagcctcagcagcaa

SEQ ID NO: 6520664 - DNA, 18 bp, Homo sapiens
tggagcctcggtggccat

SEQ ID NO: 6520665 - DNA, 21 bp, Homo sapiens
tggagcctcggtggccatgct

SEQ ID NO: 6520666 - DNA, 21 bp, Homo sapiens
tggagcctctttttccttctt

SEQ ID NO: 6520667 - DNA, 18 bp, Homo sapiens
tggagcctgacagccaga

SEQ ID NO: 6520668 - DNA, 21 bp, Homo sapiens
tggagcctgagtcagggccca

SEQ ID NO: 6520669 - DNA, 23 bp, Homo sapiens
tggagcctgcagggtggtgctgg

SEQ ID NO: 6520670 - DNA, 14 bp, Homo sapiens
tggagcctgccaag

SEQ ID NO: 6520671 - DNA, 14 bp, Homo sapiens
tggagcctgccgcc

SEQ ID NO: 6520672 - DNA, 23 bp, Homo sapiens
tggagcctgccgcccccgcctgg

SEQ ID NO: 6520673 - DNA, 14 bp, Homo sapiens
tggagcctggcaca

SEQ ID NO: 6520674 - DNA, 19 bp, Homo sapiens
tggagcctggcacaggact

SEQ ID NO: 6520675 - DNA, 21 bp, Homo sapiens
tggagcctggcacaggactga

SEQ ID NO: 6520676 - DNA, 14 bp, Homo sapiens
tggagcctggggtg

SEQ ID NO: 6520677 - DNA, 14 bp, Homo sapiens
tggagcctgtgtaa

SEQ ID NO: 6520678 - DNA, 16 bp, Homo sapiens
tggagcctgtgtaaca

SEQ ID NO: 6520679 - DNA, 21 bp, Homo sapiens
tggagcgcacctgccccctgg

SEQ ID NO: 6520680 - DNA, 16 bp, Homo sapiens
tggagcggagatgagg

SEQ ID NO: 6520681 - DNA, 15 bp, Homo sapiens
tggagcggagcttgc

SEQ ID NO: 6520682 - DNA, 22 bp, Homo sapiens
tggagcggctcatcagaactga

SEQ ID NO: 6520683 - DNA, 16 bp, Homo sapiens
tggagcggctctcctg

SEQ ID NO: 6520684 - DNA, 13 bp, Homo sapiens
tggagcggctgct

SEQ ID NO: 6520685 - DNA, 18 bp, Homo sapiens
tggagcggggcccacccg

SEQ ID NO: 6520686 - DNA, 18 bp, Homo sapiens
tggagcggggtatgaaga

SEQ ID NO: 6520687 - DNA, 19 bp, Homo sapiens
tggagcgtccttgtccccg

SEQ ID NO: 6520688 - DNA, 21 bp, Homo sapiens
tggagcgtccttgtccccgcc

SEQ ID NO: 6520689 - DNA, 22 bp, Homo sapiens
tggagctaaggccagctagagc

SEQ ID NO: 6520690 - DNA, 22 bp, Homo sapiens
tggagctacactcattgaaatg

SEQ ID NO: 6520691 - DNA, 22 bp, Homo sapiens
tggagctactccccacctccca

SEQ ID NO: 6520692 - DNA, 22 bp, Homo sapiens
tggagctagagaggggcctctg

SEQ ID NO: 6520693 - DNA, 17 bp, Homo sapiens
tggagctatcagtgctt

SEQ ID NO: 6520694 - DNA, 18 bp, Homo sapiens
tggagctcagagagggca

SEQ ID NO: 6520695 - DNA, 12 bp, Homo sapiens
tggagctcagcc

SEQ ID NO: 6520696 - DNA, 17 bp, Homo sapiens
tggagctcagggtcctt

SEQ ID NO: 6520697 - DNA, 12 bp, Homo sapiens
tggagctcaggt

SEQ ID NO: 6520698 - DNA, 20 bp, Homo sapiens
tggagctcatgtcagccgtg

SEQ ID NO: 6520699 - DNA, 17 bp, Homo sapiens
tggagctccactgccat

SEQ ID NO: 6520700 - DNA, 19 bp, Homo sapiens
tggagctccactgccatgt

SEQ ID NO: 6520701 - DNA, 13 bp, Homo sapiens
tggagctcctccc

SEQ ID NO: 6520702 - DNA, 17 bp, Homo sapiens
tggagctcctccctcca

SEQ ID NO: 6520703 - DNA, 20 bp, Homo sapiens
tggagctcctccctccagct

SEQ ID NO: 6520704 - DNA, 21 bp, Homo sapiens
tggagctcctccctccagctg

SEQ ID NO: 6520705 - DNA, 22 bp, Homo sapiens
tggagctcctccctccagctgc

SEQ ID NO: 6520706 - DNA, 14 bp, Homo sapiens
tggagctcctggga

SEQ ID NO: 6520707 - DNA, 18 bp, Homo sapiens
tggagctcctgggaaggc

SEQ ID NO: 6520708 - DNA, 20 bp, Homo sapiens
tggagctcctgggaaggcta

SEQ ID NO: 6520709 - DNA, 13 bp, Homo sapiens
tggagctcgcccc

SEQ ID NO: 6520710 - DNA, 17 bp, Homo sapiens
tggagctcgcccctccc

SEQ ID NO: 6520711 - DNA, 20 bp, Homo sapiens
tggagctcgcccctcccctc

SEQ ID NO: 6520712 - DNA, 21 bp, Homo sapiens
tggagctcgtggaacagttac

SEQ ID NO: 6520713 - DNA, 16 bp, Homo sapiens
tggagctctggggggc

SEQ ID NO: 6520714 - DNA, 22 bp, Homo sapiens
tggagctctgtgggtctctgga

SEQ ID NO: 6520715 - DNA, 21 bp, Homo sapiens
tggagctcttgggtcagagaa

SEQ ID NO: 6520716 - DNA, 20 bp, Homo sapiens
tggagctgaattttctggaa

SEQ ID NO: 6520717 - DNA, 14 bp, Homo sapiens
tggagctgagaaga

SEQ ID NO: 6520718 - DNA, 19 bp, Homo sapiens
tggagctgagaagaggagg

SEQ ID NO: 6520719 - DNA, 23 bp, Homo sapiens
tggagctgagaagaggaggaggt

SEQ ID NO: 6520720 - DNA, 17 bp, Homo sapiens
tggagctgagcctctca

SEQ ID NO: 6520721 - DNA, 19 bp, Homo sapiens
tggagctgagctacctggg

SEQ ID NO: 6520722 - DNA, 20 bp, Homo sapiens
tggagctgagctacctgggg

SEQ ID NO: 6520723 - DNA, 14 bp, Homo sapiens
tggagctgaggaat

SEQ ID NO: 6520724 - DNA, 16 bp, Homo sapiens
tggagctgccacagag

SEQ ID NO: 6520725 - DNA, 22 bp, Homo sapiens
tggagctgctaagctaaagaaa

SEQ ID NO: 6520726 - DNA, 23 bp, Homo sapiens
tggagctgctaagctaaagaaac

SEQ ID NO: 6520727 - DNA, 14 bp, Homo sapiens
tggagctgcttcca

SEQ ID NO: 6520728 - DNA, 18 bp, Homo sapiens
tggagctggcgtctgtct

SEQ ID NO: 6520729 - DNA, 22 bp, Homo sapiens
tggagctggtctgccaggggct

SEQ ID NO: 6520730 - DNA, 15 bp, Homo sapiens
tggagctgtcacctc

SEQ ID NO: 6520731 - DNA, 16 bp, Homo sapiens
tggagctgtcacctct

SEQ ID NO: 6520732 - DNA, 20 bp, Homo sapiens
tggagctgtcacctctcagc

SEQ ID NO: 6520733 - DNA, 14 bp, Homo sapiens
tggagctgtcatca

SEQ ID NO: 6520734 - DNA, 14 bp, Homo sapiens
tggagctgtctgtc

SEQ ID NO: 6520735 - DNA, 17 bp, Homo sapiens
tggagcttaagccactg

SEQ ID NO: 6520736 - DNA, 18 bp, Homo sapiens
tggagcttaagccactgc

SEQ ID NO: 6520737 - DNA, 20 bp, Homo sapiens
tggagcttaagccactgcct

SEQ ID NO: 6520738 - DNA, 22 bp, Homo sapiens
tggagcttacacttaaaagaaa

SEQ ID NO: 6520739 - DNA, 17 bp, Homo sapiens
tggagcttcagccaggt

SEQ ID NO: 6520740 - DNA, 16 bp, Homo sapiens
tggagcttcatcgggg

SEQ ID NO: 6520741 - DNA, 22 bp, Homo sapiens
tggagcttgaaatagtgtctga

SEQ ID NO: 6520742 - DNA, 21 bp, Homo sapiens
tggagcttggagccccctggc

SEQ ID NO: 6520743 - DNA, 20 bp, Homo sapiens
tggagcttttaaaaatgttt

SEQ ID NO: 6520744 - DNA, 16 bp, Homo sapiens
tggagcttttttcttt

SEQ ID NO: 6520745 - DNA, 16 bp, Homo sapiens
tggaggaaaaaggtca

SEQ ID NO: 6520746 - DNA, 21 bp, Homo sapiens
tggaggaaaaccaagccgtgg

SEQ ID NO: 6520747 - DNA, 19 bp, Homo sapiens
tggaggaaatgttggaact

SEQ ID NO: 6520748 - DNA, 22 bp, Homo sapiens
tggaggaacagctccctagtgg

SEQ ID NO: 6520749 - DNA, 17 bp, Homo sapiens
tggaggaagaactgaaa

SEQ ID NO: 6520750 - DNA, 20 bp, Homo sapiens
tggaggaagaactgaaaggc

SEQ ID NO: 6520751 - DNA, 16 bp, Homo sapiens
tggaggaagagccacc

SEQ ID NO: 6520752 - DNA, 17 bp, Homo sapiens
tggaggaagagccacct

SEQ ID NO: 6520753 - DNA, 18 bp, Homo sapiens
tggaggaagagccacctg

SEQ ID NO: 6520754 - DNA, 18 bp, Homo sapiens
tggaggaaggaaacaaca

SEQ ID NO: 6520755 - DNA, 13 bp, Homo sapiens
tggaggaaggatt

SEQ ID NO: 6520756 - DNA, 20 bp, Homo sapiens
tggaggaaggattgtaaaaa

SEQ ID NO: 6520757 - DNA, 11 bp, Homo sapiens
tggaggaaggc

SEQ ID NO: 6520758 - DNA, 16 bp, Homo sapiens
tggaggaaggctctgt

SEQ ID NO: 6520759 - DNA, 21 bp, Homo sapiens
tggaggaaggctctgtcactc

SEQ ID NO: 6520760 - DNA, 14 bp, Homo sapiens
tggaggaagggctg

SEQ ID NO: 6520761 - DNA, 16 bp, Homo sapiens
tggaggaagggctggg

SEQ ID NO: 6520762 - DNA, 17 bp, Homo sapiens
tggaggaagggctgggc

SEQ ID NO: 6520763 - DNA, 20 bp, Homo sapiens
tggaggaagggctgggccac

SEQ ID NO: 6520764 - DNA, 21 bp, Homo sapiens
tggaggaaggggggttgcagt

SEQ ID NO: 6520765 - DNA, 15 bp, Homo sapiens
tggaggaaggtgctg

SEQ ID NO: 6520766 - DNA, 16 bp, Homo sapiens
tggaggaaggtgctga

SEQ ID NO: 6520767 - DNA, 17 bp, Homo sapiens
tggaggaaggtgctgag

SEQ ID NO: 6520768 - DNA, 19 bp, Homo sapiens
tggaggaaggtgctgagct

SEQ ID NO: 6520769 - DNA, 17 bp, Homo sapiens
tggaggaatcactgggg

SEQ ID NO: 6520770 - DNA, 16 bp, Homo sapiens
tggaggaatgctcccc

SEQ ID NO: 6520771 - DNA, 17 bp, Homo sapiens
tggaggaccccgagggc

SEQ ID NO: 6520772 - DNA, 22 bp, Homo sapiens
tggaggaccccgagggctgagg

SEQ ID NO: 6520773 - DNA, 16 bp, Homo sapiens
tggaggaccgttctct

SEQ ID NO: 6520774 - DNA, 21 bp, Homo sapiens
tggaggaccgttctctgtccc

SEQ ID NO: 6520775 - DNA, 13 bp, Homo sapiens
tggaggacctgag

SEQ ID NO: 6520776 - DNA, 15 bp, Homo sapiens
tggaggacctgagcc

SEQ ID NO: 6520777 - DNA, 19 bp, Homo sapiens
tggaggacctgagcctgcc

SEQ ID NO: 6520778 - DNA, 16 bp, Homo sapiens
tggaggaccttaaatg

SEQ ID NO: 6520779 - DNA, 22 bp, Homo sapiens
tggaggactctagaagctcagg

SEQ ID NO: 6520780 - DNA, 13 bp, Homo sapiens
tggaggagaaata

SEQ ID NO: 6520781 - DNA, 14 bp, Homo sapiens
tggaggagaagaat

SEQ ID NO: 6520782 - DNA, 13 bp, Homo sapiens
tggaggagaagga

SEQ ID NO: 6520783 - DNA, 14 bp, Homo sapiens
tggaggagaaggag

SEQ ID NO: 6520784 - DNA, 20 bp, Homo sapiens
tggaggagaaggaggaaccc

SEQ ID NO: 6520785 - DNA, 17 bp, Homo sapiens
tggaggagactgggcac

SEQ ID NO: 6520786 - DNA, 15 bp, Homo sapiens
tggaggagagagacc

SEQ ID NO: 6520787 - DNA, 15 bp, Homo sapiens
tggaggagagagcct

SEQ ID NO: 6520788 - DNA, 16 bp, Homo sapiens
tggaggagagagcctt

SEQ ID NO: 6520789 - DNA, 11 bp, Homo sapiens
tggaggagagc

SEQ ID NO: 6520790 - DNA, 13 bp, Homo sapiens
tggaggagaggag

SEQ ID NO: 6520791 - DNA, 16 bp, Homo sapiens
tggaggagcaaaggct

SEQ ID NO: 6520792 - DNA, 23 bp, Homo sapiens
ttaatagagaaggaaagctttgg

SEQ ID NO: 6520793 - DNA, 22 bp, Homo sapiens
ttaatagagatgaatcagtttt

SEQ ID NO: 6520794 - DNA, 21 bp, Homo sapiens
ttaatagaggagctgcttgtt

SEQ ID NO: 6520795 - DNA, 11 bp, Homo sapiens
ttaatagagtt

SEQ ID NO: 6520796 - DNA, 16 bp, Homo sapiens
ttaatagagttggagt

SEQ ID NO: 6520797 - DNA, 17 bp, Homo sapiens
ttaatagattatttcat

SEQ ID NO: 6520798 - DNA, 18 bp, Homo sapiens
ttaatagattatttcata

SEQ ID NO: 6520799 - DNA, 22 bp, Homo sapiens
ttaatagattatttcatatact

SEQ ID NO: 6520800 - DNA, 14 bp, Homo sapiens
ttaatagatttggg

SEQ ID NO: 6520801 - DNA, 15 bp, Homo sapiens
ttaatagcaaagaat

SEQ ID NO: 6520802 - DNA, 19 bp, Homo sapiens
ttaatagcaacagagcact

SEQ ID NO: 6520803 - DNA, 14 bp, Homo sapiens
ttaatagcagcctt

SEQ ID NO: 6520804 - DNA, 16 bp, Homo sapiens
ttaatagcagcctttc

SEQ ID NO: 6520805 - DNA, 22 bp, Homo sapiens
ttaatagcagcctttctctctt

SEQ ID NO: 6520806 - DNA, 21 bp, Homo sapiens
ttaatagccaaagatttcata

SEQ ID NO: 6520807 - DNA, 16 bp, Homo sapiens
ttaatagcctgtcata

SEQ ID NO: 6520808 - DNA, 16 bp, Homo sapiens
ttaatagctgtgatca

SEQ ID NO: 6520809 - DNA, 20 bp, Homo sapiens
ttaatagcttttattgtata

SEQ ID NO: 6520810 - DNA, 17 bp, Homo sapiens
ttaataggataaattaa

SEQ ID NO: 6520811 - DNA, 13 bp, Homo sapiens
ttaataggatttt

SEQ ID NO: 6520812 - DNA, 17 bp, Homo sapiens
ttaataggcttgtgtaa

SEQ ID NO: 6520813 - DNA, 16 bp, Homo sapiens
ttaataggtaaaccaa

SEQ ID NO: 6520814 - DNA, 21 bp, Homo sapiens
ttaataggtttggacaaaatg

SEQ ID NO: 6520815 - DNA, 24 bp, Homo sapiens
ttaatagtacccaacctggtaatt

SEQ ID NO: 6520816 - DNA, 19 bp, Homo sapiens
ttaatagtgttaatcaatt

SEQ ID NO: 6520817 - DNA, 13 bp, Homo sapiens
ttaatagtttcta

SEQ ID NO: 6520818 - DNA, 23 bp, Homo sapiens
ttaatataaagtagtcctgtgaa

SEQ ID NO: 6520819 - DNA, 21 bp, Homo sapiens
ttaatataaagttttatatat

SEQ ID NO: 6520820 - DNA, 14 bp, Homo sapiens
ttaatataaattca

SEQ ID NO: 6520821 - DNA, 15 bp, Homo sapiens
ttaatataactgtct

SEQ ID NO: 6520822 - DNA, 16 bp, Homo sapiens
ttaatataagtttctt

SEQ ID NO: 6520823 - DNA, 15 bp, Homo sapiens
ttaatataatttaac

SEQ ID NO: 6520824 - DNA, 19 bp, Homo sapiens
ttaatatacaatctatctt

SEQ ID NO: 6520825 - DNA, 14 bp, Homo sapiens
ttaatatactcctt

SEQ ID NO: 6520826 - DNA, 16 bp, Homo sapiens
ttaatatatacatttt

SEQ ID NO: 6520827 - DNA, 20 bp, Homo sapiens
ttaatatatattatcttttc

SEQ ID NO: 6520828 - DNA, 16 bp, Homo sapiens
ttaatatatcaatatt

SEQ ID NO: 6520829 - DNA, 18 bp, Homo sapiens
ttaatatatcattatctt

SEQ ID NO: 6520830 - DNA, 13 bp, Homo sapiens
ttaatatattaag

SEQ ID NO: 6520831 - DNA, 16 bp, Homo sapiens
ttaatatattgaataa

SEQ ID NO: 6520832 - DNA, 13 bp, Homo sapiens
ttaatatatttcc

SEQ ID NO: 6520833 - DNA, 14 bp, Homo sapiens
ttaatatatttcca

SEQ ID NO: 6520834 - DNA, 15 bp, Homo sapiens
ttaatatattttttg

SEQ ID NO: 6520835 - DNA, 18 bp, Homo sapiens
ttaatatcacagcataac

SEQ ID NO: 6520836 - DNA, 21 bp, Homo sapiens
ttaatatctattccatttgta

SEQ ID NO: 6520837 - DNA, 22 bp, Homo sapiens
ttaatatctgagaagtgtatat

SEQ ID NO: 6520838 - DNA, 18 bp, Homo sapiens
ttaatatctgatactgta

SEQ ID NO: 6520839 - DNA, 20 bp, Homo sapiens
ttaatatctggcactgttaa

SEQ ID NO: 6520840 - DNA, 13 bp, Homo sapiens
ttaatatgaaatt

SEQ ID NO: 6520841 - DNA, 15 bp, Homo sapiens
ttaatatgagcttca

SEQ ID NO: 6520842 - DNA, 13 bp, Homo sapiens
ttaatatgcatct

SEQ ID NO: 6520843 - DNA, 18 bp, Homo sapiens
ttaatatgctgcaacaaa

SEQ ID NO: 6520844 - DNA, 12 bp, Homo sapiens
ttaatatggatt

SEQ ID NO: 6520845 - DNA, 17 bp, Homo sapiens
ttaatatggatttgtta

SEQ ID NO: 6520846 - DNA, 16 bp, Homo sapiens
ttaatatggtgacttt

SEQ ID NO: 6520847 - DNA, 17 bp, Homo sapiens
ttaatatggtgtatttt

SEQ ID NO: 6520848 - DNA, 13 bp, Homo sapiens
ttaatatgtattt

SEQ ID NO: 6520849 - DNA, 21 bp, Homo sapiens
ttaatatgtgctgaacattgt

SEQ ID NO: 6520850 - DNA, 13 bp, Homo sapiens
ttaatattaaagc

SEQ ID NO: 6520851 - DNA, 21 bp, Homo sapiens
ttaatattaaagccatgttta

SEQ ID NO: 6520852 - DNA, 22 bp, Homo sapiens
ttaatattaaagccatgtttat

SEQ ID NO: 6520853 - DNA, 17 bp, Homo sapiens
ttaatattaacttttaa

SEQ ID NO: 6520854 - DNA, 14 bp, Homo sapiens
ttaatattaattta

SEQ ID NO: 6520855 - DNA, 15 bp, Homo sapiens
ttaatattaatttat

SEQ ID NO: 6520856 - DNA, 22 bp, Homo sapiens
ttaatattactcagcacagaga

SEQ ID NO: 6520857 - DNA, 19 bp, Homo sapiens
ttaatattagcttgcttaa

SEQ ID NO: 6520858 - DNA, 23 bp, Homo sapiens
ttaatattatataggatattgct

SEQ ID NO: 6520859 - DNA, 13 bp, Homo sapiens
ttaatattattat

SEQ ID NO: 6520860 - DNA, 18 bp, Homo sapiens
ttaatattcccattttat

SEQ ID NO: 6520861 - DNA, 18 bp, Homo sapiens
ttaatattcttcaaatgt

SEQ ID NO: 6520862 - DNA, 14 bp, Homo sapiens
ttaatattcttttg

SEQ ID NO: 6520863 - DNA, 23 bp, Homo sapiens
ttaatattcttttgtttccatgg

SEQ ID NO: 6520864 - DNA, 22 bp, Homo sapiens
ttaatattgatatgcttataca

SEQ ID NO: 6520865 - DNA, 17 bp, Homo sapiens
ttaatattgatgtcagt

SEQ ID NO: 6520866 - DNA, 22 bp, Homo sapiens
ttaatatttaaacagcagtgtt

SEQ ID NO: 6520867 - DNA, 16 bp, Homo sapiens
ttaatatttaacatta

SEQ ID NO: 6520868 - DNA, 17 bp, Homo sapiens
ttaatatttaccaaagt

SEQ ID NO: 6520869 - DNA, 20 bp, Homo sapiens
ttaatatttaccaaagtagg

SEQ ID NO: 6520870 - DNA, 14 bp, Homo sapiens
ttaatatttcttca

SEQ ID NO: 6520871 - DNA, 12 bp, Homo sapiens
ttaatatttgct

SEQ ID NO: 6520872 - DNA, 12 bp, Homo sapiens
ttaatatttgtt

SEQ ID NO: 6520873 - DNA, 16 bp, Homo sapiens
ttaatattttatgtgt

SEQ ID NO: 6520874 - DNA, 17 bp, Homo sapiens
ttaatattttatgtgta

SEQ ID NO: 6520875 - DNA, 16 bp, Homo sapiens
ttaatattttgtaata

SEQ ID NO: 6520876 - DNA, 15 bp, Homo sapiens
ttaatattttgtatt

SEQ ID NO: 6520877 - DNA, 16 bp, Homo sapiens
ttaatcaacagaagta

SEQ ID NO: 6520878 - DNA, 17 bp, Homo sapiens
ttaatcaactttcctta

SEQ ID NO: 6520879 - DNA, 16 bp, Homo sapiens
ttaatcaagagaaact

SEQ ID NO: 6520880 - DNA, 17 bp, Homo sapiens
ttaatcaagagaaactt

SEQ ID NO: 6520881 - DNA, 14 bp, Homo sapiens
ttaatcaagagaga

SEQ ID NO: 6520882 - DNA, 21 bp, Homo sapiens
ttaatcaagatttttttcctg

SEQ ID NO: 6520883 - DNA, 22 bp, Homo sapiens
ttaatcaagtacctatattgat

SEQ ID NO: 6520884 - DNA, 19 bp, Homo sapiens
ttaatcaatatttaagaga

SEQ ID NO: 6520885 - DNA, 16 bp, Homo sapiens
ttaatcaatgtgacat

SEQ ID NO: 6520886 - DNA, 16 bp, Homo sapiens
ttaatcaattaatttt

SEQ ID NO: 6520887 - DNA, 18 bp, Homo sapiens
ttaatcaatttaaaccca

SEQ ID NO: 6520888 - DNA, 20 bp, Homo sapiens
ttaatcacattttgtatgga

SEQ ID NO: 6520889 - DNA, 15 bp, Homo sapiens
ttaatcactactgta

SEQ ID NO: 6520890 - DNA, 17 bp, Homo sapiens
ttaatcactattgttcc

SEQ ID NO: 6520891 - DNA, 17 bp, Homo sapiens
ttaatcactgtgtatat

SEQ ID NO: 6520892 - DNA, 20 bp, Homo sapiens
ttaatcactgtgtatatttg

SEQ ID NO: 6520893 - DNA, 15 bp, Homo sapiens
ttaatcacttaacat

SEQ ID NO: 6520894 - DNA, 20 bp, Homo sapiens
ttaatcacttaacattccta

SEQ ID NO: 6520895 - DNA, 20 bp, Homo sapiens
ttaatcagctgttgcaggca

SEQ ID NO: 6520896 - DNA, 20 bp, Homo sapiens
ttaatcaggtcctcagagaa

SEQ ID NO: 6520897 - DNA, 13 bp, Homo sapiens
ttaatcagtgaag

SEQ ID NO: 6520898 - DNA, 12 bp, Homo sapiens
ttaatcagtgtg

SEQ ID NO: 6520899 - DNA, 12 bp, Homo sapiens
ttaatcagtgtt

SEQ ID NO: 6520900 - DNA, 13 bp, Homo sapiens
ttaatcagtgttg

SEQ ID NO: 6520901 - DNA, 14 bp, Homo sapiens
ttaatcagtgttga

SEQ ID NO: 6520902 - DNA, 15 bp, Homo sapiens
ttaatcagtgttgat

SEQ ID NO: 6520903 - DNA, 18 bp, Homo sapiens
ttaatcagtttctgaaat

SEQ ID NO: 6520904 - DNA, 13 bp, Homo sapiens
ttaatcatataaa

SEQ ID NO: 6520905 - DNA, 19 bp, Homo sapiens
ttaatcatataaatagaat

SEQ ID NO: 6520906 - DNA, 16 bp, Homo sapiens
ttaatcatatttgaaa

SEQ ID NO: 6520907 - DNA, 17 bp, Homo sapiens
ttaatcatcaagagaat

SEQ ID NO: 6520908 - DNA, 15 bp, Homo sapiens
ttaatcatctataaa

SEQ ID NO: 6520909 - DNA, 18 bp, Homo sapiens
ttaatcatctataaagaa

SEQ ID NO: 6520910 - DNA, 22 bp, Homo sapiens
ttaatcatgagcctgtttattg

SEQ ID NO: 6520911 - DNA, 24 bp, Homo sapiens
ttaatcatgagcctgtttattgcc

SEQ ID NO: 6520912 - DNA, 22 bp, Homo sapiens
ttaatcattaggtgtgactgaa

SEQ ID NO: 6520913 - DNA, 23 bp, Homo sapiens
ttaatcattaggtgtgactgaat

SEQ ID NO: 6520914 - DNA, 16 bp, Homo sapiens
ttaatcattatttgag

SEQ ID NO: 6520915 - DNA, 14 bp, Homo sapiens
ttaatcatttccag

SEQ ID NO: 6520916 - DNA, 13 bp, Homo sapiens
ttaatcattttca

SEQ ID NO: 6520917 - DNA, 15 bp, Homo sapiens
ttaatccaatatttt

SEQ ID NO: 6520918 - DNA, 17 bp, Homo sapiens
ttaatccacacatcagt

SEQ ID NO: 6520919 - DNA, 20 bp, Homo sapiens
ttaatccagaataactagca

SEQ ID NO: 6520920 - DNA, 18 bp, Homo sapiens
ttaatccagttataagaa

SEQ ID NO: 6520921 - DNA, 19 bp, Homo sapiens
ttaatccagttataagaag

SEQ ID NO: 6520922 - DNA, 23 bp, Homo sapiens
ttaatccccatcattactggtaa

SEQ ID NO: 6520923 - DNA, 13 bp, Homo sapiens
ttaatcccctgca

SEQ ID NO: 6520924 - DNA, 15 bp, Homo sapiens
ttaatcccctgcact

SEQ ID NO: 6520925 - DNA, 22 bp, Homo sapiens
ttaatcccctgcactaggcagg

SEQ ID NO: 6520926 - DNA, 20 bp, Homo sapiens
ttaatccgccaatattagta

SEQ ID NO: 6520927 - DNA, 15 bp, Homo sapiens
ttaatcctgtaccaa

SEQ ID NO: 6520928 - DNA, 20 bp, Homo sapiens
ttaatccttctagtttccca

SEQ ID NO: 6520929 - DNA, 15 bp, Homo sapiens
ttaatcctttaactc

SEQ ID NO: 6520930 - DNA, 22 bp, Homo sapiens
ttaatcctttgttttctgacta

SEQ ID NO: 6520931 - DNA, 15 bp, Homo sapiens
ttaatcgtgtcttca

SEQ ID NO: 6520932 - DNA, 20 bp, Homo sapiens
ttaatcgtttttgttttaag

SEQ ID NO: 6520933 - DNA, 15 bp, Homo sapiens
ttaatctaaatggaa

SEQ ID NO: 6520934 - DNA, 14 bp, Homo sapiens
ttaatctactgcat

SEQ ID NO: 6520935 - DNA, 19 bp, Homo sapiens
ttaatctactttttgtatt

SEQ ID NO: 6520936 - DNA, 14 bp, Homo sapiens
ttaatctagaaaat

SEQ ID NO: 6520937 - DNA, 20 bp, Homo sapiens
ttaatctagacaatatacaa

SEQ ID NO: 6520938 - DNA, 14 bp, Homo sapiens
ttaatctagagcta

SEQ ID NO: 6520939 - DNA, 20 bp, Homo sapiens
ttaatctagagctatgcaca

SEQ ID NO: 6520940 - DNA, 22 bp, Homo sapiens
ttaatctagagctatgcacacc

SEQ ID NO: 6520941 - DNA, 21 bp, Homo sapiens
ttaatctcaaagagattcgaa

SEQ ID NO: 6520942 - DNA, 14 bp, Homo sapiens
ttaatctcacttca

SEQ ID NO: 6520943 - DNA, 19 bp, Homo sapiens
ttaatctcctattccttca

SEQ ID NO: 6520944 - DNA, 12 bp, Homo sapiens
ttaatctctaaa

SEQ ID NO: 6520945 - DNA, 17 bp, Homo sapiens
ttaatctctaaaattct

SEQ ID NO: 6520946 - DNA, 18 bp, Homo sapiens
ttaatctctaacagtgga

SEQ ID NO: 6520947 - DNA, 21 bp, Homo sapiens
ttaatctctgttatgtactgt

SEQ ID NO: 6520948 - DNA, 23 bp, Homo sapiens
ttaatctctgttatgtactgtac

SEQ ID NO: 6520949 - DNA, 11 bp, Homo sapiens
ttaatctcttg

SEQ ID NO: 6520950 - DNA, 21 bp, Homo sapiens
ttaatctcttgtcattctcat

SEQ ID NO: 6520951 - DNA, 17 bp, Homo sapiens
ttaatctgatgtataat

SEQ ID NO: 6520952 - DNA, 13 bp, Homo sapiens
ttaatctggacac

SEQ ID NO: 6520953 - DNA, 20 bp, Homo sapiens
ttaatctgggcagacattat

SEQ ID NO: 6520954 - DNA, 11 bp, Homo sapiens
ttaatcttaag

SEQ ID NO: 6520955 - DNA, 16 bp, Homo sapiens
ttaatcttagctttta

SEQ ID NO: 6520956 - DNA, 19 bp, Homo sapiens
ttaatcttagtgtatgatt

SEQ ID NO: 6520957 - DNA, 16 bp, Homo sapiens
ttaatcttatgcttaa

SEQ ID NO: 6520958 - DNA, 22 bp, Homo sapiens
ttaatcttcagttttatcttta

SEQ ID NO: 6520959 - DNA, 19 bp, Homo sapiens
ttaatcttctctcttgatt

SEQ ID NO: 6520960 - DNA, 20 bp, Homo sapiens
ttaatcttgaaggaacacaa

SEQ ID NO: 6520961 - DNA, 11 bp, Homo sapiens
ttaatcttgat

SEQ ID NO: 6520962 - DNA, 12 bp, Homo sapiens
ttaatcttgatc

SEQ ID NO: 6520963 - DNA, 14 bp, Homo sapiens
ttaatcttgatcat

SEQ ID NO: 6520964 - DNA, 20 bp, Homo sapiens
ttaatcttgcttcattgtta

SEQ ID NO: 6520965 - DNA, 14 bp, Homo sapiens
ttaatctttaataa

SEQ ID NO: 6520966 - DNA, 14 bp, Homo sapiens
ttaatctttctata

SEQ ID NO: 6520967 - DNA, 17 bp, Homo sapiens
ttaatctttctttacct

SEQ ID NO: 6520968 - DNA, 23 bp, Homo sapiens
ttaatctttctttacctgagacc

SEQ ID NO: 6520969 - DNA, 24 bp, Homo sapiens
ttaatctttctttacctgagacca

SEQ ID NO: 6520970 - DNA, 16 bp, Homo sapiens
ttaatcttttcacaaa

SEQ ID NO: 6520971 - DNA, 21 bp, Homo sapiens
tggaggagcaaaggctgagaa

SEQ ID NO: 6520972 - DNA, 11 bp, Homo sapiens
tggaggagcac

SEQ ID NO: 6520973 - DNA, 20 bp, Homo sapiens
tggaggagcagcttccttct

SEQ ID NO: 6520974 - DNA, 21 bp, Homo sapiens
tggaggagcagtgcaggcaca

SEQ ID NO: 6520975 - DNA, 22 bp, Homo sapiens
tggaggagcagtgcaggcacag

SEQ ID NO: 6520976 - DNA, 15 bp, Homo sapiens
tggaggagccaggcc

SEQ ID NO: 6520977 - DNA, 22 bp, Homo sapiens
tggaggagctcaggacactaat

SEQ ID NO: 6520978 - DNA, 17 bp, Homo sapiens
tggaggagctgagggag

SEQ ID NO: 6520979 - DNA, 18 bp, Homo sapiens
tggaggagctgagggagg

SEQ ID NO: 6520980 - DNA, 22 bp, Homo sapiens
tggaggagcttgggggatgact

SEQ ID NO: 6520981 - DNA, 13 bp, Homo sapiens
tggaggaggaagg

SEQ ID NO: 6520982 - DNA, 15 bp, Homo sapiens
tggaggaggaaggca

SEQ ID NO: 6520983 - DNA, 16 bp, Homo sapiens
tggaggaggaggagga

SEQ ID NO: 6520984 - DNA, 21 bp, Homo sapiens
tggaggaggaggaggagcctt

SEQ ID NO: 6520985 - DNA, 18 bp, Homo sapiens
tggaggaggcctgtccca

SEQ ID NO: 6520986 - DNA, 17 bp, Homo sapiens
tggaggagggagagccc

SEQ ID NO: 6520987 - DNA, 18 bp, Homo sapiens
tggaggagggagagccct

SEQ ID NO: 6520988 - DNA, 19 bp, Homo sapiens
tggaggagggagagccctg

SEQ ID NO: 6520989 - DNA, 21 bp, Homo sapiens
tggaggaggtggcttcatgtg

SEQ ID NO: 6520990 - DNA, 19 bp, Homo sapiens
tggaggaggtgtcccaagc

SEQ ID NO: 6520991 - DNA, 21 bp, Homo sapiens
tggaggatcccctccaagcct

SEQ ID NO: 6520992 - DNA, 18 bp, Homo sapiens
tggaggatggacgagtga

SEQ ID NO: 6520993 - DNA, 21 bp, Homo sapiens
tggaggatggacgagtgagct

SEQ ID NO: 6520994 - DNA, 16 bp, Homo sapiens
tggaggatgtgggcag

SEQ ID NO: 6520995 - DNA, 18 bp, Homo sapiens
tggaggattatcagtatc

SEQ ID NO: 6520996 - DNA, 13 bp, Homo sapiens
tggaggattcatg

SEQ ID NO: 6520997 - DNA, 20 bp, Homo sapiens
tggaggattctttccccaga

SEQ ID NO: 6520998 - DNA, 24 bp, Homo sapiens
tggaggattgctgccagagaagtc

SEQ ID NO: 6520999 - DNA, 17 bp, Homo sapiens
tggaggcaaatttcagc

SEQ ID NO: 6521000 - DNA, 13 bp, Homo sapiens
tggaggcaagagg

SEQ ID NO: 6521001 - DNA, 16 bp, Homo sapiens
tggaggcaagagggag

SEQ ID NO: 6521002 - DNA, 18 bp, Homo sapiens
tggaggcaagagggaggg

SEQ ID NO: 6521003 - DNA, 20 bp, Homo sapiens
tggaggcaagagggagggga

SEQ ID NO: 6521004 - DNA, 23 bp, Homo sapiens
tggaggcaagagggaggggacag

SEQ ID NO: 6521005 - DNA, 20 bp, Homo sapiens
tggaggcaatcctaccttgc

SEQ ID NO: 6521006 - DNA, 17 bp, Homo sapiens
tggaggcacacagctgc

SEQ ID NO: 6521007 - DNA, 18 bp, Homo sapiens
tggaggcacacagctgca

SEQ ID NO: 6521008 - DNA, 19 bp, Homo sapiens
tggaggcacacagctgcag

SEQ ID NO: 6521009 - DNA, 19 bp, Homo sapiens
tggaggcacgcaccactgc

SEQ ID NO: 6521010 - DNA, 22 bp, Homo sapiens
tggaggcacgcaccactgcttc

SEQ ID NO: 6521011 - DNA, 14 bp, Homo sapiens
tggaggcagacagc

SEQ ID NO: 6521012 - DNA, 18 bp, Homo sapiens
tggaggcagactcgaggg

SEQ ID NO: 6521013 - DNA, 19 bp, Homo sapiens
tggaggcagactcgagggc

SEQ ID NO: 6521014 - DNA, 11 bp, Homo sapiens
tggaggcagag

SEQ ID NO: 6521015 - DNA, 14 bp, Homo sapiens
tggaggcagaggtg

SEQ ID NO: 6521016 - DNA, 17 bp, Homo sapiens
tggaggcagccagggct

SEQ ID NO: 6521017 - DNA, 14 bp, Homo sapiens
tggaggcagggcct

SEQ ID NO: 6521018 - DNA, 22 bp, Homo sapiens
tggaggcagggccttgcccaga

SEQ ID NO: 6521019 - DNA, 19 bp, Homo sapiens
tggaggcaggggctgctgc

SEQ ID NO: 6521020 - DNA, 18 bp, Homo sapiens
tggaggcaggggcttcct

SEQ ID NO: 6521021 - DNA, 20 bp, Homo sapiens
tggaggcattcccagaggtg

SEQ ID NO: 6521022 - DNA, 15 bp, Homo sapiens
tggaggcatttcttt

SEQ ID NO: 6521023 - DNA, 14 bp, Homo sapiens
tggaggccaacaaa

SEQ ID NO: 6521024 - DNA, 16 bp, Homo sapiens
tggaggccaagcctgc

SEQ ID NO: 6521025 - DNA, 23 bp, Homo sapiens
tggaggccaccgggacagacctg

SEQ ID NO: 6521026 - DNA, 21 bp, Homo sapiens
tggaggccactgtttggaaat

SEQ ID NO: 6521027 - DNA, 10 bp, Homo sapiens
tggaggccag

SEQ ID NO: 6521028 - DNA, 19 bp, Homo sapiens
tggaggccagagtctccca

SEQ ID NO: 6521029 - DNA, 15 bp, Homo sapiens
tggaggccagccagt

SEQ ID NO: 6521030 - DNA, 13 bp, Homo sapiens
tggaggcccctgg

SEQ ID NO: 6521031 - DNA, 20 bp, Homo sapiens
tggaggcccctggagccaga

SEQ ID NO: 6521032 - DNA, 14 bp, Homo sapiens
tggaggcccctggg

SEQ ID NO: 6521033 - DNA, 17 bp, Homo sapiens
tggaggcccctgggctc

SEQ ID NO: 6521034 - DNA, 18 bp, Homo sapiens
tggaggcccctgggctct

SEQ ID NO: 6521035 - DNA, 20 bp, Homo sapiens
tggaggcccttttctggctc

SEQ ID NO: 6521036 - DNA, 23 bp, Homo sapiens
tggaggcccttttctggctcctg

SEQ ID NO: 6521037 - DNA, 21 bp, Homo sapiens
tggaggccgagtctgtcctgg

SEQ ID NO: 6521038 - DNA, 19 bp, Homo sapiens
tggaggccgctgctgacca

SEQ ID NO: 6521039 - DNA, 16 bp, Homo sapiens
tggaggcctcagggag

SEQ ID NO: 6521040 - DNA, 14 bp, Homo sapiens
tggaggcctcaggt

SEQ ID NO: 6521041 - DNA, 20 bp, Homo sapiens
tggaggcctcaggtgctgtc

SEQ ID NO: 6521042 - DNA, 24 bp, Homo sapiens
tggaggcctcaggtgctgtccatg

SEQ ID NO: 6521043 - DNA, 12 bp, Homo sapiens
tggaggcctctg

SEQ ID NO: 6521044 - DNA, 15 bp, Homo sapiens
tggaggcctctgcaa

SEQ ID NO: 6521045 - DNA, 16 bp, Homo sapiens
tggaggcctctggccc

SEQ ID NO: 6521046 - DNA, 18 bp, Homo sapiens
tggaggcctctggccctc

SEQ ID NO: 6521047 - DNA, 14 bp, Homo sapiens
tggaggcctctggg

SEQ ID NO: 6521048 - DNA, 15 bp, Homo sapiens
tggaggcctctgggc

SEQ ID NO: 6521049 - DNA, 14 bp, Homo sapiens
tggaggcctgatgc

SEQ ID NO: 6521050 - DNA, 19 bp, Homo sapiens
tggaggccttccagctgct

SEQ ID NO: 6521051 - DNA, 14 bp, Homo sapiens
tggaggccttccct

SEQ ID NO: 6521052 - DNA, 13 bp, Homo sapiens
tggaggcgagcca

SEQ ID NO: 6521053 - DNA, 16 bp, Homo sapiens
tggaggctaagcctgg

SEQ ID NO: 6521054 - DNA, 17 bp, Homo sapiens
tggaggctaagcctgga

SEQ ID NO: 6521055 - DNA, 22 bp, Homo sapiens
tggaggctacctcacctgggca

SEQ ID NO: 6521056 - DNA, 15 bp, Homo sapiens
tggaggctcagccca

SEQ ID NO: 6521057 - DNA, 14 bp, Homo sapiens
tggaggctccagga

SEQ ID NO: 6521058 - DNA, 14 bp, Homo sapiens
tggaggctcctcta

SEQ ID NO: 6521059 - DNA, 12 bp, Homo sapiens
tggaggctcctg

SEQ ID NO: 6521060 - DNA, 14 bp, Homo sapiens
tggaggctcctgtg

SEQ ID NO: 6521061 - DNA, 19 bp, Homo sapiens
tggaggctgacgtgtgagg

SEQ ID NO: 6521062 - DNA, 13 bp, Homo sapiens
tggaggctgagtt

SEQ ID NO: 6521063 - DNA, 11 bp, Homo sapiens
tggaggctgca

SEQ ID NO: 6521064 - DNA, 20 bp, Homo sapiens
tggaggctgcctcccaacag

SEQ ID NO: 6521065 - DNA, 21 bp, Homo sapiens
tggaggctgcgtcctgaggag

SEQ ID NO: 6521066 - DNA, 13 bp, Homo sapiens
tggaggctgctgc

SEQ ID NO: 6521067 - DNA, 19 bp, Homo sapiens
tggaggctgctgccccctg

SEQ ID NO: 6521068 - DNA, 14 bp, Homo sapiens
tggaggctgggtgg

SEQ ID NO: 6521069 - DNA, 23 bp, Homo sapiens
tggaggctgtcttctcaggctct

SEQ ID NO: 6521070 - DNA, 16 bp, Homo sapiens
tggaggcttcctgcgt

SEQ ID NO: 6521071 - DNA, 20 bp, Homo sapiens
tggaggcttcctgcgtcctc

SEQ ID NO: 6521072 - DNA, 19 bp, Homo sapiens
tggaggcttcttgcccaga

SEQ ID NO: 6521073 - DNA, 15 bp, Homo sapiens
tggaggcttttcact

SEQ ID NO: 6521074 - DNA, 16 bp, Homo sapiens
tggaggcttttcactg

SEQ ID NO: 6521075 - DNA, 17 bp, Homo sapiens
tggaggcttttcactgc

SEQ ID NO: 6521076 - DNA, 16 bp, Homo sapiens
tggagggaaagccagc

SEQ ID NO: 6521077 - DNA, 13 bp, Homo sapiens
tggagggaaccac

SEQ ID NO: 6521078 - DNA, 20 bp, Homo sapiens
tggagggaaccaccagcgtt

SEQ ID NO: 6521079 - DNA, 20 bp, Homo sapiens
tggagggaaggacagtccct

SEQ ID NO: 6521080 - DNA, 22 bp, Homo sapiens
tggagggaaggataaagccact

SEQ ID NO: 6521081 - DNA, 19 bp, Homo sapiens
tggagggaatgaacctgga

SEQ ID NO: 6521082 - DNA, 13 bp, Homo sapiens
tggagggagggaa

SEQ ID NO: 6521083 - DNA, 22 bp, Homo sapiens
tggagggagggcagctggcccc

SEQ ID NO: 6521084 - DNA, 23 bp, Homo sapiens
tggagggattcggccgcggctcc

SEQ ID NO: 6521085 - DNA, 22 bp, Homo sapiens
tggagggcaaggggtttccaca

SEQ ID NO: 6521086 - DNA, 15 bp, Homo sapiens
tggagggcacagccc

SEQ ID NO: 6521087 - DNA, 16 bp, Homo sapiens
tggagggcacttcagg

SEQ ID NO: 6521088 - DNA, 21 bp, Homo sapiens
tggagggcacttcctccacag

SEQ ID NO: 6521089 - DNA, 18 bp, Homo sapiens
tggagggcctgggcctgg

SEQ ID NO: 6521090 - DNA, 23 bp, Homo sapiens
tggagggcgcccagcagcctgcc

SEQ ID NO: 6521091 - DNA, 22 bp, Homo sapiens
tggagggctagaacctggagaa

SEQ ID NO: 6521092 - DNA, 23 bp, Homo sapiens
tggagggctagaacctggagagc

SEQ ID NO: 6521093 - DNA, 13 bp, Homo sapiens
tggagggctgggc

SEQ ID NO: 6521094 - DNA, 15 bp, Homo sapiens
tggagggctgggcag

SEQ ID NO: 6521095 - DNA, 18 bp, Homo sapiens
tggagggctgggcagggc

SEQ ID NO: 6521096 - DNA, 20 bp, Homo sapiens
tggagggcttggcccagcgc

SEQ ID NO: 6521097 - DNA, 11 bp, Homo sapiens
tggaggggaaa

SEQ ID NO: 6521098 - DNA, 15 bp, Homo sapiens
tggaggggaaacgca

SEQ ID NO: 6521099 - DNA, 17 bp, Homo sapiens
tggaggggaaatgggga

SEQ ID NO: 6521100 - DNA, 16 bp, Homo sapiens
tggaggggagaggggt

SEQ ID NO: 6521101 - DNA, 18 bp, Homo sapiens
tggaggggagctgctggc

SEQ ID NO: 6521102 - DNA, 17 bp, Homo sapiens
tggaggggcagcctgtg

SEQ ID NO: 6521103 - DNA, 18 bp, Homo sapiens
tggaggggcagcctgtgc

SEQ ID NO: 6521104 - DNA, 20 bp, Homo sapiens
tggaggggcagcctgtgcct

SEQ ID NO: 6521105 - DNA, 13 bp, Homo sapiens
tggaggggcaggc

SEQ ID NO: 6521106 - DNA, 15 bp, Homo sapiens
tggaggggcaggcct

SEQ ID NO: 6521107 - DNA, 19 bp, Homo sapiens
tggaggggcccacccacat

SEQ ID NO: 6521108 - DNA, 21 bp, Homo sapiens
tggaggggcccatgtgggctg

SEQ ID NO: 6521109 - DNA, 16 bp, Homo sapiens
tggaggggctgtcctc

SEQ ID NO: 6521110 - DNA, 23 bp, Homo sapiens
tggaggggctgtcctccttcctg

SEQ ID NO: 6521111 - DNA, 19 bp, Homo sapiens
tggagggggaatggcagca

SEQ ID NO: 6521112 - DNA, 19 bp, Homo sapiens
tggagggggcaagcctgta

SEQ ID NO: 6521113 - DNA, 14 bp, Homo sapiens
tggagggggctggg

SEQ ID NO: 6521114 - DNA, 17 bp, Homo sapiens
tggagggggctggggtc

SEQ ID NO: 6521115 - DNA, 19 bp, Homo sapiens
tggagggggtgtctggaag

SEQ ID NO: 6521116 - DNA, 17 bp, Homo sapiens
tggaggggtggcccaga

SEQ ID NO: 6521117 - DNA, 18 bp, Homo sapiens
tggaggggtggcccagag

SEQ ID NO: 6521118 - DNA, 21 bp, Homo sapiens
tggaggggtggcccagagcca

SEQ ID NO: 6521119 - DNA, 14 bp, Homo sapiens
tggaggggtgggga

SEQ ID NO: 6521120 - DNA, 15 bp, Homo sapiens
tggaggggtggggag

SEQ ID NO: 6521121 - DNA, 22 bp, Homo sapiens
tggagggtaactggggggccac

SEQ ID NO: 6521122 - DNA, 20 bp, Homo sapiens
tggagggtaggggagtgtgg

SEQ ID NO: 6521123 - DNA, 16 bp, Homo sapiens
tggagggtcccaagct

SEQ ID NO: 6521124 - DNA, 18 bp, Homo sapiens
tggagggtcccaagctgg

SEQ ID NO: 6521125 - DNA, 20 bp, Homo sapiens
tggagggtgggagagcccag

SEQ ID NO: 6521126 - DNA, 21 bp, Homo sapiens
tggagggtgggttggggaggg

SEQ ID NO: 6521127 - DNA, 21 bp, Homo sapiens
tggagggttgatatattcttt

SEQ ID NO: 6521128 - DNA, 13 bp, Homo sapiens
tggagggttgcca

SEQ ID NO: 6521129 - DNA, 17 bp, Homo sapiens
tggagggttggagaagg

SEQ ID NO: 6521130 - DNA, 14 bp, Homo sapiens
tggaggtacactct

SEQ ID NO: 6521131 - DNA, 20 bp, Homo sapiens
tggaggtacgaaaagagggg

SEQ ID NO: 6521132 - DNA, 18 bp, Homo sapiens
tggaggtagggctggctg

SEQ ID NO: 6521133 - DNA, 20 bp, Homo sapiens
tggaggtatcctgtgtgtct

SEQ ID NO: 6521134 - DNA, 15 bp, Homo sapiens
tggaggtatttgaaa

SEQ ID NO: 6521135 - DNA, 20 bp, Homo sapiens
tggaggtcacattcaggaag

SEQ ID NO: 6521136 - DNA, 16 bp, Homo sapiens
tggaggtcatctggcg

SEQ ID NO: 6521137 - DNA, 18 bp, Homo sapiens
tggaggtcatctggcgga

SEQ ID NO: 6521138 - DNA, 24 bp, Homo sapiens
tggaggtcccagacatgctgccca

SEQ ID NO: 6521139 - DNA, 15 bp, Homo sapiens
tggaggtcccagccc

SEQ ID NO: 6521140 - DNA, 20 bp, Homo sapiens
tggaggtcccagccctgggg

SEQ ID NO: 6521141 - DNA, 14 bp, Homo sapiens
tggaggtcgaagca

SEQ ID NO: 6521142 - DNA, 18 bp, Homo sapiens
tggaggtctccaggggcc

SEQ ID NO: 6521143 - DNA, 14 bp, Homo sapiens
tggaggtctggctg

SEQ ID NO: 6521144 - DNA, 16 bp, Homo sapiens
tggaggtctggctgag

SEQ ID NO: 6521145 - DNA, 20 bp, Homo sapiens
tggaggtctggctgagcccc

SEQ ID NO: 6521146 - DNA, 14 bp, Homo sapiens
tggaggtgacctgt

SEQ ID NO: 6521147 - DNA, 18 bp, Homo sapiens
tggaggtgacctgttagg

SEQ ID NO: 6521148 - DNA, 19 bp, Homo sapiens
tggaggtgccagcaaagcc

SEQ ID NO: 6521149 - DNA, 19 bp, Homo sapiens
ttaatcttttcacaaataa

SEQ ID NO: 6521150 - DNA, 21 bp, Homo sapiens
ttaatgaaaaatctgaatttc

SEQ ID NO: 6521151 - DNA, 16 bp, Homo sapiens
ttaatgaaaaggaatc

SEQ ID NO: 6521152 - DNA, 21 bp, Homo sapiens
ttaatgaaagggtttgtaata

SEQ ID NO: 6521153 - DNA, 13 bp, Homo sapiens
ttaatgaaataaa

SEQ ID NO: 6521154 - DNA, 23 bp, Homo sapiens
ttaatgaaatgataaagactttt

SEQ ID NO: 6521155 - DNA, 15 bp, Homo sapiens
ttaatgaactgtgac

SEQ ID NO: 6521156 - DNA, 17 bp, Homo sapiens
ttaatgaactgtgacag

SEQ ID NO: 6521157 - DNA, 18 bp, Homo sapiens
ttaatgaagaaagtggaa

SEQ ID NO: 6521158 - DNA, 23 bp, Homo sapiens
ttaatgaagaaagtggaaaacaa

SEQ ID NO: 6521159 - DNA, 16 bp, Homo sapiens
ttaatgaagcttttga

SEQ ID NO: 6521160 - DNA, 17 bp, Homo sapiens
ttaatgaagcttttgaa

SEQ ID NO: 6521161 - DNA, 19 bp, Homo sapiens
ttaatgaaggtcataagtt

SEQ ID NO: 6521162 - DNA, 14 bp, Homo sapiens
ttaatgaagtttga

SEQ ID NO: 6521163 - DNA, 16 bp, Homo sapiens
ttaatgaagtttgaat

SEQ ID NO: 6521164 - DNA, 23 bp, Homo sapiens
ttaatgaatcacatttttttatg

SEQ ID NO: 6521165 - DNA, 22 bp, Homo sapiens
ttaatgaatcgtaatgaagttg

SEQ ID NO: 6521166 - DNA, 23 bp, Homo sapiens
ttaatgaatgcccaggaagtaat

SEQ ID NO: 6521167 - DNA, 13 bp, Homo sapiens
ttaatgaatgctt

SEQ ID NO: 6521168 - DNA, 16 bp, Homo sapiens
ttaatgacaacactta

SEQ ID NO: 6521169 - DNA, 22 bp, Homo sapiens
ttaatgacaacacttaatagca

SEQ ID NO: 6521170 - DNA, 14 bp, Homo sapiens
ttaatgacacttgt

SEQ ID NO: 6521171 - DNA, 19 bp, Homo sapiens
ttaatgacacttgtcccca

SEQ ID NO: 6521172 - DNA, 20 bp, Homo sapiens
ttaatgacattgatttctaa

SEQ ID NO: 6521173 - DNA, 23 bp, Homo sapiens
ttaatgaccatgttatattgctt

SEQ ID NO: 6521174 - DNA, 19 bp, Homo sapiens
ttaatgactctttctgaag

SEQ ID NO: 6521175 - DNA, 15 bp, Homo sapiens
ttaatgacttttgaa

SEQ ID NO: 6521176 - DNA, 22 bp, Homo sapiens
ttaatgagaatagaaacgtaaa

SEQ ID NO: 6521177 - DNA, 16 bp, Homo sapiens
ttaatgagccatcact

SEQ ID NO: 6521178 - DNA, 17 bp, Homo sapiens
ttaatgagtatatgtaa

SEQ ID NO: 6521179 - DNA, 19 bp, Homo sapiens
ttaatgagtgcacctgcct

SEQ ID NO: 6521180 - DNA, 11 bp, Homo sapiens
ttaatgataaa

SEQ ID NO: 6521181 - DNA, 16 bp, Homo sapiens
ttaatgataagtaaat

SEQ ID NO: 6521182 - DNA, 17 bp, Homo sapiens
ttaatgataagtaaatg

SEQ ID NO: 6521183 - DNA, 20 bp, Homo sapiens
ttaatgatactgtctaagaa

SEQ ID NO: 6521184 - DNA, 19 bp, Homo sapiens
ttaatgatatactgatctt

SEQ ID NO: 6521185 - DNA, 23 bp, Homo sapiens
ttaatgatcaacaatttaatgta

SEQ ID NO: 6521186 - DNA, 21 bp, Homo sapiens
ttaatgatctcggatgaccaa

SEQ ID NO: 6521187 - DNA, 15 bp, Homo sapiens
ttaatgatctggtgg

SEQ ID NO: 6521188 - DNA, 16 bp, Homo sapiens
ttaatgatctggtggt

SEQ ID NO: 6521189 - DNA, 18 bp, Homo sapiens
ttaatgatgatcttcaga

SEQ ID NO: 6521190 - DNA, 16 bp, Homo sapiens
ttaatgatggtgttaa

SEQ ID NO: 6521191 - DNA, 16 bp, Homo sapiens
ttaatgattcttgtgt

SEQ ID NO: 6521192 - DNA, 21 bp, Homo sapiens
ttaatgcaagagaacatttta

SEQ ID NO: 6521193 - DNA, 16 bp, Homo sapiens
ttaatgcaatatactg

SEQ ID NO: 6521194 - DNA, 18 bp, Homo sapiens
ttaatgcatctagattat

SEQ ID NO: 6521195 - DNA, 19 bp, Homo sapiens
ttaatgcattaaacctgtc

SEQ ID NO: 6521196 - DNA, 20 bp, Homo sapiens
ttaatgcattgttgtaaagt

SEQ ID NO: 6521197 - DNA, 12 bp, Homo sapiens
ttaatgcccagc

SEQ ID NO: 6521198 - DNA, 14 bp, Homo sapiens
ttaatgcctgccca

SEQ ID NO: 6521199 - DNA, 18 bp, Homo sapiens
ttaatgctaatcttgtga

SEQ ID NO: 6521200 - DNA, 22 bp, Homo sapiens
ttaatgctaatcttgtgaaaat

SEQ ID NO: 6521201 - DNA, 14 bp, Homo sapiens
ttaatgctatttga

SEQ ID NO: 6521202 - DNA, 20 bp, Homo sapiens
ttaatgctatttgaacaagt

SEQ ID NO: 6521203 - DNA, 16 bp, Homo sapiens
ttaatgctgtctttgt

SEQ ID NO: 6521204 - DNA, 15 bp, Homo sapiens
ttaatgctgtttcta

SEQ ID NO: 6521205 - DNA, 19 bp, Homo sapiens
ttaatgctgtttctaagaa

SEQ ID NO: 6521206 - DNA, 21 bp, Homo sapiens
ttaatgctgtttctaagaaaa

SEQ ID NO: 6521207 - DNA, 23 bp, Homo sapiens
ttaatgctgtttctaagaaaatg

SEQ ID NO: 6521208 - DNA, 14 bp, Homo sapiens
ttaatgcttaagat

SEQ ID NO: 6521209 - DNA, 21 bp, Homo sapiens
ttaatgcttacctaatttcat

SEQ ID NO: 6521210 - DNA, 19 bp, Homo sapiens
ttaatgcttccagggattt

SEQ ID NO: 6521211 - DNA, 19 bp, Homo sapiens
ttaatgctttcctccctgg

SEQ ID NO: 6521212 - DNA, 22 bp, Homo sapiens
ttaatgctttcctccctggcat

SEQ ID NO: 6521213 - DNA, 18 bp, Homo sapiens
ttaatgcttttatatttt

SEQ ID NO: 6521214 - DNA, 18 bp, Homo sapiens
ttaatggaaacatgctgt

SEQ ID NO: 6521215 - DNA, 20 bp, Homo sapiens
ttaatggaaaccaagccaat

SEQ ID NO: 6521216 - DNA, 15 bp, Homo sapiens
ttaatggaaagtttg

SEQ ID NO: 6521217 - DNA, 14 bp, Homo sapiens
ttaatggaaatgtt

SEQ ID NO: 6521218 - DNA, 19 bp, Homo sapiens
ttaatggacatgagataat

SEQ ID NO: 6521219 - DNA, 22 bp, Homo sapiens
ttaatggacatgagataatgtt

SEQ ID NO: 6521220 - DNA, 14 bp, Homo sapiens
ttaatggactgtga

SEQ ID NO: 6521221 - DNA, 16 bp, Homo sapiens
ttaatggactgtgaat

SEQ ID NO: 6521222 - DNA, 20 bp, Homo sapiens
ttaatggacttatttcttca

SEQ ID NO: 6521223 - DNA, 14 bp, Homo sapiens
ttaatggattgtta

SEQ ID NO: 6521224 - DNA, 15 bp, Homo sapiens
ttaatggcatgtaat

SEQ ID NO: 6521225 - DNA, 22 bp, Homo sapiens
ttaatggccggctggaaatgct

SEQ ID NO: 6521226 - DNA, 19 bp, Homo sapiens
ttaatggctagtactgtat

SEQ ID NO: 6521227 - DNA, 16 bp, Homo sapiens
ttaatgggcacaaaat

SEQ ID NO: 6521228 - DNA, 14 bp, Homo sapiens
ttaatggtagcatt

SEQ ID NO: 6521229 - DNA, 22 bp, Homo sapiens
ttaatggtatcctactgagcat

SEQ ID NO: 6521230 - DNA, 23 bp, Homo sapiens
ttaatggtatcctactgagcatt

SEQ ID NO: 6521231 - DNA, 19 bp, Homo sapiens
ttaatggtatctgttactc

SEQ ID NO: 6521232 - DNA, 15 bp, Homo sapiens
ttaatggtctaaaaa

SEQ ID NO: 6521233 - DNA, 22 bp, Homo sapiens
ttaatggtctaaaaataaacca

SEQ ID NO: 6521234 - DNA, 20 bp, Homo sapiens
ttaatggtgccttcatttgg

SEQ ID NO: 6521235 - DNA, 14 bp, Homo sapiens
ttaatggttaagaa

SEQ ID NO: 6521236 - DNA, 16 bp, Homo sapiens
ttaatgtaaataaaac

SEQ ID NO: 6521237 - DNA, 19 bp, Homo sapiens
ttaatgtacaagttttgta

SEQ ID NO: 6521238 - DNA, 17 bp, Homo sapiens
ttaatgtacatagtgct

SEQ ID NO: 6521239 - DNA, 18 bp, Homo sapiens
ttaatgtagataaagcac

SEQ ID NO: 6521240 - DNA, 11 bp, Homo sapiens
ttaatgtagta

SEQ ID NO: 6521241 - DNA, 17 bp, Homo sapiens
ttaatgtatataaaaat

SEQ ID NO: 6521242 - DNA, 14 bp, Homo sapiens
ttaatgtatatttg

SEQ ID NO: 6521243 - DNA, 18 bp, Homo sapiens
ttaatgtatctatttgta

SEQ ID NO: 6521244 - DNA, 22 bp, Homo sapiens
ttaatgtatctatttgtacaat

SEQ ID NO: 6521245 - DNA, 13 bp, Homo sapiens
ttaatgtatctta

SEQ ID NO: 6521246 - DNA, 18 bp, Homo sapiens
ttaatgtatcttaaagga

SEQ ID NO: 6521247 - DNA, 19 bp, Homo sapiens
ttaatgtatcttaaaggac

SEQ ID NO: 6521248 - DNA, 22 bp, Homo sapiens
ttaatgtatcttaaaggacata

SEQ ID NO: 6521249 - DNA, 17 bp, Homo sapiens
ttaatgtattaatctgt

SEQ ID NO: 6521250 - DNA, 21 bp, Homo sapiens
ttaatgtattaatctgtttgt

SEQ ID NO: 6521251 - DNA, 12 bp, Homo sapiens
ttaatgtattcc

SEQ ID NO: 6521252 - DNA, 17 bp, Homo sapiens
ttaatgtatttgatgtc

SEQ ID NO: 6521253 - DNA, 22 bp, Homo sapiens
ttaatgtcaattcttgccaaat

SEQ ID NO: 6521254 - DNA, 13 bp, Homo sapiens
ttaatgtctcaaa

SEQ ID NO: 6521255 - DNA, 14 bp, Homo sapiens
ttaatgtctttgtg

SEQ ID NO: 6521256 - DNA, 19 bp, Homo sapiens
ttaatgtgaactctcccct

SEQ ID NO: 6521257 - DNA, 23 bp, Homo sapiens
ttaatgtgaactctcccctcccc

SEQ ID NO: 6521258 - DNA, 18 bp, Homo sapiens
ttaatgtgaagacatttt

SEQ ID NO: 6521259 - DNA, 14 bp, Homo sapiens
ttaatgtgaatttt

SEQ ID NO: 6521260 - DNA, 13 bp, Homo sapiens
ttaatgtgagttt

SEQ ID NO: 6521261 - DNA, 20 bp, Homo sapiens
ttaatgtgatggatggcaca

SEQ ID NO: 6521262 - DNA, 15 bp, Homo sapiens
ttaatgtgctgtgta

SEQ ID NO: 6521263 - DNA, 16 bp, Homo sapiens
ttaatgtgctgtgtaa

SEQ ID NO: 6521264 - DNA, 19 bp, Homo sapiens
ttaatgtgctgtgtaaagt

SEQ ID NO: 6521265 - DNA, 18 bp, Homo sapiens
ttaatgtggactggaaca

SEQ ID NO: 6521266 - DNA, 18 bp, Homo sapiens
ttaatgttaactttcaaa

SEQ ID NO: 6521267 - DNA, 13 bp, Homo sapiens
ttaatgttactca

SEQ ID NO: 6521268 - DNA, 16 bp, Homo sapiens
ttaatgttatgaggac

SEQ ID NO: 6521269 - DNA, 18 bp, Homo sapiens
ttaatgttccagtttgaa

SEQ ID NO: 6521270 - DNA, 22 bp, Homo sapiens
ttaatgttctgaataatttctt

SEQ ID NO: 6521271 - DNA, 14 bp, Homo sapiens
ttaatgttctgtga

SEQ ID NO: 6521272 - DNA, 18 bp, Homo sapiens
ttaatgttgaatgtattt

SEQ ID NO: 6521273 - DNA, 14 bp, Homo sapiens
ttaatgttgatttc

SEQ ID NO: 6521274 - DNA, 15 bp, Homo sapiens
ttaatgtttaaaaca

SEQ ID NO: 6521275 - DNA, 18 bp, Homo sapiens
ttaatgtttatacagagt

SEQ ID NO: 6521276 - DNA, 20 bp, Homo sapiens
ttaatgtttatacagagtaa

SEQ ID NO: 6521277 - DNA, 15 bp, Homo sapiens
ttaatgtttattcct

SEQ ID NO: 6521278 - DNA, 20 bp, Homo sapiens
ttaatgtttctgatttctga

SEQ ID NO: 6521279 - DNA, 16 bp, Homo sapiens
ttaatgttttcaaaag

SEQ ID NO: 6521280 - DNA, 13 bp, Homo sapiens
ttaatgttttcat

SEQ ID NO: 6521281 - DNA, 16 bp, Homo sapiens
ttaatgttttctgctg

SEQ ID NO: 6521282 - DNA, 13 bp, Homo sapiens
ttaatgttttgta

SEQ ID NO: 6521283 - DNA, 12 bp, Homo sapiens
ttaatgttttta

SEQ ID NO: 6521284 - DNA, 20 bp, Homo sapiens
ttaattaaaaactagtagtt

SEQ ID NO: 6521285 - DNA, 14 bp, Homo sapiens
ttaattaaaaactt

SEQ ID NO: 6521286 - DNA, 18 bp, Homo sapiens
ttaattaaaattggtaaa

SEQ ID NO: 6521287 - DNA, 23 bp, Homo sapiens
ttaattaaaattggtaaaaataa

SEQ ID NO: 6521288 - DNA, 15 bp, Homo sapiens
ttaattaaacaaatt

SEQ ID NO: 6521289 - DNA, 12 bp, Homo sapiens
ttaattaaagaa

SEQ ID NO: 6521290 - DNA, 13 bp, Homo sapiens
ttaattaaagcac

SEQ ID NO: 6521291 - DNA, 21 bp, Homo sapiens
ttaattaaagccttaagcaca

SEQ ID NO: 6521292 - DNA, 22 bp, Homo sapiens
ttaattaaagccttaagcacaa

SEQ ID NO: 6521293 - DNA, 14 bp, Homo sapiens
ttaattaaatgctc

SEQ ID NO: 6521294 - DNA, 16 bp, Homo sapiens
ttaattaaatgtattt

SEQ ID NO: 6521295 - DNA, 14 bp, Homo sapiens
ttaattaaatttca

SEQ ID NO: 6521296 - DNA, 22 bp, Homo sapiens
ttaattaaccccataattagat

SEQ ID NO: 6521297 - DNA, 23 bp, Homo sapiens
ttaattaactatgtgatgttaac

SEQ ID NO: 6521298 - DNA, 16 bp, Homo sapiens
ttaattaagactgaaa

SEQ ID NO: 6521299 - DNA, 20 bp, Homo sapiens
ttaattaagctccttcagtt

SEQ ID NO: 6521300 - DNA, 12 bp, Homo sapiens
ttaattaatgta

SEQ ID NO: 6521301 - DNA, 14 bp, Homo sapiens
ttaattaattctca

SEQ ID NO: 6521302 - DNA, 13 bp, Homo sapiens
ttaattaatttga

SEQ ID NO: 6521303 - DNA, 20 bp, Homo sapiens
ttaattaatttggagcacaa

SEQ ID NO: 6521304 - DNA, 14 bp, Homo sapiens
ttaattacaaacaa

SEQ ID NO: 6521305 - DNA, 15 bp, Homo sapiens
ttaattacaaacaat

SEQ ID NO: 6521306 - DNA, 13 bp, Homo sapiens
ttaattacaccat

SEQ ID NO: 6521307 - DNA, 15 bp, Homo sapiens
ttaattacatacaga

SEQ ID NO: 6521308 - DNA, 16 bp, Homo sapiens
ttaattaccaacctgt

SEQ ID NO: 6521309 - DNA, 17 bp, Homo sapiens
ttaattaccttattgga

SEQ ID NO: 6521310 - DNA, 15 bp, Homo sapiens
ttaattactgctata

SEQ ID NO: 6521311 - DNA, 15 bp, Homo sapiens
ttaattactgtgtgt

SEQ ID NO: 6521312 - DNA, 20 bp, Homo sapiens
ttaattacttttgaaaaagg

SEQ ID NO: 6521313 - DNA, 13 bp, Homo sapiens
ttaattagatttt

SEQ ID NO: 6521314 - DNA, 14 bp, Homo sapiens
ttaattaggaatta

SEQ ID NO: 6521315 - DNA, 19 bp, Homo sapiens
ttaattaggggttgctaag

SEQ ID NO: 6521316 - DNA, 20 bp, Homo sapiens
ttaattaggggttgctaaga

SEQ ID NO: 6521317 - DNA, 20 bp, Homo sapiens
ttaattagtgctaagtgtga

SEQ ID NO: 6521318 - DNA, 16 bp, Homo sapiens
ttaattataccagtgt

SEQ ID NO: 6521319 - DNA, 15 bp, Homo sapiens
ttaattatcttttct

SEQ ID NO: 6521320 - DNA, 15 bp, Homo sapiens
ttaattatgcagtgt

SEQ ID NO: 6521321 - DNA, 16 bp, Homo sapiens
ttaattattaactaca

SEQ ID NO: 6521322 - DNA, 14 bp, Homo sapiens
ttaattattattct

SEQ ID NO: 6521323 - DNA, 21 bp, Homo sapiens
ttaattattatttgtgtttta

SEQ ID NO: 6521324 - DNA, 10 bp, Homo sapiens
ttaattattt

SEQ ID NO: 6521325 - DNA, 13 bp, Homo sapiens
ttaattatttaaa

SEQ ID NO: 6521326 - DNA, 13 bp, Homo sapiens
ttaattcaatgaa

SEQ ID NO: 6521327 - DNA, 17 bp, Homo sapiens
ttaattcaatgaaatgg

SEQ ID NO: 6521328 - DNA, 20 bp, Homo sapiens
tggaggtgccagcaaagccc

SEQ ID NO: 6521329 - DNA, 13 bp, Homo sapiens
tggaggtgccagg

SEQ ID NO: 6521330 - DNA, 20 bp, Homo sapiens
tggaggtgctggtagctgag

SEQ ID NO: 6521331 - DNA, 18 bp, Homo sapiens
tggaggtgcttgatctat

SEQ ID NO: 6521332 - DNA, 18 bp, Homo sapiens
tggaggtggcgccccctg

SEQ ID NO: 6521333 - DNA, 12 bp, Homo sapiens
tggaggtgggag

SEQ ID NO: 6521334 - DNA, 20 bp, Homo sapiens
tggaggtgggagcaggagat

SEQ ID NO: 6521335 - DNA, 13 bp, Homo sapiens
tggaggtgggcaa

SEQ ID NO: 6521336 - DNA, 14 bp, Homo sapiens
tggaggtgggcatg

SEQ ID NO: 6521337 - DNA, 22 bp, Homo sapiens
tggaggtgggcattggcggggc

SEQ ID NO: 6521338 - DNA, 17 bp, Homo sapiens
tggaggtgggctgatgg

SEQ ID NO: 6521339 - DNA, 14 bp, Homo sapiens
tggaggtggggagg

SEQ ID NO: 6521340 - DNA, 19 bp, Homo sapiens
tggaggtggggagggcctc

SEQ ID NO: 6521341 - DNA, 18 bp, Homo sapiens
tggaggtgtcaggctgct

SEQ ID NO: 6521342 - DNA, 17 bp, Homo sapiens
tggaggttctcagagcc

SEQ ID NO: 6521343 - DNA, 23 bp, Homo sapiens
tggaggttctcagagccaagtcc

SEQ ID NO: 6521344 - DNA, 15 bp, Homo sapiens
tggaggttgaagcca

SEQ ID NO: 6521345 - DNA, 22 bp, Homo sapiens
tggaggttgaagccaagtgggg

SEQ ID NO: 6521346 - DNA, 20 bp, Homo sapiens
tggaggttgagtgagccggg

SEQ ID NO: 6521347 - DNA, 17 bp, Homo sapiens
tggaggttgataacttt

SEQ ID NO: 6521348 - DNA, 13 bp, Homo sapiens
tggaggttgcagt

SEQ ID NO: 6521349 - DNA, 21 bp, Homo sapiens
tggaggttgcagtgagctgag

SEQ ID NO: 6521350 - DNA, 15 bp, Homo sapiens
tggagtaattgcaca

SEQ ID NO: 6521351 - DNA, 15 bp, Homo sapiens
tggagtacccagcct

SEQ ID NO: 6521352 - DNA, 17 bp, Homo sapiens
tggagtacccagcctat

SEQ ID NO: 6521353 - DNA, 18 bp, Homo sapiens
tggagtactatatttaca

SEQ ID NO: 6521354 - DNA, 13 bp, Homo sapiens
tggagtagagtca

SEQ ID NO: 6521355 - DNA, 21 bp, Homo sapiens
tggagtagcctggactgtttc

SEQ ID NO: 6521356 - DNA, 17 bp, Homo sapiens
tggagtatagtgcaaat

SEQ ID NO: 6521357 - DNA, 14 bp, Homo sapiens
tggagtatatgtca

SEQ ID NO: 6521358 - DNA, 22 bp, Homo sapiens
tggagtattattgaagatgtga

SEQ ID NO: 6521359 - DNA, 13 bp, Homo sapiens
tggagtatttgga

SEQ ID NO: 6521360 - DNA, 22 bp, Homo sapiens
tggagtatttttataattttat

SEQ ID NO: 6521361 - DNA, 20 bp, Homo sapiens
tggagtcacatcagtgagga

SEQ ID NO: 6521362 - DNA, 13 bp, Homo sapiens
tggagtcagatga

SEQ ID NO: 6521363 - DNA, 18 bp, Homo sapiens
tggagtcagatgagcaag

SEQ ID NO: 6521364 - DNA, 23 bp, Homo sapiens
tggagtcaggtgtcgaggccaca

SEQ ID NO: 6521365 - DNA, 16 bp, Homo sapiens
tggagtcagtagccag

SEQ ID NO: 6521366 - DNA, 15 bp, Homo sapiens
tggagtcatgccaag

SEQ ID NO: 6521367 - DNA, 17 bp, Homo sapiens
tggagtcatgtgcctct

SEQ ID NO: 6521368 - DNA, 22 bp, Homo sapiens
tggagtcatgtgcctctgtcct

SEQ ID NO: 6521369 - DNA, 16 bp, Homo sapiens
tggagtcatttctgat

SEQ ID NO: 6521370 - DNA, 21 bp, Homo sapiens
tggagtccagatggcaggcta

SEQ ID NO: 6521371 - DNA, 14 bp, Homo sapiens
tggagtccagtctc

SEQ ID NO: 6521372 - DNA, 14 bp, Homo sapiens
tggagtccagtgct

SEQ ID NO: 6521373 - DNA, 13 bp, Homo sapiens
tggagtcccagag

SEQ ID NO: 6521374 - DNA, 22 bp, Homo sapiens
tggagtcccagagctgcacagg

SEQ ID NO: 6521375 - DNA, 15 bp, Homo sapiens
tggagtcccctcacc

SEQ ID NO: 6521376 - DNA, 16 bp, Homo sapiens
tggagtccctcctccc

SEQ ID NO: 6521377 - DNA, 15 bp, Homo sapiens
tggagtcctctccag

SEQ ID NO: 6521378 - DNA, 22 bp, Homo sapiens
tggagtccttagtatcagtcat

SEQ ID NO: 6521379 - DNA, 16 bp, Homo sapiens
tggagtcgagctggcc

SEQ ID NO: 6521380 - DNA, 14 bp, Homo sapiens
tggagtcggaaggg

SEQ ID NO: 6521381 - DNA, 20 bp, Homo sapiens
tggagtcggagtggacaccg

SEQ ID NO: 6521382 - DNA, 18 bp, Homo sapiens
tggagtcgtgggaaggag

SEQ ID NO: 6521383 - DNA, 19 bp, Homo sapiens
tggagtctatgcttaaaaa

SEQ ID NO: 6521384 - DNA, 15 bp, Homo sapiens
tggagtctcattctg

SEQ ID NO: 6521385 - DNA, 15 bp, Homo sapiens
tggagtctccagatg

SEQ ID NO: 6521386 - DNA, 14 bp, Homo sapiens
tggagtctccctct

SEQ ID NO: 6521387 - DNA, 18 bp, Homo sapiens
tggagtctcgctctgctg

SEQ ID NO: 6521388 - DNA, 13 bp, Homo sapiens
tggagtctctctc

SEQ ID NO: 6521389 - DNA, 13 bp, Homo sapiens
tggagtctgagtc

SEQ ID NO: 6521390 - DNA, 15 bp, Homo sapiens
tggagtctgcagtga

SEQ ID NO: 6521391 - DNA, 21 bp, Homo sapiens
tggagtctgcagtgaggggag

SEQ ID NO: 6521392 - DNA, 15 bp, Homo sapiens
tggagtctgccaccc

SEQ ID NO: 6521393 - DNA, 18 bp, Homo sapiens
tggagtctgccacccagg

SEQ ID NO: 6521394 - DNA, 18 bp, Homo sapiens
tggagtctggagtgggca

SEQ ID NO: 6521395 - DNA, 14 bp, Homo sapiens
tggagtctggcttt

SEQ ID NO: 6521396 - DNA, 15 bp, Homo sapiens
tggagtcttgtgaaa

SEQ ID NO: 6521397 - DNA, 19 bp, Homo sapiens
tggagtcttgtgaaagtgt

SEQ ID NO: 6521398 - DNA, 14 bp, Homo sapiens
tggagtgaagaaaa

SEQ ID NO: 6521399 - DNA, 15 bp, Homo sapiens
tggagtgaagaaaac

SEQ ID NO: 6521400 - DNA, 22 bp, Homo sapiens
tggagtgagaggcccccaccct

SEQ ID NO: 6521401 - DNA, 23 bp, Homo sapiens
tggagtgagaggcccccaccctt

SEQ ID NO: 6521402 - DNA, 17 bp, Homo sapiens
tggagtgagcagtagaa

SEQ ID NO: 6521403 - DNA, 17 bp, Homo sapiens
tggagtgaggcttccag

SEQ ID NO: 6521404 - DNA, 23 bp, Homo sapiens
tggagtgaggcttccaggctctt

SEQ ID NO: 6521405 - DNA, 22 bp, Homo sapiens
tggagtgagtcacctgctccag

SEQ ID NO: 6521406 - DNA, 16 bp, Homo sapiens
tggagtgatagctact

SEQ ID NO: 6521407 - DNA, 19 bp, Homo sapiens
tggagtgatctcagctcac

SEQ ID NO: 6521408 - DNA, 18 bp, Homo sapiens
tggagtgatttatactgt

SEQ ID NO: 6521409 - DNA, 21 bp, Homo sapiens
tggagtgcagctaacatgagt

SEQ ID NO: 6521410 - DNA, 19 bp, Homo sapiens
tggagtgcagggaggagag

SEQ ID NO: 6521411 - DNA, 16 bp, Homo sapiens
tggagtgccaagtttg

SEQ ID NO: 6521412 - DNA, 13 bp, Homo sapiens
tggagtgccatgg

SEQ ID NO: 6521413 - DNA, 17 bp, Homo sapiens
tggagtgccccaaggag

SEQ ID NO: 6521414 - DNA, 21 bp, Homo sapiens
tggagtgccctgcaggcacag

SEQ ID NO: 6521415 - DNA, 12 bp, Homo sapiens
tggagtgccttc

SEQ ID NO: 6521416 - DNA, 17 bp, Homo sapiens
tggagtgctcttcccac

SEQ ID NO: 6521417 - DNA, 16 bp, Homo sapiens
tggagtgctgcttgtg

SEQ ID NO: 6521418 - DNA, 12 bp, Homo sapiens
tggagtgctggc

SEQ ID NO: 6521419 - DNA, 13 bp, Homo sapiens
tggagtgctggct

SEQ ID NO: 6521420 - DNA, 14 bp, Homo sapiens
tggagtgctggctc

SEQ ID NO: 6521421 - DNA, 16 bp, Homo sapiens
tggagtgctgttttgt

SEQ ID NO: 6521422 - DNA, 17 bp, Homo sapiens
tggagtgcttctggaac

SEQ ID NO: 6521423 - DNA, 19 bp, Homo sapiens
tggagtggaggcattgttt

SEQ ID NO: 6521424 - DNA, 17 bp, Homo sapiens
tggagtggatgcctcag

SEQ ID NO: 6521425 - DNA, 16 bp, Homo sapiens
tggagtggcagcccag

SEQ ID NO: 6521426 - DNA, 13 bp, Homo sapiens
tggagtggccact

SEQ ID NO: 6521427 - DNA, 19 bp, Homo sapiens
tggagtgggaagggagcat

SEQ ID NO: 6521428 - DNA, 14 bp, Homo sapiens
tggagtgggcagag

SEQ ID NO: 6521429 - DNA, 19 bp, Homo sapiens
tggagtggtaacaagagga

SEQ ID NO: 6521430 - DNA, 17 bp, Homo sapiens
tggagtggtaacagctc

SEQ ID NO: 6521431 - DNA, 17 bp, Homo sapiens
tggagtgtcggatcctg

SEQ ID NO: 6521432 - DNA, 15 bp, Homo sapiens
tggagtgtgagccac

SEQ ID NO: 6521433 - DNA, 17 bp, Homo sapiens
tggagtgtgcagacagc

SEQ ID NO: 6521434 - DNA, 22 bp, Homo sapiens
tggagtgtgtgggggtctggga

SEQ ID NO: 6521435 - DNA, 17 bp, Homo sapiens
tggagtgtttgaaaact

SEQ ID NO: 6521436 - DNA, 15 bp, Homo sapiens
tggagttaaaatgca

SEQ ID NO: 6521437 - DNA, 13 bp, Homo sapiens
tggagttaaataa

SEQ ID NO: 6521438 - DNA, 17 bp, Homo sapiens
tggagttacattaatgt

SEQ ID NO: 6521439 - DNA, 20 bp, Homo sapiens
tggagttattgaagcagagt

SEQ ID NO: 6521440 - DNA, 16 bp, Homo sapiens
tggagttccggcctgg

SEQ ID NO: 6521441 - DNA, 16 bp, Homo sapiens
tggagttcctgaacct

SEQ ID NO: 6521442 - DNA, 20 bp, Homo sapiens
tggagttcctgaacctgatg

SEQ ID NO: 6521443 - DNA, 16 bp, Homo sapiens
tggagttcctgctccg

SEQ ID NO: 6521444 - DNA, 19 bp, Homo sapiens
tggagttcttagctatcct

SEQ ID NO: 6521445 - DNA, 18 bp, Homo sapiens
tggagttgaaactgctat

SEQ ID NO: 6521446 - DNA, 20 bp, Homo sapiens
tggagttgactgactgagca

SEQ ID NO: 6521447 - DNA, 17 bp, Homo sapiens
tggagttgatctggaac

SEQ ID NO: 6521448 - DNA, 19 bp, Homo sapiens
tggagttgatctggaaccc

SEQ ID NO: 6521449 - DNA, 21 bp, Homo sapiens
tggagttgattcatgtgcttg

SEQ ID NO: 6521450 - DNA, 13 bp, Homo sapiens
tggagttgggctg

SEQ ID NO: 6521451 - DNA, 13 bp, Homo sapiens
tggagtttaaaaa

SEQ ID NO: 6521452 - DNA, 14 bp, Homo sapiens
tggagtttctaagg

SEQ ID NO: 6521453 - DNA, 13 bp, Homo sapiens
tggagtttctcta

SEQ ID NO: 6521454 - DNA, 19 bp, Homo sapiens
tggagtttctctagaagct

SEQ ID NO: 6521455 - DNA, 14 bp, Homo sapiens
tggagtttgggctg

SEQ ID NO: 6521456 - DNA, 16 bp, Homo sapiens
tggagtttgggctgga

SEQ ID NO: 6521457 - DNA, 17 bp, Homo sapiens
tggagttttaactgtaa

SEQ ID NO: 6521458 - DNA, 18 bp, Homo sapiens
tggagttttataaattaa

SEQ ID NO: 6521459 - DNA, 23 bp, Homo sapiens
tggagttttataaattaaaaggt

SEQ ID NO: 6521460 - DNA, 18 bp, Homo sapiens
tggagttttttgtaccaa

SEQ ID NO: 6521461 - DNA, 14 bp, Homo sapiens
tggataaaaaagaa

SEQ ID NO: 6521462 - DNA, 13 bp, Homo sapiens
tggataaaacatt

SEQ ID NO: 6521463 - DNA, 19 bp, Homo sapiens
tggataaaataatgctgca

SEQ ID NO: 6521464 - DNA, 16 bp, Homo sapiens
tggataaaccaccctc

SEQ ID NO: 6521465 - DNA, 23 bp, Homo sapiens
tggataaaccaccctctggggac

SEQ ID NO: 6521466 - DNA, 15 bp, Homo sapiens
tggataaactgagcc

SEQ ID NO: 6521467 - DNA, 18 bp, Homo sapiens
tggataaatttaaaacac

SEQ ID NO: 6521468 - DNA, 21 bp, Homo sapiens
tggataaatttaaaacacagt

SEQ ID NO: 6521469 - DNA, 21 bp, Homo sapiens
tggataaatttgaactccatg

SEQ ID NO: 6521470 - DNA, 14 bp, Homo sapiens
tggataacaaagat

SEQ ID NO: 6521471 - DNA, 17 bp, Homo sapiens
tggataacaaagatatc

SEQ ID NO: 6521472 - DNA, 21 bp, Homo sapiens
tggataaccaggctgggctca

SEQ ID NO: 6521473 - DNA, 17 bp, Homo sapiens
tggataactagccagac

SEQ ID NO: 6521474 - DNA, 15 bp, Homo sapiens
tggataacttccaca

SEQ ID NO: 6521475 - DNA, 23 bp, Homo sapiens
tggataagctatccgtgttgcag

SEQ ID NO: 6521476 - DNA, 16 bp, Homo sapiens
tggataataaaaattg

SEQ ID NO: 6521477 - DNA, 15 bp, Homo sapiens
tggataataggaatt

SEQ ID NO: 6521478 - DNA, 23 bp, Homo sapiens
tggataatcttcggccaatttat

SEQ ID NO: 6521479 - DNA, 18 bp, Homo sapiens
tggataatgctgttgcct

SEQ ID NO: 6521480 - DNA, 14 bp, Homo sapiens
tggataattttgca

SEQ ID NO: 6521481 - DNA, 20 bp, Homo sapiens
tggatacaccgaatgaccag

SEQ ID NO: 6521482 - DNA, 16 bp, Homo sapiens
tggatacagagccacg

SEQ ID NO: 6521483 - DNA, 13 bp, Homo sapiens
tggatacagtgcc

SEQ ID NO: 6521484 - DNA, 21 bp, Homo sapiens
tggatacagtgcccaccgccc

SEQ ID NO: 6521485 - DNA, 16 bp, Homo sapiens
tggatacataaagact

SEQ ID NO: 6521486 - DNA, 18 bp, Homo sapiens
tggatacatacaccagca

SEQ ID NO: 6521487 - DNA, 15 bp, Homo sapiens
tggatacatatttca

SEQ ID NO: 6521488 - DNA, 16 bp, Homo sapiens
tggatacatctgctgt

SEQ ID NO: 6521489 - DNA, 19 bp, Homo sapiens
tggatacatctgctgtgtg

SEQ ID NO: 6521490 - DNA, 20 bp, Homo sapiens
tggataccagatatttgaat

SEQ ID NO: 6521491 - DNA, 18 bp, Homo sapiens
tggataccagctcagggg

SEQ ID NO: 6521492 - DNA, 13 bp, Homo sapiens
tggataccattat

SEQ ID NO: 6521493 - DNA, 21 bp, Homo sapiens
tggatacgtgtcaatgtgtgc

SEQ ID NO: 6521494 - DNA, 15 bp, Homo sapiens
tggatactacatctt

SEQ ID NO: 6521495 - DNA, 17 bp, Homo sapiens
tggatactgcccggggc

SEQ ID NO: 6521496 - DNA, 11 bp, Homo sapiens
tggatactgta

SEQ ID NO: 6521497 - DNA, 14 bp, Homo sapiens
tggatagaaaaaaa

SEQ ID NO: 6521498 - DNA, 15 bp, Homo sapiens
tggatagaaaaatgc

SEQ ID NO: 6521499 - DNA, 13 bp, Homo sapiens
tggatagatgccc

SEQ ID NO: 6521500 - DNA, 16 bp, Homo sapiens
tggatagcatgtcttt

SEQ ID NO: 6521501 - DNA, 16 bp, Homo sapiens
tggatagccttgaaaa

SEQ ID NO: 6521502 - DNA, 17 bp, Homo sapiens
tggatagctgccttttt

SEQ ID NO: 6521503 - DNA, 14 bp, Homo sapiens
tggataggagagga

SEQ ID NO: 6521504 - DNA, 15 bp, Homo sapiens
tggatataaaatgtg

SEQ ID NO: 6521505 - DNA, 13 bp, Homo sapiens
tggatataaatat

SEQ ID NO: 6521506 - DNA, 21 bp, Homo sapiens
tggatataatctgaatcctgt

SEQ ID NO: 6521507 - DNA, 17 bp, Homo sapiens
tggatataatgtatttt

SEQ ID NO: 6521508 - DNA, 15 bp, Homo sapiens
ttaattcaattaaaa

SEQ ID NO: 6521509 - DNA, 16 bp, Homo sapiens
ttaattcaccaaagta

SEQ ID NO: 6521510 - DNA, 17 bp, Homo sapiens
ttaattcacctatgtta

SEQ ID NO: 6521511 - DNA, 21 bp, Homo sapiens
ttaattcagaaccccaactac

SEQ ID NO: 6521512 - DNA, 22 bp, Homo sapiens
ttaattcagatgttttacgcaa

SEQ ID NO: 6521513 - DNA, 21 bp, Homo sapiens
ttaattcaggtgataactcac

SEQ ID NO: 6521514 - DNA, 17 bp, Homo sapiens
ttaattcaggtttttta

SEQ ID NO: 6521515 - DNA, 13 bp, Homo sapiens
ttaattcagtaca

SEQ ID NO: 6521516 - DNA, 15 bp, Homo sapiens
ttaattcatgaggag

SEQ ID NO: 6521517 - DNA, 21 bp, Homo sapiens
ttaattccatgaatcgcttct

SEQ ID NO: 6521518 - DNA, 19 bp, Homo sapiens
ttaattccatgtcagataa

SEQ ID NO: 6521519 - DNA, 23 bp, Homo sapiens
ttaattccatgtcagataagtgt

SEQ ID NO: 6521520 - DNA, 15 bp, Homo sapiens
ttaattccccttccc

SEQ ID NO: 6521521 - DNA, 22 bp, Homo sapiens
ttaattccctgctaaatgccat

SEQ ID NO: 6521522 - DNA, 14 bp, Homo sapiens
ttaattcctatgaa

SEQ ID NO: 6521523 - DNA, 15 bp, Homo sapiens
ttaattcctcagtta

SEQ ID NO: 6521524 - DNA, 14 bp, Homo sapiens
ttaattctaaactt

SEQ ID NO: 6521525 - DNA, 15 bp, Homo sapiens
ttaattctaaactta

SEQ ID NO: 6521526 - DNA, 13 bp, Homo sapiens
ttaattctactaa

SEQ ID NO: 6521527 - DNA, 15 bp, Homo sapiens
ttaattctactaaat

SEQ ID NO: 6521528 - DNA, 20 bp, Homo sapiens
ttaattctagatcagagagc

SEQ ID NO: 6521529 - DNA, 17 bp, Homo sapiens
ttaattctcatgtgatc

SEQ ID NO: 6521530 - DNA, 13 bp, Homo sapiens
ttaattctcattt

SEQ ID NO: 6521531 - DNA, 18 bp, Homo sapiens
ttaattctccttcccaga

SEQ ID NO: 6521532 - DNA, 14 bp, Homo sapiens
ttaattctcttgaa

SEQ ID NO: 6521533 - DNA, 18 bp, Homo sapiens
ttaattcttaaaactata

SEQ ID NO: 6521534 - DNA, 21 bp, Homo sapiens
ttaattcttaaaactataaca

SEQ ID NO: 6521535 - DNA, 22 bp, Homo sapiens
ttaattcttaaaactataacat

SEQ ID NO: 6521536 - DNA, 14 bp, Homo sapiens
ttaattcttacctc

SEQ ID NO: 6521537 - DNA, 22 bp, Homo sapiens
ttaattcttacctcatttgcat

SEQ ID NO: 6521538 - DNA, 15 bp, Homo sapiens
ttaattcttagctca

SEQ ID NO: 6521539 - DNA, 22 bp, Homo sapiens
ttaattcttcagcgtaaaatgg

SEQ ID NO: 6521540 - DNA, 23 bp, Homo sapiens
ttaattctttatcacatgttgtc

SEQ ID NO: 6521541 - DNA, 14 bp, Homo sapiens
ttaattctttctat

SEQ ID NO: 6521542 - DNA, 17 bp, Homo sapiens
ttaattctttgttctgt

SEQ ID NO: 6521543 - DNA, 23 bp, Homo sapiens
ttaattgaaaagaagtagtgtct

SEQ ID NO: 6521544 - DNA, 20 bp, Homo sapiens
ttaattgaaactagttattt

SEQ ID NO: 6521545 - DNA, 20 bp, Homo sapiens
ttaattgaaagggacaagta

SEQ ID NO: 6521546 - DNA, 16 bp, Homo sapiens
ttaattgaaagtataa

SEQ ID NO: 6521547 - DNA, 13 bp, Homo sapiens
ttaattgaaatta

SEQ ID NO: 6521548 - DNA, 16 bp, Homo sapiens
ttaattgccagcaaat

SEQ ID NO: 6521549 - DNA, 17 bp, Homo sapiens
ttaattgccagcaaata

SEQ ID NO: 6521550 - DNA, 18 bp, Homo sapiens
ttaattgcgtagaggcta

SEQ ID NO: 6521551 - DNA, 22 bp, Homo sapiens
ttaattgctctatgcctcagtt

SEQ ID NO: 6521552 - DNA, 15 bp, Homo sapiens
ttaattgctttcctg

SEQ ID NO: 6521553 - DNA, 19 bp, Homo sapiens
ttaattgctttcctgcctc

SEQ ID NO: 6521554 - DNA, 12 bp, Homo sapiens
ttaattgctttg

SEQ ID NO: 6521555 - DNA, 16 bp, Homo sapiens
ttaattggcagcagat

SEQ ID NO: 6521556 - DNA, 19 bp, Homo sapiens
ttaattggcagcagatttt

SEQ ID NO: 6521557 - DNA, 18 bp, Homo sapiens
ttaattgggccagctttt

SEQ ID NO: 6521558 - DNA, 22 bp, Homo sapiens
ttaattgggccagcttttcaaa

SEQ ID NO: 6521559 - DNA, 15 bp, Homo sapiens
ttaattgtaaactgt

SEQ ID NO: 6521560 - DNA, 18 bp, Homo sapiens
ttaattgtaaactgtact

SEQ ID NO: 6521561 - DNA, 14 bp, Homo sapiens
ttaattgtaaagta

SEQ ID NO: 6521562 - DNA, 14 bp, Homo sapiens
ttaattgtaatctg

SEQ ID NO: 6521563 - DNA, 23 bp, Homo sapiens
ttaattgtaggtcaatgaaatat

SEQ ID NO: 6521564 - DNA, 12 bp, Homo sapiens
ttaattgtataa

SEQ ID NO: 6521565 - DNA, 13 bp, Homo sapiens
ttaattgtatttt

SEQ ID NO: 6521566 - DNA, 14 bp, Homo sapiens
ttaattgtcatggt

SEQ ID NO: 6521567 - DNA, 20 bp, Homo sapiens
ttaattgtgtaactgttctt

SEQ ID NO: 6521568 - DNA, 11 bp, Homo sapiens
ttaattgtgtc

SEQ ID NO: 6521569 - DNA, 12 bp, Homo sapiens
ttaattgtgtgg

SEQ ID NO: 6521570 - DNA, 15 bp, Homo sapiens
ttaattgttcatttt

SEQ ID NO: 6521571 - DNA, 15 bp, Homo sapiens
ttaattgttccttgc

SEQ ID NO: 6521572 - DNA, 20 bp, Homo sapiens
ttaattgttgtttctttcta

SEQ ID NO: 6521573 - DNA, 12 bp, Homo sapiens
ttaattgtttaa

SEQ ID NO: 6521574 - DNA, 12 bp, Homo sapiens
ttaattgtttta

SEQ ID NO: 6521575 - DNA, 19 bp, Homo sapiens
ttaattgttttgcactttt

SEQ ID NO: 6521576 - DNA, 21 bp, Homo sapiens
ttaatttaaaaaagcaaatgg

SEQ ID NO: 6521577 - DNA, 13 bp, Homo sapiens
ttaatttaaatga

SEQ ID NO: 6521578 - DNA, 12 bp, Homo sapiens
ttaatttaactt

SEQ ID NO: 6521579 - DNA, 16 bp, Homo sapiens
ttaatttaagttttga

SEQ ID NO: 6521580 - DNA, 12 bp, Homo sapiens
ttaatttaatgt

SEQ ID NO: 6521581 - DNA, 14 bp, Homo sapiens
ttaatttaatgtat

SEQ ID NO: 6521582 - DNA, 13 bp, Homo sapiens
ttaatttaatttt

SEQ ID NO: 6521583 - DNA, 14 bp, Homo sapiens
ttaatttacaaaaa

SEQ ID NO: 6521584 - DNA, 23 bp, Homo sapiens
ttaatttactgattccagcaaga

SEQ ID NO: 6521585 - DNA, 18 bp, Homo sapiens
ttaatttactttctgcac

SEQ ID NO: 6521586 - DNA, 15 bp, Homo sapiens
ttaatttagaaaact

SEQ ID NO: 6521587 - DNA, 17 bp, Homo sapiens
ttaatttagaaactgaa

SEQ ID NO: 6521588 - DNA, 21 bp, Homo sapiens
ttaatttagaaactgaaaaat

SEQ ID NO: 6521589 - DNA, 21 bp, Homo sapiens
ttaatttagagcgtttggtta

SEQ ID NO: 6521590 - DNA, 12 bp, Homo sapiens
ttaatttagata

SEQ ID NO: 6521591 - DNA, 21 bp, Homo sapiens
ttaatttagatattttccata

SEQ ID NO: 6521592 - DNA, 22 bp, Homo sapiens
ttaatttagatattttccatat

SEQ ID NO: 6521593 - DNA, 16 bp, Homo sapiens
ttaatttaggacacat

SEQ ID NO: 6521594 - DNA, 17 bp, Homo sapiens
ttaatttagtaaaccaa

SEQ ID NO: 6521595 - DNA, 19 bp, Homo sapiens
ttaatttagtaaataaaca

SEQ ID NO: 6521596 - DNA, 15 bp, Homo sapiens
ttaatttataatgta

SEQ ID NO: 6521597 - DNA, 17 bp, Homo sapiens
ttaatttatctaaatta

SEQ ID NO: 6521598 - DNA, 14 bp, Homo sapiens
ttaatttatgcaga

SEQ ID NO: 6521599 - DNA, 20 bp, Homo sapiens
ttaatttattaaatttatta

SEQ ID NO: 6521600 - DNA, 14 bp, Homo sapiens
ttaatttattatta

SEQ ID NO: 6521601 - DNA, 13 bp, Homo sapiens
ttaatttattggg

SEQ ID NO: 6521602 - DNA, 13 bp, Homo sapiens
ttaatttatttaa

SEQ ID NO: 6521603 - DNA, 14 bp, Homo sapiens
ttaatttatttaat

SEQ ID NO: 6521604 - DNA, 14 bp, Homo sapiens
ttaatttatttcat

SEQ ID NO: 6521605 - DNA, 14 bp, Homo sapiens
ttaatttcaagctt

SEQ ID NO: 6521606 - DNA, 19 bp, Homo sapiens
ttaatttcaggaaaatgta

SEQ ID NO: 6521607 - DNA, 14 bp, Homo sapiens
ttaatttcagtaag

SEQ ID NO: 6521608 - DNA, 20 bp, Homo sapiens
ttaatttcagtcctgtagtt

SEQ ID NO: 6521609 - DNA, 23 bp, Homo sapiens
ttaatttcagtcctgtagtttta

SEQ ID NO: 6521610 - DNA, 15 bp, Homo sapiens
ttaatttcataaatt

SEQ ID NO: 6521611 - DNA, 22 bp, Homo sapiens
ttaatttccaggaaaaaataaa

SEQ ID NO: 6521612 - DNA, 21 bp, Homo sapiens
ttaatttccttctgttaagaa

SEQ ID NO: 6521613 - DNA, 13 bp, Homo sapiens
ttaatttcctttt

SEQ ID NO: 6521614 - DNA, 16 bp, Homo sapiens
ttaatttcctttttga

SEQ ID NO: 6521615 - DNA, 19 bp, Homo sapiens
ttaatttcctttttgacac

SEQ ID NO: 6521616 - DNA, 21 bp, Homo sapiens
ttaatttcctttttgacactg

SEQ ID NO: 6521617 - DNA, 22 bp, Homo sapiens
ttaatttcctttttgacactga

SEQ ID NO: 6521618 - DNA, 23 bp, Homo sapiens
ttaatttcctttttgacactgaa

SEQ ID NO: 6521619 - DNA, 20 bp, Homo sapiens
ttaatttctaagaagttact

SEQ ID NO: 6521620 - DNA, 13 bp, Homo sapiens
ttaatttctgaag

SEQ ID NO: 6521621 - DNA, 22 bp, Homo sapiens
ttaatttctgcctttcccccct

SEQ ID NO: 6521622 - DNA, 17 bp, Homo sapiens
ttaatttcttcaaaatg

SEQ ID NO: 6521623 - DNA, 18 bp, Homo sapiens
ttaatttcttgcaatttg

SEQ ID NO: 6521624 - DNA, 20 bp, Homo sapiens
ttaatttgaaaccaggacat

SEQ ID NO: 6521625 - DNA, 13 bp, Homo sapiens
ttaatttgaaata

SEQ ID NO: 6521626 - DNA, 15 bp, Homo sapiens
ttaatttgaaatatg

SEQ ID NO: 6521627 - DNA, 15 bp, Homo sapiens
ttaatttgaaatcta

SEQ ID NO: 6521628 - DNA, 22 bp, Homo sapiens
ttaatttgcaaccatcagaatt

SEQ ID NO: 6521629 - DNA, 13 bp, Homo sapiens
ttaatttggacca

SEQ ID NO: 6521630 - DNA, 19 bp, Homo sapiens
ttaatttggaccattttcc

SEQ ID NO: 6521631 - DNA, 21 bp, Homo sapiens
ttaatttggataataaaaatt

SEQ ID NO: 6521632 - DNA, 23 bp, Homo sapiens
ttaatttggcttttcttatttaa

SEQ ID NO: 6521633 - DNA, 18 bp, Homo sapiens
ttaatttggtagatgaca

SEQ ID NO: 6521634 - DNA, 21 bp, Homo sapiens
ttaatttgtaaaacttctgct

SEQ ID NO: 6521635 - DNA, 14 bp, Homo sapiens
ttaatttgtaaact

SEQ ID NO: 6521636 - DNA, 18 bp, Homo sapiens
ttaatttgtaaacttctg

SEQ ID NO: 6521637 - DNA, 16 bp, Homo sapiens
ttaatttgtatttccc

SEQ ID NO: 6521638 - DNA, 22 bp, Homo sapiens
ttaatttgtgaaaatgtaatta

SEQ ID NO: 6521639 - DNA, 11 bp, Homo sapiens
ttaatttgtgt

SEQ ID NO: 6521640 - DNA, 13 bp, Homo sapiens
ttaatttgtgtgt

SEQ ID NO: 6521641 - DNA, 18 bp, Homo sapiens
ttaatttgttttgtttta

SEQ ID NO: 6521642 - DNA, 21 bp, Homo sapiens
ttaattttaaagagtgtgtta

SEQ ID NO: 6521643 - DNA, 16 bp, Homo sapiens
ttaattttaaagtgca

SEQ ID NO: 6521644 - DNA, 15 bp, Homo sapiens
ttaattttaactgat

SEQ ID NO: 6521645 - DNA, 19 bp, Homo sapiens
ttaattttagagaaacttt

SEQ ID NO: 6521646 - DNA, 17 bp, Homo sapiens
ttaattttagtttttca

SEQ ID NO: 6521647 - DNA, 17 bp, Homo sapiens
ttaattttattcaagaa

SEQ ID NO: 6521648 - DNA, 22 bp, Homo sapiens
ttaattttcaggatttttggta

SEQ ID NO: 6521649 - DNA, 13 bp, Homo sapiens
ttaattttcagtt

SEQ ID NO: 6521650 - DNA, 20 bp, Homo sapiens
ttaattttcctggaaagact

SEQ ID NO: 6521651 - DNA, 20 bp, Homo sapiens
ttaattttctaaaacaagtt

SEQ ID NO: 6521652 - DNA, 15 bp, Homo sapiens
ttaattttctatgaa

SEQ ID NO: 6521653 - DNA, 17 bp, Homo sapiens
ttaattttctttatgga

SEQ ID NO: 6521654 - DNA, 23 bp, Homo sapiens
ttaattttgaagtgctgtttatt

SEQ ID NO: 6521655 - DNA, 23 bp, Homo sapiens
ttaattttggttgtattctttga

SEQ ID NO: 6521656 - DNA, 16 bp, Homo sapiens
ttaattttgtattttc

SEQ ID NO: 6521657 - DNA, 17 bp, Homo sapiens
ttaattttgtattttcc

SEQ ID NO: 6521658 - DNA, 18 bp, Homo sapiens
ttaattttgtattttcca

SEQ ID NO: 6521659 - DNA, 17 bp, Homo sapiens
ttaattttgtgaatcta

SEQ ID NO: 6521660 - DNA, 14 bp, Homo sapiens
ttaattttgtgcat

SEQ ID NO: 6521661 - DNA, 14 bp, Homo sapiens
ttaattttgtgttg

SEQ ID NO: 6521662 - DNA, 17 bp, Homo sapiens
ttaattttgtgttgcta

SEQ ID NO: 6521663 - DNA, 20 bp, Homo sapiens
ttaattttgtgttgctaaaa

SEQ ID NO: 6521664 - DNA, 16 bp, Homo sapiens
ttaatttttaaaagac

SEQ ID NO: 6521665 - DNA, 18 bp, Homo sapiens
ttaatttttaaaagactt

SEQ ID NO: 6521666 - DNA, 19 bp, Homo sapiens
ttaatttttaaaagacttt

SEQ ID NO: 6521667 - DNA, 13 bp, Homo sapiens
ttaatttttaaga

SEQ ID NO: 6521668 - DNA, 17 bp, Homo sapiens
ttaatttttaattgaaa

SEQ ID NO: 6521669 - DNA, 19 bp, Homo sapiens
ttaatttttacatggagaa

SEQ ID NO: 6521670 - DNA, 18 bp, Homo sapiens
ttaatttttccaactact

SEQ ID NO: 6521671 - DNA, 13 bp, Homo sapiens
ttaatttttcctt

SEQ ID NO: 6521672 - DNA, 15 bp, Homo sapiens
ttaatttttcctttt

SEQ ID NO: 6521673 - DNA, 21 bp, Homo sapiens
ttaatttttgaaaagctgcta

SEQ ID NO: 6521674 - DNA, 15 bp, Homo sapiens
ttaatttttttattg

SEQ ID NO: 6521675 - DNA, 17 bp, Homo sapiens
ttaatttttttattgtt

SEQ ID NO: 6521676 - DNA, 16 bp, Homo sapiens
ttaattttttttaatg

SEQ ID NO: 6521677 - DNA, 18 bp, Homo sapiens
ttaattttttttaatgta

SEQ ID NO: 6521678 - DNA, 16 bp, Homo sapiens
ttaattttttttggtt

SEQ ID NO: 6521679 - DNA, 22 bp, Homo sapiens
ttacaaaaacaaaataaaataa

SEQ ID NO: 6521680 - DNA, 17 bp, Homo sapiens
ttacaaaaatagtagaa

SEQ ID NO: 6521681 - DNA, 14 bp, Homo sapiens
ttacaaaactgctt

SEQ ID NO: 6521682 - DNA, 16 bp, Homo sapiens
ttacaaaactgctttg

SEQ ID NO: 6521683 - DNA, 14 bp, Homo sapiens
ttacaaaaggcagc

SEQ ID NO: 6521684 - DNA, 15 bp, Homo sapiens
ttacaaaaggcagcc

SEQ ID NO: 6521685 - DNA, 19 bp, Homo sapiens
ttacaaaaggcagcccttt

SEQ ID NO: 6521686 - DNA, 22 bp, Homo sapiens
ttacaaaaggctcgtttggatc

SEQ ID NO: 6521687 - DNA, 13 bp, Homo sapiens
ttacaaaatgcca

SEQ ID NO: 6521688 - DNA, 13 bp, Homo sapiens
tggatatagaaaa

SEQ ID NO: 6521689 - DNA, 21 bp, Homo sapiens
tggatatagctaggtgacata

SEQ ID NO: 6521690 - DNA, 16 bp, Homo sapiens
tggatatagttttact

SEQ ID NO: 6521691 - DNA, 16 bp, Homo sapiens
tggatatatttaaaaa

SEQ ID NO: 6521692 - DNA, 13 bp, Homo sapiens
tggatatatttga

SEQ ID NO: 6521693 - DNA, 18 bp, Homo sapiens
tggatatatttgaaatag

SEQ ID NO: 6521694 - DNA, 19 bp, Homo sapiens
tggatatatttgaaatagt

SEQ ID NO: 6521695 - DNA, 14 bp, Homo sapiens
tggatatcagggta

SEQ ID NO: 6521696 - DNA, 20 bp, Homo sapiens
tggatatcagggtataaatt

SEQ ID NO: 6521697 - DNA, 16 bp, Homo sapiens
tggatatcgtcatttt

SEQ ID NO: 6521698 - DNA, 13 bp, Homo sapiens
tggatatctgtta

SEQ ID NO: 6521699 - DNA, 18 bp, Homo sapiens
tggatatctgttagatgc

SEQ ID NO: 6521700 - DNA, 13 bp, Homo sapiens
tggatatgctgct

SEQ ID NO: 6521701 - DNA, 20 bp, Homo sapiens
tggatatggtgcaaaaatga

SEQ ID NO: 6521702 - DNA, 17 bp, Homo sapiens
ttactcacattctgttg

SEQ ID NO: 6521703 - DNA, 19 bp, Homo sapiens
ttactcaccatatttgaat

SEQ ID NO: 6521704 - DNA, 23 bp, Homo sapiens
ttactcagaattctctagtttga

SEQ ID NO: 6521705 - DNA, 13 bp, Homo sapiens
ttactcagagctg

SEQ ID NO: 6521706 - DNA, 22 bp, Homo sapiens
ttactcagatgacctgaggaaa

SEQ ID NO: 6521707 - DNA, 15 bp, Homo sapiens
ttactcagcagcaga

SEQ ID NO: 6521708 - DNA, 13 bp, Homo sapiens
ttactcagcccag

SEQ ID NO: 6521709 - DNA, 12 bp, Homo sapiens
ttactcagccct

SEQ ID NO: 6521710 - DNA, 13 bp, Homo sapiens
ttactcagccctg

SEQ ID NO: 6521711 - DNA, 14 bp, Homo sapiens
ttactcagccctgg

SEQ ID NO: 6521712 - DNA, 14 bp, Homo sapiens
ttactcaggaagaa

SEQ ID NO: 6521713 - DNA, 17 bp, Homo sapiens
ttactcaggaagaacac

SEQ ID NO: 6521714 - DNA, 18 bp, Homo sapiens
ttactcagggctcctccc

SEQ ID NO: 6521715 - DNA, 19 bp, Homo sapiens
ttactcagggctcctccca

SEQ ID NO: 6521716 - DNA, 21 bp, Homo sapiens
ttactcagggctcctcccagc

SEQ ID NO: 6521717 - DNA, 13 bp, Homo sapiens
ttactcaggggat

SEQ ID NO: 6521718 - DNA, 14 bp, Homo sapiens
ttactcaggggatg

SEQ ID NO: 6521719 - DNA, 21 bp, Homo sapiens
ttactcaggggatgtttacct

SEQ ID NO: 6521720 - DNA, 12 bp, Homo sapiens
ttactcaggttt

SEQ ID NO: 6521721 - DNA, 15 bp, Homo sapiens
ttactcagtttatgt

SEQ ID NO: 6521722 - DNA, 21 bp, Homo sapiens
ttactcataaggcatatacaa

SEQ ID NO: 6521723 - DNA, 15 bp, Homo sapiens
ttactcatctttatc

SEQ ID NO: 6521724 - DNA, 20 bp, Homo sapiens
ttactcattaattcaatgaa

SEQ ID NO: 6521725 - DNA, 23 bp, Homo sapiens
ttactcattaattcaatgaaatg

SEQ ID NO: 6521726 - DNA, 18 bp, Homo sapiens
ttactcattactgcaaat

SEQ ID NO: 6521727 - DNA, 17 bp, Homo sapiens
ttactcattgaaatgtc

SEQ ID NO: 6521728 - DNA, 16 bp, Homo sapiens
ttactcattgccccca

SEQ ID NO: 6521729 - DNA, 18 bp, Homo sapiens
ttactccaaaaagaaata

SEQ ID NO: 6521730 - DNA, 24 bp, Homo sapiens
ttactccaaaacttcgtttaatga

SEQ ID NO: 6521731 - DNA, 14 bp, Homo sapiens
ttactccctgttat

SEQ ID NO: 6521732 - DNA, 14 bp, Homo sapiens
ttactcccttcctg

SEQ ID NO: 6521733 - DNA, 16 bp, Homo sapiens
ttactcccttctgtag

SEQ ID NO: 6521734 - DNA, 15 bp, Homo sapiens
ttactcctcacactt

SEQ ID NO: 6521735 - DNA, 21 bp, Homo sapiens
ttactcctcacacttactgta

SEQ ID NO: 6521736 - DNA, 17 bp, Homo sapiens
ttactcctcctctttct

SEQ ID NO: 6521737 - DNA, 18 bp, Homo sapiens
ttactcctcctctttctc

SEQ ID NO: 6521738 - DNA, 19 bp, Homo sapiens
ttactcctctgaccctcct

SEQ ID NO: 6521739 - DNA, 22 bp, Homo sapiens
ttactcctctgaccctccttct

SEQ ID NO: 6521740 - DNA, 22 bp, Homo sapiens
ttactcctttgcattccatgat

SEQ ID NO: 6521741 - DNA, 16 bp, Homo sapiens
ttactcgatgtaaggg

SEQ ID NO: 6521742 - DNA, 14 bp, Homo sapiens
ttactctaaataga

SEQ ID NO: 6521743 - DNA, 22 bp, Homo sapiens
ttactctaagatcttagattct

SEQ ID NO: 6521744 - DNA, 15 bp, Homo sapiens
ttactctacactgaa

SEQ ID NO: 6521745 - DNA, 18 bp, Homo sapiens
ttactctatgatgattgc

SEQ ID NO: 6521746 - DNA, 19 bp, Homo sapiens
ttactctatgatgattgct

SEQ ID NO: 6521747 - DNA, 21 bp, Homo sapiens
ttactctatgccccaaatata

SEQ ID NO: 6521748 - DNA, 15 bp, Homo sapiens
ttactctcattcttt

SEQ ID NO: 6521749 - DNA, 12 bp, Homo sapiens
ttactctctccg

SEQ ID NO: 6521750 - DNA, 13 bp, Homo sapiens
ttactctctccga

SEQ ID NO: 6521751 - DNA, 13 bp, Homo sapiens
ttactctgaaggg

SEQ ID NO: 6521752 - DNA, 14 bp, Homo sapiens
ttactctgacataa

SEQ ID NO: 6521753 - DNA, 16 bp, Homo sapiens
ttactctgacataaac

SEQ ID NO: 6521754 - DNA, 18 bp, Homo sapiens
ttactctgagcccaggcc

SEQ ID NO: 6521755 - DNA, 18 bp, Homo sapiens
ttactctgcctacagaac

SEQ ID NO: 6521756 - DNA, 23 bp, Homo sapiens
ttactctgcggtggtgccagagg

SEQ ID NO: 6521757 - DNA, 23 bp, Homo sapiens
ttactctggagcaacctactgtc

SEQ ID NO: 6521758 - DNA, 18 bp, Homo sapiens
ttactctgggagtaatac

SEQ ID NO: 6521759 - DNA, 18 bp, Homo sapiens
ttactctgtgtaaagact

SEQ ID NO: 6521760 - DNA, 17 bp, Homo sapiens
ttactcttatcattttt

SEQ ID NO: 6521761 - DNA, 14 bp, Homo sapiens
ttactcttgggaca

SEQ ID NO: 6521762 - DNA, 18 bp, Homo sapiens
ttactcttgttgcccagg

SEQ ID NO: 6521763 - DNA, 19 bp, Homo sapiens
ttactcttgttgcccaggc

SEQ ID NO: 6521764 - DNA, 13 bp, Homo sapiens
ttactctttgaaa

SEQ ID NO: 6521765 - DNA, 21 bp, Homo sapiens
ttactgaaaaaaaaaaaagaa

SEQ ID NO: 6521766 - DNA, 12 bp, Homo sapiens
ttactgaaaaag

SEQ ID NO: 6521767 - DNA, 20 bp, Homo sapiens
ttactgaaaacaaaatatct

SEQ ID NO: 6521768 - DNA, 22 bp, Homo sapiens
ttactgaaatcttgtaagtatt

SEQ ID NO: 6521769 - DNA, 23 bp, Homo sapiens
ttactgaacaatcaaagcacttg

SEQ ID NO: 6521770 - DNA, 17 bp, Homo sapiens
ttactgaagaaatcttt

SEQ ID NO: 6521771 - DNA, 20 bp, Homo sapiens
ttactgaaggtaaaattgaa

SEQ ID NO: 6521772 - DNA, 15 bp, Homo sapiens
ttactgaatgatcta

SEQ ID NO: 6521773 - DNA, 16 bp, Homo sapiens
ttactgaatgatctat

SEQ ID NO: 6521774 - DNA, 13 bp, Homo sapiens
ttactgaatgtta

SEQ ID NO: 6521775 - DNA, 22 bp, Homo sapiens
ttactgacacttcctgtccttg

SEQ ID NO: 6521776 - DNA, 12 bp, Homo sapiens
ttactgaccagc

SEQ ID NO: 6521777 - DNA, 13 bp, Homo sapiens
ttactgagatgtt

SEQ ID NO: 6521778 - DNA, 21 bp, Homo sapiens
ttactgagcgcaagccacagc

SEQ ID NO: 6521779 - DNA, 13 bp, Homo sapiens
ttactgagcttct

SEQ ID NO: 6521780 - DNA, 19 bp, Homo sapiens
ttactgagcttctctgtga

SEQ ID NO: 6521781 - DNA, 13 bp, Homo sapiens
ttactgaggaaag

SEQ ID NO: 6521782 - DNA, 18 bp, Homo sapiens
ttactgaggggattctct

SEQ ID NO: 6521783 - DNA, 21 bp, Homo sapiens
ttactgatactacaacttttg

SEQ ID NO: 6521784 - DNA, 15 bp, Homo sapiens
ttactgatcatgcat

SEQ ID NO: 6521785 - DNA, 19 bp, Homo sapiens
ttactgatcatgcattgtt

SEQ ID NO: 6521786 - DNA, 12 bp, Homo sapiens
ttactgatgaga

SEQ ID NO: 6521787 - DNA, 18 bp, Homo sapiens
ttactgatgtgatattct

SEQ ID NO: 6521788 - DNA, 16 bp, Homo sapiens
ttactgattaacaaat

SEQ ID NO: 6521789 - DNA, 13 bp, Homo sapiens
ttactgcaaatgt

SEQ ID NO: 6521790 - DNA, 14 bp, Homo sapiens
ttactgcaaattga

SEQ ID NO: 6521791 - DNA, 16 bp, Homo sapiens
ttactgcaaattgatt

SEQ ID NO: 6521792 - DNA, 20 bp, Homo sapiens
ttactgcaacttaacttaaa

SEQ ID NO: 6521793 - DNA, 13 bp, Homo sapiens
ttactgcaatcac

SEQ ID NO: 6521794 - DNA, 15 bp, Homo sapiens
ttactgcaatcactg

SEQ ID NO: 6521795 - DNA, 16 bp, Homo sapiens
ttactgcaatcactgt

SEQ ID NO: 6521796 - DNA, 16 bp, Homo sapiens
ttactgcaatgtctgt

SEQ ID NO: 6521797 - DNA, 20 bp, Homo sapiens
ttactgcaatgtctgtccct

SEQ ID NO: 6521798 - DNA, 18 bp, Homo sapiens
ttactgcactcagattta

SEQ ID NO: 6521799 - DNA, 23 bp, Homo sapiens
ttactgcagcctgggctccctct

SEQ ID NO: 6521800 - DNA, 22 bp, Homo sapiens
ttactgcagcctttgcctcccc

SEQ ID NO: 6521801 - DNA, 15 bp, Homo sapiens
ttactgcagctttgt

SEQ ID NO: 6521802 - DNA, 22 bp, Homo sapiens
ttactgcagtacatacgtctgc

SEQ ID NO: 6521803 - DNA, 12 bp, Homo sapiens
ttactgcatttt

SEQ ID NO: 6521804 - DNA, 13 bp, Homo sapiens
ttactgcattttc

SEQ ID NO: 6521805 - DNA, 17 bp, Homo sapiens
ttactgccaaaaccaaa

SEQ ID NO: 6521806 - DNA, 19 bp, Homo sapiens
ttactgccaaaaccaaatt

SEQ ID NO: 6521807 - DNA, 21 bp, Homo sapiens
ttactgccaaaaccaaattga

SEQ ID NO: 6521808 - DNA, 15 bp, Homo sapiens
ttactgcccagatgt

SEQ ID NO: 6521809 - DNA, 17 bp, Homo sapiens
ttactgcccagatgttt

SEQ ID NO: 6521810 - DNA, 19 bp, Homo sapiens
ttactgcccagatgtttta

SEQ ID NO: 6521811 - DNA, 21 bp, Homo sapiens
ttactgccctttcaaagcact

SEQ ID NO: 6521812 - DNA, 13 bp, Homo sapiens
ttactgccttcag

SEQ ID NO: 6521813 - DNA, 19 bp, Homo sapiens
ttactgccttcagtatcaa

SEQ ID NO: 6521814 - DNA, 22 bp, Homo sapiens
ttactgctaagtatttcccagc

SEQ ID NO: 6521815 - DNA, 17 bp, Homo sapiens
ttactgctgattcttgt

SEQ ID NO: 6521816 - DNA, 21 bp, Homo sapiens
ttactgctgattcttgtaaat

SEQ ID NO: 6521817 - DNA, 22 bp, Homo sapiens
ttactgctgattcttgtaaatc

SEQ ID NO: 6521818 - DNA, 16 bp, Homo sapiens
ttactgctgctgtgct

SEQ ID NO: 6521819 - DNA, 14 bp, Homo sapiens
ttactgctgtcatt

SEQ ID NO: 6521820 - DNA, 20 bp, Homo sapiens
ttactgctgtcattgtccat

SEQ ID NO: 6521821 - DNA, 23 bp, Homo sapiens
ttactgcttcatttttgtaataa

SEQ ID NO: 6521822 - DNA, 19 bp, Homo sapiens
ttactgcttcccattgagt

SEQ ID NO: 6521823 - DNA, 18 bp, Homo sapiens
ttactgcttctctttgtg

SEQ ID NO: 6521824 - DNA, 17 bp, Homo sapiens
ttactgctttaatcaga

SEQ ID NO: 6521825 - DNA, 19 bp, Homo sapiens
ttactgctttaatcagaaa

SEQ ID NO: 6521826 - DNA, 15 bp, Homo sapiens
ttactgctttgcaaa

SEQ ID NO: 6521827 - DNA, 14 bp, Homo sapiens
ttactgcttttcat

SEQ ID NO: 6521828 - DNA, 17 bp, Homo sapiens
ttactggaaatgagccc

SEQ ID NO: 6521829 - DNA, 21 bp, Homo sapiens
ttactggaagacgaagtgtaa

SEQ ID NO: 6521830 - DNA, 18 bp, Homo sapiens
ttactggaattcttctgc

SEQ ID NO: 6521831 - DNA, 17 bp, Homo sapiens
ttactggacaaagaatt

SEQ ID NO: 6521832 - DNA, 14 bp, Homo sapiens
ttactggacctgaa

SEQ ID NO: 6521833 - DNA, 16 bp, Homo sapiens
ttactggacctgaaat

SEQ ID NO: 6521834 - DNA, 17 bp, Homo sapiens
ttactggacctgaaatt

SEQ ID NO: 6521835 - DNA, 19 bp, Homo sapiens
ttactggactgtctgatca

SEQ ID NO: 6521836 - DNA, 18 bp, Homo sapiens
ttactggataaatttaaa

SEQ ID NO: 6521837 - DNA, 12 bp, Homo sapiens
ttactggcactg

SEQ ID NO: 6521838 - DNA, 17 bp, Homo sapiens
ttactggcactgtggca

SEQ ID NO: 6521839 - DNA, 13 bp, Homo sapiens
ttactggcctttt

SEQ ID NO: 6521840 - DNA, 18 bp, Homo sapiens
ttactggcctttttcatt

SEQ ID NO: 6521841 - DNA, 20 bp, Homo sapiens
ttactggcctttttcattta

SEQ ID NO: 6521842 - DNA, 16 bp, Homo sapiens
ttactggcgtggatta

SEQ ID NO: 6521843 - DNA, 23 bp, Homo sapiens
ttactggcgtggattaaacttat

SEQ ID NO: 6521844 - DNA, 16 bp, Homo sapiens
ttactggcttctcttg

SEQ ID NO: 6521845 - DNA, 12 bp, Homo sapiens
ttactgggaagc

SEQ ID NO: 6521846 - DNA, 14 bp, Homo sapiens
ttactgggccctga

SEQ ID NO: 6521847 - DNA, 14 bp, Homo sapiens
ttactgggttctta

SEQ ID NO: 6521848 - DNA, 22 bp, Homo sapiens
ttactggtaaagcctcatttga

SEQ ID NO: 6521849 - DNA, 17 bp, Homo sapiens
ttactggtccaaaagat

SEQ ID NO: 6521850 - DNA, 22 bp, Homo sapiens
ttactggtgaggttgaggaata

SEQ ID NO: 6521851 - DNA, 20 bp, Homo sapiens
ttactggtgatgttgaaata

SEQ ID NO: 6521852 - DNA, 17 bp, Homo sapiens
ttactggtgatttctga

SEQ ID NO: 6521853 - DNA, 14 bp, Homo sapiens
ttactggtgtgagc

SEQ ID NO: 6521854 - DNA, 14 bp, Homo sapiens
ttactggttgcatg

SEQ ID NO: 6521855 - DNA, 22 bp, Homo sapiens
ttactggttggtgttcttccca

SEQ ID NO: 6521856 - DNA, 23 bp, Homo sapiens
ttactggtttccccagggaagga

SEQ ID NO: 6521857 - DNA, 15 bp, Homo sapiens
ttactgtaaaatgca

SEQ ID NO: 6521858 - DNA, 20 bp, Homo sapiens
ttactgtaaaatgcaaaaaa

SEQ ID NO: 6521859 - DNA, 20 bp, Homo sapiens
ttactgtaaatgccttgctt

SEQ ID NO: 6521860 - DNA, 19 bp, Homo sapiens
ttactgtaactgtcagtgt

SEQ ID NO: 6521861 - DNA, 15 bp, Homo sapiens
ttactgtaagacatt

SEQ ID NO: 6521862 - DNA, 14 bp, Homo sapiens
ttactgtacatgaa

SEQ ID NO: 6521863 - DNA, 14 bp, Homo sapiens
ttactgtatataaa

SEQ ID NO: 6521864 - DNA, 14 bp, Homo sapiens
ttactgtatatgta

SEQ ID NO: 6521865 - DNA, 17 bp, Homo sapiens
ttactgtatatgtattc

SEQ ID NO: 6521866 - DNA, 23 bp, Homo sapiens
ttactgtatatgtattcccttgt

SEQ ID NO: 6521867 - DNA, 22 bp, Homo sapiens
ttactgtatgtataaattatga

SEQ ID NO: 6521868 - DNA, 21 bp, Homo sapiens
ttactgtatgtttttactgaa

SEQ ID NO: 6521869 - DNA, 23 bp, Homo sapiens
ttactgtatttgggatatgagtt

SEQ ID NO: 6521870 - DNA, 20 bp, Homo sapiens
ttactgtatttttcagaaat

SEQ ID NO: 6521871 - DNA, 14 bp, Homo sapiens
ttactgtcaaaata

SEQ ID NO: 6521872 - DNA, 18 bp, Homo sapiens
ttactgtcaataaacagc

SEQ ID NO: 6521873 - DNA, 20 bp, Homo sapiens
ttactgtcaataaacagctt

SEQ ID NO: 6521874 - DNA, 12 bp, Homo sapiens
ttactgtcagat

SEQ ID NO: 6521875 - DNA, 12 bp, Homo sapiens
tggcactgctgg

SEQ ID NO: 6521876 - DNA, 12 bp, Homo sapiens
tggcactgcttg

SEQ ID NO: 6521877 - DNA, 15 bp, Homo sapiens
tggcactggatggac

SEQ ID NO: 6521878 - DNA, 16 bp, Homo sapiens
tggcactggatggact

SEQ ID NO: 6521879 - DNA, 21 bp, Homo sapiens
tggcactggcaaacagggcct

SEQ ID NO: 6521880 - DNA, 17 bp, Homo sapiens
tggcactgggaggcagg

SEQ ID NO: 6521881 - DNA, 16 bp, Homo sapiens
tggcactgtccagggc

SEQ ID NO: 6521882 - DNA, 16 bp, Homo sapiens
tggcactgtggcactg

SEQ ID NO: 6521883 - DNA, 17 bp, Homo sapiens
tggcactgttaatacac

SEQ ID NO: 6521884 - DNA, 16 bp, Homo sapiens
tggcacttaagtgcac

SEQ ID NO: 6521885 - DNA, 18 bp, Homo sapiens
tggcacttaagtgcactt

SEQ ID NO: 6521886 - DNA, 18 bp, Homo sapiens
tggcacttagcccaagag

SEQ ID NO: 6521887 - DNA, 21 bp, Homo sapiens
tggcacttagctatcagaaga

SEQ ID NO: 6521888 - DNA, 20 bp, Homo sapiens
tggcacttagtaggtcctca

SEQ ID NO: 6521889 - DNA, 19 bp, Homo sapiens
tggcacttccacctccagc

SEQ ID NO: 6521890 - DNA, 21 bp, Homo sapiens
tggcacttccacctccagcct

SEQ ID NO: 6521891 - DNA, 14 bp, Homo sapiens
tggcacttgcatct

SEQ ID NO: 6521892 - DNA, 16 bp, Homo sapiens
tggcacttgctaacaa

SEQ ID NO: 6521893 - DNA, 12 bp, Homo sapiens
tggcacttgtat

SEQ ID NO: 6521894 - DNA, 14 bp, Homo sapiens
tggcactttaatga

SEQ ID NO: 6521895 - DNA, 16 bp, Homo sapiens
tggcactttgaagggg

SEQ ID NO: 6521896 - DNA, 13 bp, Homo sapiens
tggcacttttgag

SEQ ID NO: 6521897 - DNA, 17 bp, Homo sapiens
tggcacttttgatgaaa

SEQ ID NO: 6521898 - DNA, 21 bp, Homo sapiens
tggcactttttcatttgccta

SEQ ID NO: 6521899 - DNA, 18 bp, Homo sapiens
tggcacttttttaaatat

SEQ ID NO: 6521900 - DNA, 21 bp, Homo sapiens
tggcacttttttaaatataaa

SEQ ID NO: 6521901 - DNA, 22 bp, Homo sapiens
tggcagaaagatggagaggcat

SEQ ID NO: 6521902 - DNA, 23 bp, Homo sapiens
tggcagaaagcaaatgtgacctg

SEQ ID NO: 6521903 - DNA, 16 bp, Homo sapiens
tggcagaactgagctc

SEQ ID NO: 6521904 - DNA, 21 bp, Homo sapiens
tggcagaactgagctcctctg

SEQ ID NO: 6521905 - DNA, 17 bp, Homo sapiens
tggcagaactgctgggg

SEQ ID NO: 6521906 - DNA, 18 bp, Homo sapiens
tggcagaactgctggggc

SEQ ID NO: 6521907 - DNA, 20 bp, Homo sapiens
tggcagaactgctggggctg

SEQ ID NO: 6521908 - DNA, 23 bp, Homo sapiens
tggcagaactgctggggctggtg

SEQ ID NO: 6521909 - DNA, 24 bp, Homo sapiens
tggcagaactgctggggctggtga

SEQ ID NO: 6521910 - DNA, 13 bp, Homo sapiens
tggcagaagacac

SEQ ID NO: 6521911 - DNA, 20 bp, Homo sapiens
tggcagaagacaccagagca

SEQ ID NO: 6521912 - DNA, 21 bp, Homo sapiens
tggcagaagacaccagagcag

SEQ ID NO: 6521913 - DNA, 23 bp, Homo sapiens
tggcagaagcattgcctggactg

SEQ ID NO: 6521914 - DNA, 13 bp, Homo sapiens
tggcagaagcgtc

SEQ ID NO: 6521915 - DNA, 19 bp, Homo sapiens
tggcagaagggaattgctc

SEQ ID NO: 6521916 - DNA, 19 bp, Homo sapiens
tggcagaagtgtcaccctg

SEQ ID NO: 6521917 - DNA, 14 bp, Homo sapiens
tggcagaagtgttt

SEQ ID NO: 6521918 - DNA, 16 bp, Homo sapiens
tggcagaagtgtttca

SEQ ID NO: 6521919 - DNA, 19 bp, Homo sapiens
tggcagaataatctttggg

SEQ ID NO: 6521920 - DNA, 19 bp, Homo sapiens
tggcagaatagcttatgcc

SEQ ID NO: 6521921 - DNA, 19 bp, Homo sapiens
tggcagaatgaaaatcagc

SEQ ID NO: 6521922 - DNA, 20 bp, Homo sapiens
tggcagaatgaaaatcagca

SEQ ID NO: 6521923 - DNA, 18 bp, Homo sapiens
tggcagaatgctagctct

SEQ ID NO: 6521924 - DNA, 14 bp, Homo sapiens
tggcagacaaacag

SEQ ID NO: 6521925 - DNA, 15 bp, Homo sapiens
tggcagacaaacaga

SEQ ID NO: 6521926 - DNA, 21 bp, Homo sapiens
tggcagacagccgtttgttct

SEQ ID NO: 6521927 - DNA, 15 bp, Homo sapiens
tggcagaccatctcc

SEQ ID NO: 6521928 - DNA, 17 bp, Homo sapiens
tggcagactgtgtaaaa

SEQ ID NO: 6521929 - DNA, 15 bp, Homo sapiens
tggcagagaaaatgc

SEQ ID NO: 6521930 - DNA, 14 bp, Homo sapiens
tggcagagaaggcc

SEQ ID NO: 6521931 - DNA, 16 bp, Homo sapiens
tggcagagaaggcctc

SEQ ID NO: 6521932 - DNA, 19 bp, Homo sapiens
tggcagagacagtgggcac

SEQ ID NO: 6521933 - DNA, 19 bp, Homo sapiens
tggcagagaccataagaga

SEQ ID NO: 6521934 - DNA, 22 bp, Homo sapiens
tggcagagaccataagagaaac

SEQ ID NO: 6521935 - DNA, 13 bp, Homo sapiens
tggcagagagaga

SEQ ID NO: 6521936 - DNA, 18 bp, Homo sapiens
tggcagagagcacagtga

SEQ ID NO: 6521937 - DNA, 13 bp, Homo sapiens
tggcagagatgcc

SEQ ID NO: 6521938 - DNA, 17 bp, Homo sapiens
tggcagagatgcctccc

SEQ ID NO: 6521939 - DNA, 16 bp, Homo sapiens
tggcagagcacagccc

SEQ ID NO: 6521940 - DNA, 11 bp, Homo sapiens
tggcagagcca

SEQ ID NO: 6521941 - DNA, 12 bp, Homo sapiens
tggcagagccag

SEQ ID NO: 6521942 - DNA, 16 bp, Homo sapiens
tggcagagccaggctg

SEQ ID NO: 6521943 - DNA, 15 bp, Homo sapiens
tggcagagccatcca

SEQ ID NO: 6521944 - DNA, 17 bp, Homo sapiens
tggcagagccatccacc

SEQ ID NO: 6521945 - DNA, 16 bp, Homo sapiens
tggcagagcctctgag

SEQ ID NO: 6521946 - DNA, 13 bp, Homo sapiens
tggcagagcttct

SEQ ID NO: 6521947 - DNA, 21 bp, Homo sapiens
tggcagagtggattcttgaac

SEQ ID NO: 6521948 - DNA, 17 bp, Homo sapiens
tggcagagttacagttc

SEQ ID NO: 6521949 - DNA, 15 bp, Homo sapiens
tggcagagttgaaga

SEQ ID NO: 6521950 - DNA, 19 bp, Homo sapiens
tggcagagttgaagacaga

SEQ ID NO: 6521951 - DNA, 21 bp, Homo sapiens
tggcagagttgaagacagagc

SEQ ID NO: 6521952 - DNA, 22 bp, Homo sapiens
tggcagagtttgtgtgttgtct

SEQ ID NO: 6521953 - DNA, 19 bp, Homo sapiens
tggcagataatcagcctct

SEQ ID NO: 6521954 - DNA, 23 bp, Homo sapiens
tggcagatgacaagatggtacaa

SEQ ID NO: 6521955 - DNA, 21 bp, Homo sapiens
tggcagatgagggctggctgc

SEQ ID NO: 6521956 - DNA, 22 bp, Homo sapiens
tggcagatgatttgggcagagc

SEQ ID NO: 6521957 - DNA, 13 bp, Homo sapiens
tggcagatgcagc

SEQ ID NO: 6521958 - DNA, 16 bp, Homo sapiens
tggcagatgcagctct

SEQ ID NO: 6521959 - DNA, 13 bp, Homo sapiens
tggcagatggggg

SEQ ID NO: 6521960 - DNA, 16 bp, Homo sapiens
tggcagatgggggcct

SEQ ID NO: 6521961 - DNA, 18 bp, Homo sapiens
tggcagatgtaggaggga

SEQ ID NO: 6521962 - DNA, 15 bp, Homo sapiens
tggcagatgtcttcc

SEQ ID NO: 6521963 - DNA, 16 bp, Homo sapiens
tggcagatgtcttccc

SEQ ID NO: 6521964 - DNA, 17 bp, Homo sapiens
tggcagatgtcttccct

SEQ ID NO: 6521965 - DNA, 16 bp, Homo sapiens
tggcagattttacaaa

SEQ ID NO: 6521966 - DNA, 17 bp, Homo sapiens
tggcagattttacaaaa

SEQ ID NO: 6521967 - DNA, 22 bp, Homo sapiens
tggcagattttacaaaagatgt

SEQ ID NO: 6521968 - DNA, 16 bp, Homo sapiens
tggcagcaaaggaaga

SEQ ID NO: 6521969 - DNA, 13 bp, Homo sapiens
tggcagcacagcc

SEQ ID NO: 6521970 - DNA, 17 bp, Homo sapiens
tggcagcacagcccagg

SEQ ID NO: 6521971 - DNA, 18 bp, Homo sapiens
tggcagcacagcccaggg

SEQ ID NO: 6521972 - DNA, 13 bp, Homo sapiens
tggcagcacagct

SEQ ID NO: 6521973 - DNA, 17 bp, Homo sapiens
tggcagcacagctactc

SEQ ID NO: 6521974 - DNA, 19 bp, Homo sapiens
tggcagcacccactcagcc

SEQ ID NO: 6521975 - DNA, 18 bp, Homo sapiens
tggcagcacctgtctcct

SEQ ID NO: 6521976 - DNA, 21 bp, Homo sapiens
tggcagcacggcccggcccct

SEQ ID NO: 6521977 - DNA, 22 bp, Homo sapiens
tggcagcacggcccggcccctc

SEQ ID NO: 6521978 - DNA, 20 bp, Homo sapiens
tggcagcagaaaacttgtgt

SEQ ID NO: 6521979 - DNA, 19 bp, Homo sapiens
tggcagcagcaggtgtggc

SEQ ID NO: 6521980 - DNA, 14 bp, Homo sapiens
tggcagcagccagg

SEQ ID NO: 6521981 - DNA, 19 bp, Homo sapiens
tggcagcagccagggaccc

SEQ ID NO: 6521982 - DNA, 13 bp, Homo sapiens
tggcagcaggagg

SEQ ID NO: 6521983 - DNA, 14 bp, Homo sapiens
tggcagcaggaggg

SEQ ID NO: 6521984 - DNA, 15 bp, Homo sapiens
tggcagcaggaggga

SEQ ID NO: 6521985 - DNA, 16 bp, Homo sapiens
tggcagcaggagggac

SEQ ID NO: 6521986 - DNA, 22 bp, Homo sapiens
tggcagcaggcctgttgctttt

SEQ ID NO: 6521987 - DNA, 16 bp, Homo sapiens
tggcagcaggtgctgc

SEQ ID NO: 6521988 - DNA, 14 bp, Homo sapiens
tggcagcataaagg

SEQ ID NO: 6521989 - DNA, 14 bp, Homo sapiens
tggcagcattcaga

SEQ ID NO: 6521990 - DNA, 17 bp, Homo sapiens
tggcagcattcccacca

SEQ ID NO: 6521991 - DNA, 18 bp, Homo sapiens
tggcagcattcccaccaa

SEQ ID NO: 6521992 - DNA, 20 bp, Homo sapiens
tggcagcattcccaccaaca

SEQ ID NO: 6521993 - DNA, 15 bp, Homo sapiens
tggcagccaaggaat

SEQ ID NO: 6521994 - DNA, 16 bp, Homo sapiens
tggcagccaaggaatg

SEQ ID NO: 6521995 - DNA, 19 bp, Homo sapiens
tggcagccacacttctcag

SEQ ID NO: 6521996 - DNA, 21 bp, Homo sapiens
tggcagccacacttctcagga

SEQ ID NO: 6521997 - DNA, 15 bp, Homo sapiens
tggcagccaccccct

SEQ ID NO: 6521998 - DNA, 15 bp, Homo sapiens
tggcagccagggagc

SEQ ID NO: 6521999 - DNA, 13 bp, Homo sapiens
tggcagccatgcc

SEQ ID NO: 6522000 - DNA, 14 bp, Homo sapiens
tggcagccatgcct

SEQ ID NO: 6522001 - DNA, 18 bp, Homo sapiens
tggcagccatgcctcatg

SEQ ID NO: 6522002 - DNA, 20 bp, Homo sapiens
tggcagccatgcctcatgcc

SEQ ID NO: 6522003 - DNA, 14 bp, Homo sapiens
tggcagcccactgc

SEQ ID NO: 6522004 - DNA, 14 bp, Homo sapiens
tggcagcccagcca

SEQ ID NO: 6522005 - DNA, 16 bp, Homo sapiens
tggcagcccagccagc

SEQ ID NO: 6522006 - DNA, 17 bp, Homo sapiens
tggcagcccagccagcg

SEQ ID NO: 6522007 - DNA, 18 bp, Homo sapiens
tggcagcccagccagcgt

SEQ ID NO: 6522008 - DNA, 16 bp, Homo sapiens
tggcagcccggctgct

SEQ ID NO: 6522009 - DNA, 17 bp, Homo sapiens
tggcagcccggctgctg

SEQ ID NO: 6522010 - DNA, 23 bp, Homo sapiens
tggcagcccggctgctgcttgga

SEQ ID NO: 6522011 - DNA, 15 bp, Homo sapiens
tggcagccgcctccc

SEQ ID NO: 6522012 - DNA, 17 bp, Homo sapiens
tggcagccgtcccaggc

SEQ ID NO: 6522013 - DNA, 18 bp, Homo sapiens
tggcagccgtcccaggcc

SEQ ID NO: 6522014 - DNA, 16 bp, Homo sapiens
tggcagccgtgccttc

SEQ ID NO: 6522015 - DNA, 17 bp, Homo sapiens
tggcagccgtgccttca

SEQ ID NO: 6522016 - DNA, 19 bp, Homo sapiens
tggcagccgtgccttcagc

SEQ ID NO: 6522017 - DNA, 14 bp, Homo sapiens
tggcagcctcagag

SEQ ID NO: 6522018 - DNA, 16 bp, Homo sapiens
tggcagcctcttcaaa

SEQ ID NO: 6522019 - DNA, 15 bp, Homo sapiens
tggcagcctgcacct

SEQ ID NO: 6522020 - DNA, 18 bp, Homo sapiens
tggcagcctgcacctggt

SEQ ID NO: 6522021 - DNA, 13 bp, Homo sapiens
tggcagccttggc

SEQ ID NO: 6522022 - DNA, 16 bp, Homo sapiens
tggcagcgcccagcct

SEQ ID NO: 6522023 - DNA, 18 bp, Homo sapiens
tggcagcgcccagcctgg

SEQ ID NO: 6522024 - DNA, 15 bp, Homo sapiens
tggcagcgcctcccg

SEQ ID NO: 6522025 - DNA, 22 bp, Homo sapiens
tggcagcgcctcccgccgcctc

SEQ ID NO: 6522026 - DNA, 17 bp, Homo sapiens
tggcagcgcctcgcccc

SEQ ID NO: 6522027 - DNA, 20 bp, Homo sapiens
tggcagctagactggagtga

SEQ ID NO: 6522028 - DNA, 22 bp, Homo sapiens
tggcagctagactggagtgagg

SEQ ID NO: 6522029 - DNA, 16 bp, Homo sapiens
tggcagctcaaagact

SEQ ID NO: 6522030 - DNA, 15 bp, Homo sapiens
tggcagctcacctct

SEQ ID NO: 6522031 - DNA, 19 bp, Homo sapiens
tggcagctcacctctccct

SEQ ID NO: 6522032 - DNA, 22 bp, Homo sapiens
tggcagctcacctctcccttgg

SEQ ID NO: 6522033 - DNA, 23 bp, Homo sapiens
tggcagctcacctctcccttgga

SEQ ID NO: 6522034 - DNA, 14 bp, Homo sapiens
tggcagctcagaga

SEQ ID NO: 6522035 - DNA, 18 bp, Homo sapiens
tggcagctcctctccttg

SEQ ID NO: 6522036 - DNA, 23 bp, Homo sapiens
tggcagctcctctccttgggctc

SEQ ID NO: 6522037 - DNA, 12 bp, Homo sapiens
tggcagctctcc

SEQ ID NO: 6522038 - DNA, 15 bp, Homo sapiens
tggcagctctccagt

SEQ ID NO: 6522039 - DNA, 19 bp, Homo sapiens
tggcagctgagagccctgc

SEQ ID NO: 6522040 - DNA, 23 bp, Homo sapiens
tggcagctgagagccctgctgtg

SEQ ID NO: 6522041 - DNA, 16 bp, Homo sapiens
tggcagctgccacgcc

SEQ ID NO: 6522042 - DNA, 15 bp, Homo sapiens
tggcagctgcccctc

SEQ ID NO: 6522043 - DNA, 16 bp, Homo sapiens
tggcagctgcccctcc

SEQ ID NO: 6522044 - DNA, 17 bp, Homo sapiens
tggcagctgcccctcct

SEQ ID NO: 6522045 - DNA, 20 bp, Homo sapiens
tggcagctgcccctcctgga

SEQ ID NO: 6522046 - DNA, 16 bp, Homo sapiens
tggcagctgcccctgg

SEQ ID NO: 6522047 - DNA, 17 bp, Homo sapiens
tggcagctgcggtccac

SEQ ID NO: 6522048 - DNA, 12 bp, Homo sapiens
tggcagctgctg

SEQ ID NO: 6522049 - DNA, 13 bp, Homo sapiens
tggcagctgctgt

SEQ ID NO: 6522050 - DNA, 14 bp, Homo sapiens
tggcagctgggcag

SEQ ID NO: 6522051 - DNA, 13 bp, Homo sapiens
tggcagctgggcc

SEQ ID NO: 6522052 - DNA, 14 bp, Homo sapiens
tggcagctgggccc

SEQ ID NO: 6522053 - DNA, 13 bp, Homo sapiens
tggcagctgggga

SEQ ID NO: 6522054 - DNA, 16 bp, Homo sapiens
tggcagctgtttctca

SEQ ID NO: 6522055 - DNA, 19 bp, Homo sapiens
ttactgtcagattaaatta

SEQ ID NO: 6522056 - DNA, 19 bp, Homo sapiens
ttactgtcagttgtacttc

SEQ ID NO: 6522057 - DNA, 19 bp, Homo sapiens
ttactgtctattaatattc

SEQ ID NO: 6522058 - DNA, 16 bp, Homo sapiens
ttactgtctgtagtgt

SEQ ID NO: 6522059 - DNA, 17 bp, Homo sapiens
ttactgtctgtagtgtt

SEQ ID NO: 6522060 - DNA, 17 bp, Homo sapiens
ttactgtcttaaatcag

SEQ ID NO: 6522061 - DNA, 15 bp, Homo sapiens
ttactgtcttgaatt

SEQ ID NO: 6522062 - DNA, 14 bp, Homo sapiens
ttactgtctttatt

SEQ ID NO: 6522063 - DNA, 17 bp, Homo sapiens
ttactgtcttttttcta

SEQ ID NO: 6522064 - DNA, 12 bp, Homo sapiens
ttactgtgaaaa

SEQ ID NO: 6522065 - DNA, 19 bp, Homo sapiens
ttactgtgaaaaaaaattt

SEQ ID NO: 6522066 - DNA, 20 bp, Homo sapiens
ttactgtgaagagaatgtat

SEQ ID NO: 6522067 - DNA, 20 bp, Homo sapiens
ttactgtgagaactgtgaat

SEQ ID NO: 6522068 - DNA, 16 bp, Homo sapiens
ttactgtgatttctgg

SEQ ID NO: 6522069 - DNA, 14 bp, Homo sapiens
ttactgtggaggaa

SEQ ID NO: 6522070 - DNA, 16 bp, Homo sapiens
ttactgtggaggaagg

SEQ ID NO: 6522071 - DNA, 14 bp, Homo sapiens
ttactgtgtaaact

SEQ ID NO: 6522072 - DNA, 13 bp, Homo sapiens
ttactgtgtaatt

SEQ ID NO: 6522073 - DNA, 20 bp, Homo sapiens
ttactgtgtaattagtgcca

SEQ ID NO: 6522074 - DNA, 14 bp, Homo sapiens
ttactgtgtctttg

SEQ ID NO: 6522075 - DNA, 13 bp, Homo sapiens
ttactgtgtgaag

SEQ ID NO: 6522076 - DNA, 14 bp, Homo sapiens
ttactgtgttttat

SEQ ID NO: 6522077 - DNA, 22 bp, Homo sapiens
ttactgttaaaactgtaccttt

SEQ ID NO: 6522078 - DNA, 23 bp, Homo sapiens
ttactgttaaaactgtacctttt

SEQ ID NO: 6522079 - DNA, 15 bp, Homo sapiens
ttactgttaaccatt

SEQ ID NO: 6522080 - DNA, 17 bp, Homo sapiens
ttactgttagaattctt

SEQ ID NO: 6522081 - DNA, 13 bp, Homo sapiens
ttactgttcatgg

SEQ ID NO: 6522082 - DNA, 23 bp, Homo sapiens
ttactgttcatttgatttgtaca

SEQ ID NO: 6522083 - DNA, 14 bp, Homo sapiens
ttactgttctgaaa

SEQ ID NO: 6522084 - DNA, 14 bp, Homo sapiens
ttactgttcttatt

SEQ ID NO: 6522085 - DNA, 13 bp, Homo sapiens
ttactgttcttgc

SEQ ID NO: 6522086 - DNA, 14 bp, Homo sapiens
ttactgttcttgct

SEQ ID NO: 6522087 - DNA, 16 bp, Homo sapiens
ttactgttcttgctgc

SEQ ID NO: 6522088 - DNA, 18 bp, Homo sapiens
ttactgttcttgctgcta

SEQ ID NO: 6522089 - DNA, 18 bp, Homo sapiens
ttactgttgaacttagaa

SEQ ID NO: 6522090 - DNA, 21 bp, Homo sapiens
ttactgttgataattcttatt

SEQ ID NO: 6522091 - DNA, 15 bp, Homo sapiens
ttactgttgcattta

SEQ ID NO: 6522092 - DNA, 20 bp, Homo sapiens
ttactgttgcatttactttt

SEQ ID NO: 6522093 - DNA, 14 bp, Homo sapiens
ttactgttgtacaa

SEQ ID NO: 6522094 - DNA, 20 bp, Homo sapiens
ttactgttgtacaatcatgt

SEQ ID NO: 6522095 - DNA, 17 bp, Homo sapiens
ttactgtttattacttc

SEQ ID NO: 6522096 - DNA, 14 bp, Homo sapiens
ttactgtttctgtc

SEQ ID NO: 6522097 - DNA, 16 bp, Homo sapiens
ttactgtttctgtcag

SEQ ID NO: 6522098 - DNA, 20 bp, Homo sapiens
ttactgtttgaaaagaaata

SEQ ID NO: 6522099 - DNA, 17 bp, Homo sapiens
ttactgttttaattgta

SEQ ID NO: 6522100 - DNA, 20 bp, Homo sapiens
ttactgttttaattgtagtt

SEQ ID NO: 6522101 - DNA, 14 bp, Homo sapiens
ttactgttttatgt

SEQ ID NO: 6522102 - DNA, 17 bp, Homo sapiens
ttactgttttatgttga

SEQ ID NO: 6522103 - DNA, 19 bp, Homo sapiens
ttactgttttgccaagaat

SEQ ID NO: 6522104 - DNA, 16 bp, Homo sapiens
ttacttaaacatcatt

SEQ ID NO: 6522105 - DNA, 13 bp, Homo sapiens
ttacttaaagatt

SEQ ID NO: 6522106 - DNA, 14 bp, Homo sapiens
ttacttaaagattt

SEQ ID NO: 6522107 - DNA, 22 bp, Homo sapiens
ttacttaaagatttatcaaatc

SEQ ID NO: 6522108 - DNA, 16 bp, Homo sapiens
ttacttaaagcttgtt

SEQ ID NO: 6522109 - DNA, 16 bp, Homo sapiens
ttacttaactgtttca

SEQ ID NO: 6522110 - DNA, 13 bp, Homo sapiens
ttacttaaggcag

SEQ ID NO: 6522111 - DNA, 16 bp, Homo sapiens
ttacttaagtgttcat

SEQ ID NO: 6522112 - DNA, 20 bp, Homo sapiens
ttacttaagtgttcatttta

SEQ ID NO: 6522113 - DNA, 14 bp, Homo sapiens
ttacttaatgacca

SEQ ID NO: 6522114 - DNA, 13 bp, Homo sapiens
ttacttaatgtga

SEQ ID NO: 6522115 - DNA, 20 bp, Homo sapiens
ttacttacaaaagcagcttt

SEQ ID NO: 6522116 - DNA, 19 bp, Homo sapiens
ttacttacacacctgagaa

SEQ ID NO: 6522117 - DNA, 14 bp, Homo sapiens
ttacttacagcata

SEQ ID NO: 6522118 - DNA, 13 bp, Homo sapiens
ttacttacctgca

SEQ ID NO: 6522119 - DNA, 16 bp, Homo sapiens
ttacttactgctatct

SEQ ID NO: 6522120 - DNA, 14 bp, Homo sapiens
ttacttactgttaa

SEQ ID NO: 6522121 - DNA, 15 bp, Homo sapiens
ttacttagaggaaat

SEQ ID NO: 6522122 - DNA, 14 bp, Homo sapiens
ttacttagcaatgt

SEQ ID NO: 6522123 - DNA, 13 bp, Homo sapiens
ttacttagcatgc

SEQ ID NO: 6522124 - DNA, 19 bp, Homo sapiens
ttacttagcttatcaattt

SEQ ID NO: 6522125 - DNA, 21 bp, Homo sapiens
ttacttagcttatcaatttgt

SEQ ID NO: 6522126 - DNA, 18 bp, Homo sapiens
ttacttaggtgtggggga

SEQ ID NO: 6522127 - DNA, 13 bp, Homo sapiens
ttacttatgtaga

SEQ ID NO: 6522128 - DNA, 23 bp, Homo sapiens
ttacttatgtagaaactgaggcc

SEQ ID NO: 6522129 - DNA, 24 bp, Homo sapiens
ttacttatttaaaaatgcatgata

SEQ ID NO: 6522130 - DNA, 21 bp, Homo sapiens
ttacttcaaagtgcctgggct

SEQ ID NO: 6522131 - DNA, 13 bp, Homo sapiens
ttacttcagggct

SEQ ID NO: 6522132 - DNA, 13 bp, Homo sapiens
ttacttcagtata

SEQ ID NO: 6522133 - DNA, 11 bp, Homo sapiens
ttacttcatat

SEQ ID NO: 6522134 - DNA, 12 bp, Homo sapiens
ttacttccagca

SEQ ID NO: 6522135 - DNA, 16 bp, Homo sapiens
ttacttccagcaaaat

SEQ ID NO: 6522136 - DNA, 17 bp, Homo sapiens
ttacttccagcaaaatc

SEQ ID NO: 6522137 - DNA, 20 bp, Homo sapiens
ttacttccagcaaaatccaa

SEQ ID NO: 6522138 - DNA, 14 bp, Homo sapiens
ttacttcccccacc

SEQ ID NO: 6522139 - DNA, 17 bp, Homo sapiens
ttacttcccccaccctg

SEQ ID NO: 6522140 - DNA, 15 bp, Homo sapiens
ttacttcctatcaag

SEQ ID NO: 6522141 - DNA, 22 bp, Homo sapiens
ttacttcgtgtccgactcttct

SEQ ID NO: 6522142 - DNA, 17 bp, Homo sapiens
ttacttctaatcttaaa

SEQ ID NO: 6522143 - DNA, 11 bp, Homo sapiens
ttacttctaga

SEQ ID NO: 6522144 - DNA, 15 bp, Homo sapiens
ttacttctcccctgg

SEQ ID NO: 6522145 - DNA, 16 bp, Homo sapiens
ttacttctcgaattga

SEQ ID NO: 6522146 - DNA, 15 bp, Homo sapiens
ttacttctctataaa

SEQ ID NO: 6522147 - DNA, 14 bp, Homo sapiens
ttacttctctgagt

SEQ ID NO: 6522148 - DNA, 11 bp, Homo sapiens
ttacttctctt

SEQ ID NO: 6522149 - DNA, 14 bp, Homo sapiens
ttacttctggcctt

SEQ ID NO: 6522150 - DNA, 12 bp, Homo sapiens
ttacttgaactt

SEQ ID NO: 6522151 - DNA, 18 bp, Homo sapiens
ttacttgaactttccaaa

SEQ ID NO: 6522152 - DNA, 13 bp, Homo sapiens
ttacttgaatgta

SEQ ID NO: 6522153 - DNA, 14 bp, Homo sapiens
ttacttgacctcct

SEQ ID NO: 6522154 - DNA, 15 bp, Homo sapiens
ttacttgatgatttt

SEQ ID NO: 6522155 - DNA, 13 bp, Homo sapiens
ttacttgcaggta

SEQ ID NO: 6522156 - DNA, 23 bp, Homo sapiens
ttacttgccaagcagtgcacatt

SEQ ID NO: 6522157 - DNA, 12 bp, Homo sapiens
ttacttgctgct

SEQ ID NO: 6522158 - DNA, 18 bp, Homo sapiens
ttacttggaaatattaaa

SEQ ID NO: 6522159 - DNA, 12 bp, Homo sapiens
ttacttggcttt

SEQ ID NO: 6522160 - DNA, 13 bp, Homo sapiens
ttacttggctttt

SEQ ID NO: 6522161 - DNA, 18 bp, Homo sapiens
ttacttggtgtaattaat

SEQ ID NO: 6522162 - DNA, 17 bp, Homo sapiens
ttacttgtaaatataaa

SEQ ID NO: 6522163 - DNA, 21 bp, Homo sapiens
ttacttgtaaatataaagacg

SEQ ID NO: 6522164 - DNA, 16 bp, Homo sapiens
ttacttgtagaaatct

SEQ ID NO: 6522165 - DNA, 17 bp, Homo sapiens
ttacttgtagaaatctg

SEQ ID NO: 6522166 - DNA, 15 bp, Homo sapiens
ttacttgtatgtagc

SEQ ID NO: 6522167 - DNA, 20 bp, Homo sapiens
ttacttgtctgtcaaatgtt

SEQ ID NO: 6522168 - DNA, 19 bp, Homo sapiens
ttacttgtggtgtgaccat

SEQ ID NO: 6522169 - DNA, 19 bp, Homo sapiens
ttacttgtgttacttgcca

SEQ ID NO: 6522170 - DNA, 17 bp, Homo sapiens
ttactttaaaaagaaat

SEQ ID NO: 6522171 - DNA, 17 bp, Homo sapiens
ttactttaaaaggagcc

SEQ ID NO: 6522172 - DNA, 13 bp, Homo sapiens
ttactttaaacta

SEQ ID NO: 6522173 - DNA, 17 bp, Homo sapiens
ttactttaattactgga

SEQ ID NO: 6522174 - DNA, 12 bp, Homo sapiens
ttactttagtta

SEQ ID NO: 6522175 - DNA, 16 bp, Homo sapiens
ttactttatcactttt

SEQ ID NO: 6522176 - DNA, 13 bp, Homo sapiens
ttactttattaga

SEQ ID NO: 6522177 - DNA, 16 bp, Homo sapiens
ttactttattataaaa

SEQ ID NO: 6522178 - DNA, 12 bp, Homo sapiens
ttactttcaaaa

SEQ ID NO: 6522179 - DNA, 13 bp, Homo sapiens
ttactttcaaaat

SEQ ID NO: 6522180 - DNA, 14 bp, Homo sapiens
ttactttcaagtaa

SEQ ID NO: 6522181 - DNA, 13 bp, Homo sapiens
ttactttcagttt

SEQ ID NO: 6522182 - DNA, 11 bp, Homo sapiens
ttactttccct

SEQ ID NO: 6522183 - DNA, 14 bp, Homo sapiens
ttactttcctctga

SEQ ID NO: 6522184 - DNA, 22 bp, Homo sapiens
ttactttctcccagtatgtttt

SEQ ID NO: 6522185 - DNA, 14 bp, Homo sapiens
ttactttggactga

SEQ ID NO: 6522186 - DNA, 10 bp, Homo sapiens
ttactttgta

SEQ ID NO: 6522187 - DNA, 13 bp, Homo sapiens
ttactttgtaaat

SEQ ID NO: 6522188 - DNA, 17 bp, Homo sapiens
ttactttgtaaattctg

SEQ ID NO: 6522189 - DNA, 18 bp, Homo sapiens
ttactttgtaaattctga

SEQ ID NO: 6522190 - DNA, 22 bp, Homo sapiens
ttactttgtaaattctgatttc

SEQ ID NO: 6522191 - DNA, 15 bp, Homo sapiens
ttactttgtaatttt

SEQ ID NO: 6522192 - DNA, 14 bp, Homo sapiens
ttactttgtctttt

SEQ ID NO: 6522193 - DNA, 16 bp, Homo sapiens
ttactttgtggatata

SEQ ID NO: 6522194 - DNA, 14 bp, Homo sapiens
ttactttgtgttca

SEQ ID NO: 6522195 - DNA, 22 bp, Homo sapiens
ttactttgttttaaaaagcatc

SEQ ID NO: 6522196 - DNA, 20 bp, Homo sapiens
ttactttgtttttattctgt

SEQ ID NO: 6522197 - DNA, 21 bp, Homo sapiens
ttactttgtttttattctgtt

SEQ ID NO: 6522198 - DNA, 19 bp, Homo sapiens
ttacttttaaatattaact

SEQ ID NO: 6522199 - DNA, 22 bp, Homo sapiens
ttacttttaaatgcaatctctt

SEQ ID NO: 6522200 - DNA, 17 bp, Homo sapiens
ttacttttaataaagta

SEQ ID NO: 6522201 - DNA, 19 bp, Homo sapiens
ttacttttaataaagtatg

SEQ ID NO: 6522202 - DNA, 15 bp, Homo sapiens
ttacttttacagtca

SEQ ID NO: 6522203 - DNA, 16 bp, Homo sapiens
ttacttttacagtcat

SEQ ID NO: 6522204 - DNA, 22 bp, Homo sapiens
ttacttttataataaaaggaaa

SEQ ID NO: 6522205 - DNA, 16 bp, Homo sapiens
ttacttttcacactgt

SEQ ID NO: 6522206 - DNA, 16 bp, Homo sapiens
ttacttttctgccaaa

SEQ ID NO: 6522207 - DNA, 15 bp, Homo sapiens
ttactttttaaaaat

SEQ ID NO: 6522208 - DNA, 16 bp, Homo sapiens
ttactttttaaaaata

SEQ ID NO: 6522209 - DNA, 14 bp, Homo sapiens
ttactttttaaaca

SEQ ID NO: 6522210 - DNA, 18 bp, Homo sapiens
ttactttttatatagcaa

SEQ ID NO: 6522211 - DNA, 19 bp, Homo sapiens
ttactttttcttgtattca

SEQ ID NO: 6522212 - DNA, 15 bp, Homo sapiens
ttactttttgtaaat

SEQ ID NO: 6522213 - DNA, 14 bp, Homo sapiens
ttactttttgtaga

SEQ ID NO: 6522214 - DNA, 17 bp, Homo sapiens
ttacttttttaaaattg

SEQ ID NO: 6522215 - DNA, 17 bp, Homo sapiens
ttacttttttacactga

SEQ ID NO: 6522216 - DNA, 23 bp, Homo sapiens
ttacttttttagtaacaattcag

SEQ ID NO: 6522217 - DNA, 18 bp, Homo sapiens
ttacttttttatagctta

SEQ ID NO: 6522218 - DNA, 20 bp, Homo sapiens
ttactttttttctgtgacat

SEQ ID NO: 6522219 - DNA, 23 bp, Homo sapiens
ttacttttttttttttttggtag

SEQ ID NO: 6522220 - DNA, 11 bp, Homo sapiens
ttagaaaaaaa

SEQ ID NO: 6522221 - DNA, 12 bp, Homo sapiens
ttagaaaaaaca

SEQ ID NO: 6522222 - DNA, 23 bp, Homo sapiens
ttagaaaaacaaatgattagtta

SEQ ID NO: 6522223 - DNA, 15 bp, Homo sapiens
ttagaaaaacattta

SEQ ID NO: 6522224 - DNA, 20 bp, Homo sapiens
ttagaaaaagaacatgcagt

SEQ ID NO: 6522225 - DNA, 21 bp, Homo sapiens
ttagaaaacataatcttctgc

SEQ ID NO: 6522226 - DNA, 17 bp, Homo sapiens
ttagaaaacattcatcc

SEQ ID NO: 6522227 - DNA, 19 bp, Homo sapiens
ttagaaaacccaagttttt

SEQ ID NO: 6522228 - DNA, 16 bp, Homo sapiens
ttagaaaactttaaag

SEQ ID NO: 6522229 - DNA, 19 bp, Homo sapiens
ttagaaaaggaaataggtt

SEQ ID NO: 6522230 - DNA, 23 bp, Homo sapiens
ttagaaaagggagtttaaaaatg

SEQ ID NO: 6522231 - DNA, 22 bp, Homo sapiens
ttagaaaaggtgataaaatcat

SEQ ID NO: 6522232 - DNA, 13 bp, Homo sapiens
ttagaaaagtgaa

SEQ ID NO: 6522233 - DNA, 12 bp, Homo sapiens
ttagaaaagtgg

SEQ ID NO: 6522234 - DNA, 19 bp, Homo sapiens
ttagaaaatgacttatttc

SEQ ID NO: 6522235 - DNA, 21 bp, Homo sapiens
ttagaaaatgacttatttctg

SEQ ID NO: 6522236 - DNA, 12 bp, Homo sapiens
ttagaaaatgtg

SEQ ID NO: 6522237 - DNA, 23 bp, Homo sapiens
ttagaaacaaatttttttcttgt

SEQ ID NO: 6522238 - DNA, 17 bp, Homo sapiens
tggcagctgtttctcat

SEQ ID NO: 6522239 - DNA, 21 bp, Homo sapiens
tggcagctgtttctcatgaag

SEQ ID NO: 6522240 - DNA, 23 bp, Homo sapiens
tggcagcttcaaaacagaacggg

SEQ ID NO: 6522241 - DNA, 14 bp, Homo sapiens
tggcagcttgctgg

SEQ ID NO: 6522242 - DNA, 17 bp, Homo sapiens
tggcagcttgctgggct

SEQ ID NO: 6522243 - DNA, 16 bp, Homo sapiens
tggcaggaaccatgga

SEQ ID NO: 6522244 - DNA, 17 bp, Homo sapiens
tggcaggacacatcccg

SEQ ID NO: 6522245 - DNA, 15 bp, Homo sapiens
tggcaggacctgcct

SEQ ID NO: 6522246 - DNA, 16 bp, Homo sapiens
tggcaggacctgccta

SEQ ID NO: 6522247 - DNA, 19 bp, Homo sapiens
tggcaggacctgcctagca

SEQ ID NO: 6522248 - DNA, 23 bp, Homo sapiens
tggcaggactcctggcagggcca

SEQ ID NO: 6522249 - DNA, 23 bp, Homo sapiens
tggcaggagaatcaataaaaatc

SEQ ID NO: 6522250 - DNA, 19 bp, Homo sapiens
tggcaggagaatcagcctg

SEQ ID NO: 6522251 - DNA, 17 bp, Homo sapiens
tggcaggagctactgag

SEQ ID NO: 6522252 - DNA, 23 bp, Homo sapiens
tggcaggagctactgagaacata

SEQ ID NO: 6522253 - DNA, 14 bp, Homo sapiens
tggcaggagctcct

SEQ ID NO: 6522254 - DNA, 18 bp, Homo sapiens
tggcaggagctcctggaa

SEQ ID NO: 6522255 - DNA, 14 bp, Homo sapiens
tggcaggaggacag

SEQ ID NO: 6522256 - DNA, 12 bp, Homo sapiens
tggcaggaggct

SEQ ID NO: 6522257 - DNA, 13 bp, Homo sapiens
tggcaggagggtg

SEQ ID NO: 6522258 - DNA, 18 bp, Homo sapiens
tggcaggagtctctgcca

SEQ ID NO: 6522259 - DNA, 19 bp, Homo sapiens
tggcaggagtctctgccag

SEQ ID NO: 6522260 - DNA, 19 bp, Homo sapiens
tggcaggatcacagctcac

SEQ ID NO: 6522261 - DNA, 12 bp, Homo sapiens
tggcaggatcca

SEQ ID NO: 6522262 - DNA, 16 bp, Homo sapiens
tggcaggatccaaggg

SEQ ID NO: 6522263 - DNA, 22 bp, Homo sapiens
tggcaggatcggcttcctcagg

SEQ ID NO: 6522264 - DNA, 18 bp, Homo sapiens
tggcaggcagaggcccag

SEQ ID NO: 6522265 - DNA, 23 bp, Homo sapiens
tggcaggcagcgccaagcaacct

SEQ ID NO: 6522266 - DNA, 11 bp, Homo sapiens
tggcaggcagg

SEQ ID NO: 6522267 - DNA, 18 bp, Homo sapiens
tggcaggcagttctagaa

SEQ ID NO: 6522268 - DNA, 13 bp, Homo sapiens
tggcaggcccact

SEQ ID NO: 6522269 - DNA, 16 bp, Homo sapiens
tggcaggcctcccttt

SEQ ID NO: 6522270 - DNA, 18 bp, Homo sapiens
tggcaggctacagttggg

SEQ ID NO: 6522271 - DNA, 16 bp, Homo sapiens
tggcaggctgaggcat

SEQ ID NO: 6522272 - DNA, 12 bp, Homo sapiens
tggcaggctggc

SEQ ID NO: 6522273 - DNA, 15 bp, Homo sapiens
tggcaggctggccag

SEQ ID NO: 6522274 - DNA, 14 bp, Homo sapiens
tggcagggaagctt

SEQ ID NO: 6522275 - DNA, 16 bp, Homo sapiens
tggcagggaagggtgc

SEQ ID NO: 6522276 - DNA, 20 bp, Homo sapiens
tggcagggaagggtgcctgg

SEQ ID NO: 6522277 - DNA, 23 bp, Homo sapiens
tggcagggaagggtgcctggctg

SEQ ID NO: 6522278 - DNA, 12 bp, Homo sapiens
tggcagggaccg

SEQ ID NO: 6522279 - DNA, 19 bp, Homo sapiens
tggcagggaccggcagagc

SEQ ID NO: 6522280 - DNA, 20 bp, Homo sapiens
tggcagggaccggcagagct

SEQ ID NO: 6522281 - DNA, 21 bp, Homo sapiens
tggcagggaccggcagagctc

SEQ ID NO: 6522282 - DNA, 23 bp, Homo sapiens
tggcagggaccggcagagctcta

SEQ ID NO: 6522283 - DNA, 19 bp, Homo sapiens
tggcagggacctgagagca

SEQ ID NO: 6522284 - DNA, 21 bp, Homo sapiens
tggcagggaggtcaggccctg

SEQ ID NO: 6522285 - DNA, 15 bp, Homo sapiens
tggcagggcacaggg

SEQ ID NO: 6522286 - DNA, 16 bp, Homo sapiens
tggcagggcacagggc

SEQ ID NO: 6522287 - DNA, 17 bp, Homo sapiens
tggcagggcacagggcc

SEQ ID NO: 6522288 - DNA, 14 bp, Homo sapiens
tggcagggcagcag

SEQ ID NO: 6522289 - DNA, 16 bp, Homo sapiens
tggcagggcaggcaga

SEQ ID NO: 6522290 - DNA, 17 bp, Homo sapiens
tggcagggcaggcagag

SEQ ID NO: 6522291 - DNA, 14 bp, Homo sapiens
tggcagggccacct

SEQ ID NO: 6522292 - DNA, 24 bp, Homo sapiens
tggcagggccacctgcaggaccct

SEQ ID NO: 6522293 - DNA, 12 bp, Homo sapiens
tggcagggccag

SEQ ID NO: 6522294 - DNA, 16 bp, Homo sapiens
tggcagggccaggcct

SEQ ID NO: 6522295 - DNA, 22 bp, Homo sapiens
tggcagggccaggcctctgctg

SEQ ID NO: 6522296 - DNA, 15 bp, Homo sapiens
tggcagggccagggc

SEQ ID NO: 6522297 - DNA, 16 bp, Homo sapiens
tggcagggccagggca

SEQ ID NO: 6522298 - DNA, 17 bp, Homo sapiens
tggcagggccagggcaa

SEQ ID NO: 6522299 - DNA, 19 bp, Homo sapiens
tggcagggccagggcaatg

SEQ ID NO: 6522300 - DNA, 21 bp, Homo sapiens
tggcagggccagggcaatgcc

SEQ ID NO: 6522301 - DNA, 14 bp, Homo sapiens
tggcagggcctagc

SEQ ID NO: 6522302 - DNA, 20 bp, Homo sapiens
tggcagggcctcatctcacc

SEQ ID NO: 6522303 - DNA, 12 bp, Homo sapiens
tggcagggctca

SEQ ID NO: 6522304 - DNA, 17 bp, Homo sapiens
tggcagggctcacactc

SEQ ID NO: 6522305 - DNA, 19 bp, Homo sapiens
tggcagggctcacactcct

SEQ ID NO: 6522306 - DNA, 14 bp, Homo sapiens
tggcagggctcagg

SEQ ID NO: 6522307 - DNA, 15 bp, Homo sapiens
tggcagggctgagga

SEQ ID NO: 6522308 - DNA, 21 bp, Homo sapiens
tggcagggctggccccagggc

SEQ ID NO: 6522309 - DNA, 18 bp, Homo sapiens
tggcaggggaaactctgg

SEQ ID NO: 6522310 - DNA, 19 bp, Homo sapiens
tggcaggggaaactctggt

SEQ ID NO: 6522311 - DNA, 21 bp, Homo sapiens
tggcaggggaaactctggtgc

SEQ ID NO: 6522312 - DNA, 14 bp, Homo sapiens
tggcaggggaagcc

SEQ ID NO: 6522313 - DNA, 15 bp, Homo sapiens
tggcaggggagcagg

SEQ ID NO: 6522314 - DNA, 22 bp, Homo sapiens
tggcaggggatccagctcaagg

SEQ ID NO: 6522315 - DNA, 13 bp, Homo sapiens
tggcaggggcagt

SEQ ID NO: 6522316 - DNA, 14 bp, Homo sapiens
tggcaggggcagtg

SEQ ID NO: 6522317 - DNA, 21 bp, Homo sapiens
tggcaggggcagtggcctgga

SEQ ID NO: 6522318 - DNA, 18 bp, Homo sapiens
tggcagggggccccgcca

SEQ ID NO: 6522319 - DNA, 23 bp, Homo sapiens
tggcagggggccccgccagggct

SEQ ID NO: 6522320 - DNA, 21 bp, Homo sapiens
tggcagggggtgaaggcagga

SEQ ID NO: 6522321 - DNA, 21 bp, Homo sapiens
tggcaggggtggaggagagcc

SEQ ID NO: 6522322 - DNA, 22 bp, Homo sapiens
tggcaggggtggaggagagcct

SEQ ID NO: 6522323 - DNA, 21 bp, Homo sapiens
tggcaggggtggctgcctcat

SEQ ID NO: 6522324 - DNA, 15 bp, Homo sapiens
tggcagggtccctcc

SEQ ID NO: 6522325 - DNA, 16 bp, Homo sapiens
tggcaggtcactgtca

SEQ ID NO: 6522326 - DNA, 21 bp, Homo sapiens
tggcaggtcactgtcactgcc

SEQ ID NO: 6522327 - DNA, 23 bp, Homo sapiens
tggcaggtcatggagcagccccc

SEQ ID NO: 6522328 - DNA, 18 bp, Homo sapiens
tggcaggtcccctgccct

SEQ ID NO: 6522329 - DNA, 17 bp, Homo sapiens
tggcaggtcctcccctc

SEQ ID NO: 6522330 - DNA, 22 bp, Homo sapiens
tggcaggtgatgtcctgtaaac

SEQ ID NO: 6522331 - DNA, 16 bp, Homo sapiens
tggcaggtggccaggg

SEQ ID NO: 6522332 - DNA, 17 bp, Homo sapiens
tggcaggtggccagggc

SEQ ID NO: 6522333 - DNA, 15 bp, Homo sapiens
tggcaggtgggctgc

SEQ ID NO: 6522334 - DNA, 15 bp, Homo sapiens
tggcaggtgggggtg

SEQ ID NO: 6522335 - DNA, 14 bp, Homo sapiens
tggcaggtgtggga

SEQ ID NO: 6522336 - DNA, 17 bp, Homo sapiens
tggcaggtgtgggctcc

SEQ ID NO: 6522337 - DNA, 22 bp, Homo sapiens
tggcaggtgtgggctcccacgc

SEQ ID NO: 6522338 - DNA, 14 bp, Homo sapiens
tggcaggttttaca

SEQ ID NO: 6522339 - DNA, 15 bp, Homo sapiens
tggcagtacagagtg

SEQ ID NO: 6522340 - DNA, 14 bp, Homo sapiens
tggcagtattgaca

SEQ ID NO: 6522341 - DNA, 14 bp, Homo sapiens
tggcagtccagcca

SEQ ID NO: 6522342 - DNA, 19 bp, Homo sapiens
tggcagtcctggaggcagg

SEQ ID NO: 6522343 - DNA, 20 bp, Homo sapiens
tggcagtctaagtgtaaatg

SEQ ID NO: 6522344 - DNA, 13 bp, Homo sapiens
tggcagtctatat

SEQ ID NO: 6522345 - DNA, 22 bp, Homo sapiens
tggcagtctgaatttttaaaac

SEQ ID NO: 6522346 - DNA, 13 bp, Homo sapiens
tggcagtgacttt

SEQ ID NO: 6522347 - DNA, 14 bp, Homo sapiens
tggcagtgagtgag

SEQ ID NO: 6522348 - DNA, 19 bp, Homo sapiens
tggcagtgatcctgcaagt

SEQ ID NO: 6522349 - DNA, 20 bp, Homo sapiens
tggcagtgctgattcagcct

SEQ ID NO: 6522350 - DNA, 21 bp, Homo sapiens
tggcagtggaaaaatcagaag

SEQ ID NO: 6522351 - DNA, 12 bp, Homo sapiens
tggcagtggagg

SEQ ID NO: 6522352 - DNA, 14 bp, Homo sapiens
tggcagtggcagag

SEQ ID NO: 6522353 - DNA, 18 bp, Homo sapiens
tggcagtggcagagaatc

SEQ ID NO: 6522354 - DNA, 13 bp, Homo sapiens
tggcagtggccag

SEQ ID NO: 6522355 - DNA, 22 bp, Homo sapiens
tggcagtggccaggcagggagt

SEQ ID NO: 6522356 - DNA, 18 bp, Homo sapiens
tggcagtggctctcagag

SEQ ID NO: 6522357 - DNA, 13 bp, Homo sapiens
tggcagtggctgt

SEQ ID NO: 6522358 - DNA, 18 bp, Homo sapiens
tggcagtggctgtgaagg

SEQ ID NO: 6522359 - DNA, 21 bp, Homo sapiens
tggcagtggctgtgaaggagt

SEQ ID NO: 6522360 - DNA, 19 bp, Homo sapiens
tggcagtgggaaaaatgta

SEQ ID NO: 6522361 - DNA, 23 bp, Homo sapiens
tggcagtgggaatgttctttctg

SEQ ID NO: 6522362 - DNA, 15 bp, Homo sapiens
tggcagtgggaccaa

SEQ ID NO: 6522363 - DNA, 13 bp, Homo sapiens
tggcagtgggagc

SEQ ID NO: 6522364 - DNA, 16 bp, Homo sapiens
tggcagtgggagctgc

SEQ ID NO: 6522365 - DNA, 19 bp, Homo sapiens
tggcagtgtggggagggca

SEQ ID NO: 6522366 - DNA, 14 bp, Homo sapiens
tggcagtgtgtcac

SEQ ID NO: 6522367 - DNA, 23 bp, Homo sapiens
tggcagtgtgtcacactgagctg

SEQ ID NO: 6522368 - DNA, 24 bp, Homo sapiens
tggcagtgtgtcacactgagctgg

SEQ ID NO: 6522369 - DNA, 18 bp, Homo sapiens
tggcagtgttttgagaac

SEQ ID NO: 6522370 - DNA, 23 bp, Homo sapiens
tggcagttaattggatgttcact

SEQ ID NO: 6522371 - DNA, 13 bp, Homo sapiens
tggcagttatatt

SEQ ID NO: 6522372 - DNA, 16 bp, Homo sapiens
tggcagttcctggcat

SEQ ID NO: 6522373 - DNA, 20 bp, Homo sapiens
tggcagttggaggacacagt

SEQ ID NO: 6522374 - DNA, 22 bp, Homo sapiens
tggcataaattacagtcatctg

SEQ ID NO: 6522375 - DNA, 19 bp, Homo sapiens
tggcataacaaaggcaaga

SEQ ID NO: 6522376 - DNA, 15 bp, Homo sapiens
tggcataacataaat

SEQ ID NO: 6522377 - DNA, 22 bp, Homo sapiens
tggcataacataaatctgtgaa

SEQ ID NO: 6522378 - DNA, 19 bp, Homo sapiens
tggcataactgtgattctt

SEQ ID NO: 6522379 - DNA, 11 bp, Homo sapiens
tggcatacaaa

SEQ ID NO: 6522380 - DNA, 16 bp, Homo sapiens
tggcatacctgtgcct

SEQ ID NO: 6522381 - DNA, 16 bp, Homo sapiens
tggcatacctttcaca

SEQ ID NO: 6522382 - DNA, 16 bp, Homo sapiens
tggcatagagaataca

SEQ ID NO: 6522383 - DNA, 15 bp, Homo sapiens
tggcatagagcagca

SEQ ID NO: 6522384 - DNA, 17 bp, Homo sapiens
tggcatagcccagacac

SEQ ID NO: 6522385 - DNA, 19 bp, Homo sapiens
tggcatagcccagacacag

SEQ ID NO: 6522386 - DNA, 16 bp, Homo sapiens
tggcatagccccggcc

SEQ ID NO: 6522387 - DNA, 14 bp, Homo sapiens
tggcatagctctgg

SEQ ID NO: 6522388 - DNA, 16 bp, Homo sapiens
tggcatagctctgggg

SEQ ID NO: 6522389 - DNA, 17 bp, Homo sapiens
tggcataggactctttg

SEQ ID NO: 6522390 - DNA, 20 bp, Homo sapiens
tggcatatatgtgatctggg

SEQ ID NO: 6522391 - DNA, 15 bp, Homo sapiens
tggcatatctctgtt

SEQ ID NO: 6522392 - DNA, 16 bp, Homo sapiens
tggcatatttttcaca

SEQ ID NO: 6522393 - DNA, 19 bp, Homo sapiens
tggcatcaaccaccatgga

SEQ ID NO: 6522394 - DNA, 22 bp, Homo sapiens
tggcatcaagaggtgggagggc

SEQ ID NO: 6522395 - DNA, 18 bp, Homo sapiens
tggcatcacagaccccag

SEQ ID NO: 6522396 - DNA, 21 bp, Homo sapiens
tggcatcacagaccccagctg

SEQ ID NO: 6522397 - DNA, 18 bp, Homo sapiens
tggcatcacagggcagag

SEQ ID NO: 6522398 - DNA, 14 bp, Homo sapiens
tggcatcagctggc

SEQ ID NO: 6522399 - DNA, 15 bp, Homo sapiens
tggcatcagctggcg

SEQ ID NO: 6522400 - DNA, 13 bp, Homo sapiens
tggcatcaggagc

SEQ ID NO: 6522401 - DNA, 18 bp, Homo sapiens
tggcatcaggtctgggca

SEQ ID NO: 6522402 - DNA, 21 bp, Homo sapiens
tggcatcaggtctgggcaagt

SEQ ID NO: 6522403 - DNA, 13 bp, Homo sapiens
tggcatcagttta

SEQ ID NO: 6522404 - DNA, 22 bp, Homo sapiens
tggcatcatccattctctctgc

SEQ ID NO: 6522405 - DNA, 19 bp, Homo sapiens
tggcatccaaatggctgct

SEQ ID NO: 6522406 - DNA, 21 bp, Homo sapiens
tggcatccagagtccctgcct

SEQ ID NO: 6522407 - DNA, 18 bp, Homo sapiens
tggcatccagggctgcca

SEQ ID NO: 6522408 - DNA, 19 bp, Homo sapiens
tggcatccagggctgccag

SEQ ID NO: 6522409 - DNA, 14 bp, Homo sapiens
tggcatccctgggc

SEQ ID NO: 6522410 - DNA, 20 bp, Homo sapiens
tggcatccctgggccttggg

SEQ ID NO: 6522411 - DNA, 16 bp, Homo sapiens
tggcatcctccggaga

SEQ ID NO: 6522412 - DNA, 23 bp, Homo sapiens
tggcatcctcttgaataggaaga

SEQ ID NO: 6522413 - DNA, 16 bp, Homo sapiens
tggcatcctgtgaagt

SEQ ID NO: 6522414 - DNA, 23 bp, Homo sapiens
tggcatcgaccacaccagcctcc

SEQ ID NO: 6522415 - DNA, 21 bp, Homo sapiens
tggcatctaattcttattttt

SEQ ID NO: 6522416 - DNA, 13 bp, Homo sapiens
ttagaaacactgc

SEQ ID NO: 6522417 - DNA, 15 bp, Homo sapiens
ttagaaacagaaata

SEQ ID NO: 6522418 - DNA, 17 bp, Homo sapiens
ttagaaaccatgaaaaa

SEQ ID NO: 6522419 - DNA, 19 bp, Homo sapiens
ttagaaactacaaatatag

SEQ ID NO: 6522420 - DNA, 10 bp, Homo sapiens
ttagaaactg

SEQ ID NO: 6522421 - DNA, 19 bp, Homo sapiens
ttagaaactggttctgtgt

SEQ ID NO: 6522422 - DNA, 19 bp, Homo sapiens
ttagaaacttatcttacaa

SEQ ID NO: 6522423 - DNA, 20 bp, Homo sapiens
ttagaaagaaaattatattc

SEQ ID NO: 6522424 - DNA, 19 bp, Homo sapiens
ttagaaagaattagccaac

SEQ ID NO: 6522425 - DNA, 17 bp, Homo sapiens
ttagaaagcaacttatc

SEQ ID NO: 6522426 - DNA, 16 bp, Homo sapiens
ttagaaagcatttgaa

SEQ ID NO: 6522427 - DNA, 18 bp, Homo sapiens
ttagaaagcatttgaatg

SEQ ID NO: 6522428 - DNA, 19 bp, Homo sapiens
ttagaaagcatttgaatgc

SEQ ID NO: 6522429 - DNA, 23 bp, Homo sapiens
ttagaaagcatttgaatgcattt

SEQ ID NO: 6522430 - DNA, 22 bp, Homo sapiens
ttagaaaggacaacagttctga

SEQ ID NO: 6522431 - DNA, 19 bp, Homo sapiens
ttagaaaggcaaagtacat

SEQ ID NO: 6522432 - DNA, 22 bp, Homo sapiens
ttagaaagtaagagctctaagt

SEQ ID NO: 6522433 - DNA, 13 bp, Homo sapiens
ttagaaagttatt

SEQ ID NO: 6522434 - DNA, 16 bp, Homo sapiens
ttagaaagttattgtg

SEQ ID NO: 6522435 - DNA, 12 bp, Homo sapiens
ttagaaatactt

SEQ ID NO: 6522436 - DNA, 14 bp, Homo sapiens
ttagaaatataatt

SEQ ID NO: 6522437 - DNA, 14 bp, Homo sapiens
ttagaaatatcctt

SEQ ID NO: 6522438 - DNA, 19 bp, Homo sapiens
ttagaaatatcctttggaa

SEQ ID NO: 6522439 - DNA, 21 bp, Homo sapiens
ttagaaatatccttttagaag

SEQ ID NO: 6522440 - DNA, 11 bp, Homo sapiens
ttagaaatatt

SEQ ID NO: 6522441 - DNA, 18 bp, Homo sapiens
ttagaaatgaccaatatt

SEQ ID NO: 6522442 - DNA, 16 bp, Homo sapiens
ttagaaatgatttcaa

SEQ ID NO: 6522443 - DNA, 13 bp, Homo sapiens
ttagaaatgcaaa

SEQ ID NO: 6522444 - DNA, 17 bp, Homo sapiens
ttagaaatgtaaactgc

SEQ ID NO: 6522445 - DNA, 17 bp, Homo sapiens
ttagaaattacaagttt

SEQ ID NO: 6522446 - DNA, 19 bp, Homo sapiens
ttagaaattacctgtggat

SEQ ID NO: 6522447 - DNA, 17 bp, Homo sapiens
ttagaaattgcatttcc

SEQ ID NO: 6522448 - DNA, 21 bp, Homo sapiens
ttagaaatttattcttatctt

SEQ ID NO: 6522449 - DNA, 15 bp, Homo sapiens
ttagaacaacataaa

SEQ ID NO: 6522450 - DNA, 17 bp, Homo sapiens
ttagaacacacacactt

SEQ ID NO: 6522451 - DNA, 17 bp, Homo sapiens
ttagaacactattttca

SEQ ID NO: 6522452 - DNA, 20 bp, Homo sapiens
ttagaacactattttcagaa

SEQ ID NO: 6522453 - DNA, 18 bp, Homo sapiens
ttagaacagatggctgtg

SEQ ID NO: 6522454 - DNA, 22 bp, Homo sapiens
ttagaacaggcaagtgaagaaa

SEQ ID NO: 6522455 - DNA, 13 bp, Homo sapiens
ttagaacaggttt

SEQ ID NO: 6522456 - DNA, 15 bp, Homo sapiens
ttagaacaggttttt

SEQ ID NO: 6522457 - DNA, 22 bp, Homo sapiens
ttagaacatttaataatgtatg

SEQ ID NO: 6522458 - DNA, 15 bp, Homo sapiens
ttagaaccacagcag

SEQ ID NO: 6522459 - DNA, 22 bp, Homo sapiens
ttagaaccacagcagacaccat

SEQ ID NO: 6522460 - DNA, 20 bp, Homo sapiens
ttagaaccagccgtatttta

SEQ ID NO: 6522461 - DNA, 22 bp, Homo sapiens
ttagaaccagccgtattttaca

SEQ ID NO: 6522462 - DNA, 22 bp, Homo sapiens
ttagaaccagtcttttgaaaga

SEQ ID NO: 6522463 - DNA, 23 bp, Homo sapiens
ttagaacccagcagttaccttaa

SEQ ID NO: 6522464 - DNA, 16 bp, Homo sapiens
ttagaacccttctgct

SEQ ID NO: 6522465 - DNA, 16 bp, Homo sapiens
ttagaacctgaggtct

SEQ ID NO: 6522466 - DNA, 19 bp, Homo sapiens
ttagaacctgcatttaaga

SEQ ID NO: 6522467 - DNA, 17 bp, Homo sapiens
ttagaacgagcctggaa

SEQ ID NO: 6522468 - DNA, 18 bp, Homo sapiens
ttagaacgttaaactatt

SEQ ID NO: 6522469 - DNA, 22 bp, Homo sapiens
ttagaactctagagagccttaa

SEQ ID NO: 6522470 - DNA, 13 bp, Homo sapiens
ttagaagaaaagt

SEQ ID NO: 6522471 - DNA, 22 bp, Homo sapiens
ttagaagaaaataatttatatg

SEQ ID NO: 6522472 - DNA, 21 bp, Homo sapiens
ttagaagaagaggaagaaatt

SEQ ID NO: 6522473 - DNA, 16 bp, Homo sapiens
ttagaagaagtgtgtc

SEQ ID NO: 6522474 - DNA, 17 bp, Homo sapiens
ttagaagagcctgactg

SEQ ID NO: 6522475 - DNA, 21 bp, Homo sapiens
ttagaagcaaagatttcagta

SEQ ID NO: 6522476 - DNA, 17 bp, Homo sapiens
ttagaagcagagggaca

SEQ ID NO: 6522477 - DNA, 19 bp, Homo sapiens
ttagaaggaggttctaata

SEQ ID NO: 6522478 - DNA, 16 bp, Homo sapiens
ttagaaggcactggga

SEQ ID NO: 6522479 - DNA, 13 bp, Homo sapiens
ttagaaggtatta

SEQ ID NO: 6522480 - DNA, 18 bp, Homo sapiens
ttagaaggttctctcctc

SEQ ID NO: 6522481 - DNA, 15 bp, Homo sapiens
ttagaaggttgtatt

SEQ ID NO: 6522482 - DNA, 21 bp, Homo sapiens
ttagaagtacgtttttgcatt

SEQ ID NO: 6522483 - DNA, 16 bp, Homo sapiens
ttagaagtgagagaaa

SEQ ID NO: 6522484 - DNA, 19 bp, Homo sapiens
ttagaagtgcatttctgaa

SEQ ID NO: 6522485 - DNA, 17 bp, Homo sapiens
ttagaagtgtcatgttt

SEQ ID NO: 6522486 - DNA, 16 bp, Homo sapiens
ttagaataaattccca

SEQ ID NO: 6522487 - DNA, 18 bp, Homo sapiens
ttagaataagaatttgca

SEQ ID NO: 6522488 - DNA, 19 bp, Homo sapiens
ttagaataagaatttgcat

SEQ ID NO: 6522489 - DNA, 15 bp, Homo sapiens
ttagaataatttcat

SEQ ID NO: 6522490 - DNA, 14 bp, Homo sapiens
ttagaatattaaaa

SEQ ID NO: 6522491 - DNA, 19 bp, Homo sapiens
ttagaatattatcttcata

SEQ ID NO: 6522492 - DNA, 23 bp, Homo sapiens
ttagaatcaaacattttgaaagt

SEQ ID NO: 6522493 - DNA, 14 bp, Homo sapiens
ttagaatcagaata

SEQ ID NO: 6522494 - DNA, 15 bp, Homo sapiens
ttagaatcagaataa

SEQ ID NO: 6522495 - DNA, 13 bp, Homo sapiens
ttagaatctagaa

SEQ ID NO: 6522496 - DNA, 14 bp, Homo sapiens
ttagaatctatttt

SEQ ID NO: 6522497 - DNA, 14 bp, Homo sapiens
ttagaatcttgttt

SEQ ID NO: 6522498 - DNA, 19 bp, Homo sapiens
ttagaatgaatttatcttt

SEQ ID NO: 6522499 - DNA, 21 bp, Homo sapiens
ttagaatgattccctcttgct

SEQ ID NO: 6522500 - DNA, 21 bp, Homo sapiens
ttagaatgccataaaattgca

SEQ ID NO: 6522501 - DNA, 13 bp, Homo sapiens
ttagaatgctgcg

SEQ ID NO: 6522502 - DNA, 15 bp, Homo sapiens
ttagaatggaggaag

SEQ ID NO: 6522503 - DNA, 20 bp, Homo sapiens
ttagaatggaggaagaacaa

SEQ ID NO: 6522504 - DNA, 13 bp, Homo sapiens
ttagaatggggct

SEQ ID NO: 6522505 - DNA, 19 bp, Homo sapiens
ttagaatggtgattttaaa

SEQ ID NO: 6522506 - DNA, 13 bp, Homo sapiens
ttagaatgtcagt

SEQ ID NO: 6522507 - DNA, 11 bp, Homo sapiens
ttagaatgtga

SEQ ID NO: 6522508 - DNA, 13 bp, Homo sapiens
ttagaatgtgaaa

SEQ ID NO: 6522509 - DNA, 19 bp, Homo sapiens
ttagaatgtttctatttcc

SEQ ID NO: 6522510 - DNA, 17 bp, Homo sapiens
ttagaattaaaaaagca

SEQ ID NO: 6522511 - DNA, 19 bp, Homo sapiens
ttagaattaaccattgcta

SEQ ID NO: 6522512 - DNA, 16 bp, Homo sapiens
ttagaattatttaaac

SEQ ID NO: 6522513 - DNA, 21 bp, Homo sapiens
ttagaattgctggatgcattt

SEQ ID NO: 6522514 - DNA, 18 bp, Homo sapiens
ttagaatttgaaaggaaa

SEQ ID NO: 6522515 - DNA, 23 bp, Homo sapiens
ttagaatttgtttcatctatttt

SEQ ID NO: 6522516 - DNA, 22 bp, Homo sapiens
ttagacaaatactcatgtgtat

SEQ ID NO: 6522517 - DNA, 18 bp, Homo sapiens
ttagacaactagatttgt

SEQ ID NO: 6522518 - DNA, 21 bp, Homo sapiens
ttagacaactagatttgtcct

SEQ ID NO: 6522519 - DNA, 14 bp, Homo sapiens
ttagacaagcctgg

SEQ ID NO: 6522520 - DNA, 17 bp, Homo sapiens
ttagacaagcctggagg

SEQ ID NO: 6522521 - DNA, 23 bp, Homo sapiens
ttagacaatgtggaattacataa

SEQ ID NO: 6522522 - DNA, 13 bp, Homo sapiens
ttagacacacata

SEQ ID NO: 6522523 - DNA, 20 bp, Homo sapiens
ttagacacacatatacatta

SEQ ID NO: 6522524 - DNA, 19 bp, Homo sapiens
ttagacaccacctggagtg

SEQ ID NO: 6522525 - DNA, 16 bp, Homo sapiens
ttagacactgggagaa

SEQ ID NO: 6522526 - DNA, 13 bp, Homo sapiens
ttagacactttgg

SEQ ID NO: 6522527 - DNA, 18 bp, Homo sapiens
ttagacagtaagagttta

SEQ ID NO: 6522528 - DNA, 22 bp, Homo sapiens
ttagacagtaagagtttacaag

SEQ ID NO: 6522529 - DNA, 16 bp, Homo sapiens
ttagacagtccctgcc

SEQ ID NO: 6522530 - DNA, 22 bp, Homo sapiens
ttagacattctcttactttttg

SEQ ID NO: 6522531 - DNA, 15 bp, Homo sapiens
ttagaccacaaatag

SEQ ID NO: 6522532 - DNA, 19 bp, Homo sapiens
ttagaccaccaagccttga

SEQ ID NO: 6522533 - DNA, 20 bp, Homo sapiens
ttagaccagaaagtgtgtgt

SEQ ID NO: 6522534 - DNA, 17 bp, Homo sapiens
ttagaccccatacaagt

SEQ ID NO: 6522535 - DNA, 23 bp, Homo sapiens
ttagacccctgggtgggccctgc

SEQ ID NO: 6522536 - DNA, 19 bp, Homo sapiens
ttagaccctcatgctgcca

SEQ ID NO: 6522537 - DNA, 20 bp, Homo sapiens
ttagaccctcatgctgccaa

SEQ ID NO: 6522538 - DNA, 20 bp, Homo sapiens
ttagaccgtggtgtcctctg

SEQ ID NO: 6522539 - DNA, 23 bp, Homo sapiens
ttagacctacagggggtctggct

SEQ ID NO: 6522540 - DNA, 15 bp, Homo sapiens
ttagacctatactga

SEQ ID NO: 6522541 - DNA, 17 bp, Homo sapiens
ttagacctatactgaaa

SEQ ID NO: 6522542 - DNA, 11 bp, Homo sapiens
ttagacctcag

SEQ ID NO: 6522543 - DNA, 18 bp, Homo sapiens
ttagacctcatctccaag

SEQ ID NO: 6522544 - DNA, 19 bp, Homo sapiens
ttagacctcatctccaaga

SEQ ID NO: 6522545 - DNA, 23 bp, Homo sapiens
ttagacctcatctccaagatagc

SEQ ID NO: 6522546 - DNA, 18 bp, Homo sapiens
ttagacgaagaagctggc

SEQ ID NO: 6522547 - DNA, 18 bp, Homo sapiens
ttagactaaggccattat

SEQ ID NO: 6522548 - DNA, 14 bp, Homo sapiens
ttagactagttgaa

SEQ ID NO: 6522549 - DNA, 19 bp, Homo sapiens
ttagactatttctttttat

SEQ ID NO: 6522550 - DNA, 20 bp, Homo sapiens
ttagactcaaagaagtactg

SEQ ID NO: 6522551 - DNA, 12 bp, Homo sapiens
ttagactgaaaa

SEQ ID NO: 6522552 - DNA, 14 bp, Homo sapiens
ttagactgagtaaa

SEQ ID NO: 6522553 - DNA, 13 bp, Homo sapiens
ttagactgccagc

SEQ ID NO: 6522554 - DNA, 14 bp, Homo sapiens
ttagactgccagct

SEQ ID NO: 6522555 - DNA, 17 bp, Homo sapiens
ttagactggacagcttg

SEQ ID NO: 6522556 - DNA, 20 bp, Homo sapiens
ttagactgtagcctggatat

SEQ ID NO: 6522557 - DNA, 18 bp, Homo sapiens
ttagactgtgattcagaa

SEQ ID NO: 6522558 - DNA, 15 bp, Homo sapiens
ttagactgtggccat

SEQ ID NO: 6522559 - DNA, 22 bp, Homo sapiens
ttagactgtggccatatatgct

SEQ ID NO: 6522560 - DNA, 21 bp, Homo sapiens
ttagacttcgactcaggatcc

SEQ ID NO: 6522561 - DNA, 16 bp, Homo sapiens
ttagacttctaaataa

SEQ ID NO: 6522562 - DNA, 17 bp, Homo sapiens
ttagacttctgttttca

SEQ ID NO: 6522563 - DNA, 15 bp, Homo sapiens
ttagacttgctccct

SEQ ID NO: 6522564 - DNA, 21 bp, Homo sapiens
ttagacttgtgtgcatggaag

SEQ ID NO: 6522565 - DNA, 22 bp, Homo sapiens
ttagacttttccaatatgtgat

SEQ ID NO: 6522566 - DNA, 13 bp, Homo sapiens
ttagagaaaacta

SEQ ID NO: 6522567 - DNA, 15 bp, Homo sapiens
ttagagaaactttga

SEQ ID NO: 6522568 - DNA, 15 bp, Homo sapiens
ttagagaagccataa

SEQ ID NO: 6522569 - DNA, 14 bp, Homo sapiens
ttagagaagctgaa

SEQ ID NO: 6522570 - DNA, 16 bp, Homo sapiens
ttagagaagctgaaag

SEQ ID NO: 6522571 - DNA, 17 bp, Homo sapiens
ttagagaaggctcagcc

SEQ ID NO: 6522572 - DNA, 21 bp, Homo sapiens
ttagagaagtatacataagtt

SEQ ID NO: 6522573 - DNA, 13 bp, Homo sapiens
ttagagacaggga

SEQ ID NO: 6522574 - DNA, 22 bp, Homo sapiens
ttagagagattggccagcaaaa

SEQ ID NO: 6522575 - DNA, 15 bp, Homo sapiens
ttagagagcctgtca

SEQ ID NO: 6522576 - DNA, 22 bp, Homo sapiens
ttagagagcctgtcaccagagc

SEQ ID NO: 6522577 - DNA, 14 bp, Homo sapiens
ttagagaggaaaag

SEQ ID NO: 6522578 - DNA, 15 bp, Homo sapiens
ttagagataattctg

SEQ ID NO: 6522579 - DNA, 17 bp, Homo sapiens
ttagagataattgcttg

SEQ ID NO: 6522580 - DNA, 19 bp, Homo sapiens
ttagagataccctctgaga

SEQ ID NO: 6522581 - DNA, 13 bp, Homo sapiens
ttagagatgaatt

SEQ ID NO: 6522582 - DNA, 17 bp, Homo sapiens
ttagagatggagtttgc

SEQ ID NO: 6522583 - DNA, 16 bp, Homo sapiens
ttagagattaatttgt

SEQ ID NO: 6522584 - DNA, 22 bp, Homo sapiens
ttagagattttacaaaatgctg

SEQ ID NO: 6522585 - DNA, 19 bp, Homo sapiens
ttagagcaatgcattctgg

SEQ ID NO: 6522586 - DNA, 21 bp, Homo sapiens
ttagagcagatgacccctccc

SEQ ID NO: 6522587 - DNA, 17 bp, Homo sapiens
ttagagcagcctcgtgg

SEQ ID NO: 6522588 - DNA, 18 bp, Homo sapiens
ttagagcagcctcgtgga

SEQ ID NO: 6522589 - DNA, 20 bp, Homo sapiens
ttagagcagtttctgtcctg

SEQ ID NO: 6522590 - DNA, 12 bp, Homo sapiens
ttagagcattaa

SEQ ID NO: 6522591 - DNA, 17 bp, Homo sapiens
ttagagccaagctgcac

SEQ ID NO: 6522592 - DNA, 20 bp, Homo sapiens
ttagagccattagagcacag

SEQ ID NO: 6522593 - DNA, 21 bp, Homo sapiens
ttagagcccattaatcttgat

SEQ ID NO: 6522594 - DNA, 16 bp, Homo sapiens
tggcatctagccagag

SEQ ID NO: 6522595 - DNA, 22 bp, Homo sapiens
tggcatctagccagaggctgga

SEQ ID NO: 6522596 - DNA, 14 bp, Homo sapiens
tggcatctccccca

SEQ ID NO: 6522597 - DNA, 16 bp, Homo sapiens
tggcatctcccccacc

SEQ ID NO: 6522598 - DNA, 17 bp, Homo sapiens
tggcatctcccccaccc

SEQ ID NO: 6522599 - DNA, 21 bp, Homo sapiens
tggcatctcccccaccctgtg

SEQ ID NO: 6522600 - DNA, 21 bp, Homo sapiens
tggcatctctccccatatata

SEQ ID NO: 6522601 - DNA, 12 bp, Homo sapiens
tggcatctctgt

SEQ ID NO: 6522602 - DNA, 15 bp, Homo sapiens
tggcatctctgtccc

SEQ ID NO: 6522603 - DNA, 22 bp, Homo sapiens
tggcatctgaatgaaaataact

SEQ ID NO: 6522604 - DNA, 15 bp, Homo sapiens
tggcatctgacacaa

SEQ ID NO: 6522605 - DNA, 15 bp, Homo sapiens
tggcatctgcaaagg

SEQ ID NO: 6522606 - DNA, 13 bp, Homo sapiens
tggcatctgctct

SEQ ID NO: 6522607 - DNA, 11 bp, Homo sapiens
tggcatctgtg

SEQ ID NO: 6522608 - DNA, 20 bp, Homo sapiens
tggcatcttagacctccaca

SEQ ID NO: 6522609 - DNA, 17 bp, Homo sapiens
tggcatcttcaatatga

SEQ ID NO: 6522610 - DNA, 15 bp, Homo sapiens
tggcatcttctggag

SEQ ID NO: 6522611 - DNA, 16 bp, Homo sapiens
tggcatcttctggaga

SEQ ID NO: 6522612 - DNA, 17 bp, Homo sapiens
tggcatgaagattttct

SEQ ID NO: 6522613 - DNA, 14 bp, Homo sapiens
tggcatgacaacta

SEQ ID NO: 6522614 - DNA, 15 bp, Homo sapiens
tggcatgacaaggtg

SEQ ID NO: 6522615 - DNA, 17 bp, Homo sapiens
tggcatgacaaggtgtg

SEQ ID NO: 6522616 - DNA, 19 bp, Homo sapiens
tggcatgaccatcctgtcc

SEQ ID NO: 6522617 - DNA, 21 bp, Homo sapiens
tggcatgaccatcctgtcctt

SEQ ID NO: 6522618 - DNA, 21 bp, Homo sapiens
tggcatgatcatagctcactg

SEQ ID NO: 6522619 - DNA, 16 bp, Homo sapiens
tggcatgatccaagca

SEQ ID NO: 6522620 - DNA, 19 bp, Homo sapiens
tggcatgatttatatatgg

SEQ ID NO: 6522621 - DNA, 12 bp, Homo sapiens
tggcatgcaaaa

SEQ ID NO: 6522622 - DNA, 20 bp, Homo sapiens
tggcatgcaaaagaaagcaa

SEQ ID NO: 6522623 - DNA, 13 bp, Homo sapiens
tggcatgcatctt

SEQ ID NO: 6522624 - DNA, 17 bp, Homo sapiens
tggcatgcatggaggac

SEQ ID NO: 6522625 - DNA, 19 bp, Homo sapiens
tggcatgccttccagcacc

SEQ ID NO: 6522626 - DNA, 15 bp, Homo sapiens
tggcatgctgtctct

SEQ ID NO: 6522627 - DNA, 20 bp, Homo sapiens
tggcatgcttaaatattgaa

SEQ ID NO: 6522628 - DNA, 21 bp, Homo sapiens
tggcatggaaatttaaagcag

SEQ ID NO: 6522629 - DNA, 23 bp, Homo sapiens
tggcatggaaatttaaagcaggt

SEQ ID NO: 6522630 - DNA, 18 bp, Homo sapiens
tggcatggaaggggcttc

SEQ ID NO: 6522631 - DNA, 15 bp, Homo sapiens
tggcatggagactct

SEQ ID NO: 6522632 - DNA, 15 bp, Homo sapiens
tggcatggcaggagt

SEQ ID NO: 6522633 - DNA, 15 bp, Homo sapiens
tggcatggctccagt

SEQ ID NO: 6522634 - DNA, 15 bp, Homo sapiens
tggcatgggaatgaa

SEQ ID NO: 6522635 - DNA, 18 bp, Homo sapiens
tggcatgggacaggggga

SEQ ID NO: 6522636 - DNA, 19 bp, Homo sapiens
tggcatgggcgcaggccca

SEQ ID NO: 6522637 - DNA, 16 bp, Homo sapiens
tggcatgggggcctca

SEQ ID NO: 6522638 - DNA, 14 bp, Homo sapiens
tggcatggtcctgt

SEQ ID NO: 6522639 - DNA, 19 bp, Homo sapiens
tggcatggtggcacgtgcc

SEQ ID NO: 6522640 - DNA, 17 bp, Homo sapiens
tggcatggtggctcccg

SEQ ID NO: 6522641 - DNA, 22 bp, Homo sapiens
tggcatggtggttgggacccag

SEQ ID NO: 6522642 - DNA, 19 bp, Homo sapiens
tggcatggttgttgcatat

SEQ ID NO: 6522643 - DNA, 21 bp, Homo sapiens
tggcatggttgttgcatatag

SEQ ID NO: 6522644 - DNA, 21 bp, Homo sapiens
tggcatggttttgtgccatct

SEQ ID NO: 6522645 - DNA, 22 bp, Homo sapiens
tggcatggttttgtgccatctg

SEQ ID NO: 6522646 - DNA, 19 bp, Homo sapiens
tggcatgtaaatgtaaact

SEQ ID NO: 6522647 - DNA, 20 bp, Homo sapiens
tggcatgtcagagccaggct

SEQ ID NO: 6522648 - DNA, 15 bp, Homo sapiens
tggcatgtcatttgc

SEQ ID NO: 6522649 - DNA, 12 bp, Homo sapiens
tggcatgtctgg

SEQ ID NO: 6522650 - DNA, 22 bp, Homo sapiens
tggcatgtctgggtcgtctttt

SEQ ID NO: 6522651 - DNA, 17 bp, Homo sapiens
tggcatgtggcctgtgg

SEQ ID NO: 6522652 - DNA, 18 bp, Homo sapiens
tggcatgtggcctgtggc

SEQ ID NO: 6522653 - DNA, 17 bp, Homo sapiens
tggcatgtttcactcct

SEQ ID NO: 6522654 - DNA, 17 bp, Homo sapiens
tggcatgttttctttgt

SEQ ID NO: 6522655 - DNA, 22 bp, Homo sapiens
tggcatgttttctttgtttcct

SEQ ID NO: 6522656 - DNA, 13 bp, Homo sapiens
tggcattaaaact

SEQ ID NO: 6522657 - DNA, 16 bp, Homo sapiens
tggcattaattattaa

SEQ ID NO: 6522658 - DNA, 17 bp, Homo sapiens
tggcattaattattaat

SEQ ID NO: 6522659 - DNA, 23 bp, Homo sapiens
tggcattaattgttccttgcttt

SEQ ID NO: 6522660 - DNA, 19 bp, Homo sapiens
tggcattacagctggagaa

SEQ ID NO: 6522661 - DNA, 13 bp, Homo sapiens
tggcattactctg

SEQ ID NO: 6522662 - DNA, 17 bp, Homo sapiens
tggcattagaattattt

SEQ ID NO: 6522663 - DNA, 12 bp, Homo sapiens
tggcattattag

SEQ ID NO: 6522664 - DNA, 12 bp, Homo sapiens
tggcattcctct

SEQ ID NO: 6522665 - DNA, 18 bp, Homo sapiens
tggcattcctctaatgtt

SEQ ID NO: 6522666 - DNA, 16 bp, Homo sapiens
tggcattctacacctg

SEQ ID NO: 6522667 - DNA, 17 bp, Homo sapiens
tggcattctctctgctc

SEQ ID NO: 6522668 - DNA, 15 bp, Homo sapiens
tggcattgatcttaa

SEQ ID NO: 6522669 - DNA, 21 bp, Homo sapiens
tggcattggcagcaggtgctg

SEQ ID NO: 6522670 - DNA, 20 bp, Homo sapiens
tggcattgtccctgtgccta

SEQ ID NO: 6522671 - DNA, 19 bp, Homo sapiens
tggcatttcaattcctggc

SEQ ID NO: 6522672 - DNA, 18 bp, Homo sapiens
tggcatttccaaacatcc

SEQ ID NO: 6522673 - DNA, 15 bp, Homo sapiens
tggcatttccctact

SEQ ID NO: 6522674 - DNA, 17 bp, Homo sapiens
tggcatttcgaggttta

SEQ ID NO: 6522675 - DNA, 18 bp, Homo sapiens
tggcatttctctttaaac

SEQ ID NO: 6522676 - DNA, 17 bp, Homo sapiens
tggcatttctttatgaa

SEQ ID NO: 6522677 - DNA, 15 bp, Homo sapiens
tggcatttgcaataa

SEQ ID NO: 6522678 - DNA, 15 bp, Homo sapiens
tggcatttgctgaat

SEQ ID NO: 6522679 - DNA, 17 bp, Homo sapiens
tggcatttggcctcttg

SEQ ID NO: 6522680 - DNA, 21 bp, Homo sapiens
tggcatttggtctcaggcagc

SEQ ID NO: 6522681 - DNA, 22 bp, Homo sapiens
tggcatttggtctcaggcagca

SEQ ID NO: 6522682 - DNA, 21 bp, Homo sapiens
tggcatttgtgatcatgagat

SEQ ID NO: 6522683 - DNA, 22 bp, Homo sapiens
tggcattttaagtgtttaaaag

SEQ ID NO: 6522684 - DNA, 23 bp, Homo sapiens
tggcattttaagtgtttaaaagc

SEQ ID NO: 6522685 - DNA, 14 bp, Homo sapiens
tggcattttggctc

SEQ ID NO: 6522686 - DNA, 15 bp, Homo sapiens
tggcattttggctca

SEQ ID NO: 6522687 - DNA, 20 bp, Homo sapiens
tggcattttgtagtcttaac

SEQ ID NO: 6522688 - DNA, 17 bp, Homo sapiens
tggcatttttagctcct

SEQ ID NO: 6522689 - DNA, 18 bp, Homo sapiens
tggcatttttgcttccta

SEQ ID NO: 6522690 - DNA, 14 bp, Homo sapiens
tggccaaaaagaat

SEQ ID NO: 6522691 - DNA, 13 bp, Homo sapiens
tggccaaaactta

SEQ ID NO: 6522692 - DNA, 14 bp, Homo sapiens
tggccaaaatacca

SEQ ID NO: 6522693 - DNA, 21 bp, Homo sapiens
tggccaaacatcagacctgtc

SEQ ID NO: 6522694 - DNA, 23 bp, Homo sapiens
tggccaaacatcagacctgtctt

SEQ ID NO: 6522695 - DNA, 24 bp, Homo sapiens
tggccaaagcaaaggagagtcctg

SEQ ID NO: 6522696 - DNA, 22 bp, Homo sapiens
tggccaaagtcagtaggagagg

SEQ ID NO: 6522697 - DNA, 14 bp, Homo sapiens
tggccaaagtgtta

SEQ ID NO: 6522698 - DNA, 12 bp, Homo sapiens
tggccaaatatg

SEQ ID NO: 6522699 - DNA, 14 bp, Homo sapiens
tggccaaatatgca

SEQ ID NO: 6522700 - DNA, 17 bp, Homo sapiens
tggccaaatatgcactt

SEQ ID NO: 6522701 - DNA, 19 bp, Homo sapiens
tggccaaatatgcactttc

SEQ ID NO: 6522702 - DNA, 16 bp, Homo sapiens
tggccaaattatttgt

SEQ ID NO: 6522703 - DNA, 18 bp, Homo sapiens
tggccaaattatttgtgt

SEQ ID NO: 6522704 - DNA, 22 bp, Homo sapiens
tggccaacatcgtgaaaccctg

SEQ ID NO: 6522705 - DNA, 15 bp, Homo sapiens
tggccaaccaggacc

SEQ ID NO: 6522706 - DNA, 18 bp, Homo sapiens
tggccaacgtggacctgc

SEQ ID NO: 6522707 - DNA, 16 bp, Homo sapiens
tggccaagaagcagtg

SEQ ID NO: 6522708 - DNA, 22 bp, Homo sapiens
tggccaagaagcagtggcctta

SEQ ID NO: 6522709 - DNA, 20 bp, Homo sapiens
tggccaagatcacagtggcc

SEQ ID NO: 6522710 - DNA, 13 bp, Homo sapiens
tggccaagcagaa

SEQ ID NO: 6522711 - DNA, 13 bp, Homo sapiens
tggccaagcctgc

SEQ ID NO: 6522712 - DNA, 16 bp, Homo sapiens
tggccaagcctgcccc

SEQ ID NO: 6522713 - DNA, 19 bp, Homo sapiens
tggccaagcctgccccggc

SEQ ID NO: 6522714 - DNA, 17 bp, Homo sapiens
tggccaagcctggccct

SEQ ID NO: 6522715 - DNA, 19 bp, Homo sapiens
tggccaaggagctgctata

SEQ ID NO: 6522716 - DNA, 19 bp, Homo sapiens
tggccaaggctctctctgt

SEQ ID NO: 6522717 - DNA, 19 bp, Homo sapiens
tggccaagggccagacaga

SEQ ID NO: 6522718 - DNA, 17 bp, Homo sapiens
tggccaaggggccagct

SEQ ID NO: 6522719 - DNA, 16 bp, Homo sapiens
tggccaaggtgtccag

SEQ ID NO: 6522720 - DNA, 21 bp, Homo sapiens
tggccaaggtgtccagggtcc

SEQ ID NO: 6522721 - DNA, 14 bp, Homo sapiens
tggccaagttcctc

SEQ ID NO: 6522722 - DNA, 16 bp, Homo sapiens
tggccaagttcttagt

SEQ ID NO: 6522723 - DNA, 16 bp, Homo sapiens
tggccaatgcggccca

SEQ ID NO: 6522724 - DNA, 14 bp, Homo sapiens
tggccaatgtgcat

SEQ ID NO: 6522725 - DNA, 18 bp, Homo sapiens
tggccaattaaaaacgaa

SEQ ID NO: 6522726 - DNA, 17 bp, Homo sapiens
tggccaatttttgtact

SEQ ID NO: 6522727 - DNA, 14 bp, Homo sapiens
tggccacaactgct

SEQ ID NO: 6522728 - DNA, 21 bp, Homo sapiens
tggccacaaggaaaaggagga

SEQ ID NO: 6522729 - DNA, 14 bp, Homo sapiens
tggccacacagcag

SEQ ID NO: 6522730 - DNA, 14 bp, Homo sapiens
tggccacacaggca

SEQ ID NO: 6522731 - DNA, 15 bp, Homo sapiens
tggccacacaggcag

SEQ ID NO: 6522732 - DNA, 16 bp, Homo sapiens
tggccacacaggcagg

SEQ ID NO: 6522733 - DNA, 22 bp, Homo sapiens
tggccacaccacagcaagccgg

SEQ ID NO: 6522734 - DNA, 16 bp, Homo sapiens
tggccacactgggctc

SEQ ID NO: 6522735 - DNA, 16 bp, Homo sapiens
tggccacactggggct

SEQ ID NO: 6522736 - DNA, 23 bp, Homo sapiens
tggccacagcaagtacagcggct

SEQ ID NO: 6522737 - DNA, 12 bp, Homo sapiens
tggccacagcag

SEQ ID NO: 6522738 - DNA, 13 bp, Homo sapiens
tggccacagcagg

SEQ ID NO: 6522739 - DNA, 15 bp, Homo sapiens
tggccacagccacct

SEQ ID NO: 6522740 - DNA, 13 bp, Homo sapiens
tggccacagccag

SEQ ID NO: 6522741 - DNA, 19 bp, Homo sapiens
tggccacagcccccttgcc

SEQ ID NO: 6522742 - DNA, 23 bp, Homo sapiens
tggccacagcccccttgccctcc

SEQ ID NO: 6522743 - DNA, 13 bp, Homo sapiens
tggccacagcctt

SEQ ID NO: 6522744 - DNA, 22 bp, Homo sapiens
tggccacagccttccctctgca

SEQ ID NO: 6522745 - DNA, 20 bp, Homo sapiens
tggccacagcgccagcctca

SEQ ID NO: 6522746 - DNA, 14 bp, Homo sapiens
tggccacagtggca

SEQ ID NO: 6522747 - DNA, 16 bp, Homo sapiens
tggccacatcagcccc

SEQ ID NO: 6522748 - DNA, 20 bp, Homo sapiens
tggccacatcctcatggccc

SEQ ID NO: 6522749 - DNA, 21 bp, Homo sapiens
tggccacatcctcatggccca

SEQ ID NO: 6522750 - DNA, 16 bp, Homo sapiens
tggccacatggcggag

SEQ ID NO: 6522751 - DNA, 17 bp, Homo sapiens
tggccaccaggctggcg

SEQ ID NO: 6522752 - DNA, 21 bp, Homo sapiens
tggccaccaggctggcgcagc

SEQ ID NO: 6522753 - DNA, 23 bp, Homo sapiens
tggccaccaggctggcgcagcca

SEQ ID NO: 6522754 - DNA, 22 bp, Homo sapiens
tggccaccaggtgcctttcaaa

SEQ ID NO: 6522755 - DNA, 18 bp, Homo sapiens
tggccacccaacagcacc

SEQ ID NO: 6522756 - DNA, 15 bp, Homo sapiens
tggccacccctcccc

SEQ ID NO: 6522757 - DNA, 16 bp, Homo sapiens
tggccacccctcccca

SEQ ID NO: 6522758 - DNA, 19 bp, Homo sapiens
tggccacccctccccagta

SEQ ID NO: 6522759 - DNA, 16 bp, Homo sapiens
tggccaccccttgctc

SEQ ID NO: 6522760 - DNA, 18 bp, Homo sapiens
tggccaccccttgctctc

SEQ ID NO: 6522761 - DNA, 22 bp, Homo sapiens
tggccaccccttgctctctgtt

SEQ ID NO: 6522762 - DNA, 14 bp, Homo sapiens
tggccaccctggcc

SEQ ID NO: 6522763 - DNA, 21 bp, Homo sapiens
tggccacctagaagtctccct

SEQ ID NO: 6522764 - DNA, 17 bp, Homo sapiens
tggccacctgaggtggg

SEQ ID NO: 6522765 - DNA, 23 bp, Homo sapiens
tggccacctgaggtgggcccagg

SEQ ID NO: 6522766 - DNA, 13 bp, Homo sapiens
tggccacctgcca

SEQ ID NO: 6522767 - DNA, 21 bp, Homo sapiens
tggccacctgtagccatctgc

SEQ ID NO: 6522768 - DNA, 15 bp, Homo sapiens
tggccacgcagccag

SEQ ID NO: 6522769 - DNA, 14 bp, Homo sapiens
tggccacggccaca

SEQ ID NO: 6522770 - DNA, 17 bp, Homo sapiens
tggccacggcctgggag

SEQ ID NO: 6522771 - DNA, 14 bp, Homo sapiens
tggccacgggggca

SEQ ID NO: 6522772 - DNA, 12 bp, Homo sapiens
tggccactaagc

SEQ ID NO: 6522773 - DNA, 14 bp, Homo sapiens
ttagagccttttat

SEQ ID NO: 6522774 - DNA, 15 bp, Homo sapiens
ttagagccttttatc

SEQ ID NO: 6522775 - DNA, 12 bp, Homo sapiens
ttagagctcttg

SEQ ID NO: 6522776 - DNA, 21 bp, Homo sapiens
ttagagctgacacaaacctgc

SEQ ID NO: 6522777 - DNA, 22 bp, Homo sapiens
ttagagctttttttttttaatt

SEQ ID NO: 6522778 - DNA, 19 bp, Homo sapiens
ttagaggaaaaaaatgact

SEQ ID NO: 6522779 - DNA, 16 bp, Homo sapiens
ttagaggaaaaatatt

SEQ ID NO: 6522780 - DNA, 16 bp, Homo sapiens
ttagaggaaaatgagt

SEQ ID NO: 6522781 - DNA, 19 bp, Homo sapiens
ttagaggagtctgtggctt

SEQ ID NO: 6522782 - DNA, 22 bp, Homo sapiens
ttagaggataaataataaaggt

SEQ ID NO: 6522783 - DNA, 23 bp, Homo sapiens
ttagaggcattcagttagcaaag

SEQ ID NO: 6522784 - DNA, 20 bp, Homo sapiens
ttagaggctttcaaatgtac

SEQ ID NO: 6522785 - DNA, 16 bp, Homo sapiens
ttagagggacagccaa

SEQ ID NO: 6522786 - DNA, 21 bp, Homo sapiens
ttagagggatgagacagacat

SEQ ID NO: 6522787 - DNA, 14 bp, Homo sapiens
ttagagggccttgc

SEQ ID NO: 6522788 - DNA, 16 bp, Homo sapiens
ttagaggtttgtcaac

SEQ ID NO: 6522789 - DNA, 20 bp, Homo sapiens
ttagaggttttaaagtgatt

SEQ ID NO: 6522790 - DNA, 21 bp, Homo sapiens
ttagaggttttaaagtgatta

SEQ ID NO: 6522791 - DNA, 16 bp, Homo sapiens
ttagagtaaataaact

SEQ ID NO: 6522792 - DNA, 19 bp, Homo sapiens
ttagagtaaataaactgtt

SEQ ID NO: 6522793 - DNA, 21 bp, Homo sapiens
ttagagtaaataaactgttta

SEQ ID NO: 6522794 - DNA, 18 bp, Homo sapiens
ttagagtatttacactat

SEQ ID NO: 6522795 - DNA, 19 bp, Homo sapiens
ttagagtatttcccttcca

SEQ ID NO: 6522796 - DNA, 22 bp, Homo sapiens
ttagagtcaactacacaaagca

SEQ ID NO: 6522797 - DNA, 20 bp, Homo sapiens
ttagagtcaatttgctgaaa

SEQ ID NO: 6522798 - DNA, 15 bp, Homo sapiens
ttagagtcagagatc

SEQ ID NO: 6522799 - DNA, 14 bp, Homo sapiens
ttagagtcagcctt

SEQ ID NO: 6522800 - DNA, 15 bp, Homo sapiens
ttagagtgcccagca

SEQ ID NO: 6522801 - DNA, 22 bp, Homo sapiens
ttagagtgcccttaaaataatg

SEQ ID NO: 6522802 - DNA, 17 bp, Homo sapiens
ttagagtggttattcat

SEQ ID NO: 6522803 - DNA, 13 bp, Homo sapiens
ttagagtgtctta

SEQ ID NO: 6522804 - DNA, 13 bp, Homo sapiens
ttagagttagact

SEQ ID NO: 6522805 - DNA, 14 bp, Homo sapiens
ttagagttagactg

SEQ ID NO: 6522806 - DNA, 17 bp, Homo sapiens
ttagagtttacagtttg

SEQ ID NO: 6522807 - DNA, 18 bp, Homo sapiens
ttagagtttacagtttgt

SEQ ID NO: 6522808 - DNA, 13 bp, Homo sapiens
ttagagtttctgt

SEQ ID NO: 6522809 - DNA, 19 bp, Homo sapiens
ttagagttttattcctttc

SEQ ID NO: 6522810 - DNA, 23 bp, Homo sapiens
ttagagttttattcctttccttt

SEQ ID NO: 6522811 - DNA, 16 bp, Homo sapiens
ttagataaacacaggc

SEQ ID NO: 6522812 - DNA, 13 bp, Homo sapiens
ttagataaccata

SEQ ID NO: 6522813 - DNA, 18 bp, Homo sapiens
ttagataacttcttgaaa

SEQ ID NO: 6522814 - DNA, 22 bp, Homo sapiens
ttagataatacaccactacatt

SEQ ID NO: 6522815 - DNA, 23 bp, Homo sapiens
ttagataatcaagggcactgtga

SEQ ID NO: 6522816 - DNA, 19 bp, Homo sapiens
ttagataatcttttacatt

SEQ ID NO: 6522817 - DNA, 15 bp, Homo sapiens
ttagatacacaaaat

SEQ ID NO: 6522818 - DNA, 14 bp, Homo sapiens
ttagatacacttct

SEQ ID NO: 6522819 - DNA, 13 bp, Homo sapiens
ttagatagaagaa

SEQ ID NO: 6522820 - DNA, 14 bp, Homo sapiens
ttagatataacact

SEQ ID NO: 6522821 - DNA, 17 bp, Homo sapiens
ttagatataacactatg

SEQ ID NO: 6522822 - DNA, 23 bp, Homo sapiens
ttagatatataactttagaaata

SEQ ID NO: 6522823 - DNA, 22 bp, Homo sapiens
ttagatatgttaagcatggatt

SEQ ID NO: 6522824 - DNA, 13 bp, Homo sapiens
ttagatattaaaa

SEQ ID NO: 6522825 - DNA, 12 bp, Homo sapiens
ttagatattgct

SEQ ID NO: 6522826 - DNA, 21 bp, Homo sapiens
ttagatattgctactataatc

SEQ ID NO: 6522827 - DNA, 21 bp, Homo sapiens
ttagatattgttttgtgactt

SEQ ID NO: 6522828 - DNA, 14 bp, Homo sapiens
ttagatatttacat

SEQ ID NO: 6522829 - DNA, 20 bp, Homo sapiens
ttagatatttcgaccctggg

SEQ ID NO: 6522830 - DNA, 22 bp, Homo sapiens
ttagatatttcgaccctggggc

SEQ ID NO: 6522831 - DNA, 14 bp, Homo sapiens
ttagatatttgcct

SEQ ID NO: 6522832 - DNA, 22 bp, Homo sapiens
ttagatatttgcctgtctgttt

SEQ ID NO: 6522833 - DNA, 17 bp, Homo sapiens
ttagatattttccatat

SEQ ID NO: 6522834 - DNA, 18 bp, Homo sapiens
ttagatattttccatata

SEQ ID NO: 6522835 - DNA, 20 bp, Homo sapiens
ttagatattttccatatatt

SEQ ID NO: 6522836 - DNA, 15 bp, Homo sapiens
ttagatccaaatgta

SEQ ID NO: 6522837 - DNA, 16 bp, Homo sapiens
ttagatccaaatgtaa

SEQ ID NO: 6522838 - DNA, 14 bp, Homo sapiens
ttagatccattaat

SEQ ID NO: 6522839 - DNA, 20 bp, Homo sapiens
ttagatccattaatttaaat

SEQ ID NO: 6522840 - DNA, 23 bp, Homo sapiens
ttagatccattaatttaaatgat

SEQ ID NO: 6522841 - DNA, 20 bp, Homo sapiens
ttagatcccatatttactta

SEQ ID NO: 6522842 - DNA, 18 bp, Homo sapiens
ttagatcccatgtcacct

SEQ ID NO: 6522843 - DNA, 20 bp, Homo sapiens
ttagatcccatgtcacctca

SEQ ID NO: 6522844 - DNA, 21 bp, Homo sapiens
ttagatcccatgtcacctcag

SEQ ID NO: 6522845 - DNA, 15 bp, Homo sapiens
ttagatctggcatgt

SEQ ID NO: 6522846 - DNA, 21 bp, Homo sapiens
ttagatctggtgtccagcatg

SEQ ID NO: 6522847 - DNA, 23 bp, Homo sapiens
ttagatctggtgtccagcatgga

SEQ ID NO: 6522848 - DNA, 13 bp, Homo sapiens
ttagatctgtccc

SEQ ID NO: 6522849 - DNA, 14 bp, Homo sapiens
ttagatgactgaat

SEQ ID NO: 6522850 - DNA, 12 bp, Homo sapiens
ttagatgaggtc

SEQ ID NO: 6522851 - DNA, 16 bp, Homo sapiens
ttagatgagtgaaata

SEQ ID NO: 6522852 - DNA, 23 bp, Homo sapiens
ttagatgatgactcaagattttt

SEQ ID NO: 6522853 - DNA, 15 bp, Homo sapiens
ttagatgctattaaa

SEQ ID NO: 6522854 - DNA, 16 bp, Homo sapiens
ttagatggtggcacat

SEQ ID NO: 6522855 - DNA, 16 bp, Homo sapiens
ttagatggttacactg

SEQ ID NO: 6522856 - DNA, 18 bp, Homo sapiens
ttagatggttacactgtt

SEQ ID NO: 6522857 - DNA, 16 bp, Homo sapiens
ttagatgtaattttgt

SEQ ID NO: 6522858 - DNA, 22 bp, Homo sapiens
ttagatgtagatatttgaaata

SEQ ID NO: 6522859 - DNA, 16 bp, Homo sapiens
ttagatgtgagagaaa

SEQ ID NO: 6522860 - DNA, 20 bp, Homo sapiens
ttagatgtgcaacctgtggc

SEQ ID NO: 6522861 - DNA, 20 bp, Homo sapiens
ttagatgtgccaataaccaa

SEQ ID NO: 6522862 - DNA, 21 bp, Homo sapiens
ttagatgtgtatacagaaaat

SEQ ID NO: 6522863 - DNA, 13 bp, Homo sapiens
ttagatgttacta

SEQ ID NO: 6522864 - DNA, 16 bp, Homo sapiens
ttagatgttactgtgt

SEQ ID NO: 6522865 - DNA, 19 bp, Homo sapiens
ttagatgttctctatcatt

SEQ ID NO: 6522866 - DNA, 20 bp, Homo sapiens
ttagatgttctctatcattt

SEQ ID NO: 6522867 - DNA, 16 bp, Homo sapiens
ttagatgttgccatgt

SEQ ID NO: 6522868 - DNA, 18 bp, Homo sapiens
ttagatgtttatatcaaa

SEQ ID NO: 6522869 - DNA, 16 bp, Homo sapiens
ttagatgtttatttag

SEQ ID NO: 6522870 - DNA, 18 bp, Homo sapiens
ttagatgttttgggatca

SEQ ID NO: 6522871 - DNA, 14 bp, Homo sapiens
ttagattagctctg

SEQ ID NO: 6522872 - DNA, 14 bp, Homo sapiens
ttagattatttctg

SEQ ID NO: 6522873 - DNA, 17 bp, Homo sapiens
ttagattcatctatgga

SEQ ID NO: 6522874 - DNA, 14 bp, Homo sapiens
ttagattctgtatg

SEQ ID NO: 6522875 - DNA, 14 bp, Homo sapiens
ttagattgaaattt

SEQ ID NO: 6522876 - DNA, 17 bp, Homo sapiens
ttagattgaaatttatg

SEQ ID NO: 6522877 - DNA, 22 bp, Homo sapiens
ttagattgaaatttatgactag

SEQ ID NO: 6522878 - DNA, 13 bp, Homo sapiens
ttagattgagtag

SEQ ID NO: 6522879 - DNA, 22 bp, Homo sapiens
ttagattgagtaggtaccttgt

SEQ ID NO: 6522880 - DNA, 17 bp, Homo sapiens
ttagattgtctatctgt

SEQ ID NO: 6522881 - DNA, 14 bp, Homo sapiens
ttagatttaattta

SEQ ID NO: 6522882 - DNA, 15 bp, Homo sapiens
ttagatttattagat

SEQ ID NO: 6522883 - DNA, 18 bp, Homo sapiens
ttagatttcatagttcag

SEQ ID NO: 6522884 - DNA, 14 bp, Homo sapiens
ttagatttctttga

SEQ ID NO: 6522885 - DNA, 23 bp, Homo sapiens
ttagatttgccatagagtacact

SEQ ID NO: 6522886 - DNA, 13 bp, Homo sapiens
ttagatttgtgtg

SEQ ID NO: 6522887 - DNA, 15 bp, Homo sapiens
ttagattttacatga

SEQ ID NO: 6522888 - DNA, 21 bp, Homo sapiens
ttagattttacatgaagtatt

SEQ ID NO: 6522889 - DNA, 21 bp, Homo sapiens
ttagattttctggttctaaca

SEQ ID NO: 6522890 - DNA, 21 bp, Homo sapiens
ttagattttctgtaaatgaag

SEQ ID NO: 6522891 - DNA, 21 bp, Homo sapiens
ttagattttgatagcaatgtt

SEQ ID NO: 6522892 - DNA, 16 bp, Homo sapiens
ttagattttgtgttta

SEQ ID NO: 6522893 - DNA, 22 bp, Homo sapiens
ttagattttgtgtttattcttg

SEQ ID NO: 6522894 - DNA, 18 bp, Homo sapiens
ttagcaaactgatgctga

SEQ ID NO: 6522895 - DNA, 19 bp, Homo sapiens
ttagcaaactgatgctgag

SEQ ID NO: 6522896 - DNA, 15 bp, Homo sapiens
ttagcaaagaggttg

SEQ ID NO: 6522897 - DNA, 22 bp, Homo sapiens
ttagcaaagcaaaaggctgaga

SEQ ID NO: 6522898 - DNA, 17 bp, Homo sapiens
ttagcaacaacatgcta

SEQ ID NO: 6522899 - DNA, 14 bp, Homo sapiens
ttagcaataaataa

SEQ ID NO: 6522900 - DNA, 16 bp, Homo sapiens
ttagcaataaataaca

SEQ ID NO: 6522901 - DNA, 20 bp, Homo sapiens
ttagcaataaataacacttg

SEQ ID NO: 6522902 - DNA, 17 bp, Homo sapiens
ttagcaatcattttata

SEQ ID NO: 6522903 - DNA, 14 bp, Homo sapiens
ttagcacaatttat

SEQ ID NO: 6522904 - DNA, 15 bp, Homo sapiens
ttagcacagtattta

SEQ ID NO: 6522905 - DNA, 19 bp, Homo sapiens
ttagcacagtatttaacat

SEQ ID NO: 6522906 - DNA, 20 bp, Homo sapiens
ttagcacatcactgagaaga

SEQ ID NO: 6522907 - DNA, 16 bp, Homo sapiens
ttagcactatttaaaa

SEQ ID NO: 6522908 - DNA, 12 bp, Homo sapiens
ttagcactgttg

SEQ ID NO: 6522909 - DNA, 18 bp, Homo sapiens
ttagcactgttgatgtat

SEQ ID NO: 6522910 - DNA, 17 bp, Homo sapiens
ttagcagaagaaaggaa

SEQ ID NO: 6522911 - DNA, 13 bp, Homo sapiens
ttagcagaatgga

SEQ ID NO: 6522912 - DNA, 15 bp, Homo sapiens
ttagcagacagaagt

SEQ ID NO: 6522913 - DNA, 12 bp, Homo sapiens
ttagcagagtct

SEQ ID NO: 6522914 - DNA, 15 bp, Homo sapiens
ttagcagatattaaa

SEQ ID NO: 6522915 - DNA, 21 bp, Homo sapiens
ttagcagcagcctttaatgca

SEQ ID NO: 6522916 - DNA, 13 bp, Homo sapiens
ttagcagcccagc

SEQ ID NO: 6522917 - DNA, 19 bp, Homo sapiens
ttagcagctatgtaaatga

SEQ ID NO: 6522918 - DNA, 19 bp, Homo sapiens
ttagcagcttctgtcctct

SEQ ID NO: 6522919 - DNA, 20 bp, Homo sapiens
ttagcaggagaggagagcca

SEQ ID NO: 6522920 - DNA, 23 bp, Homo sapiens
ttagcaggccaaggtctgagcca

SEQ ID NO: 6522921 - DNA, 22 bp, Homo sapiens
ttagcaggttgggctagagaaa

SEQ ID NO: 6522922 - DNA, 16 bp, Homo sapiens
ttagcagtaaaatagc

SEQ ID NO: 6522923 - DNA, 17 bp, Homo sapiens
ttagcagtggctggtgc

SEQ ID NO: 6522924 - DNA, 14 bp, Homo sapiens
ttagcagtttcctc

SEQ ID NO: 6522925 - DNA, 16 bp, Homo sapiens
ttagcagtttcctcag

SEQ ID NO: 6522926 - DNA, 16 bp, Homo sapiens
ttagcagtttgctttg

SEQ ID NO: 6522927 - DNA, 22 bp, Homo sapiens
ttagcataattttgtgttgtac

SEQ ID NO: 6522928 - DNA, 18 bp, Homo sapiens
ttagcatatgcaaatctt

SEQ ID NO: 6522929 - DNA, 11 bp, Homo sapiens
ttagcatcccc

SEQ ID NO: 6522930 - DNA, 18 bp, Homo sapiens
ttagcatcctaagaaata

SEQ ID NO: 6522931 - DNA, 21 bp, Homo sapiens
ttagcatgacaagccccaggc

SEQ ID NO: 6522932 - DNA, 15 bp, Homo sapiens
ttagcatgcacaaag

SEQ ID NO: 6522933 - DNA, 20 bp, Homo sapiens
ttagcatgcctccaaaaatt

SEQ ID NO: 6522934 - DNA, 18 bp, Homo sapiens
ttagcatggtgagctgag

SEQ ID NO: 6522935 - DNA, 17 bp, Homo sapiens
ttagcatgtgttgaaaa

SEQ ID NO: 6522936 - DNA, 16 bp, Homo sapiens
ttagcatgtttgctga

SEQ ID NO: 6522937 - DNA, 17 bp, Homo sapiens
ttagcattaaaaataaa

SEQ ID NO: 6522938 - DNA, 16 bp, Homo sapiens
ttagcattaaagttct

SEQ ID NO: 6522939 - DNA, 17 bp, Homo sapiens
ttagcattaaagttcta

SEQ ID NO: 6522940 - DNA, 14 bp, Homo sapiens
ttagcattattgcc

SEQ ID NO: 6522941 - DNA, 19 bp, Homo sapiens
ttagcattattgccaaata

SEQ ID NO: 6522942 - DNA, 18 bp, Homo sapiens
ttagcattcatattttcc

SEQ ID NO: 6522943 - DNA, 17 bp, Homo sapiens
ttagcatttaccaacat

SEQ ID NO: 6522944 - DNA, 20 bp, Homo sapiens
ttagcatttaccaacatgta

SEQ ID NO: 6522945 - DNA, 22 bp, Homo sapiens
ttagcatttagtccaatgtctt

SEQ ID NO: 6522946 - DNA, 16 bp, Homo sapiens
ttagcatttttatgca

SEQ ID NO: 6522947 - DNA, 14 bp, Homo sapiens
ttagccaaaacact

SEQ ID NO: 6522948 - DNA, 14 bp, Homo sapiens
ttagccaaacaaca

SEQ ID NO: 6522949 - DNA, 22 bp, Homo sapiens
ttagccaactgtttccctgctg

SEQ ID NO: 6522950 - DNA, 18 bp, Homo sapiens
ttagccaagtgtggtaga

SEQ ID NO: 6522951 - DNA, 23 bp, Homo sapiens
tggccactccgagaggtgggcca

SEQ ID NO: 6522952 - DNA, 13 bp, Homo sapiens
tggccactcctgg

SEQ ID NO: 6522953 - DNA, 16 bp, Homo sapiens
tggccactcctgggcc

SEQ ID NO: 6522954 - DNA, 17 bp, Homo sapiens
tggccactcctgggccc

SEQ ID NO: 6522955 - DNA, 12 bp, Homo sapiens
tggccactctgc

SEQ ID NO: 6522956 - DNA, 15 bp, Homo sapiens
tggccactgaaaagc

SEQ ID NO: 6522957 - DNA, 19 bp, Homo sapiens
tggccactgaaaagctttc

SEQ ID NO: 6522958 - DNA, 21 bp, Homo sapiens
tggccactgaattagccaaaa

SEQ ID NO: 6522959 - DNA, 15 bp, Homo sapiens
tggccactgagctgg

SEQ ID NO: 6522960 - DNA, 20 bp, Homo sapiens
tggccactgagctggctgac

SEQ ID NO: 6522961 - DNA, 14 bp, Homo sapiens
tggccactgcacag

SEQ ID NO: 6522962 - DNA, 19 bp, Homo sapiens
tggccactgcacagagctc

SEQ ID NO: 6522963 - DNA, 14 bp, Homo sapiens
tggccactgctccc

SEQ ID NO: 6522964 - DNA, 18 bp, Homo sapiens
tggccactgctcttgtga

SEQ ID NO: 6522965 - DNA, 20 bp, Homo sapiens
tggccactggatcctgctgc

SEQ ID NO: 6522966 - DNA, 14 bp, Homo sapiens
tggccactggccct

SEQ ID NO: 6522967 - DNA, 18 bp, Homo sapiens
tggccactggccctgttt

SEQ ID NO: 6522968 - DNA, 22 bp, Homo sapiens
tggccactggggtgccttcact

SEQ ID NO: 6522969 - DNA, 20 bp, Homo sapiens
tggccactgggtctcactcc

SEQ ID NO: 6522970 - DNA, 22 bp, Homo sapiens
tggccactgggtctcactcctg

SEQ ID NO: 6522971 - DNA, 13 bp, Homo sapiens
tggccactgtatt

SEQ ID NO: 6522972 - DNA, 13 bp, Homo sapiens
tggccactgtcaa

SEQ ID NO: 6522973 - DNA, 19 bp, Homo sapiens
tggccacttcattccagca

SEQ ID NO: 6522974 - DNA, 20 bp, Homo sapiens
tggccacttcattccagcag

SEQ ID NO: 6522975 - DNA, 17 bp, Homo sapiens
tggccacttctgtccat

SEQ ID NO: 6522976 - DNA, 21 bp, Homo sapiens
tggccacttgggtcttccctg

SEQ ID NO: 6522977 - DNA, 20 bp, Homo sapiens
tggccactttgcagacctgg

SEQ ID NO: 6522978 - DNA, 20 bp, Homo sapiens
tggccagaagggggccatga

SEQ ID NO: 6522979 - DNA, 16 bp, Homo sapiens
tggccagaagtcaagc

SEQ ID NO: 6522980 - DNA, 22 bp, Homo sapiens
tggccagaccagagctctggag

SEQ ID NO: 6522981 - DNA, 17 bp, Homo sapiens
tggccagaccaggtgac

SEQ ID NO: 6522982 - DNA, 13 bp, Homo sapiens
tggccagagagcc

SEQ ID NO: 6522983 - DNA, 13 bp, Homo sapiens
tggccagagaggg

SEQ ID NO: 6522984 - DNA, 21 bp, Homo sapiens
tggccagagagggcccagctg

SEQ ID NO: 6522985 - DNA, 15 bp, Homo sapiens
tggccagagagtggg

SEQ ID NO: 6522986 - DNA, 17 bp, Homo sapiens
tggccagagcacctcag

SEQ ID NO: 6522987 - DNA, 13 bp, Homo sapiens
tggccagagcctc

SEQ ID NO: 6522988 - DNA, 14 bp, Homo sapiens
tggccagagcctct

SEQ ID NO: 6522989 - DNA, 14 bp, Homo sapiens
tggccagagctgga

SEQ ID NO: 6522990 - DNA, 23 bp, Homo sapiens
tggccagagctgggaggcatggc

SEQ ID NO: 6522991 - DNA, 15 bp, Homo sapiens
tggccagaggcagct

SEQ ID NO: 6522992 - DNA, 16 bp, Homo sapiens
tggccagagggcccct

SEQ ID NO: 6522993 - DNA, 20 bp, Homo sapiens
tggccagagggcccctcact

SEQ ID NO: 6522994 - DNA, 19 bp, Homo sapiens
tggccagatgcaccagccc

SEQ ID NO: 6522995 - DNA, 20 bp, Homo sapiens
tggccagatgcaccagccct

SEQ ID NO: 6522996 - DNA, 16 bp, Homo sapiens
tggccagattgtgggg

SEQ ID NO: 6522997 - DNA, 18 bp, Homo sapiens
tggccagattgtggggtg

SEQ ID NO: 6522998 - DNA, 17 bp, Homo sapiens
tggccagcaaggcaggt

SEQ ID NO: 6522999 - DNA, 19 bp, Homo sapiens
tggccagcaaggcaggttg

SEQ ID NO: 6523000 - DNA, 21 bp, Homo sapiens
tggccagcacaccaagtggct

SEQ ID NO: 6523001 - DNA, 21 bp, Homo sapiens
tggccagcaccctctcctggg

SEQ ID NO: 6523002 - DNA, 13 bp, Homo sapiens
tggccagcagcac

SEQ ID NO: 6523003 - DNA, 20 bp, Homo sapiens
tggccagcagcacctgccct

SEQ ID NO: 6523004 - DNA, 15 bp, Homo sapiens
tggccagccccacag

SEQ ID NO: 6523005 - DNA, 21 bp, Homo sapiens
tggccagcccctggggcccag

SEQ ID NO: 6523006 - DNA, 20 bp, Homo sapiens
tggccagcccgcagaggtgg

SEQ ID NO: 6523007 - DNA, 21 bp, Homo sapiens
tggccagcccgcagaggtggg

SEQ ID NO: 6523008 - DNA, 13 bp, Homo sapiens
tggccagcccggc

SEQ ID NO: 6523009 - DNA, 16 bp, Homo sapiens
tggccagcccggctgg

SEQ ID NO: 6523010 - DNA, 24 bp, Homo sapiens
tggccagcccttcctctcactcct

SEQ ID NO: 6523011 - DNA, 12 bp, Homo sapiens
tggccagccgct

SEQ ID NO: 6523012 - DNA, 18 bp, Homo sapiens
tggccagccgctctcctg

SEQ ID NO: 6523013 - DNA, 21 bp, Homo sapiens
tggccagccgctctcctgcca

SEQ ID NO: 6523014 - DNA, 23 bp, Homo sapiens
tggccagccgctctcctgccaca

SEQ ID NO: 6523015 - DNA, 14 bp, Homo sapiens
tggccagcctggat

SEQ ID NO: 6523016 - DNA, 15 bp, Homo sapiens
tggccagcctggggc

SEQ ID NO: 6523017 - DNA, 15 bp, Homo sapiens
tggccagctcataaa

SEQ ID NO: 6523018 - DNA, 13 bp, Homo sapiens
tggccaggaagct

SEQ ID NO: 6523019 - DNA, 21 bp, Homo sapiens
tggccaggaagctttggtgag

SEQ ID NO: 6523020 - DNA, 21 bp, Homo sapiens
tggccaggaagtagcacaggc

SEQ ID NO: 6523021 - DNA, 22 bp, Homo sapiens
tggccaggaagtagcacaggct

SEQ ID NO: 6523022 - DNA, 15 bp, Homo sapiens
tggccaggagctctt

SEQ ID NO: 6523023 - DNA, 18 bp, Homo sapiens
tggccaggagctggagga

SEQ ID NO: 6523024 - DNA, 16 bp, Homo sapiens
tggccaggaggtgcca

SEQ ID NO: 6523025 - DNA, 16 bp, Homo sapiens
tggccaggaggttccc

SEQ ID NO: 6523026 - DNA, 14 bp, Homo sapiens
tggccaggatggag

SEQ ID NO: 6523027 - DNA, 20 bp, Homo sapiens
tggccaggcaccccctggag

SEQ ID NO: 6523028 - DNA, 21 bp, Homo sapiens
tggccaggcactgccttctcc

SEQ ID NO: 6523029 - DNA, 12 bp, Homo sapiens
tggccaggcagg

SEQ ID NO: 6523030 - DNA, 13 bp, Homo sapiens
tggccaggcaggg

SEQ ID NO: 6523031 - DNA, 14 bp, Homo sapiens
tggccaggcaggga

SEQ ID NO: 6523032 - DNA, 22 bp, Homo sapiens
tggccaggcagggagtgtctgc

SEQ ID NO: 6523033 - DNA, 15 bp, Homo sapiens
tggccaggccctggg

SEQ ID NO: 6523034 - DNA, 13 bp, Homo sapiens
tggccaggccggg

SEQ ID NO: 6523035 - DNA, 22 bp, Homo sapiens
tggccaggccgggaaaaagccc

SEQ ID NO: 6523036 - DNA, 13 bp, Homo sapiens
tggccaggcctag

SEQ ID NO: 6523037 - DNA, 21 bp, Homo sapiens
tggccaggcctgccagcccct

SEQ ID NO: 6523038 - DNA, 23 bp, Homo sapiens
tggccaggccttacatctggctg

SEQ ID NO: 6523039 - DNA, 13 bp, Homo sapiens
tggccaggctggt

SEQ ID NO: 6523040 - DNA, 17 bp, Homo sapiens
tggccaggctggtctca

SEQ ID NO: 6523041 - DNA, 20 bp, Homo sapiens
tggccaggctggtcttgaac

SEQ ID NO: 6523042 - DNA, 15 bp, Homo sapiens
tggccagggaggagc

SEQ ID NO: 6523043 - DNA, 22 bp, Homo sapiens
tggccagggaggcgcagggaca

SEQ ID NO: 6523044 - DNA, 20 bp, Homo sapiens
tggccagggccacgctccag

SEQ ID NO: 6523045 - DNA, 12 bp, Homo sapiens
tggccagggcct

SEQ ID NO: 6523046 - DNA, 16 bp, Homo sapiens
tggccagggctccacg

SEQ ID NO: 6523047 - DNA, 17 bp, Homo sapiens
tggccagggctccacgg

SEQ ID NO: 6523048 - DNA, 12 bp, Homo sapiens
tggccagggctt

SEQ ID NO: 6523049 - DNA, 16 bp, Homo sapiens
tggccaggggccagga

SEQ ID NO: 6523050 - DNA, 23 bp, Homo sapiens
tggccaggggtggtgagggcagt

SEQ ID NO: 6523051 - DNA, 15 bp, Homo sapiens
tggccaggtggccac

SEQ ID NO: 6523052 - DNA, 19 bp, Homo sapiens
tggccaggtggttgtctta

SEQ ID NO: 6523053 - DNA, 21 bp, Homo sapiens
tggccagtccaccctgcctgc

SEQ ID NO: 6523054 - DNA, 22 bp, Homo sapiens
tggccagtccaccctgcctgcc

SEQ ID NO: 6523055 - DNA, 16 bp, Homo sapiens
tggccagtccaggctg

SEQ ID NO: 6523056 - DNA, 17 bp, Homo sapiens
tggccagtccaggctgc

SEQ ID NO: 6523057 - DNA, 18 bp, Homo sapiens
tggccagtcctagagctc

SEQ ID NO: 6523058 - DNA, 21 bp, Homo sapiens
tggccagtcctagagctcctg

SEQ ID NO: 6523059 - DNA, 21 bp, Homo sapiens
tggccagtcctggtcctggct

SEQ ID NO: 6523060 - DNA, 15 bp, Homo sapiens
tggccagtcttcctc

SEQ ID NO: 6523061 - DNA, 22 bp, Homo sapiens
tggccagtcttcctcttagcct

SEQ ID NO: 6523062 - DNA, 18 bp, Homo sapiens
tggccagtgacatttcaa

SEQ ID NO: 6523063 - DNA, 16 bp, Homo sapiens
tggccagtgacgtggt

SEQ ID NO: 6523064 - DNA, 17 bp, Homo sapiens
tggccagtgagaagctg

SEQ ID NO: 6523065 - DNA, 19 bp, Homo sapiens
tggccagtgagatcaatgt

SEQ ID NO: 6523066 - DNA, 21 bp, Homo sapiens
tggccagtgccctgatcccag

SEQ ID NO: 6523067 - DNA, 15 bp, Homo sapiens
tggccagtgctgccc

SEQ ID NO: 6523068 - DNA, 18 bp, Homo sapiens
tggccagtgctgcttctt

SEQ ID NO: 6523069 - DNA, 15 bp, Homo sapiens
tggccagtggctgga

SEQ ID NO: 6523070 - DNA, 15 bp, Homo sapiens
tggccagttgcccag

SEQ ID NO: 6523071 - DNA, 17 bp, Homo sapiens
tggccagttgcccagag

SEQ ID NO: 6523072 - DNA, 18 bp, Homo sapiens
tggccagtttgaagcctg

SEQ ID NO: 6523073 - DNA, 14 bp, Homo sapiens
tggccagttttctg

SEQ ID NO: 6523074 - DNA, 14 bp, Homo sapiens
tggccatagaggcc

SEQ ID NO: 6523075 - DNA, 17 bp, Homo sapiens
tggccatagaggcccag

SEQ ID NO: 6523076 - DNA, 20 bp, Homo sapiens
tggccatagaggcccaggca

SEQ ID NO: 6523077 - DNA, 22 bp, Homo sapiens
tggccatagaggcccaggcacc

SEQ ID NO: 6523078 - DNA, 17 bp, Homo sapiens
tggccatatatgctgta

SEQ ID NO: 6523079 - DNA, 21 bp, Homo sapiens
tggccatatatgctgtatttc

SEQ ID NO: 6523080 - DNA, 15 bp, Homo sapiens
tggccatatttacct

SEQ ID NO: 6523081 - DNA, 18 bp, Homo sapiens
tggccatatttacctcag

SEQ ID NO: 6523082 - DNA, 21 bp, Homo sapiens
tggccatatttacctcagcct

SEQ ID NO: 6523083 - DNA, 23 bp, Homo sapiens
tggccatatttacctcagcctgg

SEQ ID NO: 6523084 - DNA, 14 bp, Homo sapiens
tggccatcactcag

SEQ ID NO: 6523085 - DNA, 21 bp, Homo sapiens
tggccatcaggactttccctg

SEQ ID NO: 6523086 - DNA, 12 bp, Homo sapiens
tggccatccctg

SEQ ID NO: 6523087 - DNA, 21 bp, Homo sapiens
tggccatccctgggcccctcc

SEQ ID NO: 6523088 - DNA, 23 bp, Homo sapiens
tggccatccctgggcccctccac

SEQ ID NO: 6523089 - DNA, 14 bp, Homo sapiens
tggccatccctgtg

SEQ ID NO: 6523090 - DNA, 17 bp, Homo sapiens
tggccatcctacccagc

SEQ ID NO: 6523091 - DNA, 18 bp, Homo sapiens
tggccatcctacccagcg

SEQ ID NO: 6523092 - DNA, 17 bp, Homo sapiens
tggccatctccctcccc

SEQ ID NO: 6523093 - DNA, 16 bp, Homo sapiens
tggccatctctggatg

SEQ ID NO: 6523094 - DNA, 18 bp, Homo sapiens
tggccatctgctcctgga

SEQ ID NO: 6523095 - DNA, 13 bp, Homo sapiens
tggccatcttctt

SEQ ID NO: 6523096 - DNA, 17 bp, Homo sapiens
tggccatcttctttctt

SEQ ID NO: 6523097 - DNA, 23 bp, Homo sapiens
tggccatgatgtccttggactcc

SEQ ID NO: 6523098 - DNA, 13 bp, Homo sapiens
tggccatgcaagt

SEQ ID NO: 6523099 - DNA, 12 bp, Homo sapiens
tggccatgccct

SEQ ID NO: 6523100 - DNA, 15 bp, Homo sapiens
tggccatgccctaga

SEQ ID NO: 6523101 - DNA, 15 bp, Homo sapiens
tggccatgcctcagc

SEQ ID NO: 6523102 - DNA, 18 bp, Homo sapiens
tggccatgctcaaccccc

SEQ ID NO: 6523103 - DNA, 21 bp, Homo sapiens
tggccatgctcctcttcccca

SEQ ID NO: 6523104 - DNA, 22 bp, Homo sapiens
tggccatgctcctcttccccag

SEQ ID NO: 6523105 - DNA, 17 bp, Homo sapiens
tggccatgctgtccctg

SEQ ID NO: 6523106 - DNA, 21 bp, Homo sapiens
tggccatgctgtccctgcact

SEQ ID NO: 6523107 - DNA, 20 bp, Homo sapiens
tggccatggacgaatatgaa

SEQ ID NO: 6523108 - DNA, 22 bp, Homo sapiens
tggccatggagaaagctgactt

SEQ ID NO: 6523109 - DNA, 14 bp, Homo sapiens
tggccatggcctct

SEQ ID NO: 6523110 - DNA, 16 bp, Homo sapiens
tggccatggcctctgc

SEQ ID NO: 6523111 - DNA, 17 bp, Homo sapiens
tggccatggcctctgca

SEQ ID NO: 6523112 - DNA, 13 bp, Homo sapiens
tggccatggcctg

SEQ ID NO: 6523113 - DNA, 11 bp, Homo sapiens
tggccatggct

SEQ ID NO: 6523114 - DNA, 15 bp, Homo sapiens
tggccatgggaggcc

SEQ ID NO: 6523115 - DNA, 19 bp, Homo sapiens
tggccatggggccctccca

SEQ ID NO: 6523116 - DNA, 20 bp, Homo sapiens
tggccatggggccctcccag

SEQ ID NO: 6523117 - DNA, 17 bp, Homo sapiens
tggccatgtcacctggc

SEQ ID NO: 6523118 - DNA, 22 bp, Homo sapiens
tggccatttccaagaggctgta

SEQ ID NO: 6523119 - DNA, 16 bp, Homo sapiens
tggccatttctgtgga

SEQ ID NO: 6523120 - DNA, 22 bp, Homo sapiens
tggccatttgctagttctgctg

SEQ ID NO: 6523121 - DNA, 18 bp, Homo sapiens
tggccattttcttgcctg

SEQ ID NO: 6523122 - DNA, 23 bp, Homo sapiens
tggccattttcttgcctgaggct

SEQ ID NO: 6523123 - DNA, 16 bp, Homo sapiens
tggccatttttctggg

SEQ ID NO: 6523124 - DNA, 14 bp, Homo sapiens
tggcccaaatccag

SEQ ID NO: 6523125 - DNA, 20 bp, Homo sapiens
tggcccaacaggggctccat

SEQ ID NO: 6523126 - DNA, 15 bp, Homo sapiens
tggcccaagactggg

SEQ ID NO: 6523127 - DNA, 18 bp, Homo sapiens
tggcccaagactgggctg

SEQ ID NO: 6523128 - DNA, 13 bp, Homo sapiens
tggcccaagagag

SEQ ID NO: 6523129 - DNA, 13 bp, Homo sapiens
ttagccacatgta

SEQ ID NO: 6523130 - DNA, 22 bp, Homo sapiens
ttagccagaatgtttcctgtgg

SEQ ID NO: 6523131 - DNA, 16 bp, Homo sapiens
ttagccagagatgcaa

SEQ ID NO: 6523132 - DNA, 17 bp, Homo sapiens
ttagccagatttgtctt

SEQ ID NO: 6523133 - DNA, 12 bp, Homo sapiens
ttagccagtgac

SEQ ID NO: 6523134 - DNA, 17 bp, Homo sapiens
ttagccagtgttttcca

SEQ ID NO: 6523135 - DNA, 20 bp, Homo sapiens
ttagccatctaatgcttgtt

SEQ ID NO: 6523136 - DNA, 16 bp, Homo sapiens
ttagccatgatctgca

SEQ ID NO: 6523137 - DNA, 13 bp, Homo sapiens
ttagccattgaaa

SEQ ID NO: 6523138 - DNA, 18 bp, Homo sapiens
ttagccatttttcaaagc

SEQ ID NO: 6523139 - DNA, 18 bp, Homo sapiens
ttagcccaatggagaaat

SEQ ID NO: 6523140 - DNA, 22 bp, Homo sapiens
ttagcccatctctccagagagc

SEQ ID NO: 6523141 - DNA, 19 bp, Homo sapiens
ttagccccagaaaatgaaa

SEQ ID NO: 6523142 - DNA, 17 bp, Homo sapiens
ttagcccggatgcccac

SEQ ID NO: 6523143 - DNA, 18 bp, Homo sapiens
ttagccctggtttgaaat

SEQ ID NO: 6523144 - DNA, 20 bp, Homo sapiens
ttagccctggtttgaaattt

SEQ ID NO: 6523145 - DNA, 18 bp, Homo sapiens
ttagcccttccttgccag

SEQ ID NO: 6523146 - DNA, 21 bp, Homo sapiens
ttagccgcaccctgcacctgc

SEQ ID NO: 6523147 - DNA, 21 bp, Homo sapiens
ttagccgggcatgatggtgca

SEQ ID NO: 6523148 - DNA, 16 bp, Homo sapiens
ttagcctaagatatac

SEQ ID NO: 6523149 - DNA, 19 bp, Homo sapiens
ttagcctaagatatacttg

SEQ ID NO: 6523150 - DNA, 17 bp, Homo sapiens
ttagcctcctcccaaag

SEQ ID NO: 6523151 - DNA, 18 bp, Homo sapiens
ttagcctcttccctctga

SEQ ID NO: 6523152 - DNA, 17 bp, Homo sapiens
ttagcctcttggaaatc

SEQ ID NO: 6523153 - DNA, 17 bp, Homo sapiens
ttagcctgagtagaaag

SEQ ID NO: 6523154 - DNA, 11 bp, Homo sapiens
ttagcctgcct

SEQ ID NO: 6523155 - DNA, 10 bp, Homo sapiens
ttagcctgga

SEQ ID NO: 6523156 - DNA, 22 bp, Homo sapiens
ttagcctggacctctgacagca

SEQ ID NO: 6523157 - DNA, 12 bp, Homo sapiens
ttagcctggact

SEQ ID NO: 6523158 - DNA, 13 bp, Homo sapiens
ttagcctggctgt

SEQ ID NO: 6523159 - DNA, 19 bp, Homo sapiens
ttagcctggtgacaggcag

SEQ ID NO: 6523160 - DNA, 20 bp, Homo sapiens
ttagcctggtgacaggcaga

SEQ ID NO: 6523161 - DNA, 12 bp, Homo sapiens
ttagccttctct

SEQ ID NO: 6523162 - DNA, 15 bp, Homo sapiens
ttagccttctctgtt

SEQ ID NO: 6523163 - DNA, 17 bp, Homo sapiens
ttagccttctctgttca

SEQ ID NO: 6523164 - DNA, 21 bp, Homo sapiens
ttagccttctctgttcatttc

SEQ ID NO: 6523165 - DNA, 21 bp, Homo sapiens
ttagccttgctgtagagactt

SEQ ID NO: 6523166 - DNA, 18 bp, Homo sapiens
ttagccttgtgccctgcc

SEQ ID NO: 6523167 - DNA, 14 bp, Homo sapiens
ttagcctttgaatg

SEQ ID NO: 6523168 - DNA, 16 bp, Homo sapiens
ttagcctttgtcccag

SEQ ID NO: 6523169 - DNA, 20 bp, Homo sapiens
ttagccttttttccccagac

SEQ ID NO: 6523170 - DNA, 23 bp, Homo sapiens
ttagccttttttccccagacttg

SEQ ID NO: 6523171 - DNA, 23 bp, Homo sapiens
ttagcgacaacagattggatttt

SEQ ID NO: 6523172 - DNA, 18 bp, Homo sapiens
ttagcgcacccagagaaa

SEQ ID NO: 6523173 - DNA, 13 bp, Homo sapiens
ttagcgctctgga

SEQ ID NO: 6523174 - DNA, 19 bp, Homo sapiens
ttagcggcaaacctttccc

SEQ ID NO: 6523175 - DNA, 21 bp, Homo sapiens
ttagcggcaaacctttccccc

SEQ ID NO: 6523176 - DNA, 13 bp, Homo sapiens
ttagcgtcaagac

SEQ ID NO: 6523177 - DNA, 21 bp, Homo sapiens
ttagcgttctggactctgccc

SEQ ID NO: 6523178 - DNA, 16 bp, Homo sapiens
ttagctaaaaatatat

SEQ ID NO: 6523179 - DNA, 23 bp, Homo sapiens
ttagctaataaaaagcttttgtc

SEQ ID NO: 6523180 - DNA, 23 bp, Homo sapiens
ttagctactttggcattgctgca

SEQ ID NO: 6523181 - DNA, 21 bp, Homo sapiens
ttagctagaatccacacatat

SEQ ID NO: 6523182 - DNA, 19 bp, Homo sapiens
ttagctagttagagactcg

SEQ ID NO: 6523183 - DNA, 18 bp, Homo sapiens
ttagctatgtttccatct

SEQ ID NO: 6523184 - DNA, 21 bp, Homo sapiens
ttagctatttatccctttcct

SEQ ID NO: 6523185 - DNA, 17 bp, Homo sapiens
ttagctcaatgagcatg

SEQ ID NO: 6523186 - DNA, 18 bp, Homo sapiens
ttagctcaatgagcatgt

SEQ ID NO: 6523187 - DNA, 21 bp, Homo sapiens
ttagctcagaggagaggagca

SEQ ID NO: 6523188 - DNA, 14 bp, Homo sapiens
ttagctcccagcta

SEQ ID NO: 6523189 - DNA, 20 bp, Homo sapiens
ttagctccctgttcttgggt

SEQ ID NO: 6523190 - DNA, 12 bp, Homo sapiens
ttagctccttga

SEQ ID NO: 6523191 - DNA, 15 bp, Homo sapiens
ttagctccttgaaga

SEQ ID NO: 6523192 - DNA, 19 bp, Homo sapiens
ttagctctggaccagcctg

SEQ ID NO: 6523193 - DNA, 20 bp, Homo sapiens
ttagctctggacgtgaaata

SEQ ID NO: 6523194 - DNA, 22 bp, Homo sapiens
ttagctctggacgtgaaatact

SEQ ID NO: 6523195 - DNA, 16 bp, Homo sapiens
ttagctctggggggca

SEQ ID NO: 6523196 - DNA, 23 bp, Homo sapiens
ttagctcttaattgttcattttg

SEQ ID NO: 6523197 - DNA, 13 bp, Homo sapiens
ttagctctttctc

SEQ ID NO: 6523198 - DNA, 18 bp, Homo sapiens
ttagctgacaaaatactt

SEQ ID NO: 6523199 - DNA, 12 bp, Homo sapiens
ttagctgaggga

SEQ ID NO: 6523200 - DNA, 13 bp, Homo sapiens
ttagctgcagaac

SEQ ID NO: 6523201 - DNA, 20 bp, Homo sapiens
ttagctgcttctatgtttca

SEQ ID NO: 6523202 - DNA, 12 bp, Homo sapiens
ttagctggaaaa

SEQ ID NO: 6523203 - DNA, 13 bp, Homo sapiens
ttagctggaaaag

SEQ ID NO: 6523204 - DNA, 16 bp, Homo sapiens
ttagctggagaactag

SEQ ID NO: 6523205 - DNA, 16 bp, Homo sapiens
ttagctggccaaggag

SEQ ID NO: 6523206 - DNA, 18 bp, Homo sapiens
ttagctggccacatggcg

SEQ ID NO: 6523207 - DNA, 12 bp, Homo sapiens
ttagctgggaga

SEQ ID NO: 6523208 - DNA, 18 bp, Homo sapiens
ttagctgggatatgtagt

SEQ ID NO: 6523209 - DNA, 17 bp, Homo sapiens
ttagctgtaacagttct

SEQ ID NO: 6523210 - DNA, 13 bp, Homo sapiens
ttagctgtactat

SEQ ID NO: 6523211 - DNA, 18 bp, Homo sapiens
ttagctgtattcatatat

SEQ ID NO: 6523212 - DNA, 15 bp, Homo sapiens
ttagctgtctgctca

SEQ ID NO: 6523213 - DNA, 17 bp, Homo sapiens
ttagctgtctgctcaga

SEQ ID NO: 6523214 - DNA, 15 bp, Homo sapiens
ttagctgtgtgaaat

SEQ ID NO: 6523215 - DNA, 18 bp, Homo sapiens
ttagctgtgttattatag

SEQ ID NO: 6523216 - DNA, 11 bp, Homo sapiens
ttagctgttta

SEQ ID NO: 6523217 - DNA, 15 bp, Homo sapiens
ttagcttacctgggc

SEQ ID NO: 6523218 - DNA, 16 bp, Homo sapiens
ttagcttagacctcag

SEQ ID NO: 6523219 - DNA, 18 bp, Homo sapiens
ttagcttagacctcagcc

SEQ ID NO: 6523220 - DNA, 15 bp, Homo sapiens
ttagcttatcaattt

SEQ ID NO: 6523221 - DNA, 17 bp, Homo sapiens
ttagcttatcaatttgt

SEQ ID NO: 6523222 - DNA, 17 bp, Homo sapiens
ttagcttatgttaactg

SEQ ID NO: 6523223 - DNA, 19 bp, Homo sapiens
ttagcttattgatcccaca

SEQ ID NO: 6523224 - DNA, 18 bp, Homo sapiens
ttagcttcagttgttctt

SEQ ID NO: 6523225 - DNA, 16 bp, Homo sapiens
ttagcttcatatctaa

SEQ ID NO: 6523226 - DNA, 18 bp, Homo sapiens
ttagcttcatatctaatt

SEQ ID NO: 6523227 - DNA, 14 bp, Homo sapiens
ttagctttaattaa

SEQ ID NO: 6523228 - DNA, 19 bp, Homo sapiens
ttagctttaattaagctct

SEQ ID NO: 6523229 - DNA, 22 bp, Homo sapiens
ttagctttattatggcttgtga

SEQ ID NO: 6523230 - DNA, 20 bp, Homo sapiens
ttagctttccaaggaagcag

SEQ ID NO: 6523231 - DNA, 18 bp, Homo sapiens
ttagctttccctgtgcca

SEQ ID NO: 6523232 - DNA, 13 bp, Homo sapiens
ttagctttctcag

SEQ ID NO: 6523233 - DNA, 22 bp, Homo sapiens
ttagctttgggtgcctttgcca

SEQ ID NO: 6523234 - DNA, 13 bp, Homo sapiens
ttagctttgtgtt

SEQ ID NO: 6523235 - DNA, 15 bp, Homo sapiens
ttagctttgtgttta

SEQ ID NO: 6523236 - DNA, 20 bp, Homo sapiens
ttagctttgtgtttggttta

SEQ ID NO: 6523237 - DNA, 17 bp, Homo sapiens
ttagcttttgatgtctc

SEQ ID NO: 6523238 - DNA, 16 bp, Homo sapiens
ttagctttttctcaga

SEQ ID NO: 6523239 - DNA, 21 bp, Homo sapiens
ttaggaaaagatatttttata

SEQ ID NO: 6523240 - DNA, 19 bp, Homo sapiens
ttaggaaaagcatctgcca

SEQ ID NO: 6523241 - DNA, 18 bp, Homo sapiens
ttaggaaaatcactttgt

SEQ ID NO: 6523242 - DNA, 16 bp, Homo sapiens
ttaggaaagagaagct

SEQ ID NO: 6523243 - DNA, 12 bp, Homo sapiens
ttaggaaataaa

SEQ ID NO: 6523244 - DNA, 18 bp, Homo sapiens
ttaggaaatttatacaaa

SEQ ID NO: 6523245 - DNA, 21 bp, Homo sapiens
ttaggaaatttatacaaagaa

SEQ ID NO: 6523246 - DNA, 14 bp, Homo sapiens
ttaggaacagagta

SEQ ID NO: 6523247 - DNA, 15 bp, Homo sapiens
ttaggaacagcagtg

SEQ ID NO: 6523248 - DNA, 23 bp, Homo sapiens
ttaggaacagctcttcactcagc

SEQ ID NO: 6523249 - DNA, 20 bp, Homo sapiens
ttaggaactcactctttaga

SEQ ID NO: 6523250 - DNA, 12 bp, Homo sapiens
ttaggaagaaat

SEQ ID NO: 6523251 - DNA, 15 bp, Homo sapiens
ttaggaagagaaacc

SEQ ID NO: 6523252 - DNA, 18 bp, Homo sapiens
ttaggaaggcagcattcc

SEQ ID NO: 6523253 - DNA, 19 bp, Homo sapiens
ttaggaatgctcaatgtgc

SEQ ID NO: 6523254 - DNA, 23 bp, Homo sapiens
ttaggaattaagttatctttaaa

SEQ ID NO: 6523255 - DNA, 16 bp, Homo sapiens
ttaggaattgaattaa

SEQ ID NO: 6523256 - DNA, 16 bp, Homo sapiens
ttaggacacagtgtgt

SEQ ID NO: 6523257 - DNA, 11 bp, Homo sapiens
ttaggacagca

SEQ ID NO: 6523258 - DNA, 13 bp, Homo sapiens
ttaggacatctta

SEQ ID NO: 6523259 - DNA, 20 bp, Homo sapiens
ttaggactaaggaactaaaa

SEQ ID NO: 6523260 - DNA, 22 bp, Homo sapiens
ttaggactaaggaactaaaact

SEQ ID NO: 6523261 - DNA, 17 bp, Homo sapiens
ttaggactcttcttcca

SEQ ID NO: 6523262 - DNA, 20 bp, Homo sapiens
ttaggactcttcttccatat

SEQ ID NO: 6523263 - DNA, 13 bp, Homo sapiens
ttaggagaagcca

SEQ ID NO: 6523264 - DNA, 13 bp, Homo sapiens
ttaggagaagttg

SEQ ID NO: 6523265 - DNA, 21 bp, Homo sapiens
ttaggagagaaggtaggggtt

SEQ ID NO: 6523266 - DNA, 16 bp, Homo sapiens
ttaggagcaagaagaa

SEQ ID NO: 6523267 - DNA, 15 bp, Homo sapiens
ttaggagctaaggct

SEQ ID NO: 6523268 - DNA, 16 bp, Homo sapiens
ttaggagctaaggctc

SEQ ID NO: 6523269 - DNA, 24 bp, Homo sapiens
ttaggagctcagttgagaaacagt

SEQ ID NO: 6523270 - DNA, 19 bp, Homo sapiens
ttaggaggctgcatgctct

SEQ ID NO: 6523271 - DNA, 21 bp, Homo sapiens
ttaggaggctgcatgctctgg

SEQ ID NO: 6523272 - DNA, 21 bp, Homo sapiens
ttaggagttcgagaccagcct

SEQ ID NO: 6523273 - DNA, 22 bp, Homo sapiens
ttaggataaagaatatttacaa

SEQ ID NO: 6523274 - DNA, 16 bp, Homo sapiens
ttaggataatacataa

SEQ ID NO: 6523275 - DNA, 21 bp, Homo sapiens
ttaggatacttaacaaataca

SEQ ID NO: 6523276 - DNA, 21 bp, Homo sapiens
ttaggatattgatttaaaatt

SEQ ID NO: 6523277 - DNA, 15 bp, Homo sapiens
ttaggatgagcaaaa

SEQ ID NO: 6523278 - DNA, 21 bp, Homo sapiens
ttaggatgcggctttctctgc

SEQ ID NO: 6523279 - DNA, 13 bp, Homo sapiens
ttaggattcaggc

SEQ ID NO: 6523280 - DNA, 16 bp, Homo sapiens
ttaggattcaggcagc

SEQ ID NO: 6523281 - DNA, 23 bp, Homo sapiens
ttaggattccatgtgaaaataaa

SEQ ID NO: 6523282 - DNA, 17 bp, Homo sapiens
ttaggattgcagatttc

SEQ ID NO: 6523283 - DNA, 14 bp, Homo sapiens
ttaggattgtgggt

SEQ ID NO: 6523284 - DNA, 14 bp, Homo sapiens
ttaggatttaacag

SEQ ID NO: 6523285 - DNA, 22 bp, Homo sapiens
ttaggattttgtgtcttttaaa

SEQ ID NO: 6523286 - DNA, 13 bp, Homo sapiens
ttaggcacacaga

SEQ ID NO: 6523287 - DNA, 15 bp, Homo sapiens
ttaggcacatcaatt

SEQ ID NO: 6523288 - DNA, 23 bp, Homo sapiens
ttaggcagcagcttttaatacag

SEQ ID NO: 6523289 - DNA, 22 bp, Homo sapiens
ttaggcaggaagtcaggagcca

SEQ ID NO: 6523290 - DNA, 18 bp, Homo sapiens
ttaggcagggatttgagg

SEQ ID NO: 6523291 - DNA, 19 bp, Homo sapiens
ttaggcagggatttgagga

SEQ ID NO: 6523292 - DNA, 18 bp, Homo sapiens
ttaggcatggttttgggc

SEQ ID NO: 6523293 - DNA, 17 bp, Homo sapiens
ttaggcatgtcccaccc

SEQ ID NO: 6523294 - DNA, 20 bp, Homo sapiens
ttaggccacattgacagtgg

SEQ ID NO: 6523295 - DNA, 13 bp, Homo sapiens
ttaggccagaggt

SEQ ID NO: 6523296 - DNA, 14 bp, Homo sapiens
ttaggcctacctga

SEQ ID NO: 6523297 - DNA, 14 bp, Homo sapiens
ttaggcctctgaga

SEQ ID NO: 6523298 - DNA, 12 bp, Homo sapiens
ttaggcctggca

SEQ ID NO: 6523299 - DNA, 14 bp, Homo sapiens
ttaggcctggcaca

SEQ ID NO: 6523300 - DNA, 17 bp, Homo sapiens
ttaggcctggcacagtg

SEQ ID NO: 6523301 - DNA, 18 bp, Homo sapiens
ttaggcctggcacagtgt

SEQ ID NO: 6523302 - DNA, 18 bp, Homo sapiens
ttaggcctggctcattct

SEQ ID NO: 6523303 - DNA, 23 bp, Homo sapiens
ttaggccttaacacactggccat

SEQ ID NO: 6523304 - DNA, 16 bp, Homo sapiens
ttaggccttcctctct

SEQ ID NO: 6523305 - DNA, 14 bp, Homo sapiens
ttaggctctgagac

SEQ ID NO: 6523306 - DNA, 14 bp, Homo sapiens
ttaggctgctggga

SEQ ID NO: 6523307 - DNA, 16 bp, Homo sapiens
ttaggctggtggccca

SEQ ID NO: 6523308 - DNA, 23 bp, Homo sapiens
tggcccaagccctccacattttc

SEQ ID NO: 6523309 - DNA, 19 bp, Homo sapiens
tggcccaagcctggtctcc

SEQ ID NO: 6523310 - DNA, 16 bp, Homo sapiens
tggcccaaggctggca

SEQ ID NO: 6523311 - DNA, 17 bp, Homo sapiens
tggcccaagggatggca

SEQ ID NO: 6523312 - DNA, 13 bp, Homo sapiens
tggcccaatgcct

SEQ ID NO: 6523313 - DNA, 19 bp, Homo sapiens
tggcccaatgcctataaaa

SEQ ID NO: 6523314 - DNA, 12 bp, Homo sapiens
tggcccacagct

SEQ ID NO: 6523315 - DNA, 15 bp, Homo sapiens
tggcccacagctctg

SEQ ID NO: 6523316 - DNA, 21 bp, Homo sapiens
tggcccacccagtccatgctc

SEQ ID NO: 6523317 - DNA, 22 bp, Homo sapiens
tggcccaccccacccacttctg

SEQ ID NO: 6523318 - DNA, 23 bp, Homo sapiens
tggcccaccccacccacttctgc

SEQ ID NO: 6523319 - DNA, 20 bp, Homo sapiens
tggcccaccccccagcctcc

SEQ ID NO: 6523320 - DNA, 18 bp, Homo sapiens
tggcccacccctcttccc

SEQ ID NO: 6523321 - DNA, 14 bp, Homo sapiens
tggcccaccgtggc

SEQ ID NO: 6523322 - DNA, 20 bp, Homo sapiens
tggcccaccgtggcactaga

SEQ ID NO: 6523323 - DNA, 14 bp, Homo sapiens
tggcccacctgagg

SEQ ID NO: 6523324 - DNA, 20 bp, Homo sapiens
tggcccacctgaggccccag

SEQ ID NO: 6523325 - DNA, 13 bp, Homo sapiens
tggcccacgcact

SEQ ID NO: 6523326 - DNA, 19 bp, Homo sapiens
tggcccacgcacttcggga

SEQ ID NO: 6523327 - DNA, 12 bp, Homo sapiens
tggcccacgccc

SEQ ID NO: 6523328 - DNA, 19 bp, Homo sapiens
tggcccacgccctccctct

SEQ ID NO: 6523329 - DNA, 21 bp, Homo sapiens
tggcccacgggccggccagct

SEQ ID NO: 6523330 - DNA, 23 bp, Homo sapiens
tggcccacgtagggggctctggg

SEQ ID NO: 6523331 - DNA, 13 bp, Homo sapiens
tggcccactgcat

SEQ ID NO: 6523332 - DNA, 12 bp, Homo sapiens
tggcccactgct

SEQ ID NO: 6523333 - DNA, 16 bp, Homo sapiens
tggcccactgctggct

SEQ ID NO: 6523334 - DNA, 12 bp, Homo sapiens
tggcccagaagc

SEQ ID NO: 6523335 - DNA, 12 bp, Homo sapiens
tggcccagagag

SEQ ID NO: 6523336 - DNA, 13 bp, Homo sapiens
tggcccagagagg

SEQ ID NO: 6523337 - DNA, 19 bp, Homo sapiens
tggcccagagccatactgc

SEQ ID NO: 6523338 - DNA, 18 bp, Homo sapiens
tggcccagagctggaaca

SEQ ID NO: 6523339 - DNA, 23 bp, Homo sapiens
tggcccagcactgcccatcccac

SEQ ID NO: 6523340 - DNA, 12 bp, Homo sapiens
tggcccagcagc

SEQ ID NO: 6523341 - DNA, 14 bp, Homo sapiens
tggcccagcagctt

SEQ ID NO: 6523342 - DNA, 22 bp, Homo sapiens
tggcccagcagcttggctgagc

SEQ ID NO: 6523343 - DNA, 14 bp, Homo sapiens
tggcccagcatgga

SEQ ID NO: 6523344 - DNA, 10 bp, Homo sapiens
tggcccagcc

SEQ ID NO: 6523345 - DNA, 13 bp, Homo sapiens
tggcccagccact

SEQ ID NO: 6523346 - DNA, 13 bp, Homo sapiens
tggcccagccagc

SEQ ID NO: 6523347 - DNA, 16 bp, Homo sapiens
tggcccagccagcagg

SEQ ID NO: 6523348 - DNA, 22 bp, Homo sapiens
tggcccagccatggctggatgt

SEQ ID NO: 6523349 - DNA, 12 bp, Homo sapiens
tggcccagccct

SEQ ID NO: 6523350 - DNA, 15 bp, Homo sapiens
tggcccagccctgct

SEQ ID NO: 6523351 - DNA, 17 bp, Homo sapiens
tggcccagccctgctgg

SEQ ID NO: 6523352 - DNA, 11 bp, Homo sapiens
tggcccagccg

SEQ ID NO: 6523353 - DNA, 19 bp, Homo sapiens
tggcccagcctgtggcctc

SEQ ID NO: 6523354 - DNA, 20 bp, Homo sapiens
tggcccagcctgtggcctca

SEQ ID NO: 6523355 - DNA, 21 bp, Homo sapiens
tggcccagcctgtggcctcag

SEQ ID NO: 6523356 - DNA, 12 bp, Homo sapiens
tggcccagcctt

SEQ ID NO: 6523357 - DNA, 13 bp, Homo sapiens
tggcccagccttt

SEQ ID NO: 6523358 - DNA, 16 bp, Homo sapiens
tggcccagcggcccct

SEQ ID NO: 6523359 - DNA, 20 bp, Homo sapiens
tggcccagcggcccctccca

SEQ ID NO: 6523360 - DNA, 21 bp, Homo sapiens
tggcccagcggcccctcccac

SEQ ID NO: 6523361 - DNA, 15 bp, Homo sapiens
tggcccagctcccca

SEQ ID NO: 6523362 - DNA, 22 bp, Homo sapiens
tggcccagctcccccgggaggg

SEQ ID NO: 6523363 - DNA, 14 bp, Homo sapiens
tggcccaggaaaaa

SEQ ID NO: 6523364 - DNA, 22 bp, Homo sapiens
tggcccaggagctctgcgccag

SEQ ID NO: 6523365 - DNA, 20 bp, Homo sapiens
tggcccaggagtttggccag

SEQ ID NO: 6523366 - DNA, 21 bp, Homo sapiens
tggcccaggagtttggccaga

SEQ ID NO: 6523367 - DNA, 14 bp, Homo sapiens
tggcccaggcagcc

SEQ ID NO: 6523368 - DNA, 16 bp, Homo sapiens
tggcccaggcagcctc

SEQ ID NO: 6523369 - DNA, 14 bp, Homo sapiens
tggcccaggccccc

SEQ ID NO: 6523370 - DNA, 15 bp, Homo sapiens
tggcccaggctggcc

SEQ ID NO: 6523371 - DNA, 16 bp, Homo sapiens
tggcccaggctggccc

SEQ ID NO: 6523372 - DNA, 20 bp, Homo sapiens
tggcccaggctggcccccac

SEQ ID NO: 6523373 - DNA, 13 bp, Homo sapiens
tggcccagggcat

SEQ ID NO: 6523374 - DNA, 20 bp, Homo sapiens
tggcccagggcccagagccc

SEQ ID NO: 6523375 - DNA, 21 bp, Homo sapiens
tggcccagggcccagagccca

SEQ ID NO: 6523376 - DNA, 23 bp, Homo sapiens
tggcccagggcccagagcccagc

SEQ ID NO: 6523377 - DNA, 13 bp, Homo sapiens
tggcccagggggc

SEQ ID NO: 6523378 - DNA, 18 bp, Homo sapiens
tggcccagggggcctgga

SEQ ID NO: 6523379 - DNA, 19 bp, Homo sapiens
tggcccagggggcctggag

SEQ ID NO: 6523380 - DNA, 22 bp, Homo sapiens
tggcccagggggcctggagcat

SEQ ID NO: 6523381 - DNA, 23 bp, Homo sapiens
tggcccagggtgaggtggcatgg

SEQ ID NO: 6523382 - DNA, 14 bp, Homo sapiens
tggcccaggtgccc

SEQ ID NO: 6523383 - DNA, 15 bp, Homo sapiens
tggcccaggtggcta

SEQ ID NO: 6523384 - DNA, 20 bp, Homo sapiens
tggcccaggtggctattttg

SEQ ID NO: 6523385 - DNA, 15 bp, Homo sapiens
tggcccagtcctctc

SEQ ID NO: 6523386 - DNA, 22 bp, Homo sapiens
tggcccagtcgtccgctcagcc

SEQ ID NO: 6523387 - DNA, 15 bp, Homo sapiens
tggcccagtgcaatc

SEQ ID NO: 6523388 - DNA, 20 bp, Homo sapiens
tggcccagtgcaatctgtcc

SEQ ID NO: 6523389 - DNA, 16 bp, Homo sapiens
tggcccagttgtccat

SEQ ID NO: 6523390 - DNA, 17 bp, Homo sapiens
tggcccagttgtccatg

SEQ ID NO: 6523391 - DNA, 12 bp, Homo sapiens
tggcccatcagg

SEQ ID NO: 6523392 - DNA, 19 bp, Homo sapiens
tggcccatcaggggcagga

SEQ ID NO: 6523393 - DNA, 21 bp, Homo sapiens
tggcccatcaggggcaggaac

SEQ ID NO: 6523394 - DNA, 16 bp, Homo sapiens
tggcccatcccccctc

SEQ ID NO: 6523395 - DNA, 17 bp, Homo sapiens
tggcccatcccccctca

SEQ ID NO: 6523396 - DNA, 21 bp, Homo sapiens
tggcccatcccccctcaccag

SEQ ID NO: 6523397 - DNA, 19 bp, Homo sapiens
tggcccatctcagcctcct

SEQ ID NO: 6523398 - DNA, 15 bp, Homo sapiens
tggccccaccctggg

SEQ ID NO: 6523399 - DNA, 12 bp, Homo sapiens
tggccccacctg

SEQ ID NO: 6523400 - DNA, 16 bp, Homo sapiens
tggccccacctgagcc

SEQ ID NO: 6523401 - DNA, 19 bp, Homo sapiens
tggccccacctggccctct

SEQ ID NO: 6523402 - DNA, 19 bp, Homo sapiens
tggccccactttgaagggc

SEQ ID NO: 6523403 - DNA, 15 bp, Homo sapiens
tggccccagagatga

SEQ ID NO: 6523404 - DNA, 19 bp, Homo sapiens
tggccccagcacagcttga

SEQ ID NO: 6523405 - DNA, 22 bp, Homo sapiens
tggccccagcccgacaggcatg

SEQ ID NO: 6523406 - DNA, 23 bp, Homo sapiens
tggccccagccctactctgtgta

SEQ ID NO: 6523407 - DNA, 16 bp, Homo sapiens
tggccccagccctgct

SEQ ID NO: 6523408 - DNA, 20 bp, Homo sapiens
tggccccagccctgctgggg

SEQ ID NO: 6523409 - DNA, 12 bp, Homo sapiens
tggccccagcct

SEQ ID NO: 6523410 - DNA, 18 bp, Homo sapiens
tggccccagcctaggtgg

SEQ ID NO: 6523411 - DNA, 16 bp, Homo sapiens
tggccccagcctggcc

SEQ ID NO: 6523412 - DNA, 17 bp, Homo sapiens
tggccccagcctggccc

SEQ ID NO: 6523413 - DNA, 20 bp, Homo sapiens
tggccccagcctggcccagc

SEQ ID NO: 6523414 - DNA, 22 bp, Homo sapiens
tggccccagctcctcttcctgc

SEQ ID NO: 6523415 - DNA, 14 bp, Homo sapiens
tggccccagctggc

SEQ ID NO: 6523416 - DNA, 12 bp, Homo sapiens
tggccccaggac

SEQ ID NO: 6523417 - DNA, 12 bp, Homo sapiens
tggccccaggcc

SEQ ID NO: 6523418 - DNA, 19 bp, Homo sapiens
tggccccaggccccagaca

SEQ ID NO: 6523419 - DNA, 12 bp, Homo sapiens
tggccccagggt

SEQ ID NO: 6523420 - DNA, 15 bp, Homo sapiens
tggccccaggtgcca

SEQ ID NO: 6523421 - DNA, 22 bp, Homo sapiens
tggccccaggtgccaccaataa

SEQ ID NO: 6523422 - DNA, 23 bp, Homo sapiens
tggccccaggtgccaccaataaa

SEQ ID NO: 6523423 - DNA, 18 bp, Homo sapiens
tggccccatattaacaaa

SEQ ID NO: 6523424 - DNA, 20 bp, Homo sapiens
tggccccatccagcatgtgt

SEQ ID NO: 6523425 - DNA, 21 bp, Homo sapiens
tggccccatccagcatgtgtg

SEQ ID NO: 6523426 - DNA, 18 bp, Homo sapiens
tggccccatcccagttgg

SEQ ID NO: 6523427 - DNA, 19 bp, Homo sapiens
tggccccatgtctctcaga

SEQ ID NO: 6523428 - DNA, 21 bp, Homo sapiens
tggccccatgtctctcagaat

SEQ ID NO: 6523429 - DNA, 15 bp, Homo sapiens
tggcccccaataaag

SEQ ID NO: 6523430 - DNA, 17 bp, Homo sapiens
tggcccccaataaaggc

SEQ ID NO: 6523431 - DNA, 20 bp, Homo sapiens
tggcccccaataaaggcagc

SEQ ID NO: 6523432 - DNA, 23 bp, Homo sapiens
tggcccccaataaaggcagctgc

SEQ ID NO: 6523433 - DNA, 13 bp, Homo sapiens
tggcccccacagc

SEQ ID NO: 6523434 - DNA, 14 bp, Homo sapiens
tggcccccacagcg

SEQ ID NO: 6523435 - DNA, 19 bp, Homo sapiens
tggcccccacccaccttcc

SEQ ID NO: 6523436 - DNA, 13 bp, Homo sapiens
tggcccccaccct

SEQ ID NO: 6523437 - DNA, 15 bp, Homo sapiens
tggcccccactggct

SEQ ID NO: 6523438 - DNA, 19 bp, Homo sapiens
tggcccccagccctggggg

SEQ ID NO: 6523439 - DNA, 16 bp, Homo sapiens
tggcccccaggggcag

SEQ ID NO: 6523440 - DNA, 15 bp, Homo sapiens
tggcccccatcagcc

SEQ ID NO: 6523441 - DNA, 19 bp, Homo sapiens
tggccccccaaagtgctgg

SEQ ID NO: 6523442 - DNA, 20 bp, Homo sapiens
tggccccccaaagtgctggg

SEQ ID NO: 6523443 - DNA, 14 bp, Homo sapiens
tggcccccccagcc

SEQ ID NO: 6523444 - DNA, 17 bp, Homo sapiens
tggcccccccagcccca

SEQ ID NO: 6523445 - DNA, 21 bp, Homo sapiens
tggcccccctggtcccctcct

SEQ ID NO: 6523446 - DNA, 17 bp, Homo sapiens
tggcccccgacccagct

SEQ ID NO: 6523447 - DNA, 16 bp, Homo sapiens
tggcccccgagctggg

SEQ ID NO: 6523448 - DNA, 17 bp, Homo sapiens
tggcccccgagctgggg

SEQ ID NO: 6523449 - DNA, 16 bp, Homo sapiens
tggccccctcagctct

SEQ ID NO: 6523450 - DNA, 11 bp, Homo sapiens
tggccccctcg

SEQ ID NO: 6523451 - DNA, 19 bp, Homo sapiens
tggccccctcgcgcccctg

SEQ ID NO: 6523452 - DNA, 20 bp, Homo sapiens
tggccccctcgcgcccctgt

SEQ ID NO: 6523453 - DNA, 19 bp, Homo sapiens
tggccccctgtgccagctc

SEQ ID NO: 6523454 - DNA, 21 bp, Homo sapiens
tggccccctgtgccagctcag

SEQ ID NO: 6523455 - DNA, 18 bp, Homo sapiens
tggcccccttcaggagcc

SEQ ID NO: 6523456 - DNA, 16 bp, Homo sapiens
tggccccctttcccgg

SEQ ID NO: 6523457 - DNA, 23 bp, Homo sapiens
tggccccctttcccgggctgtcc

SEQ ID NO: 6523458 - DNA, 18 bp, Homo sapiens
tggccccgaggctgggac

SEQ ID NO: 6523459 - DNA, 16 bp, Homo sapiens
tggccccgccctcagg

SEQ ID NO: 6523460 - DNA, 17 bp, Homo sapiens
tggccccgccctcaggc

SEQ ID NO: 6523461 - DNA, 18 bp, Homo sapiens
tggccccgctagcggggc

SEQ ID NO: 6523462 - DNA, 23 bp, Homo sapiens
tggcccctactttgtggcaatct

SEQ ID NO: 6523463 - DNA, 21 bp, Homo sapiens
tggcccctattgagaagtttt

SEQ ID NO: 6523464 - DNA, 21 bp, Homo sapiens
tggcccctcacatcctctcca

SEQ ID NO: 6523465 - DNA, 23 bp, Homo sapiens
tggcccctcacatcctctccagg

SEQ ID NO: 6523466 - DNA, 13 bp, Homo sapiens
tggcccctcacct

SEQ ID NO: 6523467 - DNA, 13 bp, Homo sapiens
tggcccctcaggg

SEQ ID NO: 6523468 - DNA, 22 bp, Homo sapiens
tggcccctcagggtccctggtg

SEQ ID NO: 6523469 - DNA, 20 bp, Homo sapiens
tggcccctccaatcctcccc

SEQ ID NO: 6523470 - DNA, 13 bp, Homo sapiens
tggcccctccagc

SEQ ID NO: 6523471 - DNA, 14 bp, Homo sapiens
tggcccctccagga

SEQ ID NO: 6523472 - DNA, 13 bp, Homo sapiens
tggcccctcccca

SEQ ID NO: 6523473 - DNA, 21 bp, Homo sapiens
tggcccctccttctcccctcc

SEQ ID NO: 6523474 - DNA, 23 bp, Homo sapiens
tggcccctccttctcccctccag

SEQ ID NO: 6523475 - DNA, 15 bp, Homo sapiens
tggcccctccttgca

SEQ ID NO: 6523476 - DNA, 21 bp, Homo sapiens
tggcccctcgaccctgtgcag

SEQ ID NO: 6523477 - DNA, 17 bp, Homo sapiens
tggcccctcgcctgtgg

SEQ ID NO: 6523478 - DNA, 10 bp, Homo sapiens
tggcccctct

SEQ ID NO: 6523479 - DNA, 15 bp, Homo sapiens
tggcccctctccctt

SEQ ID NO: 6523480 - DNA, 14 bp, Homo sapiens
tggcccctctctgt

SEQ ID NO: 6523481 - DNA, 14 bp, Homo sapiens
tggcccctctgacc

SEQ ID NO: 6523482 - DNA, 16 bp, Homo sapiens
tggcccctctgacctg

SEQ ID NO: 6523483 - DNA, 15 bp, Homo sapiens
tggcccctctgctgt

SEQ ID NO: 6523484 - DNA, 20 bp, Homo sapiens
tggcccctgaacaagaattg

SEQ ID NO: 6523485 - DNA, 14 bp, Homo sapiens
tggcccctgcccgg

SEQ ID NO: 6523486 - DNA, 15 bp, Homo sapiens
tggcccctgcccggc

SEQ ID NO: 6523487 - DNA, 17 bp, Homo sapiens
ttaggctggtggcccag

SEQ ID NO: 6523488 - DNA, 18 bp, Homo sapiens
ttaggctggtggcccagg

SEQ ID NO: 6523489 - DNA, 20 bp, Homo sapiens
ttaggctgtaactactttat

SEQ ID NO: 6523490 - DNA, 21 bp, Homo sapiens
ttaggcttacaatgtgcactg

SEQ ID NO: 6523491 - DNA, 18 bp, Homo sapiens
ttaggcttaccttggtca

SEQ ID NO: 6523492 - DNA, 19 bp, Homo sapiens
ttaggctttgtatgacagt

SEQ ID NO: 6523493 - DNA, 18 bp, Homo sapiens
ttaggcttttaagaaaca

SEQ ID NO: 6523494 - DNA, 15 bp, Homo sapiens
ttagggaaaacattc

SEQ ID NO: 6523495 - DNA, 22 bp, Homo sapiens
ttagggaacaaggatgttttta

SEQ ID NO: 6523496 - DNA, 14 bp, Homo sapiens
ttagggaagagaaa

SEQ ID NO: 6523497 - DNA, 16 bp, Homo sapiens
ttagggaagagaaaca

SEQ ID NO: 6523498 - DNA, 14 bp, Homo sapiens
ttagggaagggcct

SEQ ID NO: 6523499 - DNA, 21 bp, Homo sapiens
ttagggacaggaccccagctc

SEQ ID NO: 6523500 - DNA, 23 bp, Homo sapiens
ttagggactcaatttctccccag

SEQ ID NO: 6523501 - DNA, 21 bp, Homo sapiens
ttagggagaagggcttttctt

SEQ ID NO: 6523502 - DNA, 21 bp, Homo sapiens
ttagggagagagaagcaggca

SEQ ID NO: 6523503 - DNA, 18 bp, Homo sapiens
ttagggagagtcatattt

SEQ ID NO: 6523504 - DNA, 21 bp, Homo sapiens
ttagggagagtcatattttga

SEQ ID NO: 6523505 - DNA, 15 bp, Homo sapiens
ttagggagctcttga

SEQ ID NO: 6523506 - DNA, 17 bp, Homo sapiens
ttagggcaccaggggtt

SEQ ID NO: 6523507 - DNA, 12 bp, Homo sapiens
ttagggcagctt

SEQ ID NO: 6523508 - DNA, 14 bp, Homo sapiens
ttagggcagcttgc

SEQ ID NO: 6523509 - DNA, 22 bp, Homo sapiens
ttagggcatcctgcccctcgcc

SEQ ID NO: 6523510 - DNA, 15 bp, Homo sapiens
ttagggccctggagg

SEQ ID NO: 6523511 - DNA, 17 bp, Homo sapiens
ttagggctgcttttctt

SEQ ID NO: 6523512 - DNA, 11 bp, Homo sapiens
ttagggctgtt

SEQ ID NO: 6523513 - DNA, 21 bp, Homo sapiens
ttaggggaagtaaaacagtca

SEQ ID NO: 6523514 - DNA, 21 bp, Homo sapiens
ttaggggatggggaggaagag

SEQ ID NO: 6523515 - DNA, 16 bp, Homo sapiens
ttaggggattcttctt

SEQ ID NO: 6523516 - DNA, 18 bp, Homo sapiens
ttaggggcaaacatcaca

SEQ ID NO: 6523517 - DNA, 15 bp, Homo sapiens
ttaggggggaaagtc

SEQ ID NO: 6523518 - DNA, 14 bp, Homo sapiens
ttaggggtcctctt

SEQ ID NO: 6523519 - DNA, 14 bp, Homo sapiens
ttaggggtgaagga

SEQ ID NO: 6523520 - DNA, 21 bp, Homo sapiens
ttaggggtggagtccgccaaa

SEQ ID NO: 6523521 - DNA, 12 bp, Homo sapiens
ttaggggtgtgt

SEQ ID NO: 6523522 - DNA, 15 bp, Homo sapiens
ttaggggttcattct

SEQ ID NO: 6523523 - DNA, 19 bp, Homo sapiens
ttaggggttcattctcccg

SEQ ID NO: 6523524 - DNA, 17 bp, Homo sapiens
ttagggtacagcccagg

SEQ ID NO: 6523525 - DNA, 15 bp, Homo sapiens
ttagggtactaaatt

SEQ ID NO: 6523526 - DNA, 13 bp, Homo sapiens
ttagggtctgtcc

SEQ ID NO: 6523527 - DNA, 21 bp, Homo sapiens
ttagggtgaaacttaaaaaaa

SEQ ID NO: 6523528 - DNA, 15 bp, Homo sapiens
ttagggtgggtaaga

SEQ ID NO: 6523529 - DNA, 14 bp, Homo sapiens
ttagggttatgatt

SEQ ID NO: 6523530 - DNA, 16 bp, Homo sapiens
ttagggttctgcctct

SEQ ID NO: 6523531 - DNA, 15 bp, Homo sapiens
ttagggtttctgatt

SEQ ID NO: 6523532 - DNA, 18 bp, Homo sapiens
ttagggtttgcagagtgg

SEQ ID NO: 6523533 - DNA, 16 bp, Homo sapiens
ttaggtaaataaagct

SEQ ID NO: 6523534 - DNA, 21 bp, Homo sapiens
ttaggtaaccttatatttaca

SEQ ID NO: 6523535 - DNA, 17 bp, Homo sapiens
ttaggtaatttttttca

SEQ ID NO: 6523536 - DNA, 18 bp, Homo sapiens
ttaggtacagtaaaacaa

SEQ ID NO: 6523537 - DNA, 14 bp, Homo sapiens
ttaggtagaaaaac

SEQ ID NO: 6523538 - DNA, 15 bp, Homo sapiens
ttaggtagaaaaaca

SEQ ID NO: 6523539 - DNA, 17 bp, Homo sapiens
ttaggtagaaactattg

SEQ ID NO: 6523540 - DNA, 15 bp, Homo sapiens
ttaggtagcacagca

SEQ ID NO: 6523541 - DNA, 19 bp, Homo sapiens
ttaggtagtagaatctcag

SEQ ID NO: 6523542 - DNA, 19 bp, Homo sapiens
ttaggtatataataacttt

SEQ ID NO: 6523543 - DNA, 13 bp, Homo sapiens
ttaggtcaagaag

SEQ ID NO: 6523544 - DNA, 13 bp, Homo sapiens
ttaggtcatccaa

SEQ ID NO: 6523545 - DNA, 16 bp, Homo sapiens
ttaggtcccagaatgg

SEQ ID NO: 6523546 - DNA, 19 bp, Homo sapiens
ttaggtccctcactccaca

SEQ ID NO: 6523547 - DNA, 16 bp, Homo sapiens
ttaggtctctgttgac

SEQ ID NO: 6523548 - DNA, 14 bp, Homo sapiens
ttaggtctcttccc

SEQ ID NO: 6523549 - DNA, 16 bp, Homo sapiens
ttaggtctgcattttc

SEQ ID NO: 6523550 - DNA, 13 bp, Homo sapiens
ttaggtcttcctg

SEQ ID NO: 6523551 - DNA, 15 bp, Homo sapiens
ttaggtgaggaagca

SEQ ID NO: 6523552 - DNA, 13 bp, Homo sapiens
ttaggtgccaggc

SEQ ID NO: 6523553 - DNA, 20 bp, Homo sapiens
ttaggtgcgcagtggcatgt

SEQ ID NO: 6523554 - DNA, 18 bp, Homo sapiens
ttaggtggccgctcctcc

SEQ ID NO: 6523555 - DNA, 19 bp, Homo sapiens
ttaggtggccgctcctccc

SEQ ID NO: 6523556 - DNA, 20 bp, Homo sapiens
ttaggtggccgctcctccct

SEQ ID NO: 6523557 - DNA, 21 bp, Homo sapiens
ttaggtggctgggagttttga

SEQ ID NO: 6523558 - DNA, 19 bp, Homo sapiens
ttaggtgttgattttctgt

SEQ ID NO: 6523559 - DNA, 20 bp, Homo sapiens
ttaggttaaaaaaaggcatt

SEQ ID NO: 6523560 - DNA, 18 bp, Homo sapiens
ttaggttaactatgtaca

SEQ ID NO: 6523561 - DNA, 12 bp, Homo sapiens
ttaggttataag

SEQ ID NO: 6523562 - DNA, 14 bp, Homo sapiens
ttaggttataagaa

SEQ ID NO: 6523563 - DNA, 16 bp, Homo sapiens
ttaggttattttgctt

SEQ ID NO: 6523564 - DNA, 12 bp, Homo sapiens
ttaggttctaaa

SEQ ID NO: 6523565 - DNA, 16 bp, Homo sapiens
ttaggttctaaagttc

SEQ ID NO: 6523566 - DNA, 18 bp, Homo sapiens
ttaggttctaaagttcta

SEQ ID NO: 6523567 - DNA, 20 bp, Homo sapiens
ttaggttctaaagttctaag

SEQ ID NO: 6523568 - DNA, 17 bp, Homo sapiens
ttaggttgtgaatgcag

SEQ ID NO: 6523569 - DNA, 16 bp, Homo sapiens
ttaggtttactgtgaa

SEQ ID NO: 6523570 - DNA, 21 bp, Homo sapiens
ttaggtttccttttattctgt

SEQ ID NO: 6523571 - DNA, 16 bp, Homo sapiens
ttaggtttctttgaag

SEQ ID NO: 6523572 - DNA, 20 bp, Homo sapiens
ttaggtttgctaaatactgt

SEQ ID NO: 6523573 - DNA, 19 bp, Homo sapiens
ttaggtttggtttggtttt

SEQ ID NO: 6523574 - DNA, 14 bp, Homo sapiens
ttaggtttgtcaac

SEQ ID NO: 6523575 - DNA, 12 bp, Homo sapiens
ttaggtttgttt

SEQ ID NO: 6523576 - DNA, 14 bp, Homo sapiens
ttaggttttgtaca

SEQ ID NO: 6523577 - DNA, 17 bp, Homo sapiens
ttagtaaaaaatcaatt

SEQ ID NO: 6523578 - DNA, 21 bp, Homo sapiens
ttagtaaaaagccctatgtga

SEQ ID NO: 6523579 - DNA, 18 bp, Homo sapiens
ttagtaaaaataaatcaa

SEQ ID NO: 6523580 - DNA, 19 bp, Homo sapiens
ttagtaaaattatctgttc

SEQ ID NO: 6523581 - DNA, 23 bp, Homo sapiens
ttagtaaaattatctgttctatg

SEQ ID NO: 6523582 - DNA, 15 bp, Homo sapiens
ttagtaaagaaatga

SEQ ID NO: 6523583 - DNA, 14 bp, Homo sapiens
ttagtaaataaaat

SEQ ID NO: 6523584 - DNA, 19 bp, Homo sapiens
ttagtaaatacatcactgt

SEQ ID NO: 6523585 - DNA, 21 bp, Homo sapiens
ttagtaaatacatcactgtat

SEQ ID NO: 6523586 - DNA, 17 bp, Homo sapiens
ttagtaaatgtctttgt

SEQ ID NO: 6523587 - DNA, 16 bp, Homo sapiens
ttagtaaattattaga

SEQ ID NO: 6523588 - DNA, 11 bp, Homo sapiens
ttagtaaattc

SEQ ID NO: 6523589 - DNA, 16 bp, Homo sapiens
ttagtaactttgaaag

SEQ ID NO: 6523590 - DNA, 19 bp, Homo sapiens
ttagtaactttttatgtaa

SEQ ID NO: 6523591 - DNA, 14 bp, Homo sapiens
ttagtaaggatttt

SEQ ID NO: 6523592 - DNA, 14 bp, Homo sapiens
ttagtaaggctgtg

SEQ ID NO: 6523593 - DNA, 20 bp, Homo sapiens
ttagtaaggctgtgtacact

SEQ ID NO: 6523594 - DNA, 13 bp, Homo sapiens
ttagtaatcatat

SEQ ID NO: 6523595 - DNA, 13 bp, Homo sapiens
ttagtaatctgta

SEQ ID NO: 6523596 - DNA, 15 bp, Homo sapiens
ttagtaatctgtata

SEQ ID NO: 6523597 - DNA, 17 bp, Homo sapiens
ttagtaatctgtataat

SEQ ID NO: 6523598 - DNA, 12 bp, Homo sapiens
ttagtaatgcta

SEQ ID NO: 6523599 - DNA, 21 bp, Homo sapiens
ttagtaatgctacgtgtgatt

SEQ ID NO: 6523600 - DNA, 22 bp, Homo sapiens
ttagtaatgctacgtgtgattt

SEQ ID NO: 6523601 - DNA, 16 bp, Homo sapiens
ttagtaatggcagagc

SEQ ID NO: 6523602 - DNA, 16 bp, Homo sapiens
ttagtaatttcctaga

SEQ ID NO: 6523603 - DNA, 17 bp, Homo sapiens
ttagtaatttctttttt

SEQ ID NO: 6523604 - DNA, 14 bp, Homo sapiens
ttagtacaatagta

SEQ ID NO: 6523605 - DNA, 15 bp, Homo sapiens
ttagtacaatttcaa

SEQ ID NO: 6523606 - DNA, 14 bp, Homo sapiens
ttagtacagtagct

SEQ ID NO: 6523607 - DNA, 18 bp, Homo sapiens
ttagtacagtagcttaaa

SEQ ID NO: 6523608 - DNA, 19 bp, Homo sapiens
ttagtacatggagctcagg

SEQ ID NO: 6523609 - DNA, 13 bp, Homo sapiens
ttagtaccctgca

SEQ ID NO: 6523610 - DNA, 18 bp, Homo sapiens
ttagtaccctgcaggcca

SEQ ID NO: 6523611 - DNA, 21 bp, Homo sapiens
ttagtaccctgcaggccaggc

SEQ ID NO: 6523612 - DNA, 17 bp, Homo sapiens
ttagtaccttcaaataa

SEQ ID NO: 6523613 - DNA, 17 bp, Homo sapiens
ttagtactttatagaag

SEQ ID NO: 6523614 - DNA, 23 bp, Homo sapiens
ttagtactttggatgcaattaaa

SEQ ID NO: 6523615 - DNA, 19 bp, Homo sapiens
ttagtactttgtgctcata

SEQ ID NO: 6523616 - DNA, 13 bp, Homo sapiens
ttagtagaactta

SEQ ID NO: 6523617 - DNA, 19 bp, Homo sapiens
ttagtagaacttactgctg

SEQ ID NO: 6523618 - DNA, 17 bp, Homo sapiens
ttagtagagacagggtt

SEQ ID NO: 6523619 - DNA, 16 bp, Homo sapiens
ttagtagcagaaatat

SEQ ID NO: 6523620 - DNA, 16 bp, Homo sapiens
ttagtaggatatgcct

SEQ ID NO: 6523621 - DNA, 19 bp, Homo sapiens
ttagtaggatatgcctgct

SEQ ID NO: 6523622 - DNA, 17 bp, Homo sapiens
ttagtagtcaaaaacaa

SEQ ID NO: 6523623 - DNA, 23 bp, Homo sapiens
ttagtataaatgtacatcagttt

SEQ ID NO: 6523624 - DNA, 20 bp, Homo sapiens
ttagtataagcttttcacaa

SEQ ID NO: 6523625 - DNA, 20 bp, Homo sapiens
ttagtatagtagaaagacat

SEQ ID NO: 6523626 - DNA, 16 bp, Homo sapiens
ttagtatatgaaatat

SEQ ID NO: 6523627 - DNA, 23 bp, Homo sapiens
ttagtatatgaaatattttgaat

SEQ ID NO: 6523628 - DNA, 20 bp, Homo sapiens
ttagtatatttatataatta

SEQ ID NO: 6523629 - DNA, 17 bp, Homo sapiens
ttagtatctaacatgta

SEQ ID NO: 6523630 - DNA, 18 bp, Homo sapiens
ttagtatctaacatgtat

SEQ ID NO: 6523631 - DNA, 22 bp, Homo sapiens
ttagtatgacgctgatacataa

SEQ ID NO: 6523632 - DNA, 16 bp, Homo sapiens
ttagtatgaggcattt

SEQ ID NO: 6523633 - DNA, 12 bp, Homo sapiens
ttagtatgtctg

SEQ ID NO: 6523634 - DNA, 22 bp, Homo sapiens
ttagtatgtctgtttttgtatc

SEQ ID NO: 6523635 - DNA, 18 bp, Homo sapiens
ttagtatgtgcatttaat

SEQ ID NO: 6523636 - DNA, 15 bp, Homo sapiens
ttagtattaaaatct

SEQ ID NO: 6523637 - DNA, 13 bp, Homo sapiens
ttagtattagttt

SEQ ID NO: 6523638 - DNA, 13 bp, Homo sapiens
ttagtattatctt

SEQ ID NO: 6523639 - DNA, 13 bp, Homo sapiens
ttagtattgattc

SEQ ID NO: 6523640 - DNA, 13 bp, Homo sapiens
ttagtattgcaaa

SEQ ID NO: 6523641 - DNA, 18 bp, Homo sapiens
ttagtattgttgtccttt

SEQ ID NO: 6523642 - DNA, 20 bp, Homo sapiens
ttagtattgttgtccttttc

SEQ ID NO: 6523643 - DNA, 19 bp, Homo sapiens
ttagtatttatttatgtac

SEQ ID NO: 6523644 - DNA, 16 bp, Homo sapiens
ttagtcaaatatttat

SEQ ID NO: 6523645 - DNA, 16 bp, Homo sapiens
ttagtcaatcactgca

SEQ ID NO: 6523646 - DNA, 12 bp, Homo sapiens
ttagtcacaaag

SEQ ID NO: 6523647 - DNA, 20 bp, Homo sapiens
ttagtcacaccatcttaaat

SEQ ID NO: 6523648 - DNA, 20 bp, Homo sapiens
ttagtcacctgccccagcac

SEQ ID NO: 6523649 - DNA, 12 bp, Homo sapiens
ttagtcagaaat

SEQ ID NO: 6523650 - DNA, 13 bp, Homo sapiens
ttagtcagaaatg

SEQ ID NO: 6523651 - DNA, 14 bp, Homo sapiens
ttagtcataaaaca

SEQ ID NO: 6523652 - DNA, 15 bp, Homo sapiens
ttagtcataaaacac

SEQ ID NO: 6523653 - DNA, 15 bp, Homo sapiens
ttagtcatagaagaa

SEQ ID NO: 6523654 - DNA, 16 bp, Homo sapiens
ttagtcatagaagaac

SEQ ID NO: 6523655 - DNA, 15 bp, Homo sapiens
ttagtcatatttttg

SEQ ID NO: 6523656 - DNA, 23 bp, Homo sapiens
ttagtcatccaacaagaagaaat

SEQ ID NO: 6523657 - DNA, 14 bp, Homo sapiens
ttagtcatgtgacc

SEQ ID NO: 6523658 - DNA, 18 bp, Homo sapiens
ttagtcattaatgttctt

SEQ ID NO: 6523659 - DNA, 18 bp, Homo sapiens
ttagtcattgatagaact

SEQ ID NO: 6523660 - DNA, 23 bp, Homo sapiens
ttagtcattgatagaactacttt

SEQ ID NO: 6523661 - DNA, 22 bp, Homo sapiens
ttagtcccacagggaaatgtgt

SEQ ID NO: 6523662 - DNA, 22 bp, Homo sapiens
ttagtcccacctcttacttcct

SEQ ID NO: 6523663 - DNA, 15 bp, Homo sapiens
ttagtccccatcccg

SEQ ID NO: 6523664 - DNA, 22 bp, Homo sapiens
ttagtcccccaactctgagccc

SEQ ID NO: 6523665 - DNA, 23 bp, Homo sapiens
ttagtcctaaagggacaataact

SEQ ID NO: 6523666 - DNA, 13 bp, Homo sapiens
ttagtcctcacct

SEQ ID NO: 6523667 - DNA, 20 bp, Homo sapiens
tggcccctgcccggctgcgg

SEQ ID NO: 6523668 - DNA, 21 bp, Homo sapiens
tggcccctgcccggctgcgga

SEQ ID NO: 6523669 - DNA, 14 bp, Homo sapiens
tggcccctgccttg

SEQ ID NO: 6523670 - DNA, 20 bp, Homo sapiens
tggcccctgctgtctctctg

SEQ ID NO: 6523671 - DNA, 13 bp, Homo sapiens
tggcccctggaac

SEQ ID NO: 6523672 - DNA, 12 bp, Homo sapiens
tggcccctgggt

SEQ ID NO: 6523673 - DNA, 12 bp, Homo sapiens
tggcccctgtgg

SEQ ID NO: 6523674 - DNA, 18 bp, Homo sapiens
tggcccgacagcctggca

SEQ ID NO: 6523675 - DNA, 13 bp, Homo sapiens
tggcccgcccctc

SEQ ID NO: 6523676 - DNA, 21 bp, Homo sapiens
tggcccgcccctcgctgctgc

SEQ ID NO: 6523677 - DNA, 22 bp, Homo sapiens
tggcccgcccctcgctgctgct

SEQ ID NO: 6523678 - DNA, 14 bp, Homo sapiens
tggcccgccctcac

SEQ ID NO: 6523679 - DNA, 18 bp, Homo sapiens
tggcccgcggcctgcacc

SEQ ID NO: 6523680 - DNA, 14 bp, Homo sapiens
tggcccggcagggc

SEQ ID NO: 6523681 - DNA, 13 bp, Homo sapiens
tggcccggccccg

SEQ ID NO: 6523682 - DNA, 19 bp, Homo sapiens
tggcccggcccctcctgac

SEQ ID NO: 6523683 - DNA, 18 bp, Homo sapiens
tggcccgtgacagactcc

SEQ ID NO: 6523684 - DNA, 20 bp, Homo sapiens
tggcccgtgacagactcctg

SEQ ID NO: 6523685 - DNA, 23 bp, Homo sapiens
tggcccgtggcttggcatctgtg

SEQ ID NO: 6523686 - DNA, 21 bp, Homo sapiens
tggccctcaaagcgagccgtt

SEQ ID NO: 6523687 - DNA, 18 bp, Homo sapiens
tggccctcaaggcctccc

SEQ ID NO: 6523688 - DNA, 21 bp, Homo sapiens
tggccctcaaggcctcccaca

SEQ ID NO: 6523689 - DNA, 12 bp, Homo sapiens
tggccctcactc

SEQ ID NO: 6523690 - DNA, 22 bp, Homo sapiens
tggccctcactcaagaccaggc

SEQ ID NO: 6523691 - DNA, 12 bp, Homo sapiens
tggccctcagat

SEQ ID NO: 6523692 - DNA, 19 bp, Homo sapiens
tggccctcagctccctgac

SEQ ID NO: 6523693 - DNA, 12 bp, Homo sapiens
tggccctcagtg

SEQ ID NO: 6523694 - DNA, 14 bp, Homo sapiens
tggccctcagtttc

SEQ ID NO: 6523695 - DNA, 16 bp, Homo sapiens
tggccctcatctccag

SEQ ID NO: 6523696 - DNA, 11 bp, Homo sapiens
tggccctccac

SEQ ID NO: 6523697 - DNA, 14 bp, Homo sapiens
tggccctcccaggc

SEQ ID NO: 6523698 - DNA, 17 bp, Homo sapiens
tggccctcccaggctgg

SEQ ID NO: 6523699 - DNA, 13 bp, Homo sapiens
tggccctccctca

SEQ ID NO: 6523700 - DNA, 13 bp, Homo sapiens
tggccctcctcag

SEQ ID NO: 6523701 - DNA, 14 bp, Homo sapiens
tggccctcctcagc

SEQ ID NO: 6523702 - DNA, 18 bp, Homo sapiens
tggccctcctcagctccc

SEQ ID NO: 6523703 - DNA, 20 bp, Homo sapiens
tggccctcctcagctccctg

SEQ ID NO: 6523704 - DNA, 20 bp, Homo sapiens
tggccctcggaggtccagct

SEQ ID NO: 6523705 - DNA, 21 bp, Homo sapiens
tggccctcggaggtccagctg

SEQ ID NO: 6523706 - DNA, 17 bp, Homo sapiens
tggccctcgggccctct

SEQ ID NO: 6523707 - DNA, 16 bp, Homo sapiens
tggccctcggtggctg

SEQ ID NO: 6523708 - DNA, 17 bp, Homo sapiens
tggccctctcccctgcc

SEQ ID NO: 6523709 - DNA, 21 bp, Homo sapiens
tggccctctcccctgccccct

SEQ ID NO: 6523710 - DNA, 12 bp, Homo sapiens
tggccctctctt

SEQ ID NO: 6523711 - DNA, 23 bp, Homo sapiens
tggccctctcttaatgccacggc

SEQ ID NO: 6523712 - DNA, 16 bp, Homo sapiens
tggccctcttcttact

SEQ ID NO: 6523713 - DNA, 21 bp, Homo sapiens
tggccctgactgtcagggagg

SEQ ID NO: 6523714 - DNA, 22 bp, Homo sapiens
tggccctgactgtcagggaggg

SEQ ID NO: 6523715 - DNA, 16 bp, Homo sapiens
tggccctgaggtgtgg

SEQ ID NO: 6523716 - DNA, 23 bp, Homo sapiens
tggccctgaggtgtgggggctgc

SEQ ID NO: 6523717 - DNA, 18 bp, Homo sapiens
tggccctgatccaggaaa

SEQ ID NO: 6523718 - DNA, 18 bp, Homo sapiens
tggccctgcaaaaatata

SEQ ID NO: 6523719 - DNA, 16 bp, Homo sapiens
tggccctgcaagggcg

SEQ ID NO: 6523720 - DNA, 11 bp, Homo sapiens
tggccctgccc

SEQ ID NO: 6523721 - DNA, 16 bp, Homo sapiens
tggccctgcccagccc

SEQ ID NO: 6523722 - DNA, 15 bp, Homo sapiens
tggccctgcccctcc

SEQ ID NO: 6523723 - DNA, 18 bp, Homo sapiens
tggccctgcccctccccc

SEQ ID NO: 6523724 - DNA, 18 bp, Homo sapiens
tggccctgccctccccca

SEQ ID NO: 6523725 - DNA, 15 bp, Homo sapiens
tggccctgccctgag

SEQ ID NO: 6523726 - DNA, 15 bp, Homo sapiens
tggccctgcctcact

SEQ ID NO: 6523727 - DNA, 17 bp, Homo sapiens
tggccctgcctcctggg

SEQ ID NO: 6523728 - DNA, 18 bp, Homo sapiens
tggccctgcctcctggga

SEQ ID NO: 6523729 - DNA, 17 bp, Homo sapiens
tggccctgcttcctgct

SEQ ID NO: 6523730 - DNA, 18 bp, Homo sapiens
tggccctggagccagggc

SEQ ID NO: 6523731 - DNA, 14 bp, Homo sapiens
tggccctggcagcc

SEQ ID NO: 6523732 - DNA, 19 bp, Homo sapiens
tggccctggctctgctgtc

SEQ ID NO: 6523733 - DNA, 12 bp, Homo sapiens
tggccctgggga

SEQ ID NO: 6523734 - DNA, 21 bp, Homo sapiens
tggccctggggaagaggcctt

SEQ ID NO: 6523735 - DNA, 12 bp, Homo sapiens
tggccctggggc

SEQ ID NO: 6523736 - DNA, 13 bp, Homo sapiens
tggccctggggcc

SEQ ID NO: 6523737 - DNA, 16 bp, Homo sapiens
tggccctggggcctgt

SEQ ID NO: 6523738 - DNA, 12 bp, Homo sapiens
tggccctggggt

SEQ ID NO: 6523739 - DNA, 21 bp, Homo sapiens
tggccctgggtcccaggaccc

SEQ ID NO: 6523740 - DNA, 13 bp, Homo sapiens
tggccctgtccca

SEQ ID NO: 6523741 - DNA, 13 bp, Homo sapiens
tggccctgtccct

SEQ ID NO: 6523742 - DNA, 22 bp, Homo sapiens
tggccctgtccctcccacctct

SEQ ID NO: 6523743 - DNA, 15 bp, Homo sapiens
tggccctgtgcagac

SEQ ID NO: 6523744 - DNA, 16 bp, Homo sapiens
tggccctgtgcctggg

SEQ ID NO: 6523745 - DNA, 22 bp, Homo sapiens
tggccctgtttctccccacacc

SEQ ID NO: 6523746 - DNA, 23 bp, Homo sapiens
tggcccttaagccaaactcaggc

SEQ ID NO: 6523747 - DNA, 22 bp, Homo sapiens
tggcccttacacactcaggcct

SEQ ID NO: 6523748 - DNA, 24 bp, Homo sapiens
tggcccttacacactcaggcctgt

SEQ ID NO: 6523749 - DNA, 21 bp, Homo sapiens
tggcccttacttgcttctcta

SEQ ID NO: 6523750 - DNA, 19 bp, Homo sapiens
tggcccttcaagggtcagg

SEQ ID NO: 6523751 - DNA, 17 bp, Homo sapiens
tggcccttcagtctgct

SEQ ID NO: 6523752 - DNA, 20 bp, Homo sapiens
tggcccttcagtctgctcca

SEQ ID NO: 6523753 - DNA, 15 bp, Homo sapiens
tggcccttccagtgg

SEQ ID NO: 6523754 - DNA, 15 bp, Homo sapiens
tggcccttcccggca

SEQ ID NO: 6523755 - DNA, 15 bp, Homo sapiens
tggcccttcctggac

SEQ ID NO: 6523756 - DNA, 20 bp, Homo sapiens
tggcccttcctggacagctg

SEQ ID NO: 6523757 - DNA, 16 bp, Homo sapiens
tggcccttcctggact

SEQ ID NO: 6523758 - DNA, 20 bp, Homo sapiens
tggcccttcctggactggcc

SEQ ID NO: 6523759 - DNA, 13 bp, Homo sapiens
tggcccttccttc

SEQ ID NO: 6523760 - DNA, 22 bp, Homo sapiens
tggcccttgcagttcagcacca

SEQ ID NO: 6523761 - DNA, 17 bp, Homo sapiens
tggcccttgccggggcc

SEQ ID NO: 6523762 - DNA, 19 bp, Homo sapiens
tggcccttgccggggcctg

SEQ ID NO: 6523763 - DNA, 16 bp, Homo sapiens
tggcccttggaataaa

SEQ ID NO: 6523764 - DNA, 23 bp, Homo sapiens
tggcccttggtggggagcacaga

SEQ ID NO: 6523765 - DNA, 22 bp, Homo sapiens
tggcccttgtttacagtgagga

SEQ ID NO: 6523766 - DNA, 20 bp, Homo sapiens
tggccctttaatatttccaa

SEQ ID NO: 6523767 - DNA, 12 bp, Homo sapiens
tggccctttccc

SEQ ID NO: 6523768 - DNA, 18 bp, Homo sapiens
tggccgaaccccccactc

SEQ ID NO: 6523769 - DNA, 13 bp, Homo sapiens
tggccgactcagg

SEQ ID NO: 6523770 - DNA, 21 bp, Homo sapiens
tggccgactcagggacctaag

SEQ ID NO: 6523771 - DNA, 17 bp, Homo sapiens
tggccgactctgcactc

SEQ ID NO: 6523772 - DNA, 16 bp, Homo sapiens
tggccgagctcctggg

SEQ ID NO: 6523773 - DNA, 19 bp, Homo sapiens
tggccgagggtcctggctc

SEQ ID NO: 6523774 - DNA, 15 bp, Homo sapiens
tggccgagtccaagc

SEQ ID NO: 6523775 - DNA, 15 bp, Homo sapiens
tggccgatgagctgg

SEQ ID NO: 6523776 - DNA, 19 bp, Homo sapiens
tggccgatggggcccacat

SEQ ID NO: 6523777 - DNA, 19 bp, Homo sapiens
tggccgcaacttcccaggc

SEQ ID NO: 6523778 - DNA, 18 bp, Homo sapiens
tggccgcaagcgcaggga

SEQ ID NO: 6523779 - DNA, 20 bp, Homo sapiens
tggccgcaagcgcagggagg

SEQ ID NO: 6523780 - DNA, 21 bp, Homo sapiens
tggccgcaagcgcagggagga

SEQ ID NO: 6523781 - DNA, 22 bp, Homo sapiens
tggccgcagtgaggcggattga

SEQ ID NO: 6523782 - DNA, 20 bp, Homo sapiens
tggccgcataggcccagcca

SEQ ID NO: 6523783 - DNA, 16 bp, Homo sapiens
tggccgccacccccat

SEQ ID NO: 6523784 - DNA, 19 bp, Homo sapiens
tggccgccacccccatctt

SEQ ID NO: 6523785 - DNA, 12 bp, Homo sapiens
tggccgccacct

SEQ ID NO: 6523786 - DNA, 17 bp, Homo sapiens
tggccgccccctgcccc

SEQ ID NO: 6523787 - DNA, 23 bp, Homo sapiens
tggccgccccctgccccccagcc

SEQ ID NO: 6523788 - DNA, 16 bp, Homo sapiens
tggccgcccctgaggc

SEQ ID NO: 6523789 - DNA, 19 bp, Homo sapiens
tggccgcctggcaggtgga

SEQ ID NO: 6523790 - DNA, 21 bp, Homo sapiens
tggccgcgccaaataatgtct

SEQ ID NO: 6523791 - DNA, 17 bp, Homo sapiens
tggccgcggagcctgca

SEQ ID NO: 6523792 - DNA, 12 bp, Homo sapiens
tggccgctccgt

SEQ ID NO: 6523793 - DNA, 13 bp, Homo sapiens
tggccgctcctcc

SEQ ID NO: 6523794 - DNA, 17 bp, Homo sapiens
tggccgctgagtggcag

SEQ ID NO: 6523795 - DNA, 14 bp, Homo sapiens
tggccgctgggaga

SEQ ID NO: 6523796 - DNA, 18 bp, Homo sapiens
tggccgcttccctaccca

SEQ ID NO: 6523797 - DNA, 13 bp, Homo sapiens
tggccggaaggag

SEQ ID NO: 6523798 - DNA, 22 bp, Homo sapiens
tggccggagcaaactctgctgt

SEQ ID NO: 6523799 - DNA, 12 bp, Homo sapiens
tggccggccagc

SEQ ID NO: 6523800 - DNA, 17 bp, Homo sapiens
tggccggccagccagcc

SEQ ID NO: 6523801 - DNA, 23 bp, Homo sapiens
tggccggccagccagccactcta

SEQ ID NO: 6523802 - DNA, 19 bp, Homo sapiens
tggccggcccaggcctcca

SEQ ID NO: 6523803 - DNA, 17 bp, Homo sapiens
tggccggccctgccccc

SEQ ID NO: 6523804 - DNA, 16 bp, Homo sapiens
tggccggcctcctcct

SEQ ID NO: 6523805 - DNA, 16 bp, Homo sapiens
tggccggctctggtgg

SEQ ID NO: 6523806 - DNA, 13 bp, Homo sapiens
tggccggctggcc

SEQ ID NO: 6523807 - DNA, 14 bp, Homo sapiens
tggccggctggccg

SEQ ID NO: 6523808 - DNA, 14 bp, Homo sapiens
tggccggctggttg

SEQ ID NO: 6523809 - DNA, 20 bp, Homo sapiens
tggccggctgtgctcagaga

SEQ ID NO: 6523810 - DNA, 20 bp, Homo sapiens
tggccgggactgctgctctc

SEQ ID NO: 6523811 - DNA, 13 bp, Homo sapiens
tggccgggcacag

SEQ ID NO: 6523812 - DNA, 14 bp, Homo sapiens
tggccgggcacagc

SEQ ID NO: 6523813 - DNA, 15 bp, Homo sapiens
tggccgggcacagct

SEQ ID NO: 6523814 - DNA, 24 bp, Homo sapiens
tggccgggcacagtggctcacgcc

SEQ ID NO: 6523815 - DNA, 17 bp, Homo sapiens
tggccgggctctcatgg

SEQ ID NO: 6523816 - DNA, 18 bp, Homo sapiens
tggccggggctgaagcca

SEQ ID NO: 6523817 - DNA, 21 bp, Homo sapiens
tggccggggctgaagccacac

SEQ ID NO: 6523818 - DNA, 17 bp, Homo sapiens
tggccgggtcaccctgt

SEQ ID NO: 6523819 - DNA, 18 bp, Homo sapiens
tggccgggtgcggtggct

SEQ ID NO: 6523820 - DNA, 15 bp, Homo sapiens
tggccggtctgcaag

SEQ ID NO: 6523821 - DNA, 22 bp, Homo sapiens
tggccggtctgcaagtcagagg

SEQ ID NO: 6523822 - DNA, 16 bp, Homo sapiens
tggccggtgccagctg

SEQ ID NO: 6523823 - DNA, 17 bp, Homo sapiens
tggccggtgctgggttc

SEQ ID NO: 6523824 - DNA, 19 bp, Homo sapiens
tggccggtgtggccctgca

SEQ ID NO: 6523825 - DNA, 21 bp, Homo sapiens
tggccgtatctgagggctgct

SEQ ID NO: 6523826 - DNA, 23 bp, Homo sapiens
tggccgtggagtcgagctggccg

SEQ ID NO: 6523827 - DNA, 14 bp, Homo sapiens
tggccgtggatggc

SEQ ID NO: 6523828 - DNA, 23 bp, Homo sapiens
tggccgtggtccagctcttggcc

SEQ ID NO: 6523829 - DNA, 14 bp, Homo sapiens
tggccgttcagcct

SEQ ID NO: 6523830 - DNA, 17 bp, Homo sapiens
tggccgttcagcctgtc

SEQ ID NO: 6523831 - DNA, 14 bp, Homo sapiens
tggccgttggccac

SEQ ID NO: 6523832 - DNA, 16 bp, Homo sapiens
tggcctaaagccagca

SEQ ID NO: 6523833 - DNA, 17 bp, Homo sapiens
tggcctaaatttcttct

SEQ ID NO: 6523834 - DNA, 17 bp, Homo sapiens
tggcctaaggctgctgt

SEQ ID NO: 6523835 - DNA, 15 bp, Homo sapiens
tggcctaatcactct

SEQ ID NO: 6523836 - DNA, 18 bp, Homo sapiens
tggcctaatcactctgag

SEQ ID NO: 6523837 - DNA, 15 bp, Homo sapiens
tggcctacattcttt

SEQ ID NO: 6523838 - DNA, 19 bp, Homo sapiens
tggcctaccacagctgcct

SEQ ID NO: 6523839 - DNA, 16 bp, Homo sapiens
tggcctagacttgtgt

SEQ ID NO: 6523840 - DNA, 14 bp, Homo sapiens
tggcctagagcact

SEQ ID NO: 6523841 - DNA, 20 bp, Homo sapiens
tggcctagcaggcacaggac

SEQ ID NO: 6523842 - DNA, 23 bp, Homo sapiens
tggcctagcatacgtacacattt

SEQ ID NO: 6523843 - DNA, 19 bp, Homo sapiens
tggcctagcccaccctgct

SEQ ID NO: 6523844 - DNA, 16 bp, Homo sapiens
tggcctaggacccctc

SEQ ID NO: 6523845 - DNA, 17 bp, Homo sapiens
tggcctaggggccaggg

SEQ ID NO: 6523846 - DNA, 14 bp, Homo sapiens
ttagtcctcacctt

SEQ ID NO: 6523847 - DNA, 16 bp, Homo sapiens
ttagtcctccctgctc

SEQ ID NO: 6523848 - DNA, 22 bp, Homo sapiens
ttagtcctgggagaggacaggg

SEQ ID NO: 6523849 - DNA, 18 bp, Homo sapiens
ttagtcgccctacagaaa

SEQ ID NO: 6523850 - DNA, 22 bp, Homo sapiens
ttagtcgggcatgagtctgttt

SEQ ID NO: 6523851 - DNA, 16 bp, Homo sapiens
ttagtcgtgagctctt

SEQ ID NO: 6523852 - DNA, 18 bp, Homo sapiens
ttagtcgttatatttgac

SEQ ID NO: 6523853 - DNA, 19 bp, Homo sapiens
ttagtctactcttaagcca

SEQ ID NO: 6523854 - DNA, 22 bp, Homo sapiens
ttagtctcagtttgtgtgtctt

SEQ ID NO: 6523855 - DNA, 17 bp, Homo sapiens
ttagtctctttattcct

SEQ ID NO: 6523856 - DNA, 15 bp, Homo sapiens
ttagtctgcaaaatg

SEQ ID NO: 6523857 - DNA, 14 bp, Homo sapiens
ttagtctgtcatcc

SEQ ID NO: 6523858 - DNA, 19 bp, Homo sapiens
ttagtctgttatatttcct

SEQ ID NO: 6523859 - DNA, 22 bp, Homo sapiens
ttagtcttagggatttattttc

SEQ ID NO: 6523860 - DNA, 17 bp, Homo sapiens
ttagtcttttgtaatat

SEQ ID NO: 6523861 - DNA, 15 bp, Homo sapiens
ttagtgaaacataat

SEQ ID NO: 6523862 - DNA, 16 bp, Homo sapiens
ttagtgaagttgtgca

SEQ ID NO: 6523863 - DNA, 18 bp, Homo sapiens
ttagtgaagttgtgcaac

SEQ ID NO: 6523864 - DNA, 19 bp, Homo sapiens
ttagtgaattaaatttagt

SEQ ID NO: 6523865 - DNA, 15 bp, Homo sapiens
ttagtgacatttaat

SEQ ID NO: 6523866 - DNA, 21 bp, Homo sapiens
ttagtgaccattattcacagg

SEQ ID NO: 6523867 - DNA, 15 bp, Homo sapiens
ttagtgactaaacca

SEQ ID NO: 6523868 - DNA, 20 bp, Homo sapiens
ttagtgacttagttcttaga

SEQ ID NO: 6523869 - DNA, 20 bp, Homo sapiens
ttagtgagacatcagggagt

SEQ ID NO: 6523870 - DNA, 17 bp, Homo sapiens
ttagtgagatttgtatt

SEQ ID NO: 6523871 - DNA, 14 bp, Homo sapiens
ttagtgatatttct

SEQ ID NO: 6523872 - DNA, 18 bp, Homo sapiens
ttagtgatgtcatctgtc

SEQ ID NO: 6523873 - DNA, 21 bp, Homo sapiens
ttagtgattctgatttcagtt

SEQ ID NO: 6523874 - DNA, 15 bp, Homo sapiens
ttagtgattgctttt

SEQ ID NO: 6523875 - DNA, 13 bp, Homo sapiens
ttagtgatttgct

SEQ ID NO: 6523876 - DNA, 14 bp, Homo sapiens
ttagtgatttgcta

SEQ ID NO: 6523877 - DNA, 20 bp, Homo sapiens
ttagtgcatctttgcctctc

SEQ ID NO: 6523878 - DNA, 21 bp, Homo sapiens
ttagtgcatgtcacatgacat

SEQ ID NO: 6523879 - DNA, 18 bp, Homo sapiens
ttagtgccacttaatgta

SEQ ID NO: 6523880 - DNA, 19 bp, Homo sapiens
ttagtgccacttaatgtat

SEQ ID NO: 6523881 - DNA, 12 bp, Homo sapiens
ttagtgccaggc

SEQ ID NO: 6523882 - DNA, 14 bp, Homo sapiens
ttagtgccaggctg

SEQ ID NO: 6523883 - DNA, 19 bp, Homo sapiens
ttagtgcggacaagtttta

SEQ ID NO: 6523884 - DNA, 17 bp, Homo sapiens
ttagtgcttcagagttt

SEQ ID NO: 6523885 - DNA, 16 bp, Homo sapiens
ttagtgctttacatgc

SEQ ID NO: 6523886 - DNA, 21 bp, Homo sapiens
ttagtggaccctgaaatgtgt

SEQ ID NO: 6523887 - DNA, 13 bp, Homo sapiens
ttagtgggaagag

SEQ ID NO: 6523888 - DNA, 16 bp, Homo sapiens
ttagtgggaagagctg

SEQ ID NO: 6523889 - DNA, 19 bp, Homo sapiens
ttagtggtatgtctcttta

SEQ ID NO: 6523890 - DNA, 19 bp, Homo sapiens
ttagtggtcataaaataga

SEQ ID NO: 6523891 - DNA, 23 bp, Homo sapiens
ttagtggtggatagaagacttag

SEQ ID NO: 6523892 - DNA, 21 bp, Homo sapiens
ttagtggtggtagaaatgatt

SEQ ID NO: 6523893 - DNA, 14 bp, Homo sapiens
ttagtggtgtatat

SEQ ID NO: 6523894 - DNA, 19 bp, Homo sapiens
ttagtggtttatcagcaaa

SEQ ID NO: 6523895 - DNA, 15 bp, Homo sapiens
ttagtgtaataagac

SEQ ID NO: 6523896 - DNA, 13 bp, Homo sapiens
ttagtgtattttc

SEQ ID NO: 6523897 - DNA, 19 bp, Homo sapiens
ttagtgtctctatttatga

SEQ ID NO: 6523898 - DNA, 16 bp, Homo sapiens
ttagtgtctgacctaa

SEQ ID NO: 6523899 - DNA, 14 bp, Homo sapiens
ttagtgtctgtcca

SEQ ID NO: 6523900 - DNA, 12 bp, Homo sapiens
ttagtgtgaaat

SEQ ID NO: 6523901 - DNA, 21 bp, Homo sapiens
ttagtgtgacagtttccaaat

SEQ ID NO: 6523902 - DNA, 12 bp, Homo sapiens
ttagtgtgctgc

SEQ ID NO: 6523903 - DNA, 17 bp, Homo sapiens
ttagtgtgctgctgttc

SEQ ID NO: 6523904 - DNA, 22 bp, Homo sapiens
ttagtgtgctgctgttctgtgt

SEQ ID NO: 6523905 - DNA, 18 bp, Homo sapiens
ttagtgtgtaaaattaat

SEQ ID NO: 6523906 - DNA, 20 bp, Homo sapiens
ttagtgtgtaaaattaatgt

SEQ ID NO: 6523907 - DNA, 17 bp, Homo sapiens
ttagtgtgtgtgcatgt

SEQ ID NO: 6523908 - DNA, 16 bp, Homo sapiens
ttagtgttaaaaatct

SEQ ID NO: 6523909 - DNA, 19 bp, Homo sapiens
ttagtgttaaaaatctagt

SEQ ID NO: 6523910 - DNA, 20 bp, Homo sapiens
ttagtgttcaaatacttcaa

SEQ ID NO: 6523911 - DNA, 17 bp, Homo sapiens
ttagtgttctgtatttt

SEQ ID NO: 6523912 - DNA, 17 bp, Homo sapiens
ttagtgtttctgtgcat

SEQ ID NO: 6523913 - DNA, 21 bp, Homo sapiens
ttagtgtttgaaaaagctggt

SEQ ID NO: 6523914 - DNA, 13 bp, Homo sapiens
ttagtgttttcat

SEQ ID NO: 6523915 - DNA, 14 bp, Homo sapiens
ttagtgttttcatt

SEQ ID NO: 6523916 - DNA, 22 bp, Homo sapiens
ttagtgttttcattctggtcct

SEQ ID NO: 6523917 - DNA, 16 bp, Homo sapiens
ttagttaaaactcatc

SEQ ID NO: 6523918 - DNA, 13 bp, Homo sapiens
ttagttaaaatct

SEQ ID NO: 6523919 - DNA, 19 bp, Homo sapiens
ttagttaaaatctattttg

SEQ ID NO: 6523920 - DNA, 21 bp, Homo sapiens
ttagttaacacacatatatct

SEQ ID NO: 6523921 - DNA, 12 bp, Homo sapiens
ttagttaatctc

SEQ ID NO: 6523922 - DNA, 15 bp, Homo sapiens
ttagttaatgagcca

SEQ ID NO: 6523923 - DNA, 13 bp, Homo sapiens
ttagttaatggat

SEQ ID NO: 6523924 - DNA, 21 bp, Homo sapiens
ttagttaccttatagttactg

SEQ ID NO: 6523925 - DNA, 18 bp, Homo sapiens
ttagttacgtataatgct

SEQ ID NO: 6523926 - DNA, 22 bp, Homo sapiens
ttagttactacctcctctcctg

SEQ ID NO: 6523927 - DNA, 22 bp, Homo sapiens
ttagttacttgctataaataga

SEQ ID NO: 6523928 - DNA, 15 bp, Homo sapiens
ttagttagaaaataa

SEQ ID NO: 6523929 - DNA, 13 bp, Homo sapiens
ttagttataaaac

SEQ ID NO: 6523930 - DNA, 16 bp, Homo sapiens
ttagttatagatgtct

SEQ ID NO: 6523931 - DNA, 13 bp, Homo sapiens
ttagttatagttt

SEQ ID NO: 6523932 - DNA, 18 bp, Homo sapiens
ttagttatttaagaagaa

SEQ ID NO: 6523933 - DNA, 12 bp, Homo sapiens
ttagttcaatac

SEQ ID NO: 6523934 - DNA, 15 bp, Homo sapiens
ttagttcaatacagt

SEQ ID NO: 6523935 - DNA, 22 bp, Homo sapiens
ttagttcaccccttatcctgag

SEQ ID NO: 6523936 - DNA, 16 bp, Homo sapiens
ttagttcacctaccct

SEQ ID NO: 6523937 - DNA, 16 bp, Homo sapiens
ttagttccaacaaaga

SEQ ID NO: 6523938 - DNA, 15 bp, Homo sapiens
ttagttccactgaga

SEQ ID NO: 6523939 - DNA, 16 bp, Homo sapiens
ttagttccactgagac

SEQ ID NO: 6523940 - DNA, 20 bp, Homo sapiens
ttagttccagtttctccttg

SEQ ID NO: 6523941 - DNA, 19 bp, Homo sapiens
ttagttccctgtctcttga

SEQ ID NO: 6523942 - DNA, 14 bp, Homo sapiens
ttagttccttgagt

SEQ ID NO: 6523943 - DNA, 21 bp, Homo sapiens
ttagttctcactgttccctct

SEQ ID NO: 6523944 - DNA, 13 bp, Homo sapiens
ttagttctgactt

SEQ ID NO: 6523945 - DNA, 22 bp, Homo sapiens
ttagttctgactttgaatttat

SEQ ID NO: 6523946 - DNA, 13 bp, Homo sapiens
ttagttctgtata

SEQ ID NO: 6523947 - DNA, 13 bp, Homo sapiens
ttagttctgttga

SEQ ID NO: 6523948 - DNA, 20 bp, Homo sapiens
ttagttcttgaattgttatg

SEQ ID NO: 6523949 - DNA, 15 bp, Homo sapiens
ttagttctttgttat

SEQ ID NO: 6523950 - DNA, 15 bp, Homo sapiens
ttagttgaattccaa

SEQ ID NO: 6523951 - DNA, 19 bp, Homo sapiens
ttagttgacaacctagaat

SEQ ID NO: 6523952 - DNA, 21 bp, Homo sapiens
ttagttgatattcaaggcttt

SEQ ID NO: 6523953 - DNA, 12 bp, Homo sapiens
ttagttgcacta

SEQ ID NO: 6523954 - DNA, 18 bp, Homo sapiens
ttagttgcactaactgct

SEQ ID NO: 6523955 - DNA, 20 bp, Homo sapiens
ttagttgcactaactgctgg

SEQ ID NO: 6523956 - DNA, 15 bp, Homo sapiens
ttagttgccaacagt

SEQ ID NO: 6523957 - DNA, 15 bp, Homo sapiens
ttagttgccaatatg

SEQ ID NO: 6523958 - DNA, 22 bp, Homo sapiens
ttagttgcctaagcattgcctg

SEQ ID NO: 6523959 - DNA, 18 bp, Homo sapiens
ttagttggaaaaacaatt

SEQ ID NO: 6523960 - DNA, 16 bp, Homo sapiens
ttagttggacagttta

SEQ ID NO: 6523961 - DNA, 24 bp, Homo sapiens
ttagttggagctagaaaatgaact

SEQ ID NO: 6523962 - DNA, 16 bp, Homo sapiens
ttagttggcatttgtt

SEQ ID NO: 6523963 - DNA, 18 bp, Homo sapiens
ttagttggtgctgatgga

SEQ ID NO: 6523964 - DNA, 20 bp, Homo sapiens
ttagttgtatctcttttgaa

SEQ ID NO: 6523965 - DNA, 12 bp, Homo sapiens
ttagtttaaaat

SEQ ID NO: 6523966 - DNA, 18 bp, Homo sapiens
ttagtttaaaatgaagca

SEQ ID NO: 6523967 - DNA, 13 bp, Homo sapiens
ttagtttacaata

SEQ ID NO: 6523968 - DNA, 14 bp, Homo sapiens
ttagtttactggat

SEQ ID NO: 6523969 - DNA, 11 bp, Homo sapiens
ttagtttagaa

SEQ ID NO: 6523970 - DNA, 14 bp, Homo sapiens
ttagtttagtgtgt

SEQ ID NO: 6523971 - DNA, 21 bp, Homo sapiens
ttagtttagtgtgtgtgcaga

SEQ ID NO: 6523972 - DNA, 13 bp, Homo sapiens
ttagtttcaaaat

SEQ ID NO: 6523973 - DNA, 14 bp, Homo sapiens
ttagtttcaaaatg

SEQ ID NO: 6523974 - DNA, 21 bp, Homo sapiens
ttagtttcaagagtctaaacc

SEQ ID NO: 6523975 - DNA, 19 bp, Homo sapiens
ttagtttcagaagtactgg

SEQ ID NO: 6523976 - DNA, 22 bp, Homo sapiens
ttagtttcagtagattgcagaa

SEQ ID NO: 6523977 - DNA, 14 bp, Homo sapiens
ttagtttctgaact

SEQ ID NO: 6523978 - DNA, 21 bp, Homo sapiens
ttagtttctgttctgtggaaa

SEQ ID NO: 6523979 - DNA, 15 bp, Homo sapiens
ttagtttgaaacaga

SEQ ID NO: 6523980 - DNA, 13 bp, Homo sapiens
ttagtttgacact

SEQ ID NO: 6523981 - DNA, 22 bp, Homo sapiens
ttagtttgcagttacactaaaa

SEQ ID NO: 6523982 - DNA, 14 bp, Homo sapiens
ttagtttgcattta

SEQ ID NO: 6523983 - DNA, 16 bp, Homo sapiens
ttagtttgtgtgttgt

SEQ ID NO: 6523984 - DNA, 20 bp, Homo sapiens
ttagttttaagccttaaggt

SEQ ID NO: 6523985 - DNA, 17 bp, Homo sapiens
ttagttttattttctaa

SEQ ID NO: 6523986 - DNA, 14 bp, Homo sapiens
ttagttttcttgtt

SEQ ID NO: 6523987 - DNA, 12 bp, Homo sapiens
ttagttttgatt

SEQ ID NO: 6523988 - DNA, 13 bp, Homo sapiens
ttagttttgcata

SEQ ID NO: 6523989 - DNA, 13 bp, Homo sapiens
ttagttttgcttt

SEQ ID NO: 6523990 - DNA, 18 bp, Homo sapiens
ttagttttgcttttagtt

SEQ ID NO: 6523991 - DNA, 15 bp, Homo sapiens
ttagttttgtaactt

SEQ ID NO: 6523992 - DNA, 14 bp, Homo sapiens
ttagttttgtgctt

SEQ ID NO: 6523993 - DNA, 14 bp, Homo sapiens
ttagttttgttcca

SEQ ID NO: 6523994 - DNA, 21 bp, Homo sapiens
ttagtttttaaaatttatttg

SEQ ID NO: 6523995 - DNA, 16 bp, Homo sapiens
ttagtttttcattaaa

SEQ ID NO: 6523996 - DNA, 19 bp, Homo sapiens
ttagtttttggttgggaat

SEQ ID NO: 6523997 - DNA, 21 bp, Homo sapiens
ttagtttttgtgaagtttaat

SEQ ID NO: 6523998 - DNA, 14 bp, Homo sapiens
ttataaaaaatggt

SEQ ID NO: 6523999 - DNA, 15 bp, Homo sapiens
ttataaaaaatggtt

SEQ ID NO: 6524000 - DNA, 14 bp, Homo sapiens
ttataaaaaattaa

SEQ ID NO: 6524001 - DNA, 22 bp, Homo sapiens
ttataaaaaattaacttagttt

SEQ ID NO: 6524002 - DNA, 14 bp, Homo sapiens
ttataaaaacactt

SEQ ID NO: 6524003 - DNA, 19 bp, Homo sapiens
ttataaaaacattgaaata

SEQ ID NO: 6524004 - DNA, 12 bp, Homo sapiens
ttataaaaagat

SEQ ID NO: 6524005 - DNA, 12 bp, Homo sapiens
ttataaaaagtt

SEQ ID NO: 6524006 - DNA, 14 bp, Homo sapiens
ttataaaaatataa

SEQ ID NO: 6524007 - DNA, 17 bp, Homo sapiens
ttataaaaatataaatt

SEQ ID NO: 6524008 - DNA, 15 bp, Homo sapiens
ttataaaaatatcaa

SEQ ID NO: 6524009 - DNA, 22 bp, Homo sapiens
ttataaaagggggtccgtggaa

SEQ ID NO: 6524010 - DNA, 12 bp, Homo sapiens
ttataaaagtgt

SEQ ID NO: 6524011 - DNA, 13 bp, Homo sapiens
ttataaaataaca

SEQ ID NO: 6524012 - DNA, 22 bp, Homo sapiens
ttataaaataacatgctgccat

SEQ ID NO: 6524013 - DNA, 16 bp, Homo sapiens
ttataaaatcaagttt

SEQ ID NO: 6524014 - DNA, 16 bp, Homo sapiens
ttataaaatggacaca

SEQ ID NO: 6524015 - DNA, 16 bp, Homo sapiens
ttataaaattaagcaa

SEQ ID NO: 6524016 - DNA, 17 bp, Homo sapiens
ttataaaattattttta

SEQ ID NO: 6524017 - DNA, 15 bp, Homo sapiens
ttataaaattgaaaa

SEQ ID NO: 6524018 - DNA, 18 bp, Homo sapiens
ttataaaattgaaaacac

SEQ ID NO: 6524019 - DNA, 20 bp, Homo sapiens
ttataaaattgaaaacacta

SEQ ID NO: 6524020 - DNA, 12 bp, Homo sapiens
ttataaacacat

SEQ ID NO: 6524021 - DNA, 23 bp, Homo sapiens
ttataaacagacaatatgtgagt

SEQ ID NO: 6524022 - DNA, 15 bp, Homo sapiens
ttataaacagataat

SEQ ID NO: 6524023 - DNA, 19 bp, Homo sapiens
ttataaacagataatgctt

SEQ ID NO: 6524024 - DNA, 11 bp, Homo sapiens
ttataaacagt

SEQ ID NO: 6524025 - DNA, 21 bp, Homo sapiens
ttataaacagttttacttgtg

SEQ ID NO: 6524026 - DNA, 22 bp, Homo sapiens
ttataaacatgtccccttccct

SEQ ID NO: 6524027 - DNA, 16 bp, Homo sapiens
tggcctaggtgggagc

SEQ ID NO: 6524028 - DNA, 23 bp, Homo sapiens
tggcctaggtgggagccaccact

SEQ ID NO: 6524029 - DNA, 16 bp, Homo sapiens
tggcctagtcagatgg

SEQ ID NO: 6524030 - DNA, 17 bp, Homo sapiens
tggcctagtcagatgga

SEQ ID NO: 6524031 - DNA, 20 bp, Homo sapiens
tggcctagtggggaggggcc

SEQ ID NO: 6524032 - DNA, 22 bp, Homo sapiens
tggcctagtggggaggggcctg

SEQ ID NO: 6524033 - DNA, 23 bp, Homo sapiens
tggcctagtggggaggggcctgg

SEQ ID NO: 6524034 - DNA, 18 bp, Homo sapiens
tggcctatccgctgccag

SEQ ID NO: 6524035 - DNA, 19 bp, Homo sapiens
tggcctatccgctgccagc

SEQ ID NO: 6524036 - DNA, 18 bp, Homo sapiens
tggcctatgaccctgtgc

SEQ ID NO: 6524037 - DNA, 19 bp, Homo sapiens
tggcctatgaccctgtgcc

SEQ ID NO: 6524038 - DNA, 20 bp, Homo sapiens
tggcctatgaccctgtgcct

SEQ ID NO: 6524039 - DNA, 15 bp, Homo sapiens
tggcctatgcacata

SEQ ID NO: 6524040 - DNA, 17 bp, Homo sapiens
tggcctattatattaaa

SEQ ID NO: 6524041 - DNA, 17 bp, Homo sapiens
tggcctatttcagctgc

SEQ ID NO: 6524042 - DNA, 21 bp, Homo sapiens
tggcctatttcagctgctttg

SEQ ID NO: 6524043 - DNA, 23 bp, Homo sapiens
tggcctattttggacgtgtgagg

SEQ ID NO: 6524044 - DNA, 18 bp, Homo sapiens
tggcctcaaaacagaagc

SEQ ID NO: 6524045 - DNA, 17 bp, Homo sapiens
tggcctcaactgagaag

SEQ ID NO: 6524046 - DNA, 22 bp, Homo sapiens
tggcctcaactgagaagccaag

SEQ ID NO: 6524047 - DNA, 15 bp, Homo sapiens
tggcctcaagagcac

SEQ ID NO: 6524048 - DNA, 13 bp, Homo sapiens
tggcctcaagatc

SEQ ID NO: 6524049 - DNA, 21 bp, Homo sapiens
tggcctcaagatcaatgaaat

SEQ ID NO: 6524050 - DNA, 22 bp, Homo sapiens
tggcctcaagatcaatgaaatg

SEQ ID NO: 6524051 - DNA, 15 bp, Homo sapiens
tggcctcacccaccc

SEQ ID NO: 6524052 - DNA, 14 bp, Homo sapiens
tggcctcaccctga

SEQ ID NO: 6524053 - DNA, 21 bp, Homo sapiens
tggcctcacgcccagcctcct

SEQ ID NO: 6524054 - DNA, 16 bp, Homo sapiens
tggcctcactggctgg

SEQ ID NO: 6524055 - DNA, 20 bp, Homo sapiens
tggcctcactggctggggca

SEQ ID NO: 6524056 - DNA, 17 bp, Homo sapiens
tggcctcacttccctgg

SEQ ID NO: 6524057 - DNA, 14 bp, Homo sapiens
tggcctcagactgc

SEQ ID NO: 6524058 - DNA, 21 bp, Homo sapiens
tggcctcagactgcacccagg

SEQ ID NO: 6524059 - DNA, 22 bp, Homo sapiens
tggcctcagactgcacccagga

SEQ ID NO: 6524060 - DNA, 12 bp, Homo sapiens
tggcctcagcag

SEQ ID NO: 6524061 - DNA, 17 bp, Homo sapiens
tggcctcagcaggaacc

SEQ ID NO: 6524062 - DNA, 16 bp, Homo sapiens
tggcctcagccctcag

SEQ ID NO: 6524063 - DNA, 17 bp, Homo sapiens
tggcctcagccctcaga

SEQ ID NO: 6524064 - DNA, 18 bp, Homo sapiens
tggcctcagccctgctcc

SEQ ID NO: 6524065 - DNA, 15 bp, Homo sapiens
tggcctcagctggct

SEQ ID NO: 6524066 - DNA, 20 bp, Homo sapiens
tggcctcagctggctgtatg

SEQ ID NO: 6524067 - DNA, 17 bp, Homo sapiens
tggcctcatctctgcct

SEQ ID NO: 6524068 - DNA, 20 bp, Homo sapiens
tggcctcatgtggctggaag

SEQ ID NO: 6524069 - DNA, 21 bp, Homo sapiens
tggcctcatgtggctggaaga

SEQ ID NO: 6524070 - DNA, 21 bp, Homo sapiens
tggcctccacagttcgacctg

SEQ ID NO: 6524071 - DNA, 13 bp, Homo sapiens
tggcctccagcct

SEQ ID NO: 6524072 - DNA, 13 bp, Homo sapiens
tggcctccagctc

SEQ ID NO: 6524073 - DNA, 15 bp, Homo sapiens
tggcctccaggcccg

SEQ ID NO: 6524074 - DNA, 22 bp, Homo sapiens
tggcctccaggcccgtctgtcc

SEQ ID NO: 6524075 - DNA, 15 bp, Homo sapiens
tggcctccatcctca

SEQ ID NO: 6524076 - DNA, 17 bp, Homo sapiens
tggcctccatcctcatc

SEQ ID NO: 6524077 - DNA, 23 bp, Homo sapiens
tggcctccatcctcatctctctt

SEQ ID NO: 6524078 - DNA, 19 bp, Homo sapiens
tggcctcccaaagtgctgg

SEQ ID NO: 6524079 - DNA, 20 bp, Homo sapiens
tggcctcccaaatgagccat

SEQ ID NO: 6524080 - DNA, 14 bp, Homo sapiens
tggcctcccacccg

SEQ ID NO: 6524081 - DNA, 22 bp, Homo sapiens
tggcctcccagaatgctgggtt

SEQ ID NO: 6524082 - DNA, 13 bp, Homo sapiens
tggcctcccagcc

SEQ ID NO: 6524083 - DNA, 14 bp, Homo sapiens
tggcctcccctgcc

SEQ ID NO: 6524084 - DNA, 17 bp, Homo sapiens
tggcctcccctgccacc

SEQ ID NO: 6524085 - DNA, 17 bp, Homo sapiens
tggcctcccctgcggag

SEQ ID NO: 6524086 - DNA, 12 bp, Homo sapiens
tggcctccctcc

SEQ ID NO: 6524087 - DNA, 16 bp, Homo sapiens
tggcctccctgctcta

SEQ ID NO: 6524088 - DNA, 14 bp, Homo sapiens
tggcctccctgctg

SEQ ID NO: 6524089 - DNA, 15 bp, Homo sapiens
tggcctccctgctgt

SEQ ID NO: 6524090 - DNA, 16 bp, Homo sapiens
tggcctccctggctcc

SEQ ID NO: 6524091 - DNA, 18 bp, Homo sapiens
tggcctccctggctcctc

SEQ ID NO: 6524092 - DNA, 20 bp, Homo sapiens
tggcctccgatgcctggcct

SEQ ID NO: 6524093 - DNA, 15 bp, Homo sapiens
tggcctccggcctcc

SEQ ID NO: 6524094 - DNA, 22 bp, Homo sapiens
tggcctccgtcctgtcactgat

SEQ ID NO: 6524095 - DNA, 19 bp, Homo sapiens
tggcctcctaaggctcccc

SEQ ID NO: 6524096 - DNA, 23 bp, Homo sapiens
tggcctcctaaggctccccaccc

SEQ ID NO: 6524097 - DNA, 18 bp, Homo sapiens
tggcctcctcccttagct

SEQ ID NO: 6524098 - DNA, 13 bp, Homo sapiens
tggcctcctgcct

SEQ ID NO: 6524099 - DNA, 14 bp, Homo sapiens
tggcctcctgcctc

SEQ ID NO: 6524100 - DNA, 15 bp, Homo sapiens
tggcctcctgcctct

SEQ ID NO: 6524101 - DNA, 21 bp, Homo sapiens
tggcctcctgcctctactggg

SEQ ID NO: 6524102 - DNA, 15 bp, Homo sapiens
tggcctcctgggggc

SEQ ID NO: 6524103 - DNA, 15 bp, Homo sapiens
tggcctccttgcttg

SEQ ID NO: 6524104 - DNA, 14 bp, Homo sapiens
tggcctcgcctggc

SEQ ID NO: 6524105 - DNA, 15 bp, Homo sapiens
tggcctcgcctggcc

SEQ ID NO: 6524106 - DNA, 16 bp, Homo sapiens
tggcctcgcctgggcc

SEQ ID NO: 6524107 - DNA, 20 bp, Homo sapiens
tggcctcgcctgggcccagg

SEQ ID NO: 6524108 - DNA, 23 bp, Homo sapiens
tggcctcgggacacctgccctgc

SEQ ID NO: 6524109 - DNA, 18 bp, Homo sapiens
tggcctcggggcagggca

SEQ ID NO: 6524110 - DNA, 19 bp, Homo sapiens
tggcctcggggcagggcag

SEQ ID NO: 6524111 - DNA, 18 bp, Homo sapiens
tggcctcgtgaggggcaa

SEQ ID NO: 6524112 - DNA, 17 bp, Homo sapiens
tggcctctaccacaagg

SEQ ID NO: 6524113 - DNA, 21 bp, Homo sapiens
tggcctctagaacacccactg

SEQ ID NO: 6524114 - DNA, 24 bp, Homo sapiens
tggcctctagaacacccactggcc

SEQ ID NO: 6524115 - DNA, 20 bp, Homo sapiens
tggcctctcactgcctcccc

SEQ ID NO: 6524116 - DNA, 13 bp, Homo sapiens
tggcctctcccca

SEQ ID NO: 6524117 - DNA, 14 bp, Homo sapiens
tggcctctctatcc

SEQ ID NO: 6524118 - DNA, 17 bp, Homo sapiens
tggcctctctatcctct

SEQ ID NO: 6524119 - DNA, 23 bp, Homo sapiens
tggcctctctatcctctcttcct

SEQ ID NO: 6524120 - DNA, 22 bp, Homo sapiens
tggcctctctctagggtacatg

SEQ ID NO: 6524121 - DNA, 19 bp, Homo sapiens
tggcctctctctctctcct

SEQ ID NO: 6524122 - DNA, 20 bp, Homo sapiens
tggcctctctctctctcctc

SEQ ID NO: 6524123 - DNA, 18 bp, Homo sapiens
tggcctctgcactcccct

SEQ ID NO: 6524124 - DNA, 20 bp, Homo sapiens
tggcctctgcactcccctgc

SEQ ID NO: 6524125 - DNA, 13 bp, Homo sapiens
tggcctctgcccc

SEQ ID NO: 6524126 - DNA, 15 bp, Homo sapiens
tggcctctgcccctc

SEQ ID NO: 6524127 - DNA, 16 bp, Homo sapiens
tggcctctgcccctct

SEQ ID NO: 6524128 - DNA, 21 bp, Homo sapiens
tggcctctgcctccaccctcc

SEQ ID NO: 6524129 - DNA, 13 bp, Homo sapiens
tggcctctgcctg

SEQ ID NO: 6524130 - DNA, 16 bp, Homo sapiens
tggcctctgcctgggg

SEQ ID NO: 6524131 - DNA, 12 bp, Homo sapiens
tggcctctgctg

SEQ ID NO: 6524132 - DNA, 14 bp, Homo sapiens
tggcctctgctgaa

SEQ ID NO: 6524133 - DNA, 20 bp, Homo sapiens
tggcctctgcttacttttta

SEQ ID NO: 6524134 - DNA, 13 bp, Homo sapiens
tggcctctggaaa

SEQ ID NO: 6524135 - DNA, 13 bp, Homo sapiens
tggcctctgggca

SEQ ID NO: 6524136 - DNA, 14 bp, Homo sapiens
tggcctctgggcag

SEQ ID NO: 6524137 - DNA, 14 bp, Homo sapiens
tggcctctggggca

SEQ ID NO: 6524138 - DNA, 20 bp, Homo sapiens
tggcctctggggcaggacca

SEQ ID NO: 6524139 - DNA, 22 bp, Homo sapiens
tggcctctgtgattacatagat

SEQ ID NO: 6524140 - DNA, 15 bp, Homo sapiens
tggcctctgtgccat

SEQ ID NO: 6524141 - DNA, 21 bp, Homo sapiens
tggcctcttcctccctccctg

SEQ ID NO: 6524142 - DNA, 14 bp, Homo sapiens
tggcctcttctaga

SEQ ID NO: 6524143 - DNA, 21 bp, Homo sapiens
tggcctcttgagttcctctgc

SEQ ID NO: 6524144 - DNA, 22 bp, Homo sapiens
tggcctcttgagttcctctgca

SEQ ID NO: 6524145 - DNA, 17 bp, Homo sapiens
tggcctcttgtagtctt

SEQ ID NO: 6524146 - DNA, 14 bp, Homo sapiens
tggcctcttttcag

SEQ ID NO: 6524147 - DNA, 21 bp, Homo sapiens
tggcctgaacagatgtaaatc

SEQ ID NO: 6524148 - DNA, 20 bp, Homo sapiens
tggcctgaaccacaggagag

SEQ ID NO: 6524149 - DNA, 17 bp, Homo sapiens
tggcctgacttggggga

SEQ ID NO: 6524150 - DNA, 14 bp, Homo sapiens
tggcctgagaagag

SEQ ID NO: 6524151 - DNA, 12 bp, Homo sapiens
tggcctgagaca

SEQ ID NO: 6524152 - DNA, 14 bp, Homo sapiens
tggcctgagctggg

SEQ ID NO: 6524153 - DNA, 23 bp, Homo sapiens
tggcctgaggacccggcgctgag

SEQ ID NO: 6524154 - DNA, 12 bp, Homo sapiens
tggcctgaggtc

SEQ ID NO: 6524155 - DNA, 23 bp, Homo sapiens
tggcctgagtcctggtccctctg

SEQ ID NO: 6524156 - DNA, 21 bp, Homo sapiens
tggcctgatgaccaattttaa

SEQ ID NO: 6524157 - DNA, 18 bp, Homo sapiens
tggcctgatgatggtggg

SEQ ID NO: 6524158 - DNA, 17 bp, Homo sapiens
tggcctgcaaactggga

SEQ ID NO: 6524159 - DNA, 21 bp, Homo sapiens
tggcctgcacggtgggccttg

SEQ ID NO: 6524160 - DNA, 14 bp, Homo sapiens
tggcctgcactaat

SEQ ID NO: 6524161 - DNA, 13 bp, Homo sapiens
tggcctgcaggag

SEQ ID NO: 6524162 - DNA, 18 bp, Homo sapiens
tggcctgcataggctcct

SEQ ID NO: 6524163 - DNA, 11 bp, Homo sapiens
tggcctgccca

SEQ ID NO: 6524164 - DNA, 17 bp, Homo sapiens
tggcctgcccagcctca

SEQ ID NO: 6524165 - DNA, 20 bp, Homo sapiens
tggcctgcccgtgccctggt

SEQ ID NO: 6524166 - DNA, 22 bp, Homo sapiens
tggcctgctaaggctcctcctt

SEQ ID NO: 6524167 - DNA, 12 bp, Homo sapiens
tggcctgctcat

SEQ ID NO: 6524168 - DNA, 11 bp, Homo sapiens
tggcctgctgt

SEQ ID NO: 6524169 - DNA, 12 bp, Homo sapiens
tggcctgctgtg

SEQ ID NO: 6524170 - DNA, 23 bp, Homo sapiens
tggcctggaccattcctgtccct

SEQ ID NO: 6524171 - DNA, 13 bp, Homo sapiens
tggcctggagagg

SEQ ID NO: 6524172 - DNA, 18 bp, Homo sapiens
tggcctggagcaggccca

SEQ ID NO: 6524173 - DNA, 16 bp, Homo sapiens
tggcctggaggctcag

SEQ ID NO: 6524174 - DNA, 21 bp, Homo sapiens
tggcctggatctccccactct

SEQ ID NO: 6524175 - DNA, 18 bp, Homo sapiens
tggcctggcacacatcag

SEQ ID NO: 6524176 - DNA, 13 bp, Homo sapiens
tggcctggcaggg

SEQ ID NO: 6524177 - DNA, 15 bp, Homo sapiens
tggcctggcaggggg

SEQ ID NO: 6524178 - DNA, 12 bp, Homo sapiens
tggcctggccag

SEQ ID NO: 6524179 - DNA, 13 bp, Homo sapiens
tggcctggccagg

SEQ ID NO: 6524180 - DNA, 16 bp, Homo sapiens
tggcctggccaggagc

SEQ ID NO: 6524181 - DNA, 18 bp, Homo sapiens
tggcctggccaggagctc

SEQ ID NO: 6524182 - DNA, 17 bp, Homo sapiens
tggcctggccagtgccc

SEQ ID NO: 6524183 - DNA, 17 bp, Homo sapiens
tggcctggcccccagct

SEQ ID NO: 6524184 - DNA, 18 bp, Homo sapiens
tggcctggcccctcaggg

SEQ ID NO: 6524185 - DNA, 15 bp, Homo sapiens
tggcctggccctcct

SEQ ID NO: 6524186 - DNA, 13 bp, Homo sapiens
tggcctggccctt

SEQ ID NO: 6524187 - DNA, 14 bp, Homo sapiens
tggcctggcctcca

SEQ ID NO: 6524188 - DNA, 16 bp, Homo sapiens
tggcctggcctccagc

SEQ ID NO: 6524189 - DNA, 18 bp, Homo sapiens
tggcctggcctggccctg

SEQ ID NO: 6524190 - DNA, 19 bp, Homo sapiens
tggcctggcctggccctgc

SEQ ID NO: 6524191 - DNA, 18 bp, Homo sapiens
tggcctggctccgctgtg

SEQ ID NO: 6524192 - DNA, 12 bp, Homo sapiens
tggcctggctct

SEQ ID NO: 6524193 - DNA, 17 bp, Homo sapiens
tggcctggctgcctggt

SEQ ID NO: 6524194 - DNA, 16 bp, Homo sapiens
tggcctggcttctcct

SEQ ID NO: 6524195 - DNA, 22 bp, Homo sapiens
tggcctggcttgtcggagcaag

SEQ ID NO: 6524196 - DNA, 14 bp, Homo sapiens
tggcctgggcctcc

SEQ ID NO: 6524197 - DNA, 16 bp, Homo sapiens
tggcctgggcttggcc

SEQ ID NO: 6524198 - DNA, 17 bp, Homo sapiens
tggcctgggtcccaggg

SEQ ID NO: 6524199 - DNA, 19 bp, Homo sapiens
tggcctgggtcccagggct

SEQ ID NO: 6524200 - DNA, 22 bp, Homo sapiens
tggcctgggtcccagggctggc

SEQ ID NO: 6524201 - DNA, 14 bp, Homo sapiens
tggcctgggtcctc

SEQ ID NO: 6524202 - DNA, 22 bp, Homo sapiens
tggcctgggtcctcggccctgt

SEQ ID NO: 6524203 - DNA, 23 bp, Homo sapiens
tggcctgggtcctcggccctgta

SEQ ID NO: 6524204 - DNA, 24 bp, Homo sapiens
tggcctgggtcctcggccctgtag

SEQ ID NO: 6524205 - DNA, 20 bp, Homo sapiens
tggcctggtaggtctggatt

SEQ ID NO: 6524206 - DNA, 18 bp, Homo sapiens
ttataaaccaatcttaaa

SEQ ID NO: 6524207 - DNA, 17 bp, Homo sapiens
ttataaaccaatgaaat

SEQ ID NO: 6524208 - DNA, 20 bp, Homo sapiens
ttataaaccacttgagccta

SEQ ID NO: 6524209 - DNA, 22 bp, Homo sapiens
ttataaactaccaaattagtga

SEQ ID NO: 6524210 - DNA, 14 bp, Homo sapiens
ttataaactataaa

SEQ ID NO: 6524211 - DNA, 11 bp, Homo sapiens
ttataaacttt

SEQ ID NO: 6524212 - DNA, 17 bp, Homo sapiens
ttataaactttaccttt

SEQ ID NO: 6524213 - DNA, 18 bp, Homo sapiens
ttataaactttacctttt

SEQ ID NO: 6524214 - DNA, 12 bp, Homo sapiens
ttataaactttt

SEQ ID NO: 6524215 - DNA, 16 bp, Homo sapiens
ttataaacttttttct

SEQ ID NO: 6524216 - DNA, 23 bp, Homo sapiens
ttataaagaccgtacaaactcag

SEQ ID NO: 6524217 - DNA, 17 bp, Homo sapiens
ttataaagagtgctaca

SEQ ID NO: 6524218 - DNA, 14 bp, Homo sapiens
ttataaagccaaga

SEQ ID NO: 6524219 - DNA, 12 bp, Homo sapiens
ttataaaggaat

SEQ ID NO: 6524220 - DNA, 19 bp, Homo sapiens
ttataaagtctaagcaaga

SEQ ID NO: 6524221 - DNA, 17 bp, Homo sapiens
ttataaagtgcttgtgt

SEQ ID NO: 6524222 - DNA, 19 bp, Homo sapiens
ttataaagtggacttctga

SEQ ID NO: 6524223 - DNA, 18 bp, Homo sapiens
ttataaataaaatcatgt

SEQ ID NO: 6524224 - DNA, 14 bp, Homo sapiens
ttataaataaacat

SEQ ID NO: 6524225 - DNA, 18 bp, Homo sapiens
ttataaataaatgccaac

SEQ ID NO: 6524226 - DNA, 16 bp, Homo sapiens
ttataaatagccttca

SEQ ID NO: 6524227 - DNA, 16 bp, Homo sapiens
ttataaatatatataa

SEQ ID NO: 6524228 - DNA, 17 bp, Homo sapiens
ttataaatatatataaa

SEQ ID NO: 6524229 - DNA, 15 bp, Homo sapiens
ttataaatatattta

SEQ ID NO: 6524230 - DNA, 16 bp, Homo sapiens
ttataaatatgtgaaa

SEQ ID NO: 6524231 - DNA, 20 bp, Homo sapiens
ttataaatatgtgaaaatga

SEQ ID NO: 6524232 - DNA, 23 bp, Homo sapiens
ttataaatcatattgatgaaaag

SEQ ID NO: 6524233 - DNA, 18 bp, Homo sapiens
ttataaatcttatgctct

SEQ ID NO: 6524234 - DNA, 14 bp, Homo sapiens
ttataaatgaaatt

SEQ ID NO: 6524235 - DNA, 21 bp, Homo sapiens
ttataaatgaaatttgcaaaa

SEQ ID NO: 6524236 - DNA, 14 bp, Homo sapiens
ttataaatgaagat

SEQ ID NO: 6524237 - DNA, 20 bp, Homo sapiens
ttataaatgagcaaatggaa

SEQ ID NO: 6524238 - DNA, 22 bp, Homo sapiens
ttataaatgcactgtaatatgt

SEQ ID NO: 6524239 - DNA, 24 bp, Homo sapiens
ttataaatgcattaaataagagtt

SEQ ID NO: 6524240 - DNA, 11 bp, Homo sapiens
ttataaatgtg

SEQ ID NO: 6524241 - DNA, 17 bp, Homo sapiens
ttataaatgtttcatga

SEQ ID NO: 6524242 - DNA, 18 bp, Homo sapiens
ttataaatgtttcatgaa

SEQ ID NO: 6524243 - DNA, 11 bp, Homo sapiens
ttataaattaa

SEQ ID NO: 6524244 - DNA, 13 bp, Homo sapiens
ttataaattaaat

SEQ ID NO: 6524245 - DNA, 16 bp, Homo sapiens
ttataaattatgttta

SEQ ID NO: 6524246 - DNA, 21 bp, Homo sapiens
ttataaattatgtttatataa

SEQ ID NO: 6524247 - DNA, 20 bp, Homo sapiens
ttataaattcataactggta

SEQ ID NO: 6524248 - DNA, 17 bp, Homo sapiens
ttataaattttgtacat

SEQ ID NO: 6524249 - DNA, 18 bp, Homo sapiens
ttataacaatataactga

SEQ ID NO: 6524250 - DNA, 22 bp, Homo sapiens
ttataacagcaaatgaaagact

SEQ ID NO: 6524251 - DNA, 16 bp, Homo sapiens
ttataacagttataaa

SEQ ID NO: 6524252 - DNA, 17 bp, Homo sapiens
ttataacattgtatgtt

SEQ ID NO: 6524253 - DNA, 18 bp, Homo sapiens
ttataacattgtatgtta

SEQ ID NO: 6524254 - DNA, 16 bp, Homo sapiens
ttataaccatgagaat

SEQ ID NO: 6524255 - DNA, 16 bp, Homo sapiens
ttataaccttaattta

SEQ ID NO: 6524256 - DNA, 19 bp, Homo sapiens
ttataaccttaatttatta

SEQ ID NO: 6524257 - DNA, 15 bp, Homo sapiens
ttataactaatatgg

SEQ ID NO: 6524258 - DNA, 12 bp, Homo sapiens
ttataactagac

SEQ ID NO: 6524259 - DNA, 23 bp, Homo sapiens
ttataactagacatctgctgtta

SEQ ID NO: 6524260 - DNA, 17 bp, Homo sapiens
ttataactatataaatg

SEQ ID NO: 6524261 - DNA, 18 bp, Homo sapiens
ttataactattacagtgt

SEQ ID NO: 6524262 - DNA, 16 bp, Homo sapiens
ttataactcatcataa

SEQ ID NO: 6524263 - DNA, 17 bp, Homo sapiens
ttataactcatcataaa

SEQ ID NO: 6524264 - DNA, 21 bp, Homo sapiens
ttataactcatcataaaataa

SEQ ID NO: 6524265 - DNA, 12 bp, Homo sapiens
ttataactcatg

SEQ ID NO: 6524266 - DNA, 16 bp, Homo sapiens
ttataactggaaagaa

SEQ ID NO: 6524267 - DNA, 20 bp, Homo sapiens
ttataactgttttagaaatt

SEQ ID NO: 6524268 - DNA, 15 bp, Homo sapiens
ttataacttaatgaa

SEQ ID NO: 6524269 - DNA, 16 bp, Homo sapiens
ttataacttattagca

SEQ ID NO: 6524270 - DNA, 15 bp, Homo sapiens
ttataacttctgaag

SEQ ID NO: 6524271 - DNA, 13 bp, Homo sapiens
ttataagaaaaat

SEQ ID NO: 6524272 - DNA, 20 bp, Homo sapiens
ttataagaaaaatgtgaatt

SEQ ID NO: 6524273 - DNA, 12 bp, Homo sapiens
ttataagaaaac

SEQ ID NO: 6524274 - DNA, 17 bp, Homo sapiens
ttataagaaaacatgta

SEQ ID NO: 6524275 - DNA, 12 bp, Homo sapiens
ttataagaaaca

SEQ ID NO: 6524276 - DNA, 18 bp, Homo sapiens
ttataagaagaagttcat

SEQ ID NO: 6524277 - DNA, 11 bp, Homo sapiens
ttataagaatt

SEQ ID NO: 6524278 - DNA, 18 bp, Homo sapiens
ttataagaattaatctta

SEQ ID NO: 6524279 - DNA, 19 bp, Homo sapiens
ttataagagagcttattgt

SEQ ID NO: 6524280 - DNA, 21 bp, Homo sapiens
ttataagagagcttattgttt

SEQ ID NO: 6524281 - DNA, 21 bp, Homo sapiens
ttataagagggcatatacagt

SEQ ID NO: 6524282 - DNA, 16 bp, Homo sapiens
ttataagcaacatgaa

SEQ ID NO: 6524283 - DNA, 23 bp, Homo sapiens
ttataagcacagacaattctaat

SEQ ID NO: 6524284 - DNA, 14 bp, Homo sapiens
ttataagcagattt

SEQ ID NO: 6524285 - DNA, 22 bp, Homo sapiens
ttataagcatcattatttatgt

SEQ ID NO: 6524286 - DNA, 12 bp, Homo sapiens
ttataagcattg

SEQ ID NO: 6524287 - DNA, 15 bp, Homo sapiens
ttataagcattgaaa

SEQ ID NO: 6524288 - DNA, 16 bp, Homo sapiens
ttataagcattgccat

SEQ ID NO: 6524289 - DNA, 17 bp, Homo sapiens
ttataagcccaaatggc

SEQ ID NO: 6524290 - DNA, 20 bp, Homo sapiens
ttataagcgtatttagactg

SEQ ID NO: 6524291 - DNA, 13 bp, Homo sapiens
ttataaggactgc

SEQ ID NO: 6524292 - DNA, 22 bp, Homo sapiens
ttataaggactgcatggtaatt

SEQ ID NO: 6524293 - DNA, 23 bp, Homo sapiens
ttataaggccatttccttttcac

SEQ ID NO: 6524294 - DNA, 22 bp, Homo sapiens
ttataaggtagtactgatttta

SEQ ID NO: 6524295 - DNA, 20 bp, Homo sapiens
ttataaggtgttttctgtgt

SEQ ID NO: 6524296 - DNA, 23 bp, Homo sapiens
ttataaggtgttttctgtgtaac

SEQ ID NO: 6524297 - DNA, 13 bp, Homo sapiens
ttataagtgactt

SEQ ID NO: 6524298 - DNA, 15 bp, Homo sapiens
ttataagttcacaaa

SEQ ID NO: 6524299 - DNA, 17 bp, Homo sapiens
ttataagttgaccttta

SEQ ID NO: 6524300 - DNA, 21 bp, Homo sapiens
ttataataaaaggaaaagcaa

SEQ ID NO: 6524301 - DNA, 14 bp, Homo sapiens
ttataataaactgt

SEQ ID NO: 6524302 - DNA, 21 bp, Homo sapiens
ttataataaaggactgtaatc

SEQ ID NO: 6524303 - DNA, 21 bp, Homo sapiens
ttataataaaggtcacataaa

SEQ ID NO: 6524304 - DNA, 16 bp, Homo sapiens
ttataataactgaact

SEQ ID NO: 6524305 - DNA, 17 bp, Homo sapiens
ttataataactgaactg

SEQ ID NO: 6524306 - DNA, 19 bp, Homo sapiens
ttataataagcaaaaagat

SEQ ID NO: 6524307 - DNA, 13 bp, Homo sapiens
ttataatactgtt

SEQ ID NO: 6524308 - DNA, 22 bp, Homo sapiens
ttataatactgttttaaaatgt

SEQ ID NO: 6524309 - DNA, 13 bp, Homo sapiens
ttataatagattt

SEQ ID NO: 6524310 - DNA, 14 bp, Homo sapiens
ttataatatagaaa

SEQ ID NO: 6524311 - DNA, 19 bp, Homo sapiens
ttataatatgtgccttaag

SEQ ID NO: 6524312 - DNA, 16 bp, Homo sapiens
ttataatattcataca

SEQ ID NO: 6524313 - DNA, 23 bp, Homo sapiens
ttataatcagaatggaagagaga

SEQ ID NO: 6524314 - DNA, 21 bp, Homo sapiens
ttataatcctcaagagaaaat

SEQ ID NO: 6524315 - DNA, 24 bp, Homo sapiens
ttataatccttaaatcttaatgtt

SEQ ID NO: 6524316 - DNA, 16 bp, Homo sapiens
ttataatctgaagata

SEQ ID NO: 6524317 - DNA, 13 bp, Homo sapiens
ttataatctgatg

SEQ ID NO: 6524318 - DNA, 20 bp, Homo sapiens
ttataatcttccatacttct

SEQ ID NO: 6524319 - DNA, 13 bp, Homo sapiens
ttataatgaagaa

SEQ ID NO: 6524320 - DNA, 14 bp, Homo sapiens
ttataatgaagaac

SEQ ID NO: 6524321 - DNA, 18 bp, Homo sapiens
ttataatgaatactttct

SEQ ID NO: 6524322 - DNA, 12 bp, Homo sapiens
ttataatgactg

SEQ ID NO: 6524323 - DNA, 19 bp, Homo sapiens
ttataatgaggatgattat

SEQ ID NO: 6524324 - DNA, 22 bp, Homo sapiens
ttataatgattaagggacattt

SEQ ID NO: 6524325 - DNA, 21 bp, Homo sapiens
ttataatgcaatgataaataa

SEQ ID NO: 6524326 - DNA, 16 bp, Homo sapiens
ttataatgccagaata

SEQ ID NO: 6524327 - DNA, 19 bp, Homo sapiens
ttataatggccctgtagct

SEQ ID NO: 6524328 - DNA, 13 bp, Homo sapiens
ttataatgtattc

SEQ ID NO: 6524329 - DNA, 14 bp, Homo sapiens
ttataatgtatttg

SEQ ID NO: 6524330 - DNA, 19 bp, Homo sapiens
ttataatgtatttgaaaat

SEQ ID NO: 6524331 - DNA, 20 bp, Homo sapiens
ttataatgtatttgaaaatt

SEQ ID NO: 6524332 - DNA, 16 bp, Homo sapiens
ttataatgtcaaatga

SEQ ID NO: 6524333 - DNA, 18 bp, Homo sapiens
ttataatgtcaaatgaaa

SEQ ID NO: 6524334 - DNA, 19 bp, Homo sapiens
ttataatgtggatttccta

SEQ ID NO: 6524335 - DNA, 20 bp, Homo sapiens
ttataatgttgtatttaatt

SEQ ID NO: 6524336 - DNA, 21 bp, Homo sapiens
ttataattaaagatgccatag

SEQ ID NO: 6524337 - DNA, 14 bp, Homo sapiens
ttataattaatgtt

SEQ ID NO: 6524338 - DNA, 13 bp, Homo sapiens
ttataattcataa

SEQ ID NO: 6524339 - DNA, 20 bp, Homo sapiens
ttataattgtacaaaattaa

SEQ ID NO: 6524340 - DNA, 14 bp, Homo sapiens
ttataattgtcatg

SEQ ID NO: 6524341 - DNA, 14 bp, Homo sapiens
ttataattgttgca

SEQ ID NO: 6524342 - DNA, 13 bp, Homo sapiens
ttataattgttta

SEQ ID NO: 6524343 - DNA, 15 bp, Homo sapiens
ttataattgtttata

SEQ ID NO: 6524344 - DNA, 19 bp, Homo sapiens
ttataatttataaatacag

SEQ ID NO: 6524345 - DNA, 17 bp, Homo sapiens
ttataatttctacccat

SEQ ID NO: 6524346 - DNA, 21 bp, Homo sapiens
ttataattttaaatgtttttt

SEQ ID NO: 6524347 - DNA, 18 bp, Homo sapiens
ttataattttactcactc

SEQ ID NO: 6524348 - DNA, 20 bp, Homo sapiens
ttataattttagtttatatt

SEQ ID NO: 6524349 - DNA, 16 bp, Homo sapiens
ttataattttatctgt

SEQ ID NO: 6524350 - DNA, 12 bp, Homo sapiens
ttataattttct

SEQ ID NO: 6524351 - DNA, 16 bp, Homo sapiens
ttatacaaaagagcat

SEQ ID NO: 6524352 - DNA, 22 bp, Homo sapiens
ttatacaaaagagcatggatgc

SEQ ID NO: 6524353 - DNA, 14 bp, Homo sapiens
ttatacaaaataat

SEQ ID NO: 6524354 - DNA, 20 bp, Homo sapiens
ttatacaaacctaccaaaat

SEQ ID NO: 6524355 - DNA, 15 bp, Homo sapiens
ttatacaaatgtctt

SEQ ID NO: 6524356 - DNA, 21 bp, Homo sapiens
ttatacaacagtgctaaaaat

SEQ ID NO: 6524357 - DNA, 13 bp, Homo sapiens
ttatacaataacc

SEQ ID NO: 6524358 - DNA, 17 bp, Homo sapiens
ttatacaataacccagt

SEQ ID NO: 6524359 - DNA, 23 bp, Homo sapiens
ttatacaataacccagttacttt

SEQ ID NO: 6524360 - DNA, 16 bp, Homo sapiens
ttatacacaactttgc

SEQ ID NO: 6524361 - DNA, 12 bp, Homo sapiens
ttatacacagaa

SEQ ID NO: 6524362 - DNA, 14 bp, Homo sapiens
ttatacacagaaaa

SEQ ID NO: 6524363 - DNA, 14 bp, Homo sapiens
ttatacacagttcc

SEQ ID NO: 6524364 - DNA, 18 bp, Homo sapiens
ttatacacagttccacaa

SEQ ID NO: 6524365 - DNA, 14 bp, Homo sapiens
ttatacacataatt

SEQ ID NO: 6524366 - DNA, 15 bp, Homo sapiens
ttatacaccagcaat

SEQ ID NO: 6524367 - DNA, 13 bp, Homo sapiens
ttatacactgtgt

SEQ ID NO: 6524368 - DNA, 22 bp, Homo sapiens
ttatacagaccgaactgttgta

SEQ ID NO: 6524369 - DNA, 20 bp, Homo sapiens
ttatacagacctaatatcat

SEQ ID NO: 6524370 - DNA, 13 bp, Homo sapiens
ttatacagagtaa

SEQ ID NO: 6524371 - DNA, 18 bp, Homo sapiens
ttatacagagtaattata

SEQ ID NO: 6524372 - DNA, 13 bp, Homo sapiens
ttatacagctgta

SEQ ID NO: 6524373 - DNA, 15 bp, Homo sapiens
ttatacagctgtatt

SEQ ID NO: 6524374 - DNA, 22 bp, Homo sapiens
ttatacaggtcatattaatata

SEQ ID NO: 6524375 - DNA, 16 bp, Homo sapiens
ttatacagtgtacatg

SEQ ID NO: 6524376 - DNA, 20 bp, Homo sapiens
ttatacagtgtacatgtaca

SEQ ID NO: 6524377 - DNA, 13 bp, Homo sapiens
ttatacataaaca

SEQ ID NO: 6524378 - DNA, 14 bp, Homo sapiens
ttatacataaacag

SEQ ID NO: 6524379 - DNA, 15 bp, Homo sapiens
ttatacataaacagt

SEQ ID NO: 6524380 - DNA, 14 bp, Homo sapiens
ttatacataataaa

SEQ ID NO: 6524381 - DNA, 22 bp, Homo sapiens
ttatacatagtcacaaaaatgg

SEQ ID NO: 6524382 - DNA, 14 bp, Homo sapiens
ttatacatatcaga

SEQ ID NO: 6524383 - DNA, 16 bp, Homo sapiens
ttatacatcacttcct

SEQ ID NO: 6524384 - DNA, 13 bp, Homo sapiens
ttatacatcttca

SEQ ID NO: 6524385 - DNA, 21 bp, Homo sapiens
ttatacattagtaaatgtctt

SEQ ID NO: 6524386 - DNA, 16 bp, Homo sapiens
tggcctggtccctggt

SEQ ID NO: 6524387 - DNA, 20 bp, Homo sapiens
tggcctggtccctggtcctt

SEQ ID NO: 6524388 - DNA, 23 bp, Homo sapiens
tggcctggtggccatgtcgcctg

SEQ ID NO: 6524389 - DNA, 17 bp, Homo sapiens
tggcctggtgggtcagg

SEQ ID NO: 6524390 - DNA, 18 bp, Homo sapiens
tggcctggtgggtcaggg

SEQ ID NO: 6524391 - DNA, 21 bp, Homo sapiens
tggcctggtgggtcaggggga

SEQ ID NO: 6524392 - DNA, 19 bp, Homo sapiens
tggcctggttgtttccgta

SEQ ID NO: 6524393 - DNA, 21 bp, Homo sapiens
tggcctgtagaatagcctgtg

SEQ ID NO: 6524394 - DNA, 21 bp, Homo sapiens
tggcctgtccctagggctctc

SEQ ID NO: 6524395 - DNA, 22 bp, Homo sapiens
tggcctgtccctagggctctcc

SEQ ID NO: 6524396 - DNA, 14 bp, Homo sapiens
tggcctgtctcatc

SEQ ID NO: 6524397 - DNA, 18 bp, Homo sapiens
tggcctgtctcatcccca

SEQ ID NO: 6524398 - DNA, 20 bp, Homo sapiens
tggcctgtctcatccccagg

SEQ ID NO: 6524399 - DNA, 24 bp, Homo sapiens
tggcctgtctcatccccaggggtc

SEQ ID NO: 6524400 - DNA, 17 bp, Homo sapiens
tggcctgtctccctagg

SEQ ID NO: 6524401 - DNA, 18 bp, Homo sapiens
tggcctgtgagcaagagc

SEQ ID NO: 6524402 - DNA, 21 bp, Homo sapiens
tggcctgtgagcaagagccag

SEQ ID NO: 6524403 - DNA, 21 bp, Homo sapiens
tggcctgtgatgttttatcct

SEQ ID NO: 6524404 - DNA, 21 bp, Homo sapiens
tggcctgtgcgatcccacccg

SEQ ID NO: 6524405 - DNA, 17 bp, Homo sapiens
tggcctgtgcttggagg

SEQ ID NO: 6524406 - DNA, 12 bp, Homo sapiens
tggcctgtggca

SEQ ID NO: 6524407 - DNA, 15 bp, Homo sapiens
tggcctgtggcacag

SEQ ID NO: 6524408 - DNA, 17 bp, Homo sapiens
tggcctgtggcaggcct

SEQ ID NO: 6524409 - DNA, 19 bp, Homo sapiens
tggcctgtggcaggcctag

SEQ ID NO: 6524410 - DNA, 12 bp, Homo sapiens
tggcctgtggct

SEQ ID NO: 6524411 - DNA, 16 bp, Homo sapiens
tggcctgtggctgtcg

SEQ ID NO: 6524412 - DNA, 15 bp, Homo sapiens
tggcctgtgggcctc

SEQ ID NO: 6524413 - DNA, 20 bp, Homo sapiens
tggcctgtgggcctcacctg

SEQ ID NO: 6524414 - DNA, 16 bp, Homo sapiens
tggcctgtgtcactca

SEQ ID NO: 6524415 - DNA, 16 bp, Homo sapiens
tggcctgtgtcccatg

SEQ ID NO: 6524416 - DNA, 20 bp, Homo sapiens
tggcctgtgtcccatgaccc

SEQ ID NO: 6524417 - DNA, 22 bp, Homo sapiens
tggcctgtgtcccatgacccac

SEQ ID NO: 6524418 - DNA, 20 bp, Homo sapiens
tggcctgtgtggccacttct

SEQ ID NO: 6524419 - DNA, 13 bp, Homo sapiens
tggcctgttccct

SEQ ID NO: 6524420 - DNA, 16 bp, Homo sapiens
tggcctgttccctaga

SEQ ID NO: 6524421 - DNA, 17 bp, Homo sapiens
tggcctgttccctagag

SEQ ID NO: 6524422 - DNA, 23 bp, Homo sapiens
tggcctgttctgtaggagagact

SEQ ID NO: 6524423 - DNA, 18 bp, Homo sapiens
tggcctgtttcaacacag

SEQ ID NO: 6524424 - DNA, 12 bp, Homo sapiens
tggcctgtttga

SEQ ID NO: 6524425 - DNA, 20 bp, Homo sapiens
tggcctgtttgatgtatgtg

SEQ ID NO: 6524426 - DNA, 23 bp, Homo sapiens
tggcctgtttgatgtatgtgtga

SEQ ID NO: 6524427 - DNA, 18 bp, Homo sapiens
tggccttaactggccctc

SEQ ID NO: 6524428 - DNA, 15 bp, Homo sapiens
tggccttaatttcct

SEQ ID NO: 6524429 - DNA, 16 bp, Homo sapiens
tggccttaatttcctt

SEQ ID NO: 6524430 - DNA, 15 bp, Homo sapiens
tggccttacccctgc

SEQ ID NO: 6524431 - DNA, 22 bp, Homo sapiens
tggccttccacgtcttcctcca

SEQ ID NO: 6524432 - DNA, 15 bp, Homo sapiens
tggccttccccagca

SEQ ID NO: 6524433 - DNA, 23 bp, Homo sapiens
tggccttccccagcatgcaccac

SEQ ID NO: 6524434 - DNA, 17 bp, Homo sapiens
tggccttccccagcctc

SEQ ID NO: 6524435 - DNA, 18 bp, Homo sapiens
tggccttcccgccggagg

SEQ ID NO: 6524436 - DNA, 22 bp, Homo sapiens
tggccttcccgccggaggccag

SEQ ID NO: 6524437 - DNA, 11 bp, Homo sapiens
tggccttccct

SEQ ID NO: 6524438 - DNA, 14 bp, Homo sapiens
tggccttcggcctc

SEQ ID NO: 6524439 - DNA, 18 bp, Homo sapiens
tggccttcggcctccatc

SEQ ID NO: 6524440 - DNA, 20 bp, Homo sapiens
tggccttcgtctccatctct

SEQ ID NO: 6524441 - DNA, 21 bp, Homo sapiens
tggccttctaggaatggagga

SEQ ID NO: 6524442 - DNA, 14 bp, Homo sapiens
tggccttctcagcc

SEQ ID NO: 6524443 - DNA, 18 bp, Homo sapiens
tggccttctcccctcttc

SEQ ID NO: 6524444 - DNA, 21 bp, Homo sapiens
tggccttctcccctcttctga

SEQ ID NO: 6524445 - DNA, 15 bp, Homo sapiens
tggccttgaaacagt

SEQ ID NO: 6524446 - DNA, 21 bp, Homo sapiens
tggccttgagcaagtcccatc

SEQ ID NO: 6524447 - DNA, 20 bp, Homo sapiens
tggccttgcagctggcccac

SEQ ID NO: 6524448 - DNA, 22 bp, Homo sapiens
tggccttgcccgtcgtgtgctg

SEQ ID NO: 6524449 - DNA, 23 bp, Homo sapiens
tggccttgcccgtcgtgtgctga

SEQ ID NO: 6524450 - DNA, 18 bp, Homo sapiens
tggccttgcctcggtggc

SEQ ID NO: 6524451 - DNA, 20 bp, Homo sapiens
tggccttggcatgggcgcag

SEQ ID NO: 6524452 - DNA, 14 bp, Homo sapiens
tggccttggccctg

SEQ ID NO: 6524453 - DNA, 14 bp, Homo sapiens
tggccttgggagga

SEQ ID NO: 6524454 - DNA, 21 bp, Homo sapiens
tggccttgggatccaggcccc

SEQ ID NO: 6524455 - DNA, 16 bp, Homo sapiens
tggccttgggccggtg

SEQ ID NO: 6524456 - DNA, 13 bp, Homo sapiens
tggccttgggcct

SEQ ID NO: 6524457 - DNA, 15 bp, Homo sapiens
tggccttggggccag

SEQ ID NO: 6524458 - DNA, 18 bp, Homo sapiens
tggccttgtaagaccctt

SEQ ID NO: 6524459 - DNA, 19 bp, Homo sapiens
tggccttgttctgtcacca

SEQ ID NO: 6524460 - DNA, 19 bp, Homo sapiens
tggcctttcaggtccaggc

SEQ ID NO: 6524461 - DNA, 11 bp, Homo sapiens
tggcctttcct

SEQ ID NO: 6524462 - DNA, 14 bp, Homo sapiens
tggcctttcctgga

SEQ ID NO: 6524463 - DNA, 15 bp, Homo sapiens
tggcctttcctggaa

SEQ ID NO: 6524464 - DNA, 15 bp, Homo sapiens
tggcctttccttccc

SEQ ID NO: 6524465 - DNA, 17 bp, Homo sapiens
tggcctttccttccctc

SEQ ID NO: 6524466 - DNA, 15 bp, Homo sapiens
tggcctttccttgta

SEQ ID NO: 6524467 - DNA, 13 bp, Homo sapiens
tggcctttcttct

SEQ ID NO: 6524468 - DNA, 14 bp, Homo sapiens
tggcctttgcattt

SEQ ID NO: 6524469 - DNA, 15 bp, Homo sapiens
tggcctttgcattta

SEQ ID NO: 6524470 - DNA, 14 bp, Homo sapiens
tggcctttggaccc

SEQ ID NO: 6524471 - DNA, 16 bp, Homo sapiens
tggcctttggacccag

SEQ ID NO: 6524472 - DNA, 21 bp, Homo sapiens
tggcctttggacccagggcct

SEQ ID NO: 6524473 - DNA, 20 bp, Homo sapiens
tggcctttgtaagacacaca

SEQ ID NO: 6524474 - DNA, 19 bp, Homo sapiens
tggcctttgtaagtgcagg

SEQ ID NO: 6524475 - DNA, 14 bp, Homo sapiens
tggcctttgtgctg

SEQ ID NO: 6524476 - DNA, 16 bp, Homo sapiens
tggcctttgtgctgcg

SEQ ID NO: 6524477 - DNA, 19 bp, Homo sapiens
tggcctttttcatttatct

SEQ ID NO: 6524478 - DNA, 22 bp, Homo sapiens
tggcctttttcatttatctata

SEQ ID NO: 6524479 - DNA, 15 bp, Homo sapiens
tggccttttttataa

SEQ ID NO: 6524480 - DNA, 22 bp, Homo sapiens
tggcgaagcctgagcaggcagg

SEQ ID NO: 6524481 - DNA, 18 bp, Homo sapiens
tggcgaatctcaaaatta

SEQ ID NO: 6524482 - DNA, 15 bp, Homo sapiens
tggcgacaagagtga

SEQ ID NO: 6524483 - DNA, 17 bp, Homo sapiens
tggcgacactcagggca

SEQ ID NO: 6524484 - DNA, 19 bp, Homo sapiens
tggcgacactcagggcagc

SEQ ID NO: 6524485 - DNA, 23 bp, Homo sapiens
tggcgacactcagggcagctgcc

SEQ ID NO: 6524486 - DNA, 14 bp, Homo sapiens
tggcgaccaccaaa

SEQ ID NO: 6524487 - DNA, 15 bp, Homo sapiens
tggcgaccaccaaag

SEQ ID NO: 6524488 - DNA, 18 bp, Homo sapiens
tggcgactctgcagagtc

SEQ ID NO: 6524489 - DNA, 15 bp, Homo sapiens
tggcgagaggagagg

SEQ ID NO: 6524490 - DNA, 16 bp, Homo sapiens
tggcgagaggagagga

SEQ ID NO: 6524491 - DNA, 14 bp, Homo sapiens
tggcgagccatttg

SEQ ID NO: 6524492 - DNA, 16 bp, Homo sapiens
tggcgatctcccaggg

SEQ ID NO: 6524493 - DNA, 18 bp, Homo sapiens
tggcgatctcccagggct

SEQ ID NO: 6524494 - DNA, 23 bp, Homo sapiens
tggcgatggggactctgccgctg

SEQ ID NO: 6524495 - DNA, 18 bp, Homo sapiens
tggcgcaaggtcctcttg

SEQ ID NO: 6524496 - DNA, 16 bp, Homo sapiens
tggcgcaatctcggct

SEQ ID NO: 6524497 - DNA, 16 bp, Homo sapiens
tggcgcaccctcccct

SEQ ID NO: 6524498 - DNA, 21 bp, Homo sapiens
tggcgcaggtgccatgcctgc

SEQ ID NO: 6524499 - DNA, 22 bp, Homo sapiens
tggcgcaggtgccatgcctgct

SEQ ID NO: 6524500 - DNA, 16 bp, Homo sapiens
tggcgcaggtgggctg

SEQ ID NO: 6524501 - DNA, 13 bp, Homo sapiens
tggcgcagtgcct

SEQ ID NO: 6524502 - DNA, 15 bp, Homo sapiens
tggcgcagtgcctct

SEQ ID NO: 6524503 - DNA, 13 bp, Homo sapiens
tggcgccaggggc

SEQ ID NO: 6524504 - DNA, 20 bp, Homo sapiens
tggcgccaggggcaggcagc

SEQ ID NO: 6524505 - DNA, 17 bp, Homo sapiens
tggcgccatctcggctc

SEQ ID NO: 6524506 - DNA, 21 bp, Homo sapiens
tggcgcccatcctagtgggca

SEQ ID NO: 6524507 - DNA, 23 bp, Homo sapiens
tggcgcccatcctagtgggcact

SEQ ID NO: 6524508 - DNA, 12 bp, Homo sapiens
tggcgccccatg

SEQ ID NO: 6524509 - DNA, 21 bp, Homo sapiens
tggcgccccatgggccctcag

SEQ ID NO: 6524510 - DNA, 17 bp, Homo sapiens
tggcgccccctggtggg

SEQ ID NO: 6524511 - DNA, 20 bp, Homo sapiens
tggcgccccctggtgggaca

SEQ ID NO: 6524512 - DNA, 22 bp, Homo sapiens
tggcgcccctgcctgtgcccgc

SEQ ID NO: 6524513 - DNA, 14 bp, Homo sapiens
tggcgccctgcctc

SEQ ID NO: 6524514 - DNA, 15 bp, Homo sapiens
tggcgccctgcctcc

SEQ ID NO: 6524515 - DNA, 12 bp, Homo sapiens
tggcgccctgcg

SEQ ID NO: 6524516 - DNA, 19 bp, Homo sapiens
tggcgccctgcgtaaccct

SEQ ID NO: 6524517 - DNA, 15 bp, Homo sapiens
tggcgccgtctccag

SEQ ID NO: 6524518 - DNA, 18 bp, Homo sapiens
tggcgccgtctccagggg

SEQ ID NO: 6524519 - DNA, 22 bp, Homo sapiens
tggcgccttctcggagctggcc

SEQ ID NO: 6524520 - DNA, 18 bp, Homo sapiens
tggcgcgatctcagctca

SEQ ID NO: 6524521 - DNA, 16 bp, Homo sapiens
tggcgcgggaggcacc

SEQ ID NO: 6524522 - DNA, 20 bp, Homo sapiens
tggcgcgggaggcaccagct

SEQ ID NO: 6524523 - DNA, 14 bp, Homo sapiens
tggcgctcagaccc

SEQ ID NO: 6524524 - DNA, 13 bp, Homo sapiens
tggcgctcagcag

SEQ ID NO: 6524525 - DNA, 14 bp, Homo sapiens
tggcgctctcagct

SEQ ID NO: 6524526 - DNA, 12 bp, Homo sapiens
tggcgctggtgc

SEQ ID NO: 6524527 - DNA, 21 bp, Homo sapiens
tggcgctgtgctagctttcct

SEQ ID NO: 6524528 - DNA, 17 bp, Homo sapiens
tggcgcttggatctggg

SEQ ID NO: 6524529 - DNA, 14 bp, Homo sapiens
tggcggaacctggc

SEQ ID NO: 6524530 - DNA, 16 bp, Homo sapiens
tggcggaacctggctg

SEQ ID NO: 6524531 - DNA, 19 bp, Homo sapiens
tggcggagaaggagaggaa

SEQ ID NO: 6524532 - DNA, 16 bp, Homo sapiens
tggcggaggctgctcg

SEQ ID NO: 6524533 - DNA, 12 bp, Homo sapiens
tggcggcacaca

SEQ ID NO: 6524534 - DNA, 21 bp, Homo sapiens
tggcggccccaactcgggctc

SEQ ID NO: 6524535 - DNA, 20 bp, Homo sapiens
tggcggcccctcagcctgcc

SEQ ID NO: 6524536 - DNA, 23 bp, Homo sapiens
tggcggcccttctgactgtttat

SEQ ID NO: 6524537 - DNA, 22 bp, Homo sapiens
tggcggctactcagcagccctc

SEQ ID NO: 6524538 - DNA, 20 bp, Homo sapiens
tggcggctctagccccagcg

SEQ ID NO: 6524539 - DNA, 20 bp, Homo sapiens
tggcggctggggtcccagca

SEQ ID NO: 6524540 - DNA, 20 bp, Homo sapiens
tggcgggaagggtgggccct

SEQ ID NO: 6524541 - DNA, 22 bp, Homo sapiens
tggcgggaagggtgggccctgg

SEQ ID NO: 6524542 - DNA, 23 bp, Homo sapiens
tggcgggaagggtgggccctgga

SEQ ID NO: 6524543 - DNA, 16 bp, Homo sapiens
tggcgggactggagaa

SEQ ID NO: 6524544 - DNA, 16 bp, Homo sapiens
tggcgggatgggccac

SEQ ID NO: 6524545 - DNA, 23 bp, Homo sapiens
tggcgggcagcccagcctctgtc

SEQ ID NO: 6524546 - DNA, 21 bp, Homo sapiens
tggcgggcctttttcctgcgt

SEQ ID NO: 6524547 - DNA, 17 bp, Homo sapiens
tggcgggcgcctgtagt

SEQ ID NO: 6524548 - DNA, 18 bp, Homo sapiens
tggcgggctggtgacctt

SEQ ID NO: 6524549 - DNA, 14 bp, Homo sapiens
tggcggggaaccct

SEQ ID NO: 6524550 - DNA, 17 bp, Homo sapiens
tggcggggaggaggaaa

SEQ ID NO: 6524551 - DNA, 20 bp, Homo sapiens
tggcggggatctgggagggt

SEQ ID NO: 6524552 - DNA, 15 bp, Homo sapiens
tggcggggcagcagg

SEQ ID NO: 6524553 - DNA, 12 bp, Homo sapiens
tggcggggcagg

SEQ ID NO: 6524554 - DNA, 14 bp, Homo sapiens
tggcggggcaggag

SEQ ID NO: 6524555 - DNA, 17 bp, Homo sapiens
tggcggggcaggaggcc

SEQ ID NO: 6524556 - DNA, 14 bp, Homo sapiens
tggcggggcccctg

SEQ ID NO: 6524557 - DNA, 19 bp, Homo sapiens
tggcggggtctgctcctgg

SEQ ID NO: 6524558 - DNA, 21 bp, Homo sapiens
tggcggggtctgctcctggga

SEQ ID NO: 6524559 - DNA, 15 bp, Homo sapiens
tggcggggtggggtg

SEQ ID NO: 6524560 - DNA, 15 bp, Homo sapiens
tggcgggtgggggtg

SEQ ID NO: 6524561 - DNA, 15 bp, Homo sapiens
tggcgtaagtacaga

SEQ ID NO: 6524562 - DNA, 17 bp, Homo sapiens
tggcgtaagtacagaga

SEQ ID NO: 6524563 - DNA, 20 bp, Homo sapiens
tggcgtaagtacagagaagc

SEQ ID NO: 6524564 - DNA, 12 bp, Homo sapiens
ttatacatttgg

SEQ ID NO: 6524565 - DNA, 16 bp, Homo sapiens
ttataccaaaatgttg

SEQ ID NO: 6524566 - DNA, 22 bp, Homo sapiens
ttataccagcaaagagaatgta

SEQ ID NO: 6524567 - DNA, 22 bp, Homo sapiens
ttataccagcttaatagctgta

SEQ ID NO: 6524568 - DNA, 19 bp, Homo sapiens
ttataccaggttacctcac

SEQ ID NO: 6524569 - DNA, 14 bp, Homo sapiens
ttataccagtgtta

SEQ ID NO: 6524570 - DNA, 22 bp, Homo sapiens
ttatacccaaccccagatgccc

SEQ ID NO: 6524571 - DNA, 18 bp, Homo sapiens
ttataccccaataatcaa

SEQ ID NO: 6524572 - DNA, 14 bp, Homo sapiens
ttataccccatata

SEQ ID NO: 6524573 - DNA, 15 bp, Homo sapiens
ttatacctacctgtg

SEQ ID NO: 6524574 - DNA, 16 bp, Homo sapiens
ttatacctacctgtgt

SEQ ID NO: 6524575 - DNA, 19 bp, Homo sapiens
ttatacctcaaactatctg

SEQ ID NO: 6524576 - DNA, 14 bp, Homo sapiens
ttatacctgtttaa

SEQ ID NO: 6524577 - DNA, 15 bp, Homo sapiens
ttatacctgtttaaa

SEQ ID NO: 6524578 - DNA, 16 bp, Homo sapiens
ttatacgaaataattg

SEQ ID NO: 6524579 - DNA, 22 bp, Homo sapiens
ttatacgctggcaacacagagg

SEQ ID NO: 6524580 - DNA, 16 bp, Homo sapiens
ttatactaagaaaaga

SEQ ID NO: 6524581 - DNA, 15 bp, Homo sapiens
ttatactatattaac

SEQ ID NO: 6524582 - DNA, 16 bp, Homo sapiens
ttatactgaagctagt

SEQ ID NO: 6524583 - DNA, 13 bp, Homo sapiens
ttatactgattat

SEQ ID NO: 6524584 - DNA, 14 bp, Homo sapiens
ttatactggcatgc

SEQ ID NO: 6524585 - DNA, 20 bp, Homo sapiens
ttatactgggtttcaagaaa

SEQ ID NO: 6524586 - DNA, 13 bp, Homo sapiens
ttatactgtacaa

SEQ ID NO: 6524587 - DNA, 14 bp, Homo sapiens
ttatactgtacaat

SEQ ID NO: 6524588 - DNA, 20 bp, Homo sapiens
ttatactgtagcaatatatt

SEQ ID NO: 6524589 - DNA, 23 bp, Homo sapiens
ttatactgtagcaatatatttgt

SEQ ID NO: 6524590 - DNA, 16 bp, Homo sapiens
ttatactgtgaagtta

SEQ ID NO: 6524591 - DNA, 13 bp, Homo sapiens
ttatacttcaaaa

SEQ ID NO: 6524592 - DNA, 18 bp, Homo sapiens
ttatactttccctaccct

SEQ ID NO: 6524593 - DNA, 21 bp, Homo sapiens
ttatactttgcaatccaaata

SEQ ID NO: 6524594 - DNA, 18 bp, Homo sapiens
ttatactttgtaaagaca

SEQ ID NO: 6524595 - DNA, 16 bp, Homo sapiens
ttatactttgttgttt

SEQ ID NO: 6524596 - DNA, 19 bp, Homo sapiens
ttatactttgttgttttta

SEQ ID NO: 6524597 - DNA, 14 bp, Homo sapiens
ttatagaaaaggaa

SEQ ID NO: 6524598 - DNA, 19 bp, Homo sapiens
ttatagaaaatgcattatt

SEQ ID NO: 6524599 - DNA, 21 bp, Homo sapiens
ttatagaaaatgcattattta

SEQ ID NO: 6524600 - DNA, 16 bp, Homo sapiens
ttatagaaatttacta

SEQ ID NO: 6524601 - DNA, 22 bp, Homo sapiens
ttatagaacatattttccttta

SEQ ID NO: 6524602 - DNA, 12 bp, Homo sapiens
ttatagaagaaa

SEQ ID NO: 6524603 - DNA, 15 bp, Homo sapiens
ttatagaagaatgca

SEQ ID NO: 6524604 - DNA, 19 bp, Homo sapiens
ttatagaagaatgcatgct

SEQ ID NO: 6524605 - DNA, 12 bp, Homo sapiens
ttatagaataaa

SEQ ID NO: 6524606 - DNA, 19 bp, Homo sapiens
ttatagaataaaagctgtg

SEQ ID NO: 6524607 - DNA, 20 bp, Homo sapiens
ttatagaataaaagctgtgg

SEQ ID NO: 6524608 - DNA, 22 bp, Homo sapiens
ttatagaataaaagctgtggaa

SEQ ID NO: 6524609 - DNA, 16 bp, Homo sapiens
ttatagaatatggact

SEQ ID NO: 6524610 - DNA, 16 bp, Homo sapiens
ttatagacaaaagaat

SEQ ID NO: 6524611 - DNA, 17 bp, Homo sapiens
ttatagacaccctggca

SEQ ID NO: 6524612 - DNA, 14 bp, Homo sapiens
ttatagagaatgat

SEQ ID NO: 6524613 - DNA, 13 bp, Homo sapiens
ttatagagcacaa

SEQ ID NO: 6524614 - DNA, 15 bp, Homo sapiens
ttatagagcagaaat

SEQ ID NO: 6524615 - DNA, 22 bp, Homo sapiens
ttatagagcagaaattctgttt

SEQ ID NO: 6524616 - DNA, 17 bp, Homo sapiens
ttatagagcctcaattt

SEQ ID NO: 6524617 - DNA, 21 bp, Homo sapiens
ttatagaggctagcttctgct

SEQ ID NO: 6524618 - DNA, 23 bp, Homo sapiens
ttatagagtgtacttaactattc

SEQ ID NO: 6524619 - DNA, 19 bp, Homo sapiens
ttatagagttattatagtt

SEQ ID NO: 6524620 - DNA, 12 bp, Homo sapiens
ttatagatgcaa

SEQ ID NO: 6524621 - DNA, 14 bp, Homo sapiens
ttatagattctaaa

SEQ ID NO: 6524622 - DNA, 17 bp, Homo sapiens
ttatagattgtcttaat

SEQ ID NO: 6524623 - DNA, 15 bp, Homo sapiens
ttatagatttgacct

SEQ ID NO: 6524624 - DNA, 21 bp, Homo sapiens
ttatagcaaaaatgttttcca

SEQ ID NO: 6524625 - DNA, 17 bp, Homo sapiens
ttatagcaaagttatct

SEQ ID NO: 6524626 - DNA, 18 bp, Homo sapiens
ttatagcaacaacaattg

SEQ ID NO: 6524627 - DNA, 22 bp, Homo sapiens
ttatagcaagatattgatcaaa

SEQ ID NO: 6524628 - DNA, 14 bp, Homo sapiens
ttatagcactttga

SEQ ID NO: 6524629 - DNA, 22 bp, Homo sapiens
ttatagccacatccctttgaaa

SEQ ID NO: 6524630 - DNA, 17 bp, Homo sapiens
ttatagcctctgtctgg

SEQ ID NO: 6524631 - DNA, 16 bp, Homo sapiens
ttatagcgcctgtata

SEQ ID NO: 6524632 - DNA, 17 bp, Homo sapiens
ttatagctattactgtc

SEQ ID NO: 6524633 - DNA, 16 bp, Homo sapiens
ttatagctcagtttat

SEQ ID NO: 6524634 - DNA, 15 bp, Homo sapiens
ttatagctcatttgt

SEQ ID NO: 6524635 - DNA, 13 bp, Homo sapiens
ttataggaaaaaa

SEQ ID NO: 6524636 - DNA, 18 bp, Homo sapiens
ttataggaaaaaaactgg

SEQ ID NO: 6524637 - DNA, 18 bp, Homo sapiens
ttataggaaataaatcta

SEQ ID NO: 6524638 - DNA, 19 bp, Homo sapiens
ttataggaatagaggaaga

SEQ ID NO: 6524639 - DNA, 21 bp, Homo sapiens
ttataggagagattgggagaa

SEQ ID NO: 6524640 - DNA, 15 bp, Homo sapiens
ttataggataactga

SEQ ID NO: 6524641 - DNA, 24 bp, Homo sapiens
ttataggatttatttaaaatagca

SEQ ID NO: 6524642 - DNA, 18 bp, Homo sapiens
ttataggcagatctttaa

SEQ ID NO: 6524643 - DNA, 16 bp, Homo sapiens
ttataggcgttttttg

SEQ ID NO: 6524644 - DNA, 20 bp, Homo sapiens
ttataggctagacttagatt

SEQ ID NO: 6524645 - DNA, 15 bp, Homo sapiens
ttataggtaaaatct

SEQ ID NO: 6524646 - DNA, 14 bp, Homo sapiens
ttataggtgagaaa

SEQ ID NO: 6524647 - DNA, 18 bp, Homo sapiens
ttataggtgagaaaaaaa

SEQ ID NO: 6524648 - DNA, 19 bp, Homo sapiens
ttataggtggcctctcctt

SEQ ID NO: 6524649 - DNA, 22 bp, Homo sapiens
ttataggtgttggttttggggg

SEQ ID NO: 6524650 - DNA, 13 bp, Homo sapiens
ttatagtaatgag

SEQ ID NO: 6524651 - DNA, 17 bp, Homo sapiens
ttatagtacatgataaa

SEQ ID NO: 6524652 - DNA, 17 bp, Homo sapiens
ttatagtactagagata

SEQ ID NO: 6524653 - DNA, 16 bp, Homo sapiens
ttatagtactgacaga

SEQ ID NO: 6524654 - DNA, 17 bp, Homo sapiens
ttatagtactgctttac

SEQ ID NO: 6524655 - DNA, 14 bp, Homo sapiens
ttatagtattaagt

SEQ ID NO: 6524656 - DNA, 16 bp, Homo sapiens
ttatagtcaatggctt

SEQ ID NO: 6524657 - DNA, 22 bp, Homo sapiens
ttatagtcatttattttaaaaa

SEQ ID NO: 6524658 - DNA, 21 bp, Homo sapiens
ttatagtcctcctggaacttg

SEQ ID NO: 6524659 - DNA, 20 bp, Homo sapiens
ttatagtctaagactatata

SEQ ID NO: 6524660 - DNA, 20 bp, Homo sapiens
ttatagtctatgtgattctg

SEQ ID NO: 6524661 - DNA, 17 bp, Homo sapiens
ttatagtctcaaatcaa

SEQ ID NO: 6524662 - DNA, 15 bp, Homo sapiens
ttatagtctgtactt

SEQ ID NO: 6524663 - DNA, 15 bp, Homo sapiens
ttatagtcttagtaa

SEQ ID NO: 6524664 - DNA, 16 bp, Homo sapiens
ttatagtgaagtgtta

SEQ ID NO: 6524665 - DNA, 17 bp, Homo sapiens
ttatagtgaagtgttaa

SEQ ID NO: 6524666 - DNA, 21 bp, Homo sapiens
ttatagtgatgtaatcttgaa

SEQ ID NO: 6524667 - DNA, 13 bp, Homo sapiens
ttatagtgcaata

SEQ ID NO: 6524668 - DNA, 17 bp, Homo sapiens
ttatagtgcaatatatt

SEQ ID NO: 6524669 - DNA, 16 bp, Homo sapiens
ttatagtggaaaaaca

SEQ ID NO: 6524670 - DNA, 20 bp, Homo sapiens
ttatagtggtgttttaaaga

SEQ ID NO: 6524671 - DNA, 21 bp, Homo sapiens
ttatagtgtttggacagctga

SEQ ID NO: 6524672 - DNA, 13 bp, Homo sapiens
ttatagttaatct

SEQ ID NO: 6524673 - DNA, 14 bp, Homo sapiens
ttatagttatgtct

SEQ ID NO: 6524674 - DNA, 16 bp, Homo sapiens
ttatagttattaaatg

SEQ ID NO: 6524675 - DNA, 16 bp, Homo sapiens
ttatagttcatagttg

SEQ ID NO: 6524676 - DNA, 14 bp, Homo sapiens
ttatagttgaagat

SEQ ID NO: 6524677 - DNA, 13 bp, Homo sapiens
ttatagtttgaca

SEQ ID NO: 6524678 - DNA, 19 bp, Homo sapiens
ttatataaagagaaaattg

SEQ ID NO: 6524679 - DNA, 22 bp, Homo sapiens
ttatataaagagaaaattgaat

SEQ ID NO: 6524680 - DNA, 18 bp, Homo sapiens
ttatataaagtattcttt

SEQ ID NO: 6524681 - DNA, 22 bp, Homo sapiens
ttatataaagtattctttttct

SEQ ID NO: 6524682 - DNA, 13 bp, Homo sapiens
ttatataaatata

SEQ ID NO: 6524683 - DNA, 14 bp, Homo sapiens
ttatataaatatat

SEQ ID NO: 6524684 - DNA, 13 bp, Homo sapiens
ttatataaatgct

SEQ ID NO: 6524685 - DNA, 20 bp, Homo sapiens
ttatataacaaaaaaggttt

SEQ ID NO: 6524686 - DNA, 15 bp, Homo sapiens
ttatataactctttg

SEQ ID NO: 6524687 - DNA, 12 bp, Homo sapiens
ttatataactgt

SEQ ID NO: 6524688 - DNA, 22 bp, Homo sapiens
ttatataactgtatttgaaata

SEQ ID NO: 6524689 - DNA, 14 bp, Homo sapiens
ttatataaggcatt

SEQ ID NO: 6524690 - DNA, 19 bp, Homo sapiens
ttatataagtctgttattt

SEQ ID NO: 6524691 - DNA, 18 bp, Homo sapiens
ttatataatatctaaagt

SEQ ID NO: 6524692 - DNA, 16 bp, Homo sapiens
ttatataattatgtta

SEQ ID NO: 6524693 - DNA, 17 bp, Homo sapiens
ttatataattatgttat

SEQ ID NO: 6524694 - DNA, 22 bp, Homo sapiens
ttatataattcactcaagcact

SEQ ID NO: 6524695 - DNA, 16 bp, Homo sapiens
ttatataattgttgaa

SEQ ID NO: 6524696 - DNA, 15 bp, Homo sapiens
ttatatacaaagctg

SEQ ID NO: 6524697 - DNA, 21 bp, Homo sapiens
ttatatacagaggaaatctgt

SEQ ID NO: 6524698 - DNA, 15 bp, Homo sapiens
ttatatactgctatt

SEQ ID NO: 6524699 - DNA, 15 bp, Homo sapiens
ttatatactttttca

SEQ ID NO: 6524700 - DNA, 18 bp, Homo sapiens
ttatatagcaaagatata

SEQ ID NO: 6524701 - DNA, 13 bp, Homo sapiens
ttatatagcaaga

SEQ ID NO: 6524702 - DNA, 19 bp, Homo sapiens
ttatatagcaagacattat

SEQ ID NO: 6524703 - DNA, 17 bp, Homo sapiens
ttatatagcatctggaa

SEQ ID NO: 6524704 - DNA, 13 bp, Homo sapiens
ttatatagcttga

SEQ ID NO: 6524705 - DNA, 14 bp, Homo sapiens
ttatatagcttgaa

SEQ ID NO: 6524706 - DNA, 18 bp, Homo sapiens
ttatataggttgtgcaaa

SEQ ID NO: 6524707 - DNA, 23 bp, Homo sapiens
ttatataggttttgtttgctatc

SEQ ID NO: 6524708 - DNA, 19 bp, Homo sapiens
ttatatagtctacagttgt

SEQ ID NO: 6524709 - DNA, 18 bp, Homo sapiens
ttatatataaaaagaaac

SEQ ID NO: 6524710 - DNA, 16 bp, Homo sapiens
ttatatataaaataaa

SEQ ID NO: 6524711 - DNA, 22 bp, Homo sapiens
ttatatataaaataaatatact

SEQ ID NO: 6524712 - DNA, 14 bp, Homo sapiens
ttatatataaatat

SEQ ID NO: 6524713 - DNA, 15 bp, Homo sapiens
ttatatataaatata

SEQ ID NO: 6524714 - DNA, 12 bp, Homo sapiens
ttatatataata

SEQ ID NO: 6524715 - DNA, 13 bp, Homo sapiens
ttatatataataa

SEQ ID NO: 6524716 - DNA, 13 bp, Homo sapiens
ttatatatacatt

SEQ ID NO: 6524717 - DNA, 12 bp, Homo sapiens
ttatatatagaa

SEQ ID NO: 6524718 - DNA, 15 bp, Homo sapiens
ttatatatatagttt

SEQ ID NO: 6524719 - DNA, 18 bp, Homo sapiens
ttatatatatatgtatat

SEQ ID NO: 6524720 - DNA, 12 bp, Homo sapiens
ttatatatatct

SEQ ID NO: 6524721 - DNA, 15 bp, Homo sapiens
ttatatatatctata

SEQ ID NO: 6524722 - DNA, 23 bp, Homo sapiens
ttatatatattgttaaatccttt

SEQ ID NO: 6524723 - DNA, 16 bp, Homo sapiens
ttatatatcagttata

SEQ ID NO: 6524724 - DNA, 13 bp, Homo sapiens
ttatatatcataa

SEQ ID NO: 6524725 - DNA, 20 bp, Homo sapiens
ttatatatcataaagtatgc

SEQ ID NO: 6524726 - DNA, 18 bp, Homo sapiens
ttatatatgaagttgtat

SEQ ID NO: 6524727 - DNA, 20 bp, Homo sapiens
ttatatatgaatattacatg

SEQ ID NO: 6524728 - DNA, 15 bp, Homo sapiens
ttatatatggcatat

SEQ ID NO: 6524729 - DNA, 13 bp, Homo sapiens
ttatatatgtata

SEQ ID NO: 6524730 - DNA, 13 bp, Homo sapiens
ttatatatgtgaa

SEQ ID NO: 6524731 - DNA, 15 bp, Homo sapiens
ttatatattataagt

SEQ ID NO: 6524732 - DNA, 17 bp, Homo sapiens
ttatatattatatggaa

SEQ ID NO: 6524733 - DNA, 21 bp, Homo sapiens
ttatatattatgtgaagaatt

SEQ ID NO: 6524734 - DNA, 22 bp, Homo sapiens
ttatatattatgtgaagaattt

SEQ ID NO: 6524735 - DNA, 22 bp, Homo sapiens
ttatatattggtaacatccttt

SEQ ID NO: 6524736 - DNA, 16 bp, Homo sapiens
ttatatatttaaaagt

SEQ ID NO: 6524737 - DNA, 18 bp, Homo sapiens
ttatatatttaacatgtg

SEQ ID NO: 6524738 - DNA, 14 bp, Homo sapiens
ttatatatttacag

SEQ ID NO: 6524739 - DNA, 13 bp, Homo sapiens
ttatatatttata

SEQ ID NO: 6524740 - DNA, 15 bp, Homo sapiens
ttatatatttataac

SEQ ID NO: 6524741 - DNA, 12 bp, Homo sapiens
ttatatatttct

SEQ ID NO: 6524742 - DNA, 18 bp, Homo sapiens
ttatatattttgttgttc

SEQ ID NO: 6524743 - DNA, 23 bp, Homo sapiens
ttatatattttgttgttcctcta

SEQ ID NO: 6524744 - DNA, 14 bp, Homo sapiens
ttatatcaaagtat

SEQ ID NO: 6524745 - DNA, 23 bp, Homo sapiens
tggcgtaagtacagagaagccat

SEQ ID NO: 6524746 - DNA, 23 bp, Homo sapiens
tggcgtagagggtgctgccccat

SEQ ID NO: 6524747 - DNA, 17 bp, Homo sapiens
tggcgtaggctacagag

SEQ ID NO: 6524748 - DNA, 22 bp, Homo sapiens
tggcgtaggctacagagaagcc

SEQ ID NO: 6524749 - DNA, 14 bp, Homo sapiens
tggcgtctgctctg

SEQ ID NO: 6524750 - DNA, 15 bp, Homo sapiens
tggcgtctgctctgg

SEQ ID NO: 6524751 - DNA, 14 bp, Homo sapiens
tggcgtgaacccag

SEQ ID NO: 6524752 - DNA, 21 bp, Homo sapiens
tggcgtgacggtaaccccata

SEQ ID NO: 6524753 - DNA, 15 bp, Homo sapiens
tggcgtgagaggcaa

SEQ ID NO: 6524754 - DNA, 15 bp, Homo sapiens
tggcgtgatatccat

SEQ ID NO: 6524755 - DNA, 22 bp, Homo sapiens
tggcgtgcagtggtgcgatctg

SEQ ID NO: 6524756 - DNA, 21 bp, Homo sapiens
tggcgtgctcagacccaacag

SEQ ID NO: 6524757 - DNA, 14 bp, Homo sapiens
tggcgtggagcagg

SEQ ID NO: 6524758 - DNA, 15 bp, Homo sapiens
tggcgtggagcaggc

SEQ ID NO: 6524759 - DNA, 13 bp, Homo sapiens
tggcgtggattaa

SEQ ID NO: 6524760 - DNA, 14 bp, Homo sapiens
tggcgtggcctccc

SEQ ID NO: 6524761 - DNA, 20 bp, Homo sapiens
tggcgtggggggagctctgg

SEQ ID NO: 6524762 - DNA, 18 bp, Homo sapiens
tggcgtgtccctctcgga

SEQ ID NO: 6524763 - DNA, 16 bp, Homo sapiens
tggcgttatggcagcc

SEQ ID NO: 6524764 - DNA, 23 bp, Homo sapiens
tggcgttatggcagcccggctgc

SEQ ID NO: 6524765 - DNA, 22 bp, Homo sapiens
tggcgttcacctccctgctcag

SEQ ID NO: 6524766 - DNA, 23 bp, Homo sapiens
tggcgttcacctccctgctcagt

SEQ ID NO: 6524767 - DNA, 19 bp, Homo sapiens
tggcgttctcaagaatcta

SEQ ID NO: 6524768 - DNA, 23 bp, Homo sapiens
tggcgtttttctcgtccccctcc

SEQ ID NO: 6524769 - DNA, 15 bp, Homo sapiens
tggctaaaagacatg

SEQ ID NO: 6524770 - DNA, 22 bp, Homo sapiens
tggctaaagataattgctattt

SEQ ID NO: 6524771 - DNA, 20 bp, Homo sapiens
tggctaacagtctagtgcaa

SEQ ID NO: 6524772 - DNA, 15 bp, Homo sapiens
tggctaacatagcac

SEQ ID NO: 6524773 - DNA, 14 bp, Homo sapiens
tggctaaccaagag

SEQ ID NO: 6524774 - DNA, 21 bp, Homo sapiens
tggctaactatatttgctttt

SEQ ID NO: 6524775 - DNA, 20 bp, Homo sapiens
tggctaacttacaaagattc

SEQ ID NO: 6524776 - DNA, 18 bp, Homo sapiens
tggctaagcaaaatgtga

SEQ ID NO: 6524777 - DNA, 17 bp, Homo sapiens
tggctaaggcaccagcc

SEQ ID NO: 6524778 - DNA, 19 bp, Homo sapiens
tggctaagggggaccatgg

SEQ ID NO: 6524779 - DNA, 18 bp, Homo sapiens
tggctaataaactgtatt

SEQ ID NO: 6524780 - DNA, 19 bp, Homo sapiens
tggctaataaactgtatta

SEQ ID NO: 6524781 - DNA, 19 bp, Homo sapiens
tggctaatggagtgtttga

SEQ ID NO: 6524782 - DNA, 16 bp, Homo sapiens
tggctaattttctgta

SEQ ID NO: 6524783 - DNA, 14 bp, Homo sapiens
tggctacagtacca

SEQ ID NO: 6524784 - DNA, 15 bp, Homo sapiens
tggctacatcccagc

SEQ ID NO: 6524785 - DNA, 16 bp, Homo sapiens
tggctaccgatttcag

SEQ ID NO: 6524786 - DNA, 18 bp, Homo sapiens
tggctacgcctcttctgt

SEQ ID NO: 6524787 - DNA, 23 bp, Homo sapiens
tggctacgttttggttctatgct

SEQ ID NO: 6524788 - DNA, 17 bp, Homo sapiens
tggctactccctggacc

SEQ ID NO: 6524789 - DNA, 18 bp, Homo sapiens
tggctactccctggacca

SEQ ID NO: 6524790 - DNA, 14 bp, Homo sapiens
tggctactctgtgc

SEQ ID NO: 6524791 - DNA, 18 bp, Homo sapiens
tggctactctgtgccaga

SEQ ID NO: 6524792 - DNA, 19 bp, Homo sapiens
tggctactctgtgccagag

SEQ ID NO: 6524793 - DNA, 20 bp, Homo sapiens
tggctactctgtgccagagc

SEQ ID NO: 6524794 - DNA, 22 bp, Homo sapiens
tggctactctgtgccagagcct

SEQ ID NO: 6524795 - DNA, 12 bp, Homo sapiens
tggctactgtct

SEQ ID NO: 6524796 - DNA, 23 bp, Homo sapiens
tggctactgtctattaaaattct

SEQ ID NO: 6524797 - DNA, 18 bp, Homo sapiens
tggctacttcccttcctc

SEQ ID NO: 6524798 - DNA, 22 bp, Homo sapiens
tggctactttggtttctgtctg

SEQ ID NO: 6524799 - DNA, 18 bp, Homo sapiens
tggctacttttgaaaatc

SEQ ID NO: 6524800 - DNA, 15 bp, Homo sapiens
tggctactttttcat

SEQ ID NO: 6524801 - DNA, 20 bp, Homo sapiens
tggctacttttttctatgct

SEQ ID NO: 6524802 - DNA, 18 bp, Homo sapiens
tggctagaatcagggtgg

SEQ ID NO: 6524803 - DNA, 15 bp, Homo sapiens
tggctagagccgagg

SEQ ID NO: 6524804 - DNA, 23 bp, Homo sapiens
tggctagaggccagccccaccca

SEQ ID NO: 6524805 - DNA, 23 bp, Homo sapiens
tggctagagggcccaaagcttgt

SEQ ID NO: 6524806 - DNA, 18 bp, Homo sapiens
tggctagagtcctcactc

SEQ ID NO: 6524807 - DNA, 12 bp, Homo sapiens
tggctagagttt

SEQ ID NO: 6524808 - DNA, 15 bp, Homo sapiens
tggctagagtttcca

SEQ ID NO: 6524809 - DNA, 17 bp, Homo sapiens
tggctagagtttccact

SEQ ID NO: 6524810 - DNA, 22 bp, Homo sapiens
tggctaggaaagggaagcctga

SEQ ID NO: 6524811 - DNA, 17 bp, Homo sapiens
tggctaggggagcaggg

SEQ ID NO: 6524812 - DNA, 22 bp, Homo sapiens
tggctagggttccactggagaa

SEQ ID NO: 6524813 - DNA, 15 bp, Homo sapiens
tggctagtactgtat

SEQ ID NO: 6524814 - DNA, 19 bp, Homo sapiens
tggctagtactgtattggc

SEQ ID NO: 6524815 - DNA, 15 bp, Homo sapiens
tggctagtcaagctc

SEQ ID NO: 6524816 - DNA, 21 bp, Homo sapiens
tggctagtcaagctcctcctc

SEQ ID NO: 6524817 - DNA, 15 bp, Homo sapiens
tggctagtccttgtt

SEQ ID NO: 6524818 - DNA, 13 bp, Homo sapiens
tggctataaatat

SEQ ID NO: 6524819 - DNA, 18 bp, Homo sapiens
tggctataacatgtcttt

SEQ ID NO: 6524820 - DNA, 11 bp, Homo sapiens
tggctatacag

SEQ ID NO: 6524821 - DNA, 19 bp, Homo sapiens
tggctatagatgtcttttc

SEQ ID NO: 6524822 - DNA, 23 bp, Homo sapiens
tggctataggtgctacaaaaaca

SEQ ID NO: 6524823 - DNA, 13 bp, Homo sapiens
tggctatattaat

SEQ ID NO: 6524824 - DNA, 19 bp, Homo sapiens
tggctatcctagagaggct

SEQ ID NO: 6524825 - DNA, 20 bp, Homo sapiens
tggctatcctagagaggctg

SEQ ID NO: 6524826 - DNA, 20 bp, Homo sapiens
tggctatctatacctgcctt

SEQ ID NO: 6524827 - DNA, 21 bp, Homo sapiens
tggctatctatacctgccttt

SEQ ID NO: 6524828 - DNA, 23 bp, Homo sapiens
tggctatctgcatttataaatgt

SEQ ID NO: 6524829 - DNA, 14 bp, Homo sapiens
tggctatgaacaga

SEQ ID NO: 6524830 - DNA, 16 bp, Homo sapiens
tggctatgatggtgac

SEQ ID NO: 6524831 - DNA, 22 bp, Homo sapiens
tggctatgtagacataaagaag

SEQ ID NO: 6524832 - DNA, 21 bp, Homo sapiens
tggctattgaagatgctgcct

SEQ ID NO: 6524833 - DNA, 21 bp, Homo sapiens
tggctatttaaaaagctcttt

SEQ ID NO: 6524834 - DNA, 16 bp, Homo sapiens
tggctatttaaagaca

SEQ ID NO: 6524835 - DNA, 21 bp, Homo sapiens
tggctatttctgtgtccagtt

SEQ ID NO: 6524836 - DNA, 22 bp, Homo sapiens
tggctattttgagaactccagc

SEQ ID NO: 6524837 - DNA, 17 bp, Homo sapiens
tggctcaacacatgaga

SEQ ID NO: 6524838 - DNA, 17 bp, Homo sapiens
tggctcaagacaaggct

SEQ ID NO: 6524839 - DNA, 12 bp, Homo sapiens
tggctcacaagg

SEQ ID NO: 6524840 - DNA, 17 bp, Homo sapiens
tggctcacacctgtaat

SEQ ID NO: 6524841 - DNA, 13 bp, Homo sapiens
tggctcacactga

SEQ ID NO: 6524842 - DNA, 15 bp, Homo sapiens
tggctcacagccacc

SEQ ID NO: 6524843 - DNA, 16 bp, Homo sapiens
tggctcacagccacca

SEQ ID NO: 6524844 - DNA, 17 bp, Homo sapiens
tggctcacagccaccac

SEQ ID NO: 6524845 - DNA, 20 bp, Homo sapiens
tggctcacagccaccacctg

SEQ ID NO: 6524846 - DNA, 15 bp, Homo sapiens
tggctcacccaagca

SEQ ID NO: 6524847 - DNA, 18 bp, Homo sapiens
tggctcacccctctcccc

SEQ ID NO: 6524848 - DNA, 15 bp, Homo sapiens
tggctcacgccccgc

SEQ ID NO: 6524849 - DNA, 20 bp, Homo sapiens
tggctcacgccccgctgtgt

SEQ ID NO: 6524850 - DNA, 14 bp, Homo sapiens
tggctcactactga

SEQ ID NO: 6524851 - DNA, 21 bp, Homo sapiens
tggctcactatggtgccaatg

SEQ ID NO: 6524852 - DNA, 16 bp, Homo sapiens
tggctcactgcagcct

SEQ ID NO: 6524853 - DNA, 22 bp, Homo sapiens
tggctcactgcagcctccgcct

SEQ ID NO: 6524854 - DNA, 15 bp, Homo sapiens
tggctcactggcagg

SEQ ID NO: 6524855 - DNA, 15 bp, Homo sapiens
tggctcactggctgg

SEQ ID NO: 6524856 - DNA, 17 bp, Homo sapiens
tggctcactggctggga

SEQ ID NO: 6524857 - DNA, 18 bp, Homo sapiens
tggctcagacatgttttc

SEQ ID NO: 6524858 - DNA, 14 bp, Homo sapiens
tggctcagacccct

SEQ ID NO: 6524859 - DNA, 17 bp, Homo sapiens
tggctcagacccctcag

SEQ ID NO: 6524860 - DNA, 19 bp, Homo sapiens
tggctcagagcttgaagat

SEQ ID NO: 6524861 - DNA, 16 bp, Homo sapiens
tggctcagccagcact

SEQ ID NO: 6524862 - DNA, 13 bp, Homo sapiens
tggctcagcccgg

SEQ ID NO: 6524863 - DNA, 19 bp, Homo sapiens
tggctcagcctgtctcggg

SEQ ID NO: 6524864 - DNA, 22 bp, Homo sapiens
tggctcagcctgtctcgggctg

SEQ ID NO: 6524865 - DNA, 14 bp, Homo sapiens
tggctcagctcggg

SEQ ID NO: 6524866 - DNA, 15 bp, Homo sapiens
tggctcagctgtggt

SEQ ID NO: 6524867 - DNA, 21 bp, Homo sapiens
tggctcaggaagaaaccccaa

SEQ ID NO: 6524868 - DNA, 12 bp, Homo sapiens
tggctcaggagg

SEQ ID NO: 6524869 - DNA, 21 bp, Homo sapiens
tggctcaggaggaggggtgag

SEQ ID NO: 6524870 - DNA, 12 bp, Homo sapiens
tggctcaggcag

SEQ ID NO: 6524871 - DNA, 14 bp, Homo sapiens
tggctcaggcagac

SEQ ID NO: 6524872 - DNA, 14 bp, Homo sapiens
tggctcaggcccag

SEQ ID NO: 6524873 - DNA, 23 bp, Homo sapiens
tggctcagtgccacctatgcctg

SEQ ID NO: 6524874 - DNA, 22 bp, Homo sapiens
tggctcatattcctgcagcctg

SEQ ID NO: 6524875 - DNA, 14 bp, Homo sapiens
tggctcatgcccct

SEQ ID NO: 6524876 - DNA, 18 bp, Homo sapiens
tggctcatgccccttggg

SEQ ID NO: 6524877 - DNA, 21 bp, Homo sapiens
tggctcatgcctgtaatccca

SEQ ID NO: 6524878 - DNA, 17 bp, Homo sapiens
tggctcattgtagcaca

SEQ ID NO: 6524879 - DNA, 16 bp, Homo sapiens
tggctccaaaccctcg

SEQ ID NO: 6524880 - DNA, 20 bp, Homo sapiens
tggctccaaaccctcgaggc

SEQ ID NO: 6524881 - DNA, 23 bp, Homo sapiens
tggctccaacccgttgggtccct

SEQ ID NO: 6524882 - DNA, 19 bp, Homo sapiens
tggctccaaggtgctctgt

SEQ ID NO: 6524883 - DNA, 17 bp, Homo sapiens
tggctccacacacacaa

SEQ ID NO: 6524884 - DNA, 16 bp, Homo sapiens
tggctccacacctcca

SEQ ID NO: 6524885 - DNA, 15 bp, Homo sapiens
tggctccacgccctg

SEQ ID NO: 6524886 - DNA, 18 bp, Homo sapiens
tggctccacgccctgggg

SEQ ID NO: 6524887 - DNA, 19 bp, Homo sapiens
tggctccacgccctgggga

SEQ ID NO: 6524888 - DNA, 19 bp, Homo sapiens
tggctccactcttgatctc

SEQ ID NO: 6524889 - DNA, 11 bp, Homo sapiens
tggctccagaa

SEQ ID NO: 6524890 - DNA, 15 bp, Homo sapiens
tggctccagaaatgt

SEQ ID NO: 6524891 - DNA, 16 bp, Homo sapiens
tggctccagaatgtgc

SEQ ID NO: 6524892 - DNA, 13 bp, Homo sapiens
tggctccaggagc

SEQ ID NO: 6524893 - DNA, 14 bp, Homo sapiens
tggctccaggagca

SEQ ID NO: 6524894 - DNA, 14 bp, Homo sapiens
tggctccaggccaa

SEQ ID NO: 6524895 - DNA, 15 bp, Homo sapiens
tggctccaggccagg

SEQ ID NO: 6524896 - DNA, 13 bp, Homo sapiens
tggctccaggctc

SEQ ID NO: 6524897 - DNA, 13 bp, Homo sapiens
tggctccagtctc

SEQ ID NO: 6524898 - DNA, 19 bp, Homo sapiens
tggctccatgattctctga

SEQ ID NO: 6524899 - DNA, 20 bp, Homo sapiens
tggctccatgattctctgag

SEQ ID NO: 6524900 - DNA, 16 bp, Homo sapiens
tggctcccaagggagg

SEQ ID NO: 6524901 - DNA, 20 bp, Homo sapiens
tggctcccacaggcccttcc

SEQ ID NO: 6524902 - DNA, 17 bp, Homo sapiens
tggctcccagggccatg

SEQ ID NO: 6524903 - DNA, 18 bp, Homo sapiens
tggctcccagggtcctgg

SEQ ID NO: 6524904 - DNA, 14 bp, Homo sapiens
tggctcccagggtg

SEQ ID NO: 6524905 - DNA, 14 bp, Homo sapiens
tggctccccaaagg

SEQ ID NO: 6524906 - DNA, 15 bp, Homo sapiens
tggctccccacctgg

SEQ ID NO: 6524907 - DNA, 17 bp, Homo sapiens
tggctccccacctggac

SEQ ID NO: 6524908 - DNA, 21 bp, Homo sapiens
tggctccccacctggacacac

SEQ ID NO: 6524909 - DNA, 19 bp, Homo sapiens
tggctccccacgagtcacc

SEQ ID NO: 6524910 - DNA, 23 bp, Homo sapiens
tggctccccacgagtcacctgca

SEQ ID NO: 6524911 - DNA, 21 bp, Homo sapiens
tggctccccctccccaggctg

SEQ ID NO: 6524912 - DNA, 15 bp, Homo sapiens
tggctccccctctgc

SEQ ID NO: 6524913 - DNA, 19 bp, Homo sapiens
tggctccccctctgcttct

SEQ ID NO: 6524914 - DNA, 13 bp, Homo sapiens
tggctccccctga

SEQ ID NO: 6524915 - DNA, 16 bp, Homo sapiens
tggctccccgagggct

SEQ ID NO: 6524916 - DNA, 20 bp, Homo sapiens
tggctccccgagggctcaga

SEQ ID NO: 6524917 - DNA, 13 bp, Homo sapiens
tggctcccctcta

SEQ ID NO: 6524918 - DNA, 14 bp, Homo sapiens
tggctcccctctat

SEQ ID NO: 6524919 - DNA, 12 bp, Homo sapiens
tggctcccctgc

SEQ ID NO: 6524920 - DNA, 13 bp, Homo sapiens
tggctcccctgca

SEQ ID NO: 6524921 - DNA, 19 bp, Homo sapiens
tggctcccctgcagccctg

SEQ ID NO: 6524922 - DNA, 13 bp, Homo sapiens
tggctcccctgcc

SEQ ID NO: 6524923 - DNA, 15 bp, Homo sapiens
ttatatcaaagtatt

SEQ ID NO: 6524924 - DNA, 14 bp, Homo sapiens
ttatatcaaatgag

SEQ ID NO: 6524925 - DNA, 18 bp, Homo sapiens
ttatatcacacaatatag

SEQ ID NO: 6524926 - DNA, 17 bp, Homo sapiens
ttatatcagactgcttt

SEQ ID NO: 6524927 - DNA, 22 bp, Homo sapiens
ttatatcagactgctttgagaa

SEQ ID NO: 6524928 - DNA, 15 bp, Homo sapiens
ttatatcagcctgag

SEQ ID NO: 6524929 - DNA, 16 bp, Homo sapiens
ttatatcagcctgagt

SEQ ID NO: 6524930 - DNA, 19 bp, Homo sapiens
ttatatcatacagttttca

SEQ ID NO: 6524931 - DNA, 21 bp, Homo sapiens
ttatatcatcagcataccttt

SEQ ID NO: 6524932 - DNA, 18 bp, Homo sapiens
ttatatcattttaaaatg

SEQ ID NO: 6524933 - DNA, 17 bp, Homo sapiens
ttatatctaatttatac

SEQ ID NO: 6524934 - DNA, 18 bp, Homo sapiens
ttatatctaatttataca

SEQ ID NO: 6524935 - DNA, 20 bp, Homo sapiens
ttatatctaatttatacaaa

SEQ ID NO: 6524936 - DNA, 20 bp, Homo sapiens
ttatatctctgtatgccatt

SEQ ID NO: 6524937 - DNA, 20 bp, Homo sapiens
ttatatctgaggaattctgt

SEQ ID NO: 6524938 - DNA, 21 bp, Homo sapiens
ttatatctgaggaattctgta

SEQ ID NO: 6524939 - DNA, 12 bp, Homo sapiens
ttatatctgtaa

SEQ ID NO: 6524940 - DNA, 22 bp, Homo sapiens
ttatatctgtaatgatactgat

SEQ ID NO: 6524941 - DNA, 17 bp, Homo sapiens
ttatatctgtacaatga

SEQ ID NO: 6524942 - DNA, 14 bp, Homo sapiens
ttatatctgtatgt

SEQ ID NO: 6524943 - DNA, 14 bp, Homo sapiens
ttatatctgttttg

SEQ ID NO: 6524944 - DNA, 19 bp, Homo sapiens
ttatatcttatatataata

SEQ ID NO: 6524945 - DNA, 14 bp, Homo sapiens
ttatatcttgttta

SEQ ID NO: 6524946 - DNA, 19 bp, Homo sapiens
ttatatcttgtttacaata

SEQ ID NO: 6524947 - DNA, 17 bp, Homo sapiens
ttatatcttttggttat

SEQ ID NO: 6524948 - DNA, 17 bp, Homo sapiens
ttatatgaaaacactca

SEQ ID NO: 6524949 - DNA, 16 bp, Homo sapiens
ttatatgaagataagt

SEQ ID NO: 6524950 - DNA, 20 bp, Homo sapiens
ttatatgaagcaagctgtgt

SEQ ID NO: 6524951 - DNA, 22 bp, Homo sapiens
ttatatgaagcaagctgtgtta

SEQ ID NO: 6524952 - DNA, 22 bp, Homo sapiens
ttatatgaagtattaaaatgca

SEQ ID NO: 6524953 - DNA, 12 bp, Homo sapiens
ttatatgaagtt

SEQ ID NO: 6524954 - DNA, 22 bp, Homo sapiens
ttatatgaccatatttactctt

SEQ ID NO: 6524955 - DNA, 21 bp, Homo sapiens
ttatatgacttcttgttcatg

SEQ ID NO: 6524956 - DNA, 15 bp, Homo sapiens
ttatatgatatgcat

SEQ ID NO: 6524957 - DNA, 16 bp, Homo sapiens
ttatatgatatgcatg

SEQ ID NO: 6524958 - DNA, 15 bp, Homo sapiens
ttatatgatattctt

SEQ ID NO: 6524959 - DNA, 15 bp, Homo sapiens
ttatatgatttttga

SEQ ID NO: 6524960 - DNA, 10 bp, Homo sapiens
ttatatgcat

SEQ ID NO: 6524961 - DNA, 17 bp, Homo sapiens
ttatatgccaagctaat

SEQ ID NO: 6524962 - DNA, 13 bp, Homo sapiens
ttatatgctaatt

SEQ ID NO: 6524963 - DNA, 20 bp, Homo sapiens
ttatatgctttttctcagat

SEQ ID NO: 6524964 - DNA, 19 bp, Homo sapiens
ttatatggaaatatatatt

SEQ ID NO: 6524965 - DNA, 13 bp, Homo sapiens
ttatatggaaatt

SEQ ID NO: 6524966 - DNA, 15 bp, Homo sapiens
ttatatggaagaaag

SEQ ID NO: 6524967 - DNA, 20 bp, Homo sapiens
ttatatggcgttttgtctgt

SEQ ID NO: 6524968 - DNA, 16 bp, Homo sapiens
ttatatgtaaatgtgt

SEQ ID NO: 6524969 - DNA, 15 bp, Homo sapiens
ttatatgtactttta

SEQ ID NO: 6524970 - DNA, 15 bp, Homo sapiens
ttatatgtatccagt

SEQ ID NO: 6524971 - DNA, 21 bp, Homo sapiens
ttatatgtatccagtacattt

SEQ ID NO: 6524972 - DNA, 19 bp, Homo sapiens
ttatatgtatgtgtttaga

SEQ ID NO: 6524973 - DNA, 20 bp, Homo sapiens
ttatatgtatgtgtttagaa

SEQ ID NO: 6524974 - DNA, 14 bp, Homo sapiens
ttatatgtgtaatt

SEQ ID NO: 6524975 - DNA, 13 bp, Homo sapiens
ttatatgtgttga

SEQ ID NO: 6524976 - DNA, 14 bp, Homo sapiens
ttatatgtgttgaa

SEQ ID NO: 6524977 - DNA, 15 bp, Homo sapiens
ttatatgttaatttg

SEQ ID NO: 6524978 - DNA, 16 bp, Homo sapiens
ttatatgttaatttgt

SEQ ID NO: 6524979 - DNA, 17 bp, Homo sapiens
ttatatgttattaaaca

SEQ ID NO: 6524980 - DNA, 18 bp, Homo sapiens
ttatatgttcatattgga

SEQ ID NO: 6524981 - DNA, 16 bp, Homo sapiens
ttatattaaagtaaat

SEQ ID NO: 6524982 - DNA, 24 bp, Homo sapiens
ttatattaaagtaaatggcatgga

SEQ ID NO: 6524983 - DNA, 19 bp, Homo sapiens
ttatattaatgtacttgtt

SEQ ID NO: 6524984 - DNA, 18 bp, Homo sapiens
ttatattaattatgaaga

SEQ ID NO: 6524985 - DNA, 18 bp, Homo sapiens
ttatattacttttgtaaa

SEQ ID NO: 6524986 - DNA, 19 bp, Homo sapiens
ttatattagagtcagagat

SEQ ID NO: 6524987 - DNA, 19 bp, Homo sapiens
ttatattagagtgccctta

SEQ ID NO: 6524988 - DNA, 20 bp, Homo sapiens
ttatattatgaataaaattg

SEQ ID NO: 6524989 - DNA, 14 bp, Homo sapiens
ttatattatgtagt

SEQ ID NO: 6524990 - DNA, 20 bp, Homo sapiens
ttatattattttctgtaatt

SEQ ID NO: 6524991 - DNA, 15 bp, Homo sapiens
ttatattcaaccatg

SEQ ID NO: 6524992 - DNA, 17 bp, Homo sapiens
ttatattcaaccatgga

SEQ ID NO: 6524993 - DNA, 23 bp, Homo sapiens
ttatattcagagatgtaccatgt

SEQ ID NO: 6524994 - DNA, 13 bp, Homo sapiens
ttatattccactt

SEQ ID NO: 6524995 - DNA, 14 bp, Homo sapiens
ttatattccatata

SEQ ID NO: 6524996 - DNA, 16 bp, Homo sapiens
ttatattccatatatt

SEQ ID NO: 6524997 - DNA, 21 bp, Homo sapiens
ttatattcctctaaaactctc

SEQ ID NO: 6524998 - DNA, 16 bp, Homo sapiens
ttatattctcagcaga

SEQ ID NO: 6524999 - DNA, 20 bp, Homo sapiens
ttatattctcagcagagtgc

SEQ ID NO: 6525000 - DNA, 23 bp, Homo sapiens
ttatattctcttatgatacttga

SEQ ID NO: 6525001 - DNA, 21 bp, Homo sapiens
ttatattctgcagaaaattaa

SEQ ID NO: 6525002 - DNA, 14 bp, Homo sapiens
ttatattgagacaa

SEQ ID NO: 6525003 - DNA, 18 bp, Homo sapiens
ttatattgagacaaaaat

SEQ ID NO: 6525004 - DNA, 23 bp, Homo sapiens
ttatattgcttcctgtgtaacat

SEQ ID NO: 6525005 - DNA, 19 bp, Homo sapiens
ttatattggtgcgttttta

SEQ ID NO: 6525006 - DNA, 14 bp, Homo sapiens
ttatattgtaagaa

SEQ ID NO: 6525007 - DNA, 16 bp, Homo sapiens
ttatattgtaagaaat

SEQ ID NO: 6525008 - DNA, 21 bp, Homo sapiens
ttatattgtatattctggaaa

SEQ ID NO: 6525009 - DNA, 22 bp, Homo sapiens
ttatattgtatattctggaaaa

SEQ ID NO: 6525010 - DNA, 15 bp, Homo sapiens
ttatattgttttctc

SEQ ID NO: 6525011 - DNA, 20 bp, Homo sapiens
ttatattgtttttatatatt

SEQ ID NO: 6525012 - DNA, 23 bp, Homo sapiens
ttatattgtttttatatattata

SEQ ID NO: 6525013 - DNA, 18 bp, Homo sapiens
ttatatttaaaaattgtt

SEQ ID NO: 6525014 - DNA, 14 bp, Homo sapiens
ttatatttaaatta

SEQ ID NO: 6525015 - DNA, 13 bp, Homo sapiens
ttatatttacaat

SEQ ID NO: 6525016 - DNA, 16 bp, Homo sapiens
ttatatttacaataaa

SEQ ID NO: 6525017 - DNA, 13 bp, Homo sapiens
ttatatttatcca

SEQ ID NO: 6525018 - DNA, 10 bp, Homo sapiens
ttatatttca

SEQ ID NO: 6525019 - DNA, 16 bp, Homo sapiens
ttatatttcaataaat

SEQ ID NO: 6525020 - DNA, 23 bp, Homo sapiens
ttatatttccctaaaatacattt

SEQ ID NO: 6525021 - DNA, 21 bp, Homo sapiens
ttatatttcctttatgtgaat

SEQ ID NO: 6525022 - DNA, 14 bp, Homo sapiens
ttatatttctgtgt

SEQ ID NO: 6525023 - DNA, 12 bp, Homo sapiens
ttatatttgaaa

SEQ ID NO: 6525024 - DNA, 13 bp, Homo sapiens
ttatatttgaaat

SEQ ID NO: 6525025 - DNA, 16 bp, Homo sapiens
ttatatttgaattagt

SEQ ID NO: 6525026 - DNA, 23 bp, Homo sapiens
ttatatttgacattcttcactgt

SEQ ID NO: 6525027 - DNA, 12 bp, Homo sapiens
ttatatttgcat

SEQ ID NO: 6525028 - DNA, 17 bp, Homo sapiens
ttatatttggaaagaga

SEQ ID NO: 6525029 - DNA, 22 bp, Homo sapiens
ttatatttggatgcagagttca

SEQ ID NO: 6525030 - DNA, 18 bp, Homo sapiens
ttatatttggcccaaact

SEQ ID NO: 6525031 - DNA, 15 bp, Homo sapiens
ttatatttgtaggag

SEQ ID NO: 6525032 - DNA, 13 bp, Homo sapiens
ttatatttgtctc

SEQ ID NO: 6525033 - DNA, 19 bp, Homo sapiens
ttatattttactactgtgg

SEQ ID NO: 6525034 - DNA, 15 bp, Homo sapiens
ttatattttatactg

SEQ ID NO: 6525035 - DNA, 20 bp, Homo sapiens
ttatattttatgaacattgt

SEQ ID NO: 6525036 - DNA, 19 bp, Homo sapiens
ttatattttattgctacaa

SEQ ID NO: 6525037 - DNA, 18 bp, Homo sapiens
ttatattttcagcaaaga

SEQ ID NO: 6525038 - DNA, 21 bp, Homo sapiens
ttatattttgattttacatgc

SEQ ID NO: 6525039 - DNA, 16 bp, Homo sapiens
ttatattttgtgtata

SEQ ID NO: 6525040 - DNA, 20 bp, Homo sapiens
ttatatttttaaaaaactga

SEQ ID NO: 6525041 - DNA, 19 bp, Homo sapiens
ttatatttttaataaaagt

SEQ ID NO: 6525042 - DNA, 16 bp, Homo sapiens
ttatatttttcttaaa

SEQ ID NO: 6525043 - DNA, 17 bp, Homo sapiens
ttatatttttcttaaaa

SEQ ID NO: 6525044 - DNA, 22 bp, Homo sapiens
ttatatttttgtacatattgtt

SEQ ID NO: 6525045 - DNA, 19 bp, Homo sapiens
ttatattttttgtctgttt

SEQ ID NO: 6525046 - DNA, 17 bp, Homo sapiens
ttatatttttttaactg

SEQ ID NO: 6525047 - DNA, 22 bp, Homo sapiens
ttatcaaaaagctaatgtgcag

SEQ ID NO: 6525048 - DNA, 14 bp, Homo sapiens
ttatcaaaaagtat

SEQ ID NO: 6525049 - DNA, 17 bp, Homo sapiens
ttatcaaaaagtattat

SEQ ID NO: 6525050 - DNA, 16 bp, Homo sapiens
ttatcaaaaatttcat

SEQ ID NO: 6525051 - DNA, 15 bp, Homo sapiens
ttatcaaaactgttg

SEQ ID NO: 6525052 - DNA, 15 bp, Homo sapiens
ttatcaaaactttct

SEQ ID NO: 6525053 - DNA, 20 bp, Homo sapiens
ttatcaaaagtgatcagcaa

SEQ ID NO: 6525054 - DNA, 20 bp, Homo sapiens
ttatcaaaatagtctaaggc

SEQ ID NO: 6525055 - DNA, 13 bp, Homo sapiens
ttatcaaagcata

SEQ ID NO: 6525056 - DNA, 15 bp, Homo sapiens
ttatcaaagcataga

SEQ ID NO: 6525057 - DNA, 15 bp, Homo sapiens
ttatcaaataatatt

SEQ ID NO: 6525058 - DNA, 19 bp, Homo sapiens
ttatcaaataatattcatg

SEQ ID NO: 6525059 - DNA, 20 bp, Homo sapiens
ttatcaaatcagtcagtgca

SEQ ID NO: 6525060 - DNA, 14 bp, Homo sapiens
ttatcaaatcattc

SEQ ID NO: 6525061 - DNA, 18 bp, Homo sapiens
ttatcaaatcattcaaaa

SEQ ID NO: 6525062 - DNA, 21 bp, Homo sapiens
ttatcaaatcattcaaaactt

SEQ ID NO: 6525063 - DNA, 14 bp, Homo sapiens
ttatcaacatttgt

SEQ ID NO: 6525064 - DNA, 19 bp, Homo sapiens
ttatcaagagactcctgaa

SEQ ID NO: 6525065 - DNA, 23 bp, Homo sapiens
ttatcaagagttgtgacaacttc

SEQ ID NO: 6525066 - DNA, 16 bp, Homo sapiens
ttatcaagcaaaatgt

SEQ ID NO: 6525067 - DNA, 19 bp, Homo sapiens
ttatcaaggaagtcttcaa

SEQ ID NO: 6525068 - DNA, 11 bp, Homo sapiens
ttatcaagtgt

SEQ ID NO: 6525069 - DNA, 15 bp, Homo sapiens
ttatcaagtgtcttc

SEQ ID NO: 6525070 - DNA, 17 bp, Homo sapiens
ttatcaagtgtcttcca

SEQ ID NO: 6525071 - DNA, 22 bp, Homo sapiens
ttatcaagtttgggtctgtgct

SEQ ID NO: 6525072 - DNA, 15 bp, Homo sapiens
ttatcaataaagcac

SEQ ID NO: 6525073 - DNA, 16 bp, Homo sapiens
ttatcaatatctaata

SEQ ID NO: 6525074 - DNA, 18 bp, Homo sapiens
ttatcaattatattatgt

SEQ ID NO: 6525075 - DNA, 21 bp, Homo sapiens
ttatcaattgcaaaatgcgta

SEQ ID NO: 6525076 - DNA, 14 bp, Homo sapiens
ttatcaatttgtca

SEQ ID NO: 6525077 - DNA, 21 bp, Homo sapiens
ttatcaatttgtcattttgaa

SEQ ID NO: 6525078 - DNA, 19 bp, Homo sapiens
ttatcaatttttcccagta

SEQ ID NO: 6525079 - DNA, 13 bp, Homo sapiens
ttatcacacaaag

SEQ ID NO: 6525080 - DNA, 22 bp, Homo sapiens
ttatcacataagagagatgaga

SEQ ID NO: 6525081 - DNA, 16 bp, Homo sapiens
ttatcacatgtatgtt

SEQ ID NO: 6525082 - DNA, 12 bp, Homo sapiens
ttatcacatttt

SEQ ID NO: 6525083 - DNA, 20 bp, Homo sapiens
ttatcaccagagagggactg

SEQ ID NO: 6525084 - DNA, 19 bp, Homo sapiens
ttatcaccagctgcctctt

SEQ ID NO: 6525085 - DNA, 17 bp, Homo sapiens
ttatcacccagaagaaa

SEQ ID NO: 6525086 - DNA, 18 bp, Homo sapiens
ttatcacccccttgttgt

SEQ ID NO: 6525087 - DNA, 23 bp, Homo sapiens
ttatcacctagctgaatgttttt

SEQ ID NO: 6525088 - DNA, 19 bp, Homo sapiens
ttatcacctcattctgaac

SEQ ID NO: 6525089 - DNA, 19 bp, Homo sapiens
ttatcacctggcttgttta

SEQ ID NO: 6525090 - DNA, 16 bp, Homo sapiens
ttatcacctgttcatt

SEQ ID NO: 6525091 - DNA, 18 bp, Homo sapiens
ttatcactaagaaagaaa

SEQ ID NO: 6525092 - DNA, 18 bp, Homo sapiens
ttatcactgaaaaaatgt

SEQ ID NO: 6525093 - DNA, 19 bp, Homo sapiens
ttatcactgaaaaaatgta

SEQ ID NO: 6525094 - DNA, 23 bp, Homo sapiens
ttatcactgtttaaagctttgaa

SEQ ID NO: 6525095 - DNA, 20 bp, Homo sapiens
ttatcagaaagatcaaatta

SEQ ID NO: 6525096 - DNA, 17 bp, Homo sapiens
ttatcagaagcaaggaa

SEQ ID NO: 6525097 - DNA, 15 bp, Homo sapiens
ttatcagaatatcaa

SEQ ID NO: 6525098 - DNA, 22 bp, Homo sapiens
ttatcagactcggaatctattt

SEQ ID NO: 6525099 - DNA, 14 bp, Homo sapiens
ttatcagatacatc

SEQ ID NO: 6525100 - DNA, 22 bp, Homo sapiens
ttatcagctacttaagagaaat

SEQ ID NO: 6525101 - DNA, 13 bp, Homo sapiens
tggctcccctggg

SEQ ID NO: 6525102 - DNA, 16 bp, Homo sapiens
tggctcccctggggtg

SEQ ID NO: 6525103 - DNA, 21 bp, Homo sapiens
tggctcccctggggtgcaggc

SEQ ID NO: 6525104 - DNA, 19 bp, Homo sapiens
tggctcccgcggtgccatg

SEQ ID NO: 6525105 - DNA, 16 bp, Homo sapiens
tggctccctcactctc

SEQ ID NO: 6525106 - DNA, 20 bp, Homo sapiens
tggctccctcactctcagga

SEQ ID NO: 6525107 - DNA, 17 bp, Homo sapiens
tggctccctcccaccca

SEQ ID NO: 6525108 - DNA, 18 bp, Homo sapiens
tggctccctcccacccaa

SEQ ID NO: 6525109 - DNA, 20 bp, Homo sapiens
tggctccctcctccaggcct

SEQ ID NO: 6525110 - DNA, 21 bp, Homo sapiens
tggctccctcctccaggcctg

SEQ ID NO: 6525111 - DNA, 14 bp, Homo sapiens
tggctccctctctc

SEQ ID NO: 6525112 - DNA, 23 bp, Homo sapiens
tggctccctctctcctggactgg

SEQ ID NO: 6525113 - DNA, 17 bp, Homo sapiens
tggctccctcttctttc

SEQ ID NO: 6525114 - DNA, 14 bp, Homo sapiens
tggctccctgcccc

SEQ ID NO: 6525115 - DNA, 15 bp, Homo sapiens
tggctccctgggcag

SEQ ID NO: 6525116 - DNA, 14 bp, Homo sapiens
tggctccctgggct

SEQ ID NO: 6525117 - DNA, 15 bp, Homo sapiens
tggctccctgggctg

SEQ ID NO: 6525118 - DNA, 21 bp, Homo sapiens
tggctccctgggctggcatgg

SEQ ID NO: 6525119 - DNA, 16 bp, Homo sapiens
tggctcccttacttta

SEQ ID NO: 6525120 - DNA, 23 bp, Homo sapiens
tggctccgcaggggtttgggtgg

SEQ ID NO: 6525121 - DNA, 15 bp, Homo sapiens
tggctccggcctctg

SEQ ID NO: 6525122 - DNA, 23 bp, Homo sapiens
tggctccgtggccccgccctcag

SEQ ID NO: 6525123 - DNA, 20 bp, Homo sapiens
tggctcctaccagcaaacag

SEQ ID NO: 6525124 - DNA, 13 bp, Homo sapiens
tggctcctagggg

SEQ ID NO: 6525125 - DNA, 13 bp, Homo sapiens
tggctcctccagg

SEQ ID NO: 6525126 - DNA, 16 bp, Homo sapiens
tggctcctcccggtgc

SEQ ID NO: 6525127 - DNA, 19 bp, Homo sapiens
tggctcctcccggtgccca

SEQ ID NO: 6525128 - DNA, 19 bp, Homo sapiens
tggctcctctgttatttgt

SEQ ID NO: 6525129 - DNA, 14 bp, Homo sapiens
tggctcctgagggg

SEQ ID NO: 6525130 - DNA, 12 bp, Homo sapiens
tggctcctgatc

SEQ ID NO: 6525131 - DNA, 14 bp, Homo sapiens
tggctcctgccact

SEQ ID NO: 6525132 - DNA, 16 bp, Homo sapiens
tggctcctgccactga

SEQ ID NO: 6525133 - DNA, 17 bp, Homo sapiens
tggctcctgccttgatg

SEQ ID NO: 6525134 - DNA, 13 bp, Homo sapiens
tggctcctggacc

SEQ ID NO: 6525135 - DNA, 14 bp, Homo sapiens
tggctcctgggccg

SEQ ID NO: 6525136 - DNA, 15 bp, Homo sapiens
tggctcctgtctggc

SEQ ID NO: 6525137 - DNA, 13 bp, Homo sapiens
tggctcctgtgtg

SEQ ID NO: 6525138 - DNA, 14 bp, Homo sapiens
tggctcctgtgtgg

SEQ ID NO: 6525139 - DNA, 17 bp, Homo sapiens
tggctccttcccatcgc

SEQ ID NO: 6525140 - DNA, 19 bp, Homo sapiens
tggctccttgcagcagggc

SEQ ID NO: 6525141 - DNA, 15 bp, Homo sapiens
tggctccttgccctc

SEQ ID NO: 6525142 - DNA, 17 bp, Homo sapiens
tggctccttgtgccaga

SEQ ID NO: 6525143 - DNA, 18 bp, Homo sapiens
tggctccttgtgccagag

SEQ ID NO: 6525144 - DNA, 19 bp, Homo sapiens
tggctcctttgcctctgct

SEQ ID NO: 6525145 - DNA, 16 bp, Homo sapiens
tggctcgcacccccac

SEQ ID NO: 6525146 - DNA, 17 bp, Homo sapiens
tggctcgcacccccact

SEQ ID NO: 6525147 - DNA, 15 bp, Homo sapiens
tggctcgccaggcca

SEQ ID NO: 6525148 - DNA, 16 bp, Homo sapiens
tggctcgcttttttct

SEQ ID NO: 6525149 - DNA, 16 bp, Homo sapiens
tggctcggacccaccc

SEQ ID NO: 6525150 - DNA, 17 bp, Homo sapiens
tggctcggacccacccc

SEQ ID NO: 6525151 - DNA, 22 bp, Homo sapiens
tggctcggacccaccccaactc

SEQ ID NO: 6525152 - DNA, 23 bp, Homo sapiens
tggctcggcgcccccacccctgg

SEQ ID NO: 6525153 - DNA, 17 bp, Homo sapiens
tggctcgggtgcccagg

SEQ ID NO: 6525154 - DNA, 12 bp, Homo sapiens
tggctcgtgggc

SEQ ID NO: 6525155 - DNA, 15 bp, Homo sapiens
tggctcgtgggctct

SEQ ID NO: 6525156 - DNA, 12 bp, Homo sapiens
tggctctacaca

SEQ ID NO: 6525157 - DNA, 14 bp, Homo sapiens
tggctctacacata

SEQ ID NO: 6525158 - DNA, 19 bp, Homo sapiens
tggctctaccctgtctgtc

SEQ ID NO: 6525159 - DNA, 21 bp, Homo sapiens
tggctctaccttcctgtccct

SEQ ID NO: 6525160 - DNA, 23 bp, Homo sapiens
tggctctaccttcctgtccctga

SEQ ID NO: 6525161 - DNA, 18 bp, Homo sapiens
tggctctaggacccccag

SEQ ID NO: 6525162 - DNA, 21 bp, Homo sapiens
tggctctattggatttgtcca

SEQ ID NO: 6525163 - DNA, 22 bp, Homo sapiens
tggctctattggatttgtccaa

SEQ ID NO: 6525164 - DNA, 23 bp, Homo sapiens
tggctctattggatttgtccaaa

SEQ ID NO: 6525165 - DNA, 14 bp, Homo sapiens
tggctctcaagtga

SEQ ID NO: 6525166 - DNA, 14 bp, Homo sapiens
tggctctcagagca

SEQ ID NO: 6525167 - DNA, 23 bp, Homo sapiens
tggctctccaagtgccagaggtg

SEQ ID NO: 6525168 - DNA, 17 bp, Homo sapiens
tggctctcctctggcta

SEQ ID NO: 6525169 - DNA, 18 bp, Homo sapiens
tggctctcctctggctag

SEQ ID NO: 6525170 - DNA, 22 bp, Homo sapiens
tggctctctattccctcagcct

SEQ ID NO: 6525171 - DNA, 21 bp, Homo sapiens
tggctctctgacgtcaaccca

SEQ ID NO: 6525172 - DNA, 19 bp, Homo sapiens
tggctctgaaggatcctgg

SEQ ID NO: 6525173 - DNA, 22 bp, Homo sapiens
tggctctgaatgtagccagccc

SEQ ID NO: 6525174 - DNA, 23 bp, Homo sapiens
tggctctgaatgtagccagccca

SEQ ID NO: 6525175 - DNA, 15 bp, Homo sapiens
tggctctgagaaggg

SEQ ID NO: 6525176 - DNA, 20 bp, Homo sapiens
tggctctgaggtgcctgtcc

SEQ ID NO: 6525177 - DNA, 12 bp, Homo sapiens
tggctctgcagc

SEQ ID NO: 6525178 - DNA, 18 bp, Homo sapiens
tggctctgcagcacattg

SEQ ID NO: 6525179 - DNA, 16 bp, Homo sapiens
tggctctgccagtgga

SEQ ID NO: 6525180 - DNA, 12 bp, Homo sapiens
tggctctgcccc

SEQ ID NO: 6525181 - DNA, 16 bp, Homo sapiens
tggctctgccccctcc

SEQ ID NO: 6525182 - DNA, 14 bp, Homo sapiens
tggctctgccccgc

SEQ ID NO: 6525183 - DNA, 13 bp, Homo sapiens
tggctctgcccct

SEQ ID NO: 6525184 - DNA, 18 bp, Homo sapiens
tggctctgcccctcaggg

SEQ ID NO: 6525185 - DNA, 23 bp, Homo sapiens
tggctctgcccctcagggggcca

SEQ ID NO: 6525186 - DNA, 12 bp, Homo sapiens
tggctctgctgg

SEQ ID NO: 6525187 - DNA, 15 bp, Homo sapiens
tggctctggactcta

SEQ ID NO: 6525188 - DNA, 21 bp, Homo sapiens
tggctctggagacagccccag

SEQ ID NO: 6525189 - DNA, 22 bp, Homo sapiens
tggctctggagacagccccaga

SEQ ID NO: 6525190 - DNA, 11 bp, Homo sapiens
tggctctgggc

SEQ ID NO: 6525191 - DNA, 20 bp, Homo sapiens
tggctctggggtatgtgtgt

SEQ ID NO: 6525192 - DNA, 20 bp, Homo sapiens
tggctctgggtgaggtaggc

SEQ ID NO: 6525193 - DNA, 15 bp, Homo sapiens
tggctctgggtgggc

SEQ ID NO: 6525194 - DNA, 19 bp, Homo sapiens
tggctctgggtgggcgtgg

SEQ ID NO: 6525195 - DNA, 23 bp, Homo sapiens
tggctctgggtgggcgtggcctg

SEQ ID NO: 6525196 - DNA, 21 bp, Homo sapiens
tggctctgtcaccgccatgca

SEQ ID NO: 6525197 - DNA, 14 bp, Homo sapiens
tggctctgttgctg

SEQ ID NO: 6525198 - DNA, 21 bp, Homo sapiens
tggctctgttgctgtcctcca

SEQ ID NO: 6525199 - DNA, 16 bp, Homo sapiens
tggctcttagaaactc

SEQ ID NO: 6525200 - DNA, 20 bp, Homo sapiens
tggctcttagaaactcagga

SEQ ID NO: 6525201 - DNA, 15 bp, Homo sapiens
tggctcttatttctg

SEQ ID NO: 6525202 - DNA, 17 bp, Homo sapiens
tggctcttatttctgaa

SEQ ID NO: 6525203 - DNA, 24 bp, Homo sapiens
tggctcttatttctgaattcaaag

SEQ ID NO: 6525204 - DNA, 22 bp, Homo sapiens
tggctcttcagaggagcatcag

SEQ ID NO: 6525205 - DNA, 13 bp, Homo sapiens
tggctcttccagg

SEQ ID NO: 6525206 - DNA, 21 bp, Homo sapiens
tggctcttccaggctgggaga

SEQ ID NO: 6525207 - DNA, 23 bp, Homo sapiens
tggctcttgatacccccctctgt

SEQ ID NO: 6525208 - DNA, 16 bp, Homo sapiens
tggctcttggcttcca

SEQ ID NO: 6525209 - DNA, 14 bp, Homo sapiens
tggctctttcagag

SEQ ID NO: 6525210 - DNA, 12 bp, Homo sapiens
tggctctttgtg

SEQ ID NO: 6525211 - DNA, 22 bp, Homo sapiens
tggctcttttacccaataagat

SEQ ID NO: 6525212 - DNA, 17 bp, Homo sapiens
tggctctttttttcctt

SEQ ID NO: 6525213 - DNA, 12 bp, Homo sapiens
tggctgaaaatc

SEQ ID NO: 6525214 - DNA, 22 bp, Homo sapiens
tggctgaaataaaagcctctgg

SEQ ID NO: 6525215 - DNA, 19 bp, Homo sapiens
tggctgaaattatgtcaaa

SEQ ID NO: 6525216 - DNA, 16 bp, Homo sapiens
tggctgaaattctcct

SEQ ID NO: 6525217 - DNA, 18 bp, Homo sapiens
tggctgaacagtgctctg

SEQ ID NO: 6525218 - DNA, 15 bp, Homo sapiens
tggctgaaccctgtg

SEQ ID NO: 6525219 - DNA, 16 bp, Homo sapiens
tggctgaaccctgtgc

SEQ ID NO: 6525220 - DNA, 13 bp, Homo sapiens
tggctgaactcat

SEQ ID NO: 6525221 - DNA, 17 bp, Homo sapiens
tggctgaacttggagag

SEQ ID NO: 6525222 - DNA, 17 bp, Homo sapiens
tggctgaagaaacacag

SEQ ID NO: 6525223 - DNA, 20 bp, Homo sapiens
tggctgaagaaacacagcat

SEQ ID NO: 6525224 - DNA, 14 bp, Homo sapiens
tggctgaagaatga

SEQ ID NO: 6525225 - DNA, 20 bp, Homo sapiens
tggctgaagacttttgttat

SEQ ID NO: 6525226 - DNA, 13 bp, Homo sapiens
tggctgaagctgg

SEQ ID NO: 6525227 - DNA, 13 bp, Homo sapiens
tggctgaaggact

SEQ ID NO: 6525228 - DNA, 15 bp, Homo sapiens
tggctgaccaggccc

SEQ ID NO: 6525229 - DNA, 16 bp, Homo sapiens
tggctgaccaggccct

SEQ ID NO: 6525230 - DNA, 18 bp, Homo sapiens
tggctgaccaggccctgc

SEQ ID NO: 6525231 - DNA, 15 bp, Homo sapiens
tggctgacccagtcc

SEQ ID NO: 6525232 - DNA, 20 bp, Homo sapiens
tggctgacccagtccctggg

SEQ ID NO: 6525233 - DNA, 20 bp, Homo sapiens
tggctgaccccaaagagcct

SEQ ID NO: 6525234 - DNA, 15 bp, Homo sapiens
tggctgacccccctc

SEQ ID NO: 6525235 - DNA, 15 bp, Homo sapiens
tggctgacctgctgt

SEQ ID NO: 6525236 - DNA, 15 bp, Homo sapiens
tggctgactggccag

SEQ ID NO: 6525237 - DNA, 15 bp, Homo sapiens
tggctgactgggaac

SEQ ID NO: 6525238 - DNA, 20 bp, Homo sapiens
tggctgacttacatcatgtg

SEQ ID NO: 6525239 - DNA, 20 bp, Homo sapiens
tggctgagaaaatgtaagga

SEQ ID NO: 6525240 - DNA, 17 bp, Homo sapiens
tggctgagacactgaag

SEQ ID NO: 6525241 - DNA, 18 bp, Homo sapiens
tggctgagagggtgtggg

SEQ ID NO: 6525242 - DNA, 19 bp, Homo sapiens
tggctgagatatgaacata

SEQ ID NO: 6525243 - DNA, 14 bp, Homo sapiens
tggctgagatggag

SEQ ID NO: 6525244 - DNA, 17 bp, Homo sapiens
tggctgagcccctgtct

SEQ ID NO: 6525245 - DNA, 19 bp, Homo sapiens
tggctgagcggatgcatct

SEQ ID NO: 6525246 - DNA, 21 bp, Homo sapiens
tggctgaggcttgggcccagt

SEQ ID NO: 6525247 - DNA, 15 bp, Homo sapiens
tggctgagggcagct

SEQ ID NO: 6525248 - DNA, 24 bp, Homo sapiens
tggctgaggttcctctgcctgccc

SEQ ID NO: 6525249 - DNA, 15 bp, Homo sapiens
tggctgagtactgga

SEQ ID NO: 6525250 - DNA, 22 bp, Homo sapiens
tggctgagtggaatgcagggaa

SEQ ID NO: 6525251 - DNA, 19 bp, Homo sapiens
tggctgataaaagatacat

SEQ ID NO: 6525252 - DNA, 22 bp, Homo sapiens
tggctgatgggtggacctgtgt

SEQ ID NO: 6525253 - DNA, 17 bp, Homo sapiens
tggctgattggaaaata

SEQ ID NO: 6525254 - DNA, 19 bp, Homo sapiens
tggctgcaaataaggacag

SEQ ID NO: 6525255 - DNA, 15 bp, Homo sapiens
tggctgcaagcccac

SEQ ID NO: 6525256 - DNA, 13 bp, Homo sapiens
tggctgcacagcc

SEQ ID NO: 6525257 - DNA, 14 bp, Homo sapiens
tggctgcacagccc

SEQ ID NO: 6525258 - DNA, 21 bp, Homo sapiens
tggctgcacgtcaccctcctg

SEQ ID NO: 6525259 - DNA, 22 bp, Homo sapiens
tggctgcacgtcaccctcctga

SEQ ID NO: 6525260 - DNA, 22 bp, Homo sapiens
tggctgcactcaagaccctcga

SEQ ID NO: 6525261 - DNA, 21 bp, Homo sapiens
tggctgcagatgactggaaac

SEQ ID NO: 6525262 - DNA, 12 bp, Homo sapiens
tggctgcagcag

SEQ ID NO: 6525263 - DNA, 17 bp, Homo sapiens
tggctgcagcctccggg

SEQ ID NO: 6525264 - DNA, 12 bp, Homo sapiens
tggctgcaggca

SEQ ID NO: 6525265 - DNA, 18 bp, Homo sapiens
tggctgcaggcaccgctg

SEQ ID NO: 6525266 - DNA, 13 bp, Homo sapiens
tggctgcaggtgt

SEQ ID NO: 6525267 - DNA, 19 bp, Homo sapiens
tggctgcataaatgtggta

SEQ ID NO: 6525268 - DNA, 18 bp, Homo sapiens
tggctgccacacccaggg

SEQ ID NO: 6525269 - DNA, 22 bp, Homo sapiens
tggctgccacacccaggggaag

SEQ ID NO: 6525270 - DNA, 21 bp, Homo sapiens
tggctgccagcccactgcctc

SEQ ID NO: 6525271 - DNA, 13 bp, Homo sapiens
tggctgcccacac

SEQ ID NO: 6525272 - DNA, 22 bp, Homo sapiens
tggctgcccatcatgtggcccc

SEQ ID NO: 6525273 - DNA, 17 bp, Homo sapiens
tggctgccccaacctgc

SEQ ID NO: 6525274 - DNA, 13 bp, Homo sapiens
tggctgccccaca

SEQ ID NO: 6525275 - DNA, 19 bp, Homo sapiens
tggctgccccacaggccac

SEQ ID NO: 6525276 - DNA, 19 bp, Homo sapiens
tggctgccccattccagct

SEQ ID NO: 6525277 - DNA, 21 bp, Homo sapiens
tggctgccccattccagctct

SEQ ID NO: 6525278 - DNA, 15 bp, Homo sapiens
tggctgcccctcacc

SEQ ID NO: 6525279 - DNA, 16 bp, Homo sapiens
tggctgcccctcacct

SEQ ID NO: 6525280 - DNA, 16 bp, Homo sapiens
ttatcagctgggcagt

SEQ ID NO: 6525281 - DNA, 21 bp, Homo sapiens
ttatcagggcccaaataacag

SEQ ID NO: 6525282 - DNA, 23 bp, Homo sapiens
ttatcagtaatgctaaatgtgta

SEQ ID NO: 6525283 - DNA, 16 bp, Homo sapiens
ttatcagtagaaagag

SEQ ID NO: 6525284 - DNA, 14 bp, Homo sapiens
ttatcagtcaatat

SEQ ID NO: 6525285 - DNA, 21 bp, Homo sapiens
ttatcagtcataactaaataa

SEQ ID NO: 6525286 - DNA, 18 bp, Homo sapiens
ttatcagtgaatataaat

SEQ ID NO: 6525287 - DNA, 19 bp, Homo sapiens
ttatcagtgcttaatgtga

SEQ ID NO: 6525288 - DNA, 22 bp, Homo sapiens
ttatcagttaaaatcacatttt

SEQ ID NO: 6525289 - DNA, 17 bp, Homo sapiens
ttatcagttaacattaa

SEQ ID NO: 6525290 - DNA, 19 bp, Homo sapiens
ttatcagttatattttgct

SEQ ID NO: 6525291 - DNA, 15 bp, Homo sapiens
ttatcagttggacag

SEQ ID NO: 6525292 - DNA, 21 bp, Homo sapiens
ttatcagtttccagtctcaaa

SEQ ID NO: 6525293 - DNA, 19 bp, Homo sapiens
ttatcagtttgctaatgtt

SEQ ID NO: 6525294 - DNA, 14 bp, Homo sapiens
ttatcataagaatt

SEQ ID NO: 6525295 - DNA, 16 bp, Homo sapiens
ttatcataagaatttt

SEQ ID NO: 6525296 - DNA, 18 bp, Homo sapiens
ttatcatcacaaatggct

SEQ ID NO: 6525297 - DNA, 20 bp, Homo sapiens
ttatcatccacattgtttta

SEQ ID NO: 6525298 - DNA, 19 bp, Homo sapiens
ttatcatcctataaagaaa

SEQ ID NO: 6525299 - DNA, 19 bp, Homo sapiens
ttatcatcctttcagtttt

SEQ ID NO: 6525300 - DNA, 14 bp, Homo sapiens
ttatcatgaagcct

SEQ ID NO: 6525301 - DNA, 18 bp, Homo sapiens
ttatcatgaattttaaag

SEQ ID NO: 6525302 - DNA, 11 bp, Homo sapiens
ttatcatggaa

SEQ ID NO: 6525303 - DNA, 16 bp, Homo sapiens
ttatcatggtatttga

SEQ ID NO: 6525304 - DNA, 17 bp, Homo sapiens
ttatcatggtcctgaat

SEQ ID NO: 6525305 - DNA, 18 bp, Homo sapiens
ttatcatgtgaaatcatt

SEQ ID NO: 6525306 - DNA, 22 bp, Homo sapiens
ttatcatgtgaaatcattcatt

SEQ ID NO: 6525307 - DNA, 11 bp, Homo sapiens
ttatcatgtgt

SEQ ID NO: 6525308 - DNA, 15 bp, Homo sapiens
ttatcatgtgtaatc

SEQ ID NO: 6525309 - DNA, 21 bp, Homo sapiens
ttatcatgtgtaatcaataaa

SEQ ID NO: 6525310 - DNA, 15 bp, Homo sapiens
ttatcattaaaaatt

SEQ ID NO: 6525311 - DNA, 17 bp, Homo sapiens
ttatcattaaaaattac

SEQ ID NO: 6525312 - DNA, 21 bp, Homo sapiens
ttatcattaatttttaattga

SEQ ID NO: 6525313 - DNA, 16 bp, Homo sapiens
ttatcatttttgtata

SEQ ID NO: 6525314 - DNA, 15 bp, Homo sapiens
ttatccaaaatgctt

SEQ ID NO: 6525315 - DNA, 18 bp, Homo sapiens
ttatccaaaatgtgtatt

SEQ ID NO: 6525316 - DNA, 21 bp, Homo sapiens
ttatccaaaatgtgtatttct

SEQ ID NO: 6525317 - DNA, 22 bp, Homo sapiens
ttatccaaaatgtgtatttctt

SEQ ID NO: 6525318 - DNA, 15 bp, Homo sapiens
ttatccaatcctcag

SEQ ID NO: 6525319 - DNA, 20 bp, Homo sapiens
ttatccacttttcttcttcc

SEQ ID NO: 6525320 - DNA, 21 bp, Homo sapiens
ttatccacttttcttcttcct

SEQ ID NO: 6525321 - DNA, 14 bp, Homo sapiens
ttatccataaaaaa

SEQ ID NO: 6525322 - DNA, 15 bp, Homo sapiens
ttatccataatgatg

SEQ ID NO: 6525323 - DNA, 12 bp, Homo sapiens
ttatccatatta

SEQ ID NO: 6525324 - DNA, 22 bp, Homo sapiens
ttatccatattacgttgtttct

SEQ ID NO: 6525325 - DNA, 17 bp, Homo sapiens
ttatccatgacaggcct

SEQ ID NO: 6525326 - DNA, 18 bp, Homo sapiens
ttatccatggggaaggga

SEQ ID NO: 6525327 - DNA, 19 bp, Homo sapiens
ttatccattacgtgcattt

SEQ ID NO: 6525328 - DNA, 23 bp, Homo sapiens
ttatccattcccaagatgcctga

SEQ ID NO: 6525329 - DNA, 23 bp, Homo sapiens
ttatcccaaagttgttgtaacct

SEQ ID NO: 6525330 - DNA, 22 bp, Homo sapiens
ttatcccacggaaaatgccaat

SEQ ID NO: 6525331 - DNA, 21 bp, Homo sapiens
ttatcccatttagtgtgaata

SEQ ID NO: 6525332 - DNA, 19 bp, Homo sapiens
ttatcccccccagcctggc

SEQ ID NO: 6525333 - DNA, 20 bp, Homo sapiens
ttatccctattttgctgatg

SEQ ID NO: 6525334 - DNA, 15 bp, Homo sapiens
ttatccctcattcat

SEQ ID NO: 6525335 - DNA, 14 bp, Homo sapiens
ttatcccttaagaa

SEQ ID NO: 6525336 - DNA, 16 bp, Homo sapiens
ttatcccttaagaatg

SEQ ID NO: 6525337 - DNA, 20 bp, Homo sapiens
ttatccctttacaatgtgaa

SEQ ID NO: 6525338 - DNA, 23 bp, Homo sapiens
ttatccctttacaatgtgaatag

SEQ ID NO: 6525339 - DNA, 13 bp, Homo sapiens
ttatcctaaagat

SEQ ID NO: 6525340 - DNA, 15 bp, Homo sapiens
ttatcctagaaaatt

SEQ ID NO: 6525341 - DNA, 19 bp, Homo sapiens
ttatcctagaaaattgttt

SEQ ID NO: 6525342 - DNA, 18 bp, Homo sapiens
ttatcctagcacatgctt

SEQ ID NO: 6525343 - DNA, 20 bp, Homo sapiens
ttatcctcaagttgtgtgct

SEQ ID NO: 6525344 - DNA, 15 bp, Homo sapiens
ttatcctcacataaa

SEQ ID NO: 6525345 - DNA, 16 bp, Homo sapiens
ttatcctccaccgtct

SEQ ID NO: 6525346 - DNA, 11 bp, Homo sapiens
ttatcctccct

SEQ ID NO: 6525347 - DNA, 19 bp, Homo sapiens
ttatcctctgatctccatg

SEQ ID NO: 6525348 - DNA, 21 bp, Homo sapiens
ttatcctctgatctccatggc

SEQ ID NO: 6525349 - DNA, 11 bp, Homo sapiens
ttatcctctgt

SEQ ID NO: 6525350 - DNA, 14 bp, Homo sapiens
ttatcctcttggtg

SEQ ID NO: 6525351 - DNA, 14 bp, Homo sapiens
ttatcctctttaga

SEQ ID NO: 6525352 - DNA, 22 bp, Homo sapiens
ttatcctgaactcttctgcaaa

SEQ ID NO: 6525353 - DNA, 23 bp, Homo sapiens
ttatcctgcaagggacaggaagg

SEQ ID NO: 6525354 - DNA, 14 bp, Homo sapiens
ttatcctgtattct

SEQ ID NO: 6525355 - DNA, 16 bp, Homo sapiens
ttatcctgtattcttg

SEQ ID NO: 6525356 - DNA, 15 bp, Homo sapiens
ttatcctgtgtgatt

SEQ ID NO: 6525357 - DNA, 22 bp, Homo sapiens
ttatccttacactcccccagcc

SEQ ID NO: 6525358 - DNA, 22 bp, Homo sapiens
ttatccttaggaaaatgcttct

SEQ ID NO: 6525359 - DNA, 23 bp, Homo sapiens
ttatccttgtctgaatgtattta

SEQ ID NO: 6525360 - DNA, 16 bp, Homo sapiens
ttatccttttatctca

SEQ ID NO: 6525361 - DNA, 14 bp, Homo sapiens
ttatcgaaactcat

SEQ ID NO: 6525362 - DNA, 23 bp, Homo sapiens
ttatcgagcatgttgttttttca

SEQ ID NO: 6525363 - DNA, 15 bp, Homo sapiens
ttatcggaagcagtg

SEQ ID NO: 6525364 - DNA, 16 bp, Homo sapiens
ttatcggaagcagtgc

SEQ ID NO: 6525365 - DNA, 18 bp, Homo sapiens
ttatcggacattctaatg

SEQ ID NO: 6525366 - DNA, 22 bp, Homo sapiens
ttatcggattactgaattgtat

SEQ ID NO: 6525367 - DNA, 18 bp, Homo sapiens
ttatcggctctattctct

SEQ ID NO: 6525368 - DNA, 16 bp, Homo sapiens
ttatcgggaacagtgt

SEQ ID NO: 6525369 - DNA, 17 bp, Homo sapiens
ttatcgggaacagtgtt

SEQ ID NO: 6525370 - DNA, 16 bp, Homo sapiens
ttatcgggagcagtgt

SEQ ID NO: 6525371 - DNA, 18 bp, Homo sapiens
ttatcgggagcagtgtct

SEQ ID NO: 6525372 - DNA, 23 bp, Homo sapiens
ttatcgggagcagtgtcttccat

SEQ ID NO: 6525373 - DNA, 23 bp, Homo sapiens
ttatctaaacccagcaaaacaga

SEQ ID NO: 6525374 - DNA, 16 bp, Homo sapiens
ttatctaaatgaatga

SEQ ID NO: 6525375 - DNA, 23 bp, Homo sapiens
ttatctaactatatgtacagctc

SEQ ID NO: 6525376 - DNA, 22 bp, Homo sapiens
ttatctaaggtccccagcagaa

SEQ ID NO: 6525377 - DNA, 21 bp, Homo sapiens
ttatctaagttaatttaaagt

SEQ ID NO: 6525378 - DNA, 18 bp, Homo sapiens
ttatctaatcatgaaact

SEQ ID NO: 6525379 - DNA, 16 bp, Homo sapiens
ttatctaatttataaa

SEQ ID NO: 6525380 - DNA, 17 bp, Homo sapiens
ttatctaatttataaaa

SEQ ID NO: 6525381 - DNA, 18 bp, Homo sapiens
ttatctaccaactttcaa

SEQ ID NO: 6525382 - DNA, 23 bp, Homo sapiens
ttatctacccaagggcagaaagt

SEQ ID NO: 6525383 - DNA, 18 bp, Homo sapiens
ttatctacctcaaggtaa

SEQ ID NO: 6525384 - DNA, 23 bp, Homo sapiens
ttatctactaattgagccattta

SEQ ID NO: 6525385 - DNA, 20 bp, Homo sapiens
ttatctacttccaaactaat

SEQ ID NO: 6525386 - DNA, 23 bp, Homo sapiens
ttatctagaaattaagattgaag

SEQ ID NO: 6525387 - DNA, 17 bp, Homo sapiens
ttatctagatgtaaatt

SEQ ID NO: 6525388 - DNA, 23 bp, Homo sapiens
ttatctagcaagaagattctaaa

SEQ ID NO: 6525389 - DNA, 17 bp, Homo sapiens
ttatctataatttacct

SEQ ID NO: 6525390 - DNA, 18 bp, Homo sapiens
ttatctatgatgtttctt

SEQ ID NO: 6525391 - DNA, 14 bp, Homo sapiens
ttatctatggaaat

SEQ ID NO: 6525392 - DNA, 19 bp, Homo sapiens
ttatctattaaaattgcca

SEQ ID NO: 6525393 - DNA, 22 bp, Homo sapiens
ttatctattaaaattgccattt

SEQ ID NO: 6525394 - DNA, 21 bp, Homo sapiens
ttatctatttgtatatataca

SEQ ID NO: 6525395 - DNA, 22 bp, Homo sapiens
ttatctatttgtatatatacat

SEQ ID NO: 6525396 - DNA, 12 bp, Homo sapiens
ttatctcaagta

SEQ ID NO: 6525397 - DNA, 21 bp, Homo sapiens
ttatctcaagtaaaacaaatg

SEQ ID NO: 6525398 - DNA, 20 bp, Homo sapiens
ttatctcactttgtaaataa

SEQ ID NO: 6525399 - DNA, 17 bp, Homo sapiens
ttatctcagtcatgcat

SEQ ID NO: 6525400 - DNA, 21 bp, Homo sapiens
ttatctcagtcatgcataaat

SEQ ID NO: 6525401 - DNA, 22 bp, Homo sapiens
ttatctcagtcatgcataaata

SEQ ID NO: 6525402 - DNA, 23 bp, Homo sapiens
ttatctccagccaatttcaaaga

SEQ ID NO: 6525403 - DNA, 20 bp, Homo sapiens
ttatctccatactttggatg

SEQ ID NO: 6525404 - DNA, 21 bp, Homo sapiens
ttatctccccttcacatgcat

SEQ ID NO: 6525405 - DNA, 14 bp, Homo sapiens
ttatctccctgctt

SEQ ID NO: 6525406 - DNA, 17 bp, Homo sapiens
ttatctccctgcttcat

SEQ ID NO: 6525407 - DNA, 22 bp, Homo sapiens
ttatctccctgcttcatatctc

SEQ ID NO: 6525408 - DNA, 17 bp, Homo sapiens
ttatctcctaattgtat

SEQ ID NO: 6525409 - DNA, 22 bp, Homo sapiens
ttatctcctaattgtatgttag

SEQ ID NO: 6525410 - DNA, 14 bp, Homo sapiens
ttatctcctcctcc

SEQ ID NO: 6525411 - DNA, 14 bp, Homo sapiens
ttatctcctgtgat

SEQ ID NO: 6525412 - DNA, 17 bp, Homo sapiens
ttatctccttgtggcct

SEQ ID NO: 6525413 - DNA, 21 bp, Homo sapiens
ttatctcctttgaagaaggca

SEQ ID NO: 6525414 - DNA, 14 bp, Homo sapiens
ttatctctctgtgc

SEQ ID NO: 6525415 - DNA, 19 bp, Homo sapiens
ttatctcttttatatttgt

SEQ ID NO: 6525416 - DNA, 23 bp, Homo sapiens
ttatctgaaaggccagcagctga

SEQ ID NO: 6525417 - DNA, 20 bp, Homo sapiens
ttatctgaatagtgtcacca

SEQ ID NO: 6525418 - DNA, 18 bp, Homo sapiens
ttatctgaatttttaaac

SEQ ID NO: 6525419 - DNA, 20 bp, Homo sapiens
ttatctgaatttttaaacaa

SEQ ID NO: 6525420 - DNA, 15 bp, Homo sapiens
ttatctgatctgtga

SEQ ID NO: 6525421 - DNA, 12 bp, Homo sapiens
ttatctgcctgg

SEQ ID NO: 6525422 - DNA, 19 bp, Homo sapiens
ttatctgcctggcctggct

SEQ ID NO: 6525423 - DNA, 21 bp, Homo sapiens
ttatctgcctggcctggctcc

SEQ ID NO: 6525424 - DNA, 22 bp, Homo sapiens
ttatctggaagatctgcaaaca

SEQ ID NO: 6525425 - DNA, 19 bp, Homo sapiens
ttatctgggttctcttcat

SEQ ID NO: 6525426 - DNA, 22 bp, Homo sapiens
ttatctggtatggtgctaatat

SEQ ID NO: 6525427 - DNA, 16 bp, Homo sapiens
ttatctggtgcctcct

SEQ ID NO: 6525428 - DNA, 17 bp, Homo sapiens
ttatctggttctatatg

SEQ ID NO: 6525429 - DNA, 14 bp, Homo sapiens
ttatctgtaattgt

SEQ ID NO: 6525430 - DNA, 21 bp, Homo sapiens
ttatctgtaattgtaattcca

SEQ ID NO: 6525431 - DNA, 12 bp, Homo sapiens
ttatctgtccca

SEQ ID NO: 6525432 - DNA, 17 bp, Homo sapiens
ttatctgtctgagccct

SEQ ID NO: 6525433 - DNA, 20 bp, Homo sapiens
ttatctgtcttgacttttta

SEQ ID NO: 6525434 - DNA, 19 bp, Homo sapiens
ttatctgtgaccacacgct

SEQ ID NO: 6525435 - DNA, 19 bp, Homo sapiens
ttatctgtgcgtgaaacac

SEQ ID NO: 6525436 - DNA, 21 bp, Homo sapiens
ttatctgtggagttcctgctc

SEQ ID NO: 6525437 - DNA, 18 bp, Homo sapiens
ttatctgtgtttttgaaa

SEQ ID NO: 6525438 - DNA, 15 bp, Homo sapiens
ttatctgttctatgg

SEQ ID NO: 6525439 - DNA, 22 bp, Homo sapiens
ttatctgttctatggaccaaat

SEQ ID NO: 6525440 - DNA, 23 bp, Homo sapiens
ttatctgttctatggaccaaatg

SEQ ID NO: 6525441 - DNA, 15 bp, Homo sapiens
ttatctgttcttttg

SEQ ID NO: 6525442 - DNA, 16 bp, Homo sapiens
ttatctgttgccttat

SEQ ID NO: 6525443 - DNA, 16 bp, Homo sapiens
ttatctgttgtcccct

SEQ ID NO: 6525444 - DNA, 12 bp, Homo sapiens
ttatctgtttcc

SEQ ID NO: 6525445 - DNA, 16 bp, Homo sapiens
ttatctgtttgagaaa

SEQ ID NO: 6525446 - DNA, 20 bp, Homo sapiens
ttatctgtttgagaaagtca

SEQ ID NO: 6525447 - DNA, 14 bp, Homo sapiens
ttatctgttttcta

SEQ ID NO: 6525448 - DNA, 18 bp, Homo sapiens
ttatctgttttctacctc

SEQ ID NO: 6525449 - DNA, 23 bp, Homo sapiens
ttatctgttttctacctcctcct

SEQ ID NO: 6525450 - DNA, 16 bp, Homo sapiens
ttatcttaaaactcct

SEQ ID NO: 6525451 - DNA, 13 bp, Homo sapiens
ttatcttaaaagg

SEQ ID NO: 6525452 - DNA, 14 bp, Homo sapiens
ttatcttaaaccca

SEQ ID NO: 6525453 - DNA, 13 bp, Homo sapiens
ttatcttaaatat

SEQ ID NO: 6525454 - DNA, 18 bp, Homo sapiens
ttatcttaaatatgaatt

SEQ ID NO: 6525455 - DNA, 14 bp, Homo sapiens
ttatcttaacactg

SEQ ID NO: 6525456 - DNA, 13 bp, Homo sapiens
tggctgccctggc

SEQ ID NO: 6525457 - DNA, 18 bp, Homo sapiens
tggctgccgttttctggg

SEQ ID NO: 6525458 - DNA, 14 bp, Homo sapiens
tggctgcctccact

SEQ ID NO: 6525459 - DNA, 16 bp, Homo sapiens
tggctgcctctgggag

SEQ ID NO: 6525460 - DNA, 14 bp, Homo sapiens
tggctgcctggagc

SEQ ID NO: 6525461 - DNA, 16 bp, Homo sapiens
tggctgcctggagccc

SEQ ID NO: 6525462 - DNA, 15 bp, Homo sapiens
tggctgcctggccca

SEQ ID NO: 6525463 - DNA, 20 bp, Homo sapiens
tggctgccttctgcggagct

SEQ ID NO: 6525464 - DNA, 20 bp, Homo sapiens
tggctgcctttgatcacagg

SEQ ID NO: 6525465 - DNA, 21 bp, Homo sapiens
tggctgcctttgatcacagga

SEQ ID NO: 6525466 - DNA, 17 bp, Homo sapiens
tggctgcgaactgtgca

SEQ ID NO: 6525467 - DNA, 20 bp, Homo sapiens
tggctgcgaactgtgcagtt

SEQ ID NO: 6525468 - DNA, 18 bp, Homo sapiens
tggctgcgctaaccccca

SEQ ID NO: 6525469 - DNA, 16 bp, Homo sapiens
tggctgcgtactccac

SEQ ID NO: 6525470 - DNA, 19 bp, Homo sapiens
tggctgcgtactccactgg

SEQ ID NO: 6525471 - DNA, 23 bp, Homo sapiens
tggctgctagattttaatttatt

SEQ ID NO: 6525472 - DNA, 15 bp, Homo sapiens
tggctgctagcactt

SEQ ID NO: 6525473 - DNA, 16 bp, Homo sapiens
tggctgctaggccaga

SEQ ID NO: 6525474 - DNA, 14 bp, Homo sapiens
tggctgctctccat

SEQ ID NO: 6525475 - DNA, 20 bp, Homo sapiens
tggctgctctccatctcttg

SEQ ID NO: 6525476 - DNA, 12 bp, Homo sapiens
tggctgctctgt

SEQ ID NO: 6525477 - DNA, 12 bp, Homo sapiens
tggctgctcttt

SEQ ID NO: 6525478 - DNA, 15 bp, Homo sapiens
tggctgctgccccca

SEQ ID NO: 6525479 - DNA, 14 bp, Homo sapiens
tggctgctgcttct

SEQ ID NO: 6525480 - DNA, 14 bp, Homo sapiens
tggctgctggccca

SEQ ID NO: 6525481 - DNA, 20 bp, Homo sapiens
tggctgcttaaactggaaag

SEQ ID NO: 6525482 - DNA, 15 bp, Homo sapiens
tggctgcttcctgtg

SEQ ID NO: 6525483 - DNA, 17 bp, Homo sapiens
tggctgcttcctgtgac

SEQ ID NO: 6525484 - DNA, 15 bp, Homo sapiens
tggctgcttgcagcc

SEQ ID NO: 6525485 - DNA, 19 bp, Homo sapiens
tggctgcttgcagccagga

SEQ ID NO: 6525486 - DNA, 21 bp, Homo sapiens
tggctgcttgcagccaggaga

SEQ ID NO: 6525487 - DNA, 16 bp, Homo sapiens
tggctgctttgcctct

SEQ ID NO: 6525488 - DNA, 18 bp, Homo sapiens
tggctgctttgcctctac

SEQ ID NO: 6525489 - DNA, 18 bp, Homo sapiens
tggctggaaactgctccc

SEQ ID NO: 6525490 - DNA, 18 bp, Homo sapiens
tggctggaagagggtgaa

SEQ ID NO: 6525491 - DNA, 13 bp, Homo sapiens
tggctggaagggg

SEQ ID NO: 6525492 - DNA, 23 bp, Homo sapiens
tggctggacccagccaggcccag

SEQ ID NO: 6525493 - DNA, 11 bp, Homo sapiens
tggctggactg

SEQ ID NO: 6525494 - DNA, 15 bp, Homo sapiens
tggctggactgtaga

SEQ ID NO: 6525495 - DNA, 17 bp, Homo sapiens
tggctggagccccatcg

SEQ ID NO: 6525496 - DNA, 11 bp, Homo sapiens
tggctggagcg

SEQ ID NO: 6525497 - DNA, 18 bp, Homo sapiens
tggctggagcggagatga

SEQ ID NO: 6525498 - DNA, 19 bp, Homo sapiens
tggctggagcggagatgag

SEQ ID NO: 6525499 - DNA, 14 bp, Homo sapiens
tggctggaggaagg

SEQ ID NO: 6525500 - DNA, 23 bp, Homo sapiens
tggctggaggagcagcagcttgg

SEQ ID NO: 6525501 - DNA, 18 bp, Homo sapiens
tggctggaggagctggcc

SEQ ID NO: 6525502 - DNA, 20 bp, Homo sapiens
tggctggaggagctggcctg

SEQ ID NO: 6525503 - DNA, 23 bp, Homo sapiens
tggctggaggagctggcctgtgg

SEQ ID NO: 6525504 - DNA, 19 bp, Homo sapiens
tggctggaggcattcccag

SEQ ID NO: 6525505 - DNA, 19 bp, Homo sapiens
tggctggatgaaattttct

SEQ ID NO: 6525506 - DNA, 16 bp, Homo sapiens
tggctggatgtgcatc

SEQ ID NO: 6525507 - DNA, 15 bp, Homo sapiens
tggctggcaggtgtt

SEQ ID NO: 6525508 - DNA, 19 bp, Homo sapiens
tggctggcctcacccaccc

SEQ ID NO: 6525509 - DNA, 12 bp, Homo sapiens
tggctggcctgg

SEQ ID NO: 6525510 - DNA, 14 bp, Homo sapiens
tggctggcctggta

SEQ ID NO: 6525511 - DNA, 15 bp, Homo sapiens
tggctggctcctagg

SEQ ID NO: 6525512 - DNA, 20 bp, Homo sapiens
tggctggctctaccttcctg

SEQ ID NO: 6525513 - DNA, 12 bp, Homo sapiens
tggctggctgag

SEQ ID NO: 6525514 - DNA, 13 bp, Homo sapiens
tggctggctgagg

SEQ ID NO: 6525515 - DNA, 15 bp, Homo sapiens
tggctggctgagggc

SEQ ID NO: 6525516 - DNA, 18 bp, Homo sapiens
tggctggctgagggcagt

SEQ ID NO: 6525517 - DNA, 23 bp, Homo sapiens
tggctgggaactcacctggggct

SEQ ID NO: 6525518 - DNA, 21 bp, Homo sapiens
tggctgggaactgcagacctg

SEQ ID NO: 6525519 - DNA, 16 bp, Homo sapiens
tggctgggactcctgg

SEQ ID NO: 6525520 - DNA, 14 bp, Homo sapiens
tggctgggaggagg

SEQ ID NO: 6525521 - DNA, 18 bp, Homo sapiens
tggctgggagggggccct

SEQ ID NO: 6525522 - DNA, 15 bp, Homo sapiens
tggctgggccatcct

SEQ ID NO: 6525523 - DNA, 11 bp, Homo sapiens
tggctgggccc

SEQ ID NO: 6525524 - DNA, 13 bp, Homo sapiens
tggctgggcccct

SEQ ID NO: 6525525 - DNA, 16 bp, Homo sapiens
tggctgggcccctggg

SEQ ID NO: 6525526 - DNA, 16 bp, Homo sapiens
tggctgggcctgggct

SEQ ID NO: 6525527 - DNA, 16 bp, Homo sapiens
tggctgggccttcacc

SEQ ID NO: 6525528 - DNA, 22 bp, Homo sapiens
tggctgggcgtgctagaggttg

SEQ ID NO: 6525529 - DNA, 11 bp, Homo sapiens
tggctgggctg

SEQ ID NO: 6525530 - DNA, 18 bp, Homo sapiens
tggctgggctgctcctga

SEQ ID NO: 6525531 - DNA, 14 bp, Homo sapiens
tggctggggcagag

SEQ ID NO: 6525532 - DNA, 14 bp, Homo sapiens
tggctggggcatgg

SEQ ID NO: 6525533 - DNA, 20 bp, Homo sapiens
tggctggggcatggaaggca

SEQ ID NO: 6525534 - DNA, 15 bp, Homo sapiens
tggctggggccgctg

SEQ ID NO: 6525535 - DNA, 17 bp, Homo sapiens
tggctggggccggggct

SEQ ID NO: 6525536 - DNA, 20 bp, Homo sapiens
tggctggggccggggctgcc

SEQ ID NO: 6525537 - DNA, 18 bp, Homo sapiens
tggctggggctggcacgg

SEQ ID NO: 6525538 - DNA, 18 bp, Homo sapiens
tggctgggggagggactg

SEQ ID NO: 6525539 - DNA, 15 bp, Homo sapiens
tggctgggggcagga

SEQ ID NO: 6525540 - DNA, 16 bp, Homo sapiens
tggctgggggcctcag

SEQ ID NO: 6525541 - DNA, 11 bp, Homo sapiens
tggctgggggg

SEQ ID NO: 6525542 - DNA, 16 bp, Homo sapiens
tggctggggggatgac

SEQ ID NO: 6525543 - DNA, 19 bp, Homo sapiens
tggctggggggtctcagca

SEQ ID NO: 6525544 - DNA, 20 bp, Homo sapiens
tggctggggggtctcagcat

SEQ ID NO: 6525545 - DNA, 18 bp, Homo sapiens
tggctgggtcaccagaaa

SEQ ID NO: 6525546 - DNA, 14 bp, Homo sapiens
tggctgggtcaggg

SEQ ID NO: 6525547 - DNA, 13 bp, Homo sapiens
tggctgggtcctt

SEQ ID NO: 6525548 - DNA, 22 bp, Homo sapiens
tggctgggtccttgggcctggc

SEQ ID NO: 6525549 - DNA, 19 bp, Homo sapiens
tggctgggtttgggcagtg

SEQ ID NO: 6525550 - DNA, 22 bp, Homo sapiens
tggctggtaagggccaagtccc

SEQ ID NO: 6525551 - DNA, 21 bp, Homo sapiens
tggctggtagcagcaggctca

SEQ ID NO: 6525552 - DNA, 23 bp, Homo sapiens
tggctggtcacgacttcttcgga

SEQ ID NO: 6525553 - DNA, 16 bp, Homo sapiens
tggctggtccagggct

SEQ ID NO: 6525554 - DNA, 22 bp, Homo sapiens
tggctggtctggagtcccaccc

SEQ ID NO: 6525555 - DNA, 17 bp, Homo sapiens
tggctggtgcccatgaa

SEQ ID NO: 6525556 - DNA, 18 bp, Homo sapiens
tggctggtgcccatgaag

SEQ ID NO: 6525557 - DNA, 23 bp, Homo sapiens
tggctggtgccgaagtgtttctg

SEQ ID NO: 6525558 - DNA, 21 bp, Homo sapiens
tggctggtgggaaggccggca

SEQ ID NO: 6525559 - DNA, 19 bp, Homo sapiens
tggctggtgtatgcacagg

SEQ ID NO: 6525560 - DNA, 15 bp, Homo sapiens
tggctggtgtcccct

SEQ ID NO: 6525561 - DNA, 19 bp, Homo sapiens
tggctggtgtccccttccc

SEQ ID NO: 6525562 - DNA, 13 bp, Homo sapiens
tggctggtgtggt

SEQ ID NO: 6525563 - DNA, 19 bp, Homo sapiens
tggctggtgtggtacagag

SEQ ID NO: 6525564 - DNA, 18 bp, Homo sapiens
tggctggttaatgggaaa

SEQ ID NO: 6525565 - DNA, 21 bp, Homo sapiens
tggctgtaaactataaactac

SEQ ID NO: 6525566 - DNA, 22 bp, Homo sapiens
tggctgtaatcatttgtttaca

SEQ ID NO: 6525567 - DNA, 20 bp, Homo sapiens
tggctgtacctgttcctccc

SEQ ID NO: 6525568 - DNA, 15 bp, Homo sapiens
tggctgtagataaat

SEQ ID NO: 6525569 - DNA, 18 bp, Homo sapiens
tggctgtagatcccaaga

SEQ ID NO: 6525570 - DNA, 21 bp, Homo sapiens
tggctgtagatggtgacctgg

SEQ ID NO: 6525571 - DNA, 18 bp, Homo sapiens
tggctgtatccatgtaat

SEQ ID NO: 6525572 - DNA, 17 bp, Homo sapiens
tggctgtatcttgtttt

SEQ ID NO: 6525573 - DNA, 15 bp, Homo sapiens
tggctgtatgtctga

SEQ ID NO: 6525574 - DNA, 13 bp, Homo sapiens
tggctgtattttt

SEQ ID NO: 6525575 - DNA, 18 bp, Homo sapiens
tggctgtatttttagaga

SEQ ID NO: 6525576 - DNA, 19 bp, Homo sapiens
tggctgtcaaatccatgtg

SEQ ID NO: 6525577 - DNA, 22 bp, Homo sapiens
tggctgtcaatgggacctgtgg

SEQ ID NO: 6525578 - DNA, 11 bp, Homo sapiens
tggctgtccag

SEQ ID NO: 6525579 - DNA, 15 bp, Homo sapiens
tggctgtccagtgcc

SEQ ID NO: 6525580 - DNA, 21 bp, Homo sapiens
tggctgtcctaccatcagctc

SEQ ID NO: 6525581 - DNA, 23 bp, Homo sapiens
tggctgtcctaccatcagctctg

SEQ ID NO: 6525582 - DNA, 19 bp, Homo sapiens
tggctgtccttccccttcc

SEQ ID NO: 6525583 - DNA, 21 bp, Homo sapiens
tggctgtctgaccagagaatg

SEQ ID NO: 6525584 - DNA, 18 bp, Homo sapiens
tggctgtctggaaagccc

SEQ ID NO: 6525585 - DNA, 17 bp, Homo sapiens
tggctgtgaaagaaaat

SEQ ID NO: 6525586 - DNA, 21 bp, Homo sapiens
tggctgtgaatgccaaagcca

SEQ ID NO: 6525587 - DNA, 22 bp, Homo sapiens
tggctgtgaatgccaaagccat

SEQ ID NO: 6525588 - DNA, 21 bp, Homo sapiens
tggctgtgacaaccctggcct

SEQ ID NO: 6525589 - DNA, 17 bp, Homo sapiens
tggctgtgacacctggt

SEQ ID NO: 6525590 - DNA, 19 bp, Homo sapiens
tggctgtgacacctggtgc

SEQ ID NO: 6525591 - DNA, 14 bp, Homo sapiens
tggctgtgacctct

SEQ ID NO: 6525592 - DNA, 17 bp, Homo sapiens
tggctgtgagcagcctc

SEQ ID NO: 6525593 - DNA, 16 bp, Homo sapiens
tggctgtgatcttaaa

SEQ ID NO: 6525594 - DNA, 16 bp, Homo sapiens
tggctgtgatgagtgt

SEQ ID NO: 6525595 - DNA, 17 bp, Homo sapiens
tggctgtgattaattat

SEQ ID NO: 6525596 - DNA, 19 bp, Homo sapiens
tggctgtgcccagcaggcc

SEQ ID NO: 6525597 - DNA, 13 bp, Homo sapiens
tggctgtgcccca

SEQ ID NO: 6525598 - DNA, 14 bp, Homo sapiens
tggctgtgcctgct

SEQ ID NO: 6525599 - DNA, 21 bp, Homo sapiens
tggctgtggaataggaacgct

SEQ ID NO: 6525600 - DNA, 14 bp, Homo sapiens
tggctgtggaggcc

SEQ ID NO: 6525601 - DNA, 17 bp, Homo sapiens
tggctgtggaggcctga

SEQ ID NO: 6525602 - DNA, 16 bp, Homo sapiens
tggctgtggagtgtgg

SEQ ID NO: 6525603 - DNA, 15 bp, Homo sapiens
tggctgtggcacaga

SEQ ID NO: 6525604 - DNA, 14 bp, Homo sapiens
tggctgtggcaggc

SEQ ID NO: 6525605 - DNA, 17 bp, Homo sapiens
tggctgtggcatccaga

SEQ ID NO: 6525606 - DNA, 18 bp, Homo sapiens
tggctgtggcattgttga

SEQ ID NO: 6525607 - DNA, 20 bp, Homo sapiens
tggctgtggcatttccaaac

SEQ ID NO: 6525608 - DNA, 15 bp, Homo sapiens
tggctgtggtcagca

SEQ ID NO: 6525609 - DNA, 16 bp, Homo sapiens
tggctgtggtcagcag

SEQ ID NO: 6525610 - DNA, 21 bp, Homo sapiens
tggctgtggttcctaagcctg

SEQ ID NO: 6525611 - DNA, 16 bp, Homo sapiens
tggctgtgtactttga

SEQ ID NO: 6525612 - DNA, 14 bp, Homo sapiens
tggctgtgtctaaa

SEQ ID NO: 6525613 - DNA, 19 bp, Homo sapiens
tggctgtgtctaaactgca

SEQ ID NO: 6525614 - DNA, 13 bp, Homo sapiens
tggctgtgtctct

SEQ ID NO: 6525615 - DNA, 22 bp, Homo sapiens
tggctgtgttctggtgaggcct

SEQ ID NO: 6525616 - DNA, 22 bp, Homo sapiens
tggctgttaagaagtttgttat

SEQ ID NO: 6525617 - DNA, 14 bp, Homo sapiens
tggctgttctggaa

SEQ ID NO: 6525618 - DNA, 18 bp, Homo sapiens
tggctgttggcagtgagt

SEQ ID NO: 6525619 - DNA, 18 bp, Homo sapiens
tggctgttggctgggggc

SEQ ID NO: 6525620 - DNA, 22 bp, Homo sapiens
tggctgtttcttgtctgttatg

SEQ ID NO: 6525621 - DNA, 16 bp, Homo sapiens
tggctgtttggacttt

SEQ ID NO: 6525622 - DNA, 12 bp, Homo sapiens
tggctgtttgtt

SEQ ID NO: 6525623 - DNA, 20 bp, Homo sapiens
tggctgttttccctctgctg

SEQ ID NO: 6525624 - DNA, 22 bp, Homo sapiens
tggctgttttccctctgctgct

SEQ ID NO: 6525625 - DNA, 17 bp, Homo sapiens
tggcttaaaacaacact

SEQ ID NO: 6525626 - DNA, 13 bp, Homo sapiens
tggcttaaaatgt

SEQ ID NO: 6525627 - DNA, 20 bp, Homo sapiens
tggcttaaagtgaaggaaat

SEQ ID NO: 6525628 - DNA, 19 bp, Homo sapiens
tggcttaaatatagttcct

SEQ ID NO: 6525629 - DNA, 22 bp, Homo sapiens
tggcttaaatatagttcctaag

SEQ ID NO: 6525630 - DNA, 21 bp, Homo sapiens
tggcttaagtgagcagaacag

SEQ ID NO: 6525631 - DNA, 15 bp, Homo sapiens
tggcttaatcatttt

SEQ ID NO: 6525632 - DNA, 16 bp, Homo sapiens
tggcttaatgcttctt

SEQ ID NO: 6525633 - DNA, 14 bp, Homo sapiens
tggcttactgaaag

SEQ ID NO: 6525634 - DNA, 13 bp, Homo sapiens
tggcttagaaatc

SEQ ID NO: 6525635 - DNA, 19 bp, Homo sapiens
ttatcttaacactgaaatt

SEQ ID NO: 6525636 - DNA, 20 bp, Homo sapiens
ttatcttacaatattgattg

SEQ ID NO: 6525637 - DNA, 12 bp, Homo sapiens
ttatcttagctg

SEQ ID NO: 6525638 - DNA, 20 bp, Homo sapiens
ttatcttatactgtacaata

SEQ ID NO: 6525639 - DNA, 14 bp, Homo sapiens
ttatcttattttct

SEQ ID NO: 6525640 - DNA, 22 bp, Homo sapiens
ttatcttctcaagttctaagat

SEQ ID NO: 6525641 - DNA, 21 bp, Homo sapiens
ttatcttctgtttttctcaaa

SEQ ID NO: 6525642 - DNA, 22 bp, Homo sapiens
ttatcttctgtttttctcaaat

SEQ ID NO: 6525643 - DNA, 19 bp, Homo sapiens
ttatcttctttattattcc

SEQ ID NO: 6525644 - DNA, 17 bp, Homo sapiens
ttatcttgaagtcagcc

SEQ ID NO: 6525645 - DNA, 14 bp, Homo sapiens
ttatcttgagtgtt

SEQ ID NO: 6525646 - DNA, 17 bp, Homo sapiens
ttatcttgatacattca

SEQ ID NO: 6525647 - DNA, 15 bp, Homo sapiens
ttatcttgctttgga

SEQ ID NO: 6525648 - DNA, 16 bp, Homo sapiens
ttatcttggactgaca

SEQ ID NO: 6525649 - DNA, 19 bp, Homo sapiens
ttatcttggccttactgta

SEQ ID NO: 6525650 - DNA, 17 bp, Homo sapiens
ttatcttggttgaaaat

SEQ ID NO: 6525651 - DNA, 18 bp, Homo sapiens
ttatcttgttattattgt

SEQ ID NO: 6525652 - DNA, 12 bp, Homo sapiens
ttatctttaaaa

SEQ ID NO: 6525653 - DNA, 16 bp, Homo sapiens
ttatctttacttttaa

SEQ ID NO: 6525654 - DNA, 19 bp, Homo sapiens
ttatctttagttgaattcc

SEQ ID NO: 6525655 - DNA, 15 bp, Homo sapiens
ttatctttcgcacag

SEQ ID NO: 6525656 - DNA, 23 bp, Homo sapiens
ttatctttctttccatttacagt

SEQ ID NO: 6525657 - DNA, 16 bp, Homo sapiens
ttatcttttagctaga

SEQ ID NO: 6525658 - DNA, 17 bp, Homo sapiens
ttatcttttctacagca

SEQ ID NO: 6525659 - DNA, 14 bp, Homo sapiens
ttatcttttggctt

SEQ ID NO: 6525660 - DNA, 15 bp, Homo sapiens
ttatcttttggcttc

SEQ ID NO: 6525661 - DNA, 18 bp, Homo sapiens
ttatgaaaaaaatatatt

SEQ ID NO: 6525662 - DNA, 23 bp, Homo sapiens
ttatgaaaaaatatgaacctatt

SEQ ID NO: 6525663 - DNA, 22 bp, Homo sapiens
ttatgaaaaaatgttcaaattc

SEQ ID NO: 6525664 - DNA, 13 bp, Homo sapiens
ttatgaaaaacat

SEQ ID NO: 6525665 - DNA, 16 bp, Homo sapiens
ttatgaaaaacatccc

SEQ ID NO: 6525666 - DNA, 17 bp, Homo sapiens
ttatgaaaaagaagaat

SEQ ID NO: 6525667 - DNA, 18 bp, Homo sapiens
ttatgaaaaagaagaatc

SEQ ID NO: 6525668 - DNA, 19 bp, Homo sapiens
ttatgaaaaagaagaatct

SEQ ID NO: 6525669 - DNA, 15 bp, Homo sapiens
ttatgaaaagtacta

SEQ ID NO: 6525670 - DNA, 18 bp, Homo sapiens
ttatgaaaatgtaagtta

SEQ ID NO: 6525671 - DNA, 23 bp, Homo sapiens
ttatgaaaatgtaagttatgtgt

SEQ ID NO: 6525672 - DNA, 15 bp, Homo sapiens
ttatgaaacagaaaa

SEQ ID NO: 6525673 - DNA, 16 bp, Homo sapiens
ttatgaaacatatcat

SEQ ID NO: 6525674 - DNA, 17 bp, Homo sapiens
ttatgaaacatatcatg

SEQ ID NO: 6525675 - DNA, 18 bp, Homo sapiens
ttatgaaacttgtgtaaa

SEQ ID NO: 6525676 - DNA, 19 bp, Homo sapiens
ttatgaaacttgtgtaaat

SEQ ID NO: 6525677 - DNA, 17 bp, Homo sapiens
ttatgaaacttttggaa

SEQ ID NO: 6525678 - DNA, 18 bp, Homo sapiens
ttatgaaacttttggaag

SEQ ID NO: 6525679 - DNA, 15 bp, Homo sapiens
ttatgaaagaatata

SEQ ID NO: 6525680 - DNA, 12 bp, Homo sapiens
ttatgaaatgcc

SEQ ID NO: 6525681 - DNA, 15 bp, Homo sapiens
ttatgaaatgccaga

SEQ ID NO: 6525682 - DNA, 11 bp, Homo sapiens
ttatgaaatgg

SEQ ID NO: 6525683 - DNA, 22 bp, Homo sapiens
ttatgaaattaacaagaactca

SEQ ID NO: 6525684 - DNA, 19 bp, Homo sapiens
ttatgaaattcaccccctt

SEQ ID NO: 6525685 - DNA, 14 bp, Homo sapiens
ttatgaacagaaat

SEQ ID NO: 6525686 - DNA, 18 bp, Homo sapiens
ttatgaacagaaatattg

SEQ ID NO: 6525687 - DNA, 22 bp, Homo sapiens
ttatgaacattgtactgttgct

SEQ ID NO: 6525688 - DNA, 22 bp, Homo sapiens
ttatgaactgcatgtataaatg

SEQ ID NO: 6525689 - DNA, 23 bp, Homo sapiens
ttatgaagaaaaagtacaatgaa

SEQ ID NO: 6525690 - DNA, 20 bp, Homo sapiens
ttatgaagaaagatactaat

SEQ ID NO: 6525691 - DNA, 13 bp, Homo sapiens
ttatgaagagcta

SEQ ID NO: 6525692 - DNA, 14 bp, Homo sapiens
ttatgaaggaattt

SEQ ID NO: 6525693 - DNA, 23 bp, Homo sapiens
ttatgaaggacctgaaataaggt

SEQ ID NO: 6525694 - DNA, 15 bp, Homo sapiens
ttatgaagtgctaca

SEQ ID NO: 6525695 - DNA, 22 bp, Homo sapiens
ttatgaagttaacagtctcatt

SEQ ID NO: 6525696 - DNA, 14 bp, Homo sapiens
ttatgaagtttaaa

SEQ ID NO: 6525697 - DNA, 23 bp, Homo sapiens
ttatgaagtttttattttaaaca

SEQ ID NO: 6525698 - DNA, 13 bp, Homo sapiens
ttatgaataaaat

SEQ ID NO: 6525699 - DNA, 22 bp, Homo sapiens
ttatgaatatttataacagcat

SEQ ID NO: 6525700 - DNA, 12 bp, Homo sapiens
ttatgaatctga

SEQ ID NO: 6525701 - DNA, 21 bp, Homo sapiens
ttatgaatctgtgctggccat

SEQ ID NO: 6525702 - DNA, 14 bp, Homo sapiens
ttatgaatctttcc

SEQ ID NO: 6525703 - DNA, 14 bp, Homo sapiens
ttatgaatgaaaaa

SEQ ID NO: 6525704 - DNA, 17 bp, Homo sapiens
ttatgaatgagttttac

SEQ ID NO: 6525705 - DNA, 14 bp, Homo sapiens
ttatgaatgtgcat

SEQ ID NO: 6525706 - DNA, 16 bp, Homo sapiens
ttatgaattacatttg

SEQ ID NO: 6525707 - DNA, 17 bp, Homo sapiens
ttatgaattacatttgt

SEQ ID NO: 6525708 - DNA, 18 bp, Homo sapiens
ttatgaattataaatgtg

SEQ ID NO: 6525709 - DNA, 19 bp, Homo sapiens
ttatgaattataaatgtgt

SEQ ID NO: 6525710 - DNA, 23 bp, Homo sapiens
ttatgacaatgactgtgctactg

SEQ ID NO: 6525711 - DNA, 21 bp, Homo sapiens
ttatgacagaggttttgaaat

SEQ ID NO: 6525712 - DNA, 13 bp, Homo sapiens
ttatgacagtaat

SEQ ID NO: 6525713 - DNA, 23 bp, Homo sapiens
ttatgacatcacttgtacaaaat

SEQ ID NO: 6525714 - DNA, 22 bp, Homo sapiens
ttatgacatgaaaagttattta

SEQ ID NO: 6525715 - DNA, 12 bp, Homo sapiens
ttatgacatttt

SEQ ID NO: 6525716 - DNA, 14 bp, Homo sapiens
ttatgaccagagca

SEQ ID NO: 6525717 - DNA, 16 bp, Homo sapiens
ttatgaccagagcaaa

SEQ ID NO: 6525718 - DNA, 18 bp, Homo sapiens
ttatgacctaagtcaggt

SEQ ID NO: 6525719 - DNA, 22 bp, Homo sapiens
ttatgacctaagtcaggtaata

SEQ ID NO: 6525720 - DNA, 18 bp, Homo sapiens
ttatgacctcttccttta

SEQ ID NO: 6525721 - DNA, 14 bp, Homo sapiens
ttatgactaatcct

SEQ ID NO: 6525722 - DNA, 21 bp, Homo sapiens
ttatgactagcaaacaaaaat

SEQ ID NO: 6525723 - DNA, 22 bp, Homo sapiens
ttatgactagcaaacaaaaata

SEQ ID NO: 6525724 - DNA, 11 bp, Homo sapiens
ttatgactcca

SEQ ID NO: 6525725 - DNA, 19 bp, Homo sapiens
ttatgacttcattaataat

SEQ ID NO: 6525726 - DNA, 17 bp, Homo sapiens
ttatgagaaaaaaacag

SEQ ID NO: 6525727 - DNA, 13 bp, Homo sapiens
ttatgagaaactg

SEQ ID NO: 6525728 - DNA, 11 bp, Homo sapiens
ttatgagaaat

SEQ ID NO: 6525729 - DNA, 13 bp, Homo sapiens
ttatgagaacatg

SEQ ID NO: 6525730 - DNA, 21 bp, Homo sapiens
ttatgagaactggttcttgcc

SEQ ID NO: 6525731 - DNA, 20 bp, Homo sapiens
ttatgagacttcctattaat

SEQ ID NO: 6525732 - DNA, 19 bp, Homo sapiens
ttatgagaggctgtcatat

SEQ ID NO: 6525733 - DNA, 16 bp, Homo sapiens
ttatgagatactttgc

SEQ ID NO: 6525734 - DNA, 15 bp, Homo sapiens
ttatgagatctaatg

SEQ ID NO: 6525735 - DNA, 18 bp, Homo sapiens
ttatgagatctaatgtga

SEQ ID NO: 6525736 - DNA, 19 bp, Homo sapiens
ttatgagatctaatgtgaa

SEQ ID NO: 6525737 - DNA, 21 bp, Homo sapiens
ttatgagccgacttctttggt

SEQ ID NO: 6525738 - DNA, 21 bp, Homo sapiens
ttatgaggaaacttggacatt

SEQ ID NO: 6525739 - DNA, 21 bp, Homo sapiens
ttatgaggacgtgtctgttat

SEQ ID NO: 6525740 - DNA, 19 bp, Homo sapiens
ttatgaggatataatgtgt

SEQ ID NO: 6525741 - DNA, 19 bp, Homo sapiens
ttatgaggttgatatcggt

SEQ ID NO: 6525742 - DNA, 15 bp, Homo sapiens
ttatgagtaactatt

SEQ ID NO: 6525743 - DNA, 16 bp, Homo sapiens
ttatgagtctttgaga

SEQ ID NO: 6525744 - DNA, 15 bp, Homo sapiens
ttatgagttagcttt

SEQ ID NO: 6525745 - DNA, 18 bp, Homo sapiens
ttatgagttccctaaaca

SEQ ID NO: 6525746 - DNA, 15 bp, Homo sapiens
ttatgagtttgctta

SEQ ID NO: 6525747 - DNA, 15 bp, Homo sapiens
ttatgagtttttgat

SEQ ID NO: 6525748 - DNA, 23 bp, Homo sapiens
ttatgagtttttgatagctttat

SEQ ID NO: 6525749 - DNA, 13 bp, Homo sapiens
ttatgataaaaaa

SEQ ID NO: 6525750 - DNA, 21 bp, Homo sapiens
ttatgataaaaaattttgtaa

SEQ ID NO: 6525751 - DNA, 16 bp, Homo sapiens
ttatgataatagattc

SEQ ID NO: 6525752 - DNA, 18 bp, Homo sapiens
ttatgataatagattctc

SEQ ID NO: 6525753 - DNA, 12 bp, Homo sapiens
ttatgatagatt

SEQ ID NO: 6525754 - DNA, 22 bp, Homo sapiens
ttatgatagcaaatggcctcat

SEQ ID NO: 6525755 - DNA, 18 bp, Homo sapiens
ttatgatatttttttaag

SEQ ID NO: 6525756 - DNA, 21 bp, Homo sapiens
ttatgatatttttttaagtct

SEQ ID NO: 6525757 - DNA, 19 bp, Homo sapiens
ttatgatcaccatgtattt

SEQ ID NO: 6525758 - DNA, 22 bp, Homo sapiens
ttatgatccagcagattattca

SEQ ID NO: 6525759 - DNA, 17 bp, Homo sapiens
ttatgatctaataaact

SEQ ID NO: 6525760 - DNA, 21 bp, Homo sapiens
ttatgatctggcccttgctta

SEQ ID NO: 6525761 - DNA, 19 bp, Homo sapiens
ttatgatgagccatattaa

SEQ ID NO: 6525762 - DNA, 20 bp, Homo sapiens
ttatgatgagccatattaat

SEQ ID NO: 6525763 - DNA, 14 bp, Homo sapiens
ttatgatgatgaaa

SEQ ID NO: 6525764 - DNA, 13 bp, Homo sapiens
ttatgatgctatt

SEQ ID NO: 6525765 - DNA, 14 bp, Homo sapiens
ttatgatgtgctta

SEQ ID NO: 6525766 - DNA, 18 bp, Homo sapiens
ttatgatgttagaagaag

SEQ ID NO: 6525767 - DNA, 21 bp, Homo sapiens
ttatgatgttttgcaaaggaa

SEQ ID NO: 6525768 - DNA, 19 bp, Homo sapiens
ttatgattaagtaatgata

SEQ ID NO: 6525769 - DNA, 20 bp, Homo sapiens
ttatgattagttatgtcttt

SEQ ID NO: 6525770 - DNA, 19 bp, Homo sapiens
ttatgattgcattgtatga

SEQ ID NO: 6525771 - DNA, 15 bp, Homo sapiens
ttatgattgcctttt

SEQ ID NO: 6525772 - DNA, 20 bp, Homo sapiens
ttatgatttaaaaaataaat

SEQ ID NO: 6525773 - DNA, 18 bp, Homo sapiens
ttatgatttcattatcac

SEQ ID NO: 6525774 - DNA, 20 bp, Homo sapiens
ttatgatttctccagaaatt

SEQ ID NO: 6525775 - DNA, 13 bp, Homo sapiens
ttatgatttgggt

SEQ ID NO: 6525776 - DNA, 19 bp, Homo sapiens
ttatgattttcataactta

SEQ ID NO: 6525777 - DNA, 18 bp, Homo sapiens
ttatgatttttttttcat

SEQ ID NO: 6525778 - DNA, 15 bp, Homo sapiens
ttatgcaaaaacata

SEQ ID NO: 6525779 - DNA, 14 bp, Homo sapiens
ttatgcaaaatgga

SEQ ID NO: 6525780 - DNA, 20 bp, Homo sapiens
ttatgcaaaatttagaagaa

SEQ ID NO: 6525781 - DNA, 14 bp, Homo sapiens
ttatgcaagcacaa

SEQ ID NO: 6525782 - DNA, 17 bp, Homo sapiens
ttatgcaaggaaggaaa

SEQ ID NO: 6525783 - DNA, 22 bp, Homo sapiens
ttatgcaaggtcttgcatttaa

SEQ ID NO: 6525784 - DNA, 13 bp, Homo sapiens
ttatgcaagtcat

SEQ ID NO: 6525785 - DNA, 12 bp, Homo sapiens
ttatgcaataaa

SEQ ID NO: 6525786 - DNA, 21 bp, Homo sapiens
ttatgcaattcagtgttccaa

SEQ ID NO: 6525787 - DNA, 11 bp, Homo sapiens
ttatgcacagc

SEQ ID NO: 6525788 - DNA, 20 bp, Homo sapiens
ttatgcactgtggtttcaga

SEQ ID NO: 6525789 - DNA, 21 bp, Homo sapiens
ttatgcacttttagaaatgca

SEQ ID NO: 6525790 - DNA, 22 bp, Homo sapiens
ttatgcacttttagaaatgcat

SEQ ID NO: 6525791 - DNA, 15 bp, Homo sapiens
ttatgcagaatttga

SEQ ID NO: 6525792 - DNA, 15 bp, Homo sapiens
ttatgcagacagtct

SEQ ID NO: 6525793 - DNA, 23 bp, Homo sapiens
ttatgcagacagtctgttatgca

SEQ ID NO: 6525794 - DNA, 20 bp, Homo sapiens
ttatgcagagtcagccattc

SEQ ID NO: 6525795 - DNA, 18 bp, Homo sapiens
ttatgcagcaaatatatg

SEQ ID NO: 6525796 - DNA, 23 bp, Homo sapiens
ttatgcagtgtttccctctgtgt

SEQ ID NO: 6525797 - DNA, 18 bp, Homo sapiens
ttatgcatgaaatgaatg

SEQ ID NO: 6525798 - DNA, 22 bp, Homo sapiens
ttatgcatgaagataatgtaaa

SEQ ID NO: 6525799 - DNA, 20 bp, Homo sapiens
ttatgcatgagaactaaata

SEQ ID NO: 6525800 - DNA, 17 bp, Homo sapiens
ttatgcatgtttgttgt

SEQ ID NO: 6525801 - DNA, 18 bp, Homo sapiens
ttatgcatttatgcatga

SEQ ID NO: 6525802 - DNA, 14 bp, Homo sapiens
ttatgcatttcaat

SEQ ID NO: 6525803 - DNA, 22 bp, Homo sapiens
ttatgccacttccttttaactg

SEQ ID NO: 6525804 - DNA, 21 bp, Homo sapiens
ttatgcccttgagtctagatg

SEQ ID NO: 6525805 - DNA, 21 bp, Homo sapiens
ttatgcctcgcttatttagcc

SEQ ID NO: 6525806 - DNA, 17 bp, Homo sapiens
ttatgccttgctatttt

SEQ ID NO: 6525807 - DNA, 14 bp, Homo sapiens
ttatgcctttctct

SEQ ID NO: 6525808 - DNA, 15 bp, Homo sapiens
ttatgccttttattt

SEQ ID NO: 6525809 - DNA, 19 bp, Homo sapiens
ttatgcgcaaatacaaaat

SEQ ID NO: 6525810 - DNA, 21 bp, Homo sapiens
ttatgcgcaaatacaaaatga

SEQ ID NO: 6525811 - DNA, 15 bp, Homo sapiens
ttatgcgtgtgacag

SEQ ID NO: 6525812 - DNA, 20 bp, Homo sapiens
ttatgctaacaaactgaaaa

SEQ ID NO: 6525813 - DNA, 22 bp, Homo sapiens
tggcttagacaccacctggagt

SEQ ID NO: 6525814 - DNA, 23 bp, Homo sapiens
tggcttagacaccacctggagtg

SEQ ID NO: 6525815 - DNA, 15 bp, Homo sapiens
tggcttagctgccat

SEQ ID NO: 6525816 - DNA, 14 bp, Homo sapiens
tggcttagtgccac

SEQ ID NO: 6525817 - DNA, 19 bp, Homo sapiens
tggcttataaacacattga

SEQ ID NO: 6525818 - DNA, 13 bp, Homo sapiens
tggcttataaatg

SEQ ID NO: 6525819 - DNA, 21 bp, Homo sapiens
tggcttatgctcagaagccag

SEQ ID NO: 6525820 - DNA, 15 bp, Homo sapiens
tggcttatgtcatca

SEQ ID NO: 6525821 - DNA, 22 bp, Homo sapiens
tggcttatgtcatcagtaaagt

SEQ ID NO: 6525822 - DNA, 15 bp, Homo sapiens
tggcttattgtgtga

SEQ ID NO: 6525823 - DNA, 18 bp, Homo sapiens
tggcttattttaatgtga

SEQ ID NO: 6525824 - DNA, 19 bp, Homo sapiens
tggcttattttaatgtgat

SEQ ID NO: 6525825 - DNA, 21 bp, Homo sapiens
tggcttattttaatgtgatga

SEQ ID NO: 6525826 - DNA, 16 bp, Homo sapiens
tggcttatttttctga

SEQ ID NO: 6525827 - DNA, 19 bp, Homo sapiens
tggcttattttttaaaata

SEQ ID NO: 6525828 - DNA, 20 bp, Homo sapiens
tggcttcaatctacgatgtt

SEQ ID NO: 6525829 - DNA, 19 bp, Homo sapiens
tggcttcaccgcattccag

SEQ ID NO: 6525830 - DNA, 20 bp, Homo sapiens
tggcttcaccgcattccagg

SEQ ID NO: 6525831 - DNA, 21 bp, Homo sapiens
tggcttcaccgcattccaggg

SEQ ID NO: 6525832 - DNA, 22 bp, Homo sapiens
tggcttcaccgcattccagggg

SEQ ID NO: 6525833 - DNA, 17 bp, Homo sapiens
tggcttcacggaagagc

SEQ ID NO: 6525834 - DNA, 15 bp, Homo sapiens
tggcttcagaattgt

SEQ ID NO: 6525835 - DNA, 21 bp, Homo sapiens
tggcttcagagcgataataca

SEQ ID NO: 6525836 - DNA, 20 bp, Homo sapiens
tggcttcagaggcctggcat

SEQ ID NO: 6525837 - DNA, 18 bp, Homo sapiens
tggcttcagcccccacca

SEQ ID NO: 6525838 - DNA, 15 bp, Homo sapiens
tggcttcagggaggg

SEQ ID NO: 6525839 - DNA, 22 bp, Homo sapiens
tggcttccagaaaaccccagca

SEQ ID NO: 6525840 - DNA, 14 bp, Homo sapiens
tggcttccagattt

SEQ ID NO: 6525841 - DNA, 22 bp, Homo sapiens
tggcttccagcgggccctctgc

SEQ ID NO: 6525842 - DNA, 20 bp, Homo sapiens
tggcttccagcttcaggcac

SEQ ID NO: 6525843 - DNA, 22 bp, Homo sapiens
tggcttccagcttcaggcacca

SEQ ID NO: 6525844 - DNA, 15 bp, Homo sapiens
tggcttccaggtatc

SEQ ID NO: 6525845 - DNA, 22 bp, Homo sapiens
tggcttccaggtatctccagga

SEQ ID NO: 6525846 - DNA, 14 bp, Homo sapiens
tggcttccatgctc

SEQ ID NO: 6525847 - DNA, 20 bp, Homo sapiens
tggcttcccaggaccctggg

SEQ ID NO: 6525848 - DNA, 23 bp, Homo sapiens
tggcttcccaggaccctgggtca

SEQ ID NO: 6525849 - DNA, 15 bp, Homo sapiens
tggcttcccatcccc

SEQ ID NO: 6525850 - DNA, 18 bp, Homo sapiens
tggcttcccatccccagc

SEQ ID NO: 6525851 - DNA, 17 bp, Homo sapiens
tggcttcccatgtcttt

SEQ ID NO: 6525852 - DNA, 18 bp, Homo sapiens
tggcttccccactccccc

SEQ ID NO: 6525853 - DNA, 19 bp, Homo sapiens
tggcttcccctccacccta

SEQ ID NO: 6525854 - DNA, 13 bp, Homo sapiens
tggcttccccttc

SEQ ID NO: 6525855 - DNA, 17 bp, Homo sapiens
tggcttccctaaactgc

SEQ ID NO: 6525856 - DNA, 19 bp, Homo sapiens
tggcttccctaaactgcag

SEQ ID NO: 6525857 - DNA, 20 bp, Homo sapiens
tggcttccctctttcatctc

SEQ ID NO: 6525858 - DNA, 14 bp, Homo sapiens
tggcttccctggaa

SEQ ID NO: 6525859 - DNA, 20 bp, Homo sapiens
tggcttccgctgtcacccag

SEQ ID NO: 6525860 - DNA, 18 bp, Homo sapiens
tggcttccgtgagacaca

SEQ ID NO: 6525861 - DNA, 15 bp, Homo sapiens
tggcttcctaaatgg

SEQ ID NO: 6525862 - DNA, 15 bp, Homo sapiens
tggcttcctccgtcc

SEQ ID NO: 6525863 - DNA, 21 bp, Homo sapiens
tggcttcctccgtccacccag

SEQ ID NO: 6525864 - DNA, 22 bp, Homo sapiens
tggcttcctccgtccacccagg

SEQ ID NO: 6525865 - DNA, 21 bp, Homo sapiens
tggcttcctccgtctgcaatg

SEQ ID NO: 6525866 - DNA, 21 bp, Homo sapiens
tggcttcctcctccctcctgc

SEQ ID NO: 6525867 - DNA, 20 bp, Homo sapiens
tggcttcctggcgcccccta

SEQ ID NO: 6525868 - DNA, 14 bp, Homo sapiens
tggcttcctttctt

SEQ ID NO: 6525869 - DNA, 16 bp, Homo sapiens
tggcttcctttcttgg

SEQ ID NO: 6525870 - DNA, 16 bp, Homo sapiens
tggcttcggacaaaat

SEQ ID NO: 6525871 - DNA, 16 bp, Homo sapiens
tggcttcggagggccg

SEQ ID NO: 6525872 - DNA, 15 bp, Homo sapiens
tggcttcggcctgct

SEQ ID NO: 6525873 - DNA, 16 bp, Homo sapiens
tggcttctcagcccct

SEQ ID NO: 6525874 - DNA, 17 bp, Homo sapiens
tggcttctcagcccctt

SEQ ID NO: 6525875 - DNA, 13 bp, Homo sapiens
tggcttctcatac

SEQ ID NO: 6525876 - DNA, 21 bp, Homo sapiens
tggcttctcatacgtccacca

SEQ ID NO: 6525877 - DNA, 12 bp, Homo sapiens
tggcttctccca

SEQ ID NO: 6525878 - DNA, 13 bp, Homo sapiens
tggcttctcccaa

SEQ ID NO: 6525879 - DNA, 14 bp, Homo sapiens
tggcttctccctgg

SEQ ID NO: 6525880 - DNA, 15 bp, Homo sapiens
tggcttctccctggg

SEQ ID NO: 6525881 - DNA, 17 bp, Homo sapiens
tggcttctccctgggga

SEQ ID NO: 6525882 - DNA, 18 bp, Homo sapiens
tggcttctccctggggac

SEQ ID NO: 6525883 - DNA, 17 bp, Homo sapiens
tggcttctcctgtgacc

SEQ ID NO: 6525884 - DNA, 16 bp, Homo sapiens
tggcttctccttggct

SEQ ID NO: 6525885 - DNA, 14 bp, Homo sapiens
tggcttctcctttg

SEQ ID NO: 6525886 - DNA, 17 bp, Homo sapiens
tggcttctctcttttcc

SEQ ID NO: 6525887 - DNA, 21 bp, Homo sapiens
tggcttctctcttttcctcct

SEQ ID NO: 6525888 - DNA, 22 bp, Homo sapiens
tggcttctgaagagcctgaagc

SEQ ID NO: 6525889 - DNA, 15 bp, Homo sapiens
tggcttctgatgaat

SEQ ID NO: 6525890 - DNA, 20 bp, Homo sapiens
tggcttctgatgaatcttgc

SEQ ID NO: 6525891 - DNA, 19 bp, Homo sapiens
tggcttctgatttttctct

SEQ ID NO: 6525892 - DNA, 21 bp, Homo sapiens
tggcttctgatttttctcttt

SEQ ID NO: 6525893 - DNA, 22 bp, Homo sapiens
tggcttctgatttttctctttt

SEQ ID NO: 6525894 - DNA, 16 bp, Homo sapiens
tggcttctgcttgtca

SEQ ID NO: 6525895 - DNA, 16 bp, Homo sapiens
tggcttctggcacctg

SEQ ID NO: 6525896 - DNA, 17 bp, Homo sapiens
tggcttctggccaggaa

SEQ ID NO: 6525897 - DNA, 19 bp, Homo sapiens
tggcttctggccaggaagc

SEQ ID NO: 6525898 - DNA, 21 bp, Homo sapiens
tggcttctgggacaggcacca

SEQ ID NO: 6525899 - DNA, 14 bp, Homo sapiens
tggcttctgggacc

SEQ ID NO: 6525900 - DNA, 15 bp, Homo sapiens
tggcttctgggagat

SEQ ID NO: 6525901 - DNA, 21 bp, Homo sapiens
tggcttctgtgatgagctgat

SEQ ID NO: 6525902 - DNA, 14 bp, Homo sapiens
tggcttctgtgcac

SEQ ID NO: 6525903 - DNA, 14 bp, Homo sapiens
tggcttctgtgcct

SEQ ID NO: 6525904 - DNA, 20 bp, Homo sapiens
tggcttctgttgcgccactg

SEQ ID NO: 6525905 - DNA, 17 bp, Homo sapiens
tggcttcttaaaaactg

SEQ ID NO: 6525906 - DNA, 18 bp, Homo sapiens
tggcttcttaaaaactgt

SEQ ID NO: 6525907 - DNA, 19 bp, Homo sapiens
tggcttcttaaaaactgtg

SEQ ID NO: 6525908 - DNA, 21 bp, Homo sapiens
tggcttcttaaaaactgtgta

SEQ ID NO: 6525909 - DNA, 23 bp, Homo sapiens
tggcttctttgctttctcgtggg

SEQ ID NO: 6525910 - DNA, 19 bp, Homo sapiens
tggcttcttttctttgtat

SEQ ID NO: 6525911 - DNA, 22 bp, Homo sapiens
tggcttcttttctttgtatcat

SEQ ID NO: 6525912 - DNA, 16 bp, Homo sapiens
tggcttgaaggactgc

SEQ ID NO: 6525913 - DNA, 17 bp, Homo sapiens
tggcttgaaggactgca

SEQ ID NO: 6525914 - DNA, 18 bp, Homo sapiens
tggcttgaattaagaaga

SEQ ID NO: 6525915 - DNA, 14 bp, Homo sapiens
tggcttgctccagg

SEQ ID NO: 6525916 - DNA, 15 bp, Homo sapiens
tggcttgctccaggg

SEQ ID NO: 6525917 - DNA, 16 bp, Homo sapiens
tggcttgctccagggt

SEQ ID NO: 6525918 - DNA, 17 bp, Homo sapiens
tggcttgctccagggtc

SEQ ID NO: 6525919 - DNA, 20 bp, Homo sapiens
tggcttgctcccgccccagg

SEQ ID NO: 6525920 - DNA, 13 bp, Homo sapiens
tggcttgctgttt

SEQ ID NO: 6525921 - DNA, 16 bp, Homo sapiens
tggcttggaagattct

SEQ ID NO: 6525922 - DNA, 17 bp, Homo sapiens
tggcttggagcagaggt

SEQ ID NO: 6525923 - DNA, 12 bp, Homo sapiens
tggcttggagga

SEQ ID NO: 6525924 - DNA, 17 bp, Homo sapiens
tggcttggagtggccaa

SEQ ID NO: 6525925 - DNA, 16 bp, Homo sapiens
tggcttggcattgacc

SEQ ID NO: 6525926 - DNA, 17 bp, Homo sapiens
tggcttggccacagcca

SEQ ID NO: 6525927 - DNA, 23 bp, Homo sapiens
tggcttggccacagccaggggag

SEQ ID NO: 6525928 - DNA, 14 bp, Homo sapiens
tggcttggccttgg

SEQ ID NO: 6525929 - DNA, 16 bp, Homo sapiens
tggcttggccttggca

SEQ ID NO: 6525930 - DNA, 16 bp, Homo sapiens
tggcttgggcagcatc

SEQ ID NO: 6525931 - DNA, 14 bp, Homo sapiens
tggcttgggcattg

SEQ ID NO: 6525932 - DNA, 13 bp, Homo sapiens
tggcttggggagc

SEQ ID NO: 6525933 - DNA, 14 bp, Homo sapiens
tggcttggggagca

SEQ ID NO: 6525934 - DNA, 16 bp, Homo sapiens
tggcttggggagcaga

SEQ ID NO: 6525935 - DNA, 18 bp, Homo sapiens
tggcttggggattgtaca

SEQ ID NO: 6525936 - DNA, 15 bp, Homo sapiens
tggcttggggggctc

SEQ ID NO: 6525937 - DNA, 18 bp, Homo sapiens
tggcttggtgagtctgtg

SEQ ID NO: 6525938 - DNA, 24 bp, Homo sapiens
tggcttgtatcaacactgttactt

SEQ ID NO: 6525939 - DNA, 19 bp, Homo sapiens
tggcttgtctcacgcagcc

SEQ ID NO: 6525940 - DNA, 15 bp, Homo sapiens
tggcttgtgaactgc

SEQ ID NO: 6525941 - DNA, 16 bp, Homo sapiens
tggcttgtgaactgct

SEQ ID NO: 6525942 - DNA, 19 bp, Homo sapiens
tggcttgtgaactgctgga

SEQ ID NO: 6525943 - DNA, 17 bp, Homo sapiens
tggcttgtgattctggg

SEQ ID NO: 6525944 - DNA, 19 bp, Homo sapiens
tggcttgtgattctgggat

SEQ ID NO: 6525945 - DNA, 19 bp, Homo sapiens
tggcttgtgtgtttcactt

SEQ ID NO: 6525946 - DNA, 20 bp, Homo sapiens
tggcttgtgtgtttcacttt

SEQ ID NO: 6525947 - DNA, 18 bp, Homo sapiens
tggcttgttctctggaac

SEQ ID NO: 6525948 - DNA, 19 bp, Homo sapiens
tggcttgttctctggaacc

SEQ ID NO: 6525949 - DNA, 16 bp, Homo sapiens
tggcttgttgtaaagc

SEQ ID NO: 6525950 - DNA, 15 bp, Homo sapiens
tggcttgtttgattt

SEQ ID NO: 6525951 - DNA, 17 bp, Homo sapiens
tggcttgtttgatttca

SEQ ID NO: 6525952 - DNA, 20 bp, Homo sapiens
tggcttgtttgatttcaaca

SEQ ID NO: 6525953 - DNA, 16 bp, Homo sapiens
tggcttgttttatttt

SEQ ID NO: 6525954 - DNA, 13 bp, Homo sapiens
tggctttacaaat

SEQ ID NO: 6525955 - DNA, 23 bp, Homo sapiens
tggctttacctttttgtatgtga

SEQ ID NO: 6525956 - DNA, 23 bp, Homo sapiens
tggctttagccataccagggtga

SEQ ID NO: 6525957 - DNA, 16 bp, Homo sapiens
tggctttatcctcttt

SEQ ID NO: 6525958 - DNA, 20 bp, Homo sapiens
tggctttcaaggctggggca

SEQ ID NO: 6525959 - DNA, 12 bp, Homo sapiens
tggctttcaagt

SEQ ID NO: 6525960 - DNA, 22 bp, Homo sapiens
tggctttcacatttaaatggtt

SEQ ID NO: 6525961 - DNA, 21 bp, Homo sapiens
tggctttcagagccagcctgg

SEQ ID NO: 6525962 - DNA, 15 bp, Homo sapiens
tggctttcagagcct

SEQ ID NO: 6525963 - DNA, 15 bp, Homo sapiens
tggctttcagagttt

SEQ ID NO: 6525964 - DNA, 15 bp, Homo sapiens
tggctttcagggcag

SEQ ID NO: 6525965 - DNA, 16 bp, Homo sapiens
tggctttcatcctgtg

SEQ ID NO: 6525966 - DNA, 21 bp, Homo sapiens
tggctttcattttctctcagg

SEQ ID NO: 6525967 - DNA, 22 bp, Homo sapiens
tggctttccacatccccaccct

SEQ ID NO: 6525968 - DNA, 16 bp, Homo sapiens
tggctttccagtcata

SEQ ID NO: 6525969 - DNA, 19 bp, Homo sapiens
tggctttcccaggagatgg

SEQ ID NO: 6525970 - DNA, 21 bp, Homo sapiens
tggctttcccggactgcaagc

SEQ ID NO: 6525971 - DNA, 14 bp, Homo sapiens
tggctttcccttcc

SEQ ID NO: 6525972 - DNA, 23 bp, Homo sapiens
tggctttctaccacacacagcct

SEQ ID NO: 6525973 - DNA, 12 bp, Homo sapiens
tggctttctccc

SEQ ID NO: 6525974 - DNA, 20 bp, Homo sapiens
tggctttctcccactgagtt

SEQ ID NO: 6525975 - DNA, 14 bp, Homo sapiens
tggctttctccctc

SEQ ID NO: 6525976 - DNA, 23 bp, Homo sapiens
tggctttctccgactgctaggga

SEQ ID NO: 6525977 - DNA, 12 bp, Homo sapiens
tggctttctctc

SEQ ID NO: 6525978 - DNA, 13 bp, Homo sapiens
tggctttctctct

SEQ ID NO: 6525979 - DNA, 16 bp, Homo sapiens
tggctttctctctggc

SEQ ID NO: 6525980 - DNA, 17 bp, Homo sapiens
tggctttctctctggct

SEQ ID NO: 6525981 - DNA, 20 bp, Homo sapiens
tggctttctctctggcttct

SEQ ID NO: 6525982 - DNA, 21 bp, Homo sapiens
tggctttctctctggcttctc

SEQ ID NO: 6525983 - DNA, 17 bp, Homo sapiens
tggctttgaggccgaag

SEQ ID NO: 6525984 - DNA, 16 bp, Homo sapiens
tggctttgatgataaa

SEQ ID NO: 6525985 - DNA, 17 bp, Homo sapiens
tggctttgcagctgctg

SEQ ID NO: 6525986 - DNA, 12 bp, Homo sapiens
tggctttgcata

SEQ ID NO: 6525987 - DNA, 16 bp, Homo sapiens
tggctttgcatttctt

SEQ ID NO: 6525988 - DNA, 22 bp, Homo sapiens
tggctttgcccaacctcagcaa

SEQ ID NO: 6525989 - DNA, 13 bp, Homo sapiens
tggctttgctgtt

SEQ ID NO: 6525990 - DNA, 18 bp, Homo sapiens
tggctttggaatagatgg

SEQ ID NO: 6525991 - DNA, 15 bp, Homo sapiens
ttatgctaagaattt

SEQ ID NO: 6525992 - DNA, 11 bp, Homo sapiens
ttatgctcacc

SEQ ID NO: 6525993 - DNA, 17 bp, Homo sapiens
ttatgctcttaattgcc

SEQ ID NO: 6525994 - DNA, 21 bp, Homo sapiens
ttatgctcttaattgccacct

SEQ ID NO: 6525995 - DNA, 20 bp, Homo sapiens
ttatgctcttttttactcat

SEQ ID NO: 6525996 - DNA, 13 bp, Homo sapiens
ttatgctgaaaca

SEQ ID NO: 6525997 - DNA, 14 bp, Homo sapiens
ttatgctgagtatg

SEQ ID NO: 6525998 - DNA, 12 bp, Homo sapiens
ttatgctgctgt

SEQ ID NO: 6525999 - DNA, 13 bp, Homo sapiens
ttatgctgctgtg

SEQ ID NO: 6526000 - DNA, 14 bp, Homo sapiens
ttatgctgctgtga

SEQ ID NO: 6526001 - DNA, 16 bp, Homo sapiens
ttatgctgctttaaca

SEQ ID NO: 6526002 - DNA, 14 bp, Homo sapiens
ttatgctgtcatgg

SEQ ID NO: 6526003 - DNA, 17 bp, Homo sapiens
ttatgctgtgacacatg

SEQ ID NO: 6526004 - DNA, 13 bp, Homo sapiens
ttatgctgtttcc

SEQ ID NO: 6526005 - DNA, 16 bp, Homo sapiens
ttatgcttccagaaac

SEQ ID NO: 6526006 - DNA, 11 bp, Homo sapiens
ttatgcttctt

SEQ ID NO: 6526007 - DNA, 14 bp, Homo sapiens
ttatgcttcttgga

SEQ ID NO: 6526008 - DNA, 14 bp, Homo sapiens
ttatgctttaaaca

SEQ ID NO: 6526009 - DNA, 14 bp, Homo sapiens
ttatgctttgaact

SEQ ID NO: 6526010 - DNA, 14 bp, Homo sapiens
ttatggaaatacca

SEQ ID NO: 6526011 - DNA, 17 bp, Homo sapiens
ttatggaacactctgag

SEQ ID NO: 6526012 - DNA, 18 bp, Homo sapiens
ttatggaacactctgaga

SEQ ID NO: 6526013 - DNA, 20 bp, Homo sapiens
ttatggaagaaagagttgtc

SEQ ID NO: 6526014 - DNA, 23 bp, Homo sapiens
ttatggaatatcatctgtcatta

SEQ ID NO: 6526015 - DNA, 21 bp, Homo sapiens
ttatggaattaaccatttaat

SEQ ID NO: 6526016 - DNA, 23 bp, Homo sapiens
ttatggaattgatttgcattgaa

SEQ ID NO: 6526017 - DNA, 15 bp, Homo sapiens
ttatggacactgcct

SEQ ID NO: 6526018 - DNA, 21 bp, Homo sapiens
ttatggacactgccttagcct

SEQ ID NO: 6526019 - DNA, 18 bp, Homo sapiens
ttatggactgttttgata

SEQ ID NO: 6526020 - DNA, 18 bp, Homo sapiens
ttatggagtcatttttac

SEQ ID NO: 6526021 - DNA, 17 bp, Homo sapiens
ttatggagtgtcaccag

SEQ ID NO: 6526022 - DNA, 22 bp, Homo sapiens
ttatggatcccaattcatttca

SEQ ID NO: 6526023 - DNA, 14 bp, Homo sapiens
ttatggatgattaa

SEQ ID NO: 6526024 - DNA, 11 bp, Homo sapiens
ttatggatgca

SEQ ID NO: 6526025 - DNA, 14 bp, Homo sapiens
ttatggcaagtgat

SEQ ID NO: 6526026 - DNA, 21 bp, Homo sapiens
ttatggcactagtatttctat

SEQ ID NO: 6526027 - DNA, 15 bp, Homo sapiens
ttatggcatttctat

SEQ ID NO: 6526028 - DNA, 11 bp, Homo sapiens
ttatggcctca

SEQ ID NO: 6526029 - DNA, 15 bp, Homo sapiens
ttatggcctttttaa

SEQ ID NO: 6526030 - DNA, 20 bp, Homo sapiens
ttatggcgtttttctcgtcc

SEQ ID NO: 6526031 - DNA, 16 bp, Homo sapiens
ttatggctgctgggct

SEQ ID NO: 6526032 - DNA, 18 bp, Homo sapiens
ttatggcttataaatgtg

SEQ ID NO: 6526033 - DNA, 18 bp, Homo sapiens
ttatggcttttgtgcatt

SEQ ID NO: 6526034 - DNA, 21 bp, Homo sapiens
ttatgggaacaagtgtacaga

SEQ ID NO: 6526035 - DNA, 15 bp, Homo sapiens
ttatgggatgtaaac

SEQ ID NO: 6526036 - DNA, 15 bp, Homo sapiens
ttatgggccctgcct

SEQ ID NO: 6526037 - DNA, 13 bp, Homo sapiens
ttatgggctgggt

SEQ ID NO: 6526038 - DNA, 22 bp, Homo sapiens
ttatgggtatgtgttgccaaag

SEQ ID NO: 6526039 - DNA, 17 bp, Homo sapiens
ttatgggtcctgcaatt

SEQ ID NO: 6526040 - DNA, 14 bp, Homo sapiens
ttatgggtttttat

SEQ ID NO: 6526041 - DNA, 15 bp, Homo sapiens
ttatggtataataaa

SEQ ID NO: 6526042 - DNA, 17 bp, Homo sapiens
ttatggtataataaagt

SEQ ID NO: 6526043 - DNA, 13 bp, Homo sapiens
ttatggtattttc

SEQ ID NO: 6526044 - DNA, 15 bp, Homo sapiens
ttatggtgtaatgca

SEQ ID NO: 6526045 - DNA, 19 bp, Homo sapiens
ttatggtgtaatgcacaat

SEQ ID NO: 6526046 - DNA, 16 bp, Homo sapiens
ttatggttatgttttt

SEQ ID NO: 6526047 - DNA, 16 bp, Homo sapiens
ttatggttctgcagtc

SEQ ID NO: 6526048 - DNA, 21 bp, Homo sapiens
ttatggtttctgtctgaatta

SEQ ID NO: 6526049 - DNA, 15 bp, Homo sapiens
ttatggttttataac

SEQ ID NO: 6526050 - DNA, 16 bp, Homo sapiens
ttatgtaaaactcgct

SEQ ID NO: 6526051 - DNA, 18 bp, Homo sapiens
ttatgtaaaactcgcttt

SEQ ID NO: 6526052 - DNA, 16 bp, Homo sapiens
ttatgtaaaatgtttt

SEQ ID NO: 6526053 - DNA, 17 bp, Homo sapiens
ttatgtaaacaaatctt

SEQ ID NO: 6526054 - DNA, 21 bp, Homo sapiens
ttatgtaaatatgaagagttt

SEQ ID NO: 6526055 - DNA, 11 bp, Homo sapiens
ttatgtaaatc

SEQ ID NO: 6526056 - DNA, 17 bp, Homo sapiens
ttatgtaaattatgtaa

SEQ ID NO: 6526057 - DNA, 17 bp, Homo sapiens
ttatgtaagaagaaact

SEQ ID NO: 6526058 - DNA, 22 bp, Homo sapiens
ttatgtaaggttttttttgtac

SEQ ID NO: 6526059 - DNA, 18 bp, Homo sapiens
ttatgtaagtttctaaga

SEQ ID NO: 6526060 - DNA, 20 bp, Homo sapiens
ttatgtaagtttctaagaat

SEQ ID NO: 6526061 - DNA, 18 bp, Homo sapiens
ttatgtaatatattgtac

SEQ ID NO: 6526062 - DNA, 15 bp, Homo sapiens
ttatgtaatctatgt

SEQ ID NO: 6526063 - DNA, 11 bp, Homo sapiens
ttatgtaattt

SEQ ID NO: 6526064 - DNA, 21 bp, Homo sapiens
ttatgtaatttctttaaatgt

SEQ ID NO: 6526065 - DNA, 13 bp, Homo sapiens
ttatgtaatttgt

SEQ ID NO: 6526066 - DNA, 16 bp, Homo sapiens
ttatgtaatttgtaca

SEQ ID NO: 6526067 - DNA, 14 bp, Homo sapiens
ttatgtacaaacat

SEQ ID NO: 6526068 - DNA, 19 bp, Homo sapiens
ttatgtacaaacatgttgt

SEQ ID NO: 6526069 - DNA, 13 bp, Homo sapiens
ttatgtacaaact

SEQ ID NO: 6526070 - DNA, 16 bp, Homo sapiens
ttatgtacaacattta

SEQ ID NO: 6526071 - DNA, 12 bp, Homo sapiens
ttatgtacaacc

SEQ ID NO: 6526072 - DNA, 14 bp, Homo sapiens
ttatgtacaaccct

SEQ ID NO: 6526073 - DNA, 14 bp, Homo sapiens
ttatgtacagaaaa

SEQ ID NO: 6526074 - DNA, 11 bp, Homo sapiens
ttatgtacata

SEQ ID NO: 6526075 - DNA, 16 bp, Homo sapiens
ttatgtaccatgaata

SEQ ID NO: 6526076 - DNA, 12 bp, Homo sapiens
ttatgtaccttt

SEQ ID NO: 6526077 - DNA, 14 bp, Homo sapiens
ttatgtactgctgt

SEQ ID NO: 6526078 - DNA, 12 bp, Homo sapiens
ttatgtactgta

SEQ ID NO: 6526079 - DNA, 12 bp, Homo sapiens
ttatgtagaaat

SEQ ID NO: 6526080 - DNA, 15 bp, Homo sapiens
ttatgtagatgtgca

SEQ ID NO: 6526081 - DNA, 16 bp, Homo sapiens
ttatgtagatgtgcat

SEQ ID NO: 6526082 - DNA, 13 bp, Homo sapiens
ttatgtagcacta

SEQ ID NO: 6526083 - DNA, 22 bp, Homo sapiens
ttatgtagcactactacagaaa

SEQ ID NO: 6526084 - DNA, 21 bp, Homo sapiens
ttatgtagctaaacattgtga

SEQ ID NO: 6526085 - DNA, 21 bp, Homo sapiens
ttatgtagtttttatatgttg

SEQ ID NO: 6526086 - DNA, 23 bp, Homo sapiens
ttatgtatatactatacaacaat

SEQ ID NO: 6526087 - DNA, 17 bp, Homo sapiens
ttatgtatcagaagaga

SEQ ID NO: 6526088 - DNA, 22 bp, Homo sapiens
ttatgtatggatatatttgaaa

SEQ ID NO: 6526089 - DNA, 14 bp, Homo sapiens
ttatgtattctctt

SEQ ID NO: 6526090 - DNA, 11 bp, Homo sapiens
ttatgtattta

SEQ ID NO: 6526091 - DNA, 20 bp, Homo sapiens
ttatgtatttaaagttgtat

SEQ ID NO: 6526092 - DNA, 19 bp, Homo sapiens
ttatgtatttcctggatgt

SEQ ID NO: 6526093 - DNA, 14 bp, Homo sapiens
ttatgtattttgaa

SEQ ID NO: 6526094 - DNA, 18 bp, Homo sapiens
ttatgtattttgaaaaag

SEQ ID NO: 6526095 - DNA, 21 bp, Homo sapiens
ttatgtcagcacacacttaca

SEQ ID NO: 6526096 - DNA, 14 bp, Homo sapiens
ttatgtcagcagct

SEQ ID NO: 6526097 - DNA, 13 bp, Homo sapiens
ttatgtcatactc

SEQ ID NO: 6526098 - DNA, 23 bp, Homo sapiens
ttatgtcatactctgtgtaatct

SEQ ID NO: 6526099 - DNA, 15 bp, Homo sapiens
ttatgtcatagaaat

SEQ ID NO: 6526100 - DNA, 17 bp, Homo sapiens
ttatgtcatagaaatat

SEQ ID NO: 6526101 - DNA, 18 bp, Homo sapiens
ttatgtcatcagtaaagt

SEQ ID NO: 6526102 - DNA, 20 bp, Homo sapiens
ttatgtcattctctttctca

SEQ ID NO: 6526103 - DNA, 12 bp, Homo sapiens
ttatgtcatttt

SEQ ID NO: 6526104 - DNA, 14 bp, Homo sapiens
ttatgtctctgcct

SEQ ID NO: 6526105 - DNA, 13 bp, Homo sapiens
ttatgtctcttgt

SEQ ID NO: 6526106 - DNA, 19 bp, Homo sapiens
ttatgtctgctgaataata

SEQ ID NO: 6526107 - DNA, 21 bp, Homo sapiens
ttatgtctgctgaataataaa

SEQ ID NO: 6526108 - DNA, 16 bp, Homo sapiens
ttatgtctgtttaaga

SEQ ID NO: 6526109 - DNA, 17 bp, Homo sapiens
ttatgtcttcttttgtg

SEQ ID NO: 6526110 - DNA, 12 bp, Homo sapiens
ttatgtgaaaaa

SEQ ID NO: 6526111 - DNA, 16 bp, Homo sapiens
ttatgtgaaaaattaa

SEQ ID NO: 6526112 - DNA, 18 bp, Homo sapiens
ttatgtgaaaaattaact

SEQ ID NO: 6526113 - DNA, 15 bp, Homo sapiens
ttatgtgaaacatgt

SEQ ID NO: 6526114 - DNA, 18 bp, Homo sapiens
ttatgtgaaatgctttct

SEQ ID NO: 6526115 - DNA, 18 bp, Homo sapiens
ttatgtgaagaatttaga

SEQ ID NO: 6526116 - DNA, 19 bp, Homo sapiens
ttatgtgaagaatttagat

SEQ ID NO: 6526117 - DNA, 16 bp, Homo sapiens
ttatgtgaaggtgttt

SEQ ID NO: 6526118 - DNA, 23 bp, Homo sapiens
ttatgtgaatgatctctctgaat

SEQ ID NO: 6526119 - DNA, 14 bp, Homo sapiens
ttatgtgactgctt

SEQ ID NO: 6526120 - DNA, 12 bp, Homo sapiens
ttatgtgacttg

SEQ ID NO: 6526121 - DNA, 14 bp, Homo sapiens
ttatgtgacttgca

SEQ ID NO: 6526122 - DNA, 14 bp, Homo sapiens
ttatgtgagaacat

SEQ ID NO: 6526123 - DNA, 16 bp, Homo sapiens
ttatgtgatcatgtgt

SEQ ID NO: 6526124 - DNA, 18 bp, Homo sapiens
ttatgtgccgtgttattg

SEQ ID NO: 6526125 - DNA, 15 bp, Homo sapiens
ttatgtgctattaat

SEQ ID NO: 6526126 - DNA, 14 bp, Homo sapiens
ttatgtgcttgaag

SEQ ID NO: 6526127 - DNA, 18 bp, Homo sapiens
ttatgtggaataatacat

SEQ ID NO: 6526128 - DNA, 21 bp, Homo sapiens
ttatgtggcttgtttatcctt

SEQ ID NO: 6526129 - DNA, 19 bp, Homo sapiens
ttatgtgtaggtgaacagt

SEQ ID NO: 6526130 - DNA, 22 bp, Homo sapiens
ttatgtgtaggtgaacagtcac

SEQ ID NO: 6526131 - DNA, 16 bp, Homo sapiens
ttatgtgtctggaaga

SEQ ID NO: 6526132 - DNA, 23 bp, Homo sapiens
ttatgtgtctggaagaagcagcg

SEQ ID NO: 6526133 - DNA, 16 bp, Homo sapiens
ttatgtgtgggaaagg

SEQ ID NO: 6526134 - DNA, 14 bp, Homo sapiens
ttatgtgttatgaa

SEQ ID NO: 6526135 - DNA, 20 bp, Homo sapiens
ttatgtgttgccaaaaccaa

SEQ ID NO: 6526136 - DNA, 23 bp, Homo sapiens
ttatgtgtttggatacatctgct

SEQ ID NO: 6526137 - DNA, 15 bp, Homo sapiens
ttatgttaacagatg

SEQ ID NO: 6526138 - DNA, 23 bp, Homo sapiens
ttatgttaactagaatgcttttg

SEQ ID NO: 6526139 - DNA, 22 bp, Homo sapiens
ttatgttaagggaagaattcca

SEQ ID NO: 6526140 - DNA, 13 bp, Homo sapiens
ttatgttaatatt

SEQ ID NO: 6526141 - DNA, 12 bp, Homo sapiens
ttatgttacagt

SEQ ID NO: 6526142 - DNA, 15 bp, Homo sapiens
ttatgttacatctgt

SEQ ID NO: 6526143 - DNA, 13 bp, Homo sapiens
ttatgttagttta

SEQ ID NO: 6526144 - DNA, 15 bp, Homo sapiens
ttatgttatatataa

SEQ ID NO: 6526145 - DNA, 16 bp, Homo sapiens
ttatgttatatataaa

SEQ ID NO: 6526146 - DNA, 12 bp, Homo sapiens
ttatgttatgaa

SEQ ID NO: 6526147 - DNA, 13 bp, Homo sapiens
ttatgttatgaaa

SEQ ID NO: 6526148 - DNA, 18 bp, Homo sapiens
ttatgttcagaaatgtaa

SEQ ID NO: 6526149 - DNA, 14 bp, Homo sapiens
ttatgttcatgtaa

SEQ ID NO: 6526150 - DNA, 17 bp, Homo sapiens
ttatgttcatttttcaa

SEQ ID NO: 6526151 - DNA, 15 bp, Homo sapiens
ttatgttcctgctgt

SEQ ID NO: 6526152 - DNA, 16 bp, Homo sapiens
ttatgttctaagtgcc

SEQ ID NO: 6526153 - DNA, 13 bp, Homo sapiens
ttatgttctcaac

SEQ ID NO: 6526154 - DNA, 16 bp, Homo sapiens
ttatgttctcagaatc

SEQ ID NO: 6526155 - DNA, 23 bp, Homo sapiens
ttatgttcttagcaataaatgct

SEQ ID NO: 6526156 - DNA, 13 bp, Homo sapiens
ttatgttcttata

SEQ ID NO: 6526157 - DNA, 15 bp, Homo sapiens
ttatgttcttataga

SEQ ID NO: 6526158 - DNA, 17 bp, Homo sapiens
ttatgttcttatagaat

SEQ ID NO: 6526159 - DNA, 18 bp, Homo sapiens
ttatgttcttatagaata

SEQ ID NO: 6526160 - DNA, 16 bp, Homo sapiens
ttatgttgacatttgt

SEQ ID NO: 6526161 - DNA, 17 bp, Homo sapiens
ttatgttgacatttgtt

SEQ ID NO: 6526162 - DNA, 19 bp, Homo sapiens
ttatgttgggtcaagtgtt

SEQ ID NO: 6526163 - DNA, 14 bp, Homo sapiens
ttatgttgtaatat

SEQ ID NO: 6526164 - DNA, 17 bp, Homo sapiens
ttatgtttaaaagaaat

SEQ ID NO: 6526165 - DNA, 18 bp, Homo sapiens
ttatgtttaaaagaaata

SEQ ID NO: 6526166 - DNA, 19 bp, Homo sapiens
ttatgtttaagtgcttggt

SEQ ID NO: 6526167 - DNA, 14 bp, Homo sapiens
ttatgtttaataag

SEQ ID NO: 6526168 - DNA, 14 bp, Homo sapiens
ttatgtttattaca

SEQ ID NO: 6526169 - DNA, 21 bp, Homo sapiens
ttatgtttctacacattgcta

SEQ ID NO: 6526170 - DNA, 12 bp, Homo sapiens
ttatgtttgaat

SEQ ID NO: 6526171 - DNA, 20 bp, Homo sapiens
ttatgttttatttaaatgct

SEQ ID NO: 6526172 - DNA, 20 bp, Homo sapiens
ttatgttttatttggcttgt

SEQ ID NO: 6526173 - DNA, 18 bp, Homo sapiens
ttatgttttggtccactt

SEQ ID NO: 6526174 - DNA, 17 bp, Homo sapiens
tggctttggcagtgttt

SEQ ID NO: 6526175 - DNA, 13 bp, Homo sapiens
tggctttggcgcc

SEQ ID NO: 6526176 - DNA, 16 bp, Homo sapiens
tggctttgggaaagcc

SEQ ID NO: 6526177 - DNA, 17 bp, Homo sapiens
tggctttgggaaagccc

SEQ ID NO: 6526178 - DNA, 21 bp, Homo sapiens
tggctttgggcaggtctgaga

SEQ ID NO: 6526179 - DNA, 13 bp, Homo sapiens
tggctttgtactt

SEQ ID NO: 6526180 - DNA, 14 bp, Homo sapiens
tggctttgtcactt

SEQ ID NO: 6526181 - DNA, 17 bp, Homo sapiens
tggctttgtcccacagc

SEQ ID NO: 6526182 - DNA, 20 bp, Homo sapiens
tggctttgtcttgaaaaaaa

SEQ ID NO: 6526183 - DNA, 16 bp, Homo sapiens
tggctttgttgatgct

SEQ ID NO: 6526184 - DNA, 16 bp, Homo sapiens
tggcttttaaacctgt

SEQ ID NO: 6526185 - DNA, 20 bp, Homo sapiens
tggcttttaaacctgttcct

SEQ ID NO: 6526186 - DNA, 12 bp, Homo sapiens
tggcttttaagc

SEQ ID NO: 6526187 - DNA, 17 bp, Homo sapiens
tggcttttacccttttt

SEQ ID NO: 6526188 - DNA, 15 bp, Homo sapiens
tggcttttactttat

SEQ ID NO: 6526189 - DNA, 20 bp, Homo sapiens
tggcttttactttattaata

SEQ ID NO: 6526190 - DNA, 15 bp, Homo sapiens
tggcttttagacaga

SEQ ID NO: 6526191 - DNA, 20 bp, Homo sapiens
tggcttttattaatgcactt

SEQ ID NO: 6526192 - DNA, 16 bp, Homo sapiens
tggcttttatttcagt

SEQ ID NO: 6526193 - DNA, 14 bp, Homo sapiens
tggcttttcactgc

SEQ ID NO: 6526194 - DNA, 16 bp, Homo sapiens
tggcttttcactgctg

SEQ ID NO: 6526195 - DNA, 22 bp, Homo sapiens
tggcttttcgcttgcttctgca

SEQ ID NO: 6526196 - DNA, 13 bp, Homo sapiens
tggcttttctgat

SEQ ID NO: 6526197 - DNA, 18 bp, Homo sapiens
tggcttttctgatccagt

SEQ ID NO: 6526198 - DNA, 22 bp, Homo sapiens
tggcttttctggaatggaattg

SEQ ID NO: 6526199 - DNA, 16 bp, Homo sapiens
tggcttttctgtttcc

SEQ ID NO: 6526200 - DNA, 22 bp, Homo sapiens
tggcttttgaatcaaagaatag

SEQ ID NO: 6526201 - DNA, 20 bp, Homo sapiens
tggcttttgccacatacata

SEQ ID NO: 6526202 - DNA, 20 bp, Homo sapiens
tggcttttgcggttcaggaa

SEQ ID NO: 6526203 - DNA, 16 bp, Homo sapiens
tggcttttgtgcatta

SEQ ID NO: 6526204 - DNA, 14 bp, Homo sapiens
tggctttttaagaa

SEQ ID NO: 6526205 - DNA, 23 bp, Homo sapiens
tggctttttcccagccctttcca

SEQ ID NO: 6526206 - DNA, 22 bp, Homo sapiens
tggctttttcctctgagcccag

SEQ ID NO: 6526207 - DNA, 13 bp, Homo sapiens
tggctttttgtac

SEQ ID NO: 6526208 - DNA, 19 bp, Homo sapiens
tggcttttttcctcctgtg

SEQ ID NO: 6526209 - DNA, 14 bp, Homo sapiens
tggcttttttgtgg

SEQ ID NO: 6526210 - DNA, 23 bp, Homo sapiens
tgggaaaaaaacgatttaccaat

SEQ ID NO: 6526211 - DNA, 17 bp, Homo sapiens
tgggaaaaaaactgaag

SEQ ID NO: 6526212 - DNA, 19 bp, Homo sapiens
tgggaaaaaaacttggcac

SEQ ID NO: 6526213 - DNA, 14 bp, Homo sapiens
tgggaaaaaagaaa

SEQ ID NO: 6526214 - DNA, 15 bp, Homo sapiens
tgggaaaaaagaaaa

SEQ ID NO: 6526215 - DNA, 15 bp, Homo sapiens
tgggaaaaaagaaat

SEQ ID NO: 6526216 - DNA, 16 bp, Homo sapiens
tgggaaaaaagaaatc

SEQ ID NO: 6526217 - DNA, 13 bp, Homo sapiens
tgggaaaaaagca

SEQ ID NO: 6526218 - DNA, 14 bp, Homo sapiens
tgggaaaaactgca

SEQ ID NO: 6526219 - DNA, 18 bp, Homo sapiens
tgggaaaaactgcagtca

SEQ ID NO: 6526220 - DNA, 13 bp, Homo sapiens
tgggaaaaagaga

SEQ ID NO: 6526221 - DNA, 21 bp, Homo sapiens
tgggaaaaatctaaaatgtgt

SEQ ID NO: 6526222 - DNA, 16 bp, Homo sapiens
tgggaaaacactgcca

SEQ ID NO: 6526223 - DNA, 11 bp, Homo sapiens
tgggaaaactt

SEQ ID NO: 6526224 - DNA, 18 bp, Homo sapiens
tgggaaaagaccagggct

SEQ ID NO: 6526225 - DNA, 16 bp, Homo sapiens
tgggaaaagggcagga

SEQ ID NO: 6526226 - DNA, 19 bp, Homo sapiens
tgggaaaatatttcctgac

SEQ ID NO: 6526227 - DNA, 15 bp, Homo sapiens
tgggaaaatggcaga

SEQ ID NO: 6526228 - DNA, 16 bp, Homo sapiens
tgggaaaatggcagaa

SEQ ID NO: 6526229 - DNA, 18 bp, Homo sapiens
tgggaaacaaataatttg

SEQ ID NO: 6526230 - DNA, 19 bp, Homo sapiens
tgggaaacactccttgcat

SEQ ID NO: 6526231 - DNA, 19 bp, Homo sapiens
tgggaaacagagtccaatt

SEQ ID NO: 6526232 - DNA, 21 bp, Homo sapiens
tgggaaaccccttctctgtga

SEQ ID NO: 6526233 - DNA, 15 bp, Homo sapiens
tgggaaacctgcctt

SEQ ID NO: 6526234 - DNA, 18 bp, Homo sapiens
tgggaaacttggctcgaa

SEQ ID NO: 6526235 - DNA, 15 bp, Homo sapiens
tgggaaacttgtcac

SEQ ID NO: 6526236 - DNA, 21 bp, Homo sapiens
tgggaaagaaggcaaagtccc

SEQ ID NO: 6526237 - DNA, 21 bp, Homo sapiens
tgggaaagcattgtaaatgtg

SEQ ID NO: 6526238 - DNA, 16 bp, Homo sapiens
tgggaaagccacctct

SEQ ID NO: 6526239 - DNA, 13 bp, Homo sapiens
tgggaaagcccag

SEQ ID NO: 6526240 - DNA, 16 bp, Homo sapiens
tgggaaagcccagact

SEQ ID NO: 6526241 - DNA, 17 bp, Homo sapiens
tgggaaagcccagactt

SEQ ID NO: 6526242 - DNA, 20 bp, Homo sapiens
tgggaaagcccctgcccctc

SEQ ID NO: 6526243 - DNA, 13 bp, Homo sapiens
tgggaaaggaaaa

SEQ ID NO: 6526244 - DNA, 13 bp, Homo sapiens
tgggaaaggggag

SEQ ID NO: 6526245 - DNA, 20 bp, Homo sapiens
tgggaaagggtgaggacttc

SEQ ID NO: 6526246 - DNA, 13 bp, Homo sapiens
tgggaaaggtgct

SEQ ID NO: 6526247 - DNA, 20 bp, Homo sapiens
tgggaaaggttgaattaatt

SEQ ID NO: 6526248 - DNA, 18 bp, Homo sapiens
tgggaaataaagaaaatt

SEQ ID NO: 6526249 - DNA, 18 bp, Homo sapiens
tgggaaatagcggccctg

SEQ ID NO: 6526250 - DNA, 19 bp, Homo sapiens
tgggaaatgagaaggcagc

SEQ ID NO: 6526251 - DNA, 20 bp, Homo sapiens
tgggaaatgagaaggcagcc

SEQ ID NO: 6526252 - DNA, 14 bp, Homo sapiens
tgggaaatgcagaa

SEQ ID NO: 6526253 - DNA, 23 bp, Homo sapiens
tgggaaatgctgatttaaacttc

SEQ ID NO: 6526254 - DNA, 20 bp, Homo sapiens
tgggaaattatctgccttat

SEQ ID NO: 6526255 - DNA, 15 bp, Homo sapiens
tgggaaattcttgca

SEQ ID NO: 6526256 - DNA, 17 bp, Homo sapiens
tgggaaattcttgcact

SEQ ID NO: 6526257 - DNA, 17 bp, Homo sapiens
tgggaaattgaagtgtc

SEQ ID NO: 6526258 - DNA, 17 bp, Homo sapiens
tgggaaatttgggtttt

SEQ ID NO: 6526259 - DNA, 15 bp, Homo sapiens
tgggaacaaggaagg

SEQ ID NO: 6526260 - DNA, 18 bp, Homo sapiens
tgggaacaaggaaggaaa

SEQ ID NO: 6526261 - DNA, 15 bp, Homo sapiens
tgggaacaagtgtac

SEQ ID NO: 6526262 - DNA, 18 bp, Homo sapiens
tgggaacaagtgtacaga

SEQ ID NO: 6526263 - DNA, 21 bp, Homo sapiens
tgggaacaatatcaatatggt

SEQ ID NO: 6526264 - DNA, 18 bp, Homo sapiens
tgggaacacagtgcccca

SEQ ID NO: 6526265 - DNA, 18 bp, Homo sapiens
tgggaacactggcctggg

SEQ ID NO: 6526266 - DNA, 21 bp, Homo sapiens
tgggaacagcatggaggcaga

SEQ ID NO: 6526267 - DNA, 13 bp, Homo sapiens
tgggaacataaaa

SEQ ID NO: 6526268 - DNA, 16 bp, Homo sapiens
tgggaacatggtcacc

SEQ ID NO: 6526269 - DNA, 21 bp, Homo sapiens
tgggaacatttattttatgag

SEQ ID NO: 6526270 - DNA, 14 bp, Homo sapiens
tgggaaccaagggc

SEQ ID NO: 6526271 - DNA, 17 bp, Homo sapiens
tgggaaccatgaagctg

SEQ ID NO: 6526272 - DNA, 18 bp, Homo sapiens
tgggaacccctttcccac

SEQ ID NO: 6526273 - DNA, 16 bp, Homo sapiens
tgggaaccctccccaa

SEQ ID NO: 6526274 - DNA, 23 bp, Homo sapiens
tgggaacctagtactctctgctc

SEQ ID NO: 6526275 - DNA, 21 bp, Homo sapiens
tgggaacctcccagaggtcca

SEQ ID NO: 6526276 - DNA, 16 bp, Homo sapiens
tgggaaccttcctgtc

SEQ ID NO: 6526277 - DNA, 18 bp, Homo sapiens
tgggaacgtgtgtccagg

SEQ ID NO: 6526278 - DNA, 22 bp, Homo sapiens
tgggaactatgaggagcctctg

SEQ ID NO: 6526279 - DNA, 15 bp, Homo sapiens
tgggaactcacctgg

SEQ ID NO: 6526280 - DNA, 18 bp, Homo sapiens
tgggaactctcctggcct

SEQ ID NO: 6526281 - DNA, 16 bp, Homo sapiens
tgggaactctgacaag

SEQ ID NO: 6526282 - DNA, 22 bp, Homo sapiens
tgggaactctgacaagggctga

SEQ ID NO: 6526283 - DNA, 16 bp, Homo sapiens
tgggaactgaattgtg

SEQ ID NO: 6526284 - DNA, 16 bp, Homo sapiens
tgggaactgggccagc

SEQ ID NO: 6526285 - DNA, 20 bp, Homo sapiens
tgggaactgggccagcagag

SEQ ID NO: 6526286 - DNA, 23 bp, Homo sapiens
tgggaactgtgcaaagggctgcc

SEQ ID NO: 6526287 - DNA, 21 bp, Homo sapiens
tgggaacttctaaacacttca

SEQ ID NO: 6526288 - DNA, 12 bp, Homo sapiens
tgggaagaacaa

SEQ ID NO: 6526289 - DNA, 13 bp, Homo sapiens
tgggaagaagaag

SEQ ID NO: 6526290 - DNA, 18 bp, Homo sapiens
tgggaagaattggaagtt

SEQ ID NO: 6526291 - DNA, 13 bp, Homo sapiens
tgggaagacatga

SEQ ID NO: 6526292 - DNA, 22 bp, Homo sapiens
tgggaagaccaaaggaaggaac

SEQ ID NO: 6526293 - DNA, 18 bp, Homo sapiens
tgggaagacgcctgagct

SEQ ID NO: 6526294 - DNA, 20 bp, Homo sapiens
tgggaagactcctagctgtc

SEQ ID NO: 6526295 - DNA, 17 bp, Homo sapiens
tgggaagagaagggaag

SEQ ID NO: 6526296 - DNA, 20 bp, Homo sapiens
tgggaagagaagggaagcct

SEQ ID NO: 6526297 - DNA, 17 bp, Homo sapiens
tgggaagagcttagaaa

SEQ ID NO: 6526298 - DNA, 18 bp, Homo sapiens
tgggaagaggacttcggg

SEQ ID NO: 6526299 - DNA, 17 bp, Homo sapiens
tgggaagataggctctg

SEQ ID NO: 6526300 - DNA, 15 bp, Homo sapiens
tgggaagatgctggc

SEQ ID NO: 6526301 - DNA, 17 bp, Homo sapiens
tgggaagatggtagcag

SEQ ID NO: 6526302 - DNA, 22 bp, Homo sapiens
tgggaagatggtagcagataaa

SEQ ID NO: 6526303 - DNA, 15 bp, Homo sapiens
tgggaagatttgaaa

SEQ ID NO: 6526304 - DNA, 20 bp, Homo sapiens
tgggaagatttgaaaacaaa

SEQ ID NO: 6526305 - DNA, 12 bp, Homo sapiens
tgggaagcagga

SEQ ID NO: 6526306 - DNA, 11 bp, Homo sapiens
tgggaagccat

SEQ ID NO: 6526307 - DNA, 18 bp, Homo sapiens
tgggaagctcccacaccc

SEQ ID NO: 6526308 - DNA, 14 bp, Homo sapiens
tgggaagctgaggc

SEQ ID NO: 6526309 - DNA, 15 bp, Homo sapiens
tgggaagctgagggc

SEQ ID NO: 6526310 - DNA, 20 bp, Homo sapiens
tgggaagctgagggcaaatc

SEQ ID NO: 6526311 - DNA, 17 bp, Homo sapiens
tgggaagctggagtgct

SEQ ID NO: 6526312 - DNA, 15 bp, Homo sapiens
tgggaagctgtactc

SEQ ID NO: 6526313 - DNA, 17 bp, Homo sapiens
tgggaagcttgctggct

SEQ ID NO: 6526314 - DNA, 22 bp, Homo sapiens
tgggaaggaaacaaatgtgtat

SEQ ID NO: 6526315 - DNA, 15 bp, Homo sapiens
tgggaaggacacagc

SEQ ID NO: 6526316 - DNA, 21 bp, Homo sapiens
tgggaaggacacagcagtatt

SEQ ID NO: 6526317 - DNA, 12 bp, Homo sapiens
tgggaaggaggg

SEQ ID NO: 6526318 - DNA, 19 bp, Homo sapiens
tgggaaggagggagctgct

SEQ ID NO: 6526319 - DNA, 21 bp, Homo sapiens
tgggaaggagggagctgctca

SEQ ID NO: 6526320 - DNA, 23 bp, Homo sapiens
tgggaaggaggggagcctttggg

SEQ ID NO: 6526321 - DNA, 15 bp, Homo sapiens
tgggaaggcacctgc

SEQ ID NO: 6526322 - DNA, 13 bp, Homo sapiens
tgggaaggccagc

SEQ ID NO: 6526323 - DNA, 22 bp, Homo sapiens
tgggaaggcctcttggagacct

SEQ ID NO: 6526324 - DNA, 18 bp, Homo sapiens
tgggaaggcgagtctggg

SEQ ID NO: 6526325 - DNA, 19 bp, Homo sapiens
tgggaaggctaagttcagt

SEQ ID NO: 6526326 - DNA, 23 bp, Homo sapiens
tgggaaggctacttcggggctgg

SEQ ID NO: 6526327 - DNA, 13 bp, Homo sapiens
tgggaagggagag

SEQ ID NO: 6526328 - DNA, 21 bp, Homo sapiens
tgggaagggagagcggggcag

SEQ ID NO: 6526329 - DNA, 22 bp, Homo sapiens
tgggaagggagagttctttgct

SEQ ID NO: 6526330 - DNA, 17 bp, Homo sapiens
tgggaaggggaggaccc

SEQ ID NO: 6526331 - DNA, 15 bp, Homo sapiens
tgggaagggggcagg

SEQ ID NO: 6526332 - DNA, 21 bp, Homo sapiens
tgggaaggggtcctgcagggg

SEQ ID NO: 6526333 - DNA, 15 bp, Homo sapiens
tgggaagtgaagact

SEQ ID NO: 6526334 - DNA, 16 bp, Homo sapiens
tgggaagtgaagcccc

SEQ ID NO: 6526335 - DNA, 14 bp, Homo sapiens
tgggaagtgactta

SEQ ID NO: 6526336 - DNA, 13 bp, Homo sapiens
tgggaagtgtgtt

SEQ ID NO: 6526337 - DNA, 17 bp, Homo sapiens
tgggaagtgtgtttaga

SEQ ID NO: 6526338 - DNA, 18 bp, Homo sapiens
tgggaagttaccttttat

SEQ ID NO: 6526339 - DNA, 22 bp, Homo sapiens
tgggaagttaccttttataaga

SEQ ID NO: 6526340 - DNA, 23 bp, Homo sapiens
tgggaagttgcattcctttgtct

SEQ ID NO: 6526341 - DNA, 15 bp, Homo sapiens
tgggaagtttgctgt

SEQ ID NO: 6526342 - DNA, 21 bp, Homo sapiens
tgggaagtttgctgtgctttg

SEQ ID NO: 6526343 - DNA, 23 bp, Homo sapiens
tgggaagtttgctgtgctttgga

SEQ ID NO: 6526344 - DNA, 15 bp, Homo sapiens
tgggaataaatatgc

SEQ ID NO: 6526345 - DNA, 16 bp, Homo sapiens
tgggaataaattaata

SEQ ID NO: 6526346 - DNA, 19 bp, Homo sapiens
tgggaataaattaatatat

SEQ ID NO: 6526347 - DNA, 21 bp, Homo sapiens
tgggaataatagacactgggg

SEQ ID NO: 6526348 - DNA, 16 bp, Homo sapiens
tgggaataattgcttt

SEQ ID NO: 6526349 - DNA, 15 bp, Homo sapiens
tgggaatagggagac

SEQ ID NO: 6526350 - DNA, 16 bp, Homo sapiens
tgggaatatgtagagg

SEQ ID NO: 6526351 - DNA, 13 bp, Homo sapiens
tgggaatcaggca

SEQ ID NO: 6526352 - DNA, 14 bp, Homo sapiens
tgggaatcctgctg

SEQ ID NO: 6526353 - DNA, 15 bp, Homo sapiens
ttatgttttgtttct

SEQ ID NO: 6526354 - DNA, 12 bp, Homo sapiens
ttatgtttttct

SEQ ID NO: 6526355 - DNA, 18 bp, Homo sapiens
ttatgtttttgtactctg

SEQ ID NO: 6526356 - DNA, 23 bp, Homo sapiens
ttattaaaaatctcaaatttcta

SEQ ID NO: 6526357 - DNA, 15 bp, Homo sapiens
ttattaaaacaaaag

SEQ ID NO: 6526358 - DNA, 12 bp, Homo sapiens
ttattaaaacag

SEQ ID NO: 6526359 - DNA, 14 bp, Homo sapiens
ttattaaaagaatg

SEQ ID NO: 6526360 - DNA, 16 bp, Homo sapiens
ttattaaaatactgtt

SEQ ID NO: 6526361 - DNA, 21 bp, Homo sapiens
ttattaaaatattttcttaat

SEQ ID NO: 6526362 - DNA, 22 bp, Homo sapiens
ttattaaaatattttcttaatt

SEQ ID NO: 6526363 - DNA, 12 bp, Homo sapiens
ttattaaaatct

SEQ ID NO: 6526364 - DNA, 14 bp, Homo sapiens
ttattaaaatgatt

SEQ ID NO: 6526365 - DNA, 16 bp, Homo sapiens
ttattaaaattctgaa

SEQ ID NO: 6526366 - DNA, 19 bp, Homo sapiens
ttattaaacaattttgtta

SEQ ID NO: 6526367 - DNA, 18 bp, Homo sapiens
ttattaaacagatatctt

SEQ ID NO: 6526368 - DNA, 21 bp, Homo sapiens
ttattaaacagatttttacaa

SEQ ID NO: 6526369 - DNA, 22 bp, Homo sapiens
ttattaaacagtgaacttgtct

SEQ ID NO: 6526370 - DNA, 14 bp, Homo sapiens
ttattaaacatttt

SEQ ID NO: 6526371 - DNA, 16 bp, Homo sapiens
ttattaaacattttca

SEQ ID NO: 6526372 - DNA, 17 bp, Homo sapiens
ttattaaacattttcat

SEQ ID NO: 6526373 - DNA, 14 bp, Homo sapiens
ttattaaacccctt

SEQ ID NO: 6526374 - DNA, 20 bp, Homo sapiens
ttattaaacgtatgcatgtg

SEQ ID NO: 6526375 - DNA, 12 bp, Homo sapiens
ttattaaacttc

SEQ ID NO: 6526376 - DNA, 14 bp, Homo sapiens
ttattaaacttcag

SEQ ID NO: 6526377 - DNA, 15 bp, Homo sapiens
ttattaaacttcagc

SEQ ID NO: 6526378 - DNA, 20 bp, Homo sapiens
ttattaaagaaaaaaatgta

SEQ ID NO: 6526379 - DNA, 21 bp, Homo sapiens
ttattaaagaaaaaaatgtat

SEQ ID NO: 6526380 - DNA, 23 bp, Homo sapiens
ttattaaagaaaaaaatgtattt

SEQ ID NO: 6526381 - DNA, 13 bp, Homo sapiens
ttattaaagcaac

SEQ ID NO: 6526382 - DNA, 19 bp, Homo sapiens
ttattaaagcaacatttta

SEQ ID NO: 6526383 - DNA, 19 bp, Homo sapiens
ttattaaagtttcaaaaat

SEQ ID NO: 6526384 - DNA, 22 bp, Homo sapiens
ttattaaataaatattttacag

SEQ ID NO: 6526385 - DNA, 21 bp, Homo sapiens
ttattaaatcagttttgtgta

SEQ ID NO: 6526386 - DNA, 23 bp, Homo sapiens
ttattaaatcagttttgtgtaca

SEQ ID NO: 6526387 - DNA, 14 bp, Homo sapiens
ttattaaatcgttt

SEQ ID NO: 6526388 - DNA, 23 bp, Homo sapiens
ttattaaatcgtttaatgtttat

SEQ ID NO: 6526389 - DNA, 15 bp, Homo sapiens
ttattaaatgcttca

SEQ ID NO: 6526390 - DNA, 16 bp, Homo sapiens
ttattaaatggaaact

SEQ ID NO: 6526391 - DNA, 20 bp, Homo sapiens
ttattaaatgtttcaaaata

SEQ ID NO: 6526392 - DNA, 15 bp, Homo sapiens
ttattaaatttatta

SEQ ID NO: 6526393 - DNA, 16 bp, Homo sapiens
ttattaaatttattaa

SEQ ID NO: 6526394 - DNA, 20 bp, Homo sapiens
ttattaaatttatttgaaaa

SEQ ID NO: 6526395 - DNA, 20 bp, Homo sapiens
ttattaaatttttttgtatg

SEQ ID NO: 6526396 - DNA, 18 bp, Homo sapiens
ttattaacataggtgaaa

SEQ ID NO: 6526397 - DNA, 13 bp, Homo sapiens
ttattaaccaaat

SEQ ID NO: 6526398 - DNA, 15 bp, Homo sapiens
ttattaacctcttaa

SEQ ID NO: 6526399 - DNA, 19 bp, Homo sapiens
ttattaacgggcatgtatt

SEQ ID NO: 6526400 - DNA, 19 bp, Homo sapiens
ttattaactactgaataat

SEQ ID NO: 6526401 - DNA, 19 bp, Homo sapiens
ttattaagaccaaagactt

SEQ ID NO: 6526402 - DNA, 22 bp, Homo sapiens
ttattaagcaaccttaaagcaa

SEQ ID NO: 6526403 - DNA, 20 bp, Homo sapiens
ttattaagccaggaaacatg

SEQ ID NO: 6526404 - DNA, 19 bp, Homo sapiens
ttattaagctttttggaat

SEQ ID NO: 6526405 - DNA, 16 bp, Homo sapiens
ttattaaggaaatact

SEQ ID NO: 6526406 - DNA, 20 bp, Homo sapiens
ttattaagtatatttgtaaa

SEQ ID NO: 6526407 - DNA, 15 bp, Homo sapiens
ttattaataaaacaa

SEQ ID NO: 6526408 - DNA, 15 bp, Homo sapiens
ttattaataaacatt

SEQ ID NO: 6526409 - DNA, 15 bp, Homo sapiens
ttattaataatgaag

SEQ ID NO: 6526410 - DNA, 17 bp, Homo sapiens
ttattaataatgaagta

SEQ ID NO: 6526411 - DNA, 20 bp, Homo sapiens
ttattaatatgagttactga

SEQ ID NO: 6526412 - DNA, 12 bp, Homo sapiens
ttattaatcact

SEQ ID NO: 6526413 - DNA, 13 bp, Homo sapiens
ttattaatcactg

SEQ ID NO: 6526414 - DNA, 16 bp, Homo sapiens
ttattaatcactgtgt

SEQ ID NO: 6526415 - DNA, 17 bp, Homo sapiens
ttattaatccacaaata

SEQ ID NO: 6526416 - DNA, 13 bp, Homo sapiens
ttattaatctact

SEQ ID NO: 6526417 - DNA, 17 bp, Homo sapiens
ttattaatcttagtgta

SEQ ID NO: 6526418 - DNA, 22 bp, Homo sapiens
ttattaatgatcagctatatac

SEQ ID NO: 6526419 - DNA, 13 bp, Homo sapiens
ttattaatgcact

SEQ ID NO: 6526420 - DNA, 17 bp, Homo sapiens
ttattaatgcactttct

SEQ ID NO: 6526421 - DNA, 16 bp, Homo sapiens
ttattaatgctaaggg

SEQ ID NO: 6526422 - DNA, 13 bp, Homo sapiens
ttattaatgcttt

SEQ ID NO: 6526423 - DNA, 14 bp, Homo sapiens
ttattaatgctttg

SEQ ID NO: 6526424 - DNA, 18 bp, Homo sapiens
ttattaattttcaggatt

SEQ ID NO: 6526425 - DNA, 17 bp, Homo sapiens
ttattacaaatgcaaat

SEQ ID NO: 6526426 - DNA, 15 bp, Homo sapiens
ttattacaacaagca

SEQ ID NO: 6526427 - DNA, 20 bp, Homo sapiens
ttattacaacaagcaaactg

SEQ ID NO: 6526428 - DNA, 17 bp, Homo sapiens
ttattacaagtggctcc

SEQ ID NO: 6526429 - DNA, 21 bp, Homo sapiens
ttattacaatttgtattactt

SEQ ID NO: 6526430 - DNA, 21 bp, Homo sapiens
ttattacacctcagaaattga

SEQ ID NO: 6526431 - DNA, 14 bp, Homo sapiens
ttattacagtataa

SEQ ID NO: 6526432 - DNA, 19 bp, Homo sapiens
ttattacagtgtttatcct

SEQ ID NO: 6526433 - DNA, 17 bp, Homo sapiens
ttattacatccttgtgg

SEQ ID NO: 6526434 - DNA, 18 bp, Homo sapiens
ttattacatccttgtggc

SEQ ID NO: 6526435 - DNA, 20 bp, Homo sapiens
ttattacatccttgtggcac

SEQ ID NO: 6526436 - DNA, 15 bp, Homo sapiens
ttattacatctttat

SEQ ID NO: 6526437 - DNA, 19 bp, Homo sapiens
ttattacatctttattaac

SEQ ID NO: 6526438 - DNA, 13 bp, Homo sapiens
ttattacatgtaa

SEQ ID NO: 6526439 - DNA, 16 bp, Homo sapiens
ttattacatttataca

SEQ ID NO: 6526440 - DNA, 16 bp, Homo sapiens
ttattaccaaaacagg

SEQ ID NO: 6526441 - DNA, 19 bp, Homo sapiens
ttattacccaagtcttctc

SEQ ID NO: 6526442 - DNA, 13 bp, Homo sapiens
ttattacctctga

SEQ ID NO: 6526443 - DNA, 14 bp, Homo sapiens
ttattactaattct

SEQ ID NO: 6526444 - DNA, 13 bp, Homo sapiens
ttattactgagag

SEQ ID NO: 6526445 - DNA, 19 bp, Homo sapiens
ttattactgctaagtattt

SEQ ID NO: 6526446 - DNA, 17 bp, Homo sapiens
ttattactgtaagaaaa

SEQ ID NO: 6526447 - DNA, 18 bp, Homo sapiens
ttattactgtaagaaaat

SEQ ID NO: 6526448 - DNA, 18 bp, Homo sapiens
ttattactgtttgtcttc

SEQ ID NO: 6526449 - DNA, 14 bp, Homo sapiens
ttattacttccatg

SEQ ID NO: 6526450 - DNA, 13 bp, Homo sapiens
ttattacttctgt

SEQ ID NO: 6526451 - DNA, 18 bp, Homo sapiens
ttattacttgtaaatata

SEQ ID NO: 6526452 - DNA, 14 bp, Homo sapiens
ttattacttttgct

SEQ ID NO: 6526453 - DNA, 19 bp, Homo sapiens
ttattagaaagccatattt

SEQ ID NO: 6526454 - DNA, 13 bp, Homo sapiens
ttattagaacatt

SEQ ID NO: 6526455 - DNA, 22 bp, Homo sapiens
ttattagaatataaaaaatgtt

SEQ ID NO: 6526456 - DNA, 14 bp, Homo sapiens
ttattagaatccaa

SEQ ID NO: 6526457 - DNA, 13 bp, Homo sapiens
ttattagagattt

SEQ ID NO: 6526458 - DNA, 17 bp, Homo sapiens
ttattagagtgtctttc

SEQ ID NO: 6526459 - DNA, 13 bp, Homo sapiens
ttattagatgaat

SEQ ID NO: 6526460 - DNA, 12 bp, Homo sapiens
ttattagcagct

SEQ ID NO: 6526461 - DNA, 23 bp, Homo sapiens
ttattagcagctgactttcaaag

SEQ ID NO: 6526462 - DNA, 14 bp, Homo sapiens
ttattagcatttgt

SEQ ID NO: 6526463 - DNA, 17 bp, Homo sapiens
ttattagcgttttaaca

SEQ ID NO: 6526464 - DNA, 18 bp, Homo sapiens
ttattaggagtaattctt

SEQ ID NO: 6526465 - DNA, 17 bp, Homo sapiens
ttattaggataatacat

SEQ ID NO: 6526466 - DNA, 18 bp, Homo sapiens
ttattaggatacaagctg

SEQ ID NO: 6526467 - DNA, 23 bp, Homo sapiens
ttattagggagaaaattcaattg

SEQ ID NO: 6526468 - DNA, 20 bp, Homo sapiens
ttattagtaagaaaacatca

SEQ ID NO: 6526469 - DNA, 20 bp, Homo sapiens
ttattagtgaagtatgcact

SEQ ID NO: 6526470 - DNA, 20 bp, Homo sapiens
ttattagtgtatgctttgaa

SEQ ID NO: 6526471 - DNA, 18 bp, Homo sapiens
ttattagtttacatcatt

SEQ ID NO: 6526472 - DNA, 12 bp, Homo sapiens
ttattagttttg

SEQ ID NO: 6526473 - DNA, 14 bp, Homo sapiens
ttattataaactat

SEQ ID NO: 6526474 - DNA, 15 bp, Homo sapiens
ttattataaagctta

SEQ ID NO: 6526475 - DNA, 18 bp, Homo sapiens
ttattataaagcttaaat

SEQ ID NO: 6526476 - DNA, 21 bp, Homo sapiens
ttattataaattctactaagt

SEQ ID NO: 6526477 - DNA, 13 bp, Homo sapiens
ttattataacata

SEQ ID NO: 6526478 - DNA, 12 bp, Homo sapiens
ttattataattg

SEQ ID NO: 6526479 - DNA, 15 bp, Homo sapiens
ttattatagtctgta

SEQ ID NO: 6526480 - DNA, 14 bp, Homo sapiens
ttattatagttatt

SEQ ID NO: 6526481 - DNA, 23 bp, Homo sapiens
ttattatatatttacagaagaaa

SEQ ID NO: 6526482 - DNA, 16 bp, Homo sapiens
ttattatattcagagt

SEQ ID NO: 6526483 - DNA, 16 bp, Homo sapiens
ttattatcgcatacag

SEQ ID NO: 6526484 - DNA, 23 bp, Homo sapiens
ttattatctatggaaatgtgaga

SEQ ID NO: 6526485 - DNA, 17 bp, Homo sapiens
ttattatgaaacttgtg

SEQ ID NO: 6526486 - DNA, 21 bp, Homo sapiens
ttattatgaaacttgtgtaaa

SEQ ID NO: 6526487 - DNA, 14 bp, Homo sapiens
ttattatgcataaa

SEQ ID NO: 6526488 - DNA, 14 bp, Homo sapiens
ttattatgcattat

SEQ ID NO: 6526489 - DNA, 16 bp, Homo sapiens
ttattatggaaaacat

SEQ ID NO: 6526490 - DNA, 13 bp, Homo sapiens
ttattatggcttg

SEQ ID NO: 6526491 - DNA, 14 bp, Homo sapiens
ttattatggcttgt

SEQ ID NO: 6526492 - DNA, 13 bp, Homo sapiens
ttattatgttctt

SEQ ID NO: 6526493 - DNA, 23 bp, Homo sapiens
ttattatgttcttagcaataaat

SEQ ID NO: 6526494 - DNA, 14 bp, Homo sapiens
ttattattaacaaa

SEQ ID NO: 6526495 - DNA, 16 bp, Homo sapiens
ttattattagattctc

SEQ ID NO: 6526496 - DNA, 14 bp, Homo sapiens
ttattattattact

SEQ ID NO: 6526497 - DNA, 15 bp, Homo sapiens
ttattattattatat

SEQ ID NO: 6526498 - DNA, 14 bp, Homo sapiens
ttattattcctagt

SEQ ID NO: 6526499 - DNA, 15 bp, Homo sapiens
ttattattgctgaag

SEQ ID NO: 6526500 - DNA, 13 bp, Homo sapiens
ttattattgtact

SEQ ID NO: 6526501 - DNA, 15 bp, Homo sapiens
ttattatttaactct

SEQ ID NO: 6526502 - DNA, 13 bp, Homo sapiens
ttattatttaatt

SEQ ID NO: 6526503 - DNA, 22 bp, Homo sapiens
ttattatttatttgattaggta

SEQ ID NO: 6526504 - DNA, 13 bp, Homo sapiens
ttattatttctgt

SEQ ID NO: 6526505 - DNA, 16 bp, Homo sapiens
ttattatttgcacaga

SEQ ID NO: 6526506 - DNA, 12 bp, Homo sapiens
ttattatttgta

SEQ ID NO: 6526507 - DNA, 13 bp, Homo sapiens
ttattattttaat

SEQ ID NO: 6526508 - DNA, 16 bp, Homo sapiens
ttattattttccttcc

SEQ ID NO: 6526509 - DNA, 14 bp, Homo sapiens
ttattattttgcaa

SEQ ID NO: 6526510 - DNA, 15 bp, Homo sapiens
ttattcaaaaaatca

SEQ ID NO: 6526511 - DNA, 11 bp, Homo sapiens
ttattcaaaat

SEQ ID NO: 6526512 - DNA, 14 bp, Homo sapiens
ttattcaaaatatt

SEQ ID NO: 6526513 - DNA, 15 bp, Homo sapiens
ttattcaaagaaata

SEQ ID NO: 6526514 - DNA, 19 bp, Homo sapiens
ttattcaaagagaaaacat

SEQ ID NO: 6526515 - DNA, 17 bp, Homo sapiens
ttattcaaagcagctgt

SEQ ID NO: 6526516 - DNA, 15 bp, Homo sapiens
ttattcaaagttgcc

SEQ ID NO: 6526517 - DNA, 13 bp, Homo sapiens
ttattcaaatgaa

SEQ ID NO: 6526518 - DNA, 15 bp, Homo sapiens
ttattcaaatgaagg

SEQ ID NO: 6526519 - DNA, 15 bp, Homo sapiens
ttattcaaatttgat

SEQ ID NO: 6526520 - DNA, 14 bp, Homo sapiens
ttattcaacagaga

SEQ ID NO: 6526521 - DNA, 23 bp, Homo sapiens
ttattcaagaatgccagtagaaa

SEQ ID NO: 6526522 - DNA, 11 bp, Homo sapiens
ttattcaaggt

SEQ ID NO: 6526523 - DNA, 19 bp, Homo sapiens
ttattcaataaagtattta

SEQ ID NO: 6526524 - DNA, 13 bp, Homo sapiens
ttattcaataact

SEQ ID NO: 6526525 - DNA, 15 bp, Homo sapiens
ttattcacccctgcc

SEQ ID NO: 6526526 - DNA, 21 bp, Homo sapiens
ttattcactgaagttctcctg

SEQ ID NO: 6526527 - DNA, 13 bp, Homo sapiens
ttattcactgtaa

SEQ ID NO: 6526528 - DNA, 19 bp, Homo sapiens
ttattcactgtaagtttat

SEQ ID NO: 6526529 - DNA, 14 bp, Homo sapiens
ttattcagaaatat

SEQ ID NO: 6526530 - DNA, 15 bp, Homo sapiens
ttattcagaacttta

SEQ ID NO: 6526531 - DNA, 14 bp, Homo sapiens
ttattcagctcact

SEQ ID NO: 6526532 - DNA, 15 bp, Homo sapiens
ttattcagcttcatt

SEQ ID NO: 6526533 - DNA, 21 bp, Homo sapiens
ttattcaggaaaagcctctgt

SEQ ID NO: 6526534 - DNA, 22 bp, Homo sapiens
ttattcaggaaaagcctctgtg

SEQ ID NO: 6526535 - DNA, 15 bp, Homo sapiens
tgggaatcctgctgc

SEQ ID NO: 6526536 - DNA, 15 bp, Homo sapiens
tgggaatcctggaca

SEQ ID NO: 6526537 - DNA, 16 bp, Homo sapiens
tgggaatcctggacag

SEQ ID NO: 6526538 - DNA, 19 bp, Homo sapiens
tgggaatctaagtgggaga

SEQ ID NO: 6526539 - DNA, 14 bp, Homo sapiens
tgggaatgaagcaa

SEQ ID NO: 6526540 - DNA, 13 bp, Homo sapiens
tgggaatgaagct

SEQ ID NO: 6526541 - DNA, 18 bp, Homo sapiens
tgggaatgaagcttgtgt

SEQ ID NO: 6526542 - DNA, 16 bp, Homo sapiens
tgggaatgaatgtcag

SEQ ID NO: 6526543 - DNA, 22 bp, Homo sapiens
tgggaatgaatgtcagtgtgac

SEQ ID NO: 6526544 - DNA, 17 bp, Homo sapiens
tgggaatgaggcttgct

SEQ ID NO: 6526545 - DNA, 16 bp, Homo sapiens
tgggaatggaataact

SEQ ID NO: 6526546 - DNA, 13 bp, Homo sapiens
tgggaatggattt

SEQ ID NO: 6526547 - DNA, 14 bp, Homo sapiens
tgggaatgtatagt

SEQ ID NO: 6526548 - DNA, 20 bp, Homo sapiens
tgggaatgtatagtatttga

SEQ ID NO: 6526549 - DNA, 22 bp, Homo sapiens
tgggaatgtcctgtagagagag

SEQ ID NO: 6526550 - DNA, 20 bp, Homo sapiens
tgggaatgtctaacttaaat

SEQ ID NO: 6526551 - DNA, 10 bp, Homo sapiens
tgggaatgtt

SEQ ID NO: 6526552 - DNA, 19 bp, Homo sapiens
tgggaattcttgctgttaa

SEQ ID NO: 6526553 - DNA, 13 bp, Homo sapiens
tgggaattgcatg

SEQ ID NO: 6526554 - DNA, 14 bp, Homo sapiens
tgggaattgcatgc

SEQ ID NO: 6526555 - DNA, 18 bp, Homo sapiens
tgggaattgcgctcaggg

SEQ ID NO: 6526556 - DNA, 15 bp, Homo sapiens
tgggaattggggagg

SEQ ID NO: 6526557 - DNA, 14 bp, Homo sapiens
tgggaattgtgtga

SEQ ID NO: 6526558 - DNA, 12 bp, Homo sapiens
tgggaatttata

SEQ ID NO: 6526559 - DNA, 14 bp, Homo sapiens
tgggaatttcaatg

SEQ ID NO: 6526560 - DNA, 21 bp, Homo sapiens
tgggaatttcagctggagata

SEQ ID NO: 6526561 - DNA, 22 bp, Homo sapiens
tgggacaacaaagaggacacca

SEQ ID NO: 6526562 - DNA, 15 bp, Homo sapiens
tgggacaagcaggcc

SEQ ID NO: 6526563 - DNA, 17 bp, Homo sapiens
tgggacaagcagtccct

SEQ ID NO: 6526564 - DNA, 18 bp, Homo sapiens
tgggacaatggcaatagg

SEQ ID NO: 6526565 - DNA, 17 bp, Homo sapiens
tgggacaattgttttaa

SEQ ID NO: 6526566 - DNA, 12 bp, Homo sapiens
tgggacacacac

SEQ ID NO: 6526567 - DNA, 17 bp, Homo sapiens
tgggacacagacccagg

SEQ ID NO: 6526568 - DNA, 18 bp, Homo sapiens
tgggacacagagaccccc

SEQ ID NO: 6526569 - DNA, 13 bp, Homo sapiens
tgggacaccaggg

SEQ ID NO: 6526570 - DNA, 21 bp, Homo sapiens
tgggacaccccgacttttgtt

SEQ ID NO: 6526571 - DNA, 13 bp, Homo sapiens
tgggacaccctgt

SEQ ID NO: 6526572 - DNA, 15 bp, Homo sapiens
tgggacaccctgtga

SEQ ID NO: 6526573 - DNA, 14 bp, Homo sapiens
tgggacacctggga

SEQ ID NO: 6526574 - DNA, 15 bp, Homo sapiens
tgggacacctgggag

SEQ ID NO: 6526575 - DNA, 22 bp, Homo sapiens
tgggacacggtttaactgtccc

SEQ ID NO: 6526576 - DNA, 17 bp, Homo sapiens
tgggacactgggcagca

SEQ ID NO: 6526577 - DNA, 11 bp, Homo sapiens
tgggacagaca

SEQ ID NO: 6526578 - DNA, 16 bp, Homo sapiens
tgggacagcaacctgt

SEQ ID NO: 6526579 - DNA, 16 bp, Homo sapiens
tgggacagccactgga

SEQ ID NO: 6526580 - DNA, 14 bp, Homo sapiens
tgggacagccattt

SEQ ID NO: 6526581 - DNA, 18 bp, Homo sapiens
tgggacagcccagagcct

SEQ ID NO: 6526582 - DNA, 13 bp, Homo sapiens
tgggacagcccca

SEQ ID NO: 6526583 - DNA, 19 bp, Homo sapiens
tgggacagccccagggccc

SEQ ID NO: 6526584 - DNA, 14 bp, Homo sapiens
tgggacagcctctt

SEQ ID NO: 6526585 - DNA, 23 bp, Homo sapiens
tgggacagcctcttcagcccctt

SEQ ID NO: 6526586 - DNA, 13 bp, Homo sapiens
tgggacagctagg

SEQ ID NO: 6526587 - DNA, 19 bp, Homo sapiens
tgggacaggcaccatgctg

SEQ ID NO: 6526588 - DNA, 12 bp, Homo sapiens
tgggacaggctc

SEQ ID NO: 6526589 - DNA, 15 bp, Homo sapiens
tgggacaggctcttc

SEQ ID NO: 6526590 - DNA, 13 bp, Homo sapiens
tgggacagggagg

SEQ ID NO: 6526591 - DNA, 14 bp, Homo sapiens
tgggacagggagga

SEQ ID NO: 6526592 - DNA, 17 bp, Homo sapiens
tgggacagggaggccac

SEQ ID NO: 6526593 - DNA, 18 bp, Homo sapiens
tgggacagggcttctcct

SEQ ID NO: 6526594 - DNA, 19 bp, Homo sapiens
tgggacagggcttctcctg

SEQ ID NO: 6526595 - DNA, 20 bp, Homo sapiens
tgggacagggcttctcctgc

SEQ ID NO: 6526596 - DNA, 21 bp, Homo sapiens
tgggacagggcttctcctgcg

SEQ ID NO: 6526597 - DNA, 21 bp, Homo sapiens
tgggacagtggtgacatagtc

SEQ ID NO: 6526598 - DNA, 20 bp, Homo sapiens
tgggacagtttatcatgaag

SEQ ID NO: 6526599 - DNA, 16 bp, Homo sapiens
tgggacatagccagca

SEQ ID NO: 6526600 - DNA, 19 bp, Homo sapiens
tgggacatcctgtcatctg

SEQ ID NO: 6526601 - DNA, 19 bp, Homo sapiens
tgggacatggcacaggccc

SEQ ID NO: 6526602 - DNA, 16 bp, Homo sapiens
tgggacatgggaaagg

SEQ ID NO: 6526603 - DNA, 17 bp, Homo sapiens
tgggacattccaaagaa

SEQ ID NO: 6526604 - DNA, 19 bp, Homo sapiens
tgggacatttgctcatgga

SEQ ID NO: 6526605 - DNA, 17 bp, Homo sapiens
tgggaccaaacctagcc

SEQ ID NO: 6526606 - DNA, 20 bp, Homo sapiens
tgggaccaacacccctccca

SEQ ID NO: 6526607 - DNA, 23 bp, Homo sapiens
tgggaccaaccctggggaaggag

SEQ ID NO: 6526608 - DNA, 16 bp, Homo sapiens
tgggaccaacctgacc

SEQ ID NO: 6526609 - DNA, 17 bp, Homo sapiens
tgggaccacaactattt

SEQ ID NO: 6526610 - DNA, 23 bp, Homo sapiens
tgggaccacaggcatgcaccact

SEQ ID NO: 6526611 - DNA, 16 bp, Homo sapiens
tgggaccagagccaga

SEQ ID NO: 6526612 - DNA, 17 bp, Homo sapiens
tgggaccagagccagat

SEQ ID NO: 6526613 - DNA, 22 bp, Homo sapiens
tgggaccaggatactggacgct

SEQ ID NO: 6526614 - DNA, 13 bp, Homo sapiens
tgggaccaggcac

SEQ ID NO: 6526615 - DNA, 14 bp, Homo sapiens
tgggaccaggcacc

SEQ ID NO: 6526616 - DNA, 13 bp, Homo sapiens
tgggaccaggctc

SEQ ID NO: 6526617 - DNA, 14 bp, Homo sapiens
tgggaccaggctcc

SEQ ID NO: 6526618 - DNA, 17 bp, Homo sapiens
tgggacccacagaactt

SEQ ID NO: 6526619 - DNA, 16 bp, Homo sapiens
tgggacccacagtcac

SEQ ID NO: 6526620 - DNA, 22 bp, Homo sapiens
tgggacccacagtcacacagag

SEQ ID NO: 6526621 - DNA, 14 bp, Homo sapiens
tgggacccactccg

SEQ ID NO: 6526622 - DNA, 18 bp, Homo sapiens
tgggacccagctactctg

SEQ ID NO: 6526623 - DNA, 20 bp, Homo sapiens
tgggacccagctactctgtc

SEQ ID NO: 6526624 - DNA, 23 bp, Homo sapiens
tgggacccagctactctgtccag

SEQ ID NO: 6526625 - DNA, 15 bp, Homo sapiens
tgggacccaggctcc

SEQ ID NO: 6526626 - DNA, 21 bp, Homo sapiens
tgggacccaggctcccagcct

SEQ ID NO: 6526627 - DNA, 14 bp, Homo sapiens
tgggacccagtggc

SEQ ID NO: 6526628 - DNA, 19 bp, Homo sapiens
tgggacccagtggcagggc

SEQ ID NO: 6526629 - DNA, 14 bp, Homo sapiens
tgggaccccagctg

SEQ ID NO: 6526630 - DNA, 16 bp, Homo sapiens
tgggaccccagctgct

SEQ ID NO: 6526631 - DNA, 15 bp, Homo sapiens
tgggaccccaggccc

SEQ ID NO: 6526632 - DNA, 22 bp, Homo sapiens
tgggaccccaggcccactcagg

SEQ ID NO: 6526633 - DNA, 17 bp, Homo sapiens
tgggaccccattccagt

SEQ ID NO: 6526634 - DNA, 18 bp, Homo sapiens
tgggaccccattccagtc

SEQ ID NO: 6526635 - DNA, 13 bp, Homo sapiens
tgggaccccctcg

SEQ ID NO: 6526636 - DNA, 14 bp, Homo sapiens
tgggacccctccca

SEQ ID NO: 6526637 - DNA, 21 bp, Homo sapiens
tgggaccctcagcagctctgg

SEQ ID NO: 6526638 - DNA, 21 bp, Homo sapiens
tgggaccctccagtgctggat

SEQ ID NO: 6526639 - DNA, 23 bp, Homo sapiens
tgggaccctccagtgctggattt

SEQ ID NO: 6526640 - DNA, 22 bp, Homo sapiens
tgggaccctgtccggcccagtg

SEQ ID NO: 6526641 - DNA, 23 bp, Homo sapiens
tgggaccctgtccggcccagtgc

SEQ ID NO: 6526642 - DNA, 13 bp, Homo sapiens
tgggacccttggc

SEQ ID NO: 6526643 - DNA, 14 bp, Homo sapiens
tgggaccctttcct

SEQ ID NO: 6526644 - DNA, 23 bp, Homo sapiens
tgggaccgcctggccctccctcc

SEQ ID NO: 6526645 - DNA, 20 bp, Homo sapiens
tgggaccgctacaccactct

SEQ ID NO: 6526646 - DNA, 19 bp, Homo sapiens
tgggaccgtgccccacctc

SEQ ID NO: 6526647 - DNA, 19 bp, Homo sapiens
tgggaccgtgcgagctgcc

SEQ ID NO: 6526648 - DNA, 20 bp, Homo sapiens
tgggaccgtgcgagctgccg

SEQ ID NO: 6526649 - DNA, 17 bp, Homo sapiens
tgggacctccccagccc

SEQ ID NO: 6526650 - DNA, 18 bp, Homo sapiens
tgggacctccccagccca

SEQ ID NO: 6526651 - DNA, 23 bp, Homo sapiens
tgggacctgaatgacctgcagtc

SEQ ID NO: 6526652 - DNA, 17 bp, Homo sapiens
tgggacctgccaggcag

SEQ ID NO: 6526653 - DNA, 19 bp, Homo sapiens
tgggacctgccaggcaggg

SEQ ID NO: 6526654 - DNA, 23 bp, Homo sapiens
tgggacctgccaggcaggggtgg

SEQ ID NO: 6526655 - DNA, 21 bp, Homo sapiens
tgggacctgctgctccatgga

SEQ ID NO: 6526656 - DNA, 22 bp, Homo sapiens
tgggaccttctttattctgtgt

SEQ ID NO: 6526657 - DNA, 22 bp, Homo sapiens
tgggacgatcgcccaggctgga

SEQ ID NO: 6526658 - DNA, 19 bp, Homo sapiens
tgggacgctggtaactgtt

SEQ ID NO: 6526659 - DNA, 14 bp, Homo sapiens
tgggacggaagtgg

SEQ ID NO: 6526660 - DNA, 22 bp, Homo sapiens
tgggacggaagtggcctgagaa

SEQ ID NO: 6526661 - DNA, 13 bp, Homo sapiens
tgggacggaggtc

SEQ ID NO: 6526662 - DNA, 13 bp, Homo sapiens
tgggacggcggca

SEQ ID NO: 6526663 - DNA, 15 bp, Homo sapiens
tgggacgtggctcag

SEQ ID NO: 6526664 - DNA, 20 bp, Homo sapiens
tgggacgtggctcagccagc

SEQ ID NO: 6526665 - DNA, 21 bp, Homo sapiens
tgggacgtggctcagccagca

SEQ ID NO: 6526666 - DNA, 18 bp, Homo sapiens
tgggacgtggtcagggca

SEQ ID NO: 6526667 - DNA, 18 bp, Homo sapiens
tgggacgtgtacagcaca

SEQ ID NO: 6526668 - DNA, 17 bp, Homo sapiens
tgggactaaagccagga

SEQ ID NO: 6526669 - DNA, 18 bp, Homo sapiens
tgggactaaagccaggaa

SEQ ID NO: 6526670 - DNA, 21 bp, Homo sapiens
tgggactaaagccaggaacag

SEQ ID NO: 6526671 - DNA, 15 bp, Homo sapiens
tgggactaaatgccc

SEQ ID NO: 6526672 - DNA, 14 bp, Homo sapiens
tgggactacaggca

SEQ ID NO: 6526673 - DNA, 16 bp, Homo sapiens
tgggactacaggtgtg

SEQ ID NO: 6526674 - DNA, 19 bp, Homo sapiens
tgggactagcctggcttgg

SEQ ID NO: 6526675 - DNA, 20 bp, Homo sapiens
tgggactaggacctgagcct

SEQ ID NO: 6526676 - DNA, 19 bp, Homo sapiens
tgggactatgcttttctca

SEQ ID NO: 6526677 - DNA, 20 bp, Homo sapiens
tgggactcaatgcactgaca

SEQ ID NO: 6526678 - DNA, 13 bp, Homo sapiens
tgggactcagcct

SEQ ID NO: 6526679 - DNA, 14 bp, Homo sapiens
tgggactcaggtct

SEQ ID NO: 6526680 - DNA, 20 bp, Homo sapiens
tgggactcaggtctgtaact

SEQ ID NO: 6526681 - DNA, 15 bp, Homo sapiens
tgggactcagttctt

SEQ ID NO: 6526682 - DNA, 22 bp, Homo sapiens
tgggactcagttgttctgagca

SEQ ID NO: 6526683 - DNA, 23 bp, Homo sapiens
tgggactcagttgttctgagcac

SEQ ID NO: 6526684 - DNA, 22 bp, Homo sapiens
tgggactcatccttgcccaggt

SEQ ID NO: 6526685 - DNA, 17 bp, Homo sapiens
tgggactccaggccagc

SEQ ID NO: 6526686 - DNA, 19 bp, Homo sapiens
tgggactcccagcagagcc

SEQ ID NO: 6526687 - DNA, 15 bp, Homo sapiens
tgggactcctggtgc

SEQ ID NO: 6526688 - DNA, 20 bp, Homo sapiens
tgggactctatactaccctg

SEQ ID NO: 6526689 - DNA, 16 bp, Homo sapiens
tgggactctcctcctc

SEQ ID NO: 6526690 - DNA, 23 bp, Homo sapiens
tgggactctgaactggagctgct

SEQ ID NO: 6526691 - DNA, 18 bp, Homo sapiens
tgggactcttccctggga

SEQ ID NO: 6526692 - DNA, 14 bp, Homo sapiens
tgggactgaaaggt

SEQ ID NO: 6526693 - DNA, 14 bp, Homo sapiens
tgggactgagccag

SEQ ID NO: 6526694 - DNA, 20 bp, Homo sapiens
tgggactgagccagtcccag

SEQ ID NO: 6526695 - DNA, 11 bp, Homo sapiens
tgggactgatg

SEQ ID NO: 6526696 - DNA, 18 bp, Homo sapiens
tgggactgatgtcatctt

SEQ ID NO: 6526697 - DNA, 19 bp, Homo sapiens
tgggactgatgtcatcttg

SEQ ID NO: 6526698 - DNA, 21 bp, Homo sapiens
tgggactgatgtcatcttgag

SEQ ID NO: 6526699 - DNA, 13 bp, Homo sapiens
tgggactggagtc

SEQ ID NO: 6526700 - DNA, 16 bp, Homo sapiens
tgggactggagtcaga

SEQ ID NO: 6526701 - DNA, 21 bp, Homo sapiens
tgggactggagtcagatgagc

SEQ ID NO: 6526702 - DNA, 18 bp, Homo sapiens
tgggactggagtccctgt

SEQ ID NO: 6526703 - DNA, 16 bp, Homo sapiens
tgggactggtgggggt

SEQ ID NO: 6526704 - DNA, 17 bp, Homo sapiens
tgggactgtacacactt

SEQ ID NO: 6526705 - DNA, 18 bp, Homo sapiens
tgggactgtcttgagaaa

SEQ ID NO: 6526706 - DNA, 19 bp, Homo sapiens
tgggactgtgcctggctcc

SEQ ID NO: 6526707 - DNA, 15 bp, Homo sapiens
tgggacttattacaa

SEQ ID NO: 6526708 - DNA, 16 bp, Homo sapiens
tgggacttctacccag

SEQ ID NO: 6526709 - DNA, 20 bp, Homo sapiens
tgggacttctacccagatgg

SEQ ID NO: 6526710 - DNA, 14 bp, Homo sapiens
tgggacttcttacc

SEQ ID NO: 6526711 - DNA, 20 bp, Homo sapiens
tgggacttcttacccaaagc

SEQ ID NO: 6526712 - DNA, 13 bp, Homo sapiens
tgggacttctttt

SEQ ID NO: 6526713 - DNA, 15 bp, Homo sapiens
tgggacttcttttca

SEQ ID NO: 6526714 - DNA, 19 bp, Homo sapiens
ttattcaggaagataaaaa

SEQ ID NO: 6526715 - DNA, 18 bp, Homo sapiens
ttattcagtaactgtcag

SEQ ID NO: 6526716 - DNA, 18 bp, Homo sapiens
ttattcagtgacttctgg

SEQ ID NO: 6526717 - DNA, 21 bp, Homo sapiens
ttattcagtgccacaaattga

SEQ ID NO: 6526718 - DNA, 16 bp, Homo sapiens
ttattcagttaagaaa

SEQ ID NO: 6526719 - DNA, 17 bp, Homo sapiens
ttattcagttaagaaaa

SEQ ID NO: 6526720 - DNA, 17 bp, Homo sapiens
ttattcataatgtgaga

SEQ ID NO: 6526721 - DNA, 15 bp, Homo sapiens
ttattcatatgcata

SEQ ID NO: 6526722 - DNA, 16 bp, Homo sapiens
ttattcatatgcatat

SEQ ID NO: 6526723 - DNA, 17 bp, Homo sapiens
ttattcatgccatctgt

SEQ ID NO: 6526724 - DNA, 13 bp, Homo sapiens
ttattcatgtgaa

SEQ ID NO: 6526725 - DNA, 21 bp, Homo sapiens
ttattcattagttttgaagat

SEQ ID NO: 6526726 - DNA, 12 bp, Homo sapiens
ttattcattgtg

SEQ ID NO: 6526727 - DNA, 13 bp, Homo sapiens
ttattcatttaaa

SEQ ID NO: 6526728 - DNA, 14 bp, Homo sapiens
ttattcatttgagt

SEQ ID NO: 6526729 - DNA, 22 bp, Homo sapiens
ttattccaagggaatattgcca

SEQ ID NO: 6526730 - DNA, 17 bp, Homo sapiens
ttattccacaaacacat

SEQ ID NO: 6526731 - DNA, 22 bp, Homo sapiens
ttattccagaatgctgtacatc

SEQ ID NO: 6526732 - DNA, 15 bp, Homo sapiens
ttattccaggagaag

SEQ ID NO: 6526733 - DNA, 17 bp, Homo sapiens
ttattccatattagaaa

SEQ ID NO: 6526734 - DNA, 19 bp, Homo sapiens
ttattccatattagaaaac

SEQ ID NO: 6526735 - DNA, 23 bp, Homo sapiens
ttattccatattagaaaactttg

SEQ ID NO: 6526736 - DNA, 20 bp, Homo sapiens
ttattccatattcatgtaaa

SEQ ID NO: 6526737 - DNA, 13 bp, Homo sapiens
ttattccatgact

SEQ ID NO: 6526738 - DNA, 16 bp, Homo sapiens
ttattcccaattaaaa

SEQ ID NO: 6526739 - DNA, 20 bp, Homo sapiens
ttattccccagtgactccag

SEQ ID NO: 6526740 - DNA, 18 bp, Homo sapiens
ttattcccccaaactttt

SEQ ID NO: 6526741 - DNA, 20 bp, Homo sapiens
ttattcccccatcttcatcc

SEQ ID NO: 6526742 - DNA, 20 bp, Homo sapiens
ttattcccccctaagcttct

SEQ ID NO: 6526743 - DNA, 13 bp, Homo sapiens
ttattcccttcct

SEQ ID NO: 6526744 - DNA, 18 bp, Homo sapiens
ttattcccttcctgccag

SEQ ID NO: 6526745 - DNA, 19 bp, Homo sapiens
ttattccctttcacaaaat

SEQ ID NO: 6526746 - DNA, 16 bp, Homo sapiens
ttattccgagcattcc

SEQ ID NO: 6526747 - DNA, 15 bp, Homo sapiens
ttattccgtattaca

SEQ ID NO: 6526748 - DNA, 17 bp, Homo sapiens
ttattccgtattacatt

SEQ ID NO: 6526749 - DNA, 21 bp, Homo sapiens
ttattcctagtctttccagtc

SEQ ID NO: 6526750 - DNA, 21 bp, Homo sapiens
ttattcctagtggatgactgt

SEQ ID NO: 6526751 - DNA, 14 bp, Homo sapiens
ttattcctcagatt

SEQ ID NO: 6526752 - DNA, 19 bp, Homo sapiens
ttattcctcagattgctga

SEQ ID NO: 6526753 - DNA, 19 bp, Homo sapiens
ttattcctgtatgttgtcc

SEQ ID NO: 6526754 - DNA, 17 bp, Homo sapiens
ttattccttctgtagtg

SEQ ID NO: 6526755 - DNA, 16 bp, Homo sapiens
ttattccttgatcatt

SEQ ID NO: 6526756 - DNA, 20 bp, Homo sapiens
ttattcgaaccactgagagc

SEQ ID NO: 6526757 - DNA, 21 bp, Homo sapiens
ttattctaacaaaaagcaatt

SEQ ID NO: 6526758 - DNA, 23 bp, Homo sapiens
ttattctaataaatatactatga

SEQ ID NO: 6526759 - DNA, 13 bp, Homo sapiens
ttattctaatttt

SEQ ID NO: 6526760 - DNA, 18 bp, Homo sapiens
ttattctacttttaaata

SEQ ID NO: 6526761 - DNA, 19 bp, Homo sapiens
ttattctagttaaggaaat

SEQ ID NO: 6526762 - DNA, 14 bp, Homo sapiens
ttattctcaaagca

SEQ ID NO: 6526763 - DNA, 19 bp, Homo sapiens
ttattctcagaacaccaag

SEQ ID NO: 6526764 - DNA, 19 bp, Homo sapiens
ttattctcagtaactttta

SEQ ID NO: 6526765 - DNA, 12 bp, Homo sapiens
ttattctcattt

SEQ ID NO: 6526766 - DNA, 14 bp, Homo sapiens
ttattctctaagag

SEQ ID NO: 6526767 - DNA, 19 bp, Homo sapiens
ttattctgctgaagattca

SEQ ID NO: 6526768 - DNA, 18 bp, Homo sapiens
ttattctgggaaatgttt

SEQ ID NO: 6526769 - DNA, 19 bp, Homo sapiens
ttattctgggaatgtatag

SEQ ID NO: 6526770 - DNA, 22 bp, Homo sapiens
ttattctgggcaccacaaaata

SEQ ID NO: 6526771 - DNA, 18 bp, Homo sapiens
ttattctgtggttctata

SEQ ID NO: 6526772 - DNA, 13 bp, Homo sapiens
ttattctgtttca

SEQ ID NO: 6526773 - DNA, 20 bp, Homo sapiens
ttattcttattaaggaaata

SEQ ID NO: 6526774 - DNA, 22 bp, Homo sapiens
ttattcttccaagttcattcat

SEQ ID NO: 6526775 - DNA, 14 bp, Homo sapiens
ttattcttccagaa

SEQ ID NO: 6526776 - DNA, 14 bp, Homo sapiens
ttattcttctagag

SEQ ID NO: 6526777 - DNA, 12 bp, Homo sapiens
ttattcttgctg

SEQ ID NO: 6526778 - DNA, 21 bp, Homo sapiens
ttattcttgctgggcatactt

SEQ ID NO: 6526779 - DNA, 12 bp, Homo sapiens
ttattcttgtta

SEQ ID NO: 6526780 - DNA, 13 bp, Homo sapiens
ttattcttgttat

SEQ ID NO: 6526781 - DNA, 15 bp, Homo sapiens
ttattctttctcctt

SEQ ID NO: 6526782 - DNA, 13 bp, Homo sapiens
ttattctttgaga

SEQ ID NO: 6526783 - DNA, 15 bp, Homo sapiens
ttattctttgcactt

SEQ ID NO: 6526784 - DNA, 17 bp, Homo sapiens
ttattctttgcactttt

SEQ ID NO: 6526785 - DNA, 22 bp, Homo sapiens
ttattgaaaaaaaaaatgttga

SEQ ID NO: 6526786 - DNA, 14 bp, Homo sapiens
ttattgaaagaatt

SEQ ID NO: 6526787 - DNA, 20 bp, Homo sapiens
ttattgaaatgtataattaa

SEQ ID NO: 6526788 - DNA, 19 bp, Homo sapiens
ttattgaagatgtccccca

SEQ ID NO: 6526789 - DNA, 17 bp, Homo sapiens
ttattgaagcagagtgg

SEQ ID NO: 6526790 - DNA, 23 bp, Homo sapiens
ttattgaaggaagccaaatttat

SEQ ID NO: 6526791 - DNA, 12 bp, Homo sapiens
ttattgaataac

SEQ ID NO: 6526792 - DNA, 14 bp, Homo sapiens
ttattgacaataat

SEQ ID NO: 6526793 - DNA, 22 bp, Homo sapiens
ttattgacaataatttcaggtt

SEQ ID NO: 6526794 - DNA, 11 bp, Homo sapiens
ttattgacact

SEQ ID NO: 6526795 - DNA, 13 bp, Homo sapiens
ttattgaccattt

SEQ ID NO: 6526796 - DNA, 22 bp, Homo sapiens
ttattgaccattttttaattta

SEQ ID NO: 6526797 - DNA, 17 bp, Homo sapiens
ttattgacgaactggct

SEQ ID NO: 6526798 - DNA, 22 bp, Homo sapiens
ttattgactctgggtccttcct

SEQ ID NO: 6526799 - DNA, 20 bp, Homo sapiens
ttattgactcttgagttgtt

SEQ ID NO: 6526800 - DNA, 21 bp, Homo sapiens
ttattgactcttgagttgttt

SEQ ID NO: 6526801 - DNA, 15 bp, Homo sapiens
ttattgactgggcaa

SEQ ID NO: 6526802 - DNA, 18 bp, Homo sapiens
ttattgagaaagagcact

SEQ ID NO: 6526803 - DNA, 18 bp, Homo sapiens
ttattgagagagatgtgt

SEQ ID NO: 6526804 - DNA, 20 bp, Homo sapiens
ttattgagagagatgtgtaa

SEQ ID NO: 6526805 - DNA, 22 bp, Homo sapiens
ttattgagagagatgtgtaatt

SEQ ID NO: 6526806 - DNA, 16 bp, Homo sapiens
ttattgagattttcca

SEQ ID NO: 6526807 - DNA, 20 bp, Homo sapiens
ttattgagcaagtatccttc

SEQ ID NO: 6526808 - DNA, 22 bp, Homo sapiens
ttattgagggtcattctttatt

SEQ ID NO: 6526809 - DNA, 14 bp, Homo sapiens
ttattgagtaatat

SEQ ID NO: 6526810 - DNA, 19 bp, Homo sapiens
ttattgagttccagttgaa

SEQ ID NO: 6526811 - DNA, 14 bp, Homo sapiens
ttattgagtttgta

SEQ ID NO: 6526812 - DNA, 20 bp, Homo sapiens
ttattgatacaacaggattt

SEQ ID NO: 6526813 - DNA, 23 bp, Homo sapiens
ttattgatacaacaggattttca

SEQ ID NO: 6526814 - DNA, 14 bp, Homo sapiens
ttattgatcaaaat

SEQ ID NO: 6526815 - DNA, 14 bp, Homo sapiens
ttattgatcccaca

SEQ ID NO: 6526816 - DNA, 17 bp, Homo sapiens
ttattgatttttgtaat

SEQ ID NO: 6526817 - DNA, 17 bp, Homo sapiens
ttattgcaaagttgtat

SEQ ID NO: 6526818 - DNA, 20 bp, Homo sapiens
ttattgcaataaaagtgctt

SEQ ID NO: 6526819 - DNA, 12 bp, Homo sapiens
ttattgcacaaa

SEQ ID NO: 6526820 - DNA, 17 bp, Homo sapiens
ttattgcacattgttca

SEQ ID NO: 6526821 - DNA, 11 bp, Homo sapiens
ttattgcacta

SEQ ID NO: 6526822 - DNA, 18 bp, Homo sapiens
ttattgcagtttatcatt

SEQ ID NO: 6526823 - DNA, 14 bp, Homo sapiens
ttattgcatgctga

SEQ ID NO: 6526824 - DNA, 13 bp, Homo sapiens
ttattgcattata

SEQ ID NO: 6526825 - DNA, 19 bp, Homo sapiens
ttattgcatttgctgttgt

SEQ ID NO: 6526826 - DNA, 14 bp, Homo sapiens
ttattgccaaataa

SEQ ID NO: 6526827 - DNA, 21 bp, Homo sapiens
ttattgccattatagcgcctg

SEQ ID NO: 6526828 - DNA, 18 bp, Homo sapiens
ttattgcccatgggatat

SEQ ID NO: 6526829 - DNA, 18 bp, Homo sapiens
ttattgccctaacaattt

SEQ ID NO: 6526830 - DNA, 17 bp, Homo sapiens
ttattgccgtcctggac

SEQ ID NO: 6526831 - DNA, 15 bp, Homo sapiens
ttattgcctcccagg

SEQ ID NO: 6526832 - DNA, 19 bp, Homo sapiens
ttattgcctctgtcttaaa

SEQ ID NO: 6526833 - DNA, 22 bp, Homo sapiens
ttattgcctttagaaactgagt

SEQ ID NO: 6526834 - DNA, 23 bp, Homo sapiens
ttattgctacaaggggtgtgact

SEQ ID NO: 6526835 - DNA, 18 bp, Homo sapiens
ttattgctagtatttgaa

SEQ ID NO: 6526836 - DNA, 14 bp, Homo sapiens
ttattgctattaaa

SEQ ID NO: 6526837 - DNA, 13 bp, Homo sapiens
ttattgctgcatt

SEQ ID NO: 6526838 - DNA, 11 bp, Homo sapiens
ttattgctgcc

SEQ ID NO: 6526839 - DNA, 15 bp, Homo sapiens
ttattgctgttgctt

SEQ ID NO: 6526840 - DNA, 20 bp, Homo sapiens
ttattgcttactgtgttaaa

SEQ ID NO: 6526841 - DNA, 17 bp, Homo sapiens
ttattgcttagtaaaat

SEQ ID NO: 6526842 - DNA, 13 bp, Homo sapiens
ttattgcttttat

SEQ ID NO: 6526843 - DNA, 20 bp, Homo sapiens
ttattggaaatgtacttttg

SEQ ID NO: 6526844 - DNA, 19 bp, Homo sapiens
ttattggaagtgttcaaga

SEQ ID NO: 6526845 - DNA, 16 bp, Homo sapiens
ttattggaattaacct

SEQ ID NO: 6526846 - DNA, 16 bp, Homo sapiens
ttattggacttccatt

SEQ ID NO: 6526847 - DNA, 16 bp, Homo sapiens
ttattggatatttgat

SEQ ID NO: 6526848 - DNA, 17 bp, Homo sapiens
ttattggatgatacagt

SEQ ID NO: 6526849 - DNA, 15 bp, Homo sapiens
ttattggattcccta

SEQ ID NO: 6526850 - DNA, 14 bp, Homo sapiens
ttattggcaaagtt

SEQ ID NO: 6526851 - DNA, 23 bp, Homo sapiens
ttattggcaaagtttaaatgtat

SEQ ID NO: 6526852 - DNA, 19 bp, Homo sapiens
ttattggcagccaaggaat

SEQ ID NO: 6526853 - DNA, 12 bp, Homo sapiens
ttattggccact

SEQ ID NO: 6526854 - DNA, 15 bp, Homo sapiens
ttattggcttgataa

SEQ ID NO: 6526855 - DNA, 19 bp, Homo sapiens
ttattggcttgataaacat

SEQ ID NO: 6526856 - DNA, 18 bp, Homo sapiens
ttattggcttttctgatc

SEQ ID NO: 6526857 - DNA, 22 bp, Homo sapiens
ttattgggagtcttaataaaat

SEQ ID NO: 6526858 - DNA, 20 bp, Homo sapiens
ttattgggcaagtgattgaa

SEQ ID NO: 6526859 - DNA, 20 bp, Homo sapiens
ttattggttttccaatcatt

SEQ ID NO: 6526860 - DNA, 22 bp, Homo sapiens
ttattgtaaaagtgacatgaaa

SEQ ID NO: 6526861 - DNA, 12 bp, Homo sapiens
ttattgtaaact

SEQ ID NO: 6526862 - DNA, 15 bp, Homo sapiens
ttattgtaaactttt

SEQ ID NO: 6526863 - DNA, 20 bp, Homo sapiens
ttattgtaaagtcctatagt

SEQ ID NO: 6526864 - DNA, 17 bp, Homo sapiens
ttattgtaacagacatt

SEQ ID NO: 6526865 - DNA, 18 bp, Homo sapiens
ttattgtacagactgttt

SEQ ID NO: 6526866 - DNA, 18 bp, Homo sapiens
ttattgtaccaaagctgt

SEQ ID NO: 6526867 - DNA, 13 bp, Homo sapiens
ttattgtagtttg

SEQ ID NO: 6526868 - DNA, 18 bp, Homo sapiens
ttattgtagtttgaaagt

SEQ ID NO: 6526869 - DNA, 21 bp, Homo sapiens
ttattgtataaactatcagtt

SEQ ID NO: 6526870 - DNA, 13 bp, Homo sapiens
ttattgtatattg

SEQ ID NO: 6526871 - DNA, 14 bp, Homo sapiens
ttattgtattttga

SEQ ID NO: 6526872 - DNA, 12 bp, Homo sapiens
ttattgtcccaa

SEQ ID NO: 6526873 - DNA, 15 bp, Homo sapiens
ttattgtctagtgaa

SEQ ID NO: 6526874 - DNA, 13 bp, Homo sapiens
ttattgtctgtaa

SEQ ID NO: 6526875 - DNA, 14 bp, Homo sapiens
ttattgtctgtaaa

SEQ ID NO: 6526876 - DNA, 15 bp, Homo sapiens
ttattgtctgtaaat

SEQ ID NO: 6526877 - DNA, 23 bp, Homo sapiens
ttattgtgaatcgattcccaagc

SEQ ID NO: 6526878 - DNA, 17 bp, Homo sapiens
ttattgtgattacgtgt

SEQ ID NO: 6526879 - DNA, 16 bp, Homo sapiens
ttattgtgatttcccg

SEQ ID NO: 6526880 - DNA, 22 bp, Homo sapiens
ttattgtgctgggtcccagcct

SEQ ID NO: 6526881 - DNA, 23 bp, Homo sapiens
ttattgtgggccatgaaccaaat

SEQ ID NO: 6526882 - DNA, 22 bp, Homo sapiens
ttattgtgtgcgctgcctggcc

SEQ ID NO: 6526883 - DNA, 17 bp, Homo sapiens
ttattgtgtttgtcatt

SEQ ID NO: 6526884 - DNA, 20 bp, Homo sapiens
ttattgtgtttttaatttat

SEQ ID NO: 6526885 - DNA, 18 bp, Homo sapiens
ttattgttccaagacatt

SEQ ID NO: 6526886 - DNA, 23 bp, Homo sapiens
ttattgttccaagacattgtcaa

SEQ ID NO: 6526887 - DNA, 14 bp, Homo sapiens
ttattgttgaacat

SEQ ID NO: 6526888 - DNA, 12 bp, Homo sapiens
ttattgtttaaa

SEQ ID NO: 6526889 - DNA, 22 bp, Homo sapiens
ttattgtttaagcagaaataaa

SEQ ID NO: 6526890 - DNA, 16 bp, Homo sapiens
ttattgtttgaaagac

SEQ ID NO: 6526891 - DNA, 16 bp, Homo sapiens
ttattgtttgatgttt

SEQ ID NO: 6526892 - DNA, 18 bp, Homo sapiens
ttattgttttgttaacaa

SEQ ID NO: 6526893 - DNA, 21 bp, Homo sapiens
tgggacttcttttcacattct

SEQ ID NO: 6526894 - DNA, 22 bp, Homo sapiens
tgggacttcttttcacattctt

SEQ ID NO: 6526895 - DNA, 17 bp, Homo sapiens
tgggacttggagagcaa

SEQ ID NO: 6526896 - DNA, 21 bp, Homo sapiens
tgggactttccttccctctcc

SEQ ID NO: 6526897 - DNA, 21 bp, Homo sapiens
tgggactttgcacctctgctg

SEQ ID NO: 6526898 - DNA, 17 bp, Homo sapiens
tgggacttttctttctt

SEQ ID NO: 6526899 - DNA, 16 bp, Homo sapiens
tgggagaaaatcaact

SEQ ID NO: 6526900 - DNA, 12 bp, Homo sapiens
tgggagaaagca

SEQ ID NO: 6526901 - DNA, 14 bp, Homo sapiens
tgggagaaagcaat

SEQ ID NO: 6526902 - DNA, 19 bp, Homo sapiens
tgggagaacacatttctaa

SEQ ID NO: 6526903 - DNA, 23 bp, Homo sapiens
tgggagaacctcgttgacatgca

SEQ ID NO: 6526904 - DNA, 13 bp, Homo sapiens
tgggagaagaggg

SEQ ID NO: 6526905 - DNA, 17 bp, Homo sapiens
tgggagaagtggcccct

SEQ ID NO: 6526906 - DNA, 20 bp, Homo sapiens
tgggagaatgtcagtatgtg

SEQ ID NO: 6526907 - DNA, 21 bp, Homo sapiens
tgggagaattcttacatgttt

SEQ ID NO: 6526908 - DNA, 20 bp, Homo sapiens
tgggagacaactggacaaga

SEQ ID NO: 6526909 - DNA, 21 bp, Homo sapiens
tgggagacaagaaatccctgt

SEQ ID NO: 6526910 - DNA, 20 bp, Homo sapiens
tgggagacaatattaatttg

SEQ ID NO: 6526911 - DNA, 12 bp, Homo sapiens
tgggagacagac

SEQ ID NO: 6526912 - DNA, 18 bp, Homo sapiens
tgggagacagcagcctgt

SEQ ID NO: 6526913 - DNA, 19 bp, Homo sapiens
tgggagacagcagcctgta

SEQ ID NO: 6526914 - DNA, 15 bp, Homo sapiens
tgggagacatgtgac

SEQ ID NO: 6526915 - DNA, 18 bp, Homo sapiens
tgggagacctgtaatcat

SEQ ID NO: 6526916 - DNA, 23 bp, Homo sapiens
tgggagacgaacggaagggttgg

SEQ ID NO: 6526917 - DNA, 18 bp, Homo sapiens
tgggagagaagaggactt

SEQ ID NO: 6526918 - DNA, 17 bp, Homo sapiens
tgggagagacactccca

SEQ ID NO: 6526919 - DNA, 21 bp, Homo sapiens
tgggagagacactcccaggga

SEQ ID NO: 6526920 - DNA, 18 bp, Homo sapiens
tgggagagaccattgcat

SEQ ID NO: 6526921 - DNA, 15 bp, Homo sapiens
tgggagagacttgtt

SEQ ID NO: 6526922 - DNA, 18 bp, Homo sapiens
tgggagagcccagccatt

SEQ ID NO: 6526923 - DNA, 13 bp, Homo sapiens
tgggagagcccgt

SEQ ID NO: 6526924 - DNA, 20 bp, Homo sapiens
tgggagagcccttgtggcga

SEQ ID NO: 6526925 - DNA, 16 bp, Homo sapiens
tgggagagccttccag

SEQ ID NO: 6526926 - DNA, 12 bp, Homo sapiens
tgggagaggaag

SEQ ID NO: 6526927 - DNA, 14 bp, Homo sapiens
tgggagaggaagcc

SEQ ID NO: 6526928 - DNA, 17 bp, Homo sapiens
tgggagaggcagaaagg

SEQ ID NO: 6526929 - DNA, 13 bp, Homo sapiens
tgggagaggctgg

SEQ ID NO: 6526930 - DNA, 18 bp, Homo sapiens
tgggagagggagcaagcc

SEQ ID NO: 6526931 - DNA, 21 bp, Homo sapiens
tgggagagggagcaagccttc

SEQ ID NO: 6526932 - DNA, 18 bp, Homo sapiens
tgggagagtacctgtgtg

SEQ ID NO: 6526933 - DNA, 13 bp, Homo sapiens
tgggagagtccag

SEQ ID NO: 6526934 - DNA, 20 bp, Homo sapiens
tgggagagtccaggcctggg

SEQ ID NO: 6526935 - DNA, 21 bp, Homo sapiens
tgggagagtccttagcctggg

SEQ ID NO: 6526936 - DNA, 23 bp, Homo sapiens
tgggagagtggtgagtggaaggg

SEQ ID NO: 6526937 - DNA, 21 bp, Homo sapiens
tgggagatatatttttaagat

SEQ ID NO: 6526938 - DNA, 22 bp, Homo sapiens
tgggagatgaaaacctgcattt

SEQ ID NO: 6526939 - DNA, 14 bp, Homo sapiens
tgggagatgcagct

SEQ ID NO: 6526940 - DNA, 14 bp, Homo sapiens
tgggagatgctggg

SEQ ID NO: 6526941 - DNA, 23 bp, Homo sapiens
tgggagatggaggtagggctggc

SEQ ID NO: 6526942 - DNA, 15 bp, Homo sapiens
tgggagattatcagt

SEQ ID NO: 6526943 - DNA, 14 bp, Homo sapiens
tgggagatttggaa

SEQ ID NO: 6526944 - DNA, 22 bp, Homo sapiens
tgggagatttggaatacacatg

SEQ ID NO: 6526945 - DNA, 18 bp, Homo sapiens
tgggagcaaactgcatgc

SEQ ID NO: 6526946 - DNA, 22 bp, Homo sapiens
tgggagcaaactgcatgcccag

SEQ ID NO: 6526947 - DNA, 19 bp, Homo sapiens
tgggagcacatagccctgt

SEQ ID NO: 6526948 - DNA, 12 bp, Homo sapiens
tgggagcactgg

SEQ ID NO: 6526949 - DNA, 12 bp, Homo sapiens
tgggagcagctt

SEQ ID NO: 6526950 - DNA, 20 bp, Homo sapiens
tgggagcagcttcttgggct

SEQ ID NO: 6526951 - DNA, 23 bp, Homo sapiens
tgggagcagcttcttgggctgag

SEQ ID NO: 6526952 - DNA, 14 bp, Homo sapiens
tgggagcaggagat

SEQ ID NO: 6526953 - DNA, 13 bp, Homo sapiens
tgggagccacagg

SEQ ID NO: 6526954 - DNA, 16 bp, Homo sapiens
tgggagccacagggac

SEQ ID NO: 6526955 - DNA, 16 bp, Homo sapiens
tgggagccaccactcc

SEQ ID NO: 6526956 - DNA, 15 bp, Homo sapiens
tgggagccactgcca

SEQ ID NO: 6526957 - DNA, 17 bp, Homo sapiens
tgggagccactgccact

SEQ ID NO: 6526958 - DNA, 17 bp, Homo sapiens
tgggagccacttctccc

SEQ ID NO: 6526959 - DNA, 12 bp, Homo sapiens
tgggagccagaa

SEQ ID NO: 6526960 - DNA, 12 bp, Homo sapiens
tgggagccagga

SEQ ID NO: 6526961 - DNA, 15 bp, Homo sapiens
tgggagccaggactc

SEQ ID NO: 6526962 - DNA, 14 bp, Homo sapiens
tgggagccaggagt

SEQ ID NO: 6526963 - DNA, 24 bp, Homo sapiens
tgggagccaggagtaagacaagtg

SEQ ID NO: 6526964 - DNA, 19 bp, Homo sapiens
tgggagccagtcctccact

SEQ ID NO: 6526965 - DNA, 13 bp, Homo sapiens
tgggagcccagaa

SEQ ID NO: 6526966 - DNA, 12 bp, Homo sapiens
tgggagcccagc

SEQ ID NO: 6526967 - DNA, 14 bp, Homo sapiens
tgggagcccagcac

SEQ ID NO: 6526968 - DNA, 22 bp, Homo sapiens
tgggagccccagggtcttccct

SEQ ID NO: 6526969 - DNA, 19 bp, Homo sapiens
tgggagcccccagcctgtc

SEQ ID NO: 6526970 - DNA, 15 bp, Homo sapiens
tgggagccgcagagc

SEQ ID NO: 6526971 - DNA, 17 bp, Homo sapiens
tgggagccgcagagcct

SEQ ID NO: 6526972 - DNA, 13 bp, Homo sapiens
tgggagccgcctg

SEQ ID NO: 6526973 - DNA, 19 bp, Homo sapiens
tgggagccgggaccctcag

SEQ ID NO: 6526974 - DNA, 21 bp, Homo sapiens
tgggagccgggaccctcaggt

SEQ ID NO: 6526975 - DNA, 13 bp, Homo sapiens
tgggagccgggca

SEQ ID NO: 6526976 - DNA, 17 bp, Homo sapiens
tgggagccgtcagcctg

SEQ ID NO: 6526977 - DNA, 12 bp, Homo sapiens
tgggagcctagc

SEQ ID NO: 6526978 - DNA, 22 bp, Homo sapiens
tgggagcctagctcctgccaca

SEQ ID NO: 6526979 - DNA, 19 bp, Homo sapiens
tgggagcctcgcccctcca

SEQ ID NO: 6526980 - DNA, 15 bp, Homo sapiens
tgggagcctctgggg

SEQ ID NO: 6526981 - DNA, 21 bp, Homo sapiens
tgggagcctggttcagacaca

SEQ ID NO: 6526982 - DNA, 20 bp, Homo sapiens
tgggagctcatccctctcac

SEQ ID NO: 6526983 - DNA, 20 bp, Homo sapiens
tgggagctcatgtgtccctg

SEQ ID NO: 6526984 - DNA, 16 bp, Homo sapiens
tgggagctccactctg

SEQ ID NO: 6526985 - DNA, 19 bp, Homo sapiens
tgggagctccactctgctt

SEQ ID NO: 6526986 - DNA, 14 bp, Homo sapiens
tgggagctcctctc

SEQ ID NO: 6526987 - DNA, 17 bp, Homo sapiens
tgggagctcctctcctg

SEQ ID NO: 6526988 - DNA, 23 bp, Homo sapiens
tgggagctcctctcctggaggat

SEQ ID NO: 6526989 - DNA, 13 bp, Homo sapiens
tgggagctctgct

SEQ ID NO: 6526990 - DNA, 16 bp, Homo sapiens
tgggagctctgcttgc

SEQ ID NO: 6526991 - DNA, 17 bp, Homo sapiens
tgggagctgaaccaaag

SEQ ID NO: 6526992 - DNA, 14 bp, Homo sapiens
tgggagctgagcag

SEQ ID NO: 6526993 - DNA, 19 bp, Homo sapiens
tgggagctgagcagcctct

SEQ ID NO: 6526994 - DNA, 14 bp, Homo sapiens
tgggagctgagctg

SEQ ID NO: 6526995 - DNA, 16 bp, Homo sapiens
tgggagctgaggccac

SEQ ID NO: 6526996 - DNA, 16 bp, Homo sapiens
tgggagctgccaagag

SEQ ID NO: 6526997 - DNA, 12 bp, Homo sapiens
tgggagctgcct

SEQ ID NO: 6526998 - DNA, 24 bp, Homo sapiens
tgggagctgcctgttcagctccag

SEQ ID NO: 6526999 - DNA, 14 bp, Homo sapiens
tgggagctgctggg

SEQ ID NO: 6527000 - DNA, 18 bp, Homo sapiens
tgggagctgctgggtggc

SEQ ID NO: 6527001 - DNA, 20 bp, Homo sapiens
tgggagctggttagaaatgc

SEQ ID NO: 6527002 - DNA, 20 bp, Homo sapiens
tgggagcttcccacacctgc

SEQ ID NO: 6527003 - DNA, 23 bp, Homo sapiens
tgggagcttcccacacctgcctg

SEQ ID NO: 6527004 - DNA, 14 bp, Homo sapiens
tgggagctttaaag

SEQ ID NO: 6527005 - DNA, 15 bp, Homo sapiens
tgggaggaaatttga

SEQ ID NO: 6527006 - DNA, 20 bp, Homo sapiens
tgggaggaactccttgcaca

SEQ ID NO: 6527007 - DNA, 14 bp, Homo sapiens
tgggaggaagcaga

SEQ ID NO: 6527008 - DNA, 16 bp, Homo sapiens
tgggaggaagcagaat

SEQ ID NO: 6527009 - DNA, 18 bp, Homo sapiens
tgggaggaagcagaataa

SEQ ID NO: 6527010 - DNA, 21 bp, Homo sapiens
tgggaggaagcagaataaagc

SEQ ID NO: 6527011 - DNA, 18 bp, Homo sapiens
tgggaggaaggcccaggg

SEQ ID NO: 6527012 - DNA, 13 bp, Homo sapiens
tgggaggaattca

SEQ ID NO: 6527013 - DNA, 15 bp, Homo sapiens
tgggaggacagagcc

SEQ ID NO: 6527014 - DNA, 16 bp, Homo sapiens
tgggaggacagagccg

SEQ ID NO: 6527015 - DNA, 17 bp, Homo sapiens
tgggaggacagagccgg

SEQ ID NO: 6527016 - DNA, 12 bp, Homo sapiens
tgggaggacagg

SEQ ID NO: 6527017 - DNA, 23 bp, Homo sapiens
tgggaggacatgcgtgtgtcagg

SEQ ID NO: 6527018 - DNA, 19 bp, Homo sapiens
tgggaggacggtgcaaccc

SEQ ID NO: 6527019 - DNA, 11 bp, Homo sapiens
tgggaggagac

SEQ ID NO: 6527020 - DNA, 13 bp, Homo sapiens
tgggaggagcaga

SEQ ID NO: 6527021 - DNA, 18 bp, Homo sapiens
tgggaggagcagattttt

SEQ ID NO: 6527022 - DNA, 14 bp, Homo sapiens
tgggaggagcccct

SEQ ID NO: 6527023 - DNA, 21 bp, Homo sapiens
tgggaggaggaaaagaaacct

SEQ ID NO: 6527024 - DNA, 15 bp, Homo sapiens
tgggaggaggaagac

SEQ ID NO: 6527025 - DNA, 13 bp, Homo sapiens
tgggaggagggag

SEQ ID NO: 6527026 - DNA, 14 bp, Homo sapiens
tgggaggagggagg

SEQ ID NO: 6527027 - DNA, 14 bp, Homo sapiens
tgggaggagggcag

SEQ ID NO: 6527028 - DNA, 18 bp, Homo sapiens
tgggaggagggcaggcat

SEQ ID NO: 6527029 - DNA, 20 bp, Homo sapiens
tgggaggagggggcccggct

SEQ ID NO: 6527030 - DNA, 22 bp, Homo sapiens
tgggaggagggggcccggctgg

SEQ ID NO: 6527031 - DNA, 16 bp, Homo sapiens
tgggaggatcacttga

SEQ ID NO: 6527032 - DNA, 20 bp, Homo sapiens
tgggaggatctcttgagcct

SEQ ID NO: 6527033 - DNA, 19 bp, Homo sapiens
tgggaggattacttgaaac

SEQ ID NO: 6527034 - DNA, 17 bp, Homo sapiens
tgggaggatttgatgta

SEQ ID NO: 6527035 - DNA, 18 bp, Homo sapiens
tgggaggcaagaaaagga

SEQ ID NO: 6527036 - DNA, 18 bp, Homo sapiens
tgggaggcaagaggggtg

SEQ ID NO: 6527037 - DNA, 14 bp, Homo sapiens
tgggaggcacagca

SEQ ID NO: 6527038 - DNA, 16 bp, Homo sapiens
tgggaggcagaaacct

SEQ ID NO: 6527039 - DNA, 20 bp, Homo sapiens
tgggaggcagaggttgcagt

SEQ ID NO: 6527040 - DNA, 13 bp, Homo sapiens
tgggaggcagcat

SEQ ID NO: 6527041 - DNA, 16 bp, Homo sapiens
tgggaggcagccgagg

SEQ ID NO: 6527042 - DNA, 20 bp, Homo sapiens
tgggaggcagccgaggcctg

SEQ ID NO: 6527043 - DNA, 12 bp, Homo sapiens
tgggaggcaggg

SEQ ID NO: 6527044 - DNA, 16 bp, Homo sapiens
tgggaggcatggccct

SEQ ID NO: 6527045 - DNA, 13 bp, Homo sapiens
tgggaggccaagg

SEQ ID NO: 6527046 - DNA, 18 bp, Homo sapiens
tgggaggccaaggcaggt

SEQ ID NO: 6527047 - DNA, 18 bp, Homo sapiens
tgggaggccaaggcgggc

SEQ ID NO: 6527048 - DNA, 20 bp, Homo sapiens
tgggaggccaaggtgggagg

SEQ ID NO: 6527049 - DNA, 20 bp, Homo sapiens
tgggaggccaaggtgggcgg

SEQ ID NO: 6527050 - DNA, 13 bp, Homo sapiens
tgggaggccaggc

SEQ ID NO: 6527051 - DNA, 16 bp, Homo sapiens
tgggaggccaggcgag

SEQ ID NO: 6527052 - DNA, 20 bp, Homo sapiens
tgggaggccccactggggaa

SEQ ID NO: 6527053 - DNA, 18 bp, Homo sapiens
tgggaggcccctggtggc

SEQ ID NO: 6527054 - DNA, 20 bp, Homo sapiens
tgggaggccccttctctccc

SEQ ID NO: 6527055 - DNA, 15 bp, Homo sapiens
tgggaggccctggca

SEQ ID NO: 6527056 - DNA, 17 bp, Homo sapiens
tgggaggccctggcaga

SEQ ID NO: 6527057 - DNA, 15 bp, Homo sapiens
tgggaggccgaggca

SEQ ID NO: 6527058 - DNA, 23 bp, Homo sapiens
tgggaggcctcgtaccagccagg

SEQ ID NO: 6527059 - DNA, 17 bp, Homo sapiens
tgggaggcgggagtgga

SEQ ID NO: 6527060 - DNA, 14 bp, Homo sapiens
tgggaggcgtgccc

SEQ ID NO: 6527061 - DNA, 22 bp, Homo sapiens
tgggaggctcacccccttctcc

SEQ ID NO: 6527062 - DNA, 17 bp, Homo sapiens
tgggaggctcccagacc

SEQ ID NO: 6527063 - DNA, 14 bp, Homo sapiens
tgggaggctcccct

SEQ ID NO: 6527064 - DNA, 13 bp, Homo sapiens
tgggaggctcctg

SEQ ID NO: 6527065 - DNA, 17 bp, Homo sapiens
tgggaggctctggagcc

SEQ ID NO: 6527066 - DNA, 17 bp, Homo sapiens
tgggaggctgcagccag

SEQ ID NO: 6527067 - DNA, 20 bp, Homo sapiens
tgggaggctgcagccaggcc

SEQ ID NO: 6527068 - DNA, 17 bp, Homo sapiens
tgggaggctggtctccc

SEQ ID NO: 6527069 - DNA, 14 bp, Homo sapiens
tgggaggctgtgga

SEQ ID NO: 6527070 - DNA, 14 bp, Homo sapiens
tgggaggcttcccc

SEQ ID NO: 6527071 - DNA, 14 bp, Homo sapiens
tgggagggaaaagg

SEQ ID NO: 6527072 - DNA, 15 bp, Homo sapiens
tgggagggacagggc

SEQ ID NO: 6527073 - DNA, 21 bp, Homo sapiens
ttatttaaaaatatttcagat

SEQ ID NO: 6527074 - DNA, 14 bp, Homo sapiens
ttatttaaaactct

SEQ ID NO: 6527075 - DNA, 16 bp, Homo sapiens
ttatttaaaactctgg

SEQ ID NO: 6527076 - DNA, 15 bp, Homo sapiens
ttatttaaaagattc

SEQ ID NO: 6527077 - DNA, 18 bp, Homo sapiens
ttatttaaaagattcatt

SEQ ID NO: 6527078 - DNA, 21 bp, Homo sapiens
ttatttaaaatgtaaaaagga

SEQ ID NO: 6527079 - DNA, 16 bp, Homo sapiens
ttatttaaaattccat

SEQ ID NO: 6527080 - DNA, 21 bp, Homo sapiens
ttatttaaaattccattatct

SEQ ID NO: 6527081 - DNA, 12 bp, Homo sapiens
ttatttaaacaa

SEQ ID NO: 6527082 - DNA, 20 bp, Homo sapiens
ttatttaaacaaatgtgtaa

SEQ ID NO: 6527083 - DNA, 14 bp, Homo sapiens
ttatttaaagaaag

SEQ ID NO: 6527084 - DNA, 19 bp, Homo sapiens
ttatttaaagaaagtgaaa

SEQ ID NO: 6527085 - DNA, 13 bp, Homo sapiens
ttatttaaagcac

SEQ ID NO: 6527086 - DNA, 19 bp, Homo sapiens
ttatttaaataaaatcacc

SEQ ID NO: 6527087 - DNA, 12 bp, Homo sapiens
ttatttaaatga

SEQ ID NO: 6527088 - DNA, 13 bp, Homo sapiens
ttatttaaatgca

SEQ ID NO: 6527089 - DNA, 15 bp, Homo sapiens
ttatttaaatgtcta

SEQ ID NO: 6527090 - DNA, 16 bp, Homo sapiens
ttatttaaatgtctaa

SEQ ID NO: 6527091 - DNA, 19 bp, Homo sapiens
ttatttaaatgttgaaatc

SEQ ID NO: 6527092 - DNA, 19 bp, Homo sapiens
ttatttaaatgtttaacat

SEQ ID NO: 6527093 - DNA, 12 bp, Homo sapiens
ttatttaaatta

SEQ ID NO: 6527094 - DNA, 17 bp, Homo sapiens
ttatttaaattttcaga

SEQ ID NO: 6527095 - DNA, 18 bp, Homo sapiens
ttatttaacaaaaaatgt

SEQ ID NO: 6527096 - DNA, 18 bp, Homo sapiens
ttatttaagaagaatgag

SEQ ID NO: 6527097 - DNA, 20 bp, Homo sapiens
ttatttaagaataaagtctt

SEQ ID NO: 6527098 - DNA, 13 bp, Homo sapiens
ttatttaagattt

SEQ ID NO: 6527099 - DNA, 19 bp, Homo sapiens
ttatttaagcataatctga

SEQ ID NO: 6527100 - DNA, 12 bp, Homo sapiens
ttatttaaggat

SEQ ID NO: 6527101 - DNA, 16 bp, Homo sapiens
ttatttaaggatggat

SEQ ID NO: 6527102 - DNA, 23 bp, Homo sapiens
ttatttaaggatggatggcaccc

SEQ ID NO: 6527103 - DNA, 24 bp, Homo sapiens
ttatttaagtatggaatattcatt

SEQ ID NO: 6527104 - DNA, 14 bp, Homo sapiens
ttatttaataacat

SEQ ID NO: 6527105 - DNA, 19 bp, Homo sapiens
ttatttaataacattacct

SEQ ID NO: 6527106 - DNA, 15 bp, Homo sapiens
ttatttaatatgcat

SEQ ID NO: 6527107 - DNA, 12 bp, Homo sapiens
ttatttaatgtt

SEQ ID NO: 6527108 - DNA, 16 bp, Homo sapiens
ttatttaatgttatgt

SEQ ID NO: 6527109 - DNA, 13 bp, Homo sapiens
ttatttaatgttt

SEQ ID NO: 6527110 - DNA, 20 bp, Homo sapiens
ttatttaatgtttgatttag

SEQ ID NO: 6527111 - DNA, 19 bp, Homo sapiens
ttatttaattaaatgtatt

SEQ ID NO: 6527112 - DNA, 21 bp, Homo sapiens
ttatttaattatattatgaat

SEQ ID NO: 6527113 - DNA, 14 bp, Homo sapiens
ttatttaatttgta

SEQ ID NO: 6527114 - DNA, 14 bp, Homo sapiens
ttatttacaaatgt

SEQ ID NO: 6527115 - DNA, 17 bp, Homo sapiens
ttatttacaatgcagaa

SEQ ID NO: 6527116 - DNA, 22 bp, Homo sapiens
ttatttacagataacttcttta

SEQ ID NO: 6527117 - DNA, 15 bp, Homo sapiens
ttatttacatttaat

SEQ ID NO: 6527118 - DNA, 17 bp, Homo sapiens
ttatttacccctcccct

SEQ ID NO: 6527119 - DNA, 19 bp, Homo sapiens
ttatttaccttttaagaca

SEQ ID NO: 6527120 - DNA, 18 bp, Homo sapiens
ttatttacgcttttattg

SEQ ID NO: 6527121 - DNA, 17 bp, Homo sapiens
ttatttactaattttct

SEQ ID NO: 6527122 - DNA, 21 bp, Homo sapiens
ttatttactgagcttctctgt

SEQ ID NO: 6527123 - DNA, 14 bp, Homo sapiens
ttatttacttgaaa

SEQ ID NO: 6527124 - DNA, 13 bp, Homo sapiens
ttatttacttgta

SEQ ID NO: 6527125 - DNA, 12 bp, Homo sapiens
ttatttactttt

SEQ ID NO: 6527126 - DNA, 14 bp, Homo sapiens
ttatttagacaaga

SEQ ID NO: 6527127 - DNA, 17 bp, Homo sapiens
ttatttagactcatctt

SEQ ID NO: 6527128 - DNA, 18 bp, Homo sapiens
ttatttagcatggggatt

SEQ ID NO: 6527129 - DNA, 24 bp, Homo sapiens
ttatttagcccataatctctttga

SEQ ID NO: 6527130 - DNA, 19 bp, Homo sapiens
ttatttagtaaaattatct

SEQ ID NO: 6527131 - DNA, 22 bp, Homo sapiens
ttatttagttgaaaaatctagt

SEQ ID NO: 6527132 - DNA, 12 bp, Homo sapiens
ttatttataaac

SEQ ID NO: 6527133 - DNA, 15 bp, Homo sapiens
ttatttataacattg

SEQ ID NO: 6527134 - DNA, 16 bp, Homo sapiens
ttatttatatcttgtt

SEQ ID NO: 6527135 - DNA, 21 bp, Homo sapiens
ttatttatatggggaatatat

SEQ ID NO: 6527136 - DNA, 17 bp, Homo sapiens
ttatttatatgtactgt

SEQ ID NO: 6527137 - DNA, 21 bp, Homo sapiens
ttatttatatgtactgtttta

SEQ ID NO: 6527138 - DNA, 17 bp, Homo sapiens
ttatttatatttattga

SEQ ID NO: 6527139 - DNA, 14 bp, Homo sapiens
ttatttatcaaaat

SEQ ID NO: 6527140 - DNA, 16 bp, Homo sapiens
ttatttatcaaaatgt

SEQ ID NO: 6527141 - DNA, 18 bp, Homo sapiens
ttatttatcaatttttcc

SEQ ID NO: 6527142 - DNA, 14 bp, Homo sapiens
ttatttatcagtga

SEQ ID NO: 6527143 - DNA, 18 bp, Homo sapiens
ttatttatcagtgacaga

SEQ ID NO: 6527144 - DNA, 22 bp, Homo sapiens
ttatttatccagaaaactgtga

SEQ ID NO: 6527145 - DNA, 19 bp, Homo sapiens
ttatttatccctcattcat

SEQ ID NO: 6527146 - DNA, 22 bp, Homo sapiens
ttatttatgaaaaaatatgaac

SEQ ID NO: 6527147 - DNA, 15 bp, Homo sapiens
ttatttatgaagttt

SEQ ID NO: 6527148 - DNA, 22 bp, Homo sapiens
ttatttatggcttataaatgtg

SEQ ID NO: 6527149 - DNA, 13 bp, Homo sapiens
ttatttatgtact

SEQ ID NO: 6527150 - DNA, 13 bp, Homo sapiens
ttatttatgtatt

SEQ ID NO: 6527151 - DNA, 20 bp, Homo sapiens
ttatttattaaaaatgttct

SEQ ID NO: 6527152 - DNA, 13 bp, Homo sapiens
ttatttattaaga

SEQ ID NO: 6527153 - DNA, 15 bp, Homo sapiens
ttatttattaagatg

SEQ ID NO: 6527154 - DNA, 15 bp, Homo sapiens
ttatttattccccag

SEQ ID NO: 6527155 - DNA, 16 bp, Homo sapiens
ttatttattggcaata

SEQ ID NO: 6527156 - DNA, 13 bp, Homo sapiens
ttatttatttaat

SEQ ID NO: 6527157 - DNA, 12 bp, Homo sapiens
ttatttatttca

SEQ ID NO: 6527158 - DNA, 23 bp, Homo sapiens
ttatttatttgattaggtatgtt

SEQ ID NO: 6527159 - DNA, 16 bp, Homo sapiens
ttatttattttagcaa

SEQ ID NO: 6527160 - DNA, 13 bp, Homo sapiens
ttatttcaaaatg

SEQ ID NO: 6527161 - DNA, 20 bp, Homo sapiens
ttatttcaataaatctttca

SEQ ID NO: 6527162 - DNA, 24 bp, Homo sapiens
ttatttcaatgtaattaaactgtt

SEQ ID NO: 6527163 - DNA, 22 bp, Homo sapiens
ttatttcaattgtttatatgga

SEQ ID NO: 6527164 - DNA, 18 bp, Homo sapiens
ttatttcacaaataatag

SEQ ID NO: 6527165 - DNA, 20 bp, Homo sapiens
ttatttcactttagatgctg

SEQ ID NO: 6527166 - DNA, 17 bp, Homo sapiens
ttatttcagaaatgtac

SEQ ID NO: 6527167 - DNA, 17 bp, Homo sapiens
ttatttcagattttgat

SEQ ID NO: 6527168 - DNA, 18 bp, Homo sapiens
ttatttcagattttgata

SEQ ID NO: 6527169 - DNA, 13 bp, Homo sapiens
ttatttcagtgtg

SEQ ID NO: 6527170 - DNA, 18 bp, Homo sapiens
ttatttcataaacaactt

SEQ ID NO: 6527171 - DNA, 16 bp, Homo sapiens
ttatttcataccatta

SEQ ID NO: 6527172 - DNA, 21 bp, Homo sapiens
ttatttcatcttttattcaag

SEQ ID NO: 6527173 - DNA, 19 bp, Homo sapiens
ttatttcatgattagaaat

SEQ ID NO: 6527174 - DNA, 14 bp, Homo sapiens
ttatttcattcaca

SEQ ID NO: 6527175 - DNA, 19 bp, Homo sapiens
ttatttccaaataaaatga

SEQ ID NO: 6527176 - DNA, 15 bp, Homo sapiens
ttatttccactaaaa

SEQ ID NO: 6527177 - DNA, 15 bp, Homo sapiens
ttatttccagttgcc

SEQ ID NO: 6527178 - DNA, 12 bp, Homo sapiens
ttatttccatat

SEQ ID NO: 6527179 - DNA, 22 bp, Homo sapiens
ttatttcccaacccaggattca

SEQ ID NO: 6527180 - DNA, 19 bp, Homo sapiens
ttatttcccagtaattatt

SEQ ID NO: 6527181 - DNA, 13 bp, Homo sapiens
ttatttccccagc

SEQ ID NO: 6527182 - DNA, 17 bp, Homo sapiens
ttatttccccagccaca

SEQ ID NO: 6527183 - DNA, 18 bp, Homo sapiens
ttatttcctagttctgta

SEQ ID NO: 6527184 - DNA, 21 bp, Homo sapiens
ttatttcctgctttctaatta

SEQ ID NO: 6527185 - DNA, 17 bp, Homo sapiens
ttatttcctttgtcctt

SEQ ID NO: 6527186 - DNA, 22 bp, Homo sapiens
ttatttctaaaacattaattga

SEQ ID NO: 6527187 - DNA, 13 bp, Homo sapiens
ttatttctaaacc

SEQ ID NO: 6527188 - DNA, 17 bp, Homo sapiens
ttatttctaaagttgta

SEQ ID NO: 6527189 - DNA, 12 bp, Homo sapiens
ttatttctaaat

SEQ ID NO: 6527190 - DNA, 13 bp, Homo sapiens
ttatttctaaatc

SEQ ID NO: 6527191 - DNA, 13 bp, Homo sapiens
ttatttctaacta

SEQ ID NO: 6527192 - DNA, 16 bp, Homo sapiens
ttatttctaagtattt

SEQ ID NO: 6527193 - DNA, 17 bp, Homo sapiens
ttatttctaagtattta

SEQ ID NO: 6527194 - DNA, 19 bp, Homo sapiens
ttatttctaagtatttaaa

SEQ ID NO: 6527195 - DNA, 17 bp, Homo sapiens
ttatttctctctcctgg

SEQ ID NO: 6527196 - DNA, 16 bp, Homo sapiens
ttatttctctgatttg

SEQ ID NO: 6527197 - DNA, 16 bp, Homo sapiens
ttatttctgctctgga

SEQ ID NO: 6527198 - DNA, 12 bp, Homo sapiens
ttatttctgtct

SEQ ID NO: 6527199 - DNA, 19 bp, Homo sapiens
ttatttctgtgaaagaagt

SEQ ID NO: 6527200 - DNA, 14 bp, Homo sapiens
ttatttcttaacct

SEQ ID NO: 6527201 - DNA, 21 bp, Homo sapiens
ttatttcttccctgctttgca

SEQ ID NO: 6527202 - DNA, 15 bp, Homo sapiens
ttatttcttctctta

SEQ ID NO: 6527203 - DNA, 13 bp, Homo sapiens
ttatttctttgtg

SEQ ID NO: 6527204 - DNA, 21 bp, Homo sapiens
ttatttgaagatttaattact

SEQ ID NO: 6527205 - DNA, 14 bp, Homo sapiens
ttatttgaatgact

SEQ ID NO: 6527206 - DNA, 16 bp, Homo sapiens
ttatttgataacattt

SEQ ID NO: 6527207 - DNA, 12 bp, Homo sapiens
ttatttgatatc

SEQ ID NO: 6527208 - DNA, 12 bp, Homo sapiens
ttatttgatgac

SEQ ID NO: 6527209 - DNA, 18 bp, Homo sapiens
ttatttgatgagttctgt

SEQ ID NO: 6527210 - DNA, 22 bp, Homo sapiens
ttatttgattaggtatgtttgt

SEQ ID NO: 6527211 - DNA, 12 bp, Homo sapiens
ttatttgcaatt

SEQ ID NO: 6527212 - DNA, 19 bp, Homo sapiens
ttatttgcaatttgagcca

SEQ ID NO: 6527213 - DNA, 15 bp, Homo sapiens
ttatttgcagagaca

SEQ ID NO: 6527214 - DNA, 18 bp, Homo sapiens
ttatttgcagagacagga

SEQ ID NO: 6527215 - DNA, 21 bp, Homo sapiens
ttatttgcagtgcagtataga

SEQ ID NO: 6527216 - DNA, 13 bp, Homo sapiens
ttatttgcatgtt

SEQ ID NO: 6527217 - DNA, 16 bp, Homo sapiens
ttatttgccagagcca

SEQ ID NO: 6527218 - DNA, 18 bp, Homo sapiens
ttatttgccagagccaaa

SEQ ID NO: 6527219 - DNA, 19 bp, Homo sapiens
ttatttgctaagcatattt

SEQ ID NO: 6527220 - DNA, 16 bp, Homo sapiens
ttatttggaaaggaat

SEQ ID NO: 6527221 - DNA, 13 bp, Homo sapiens
ttatttggaaatt

SEQ ID NO: 6527222 - DNA, 16 bp, Homo sapiens
ttatttggaaatttta

SEQ ID NO: 6527223 - DNA, 18 bp, Homo sapiens
ttatttggaaccttgttt

SEQ ID NO: 6527224 - DNA, 23 bp, Homo sapiens
ttatttggaaccttgttttggac

SEQ ID NO: 6527225 - DNA, 18 bp, Homo sapiens
ttatttggaattgacatt

SEQ ID NO: 6527226 - DNA, 18 bp, Homo sapiens
ttatttggaattttaagt

SEQ ID NO: 6527227 - DNA, 17 bp, Homo sapiens
ttatttggcataactgt

SEQ ID NO: 6527228 - DNA, 19 bp, Homo sapiens
ttatttggcataactgtga

SEQ ID NO: 6527229 - DNA, 13 bp, Homo sapiens
ttatttgtacagt

SEQ ID NO: 6527230 - DNA, 14 bp, Homo sapiens
ttatttgtacagtt

SEQ ID NO: 6527231 - DNA, 18 bp, Homo sapiens
ttatttgtatgtattaaa

SEQ ID NO: 6527232 - DNA, 15 bp, Homo sapiens
ttatttgtcagtgta

SEQ ID NO: 6527233 - DNA, 16 bp, Homo sapiens
ttatttgtcttaaaaa

SEQ ID NO: 6527234 - DNA, 22 bp, Homo sapiens
ttatttgtgttttaatttaaac

SEQ ID NO: 6527235 - DNA, 19 bp, Homo sapiens
ttatttgttctttttctga

SEQ ID NO: 6527236 - DNA, 19 bp, Homo sapiens
ttatttgttgagagtgtga

SEQ ID NO: 6527237 - DNA, 18 bp, Homo sapiens
ttatttgttgttttctgg

SEQ ID NO: 6527238 - DNA, 15 bp, Homo sapiens
ttatttgttttcccg

SEQ ID NO: 6527239 - DNA, 18 bp, Homo sapiens
ttattttaaatgatctgt

SEQ ID NO: 6527240 - DNA, 12 bp, Homo sapiens
ttattttaaatt

SEQ ID NO: 6527241 - DNA, 16 bp, Homo sapiens
ttattttaaatttctt

SEQ ID NO: 6527242 - DNA, 20 bp, Homo sapiens
ttattttaagcattgtgagt

SEQ ID NO: 6527243 - DNA, 16 bp, Homo sapiens
ttattttaataatgtt

SEQ ID NO: 6527244 - DNA, 21 bp, Homo sapiens
ttattttaatagcctgtcata

SEQ ID NO: 6527245 - DNA, 20 bp, Homo sapiens
ttattttaatattgatgtca

SEQ ID NO: 6527246 - DNA, 14 bp, Homo sapiens
ttattttaatgtaa

SEQ ID NO: 6527247 - DNA, 17 bp, Homo sapiens
ttattttaatgtgatga

SEQ ID NO: 6527248 - DNA, 12 bp, Homo sapiens
ttattttacaaa

SEQ ID NO: 6527249 - DNA, 12 bp, Homo sapiens
ttattttacagt

SEQ ID NO: 6527250 - DNA, 20 bp, Homo sapiens
ttattttacatttagagtat

SEQ ID NO: 6527251 - DNA, 21 bp, Homo sapiens
ttattttagcaaatcagtata

SEQ ID NO: 6527252 - DNA, 20 bp, Homo sapiens
ttattttagcagttctgcaa

SEQ ID NO: 6527253 - DNA, 20 bp, Homo sapiens
ttattttagtctgtcatcca

SEQ ID NO: 6527254 - DNA, 19 bp, Homo sapiens
tgggagggagctgagaaga

SEQ ID NO: 6527255 - DNA, 13 bp, Homo sapiens
tgggagggaggag

SEQ ID NO: 6527256 - DNA, 23 bp, Homo sapiens
tgggagggaggcatctgcatggg

SEQ ID NO: 6527257 - DNA, 16 bp, Homo sapiens
tgggagggaggctcag

SEQ ID NO: 6527258 - DNA, 16 bp, Homo sapiens
tgggagggagggagag

SEQ ID NO: 6527259 - DNA, 18 bp, Homo sapiens
tgggagggagggagaggt

SEQ ID NO: 6527260 - DNA, 15 bp, Homo sapiens
tgggagggatcagcc

SEQ ID NO: 6527261 - DNA, 14 bp, Homo sapiens
tgggagggcaaggg

SEQ ID NO: 6527262 - DNA, 19 bp, Homo sapiens
tgggagggcagcagggcta

SEQ ID NO: 6527263 - DNA, 16 bp, Homo sapiens
tgggagggcattccat

SEQ ID NO: 6527264 - DNA, 23 bp, Homo sapiens
tgggagggcgaggcgggggagcc

SEQ ID NO: 6527265 - DNA, 14 bp, Homo sapiens
tgggagggcgtcag

SEQ ID NO: 6527266 - DNA, 20 bp, Homo sapiens
tgggagggcgtcaggcagag

SEQ ID NO: 6527267 - DNA, 12 bp, Homo sapiens
tgggaggggaag

SEQ ID NO: 6527268 - DNA, 19 bp, Homo sapiens
tgggaggggatggcagaca

SEQ ID NO: 6527269 - DNA, 20 bp, Homo sapiens
tgggaggggatggcagacag

SEQ ID NO: 6527270 - DNA, 19 bp, Homo sapiens
tgggaggggcaggctgaca

SEQ ID NO: 6527271 - DNA, 15 bp, Homo sapiens
tgggaggggccatgc

SEQ ID NO: 6527272 - DNA, 15 bp, Homo sapiens
tgggaggggccggag

SEQ ID NO: 6527273 - DNA, 23 bp, Homo sapiens
tgggaggggcgcccacctcccca

SEQ ID NO: 6527274 - DNA, 22 bp, Homo sapiens
tgggagggggagatgggtggga

SEQ ID NO: 6527275 - DNA, 16 bp, Homo sapiens
tgggagggggcagggg

SEQ ID NO: 6527276 - DNA, 17 bp, Homo sapiens
tgggagggggctccatg

SEQ ID NO: 6527277 - DNA, 22 bp, Homo sapiens
tgggagggggctccatggagga

SEQ ID NO: 6527278 - DNA, 20 bp, Homo sapiens
tgggagggggtgagaggcag

SEQ ID NO: 6527279 - DNA, 20 bp, Homo sapiens
tgggagggggttggggtggt

SEQ ID NO: 6527280 - DNA, 24 bp, Homo sapiens
tgggagggggttggggtggttgag

SEQ ID NO: 6527281 - DNA, 19 bp, Homo sapiens
tgggagggtctgcagggaa

SEQ ID NO: 6527282 - DNA, 13 bp, Homo sapiens
tgggagggtggtg

SEQ ID NO: 6527283 - DNA, 16 bp, Homo sapiens
tgggagggttggcacc

SEQ ID NO: 6527284 - DNA, 20 bp, Homo sapiens
tgggagggttggcacctgca

SEQ ID NO: 6527285 - DNA, 15 bp, Homo sapiens
tgggaggtaaggaaa

SEQ ID NO: 6527286 - DNA, 17 bp, Homo sapiens
tgggaggtcaggaaact

SEQ ID NO: 6527287 - DNA, 16 bp, Homo sapiens
tgggaggtccaaggtc

SEQ ID NO: 6527288 - DNA, 17 bp, Homo sapiens
tgggaggtccaggcagg

SEQ ID NO: 6527289 - DNA, 14 bp, Homo sapiens
tgggaggtgcgtgt

SEQ ID NO: 6527290 - DNA, 18 bp, Homo sapiens
tgggaggtgcgtgttcag

SEQ ID NO: 6527291 - DNA, 11 bp, Homo sapiens
tgggaggtgga

SEQ ID NO: 6527292 - DNA, 22 bp, Homo sapiens
tgggaggtggaagaagggagaa

SEQ ID NO: 6527293 - DNA, 18 bp, Homo sapiens
tgggaggtggaagcagag

SEQ ID NO: 6527294 - DNA, 21 bp, Homo sapiens
tgggaggtggaagcagaggcc

SEQ ID NO: 6527295 - DNA, 23 bp, Homo sapiens
tgggaggtggaagcagaggccct

SEQ ID NO: 6527296 - DNA, 19 bp, Homo sapiens
tgggaggttgatcagatct

SEQ ID NO: 6527297 - DNA, 16 bp, Homo sapiens
tgggaggttgggaggc

SEQ ID NO: 6527298 - DNA, 18 bp, Homo sapiens
tgggagtaacagggcaga

SEQ ID NO: 6527299 - DNA, 22 bp, Homo sapiens
tgggagtacaggcgtctgccac

SEQ ID NO: 6527300 - DNA, 22 bp, Homo sapiens
tgggagtagcatggactctggg

SEQ ID NO: 6527301 - DNA, 21 bp, Homo sapiens
tgggagtaggctccagacagg

SEQ ID NO: 6527302 - DNA, 14 bp, Homo sapiens
tgggagtatgttgt

SEQ ID NO: 6527303 - DNA, 16 bp, Homo sapiens
tgggagtatgttgtca

SEQ ID NO: 6527304 - DNA, 21 bp, Homo sapiens
tgggagtcaagtgtgcctgct

SEQ ID NO: 6527305 - DNA, 23 bp, Homo sapiens
tgggagtcacacagtgttggagg

SEQ ID NO: 6527306 - DNA, 14 bp, Homo sapiens
tgggagtcagagcc

SEQ ID NO: 6527307 - DNA, 15 bp, Homo sapiens
tgggagtcagagccc

SEQ ID NO: 6527308 - DNA, 17 bp, Homo sapiens
tgggagtcagagccctg

SEQ ID NO: 6527309 - DNA, 20 bp, Homo sapiens
tgggagtcagggagccctgg

SEQ ID NO: 6527310 - DNA, 16 bp, Homo sapiens
tgggagtccactttcc

SEQ ID NO: 6527311 - DNA, 18 bp, Homo sapiens
tgggagtccactttcctc

SEQ ID NO: 6527312 - DNA, 14 bp, Homo sapiens
tgggagtccaggca

SEQ ID NO: 6527313 - DNA, 20 bp, Homo sapiens
tgggagtccccttttctttt

SEQ ID NO: 6527314 - DNA, 16 bp, Homo sapiens
tgggagtctgaaatgg

SEQ ID NO: 6527315 - DNA, 20 bp, Homo sapiens
tgggagtgagaatgccgggc

SEQ ID NO: 6527316 - DNA, 22 bp, Homo sapiens
tgggagtgaggatgtctgggcc

SEQ ID NO: 6527317 - DNA, 16 bp, Homo sapiens
tgggagtgcagagaaa

SEQ ID NO: 6527318 - DNA, 17 bp, Homo sapiens
tgggagtgggagaggaa

SEQ ID NO: 6527319 - DNA, 19 bp, Homo sapiens
tgggagtgggagaggaagc

SEQ ID NO: 6527320 - DNA, 15 bp, Homo sapiens
tgggagtgggcacct

SEQ ID NO: 6527321 - DNA, 17 bp, Homo sapiens
tgggagtgggcacctca

SEQ ID NO: 6527322 - DNA, 18 bp, Homo sapiens
tgggagtgggcacctcag

SEQ ID NO: 6527323 - DNA, 15 bp, Homo sapiens
tgggagtggggcctt

SEQ ID NO: 6527324 - DNA, 18 bp, Homo sapiens
tgggagtggggcctttgc

SEQ ID NO: 6527325 - DNA, 15 bp, Homo sapiens
tgggagtgtgggctg

SEQ ID NO: 6527326 - DNA, 13 bp, Homo sapiens
tgggagtgtgtaa

SEQ ID NO: 6527327 - DNA, 20 bp, Homo sapiens
tgggagtgttcccgtgcctg

SEQ ID NO: 6527328 - DNA, 17 bp, Homo sapiens
tgggagttcagctgctt

SEQ ID NO: 6527329 - DNA, 19 bp, Homo sapiens
tgggagttctagaaccact

SEQ ID NO: 6527330 - DNA, 14 bp, Homo sapiens
tgggataaagcaag

SEQ ID NO: 6527331 - DNA, 13 bp, Homo sapiens
tgggataaatgcc

SEQ ID NO: 6527332 - DNA, 16 bp, Homo sapiens
tgggataacagaggca

SEQ ID NO: 6527333 - DNA, 20 bp, Homo sapiens
tgggataactgatttctatg

SEQ ID NO: 6527334 - DNA, 20 bp, Homo sapiens
tgggatacaacctccctctt

SEQ ID NO: 6527335 - DNA, 21 bp, Homo sapiens
tgggataggaaaaatgagtaa

SEQ ID NO: 6527336 - DNA, 17 bp, Homo sapiens
tgggataggagggtgcc

SEQ ID NO: 6527337 - DNA, 22 bp, Homo sapiens
tgggataggagggtgcccctgg

SEQ ID NO: 6527338 - DNA, 20 bp, Homo sapiens
tgggatagtgttctgctcct

SEQ ID NO: 6527339 - DNA, 22 bp, Homo sapiens
tgggatagtgttctgctcctgc

SEQ ID NO: 6527340 - DNA, 23 bp, Homo sapiens
tgggatagtgttctgctcctgct

SEQ ID NO: 6527341 - DNA, 20 bp, Homo sapiens
tgggatataagaggcagcgt

SEQ ID NO: 6527342 - DNA, 22 bp, Homo sapiens
tgggatatatggaggattcttt

SEQ ID NO: 6527343 - DNA, 14 bp, Homo sapiens
tgggatatcatttt

SEQ ID NO: 6527344 - DNA, 13 bp, Homo sapiens
tgggatatgacaa

SEQ ID NO: 6527345 - DNA, 14 bp, Homo sapiens
tgggatatggtctt

SEQ ID NO: 6527346 - DNA, 14 bp, Homo sapiens
tgggatattcttta

SEQ ID NO: 6527347 - DNA, 14 bp, Homo sapiens
tgggatatttaact

SEQ ID NO: 6527348 - DNA, 16 bp, Homo sapiens
tgggatattttgaaat

SEQ ID NO: 6527349 - DNA, 20 bp, Homo sapiens
tgggatcaaagctaggaaag

SEQ ID NO: 6527350 - DNA, 21 bp, Homo sapiens
tgggatcaaagctaggaaagg

SEQ ID NO: 6527351 - DNA, 15 bp, Homo sapiens
tgggatcaataggaa

SEQ ID NO: 6527352 - DNA, 20 bp, Homo sapiens
tgggatcacaggtgtcagcc

SEQ ID NO: 6527353 - DNA, 19 bp, Homo sapiens
tgggatcagtggggcccca

SEQ ID NO: 6527354 - DNA, 18 bp, Homo sapiens
tgggatcatgaaagtaga

SEQ ID NO: 6527355 - DNA, 15 bp, Homo sapiens
tgggatcattatttc

SEQ ID NO: 6527356 - DNA, 21 bp, Homo sapiens
tgggatcatttttccaggact

SEQ ID NO: 6527357 - DNA, 17 bp, Homo sapiens
tgggatccacttcttgg

SEQ ID NO: 6527358 - DNA, 14 bp, Homo sapiens
tgggatccagagag

SEQ ID NO: 6527359 - DNA, 18 bp, Homo sapiens
tgggatccagagagaagc

SEQ ID NO: 6527360 - DNA, 18 bp, Homo sapiens
tgggatccaggcccctcc

SEQ ID NO: 6527361 - DNA, 19 bp, Homo sapiens
tgggatcccacagccctag

SEQ ID NO: 6527362 - DNA, 14 bp, Homo sapiens
tgggatcccaccct

SEQ ID NO: 6527363 - DNA, 22 bp, Homo sapiens
tgggatccctgtctttcctaag

SEQ ID NO: 6527364 - DNA, 16 bp, Homo sapiens
tgggatccgagggccc

SEQ ID NO: 6527365 - DNA, 19 bp, Homo sapiens
tgggatccgagggcccctc

SEQ ID NO: 6527366 - DNA, 14 bp, Homo sapiens
tgggatcctccagg

SEQ ID NO: 6527367 - DNA, 14 bp, Homo sapiens
tgggatcctccctc

SEQ ID NO: 6527368 - DNA, 15 bp, Homo sapiens
tgggatcctccctca

SEQ ID NO: 6527369 - DNA, 20 bp, Homo sapiens
tgggatcctctccaccctcc

SEQ ID NO: 6527370 - DNA, 13 bp, Homo sapiens
tgggatcctggag

SEQ ID NO: 6527371 - DNA, 15 bp, Homo sapiens
tgggatccttcagca

SEQ ID NO: 6527372 - DNA, 16 bp, Homo sapiens
tgggatcgtgcatttg

SEQ ID NO: 6527373 - DNA, 15 bp, Homo sapiens
tgggatctaactgtt

SEQ ID NO: 6527374 - DNA, 15 bp, Homo sapiens
tgggatctaggagag

SEQ ID NO: 6527375 - DNA, 16 bp, Homo sapiens
tgggatctaggagagg

SEQ ID NO: 6527376 - DNA, 14 bp, Homo sapiens
tgggatctgactgc

SEQ ID NO: 6527377 - DNA, 16 bp, Homo sapiens
tgggatctgcccctcc

SEQ ID NO: 6527378 - DNA, 14 bp, Homo sapiens
tgggatctggggag

SEQ ID NO: 6527379 - DNA, 15 bp, Homo sapiens
tgggatctgtcttgg

SEQ ID NO: 6527380 - DNA, 23 bp, Homo sapiens
tgggatgacaggcgcctgccatc

SEQ ID NO: 6527381 - DNA, 13 bp, Homo sapiens
tgggatgaccagg

SEQ ID NO: 6527382 - DNA, 16 bp, Homo sapiens
tgggatgagccgctgt

SEQ ID NO: 6527383 - DNA, 14 bp, Homo sapiens
tgggatgattgaag

SEQ ID NO: 6527384 - DNA, 16 bp, Homo sapiens
tgggatgattgaagaa

SEQ ID NO: 6527385 - DNA, 17 bp, Homo sapiens
tgggatgattgaagaaa

SEQ ID NO: 6527386 - DNA, 23 bp, Homo sapiens
tgggatgattgaagaaacagcta

SEQ ID NO: 6527387 - DNA, 18 bp, Homo sapiens
tgggatgattggaggggg

SEQ ID NO: 6527388 - DNA, 17 bp, Homo sapiens
tgggatgcccttccccc

SEQ ID NO: 6527389 - DNA, 15 bp, Homo sapiens
tgggatgcctcacca

SEQ ID NO: 6527390 - DNA, 13 bp, Homo sapiens
tgggatgcggggc

SEQ ID NO: 6527391 - DNA, 21 bp, Homo sapiens
tgggatgctagccccagagat

SEQ ID NO: 6527392 - DNA, 17 bp, Homo sapiens
tgggatgctgaaggaga

SEQ ID NO: 6527393 - DNA, 14 bp, Homo sapiens
tgggatggaggaga

SEQ ID NO: 6527394 - DNA, 15 bp, Homo sapiens
tgggatggaggggag

SEQ ID NO: 6527395 - DNA, 12 bp, Homo sapiens
tgggatggcgat

SEQ ID NO: 6527396 - DNA, 13 bp, Homo sapiens
tgggatgggacag

SEQ ID NO: 6527397 - DNA, 14 bp, Homo sapiens
tgggatgggcacag

SEQ ID NO: 6527398 - DNA, 17 bp, Homo sapiens
tgggatgggcacaggct

SEQ ID NO: 6527399 - DNA, 21 bp, Homo sapiens
tgggatgggccacccaccagg

SEQ ID NO: 6527400 - DNA, 18 bp, Homo sapiens
tgggatgggctctacctc

SEQ ID NO: 6527401 - DNA, 12 bp, Homo sapiens
tgggatggggag

SEQ ID NO: 6527402 - DNA, 20 bp, Homo sapiens
tgggatggtcggatctcaca

SEQ ID NO: 6527403 - DNA, 16 bp, Homo sapiens
tgggatggtggagggc

SEQ ID NO: 6527404 - DNA, 18 bp, Homo sapiens
tgggatggtggagggcca

SEQ ID NO: 6527405 - DNA, 20 bp, Homo sapiens
tgggatggtgggcttcaggg

SEQ ID NO: 6527406 - DNA, 23 bp, Homo sapiens
tgggatgtatgaatacagcagca

SEQ ID NO: 6527407 - DNA, 15 bp, Homo sapiens
tgggatgtcttattt

SEQ ID NO: 6527408 - DNA, 17 bp, Homo sapiens
tgggatgtgctgttttc

SEQ ID NO: 6527409 - DNA, 23 bp, Homo sapiens
tgggatgtggctgcagcagcggt

SEQ ID NO: 6527410 - DNA, 20 bp, Homo sapiens
tgggatgttaagcaaaggaa

SEQ ID NO: 6527411 - DNA, 16 bp, Homo sapiens
tgggatgttcagcact

SEQ ID NO: 6527412 - DNA, 14 bp, Homo sapiens
tgggatgtttctgt

SEQ ID NO: 6527413 - DNA, 15 bp, Homo sapiens
tgggattaagggcaa

SEQ ID NO: 6527414 - DNA, 15 bp, Homo sapiens
tgggattacagacat

SEQ ID NO: 6527415 - DNA, 19 bp, Homo sapiens
tgggattacagccgtgagc

SEQ ID NO: 6527416 - DNA, 21 bp, Homo sapiens
tgggattacaggcatgtgcca

SEQ ID NO: 6527417 - DNA, 20 bp, Homo sapiens
tgggattacaggcgtgagcc

SEQ ID NO: 6527418 - DNA, 16 bp, Homo sapiens
tgggattacaggtgtg

SEQ ID NO: 6527419 - DNA, 19 bp, Homo sapiens
tgggattacaggtgtgtgc

SEQ ID NO: 6527420 - DNA, 15 bp, Homo sapiens
tgggattagaaacaa

SEQ ID NO: 6527421 - DNA, 14 bp, Homo sapiens
tgggattcaggaat

SEQ ID NO: 6527422 - DNA, 23 bp, Homo sapiens
tgggattcccaccaaggtcttca

SEQ ID NO: 6527423 - DNA, 16 bp, Homo sapiens
tgggattcctgaccca

SEQ ID NO: 6527424 - DNA, 22 bp, Homo sapiens
tgggattcctgacccaggccgc

SEQ ID NO: 6527425 - DNA, 24 bp, Homo sapiens
tgggattgaaggggcttctaatga

SEQ ID NO: 6527426 - DNA, 23 bp, Homo sapiens
tgggattggcaagtaacttctga

SEQ ID NO: 6527427 - DNA, 21 bp, Homo sapiens
tgggattgggggctggtgcca

SEQ ID NO: 6527428 - DNA, 17 bp, Homo sapiens
tgggattggggggaaag

SEQ ID NO: 6527429 - DNA, 21 bp, Homo sapiens
tgggattggggggaaagaggg

SEQ ID NO: 6527430 - DNA, 19 bp, Homo sapiens
tgggattgtggtacaatct

SEQ ID NO: 6527431 - DNA, 15 bp, Homo sapiens
tgggattgtgttaaa

SEQ ID NO: 6527432 - DNA, 23 bp, Homo sapiens
ttattttagtgtgtaaaattaat

SEQ ID NO: 6527433 - DNA, 17 bp, Homo sapiens
ttattttatatcataca

SEQ ID NO: 6527434 - DNA, 20 bp, Homo sapiens
ttattttatatcatacagtt

SEQ ID NO: 6527435 - DNA, 19 bp, Homo sapiens
ttattttatcacttgccgt

SEQ ID NO: 6527436 - DNA, 21 bp, Homo sapiens
ttattttatcacttgccgtgt

SEQ ID NO: 6527437 - DNA, 16 bp, Homo sapiens
ttattttatcctctgg

SEQ ID NO: 6527438 - DNA, 16 bp, Homo sapiens
ttattttatgagaaat

SEQ ID NO: 6527439 - DNA, 18 bp, Homo sapiens
ttattttatgagaaatgt

SEQ ID NO: 6527440 - DNA, 20 bp, Homo sapiens
ttattttatgagaaatgtaa

SEQ ID NO: 6527441 - DNA, 12 bp, Homo sapiens
ttattttatgat

SEQ ID NO: 6527442 - DNA, 18 bp, Homo sapiens
ttattttatgtttagata

SEQ ID NO: 6527443 - DNA, 15 bp, Homo sapiens
ttattttattatgaa

SEQ ID NO: 6527444 - DNA, 20 bp, Homo sapiens
ttattttattatgaaacttg

SEQ ID NO: 6527445 - DNA, 16 bp, Homo sapiens
ttattttattattcag

SEQ ID NO: 6527446 - DNA, 16 bp, Homo sapiens
ttattttattatttct

SEQ ID NO: 6527447 - DNA, 18 bp, Homo sapiens
ttattttattgaaatgta

SEQ ID NO: 6527448 - DNA, 18 bp, Homo sapiens
ttattttattgaatactg

SEQ ID NO: 6527449 - DNA, 16 bp, Homo sapiens
ttattttcaaatctgg

SEQ ID NO: 6527450 - DNA, 12 bp, Homo sapiens
ttattttcaaga

SEQ ID NO: 6527451 - DNA, 18 bp, Homo sapiens
ttattttcaagaaactga

SEQ ID NO: 6527452 - DNA, 13 bp, Homo sapiens
ttattttcaagag

SEQ ID NO: 6527453 - DNA, 15 bp, Homo sapiens
ttattttcaccctct

SEQ ID NO: 6527454 - DNA, 14 bp, Homo sapiens
ttattttcacctgt

SEQ ID NO: 6527455 - DNA, 16 bp, Homo sapiens
ttattttcagaagctg

SEQ ID NO: 6527456 - DNA, 21 bp, Homo sapiens
ttattttcagtgctttgccct

SEQ ID NO: 6527457 - DNA, 12 bp, Homo sapiens
ttattttcatta

SEQ ID NO: 6527458 - DNA, 22 bp, Homo sapiens
ttattttcccctatcatttatt

SEQ ID NO: 6527459 - DNA, 16 bp, Homo sapiens
ttattttcctccccag

SEQ ID NO: 6527460 - DNA, 14 bp, Homo sapiens
ttattttcctgtct

SEQ ID NO: 6527461 - DNA, 15 bp, Homo sapiens
ttattttctaaattc

SEQ ID NO: 6527462 - DNA, 12 bp, Homo sapiens
ttattttctaca

SEQ ID NO: 6527463 - DNA, 18 bp, Homo sapiens
ttattttctacgtttctt

SEQ ID NO: 6527464 - DNA, 19 bp, Homo sapiens
ttattttctacgtttcttt

SEQ ID NO: 6527465 - DNA, 13 bp, Homo sapiens
ttattttctatat

SEQ ID NO: 6527466 - DNA, 14 bp, Homo sapiens
ttattttctccaaa

SEQ ID NO: 6527467 - DNA, 13 bp, Homo sapiens
ttattttctgaga

SEQ ID NO: 6527468 - DNA, 17 bp, Homo sapiens
ttattttctttgaaatt

SEQ ID NO: 6527469 - DNA, 22 bp, Homo sapiens
ttattttgaaaagcttcttaat

SEQ ID NO: 6527470 - DNA, 16 bp, Homo sapiens
ttattttgaatgtacc

SEQ ID NO: 6527471 - DNA, 17 bp, Homo sapiens
ttattttgaatgtacct

SEQ ID NO: 6527472 - DNA, 16 bp, Homo sapiens
ttattttgatgtaaag

SEQ ID NO: 6527473 - DNA, 18 bp, Homo sapiens
ttattttgcatatatgtt

SEQ ID NO: 6527474 - DNA, 16 bp, Homo sapiens
ttattttgctccctct

SEQ ID NO: 6527475 - DNA, 15 bp, Homo sapiens
ttattttgctcttgt

SEQ ID NO: 6527476 - DNA, 15 bp, Homo sapiens
ttattttggaactat

SEQ ID NO: 6527477 - DNA, 21 bp, Homo sapiens
ttattttggagattataataa

SEQ ID NO: 6527478 - DNA, 13 bp, Homo sapiens
ttattttggatat

SEQ ID NO: 6527479 - DNA, 14 bp, Homo sapiens
ttattttggatata

SEQ ID NO: 6527480 - DNA, 17 bp, Homo sapiens
ttattttgtaataaact

SEQ ID NO: 6527481 - DNA, 21 bp, Homo sapiens
ttattttgtaattattgtgat

SEQ ID NO: 6527482 - DNA, 14 bp, Homo sapiens
ttattttgtacgtg

SEQ ID NO: 6527483 - DNA, 15 bp, Homo sapiens
ttattttgtacgtgt

SEQ ID NO: 6527484 - DNA, 22 bp, Homo sapiens
ttattttgtcataaaatgctat

SEQ ID NO: 6527485 - DNA, 15 bp, Homo sapiens
ttattttgtggcttt

SEQ ID NO: 6527486 - DNA, 14 bp, Homo sapiens
ttattttgtgtaaa

SEQ ID NO: 6527487 - DNA, 19 bp, Homo sapiens
ttattttgttacactaaag

SEQ ID NO: 6527488 - DNA, 21 bp, Homo sapiens
ttattttgttactgtctgtag

SEQ ID NO: 6527489 - DNA, 21 bp, Homo sapiens
ttattttgttcatacatattt

SEQ ID NO: 6527490 - DNA, 20 bp, Homo sapiens
ttattttgttgtgattttgt

SEQ ID NO: 6527491 - DNA, 16 bp, Homo sapiens
ttatttttaaaaagaa

SEQ ID NO: 6527492 - DNA, 17 bp, Homo sapiens
ttatttttaaattttct

SEQ ID NO: 6527493 - DNA, 19 bp, Homo sapiens
ttatttttacagcaaaaga

SEQ ID NO: 6527494 - DNA, 22 bp, Homo sapiens
ttatttttagaattttgtgaaa

SEQ ID NO: 6527495 - DNA, 17 bp, Homo sapiens
ttatttttagacagagt

SEQ ID NO: 6527496 - DNA, 13 bp, Homo sapiens
ttatttttataaa

SEQ ID NO: 6527497 - DNA, 21 bp, Homo sapiens
ttatttttataattaaagatg

SEQ ID NO: 6527498 - DNA, 12 bp, Homo sapiens
ttatttttatac

SEQ ID NO: 6527499 - DNA, 20 bp, Homo sapiens
ttatttttatacagtagtga

SEQ ID NO: 6527500 - DNA, 21 bp, Homo sapiens
ttatttttatcccaggaaata

SEQ ID NO: 6527501 - DNA, 15 bp, Homo sapiens
ttatttttattactt

SEQ ID NO: 6527502 - DNA, 17 bp, Homo sapiens
ttatttttattactttt

SEQ ID NO: 6527503 - DNA, 22 bp, Homo sapiens
ttatttttcaagataaggagaa

SEQ ID NO: 6527504 - DNA, 14 bp, Homo sapiens
ttatttttcaagga

SEQ ID NO: 6527505 - DNA, 14 bp, Homo sapiens
ttatttttcaagta

SEQ ID NO: 6527506 - DNA, 14 bp, Homo sapiens
ttatttttctaaaa

SEQ ID NO: 6527507 - DNA, 17 bp, Homo sapiens
ttatttttctaagtgta

SEQ ID NO: 6527508 - DNA, 15 bp, Homo sapiens
ttatttttctctctc

SEQ ID NO: 6527509 - DNA, 21 bp, Homo sapiens
ttatttttctcttgtaccata

SEQ ID NO: 6527510 - DNA, 14 bp, Homo sapiens
ttatttttctgtga

SEQ ID NO: 6527511 - DNA, 15 bp, Homo sapiens
ttatttttctgttac

SEQ ID NO: 6527512 - DNA, 16 bp, Homo sapiens
ttatttttcttttaaa

SEQ ID NO: 6527513 - DNA, 16 bp, Homo sapiens
ttatttttcttttcct

SEQ ID NO: 6527514 - DNA, 11 bp, Homo sapiens
ttatttttgaa

SEQ ID NO: 6527515 - DNA, 16 bp, Homo sapiens
ttatttttgacagact

SEQ ID NO: 6527516 - DNA, 14 bp, Homo sapiens
ttatttttgcaaaa

SEQ ID NO: 6527517 - DNA, 21 bp, Homo sapiens
ttatttttgcaaaataagttt

SEQ ID NO: 6527518 - DNA, 12 bp, Homo sapiens
ttatttttgcca

SEQ ID NO: 6527519 - DNA, 23 bp, Homo sapiens
ttatttttggcgtggctgactta

SEQ ID NO: 6527520 - DNA, 11 bp, Homo sapiens
ttatttttgta

SEQ ID NO: 6527521 - DNA, 19 bp, Homo sapiens
ttatttttgtactgtgctg

SEQ ID NO: 6527522 - DNA, 21 bp, Homo sapiens
ttatttttgtactgtgctgat

SEQ ID NO: 6527523 - DNA, 17 bp, Homo sapiens
ttatttttgtgtttcta

SEQ ID NO: 6527524 - DNA, 16 bp, Homo sapiens
ttattttttaaaataa

SEQ ID NO: 6527525 - DNA, 18 bp, Homo sapiens
ttattttttaagtattta

SEQ ID NO: 6527526 - DNA, 18 bp, Homo sapiens
ttattttttaagttcaat

SEQ ID NO: 6527527 - DNA, 16 bp, Homo sapiens
ttattttttaattatt

SEQ ID NO: 6527528 - DNA, 14 bp, Homo sapiens
ttattttttacatt

SEQ ID NO: 6527529 - DNA, 15 bp, Homo sapiens
ttattttttatacag

SEQ ID NO: 6527530 - DNA, 13 bp, Homo sapiens
ttattttttattg

SEQ ID NO: 6527531 - DNA, 14 bp, Homo sapiens
ttattttttcagac

SEQ ID NO: 6527532 - DNA, 16 bp, Homo sapiens
ttattttttcagaccg

SEQ ID NO: 6527533 - DNA, 13 bp, Homo sapiens
ttattttttccca

SEQ ID NO: 6527534 - DNA, 16 bp, Homo sapiens
ttattttttctatgaa

SEQ ID NO: 6527535 - DNA, 14 bp, Homo sapiens
ttattttttgtaac

SEQ ID NO: 6527536 - DNA, 16 bp, Homo sapiens
ttattttttgtaactc

SEQ ID NO: 6527537 - DNA, 16 bp, Homo sapiens
ttatttttttaaaatt

SEQ ID NO: 6527538 - DNA, 22 bp, Homo sapiens
ttatttttttaaagtgatttgc

SEQ ID NO: 6527539 - DNA, 13 bp, Homo sapiens
ttatttttttctg

SEQ ID NO: 6527540 - DNA, 17 bp, Homo sapiens
ttatttttttctgaatt

SEQ ID NO: 6527541 - DNA, 13 bp, Homo sapiens
ttatttttttgaa

SEQ ID NO: 6527542 - DNA, 17 bp, Homo sapiens
ttatttttttgatggct

SEQ ID NO: 6527543 - DNA, 14 bp, Homo sapiens
ttattttttttcaa

SEQ ID NO: 6527544 - DNA, 17 bp, Homo sapiens
ttattttttttcaaaat

SEQ ID NO: 6527545 - DNA, 20 bp, Homo sapiens
ttattttttttcaaaatgaa

SEQ ID NO: 6527546 - DNA, 23 bp, Homo sapiens
ttattttttttcaaaatgaagat

SEQ ID NO: 6527547 - DNA, 20 bp, Homo sapiens
ttcaaaaaaaaaatataagg

SEQ ID NO: 6527548 - DNA, 20 bp, Homo sapiens
ttcaaaaaaaatcaaactgt

SEQ ID NO: 6527549 - DNA, 18 bp, Homo sapiens
ttcaaaaaaacactagtt

SEQ ID NO: 6527550 - DNA, 18 bp, Homo sapiens
ttcaaaaaaataaaataa

SEQ ID NO: 6527551 - DNA, 15 bp, Homo sapiens
ttcaaaaaaatccta

SEQ ID NO: 6527552 - DNA, 15 bp, Homo sapiens
ttcaaaaacatgctt

SEQ ID NO: 6527553 - DNA, 23 bp, Homo sapiens
ttcaaaaacatgcttttccaaac

SEQ ID NO: 6527554 - DNA, 18 bp, Homo sapiens
ttcaaaaaccagccaggc

SEQ ID NO: 6527555 - DNA, 20 bp, Homo sapiens
ttcaaaaaccagccaggcag

SEQ ID NO: 6527556 - DNA, 12 bp, Homo sapiens
ttcaaaaactgt

SEQ ID NO: 6527557 - DNA, 13 bp, Homo sapiens
ttcaaaaactgtt

SEQ ID NO: 6527558 - DNA, 11 bp, Homo sapiens
ttcaaaaactt

SEQ ID NO: 6527559 - DNA, 14 bp, Homo sapiens
ttcaaaaagccaca

SEQ ID NO: 6527560 - DNA, 19 bp, Homo sapiens
ttcaaaaataaattagaaa

SEQ ID NO: 6527561 - DNA, 17 bp, Homo sapiens
ttcaaaaatacagaatt

SEQ ID NO: 6527562 - DNA, 21 bp, Homo sapiens
ttcaaaaatctgaagattgtt

SEQ ID NO: 6527563 - DNA, 22 bp, Homo sapiens
ttcaaaaatctgaagattgttt

SEQ ID NO: 6527564 - DNA, 21 bp, Homo sapiens
ttcaaaaatgtacaaaataaa

SEQ ID NO: 6527565 - DNA, 18 bp, Homo sapiens
ttcaaaaatgtgctgcct

SEQ ID NO: 6527566 - DNA, 23 bp, Homo sapiens
ttcaaaaattgtgtttagatttt

SEQ ID NO: 6527567 - DNA, 20 bp, Homo sapiens
ttcaaaacaaccactttctc

SEQ ID NO: 6527568 - DNA, 16 bp, Homo sapiens
ttcaaaacattccaag

SEQ ID NO: 6527569 - DNA, 22 bp, Homo sapiens
ttcaaaacattccaagaaaggt

SEQ ID NO: 6527570 - DNA, 19 bp, Homo sapiens
ttcaaaaccaaggaagcag

SEQ ID NO: 6527571 - DNA, 16 bp, Homo sapiens
ttcaaaacctgcagtt

SEQ ID NO: 6527572 - DNA, 16 bp, Homo sapiens
ttcaaaactagttctt

SEQ ID NO: 6527573 - DNA, 17 bp, Homo sapiens
ttcaaaactagttctta

SEQ ID NO: 6527574 - DNA, 13 bp, Homo sapiens
ttcaaaactttca

SEQ ID NO: 6527575 - DNA, 14 bp, Homo sapiens
ttcaaaagaacatt

SEQ ID NO: 6527576 - DNA, 16 bp, Homo sapiens
ttcaaaagaagagttt

SEQ ID NO: 6527577 - DNA, 16 bp, Homo sapiens
ttcaaaagaagttcat

SEQ ID NO: 6527578 - DNA, 14 bp, Homo sapiens
ttcaaaagacatgt

SEQ ID NO: 6527579 - DNA, 16 bp, Homo sapiens
ttcaaaagagtagaaa

SEQ ID NO: 6527580 - DNA, 15 bp, Homo sapiens
ttcaaaagataatat

SEQ ID NO: 6527581 - DNA, 13 bp, Homo sapiens
ttcaaaagggaag

SEQ ID NO: 6527582 - DNA, 20 bp, Homo sapiens
ttcaaaaggtattatacatg

SEQ ID NO: 6527583 - DNA, 21 bp, Homo sapiens
ttcaaaaggtattatacatgt

SEQ ID NO: 6527584 - DNA, 23 bp, Homo sapiens
ttcaaaaggtgattaaatattta

SEQ ID NO: 6527585 - DNA, 19 bp, Homo sapiens
ttcaaaagtaagaatgcaa

SEQ ID NO: 6527586 - DNA, 19 bp, Homo sapiens
ttcaaaagtattgaaagcc

SEQ ID NO: 6527587 - DNA, 11 bp, Homo sapiens
ttcaaaataaa

SEQ ID NO: 6527588 - DNA, 21 bp, Homo sapiens
ttcaaaataagtatttctgat

SEQ ID NO: 6527589 - DNA, 13 bp, Homo sapiens
ttcaaaatagaca

SEQ ID NO: 6527590 - DNA, 18 bp, Homo sapiens
ttcaaaatagttctattt

SEQ ID NO: 6527591 - DNA, 16 bp, Homo sapiens
ttcaaaatattgagca

SEQ ID NO: 6527592 - DNA, 13 bp, Homo sapiens
ttcaaaatattta

SEQ ID NO: 6527593 - DNA, 13 bp, Homo sapiens
ttcaaaatcaaag

SEQ ID NO: 6527594 - DNA, 19 bp, Homo sapiens
ttcaaaatcagtgatggga

SEQ ID NO: 6527595 - DNA, 16 bp, Homo sapiens
ttcaaaatcagttttt

SEQ ID NO: 6527596 - DNA, 15 bp, Homo sapiens
ttcaaaatccaaaaa

SEQ ID NO: 6527597 - DNA, 19 bp, Homo sapiens
ttcaaaatccttccaaaga

SEQ ID NO: 6527598 - DNA, 11 bp, Homo sapiens
ttcaaaatgaa

SEQ ID NO: 6527599 - DNA, 22 bp, Homo sapiens
ttcaaaatgaagatacacatta

SEQ ID NO: 6527600 - DNA, 17 bp, Homo sapiens
ttcaaaatgaattttta

SEQ ID NO: 6527601 - DNA, 19 bp, Homo sapiens
ttcaaaatgatagacatat

SEQ ID NO: 6527602 - DNA, 22 bp, Homo sapiens
ttcaaaatgatttcctctgtaa

SEQ ID NO: 6527603 - DNA, 17 bp, Homo sapiens
ttcaaaatgcatgtgat

SEQ ID NO: 6527604 - DNA, 13 bp, Homo sapiens
ttcaaaatgctct

SEQ ID NO: 6527605 - DNA, 22 bp, Homo sapiens
ttcaaaatgctgcttccactca

SEQ ID NO: 6527606 - DNA, 16 bp, Homo sapiens
ttcaaaatggagggaa

SEQ ID NO: 6527607 - DNA, 21 bp, Homo sapiens
ttcaaaatggtaactttacaa

SEQ ID NO: 6527608 - DNA, 13 bp, Homo sapiens
ttcaaaatgttaa

SEQ ID NO: 6527609 - DNA, 23 bp, Homo sapiens
ttcaaaatgttaataaaggtttc

SEQ ID NO: 6527610 - DNA, 14 bp, Homo sapiens
ttcaaaatgttcgt

SEQ ID NO: 6527611 - DNA, 20 bp, Homo sapiens
ttcaaaatgttctatttaac

SEQ ID NO: 6527612 - DNA, 16 bp, Homo sapiens
ttcaaaattgttacaa

SEQ ID NO: 6527613 - DNA, 19 bp, Homo sapiens
tgggatttatatctatagt

SEQ ID NO: 6527614 - DNA, 15 bp, Homo sapiens
tgggatttcttcgct

SEQ ID NO: 6527615 - DNA, 21 bp, Homo sapiens
tgggatttcttcgctgctcta

SEQ ID NO: 6527616 - DNA, 12 bp, Homo sapiens
tgggatttgaac

SEQ ID NO: 6527617 - DNA, 16 bp, Homo sapiens
tgggatttgctcctgg

SEQ ID NO: 6527618 - DNA, 20 bp, Homo sapiens
tgggatttggggcctcaaga

SEQ ID NO: 6527619 - DNA, 14 bp, Homo sapiens
tgggattttaaaaa

SEQ ID NO: 6527620 - DNA, 21 bp, Homo sapiens
tgggattttaaactagatgac

SEQ ID NO: 6527621 - DNA, 14 bp, Homo sapiens
tgggattttctagt

SEQ ID NO: 6527622 - DNA, 16 bp, Homo sapiens
tgggattttcttttct

SEQ ID NO: 6527623 - DNA, 13 bp, Homo sapiens
tgggattttgcaa

SEQ ID NO: 6527624 - DNA, 14 bp, Homo sapiens
tgggattttgcaaa

SEQ ID NO: 6527625 - DNA, 15 bp, Homo sapiens
tgggattttgcaaaa

SEQ ID NO: 6527626 - DNA, 16 bp, Homo sapiens
tgggcaaacagagcta

SEQ ID NO: 6527627 - DNA, 14 bp, Homo sapiens
tgggcaaacaggca

SEQ ID NO: 6527628 - DNA, 15 bp, Homo sapiens
tgggcaaacaggcag

SEQ ID NO: 6527629 - DNA, 16 bp, Homo sapiens
tgggcaaaccctggtg

SEQ ID NO: 6527630 - DNA, 18 bp, Homo sapiens
tgggcaaaccctggtgct

SEQ ID NO: 6527631 - DNA, 21 bp, Homo sapiens
tgggcaaagcctagtgaaggc

SEQ ID NO: 6527632 - DNA, 23 bp, Homo sapiens
tgggcaaagcttgtcaaagatgc

SEQ ID NO: 6527633 - DNA, 14 bp, Homo sapiens
tgggcaaaggcagg

SEQ ID NO: 6527634 - DNA, 15 bp, Homo sapiens
tgggcaaaggcaggg

SEQ ID NO: 6527635 - DNA, 16 bp, Homo sapiens
tgggcaaaggcagggc

SEQ ID NO: 6527636 - DNA, 12 bp, Homo sapiens
tgggcaacaaag

SEQ ID NO: 6527637 - DNA, 17 bp, Homo sapiens
tgggcaacactgcagga

SEQ ID NO: 6527638 - DNA, 19 bp, Homo sapiens
tgggcaacactgcaggaca

SEQ ID NO: 6527639 - DNA, 19 bp, Homo sapiens
tgggcaacagagcaagact

SEQ ID NO: 6527640 - DNA, 19 bp, Homo sapiens
tgggcaacataccaagacc

SEQ ID NO: 6527641 - DNA, 14 bp, Homo sapiens
tgggcaacatagca

SEQ ID NO: 6527642 - DNA, 16 bp, Homo sapiens
tgggcaacccccagcc

SEQ ID NO: 6527643 - DNA, 17 bp, Homo sapiens
tgggcaacccccagcct

SEQ ID NO: 6527644 - DNA, 21 bp, Homo sapiens
tgggcaactcgtgacagcctc

SEQ ID NO: 6527645 - DNA, 16 bp, Homo sapiens
tgggcaactgcagtga

SEQ ID NO: 6527646 - DNA, 17 bp, Homo sapiens
tgggcaagacctcttcc

SEQ ID NO: 6527647 - DNA, 14 bp, Homo sapiens
tgggcaagaggaaa

SEQ ID NO: 6527648 - DNA, 21 bp, Homo sapiens
tgggcaagcagaaaaattaaa

SEQ ID NO: 6527649 - DNA, 22 bp, Homo sapiens
tgggcaagcagaaaaattaaat

SEQ ID NO: 6527650 - DNA, 13 bp, Homo sapiens
tgggcaaggaaaa

SEQ ID NO: 6527651 - DNA, 14 bp, Homo sapiens
tgggcaaggaaaaa

SEQ ID NO: 6527652 - DNA, 19 bp, Homo sapiens
tgggcaaggaaaaagaaaa

SEQ ID NO: 6527653 - DNA, 16 bp, Homo sapiens
tgggcaaggcctttgg

SEQ ID NO: 6527654 - DNA, 18 bp, Homo sapiens
tgggcaaggcctttggct

SEQ ID NO: 6527655 - DNA, 14 bp, Homo sapiens
tgggcaagtagcag

SEQ ID NO: 6527656 - DNA, 17 bp, Homo sapiens
tgggcaagtagcaggac

SEQ ID NO: 6527657 - DNA, 19 bp, Homo sapiens
tgggcaagtagcaggacta

SEQ ID NO: 6527658 - DNA, 19 bp, Homo sapiens
tgggcaatattctctgtac

SEQ ID NO: 6527659 - DNA, 19 bp, Homo sapiens
tgggcaatgaaaccaaagc

SEQ ID NO: 6527660 - DNA, 14 bp, Homo sapiens
tgggcaatggccag

SEQ ID NO: 6527661 - DNA, 15 bp, Homo sapiens
tgggcaattgtctga

SEQ ID NO: 6527662 - DNA, 17 bp, Homo sapiens
tgggcacaaacagaatt

SEQ ID NO: 6527663 - DNA, 22 bp, Homo sapiens
tgggcacaactgcaataacttc

SEQ ID NO: 6527664 - DNA, 17 bp, Homo sapiens
tgggcacacacacccgc

SEQ ID NO: 6527665 - DNA, 22 bp, Homo sapiens
tgggcacacgcacaaacacaca

SEQ ID NO: 6527666 - DNA, 23 bp, Homo sapiens
tgggcacacgcacaaacacacac

SEQ ID NO: 6527667 - DNA, 21 bp, Homo sapiens
tgggcacacgcctcccactgg

SEQ ID NO: 6527668 - DNA, 23 bp, Homo sapiens
tgggcacacgctgctctgcccca

SEQ ID NO: 6527669 - DNA, 23 bp, Homo sapiens
tgggcacaggccgtcaccctggg

SEQ ID NO: 6527670 - DNA, 21 bp, Homo sapiens
tgggcacaggctgccccaccc

SEQ ID NO: 6527671 - DNA, 13 bp, Homo sapiens
tgggcacaggtca

SEQ ID NO: 6527672 - DNA, 13 bp, Homo sapiens
tgggcacagtcca

SEQ ID NO: 6527673 - DNA, 19 bp, Homo sapiens
tgggcacagtccagaccca

SEQ ID NO: 6527674 - DNA, 13 bp, Homo sapiens
tgggcacagtgct

SEQ ID NO: 6527675 - DNA, 16 bp, Homo sapiens
tgggcacagtgctgcc

SEQ ID NO: 6527676 - DNA, 18 bp, Homo sapiens
tgggcacagtgctgcccc

SEQ ID NO: 6527677 - DNA, 19 bp, Homo sapiens
tgggcacagtgctgcccct

SEQ ID NO: 6527678 - DNA, 21 bp, Homo sapiens
tgggcacagtgctgccccttg

SEQ ID NO: 6527679 - DNA, 18 bp, Homo sapiens
tgggcacatagcataggc

SEQ ID NO: 6527680 - DNA, 20 bp, Homo sapiens
tgggcacatgaggagggtgc

SEQ ID NO: 6527681 - DNA, 15 bp, Homo sapiens
tgggcacatgctcag

SEQ ID NO: 6527682 - DNA, 19 bp, Homo sapiens
tgggcaccacaggctgcct

SEQ ID NO: 6527683 - DNA, 14 bp, Homo sapiens
tgggcaccagcttc

SEQ ID NO: 6527684 - DNA, 14 bp, Homo sapiens
tgggcacccaccct

SEQ ID NO: 6527685 - DNA, 20 bp, Homo sapiens
tgggcacccaccctgggacc

SEQ ID NO: 6527686 - DNA, 15 bp, Homo sapiens
tgggcacccacctcc

SEQ ID NO: 6527687 - DNA, 16 bp, Homo sapiens
tgggcaccccaggcag

SEQ ID NO: 6527688 - DNA, 19 bp, Homo sapiens
tgggcaccccaggcagctc

SEQ ID NO: 6527689 - DNA, 20 bp, Homo sapiens
tgggcaccccaggcagctcc

SEQ ID NO: 6527690 - DNA, 20 bp, Homo sapiens
tgggcacccccagcctgggc

SEQ ID NO: 6527691 - DNA, 22 bp, Homo sapiens
tgggcacccccagcctgggcct

SEQ ID NO: 6527692 - DNA, 13 bp, Homo sapiens
tgggcacccctgc

SEQ ID NO: 6527693 - DNA, 15 bp, Homo sapiens
tgggcacccctgcct

SEQ ID NO: 6527694 - DNA, 21 bp, Homo sapiens
tgggcacccctgcctcctgcc

SEQ ID NO: 6527695 - DNA, 19 bp, Homo sapiens
tgggcaccctgcaggcagg

SEQ ID NO: 6527696 - DNA, 21 bp, Homo sapiens
tgggcaccctgcaggcaggca

SEQ ID NO: 6527697 - DNA, 16 bp, Homo sapiens
tgggcaccgtgtcctc

SEQ ID NO: 6527698 - DNA, 19 bp, Homo sapiens
tgggcaccgtgtcctcctc

SEQ ID NO: 6527699 - DNA, 17 bp, Homo sapiens
tgggcacctataatacc

SEQ ID NO: 6527700 - DNA, 19 bp, Homo sapiens
tgggcacctataataccag

SEQ ID NO: 6527701 - DNA, 21 bp, Homo sapiens
tgggcacctcagaaagtcacc

SEQ ID NO: 6527702 - DNA, 23 bp, Homo sapiens
tgggcacctcatggactccagga

SEQ ID NO: 6527703 - DNA, 19 bp, Homo sapiens
tgggcacctgcgcacaggt

SEQ ID NO: 6527704 - DNA, 20 bp, Homo sapiens
tgggcacctggggagtggga

SEQ ID NO: 6527705 - DNA, 18 bp, Homo sapiens
tgggcacgggagagcgcc

SEQ ID NO: 6527706 - DNA, 21 bp, Homo sapiens
tgggcactccgcgccgatgcc

SEQ ID NO: 6527707 - DNA, 24 bp, Homo sapiens
tgggcactccgcgccgatgccacc

SEQ ID NO: 6527708 - DNA, 17 bp, Homo sapiens
tgggcactgctgggtgg

SEQ ID NO: 6527709 - DNA, 16 bp, Homo sapiens
tgggcactggattagt

SEQ ID NO: 6527710 - DNA, 15 bp, Homo sapiens
tgggcactggcccag

SEQ ID NO: 6527711 - DNA, 16 bp, Homo sapiens
tgggcactgggatgag

SEQ ID NO: 6527712 - DNA, 13 bp, Homo sapiens
tgggcactgggca

SEQ ID NO: 6527713 - DNA, 16 bp, Homo sapiens
tgggcactgggcacta

SEQ ID NO: 6527714 - DNA, 23 bp, Homo sapiens
tgggcactgggccggcagcctgg

SEQ ID NO: 6527715 - DNA, 14 bp, Homo sapiens
tgggcactggtatt

SEQ ID NO: 6527716 - DNA, 14 bp, Homo sapiens
tgggcactggtggg

SEQ ID NO: 6527717 - DNA, 17 bp, Homo sapiens
tgggcactggtgggcca

SEQ ID NO: 6527718 - DNA, 20 bp, Homo sapiens
tgggcactggtgggtcggcc

SEQ ID NO: 6527719 - DNA, 12 bp, Homo sapiens
tgggcagaagat

SEQ ID NO: 6527720 - DNA, 16 bp, Homo sapiens
tgggcagaagatagag

SEQ ID NO: 6527721 - DNA, 13 bp, Homo sapiens
tgggcagaaggaa

SEQ ID NO: 6527722 - DNA, 20 bp, Homo sapiens
tgggcagaaggaagacttca

SEQ ID NO: 6527723 - DNA, 16 bp, Homo sapiens
tgggcagaaggccaag

SEQ ID NO: 6527724 - DNA, 14 bp, Homo sapiens
tgggcagaagtgag

SEQ ID NO: 6527725 - DNA, 19 bp, Homo sapiens
tgggcagaagtgagccccc

SEQ ID NO: 6527726 - DNA, 20 bp, Homo sapiens
tgggcagaagtgagcccccc

SEQ ID NO: 6527727 - DNA, 16 bp, Homo sapiens
tgggcagaatcctggg

SEQ ID NO: 6527728 - DNA, 19 bp, Homo sapiens
tgggcagaatcctgggccc

SEQ ID NO: 6527729 - DNA, 22 bp, Homo sapiens
tgggcagaatcctgggccccca

SEQ ID NO: 6527730 - DNA, 12 bp, Homo sapiens
tgggcagacagg

SEQ ID NO: 6527731 - DNA, 20 bp, Homo sapiens
tgggcagacaggtgggagat

SEQ ID NO: 6527732 - DNA, 13 bp, Homo sapiens
tgggcagagcaga

SEQ ID NO: 6527733 - DNA, 14 bp, Homo sapiens
tgggcagagcagag

SEQ ID NO: 6527734 - DNA, 15 bp, Homo sapiens
tgggcagagcagaga

SEQ ID NO: 6527735 - DNA, 18 bp, Homo sapiens
tgggcagagcagagacca

SEQ ID NO: 6527736 - DNA, 16 bp, Homo sapiens
tgggcagagcctgtcc

SEQ ID NO: 6527737 - DNA, 22 bp, Homo sapiens
tgggcagagcctgtccccgcct

SEQ ID NO: 6527738 - DNA, 15 bp, Homo sapiens
tgggcagagctggac

SEQ ID NO: 6527739 - DNA, 16 bp, Homo sapiens
tgggcagagctggctc

SEQ ID NO: 6527740 - DNA, 18 bp, Homo sapiens
tgggcagagctggctctg

SEQ ID NO: 6527741 - DNA, 20 bp, Homo sapiens
tgggcagagctggctctgag

SEQ ID NO: 6527742 - DNA, 22 bp, Homo sapiens
tgggcagaggggagaggaagca

SEQ ID NO: 6527743 - DNA, 12 bp, Homo sapiens
tgggcagaggtg

SEQ ID NO: 6527744 - DNA, 17 bp, Homo sapiens
tgggcagagtcctgcct

SEQ ID NO: 6527745 - DNA, 22 bp, Homo sapiens
tgggcagatctaccccttactt

SEQ ID NO: 6527746 - DNA, 19 bp, Homo sapiens
tgggcagatgaaaagctac

SEQ ID NO: 6527747 - DNA, 19 bp, Homo sapiens
tgggcagcaatttaaatgt

SEQ ID NO: 6527748 - DNA, 15 bp, Homo sapiens
tgggcagcaccctcc

SEQ ID NO: 6527749 - DNA, 16 bp, Homo sapiens
tgggcagcaccctccc

SEQ ID NO: 6527750 - DNA, 18 bp, Homo sapiens
tgggcagcacctccggga

SEQ ID NO: 6527751 - DNA, 14 bp, Homo sapiens
tgggcagcagactg

SEQ ID NO: 6527752 - DNA, 17 bp, Homo sapiens
tgggcagcagcatccca

SEQ ID NO: 6527753 - DNA, 14 bp, Homo sapiens
tgggcagcagctca

SEQ ID NO: 6527754 - DNA, 17 bp, Homo sapiens
tgggcagcatgcccaga

SEQ ID NO: 6527755 - DNA, 12 bp, Homo sapiens
tgggcagccaga

SEQ ID NO: 6527756 - DNA, 14 bp, Homo sapiens
tgggcagccaggag

SEQ ID NO: 6527757 - DNA, 16 bp, Homo sapiens
tgggcagccatgagaa

SEQ ID NO: 6527758 - DNA, 12 bp, Homo sapiens
tgggcagcccaa

SEQ ID NO: 6527759 - DNA, 16 bp, Homo sapiens
tgggcagcccaacagc

SEQ ID NO: 6527760 - DNA, 19 bp, Homo sapiens
tgggcagcccaacagcact

SEQ ID NO: 6527761 - DNA, 15 bp, Homo sapiens
tgggcagcccagaga

SEQ ID NO: 6527762 - DNA, 16 bp, Homo sapiens
tgggcagcccagagag

SEQ ID NO: 6527763 - DNA, 12 bp, Homo sapiens
tgggcagcccca

SEQ ID NO: 6527764 - DNA, 14 bp, Homo sapiens
tgggcagccccaga

SEQ ID NO: 6527765 - DNA, 15 bp, Homo sapiens
tgggcagccccagag

SEQ ID NO: 6527766 - DNA, 18 bp, Homo sapiens
tgggcagccccagagaga

SEQ ID NO: 6527767 - DNA, 17 bp, Homo sapiens
tgggcagcgcccttcct

SEQ ID NO: 6527768 - DNA, 19 bp, Homo sapiens
tgggcagcgcccttcctct

SEQ ID NO: 6527769 - DNA, 23 bp, Homo sapiens
tgggcagctaccacgggtctgcc

SEQ ID NO: 6527770 - DNA, 10 bp, Homo sapiens
tgggcagctc

SEQ ID NO: 6527771 - DNA, 20 bp, Homo sapiens
tgggcagctcctccctgtgc

SEQ ID NO: 6527772 - DNA, 12 bp, Homo sapiens
tgggcagctgcc

SEQ ID NO: 6527773 - DNA, 13 bp, Homo sapiens
tgggcagctgcct

SEQ ID NO: 6527774 - DNA, 19 bp, Homo sapiens
tgggcagctgcctcccctc

SEQ ID NO: 6527775 - DNA, 15 bp, Homo sapiens
tgggcagctggctct

SEQ ID NO: 6527776 - DNA, 16 bp, Homo sapiens
tgggcagctggctctg

SEQ ID NO: 6527777 - DNA, 12 bp, Homo sapiens
tgggcagctggg

SEQ ID NO: 6527778 - DNA, 21 bp, Homo sapiens
tgggcagctgtcatggaaaag

SEQ ID NO: 6527779 - DNA, 22 bp, Homo sapiens
tgggcagcttagggccctggag

SEQ ID NO: 6527780 - DNA, 19 bp, Homo sapiens
tgggcagcttctgttggca

SEQ ID NO: 6527781 - DNA, 18 bp, Homo sapiens
tgggcagcttgggctggc

SEQ ID NO: 6527782 - DNA, 19 bp, Homo sapiens
tgggcaggaccctgctgac

SEQ ID NO: 6527783 - DNA, 13 bp, Homo sapiens
tgggcaggacctc

SEQ ID NO: 6527784 - DNA, 17 bp, Homo sapiens
tgggcaggactcagctc

SEQ ID NO: 6527785 - DNA, 21 bp, Homo sapiens
tgggcaggactcagctcccca

SEQ ID NO: 6527786 - DNA, 14 bp, Homo sapiens
tgggcaggagactg

SEQ ID NO: 6527787 - DNA, 18 bp, Homo sapiens
tgggcaggagggaggtgc

SEQ ID NO: 6527788 - DNA, 17 bp, Homo sapiens
tgggcaggagtcaccat

SEQ ID NO: 6527789 - DNA, 21 bp, Homo sapiens
tgggcaggagtcaccatgcaa

SEQ ID NO: 6527790 - DNA, 23 bp, Homo sapiens
tgggcaggatctcaagccagccc

SEQ ID NO: 6527791 - DNA, 14 bp, Homo sapiens
tgggcaggcagaga

SEQ ID NO: 6527792 - DNA, 12 bp, Homo sapiens
tgggcagggaag

SEQ ID NO: 6527793 - DNA, 21 bp, Homo sapiens
ttcaaaattgttacaaattgt

SEQ ID NO: 6527794 - DNA, 14 bp, Homo sapiens
ttcaaacaagaatg

SEQ ID NO: 6527795 - DNA, 17 bp, Homo sapiens
ttcaaacaagtatgaat

SEQ ID NO: 6527796 - DNA, 20 bp, Homo sapiens
ttcaaacaattcaatcaaag

SEQ ID NO: 6527797 - DNA, 23 bp, Homo sapiens
ttcaaacaattcaatcaaagcta

SEQ ID NO: 6527798 - DNA, 14 bp, Homo sapiens
ttcaaacacaaatg

SEQ ID NO: 6527799 - DNA, 14 bp, Homo sapiens
ttcaaacacacaca

SEQ ID NO: 6527800 - DNA, 16 bp, Homo sapiens
ttcaaacacacacaca

SEQ ID NO: 6527801 - DNA, 22 bp, Homo sapiens
ttcaaacagcatcaaaatacaa

SEQ ID NO: 6527802 - DNA, 15 bp, Homo sapiens
ttcaaacatatataa

SEQ ID NO: 6527803 - DNA, 16 bp, Homo sapiens
ttcaaacattgagact

SEQ ID NO: 6527804 - DNA, 17 bp, Homo sapiens
ttcaaaccaaagctgcc

SEQ ID NO: 6527805 - DNA, 22 bp, Homo sapiens
ttcaaaccaaagctgcctgtgc

SEQ ID NO: 6527806 - DNA, 21 bp, Homo sapiens
ttcaaaccagtgttttggaag

SEQ ID NO: 6527807 - DNA, 19 bp, Homo sapiens
ttcaaaccatttaattcat

SEQ ID NO: 6527808 - DNA, 23 bp, Homo sapiens
ttcaaacccagagggttgctggt

SEQ ID NO: 6527809 - DNA, 21 bp, Homo sapiens
ttcaaaccttggtatctgttg

SEQ ID NO: 6527810 - DNA, 20 bp, Homo sapiens
ttcaaactaacacattttta

SEQ ID NO: 6527811 - DNA, 17 bp, Homo sapiens
ttcaaactactgtacat

SEQ ID NO: 6527812 - DNA, 13 bp, Homo sapiens
ttcaaactacttt

SEQ ID NO: 6527813 - DNA, 16 bp, Homo sapiens
ttcaaactcctgacct

SEQ ID NO: 6527814 - DNA, 19 bp, Homo sapiens
ttcaaactgagtaaattgg

SEQ ID NO: 6527815 - DNA, 16 bp, Homo sapiens
ttcaaactgcactttt

SEQ ID NO: 6527816 - DNA, 14 bp, Homo sapiens
ttcaaactgcagct

SEQ ID NO: 6527817 - DNA, 14 bp, Homo sapiens
ttcaaactgctgca

SEQ ID NO: 6527818 - DNA, 17 bp, Homo sapiens
ttcaaacttactatttt

SEQ ID NO: 6527819 - DNA, 12 bp, Homo sapiens
ttcaaactttca

SEQ ID NO: 6527820 - DNA, 13 bp, Homo sapiens
ttcaaactttcac

SEQ ID NO: 6527821 - DNA, 16 bp, Homo sapiens
ttcaaactttcacttt

SEQ ID NO: 6527822 - DNA, 22 bp, Homo sapiens
ttcaaacttttattagccagtg

SEQ ID NO: 6527823 - DNA, 21 bp, Homo sapiens
ttcaaagaaaaccctaagtgt

SEQ ID NO: 6527824 - DNA, 22 bp, Homo sapiens
ttcaaagaaaaccctaagtgtg

SEQ ID NO: 6527825 - DNA, 13 bp, Homo sapiens
ttcaaagaaactt

SEQ ID NO: 6527826 - DNA, 12 bp, Homo sapiens
ttcaaagaactc

SEQ ID NO: 6527827 - DNA, 16 bp, Homo sapiens
ttcaaagaagctgtct

SEQ ID NO: 6527828 - DNA, 17 bp, Homo sapiens
ttcaaagactcaaattt

SEQ ID NO: 6527829 - DNA, 14 bp, Homo sapiens
ttcaaagactgcca

SEQ ID NO: 6527830 - DNA, 12 bp, Homo sapiens
ttcaaagagatg

SEQ ID NO: 6527831 - DNA, 21 bp, Homo sapiens
ttcaaagagatgggccttttc

SEQ ID NO: 6527832 - DNA, 23 bp, Homo sapiens
ttcaaagagatgggccttttctt

SEQ ID NO: 6527833 - DNA, 21 bp, Homo sapiens
ttcaaagataaatgaaataaa

SEQ ID NO: 6527834 - DNA, 16 bp, Homo sapiens
ttcaaagatgataatt

SEQ ID NO: 6527835 - DNA, 18 bp, Homo sapiens
ttcaaagatgctgtgagt

SEQ ID NO: 6527836 - DNA, 21 bp, Homo sapiens
ttcaaagattatctgattcct

SEQ ID NO: 6527837 - DNA, 12 bp, Homo sapiens
ttcaaagcaatt

SEQ ID NO: 6527838 - DNA, 23 bp, Homo sapiens
ttcaaagcatggacatttagaag

SEQ ID NO: 6527839 - DNA, 21 bp, Homo sapiens
ttcaaagccaagacctcacac

SEQ ID NO: 6527840 - DNA, 13 bp, Homo sapiens
ttcaaagccacat

SEQ ID NO: 6527841 - DNA, 21 bp, Homo sapiens
ttcaaagccagcgtcctcctc

SEQ ID NO: 6527842 - DNA, 23 bp, Homo sapiens
ttcaaagccagcgtcctcctctg

SEQ ID NO: 6527843 - DNA, 13 bp, Homo sapiens
ttcaaagccatat

SEQ ID NO: 6527844 - DNA, 14 bp, Homo sapiens
ttcaaagccctgcc

SEQ ID NO: 6527845 - DNA, 15 bp, Homo sapiens
ttcaaagccctgcct

SEQ ID NO: 6527846 - DNA, 21 bp, Homo sapiens
ttcaaagccctgcctctgtgt

SEQ ID NO: 6527847 - DNA, 20 bp, Homo sapiens
ttcaaagctgtgtgtttgga

SEQ ID NO: 6527848 - DNA, 22 bp, Homo sapiens
ttcaaagcttaaaaagagctca

SEQ ID NO: 6527849 - DNA, 23 bp, Homo sapiens
ttcaaaggaaaacacctttattt

SEQ ID NO: 6527850 - DNA, 14 bp, Homo sapiens
ttcaaaggaacatt

SEQ ID NO: 6527851 - DNA, 19 bp, Homo sapiens
ttcaaaggagcaagaactt

SEQ ID NO: 6527852 - DNA, 20 bp, Homo sapiens
ttcaaaggccacatacctct

SEQ ID NO: 6527853 - DNA, 18 bp, Homo sapiens
ttcaaagggtaaattata

SEQ ID NO: 6527854 - DNA, 12 bp, Homo sapiens
ttcaaaggttct

SEQ ID NO: 6527855 - DNA, 21 bp, Homo sapiens
ttcaaaggttctaggtttcaa

SEQ ID NO: 6527856 - DNA, 20 bp, Homo sapiens
ttcaaagtaaaggcctcctc

SEQ ID NO: 6527857 - DNA, 12 bp, Homo sapiens
ttcaaagtatat

SEQ ID NO: 6527858 - DNA, 17 bp, Homo sapiens
ttcaaagtatatacaga

SEQ ID NO: 6527859 - DNA, 20 bp, Homo sapiens
ttcaaagtatatacagagcc

SEQ ID NO: 6527860 - DNA, 21 bp, Homo sapiens
ttcaaagtcatgatgttttta

SEQ ID NO: 6527861 - DNA, 20 bp, Homo sapiens
ttcaaagtctcaatgaaata

SEQ ID NO: 6527862 - DNA, 17 bp, Homo sapiens
ttcaaagtgcacacaca

SEQ ID NO: 6527863 - DNA, 15 bp, Homo sapiens
ttcaaagtgcctggg

SEQ ID NO: 6527864 - DNA, 22 bp, Homo sapiens
ttcaaagtgtctcattctcaga

SEQ ID NO: 6527865 - DNA, 23 bp, Homo sapiens
ttcaaagttgcctaaatccattt

SEQ ID NO: 6527866 - DNA, 14 bp, Homo sapiens
ttcaaagtttaata

SEQ ID NO: 6527867 - DNA, 19 bp, Homo sapiens
ttcaaagtttaataaattt

SEQ ID NO: 6527868 - DNA, 17 bp, Homo sapiens
ttcaaataaagaaattt

SEQ ID NO: 6527869 - DNA, 23 bp, Homo sapiens
ttcaaataaagtaaattgaaatg

SEQ ID NO: 6527870 - DNA, 22 bp, Homo sapiens
ttcaaataaccctgaatcagag

SEQ ID NO: 6527871 - DNA, 19 bp, Homo sapiens
ttcaaataatccattccaa

SEQ ID NO: 6527872 - DNA, 21 bp, Homo sapiens
ttcaaatagatttttgattca

SEQ ID NO: 6527873 - DNA, 17 bp, Homo sapiens
ttcaaatagtatagaaa

SEQ ID NO: 6527874 - DNA, 15 bp, Homo sapiens
ttcaaatatgtaaac

SEQ ID NO: 6527875 - DNA, 17 bp, Homo sapiens
ttcaaatatgtaaactt

SEQ ID NO: 6527876 - DNA, 15 bp, Homo sapiens
ttcaaatattgaatg

SEQ ID NO: 6527877 - DNA, 16 bp, Homo sapiens
ttcaaatattgaatgc

SEQ ID NO: 6527878 - DNA, 23 bp, Homo sapiens
ttcaaatcaatctgtaaaactaa

SEQ ID NO: 6527879 - DNA, 13 bp, Homo sapiens
ttcaaatcagtga

SEQ ID NO: 6527880 - DNA, 15 bp, Homo sapiens
ttcaaatccttccaa

SEQ ID NO: 6527881 - DNA, 23 bp, Homo sapiens
ttcaaatccttccaaaaattatt

SEQ ID NO: 6527882 - DNA, 17 bp, Homo sapiens
ttcaaatccttgaagat

SEQ ID NO: 6527883 - DNA, 13 bp, Homo sapiens
ttcaaatctgtaa

SEQ ID NO: 6527884 - DNA, 13 bp, Homo sapiens
ttcaaatcttaag

SEQ ID NO: 6527885 - DNA, 12 bp, Homo sapiens
ttcaaatgaagg

SEQ ID NO: 6527886 - DNA, 22 bp, Homo sapiens
ttcaaatgatccttcctacttt

SEQ ID NO: 6527887 - DNA, 19 bp, Homo sapiens
ttcaaatgattatgattag

SEQ ID NO: 6527888 - DNA, 12 bp, Homo sapiens
ttcaaatgcatg

SEQ ID NO: 6527889 - DNA, 21 bp, Homo sapiens
ttcaaatgcatgatattgtat

SEQ ID NO: 6527890 - DNA, 23 bp, Homo sapiens
ttcaaatgcatgatattgtatgt

SEQ ID NO: 6527891 - DNA, 13 bp, Homo sapiens
ttcaaatgcattt

SEQ ID NO: 6527892 - DNA, 14 bp, Homo sapiens
ttcaaatgcatttt

SEQ ID NO: 6527893 - DNA, 19 bp, Homo sapiens
ttcaaatgggctgctgctt

SEQ ID NO: 6527894 - DNA, 18 bp, Homo sapiens
ttcaaatgtattacagtg

SEQ ID NO: 6527895 - DNA, 16 bp, Homo sapiens
ttcaaatgtcagttca

SEQ ID NO: 6527896 - DNA, 21 bp, Homo sapiens
ttcaaatgtcagttcataata

SEQ ID NO: 6527897 - DNA, 14 bp, Homo sapiens
ttcaaatgtgctgt

SEQ ID NO: 6527898 - DNA, 13 bp, Homo sapiens
ttcaaatgttaga

SEQ ID NO: 6527899 - DNA, 23 bp, Homo sapiens
ttcaaatgttagagtttaatttt

SEQ ID NO: 6527900 - DNA, 14 bp, Homo sapiens
ttcaaatgttagat

SEQ ID NO: 6527901 - DNA, 12 bp, Homo sapiens
ttcaaattaaaa

SEQ ID NO: 6527902 - DNA, 13 bp, Homo sapiens
ttcaaattaaaaa

SEQ ID NO: 6527903 - DNA, 22 bp, Homo sapiens
ttcaaattaaagtgctgtttag

SEQ ID NO: 6527904 - DNA, 12 bp, Homo sapiens
ttcaaattctct

SEQ ID NO: 6527905 - DNA, 14 bp, Homo sapiens
ttcaaattctctat

SEQ ID NO: 6527906 - DNA, 17 bp, Homo sapiens
ttcaaattctctatgta

SEQ ID NO: 6527907 - DNA, 23 bp, Homo sapiens
ttcaaattctctatgtacagatg

SEQ ID NO: 6527908 - DNA, 23 bp, Homo sapiens
ttcaaattctgattattacaaca

SEQ ID NO: 6527909 - DNA, 16 bp, Homo sapiens
ttcaaattcttctgaa

SEQ ID NO: 6527910 - DNA, 13 bp, Homo sapiens
ttcaaattgcctt

SEQ ID NO: 6527911 - DNA, 15 bp, Homo sapiens
ttcaaattgcctttc

SEQ ID NO: 6527912 - DNA, 18 bp, Homo sapiens
ttcaaattgctgcttgga

SEQ ID NO: 6527913 - DNA, 18 bp, Homo sapiens
ttcaaattggactttcaa

SEQ ID NO: 6527914 - DNA, 19 bp, Homo sapiens
ttcaaattggactttcaaa

SEQ ID NO: 6527915 - DNA, 16 bp, Homo sapiens
ttcaaattggtctgaa

SEQ ID NO: 6527916 - DNA, 17 bp, Homo sapiens
ttcaaattggtctgaaa

SEQ ID NO: 6527917 - DNA, 23 bp, Homo sapiens
ttcaaattgtaagcatgcacaaa

SEQ ID NO: 6527918 - DNA, 21 bp, Homo sapiens
ttcaaattgtgtgtgctctgc

SEQ ID NO: 6527919 - DNA, 17 bp, Homo sapiens
ttcaaatttactgtctt

SEQ ID NO: 6527920 - DNA, 22 bp, Homo sapiens
ttcaaatttactgtcttaaatc

SEQ ID NO: 6527921 - DNA, 23 bp, Homo sapiens
ttcaaatttactgtcttaaatca

SEQ ID NO: 6527922 - DNA, 11 bp, Homo sapiens
ttcaaatttag

SEQ ID NO: 6527923 - DNA, 13 bp, Homo sapiens
ttcaaatttgtaa

SEQ ID NO: 6527924 - DNA, 19 bp, Homo sapiens
ttcaaatttgtaataaaac

SEQ ID NO: 6527925 - DNA, 21 bp, Homo sapiens
ttcaaatttgtaataaaacta

SEQ ID NO: 6527926 - DNA, 14 bp, Homo sapiens
ttcaaatttgtaca

SEQ ID NO: 6527927 - DNA, 17 bp, Homo sapiens
ttcaaatttgtgtcata

SEQ ID NO: 6527928 - DNA, 14 bp, Homo sapiens
ttcaacaaacagtg

SEQ ID NO: 6527929 - DNA, 22 bp, Homo sapiens
ttcaacaaagaaacaaagatgt

SEQ ID NO: 6527930 - DNA, 15 bp, Homo sapiens
ttcaacaaagtattt

SEQ ID NO: 6527931 - DNA, 13 bp, Homo sapiens
ttcaacaaatgat

SEQ ID NO: 6527932 - DNA, 14 bp, Homo sapiens
ttcaacaaatttca

SEQ ID NO: 6527933 - DNA, 15 bp, Homo sapiens
ttcaacaaatttcat

SEQ ID NO: 6527934 - DNA, 17 bp, Homo sapiens
ttcaacaaatttcattg

SEQ ID NO: 6527935 - DNA, 19 bp, Homo sapiens
ttcaacaaatttcattgca

SEQ ID NO: 6527936 - DNA, 20 bp, Homo sapiens
ttcaacaactttgtgctttc

SEQ ID NO: 6527937 - DNA, 22 bp, Homo sapiens
ttcaacaagatttcttaatgct

SEQ ID NO: 6527938 - DNA, 22 bp, Homo sapiens
ttcaacaagcctgaaagtaatt

SEQ ID NO: 6527939 - DNA, 20 bp, Homo sapiens
ttcaacaaggcttgctgcag

SEQ ID NO: 6527940 - DNA, 14 bp, Homo sapiens
ttcaacaattctaa

SEQ ID NO: 6527941 - DNA, 17 bp, Homo sapiens
ttcaacaatttcaataa

SEQ ID NO: 6527942 - DNA, 14 bp, Homo sapiens
ttcaacacagcttg

SEQ ID NO: 6527943 - DNA, 17 bp, Homo sapiens
ttcaacacatttttaag

SEQ ID NO: 6527944 - DNA, 17 bp, Homo sapiens
ttcaacacttattttct

SEQ ID NO: 6527945 - DNA, 22 bp, Homo sapiens
ttcaacagatgaccgtgtacaa

SEQ ID NO: 6527946 - DNA, 19 bp, Homo sapiens
ttcaacagccaagctggca

SEQ ID NO: 6527947 - DNA, 13 bp, Homo sapiens
ttcaacagggaag

SEQ ID NO: 6527948 - DNA, 18 bp, Homo sapiens
ttcaacagtgaagacaga

SEQ ID NO: 6527949 - DNA, 16 bp, Homo sapiens
ttcaacatcaatgttc

SEQ ID NO: 6527950 - DNA, 19 bp, Homo sapiens
ttcaacatcaatgttcatt

SEQ ID NO: 6527951 - DNA, 22 bp, Homo sapiens
ttcaacatcaatgttcattgta

SEQ ID NO: 6527952 - DNA, 14 bp, Homo sapiens
ttcaacatcctgcc

SEQ ID NO: 6527953 - DNA, 12 bp, Homo sapiens
ttcaacattaag

SEQ ID NO: 6527954 - DNA, 22 bp, Homo sapiens
ttcaaccaaggaggaattgaaa

SEQ ID NO: 6527955 - DNA, 18 bp, Homo sapiens
ttcaaccacgcaggaagc

SEQ ID NO: 6527956 - DNA, 14 bp, Homo sapiens
ttcaaccagataac

SEQ ID NO: 6527957 - DNA, 21 bp, Homo sapiens
ttcaaccagcattttactact

SEQ ID NO: 6527958 - DNA, 18 bp, Homo sapiens
ttcaaccagggattgttt

SEQ ID NO: 6527959 - DNA, 21 bp, Homo sapiens
ttcaaccatgaggtaaaagag

SEQ ID NO: 6527960 - DNA, 16 bp, Homo sapiens
ttcaaccattgaaggg

SEQ ID NO: 6527961 - DNA, 14 bp, Homo sapiens
ttcaaccccaccct

SEQ ID NO: 6527962 - DNA, 21 bp, Homo sapiens
ttcaaccccaccctgtttgga

SEQ ID NO: 6527963 - DNA, 18 bp, Homo sapiens
ttcaaccgcttgccatat

SEQ ID NO: 6527964 - DNA, 15 bp, Homo sapiens
ttcaacctaaatact

SEQ ID NO: 6527965 - DNA, 23 bp, Homo sapiens
ttcaacctctagaattttaagcc

SEQ ID NO: 6527966 - DNA, 15 bp, Homo sapiens
ttcaaccttaccaaa

SEQ ID NO: 6527967 - DNA, 17 bp, Homo sapiens
ttcaaccttaccaaaaa

SEQ ID NO: 6527968 - DNA, 13 bp, Homo sapiens
ttcaactattctt

SEQ ID NO: 6527969 - DNA, 18 bp, Homo sapiens
ttcaactattttattatc

SEQ ID NO: 6527970 - DNA, 13 bp, Homo sapiens
ttcaactcagact

SEQ ID NO: 6527971 - DNA, 16 bp, Homo sapiens
tgggcagggaggggct

SEQ ID NO: 6527972 - DNA, 19 bp, Homo sapiens
tgggcagggccctgtggct

SEQ ID NO: 6527973 - DNA, 16 bp, Homo sapiens
tgggcagggccgcagg

SEQ ID NO: 6527974 - DNA, 22 bp, Homo sapiens
tgggcagggccgcagggcgctc

SEQ ID NO: 6527975 - DNA, 18 bp, Homo sapiens
tgggcaggtcctggggag

SEQ ID NO: 6527976 - DNA, 20 bp, Homo sapiens
tgggcaggtggccgcccctg

SEQ ID NO: 6527977 - DNA, 23 bp, Homo sapiens
tgggcaggtggccgcccctgagg

SEQ ID NO: 6527978 - DNA, 22 bp, Homo sapiens
tgggcaggtggcctctgctggt

SEQ ID NO: 6527979 - DNA, 16 bp, Homo sapiens
tgggcaggtgggagct

SEQ ID NO: 6527980 - DNA, 19 bp, Homo sapiens
tgggcaggtgggagctgaa

SEQ ID NO: 6527981 - DNA, 17 bp, Homo sapiens
tgggcaggtggtggcac

SEQ ID NO: 6527982 - DNA, 19 bp, Homo sapiens
tgggcaggttcctggggcc

SEQ ID NO: 6527983 - DNA, 22 bp, Homo sapiens
tgggcaggttcctggggccgcc

SEQ ID NO: 6527984 - DNA, 23 bp, Homo sapiens
tgggcaggttcctggggccgcct

SEQ ID NO: 6527985 - DNA, 22 bp, Homo sapiens
tgggcagtcaccacccagccct

SEQ ID NO: 6527986 - DNA, 14 bp, Homo sapiens
tgggcagtcatttt

SEQ ID NO: 6527987 - DNA, 20 bp, Homo sapiens
tgggcagtctttcttgaaat

SEQ ID NO: 6527988 - DNA, 23 bp, Homo sapiens
tgggcagtctttcttgaaattga

SEQ ID NO: 6527989 - DNA, 12 bp, Homo sapiens
tgggcagtgcca

SEQ ID NO: 6527990 - DNA, 13 bp, Homo sapiens
tgggcagtgccac

SEQ ID NO: 6527991 - DNA, 17 bp, Homo sapiens
tgggcagtgccacagcc

SEQ ID NO: 6527992 - DNA, 21 bp, Homo sapiens
tgggcagtgccacagcctgct

SEQ ID NO: 6527993 - DNA, 18 bp, Homo sapiens
tgggcagtgccacccgca

SEQ ID NO: 6527994 - DNA, 20 bp, Homo sapiens
tgggcagtgccccagggagt

SEQ ID NO: 6527995 - DNA, 24 bp, Homo sapiens
tgggcagtgccccagggagtccag

SEQ ID NO: 6527996 - DNA, 17 bp, Homo sapiens
tgggcagtgcctcctgg

SEQ ID NO: 6527997 - DNA, 20 bp, Homo sapiens
tgggcagtgcctcctgggac

SEQ ID NO: 6527998 - DNA, 17 bp, Homo sapiens
tgggcagtggagagggg

SEQ ID NO: 6527999 - DNA, 18 bp, Homo sapiens
tgggcagtggagagggga

SEQ ID NO: 6528000 - DNA, 14 bp, Homo sapiens
tgggcagtgtggcc

SEQ ID NO: 6528001 - DNA, 18 bp, Homo sapiens
tgggcagtgtggcctctt

SEQ ID NO: 6528002 - DNA, 17 bp, Homo sapiens
tgggcagttctcccagg

SEQ ID NO: 6528003 - DNA, 23 bp, Homo sapiens
tgggcagttctcccagggagtga

SEQ ID NO: 6528004 - DNA, 17 bp, Homo sapiens
tgggcagttgggagtga

SEQ ID NO: 6528005 - DNA, 24 bp, Homo sapiens
tgggcagttggggcggcccacgcc

SEQ ID NO: 6528006 - DNA, 18 bp, Homo sapiens
tgggcagtttttctgtat

SEQ ID NO: 6528007 - DNA, 15 bp, Homo sapiens
tgggcagttttttga

SEQ ID NO: 6528008 - DNA, 15 bp, Homo sapiens
tgggcataagcaaac

SEQ ID NO: 6528009 - DNA, 22 bp, Homo sapiens
tgggcataagcaaactatattt

SEQ ID NO: 6528010 - DNA, 16 bp, Homo sapiens
tgggcatagatgcagg

SEQ ID NO: 6528011 - DNA, 22 bp, Homo sapiens
tgggcatagatgcaggtgagcc

SEQ ID NO: 6528012 - DNA, 15 bp, Homo sapiens
tgggcatagtcagtg

SEQ ID NO: 6528013 - DNA, 23 bp, Homo sapiens
tgggcatcagggcctttctcctc

SEQ ID NO: 6528014 - DNA, 14 bp, Homo sapiens
tgggcatcatttta

SEQ ID NO: 6528015 - DNA, 16 bp, Homo sapiens
tgggcatccacccagt

SEQ ID NO: 6528016 - DNA, 23 bp, Homo sapiens
tgggcatccacccagtgctgcca

SEQ ID NO: 6528017 - DNA, 15 bp, Homo sapiens
tgggcatcccagctt

SEQ ID NO: 6528018 - DNA, 20 bp, Homo sapiens
tgggcatcccagcttgcccc

SEQ ID NO: 6528019 - DNA, 21 bp, Homo sapiens
tgggcatcccagcttgccccc

SEQ ID NO: 6528020 - DNA, 18 bp, Homo sapiens
tgggcatccctcctggta

SEQ ID NO: 6528021 - DNA, 14 bp, Homo sapiens
tgggcatctggccc

SEQ ID NO: 6528022 - DNA, 23 bp, Homo sapiens
tgggcatctggccctgctgcccc

SEQ ID NO: 6528023 - DNA, 17 bp, Homo sapiens
tgggcatctgttctggt

SEQ ID NO: 6528024 - DNA, 17 bp, Homo sapiens
tgggcatcttctggctt

SEQ ID NO: 6528025 - DNA, 19 bp, Homo sapiens
tgggcatcttttgtattaa

SEQ ID NO: 6528026 - DNA, 20 bp, Homo sapiens
tgggcatgacatcctttctt

SEQ ID NO: 6528027 - DNA, 13 bp, Homo sapiens
tgggcatgccacc

SEQ ID NO: 6528028 - DNA, 14 bp, Homo sapiens
tgggcatgccaccc

SEQ ID NO: 6528029 - DNA, 22 bp, Homo sapiens
tgggcatgccaccctcacacac

SEQ ID NO: 6528030 - DNA, 17 bp, Homo sapiens
tgggcatgctcagccct

SEQ ID NO: 6528031 - DNA, 18 bp, Homo sapiens
tgggcatggcagggccag

SEQ ID NO: 6528032 - DNA, 22 bp, Homo sapiens
tgggcatggcagggccaggcct

SEQ ID NO: 6528033 - DNA, 13 bp, Homo sapiens
tgggcatggggtg

SEQ ID NO: 6528034 - DNA, 22 bp, Homo sapiens
tgggcatggggtgggcctctgg

SEQ ID NO: 6528035 - DNA, 18 bp, Homo sapiens
tgggcatgggtccagggc

SEQ ID NO: 6528036 - DNA, 20 bp, Homo sapiens
tgggcatgggtccagggcct

SEQ ID NO: 6528037 - DNA, 14 bp, Homo sapiens
tgggcatgtgggct

SEQ ID NO: 6528038 - DNA, 23 bp, Homo sapiens
tgggcattactgtttaagacact

SEQ ID NO: 6528039 - DNA, 16 bp, Homo sapiens
tgggcattagcaaggc

SEQ ID NO: 6528040 - DNA, 18 bp, Homo sapiens
tgggcattagcaaggcag

SEQ ID NO: 6528041 - DNA, 21 bp, Homo sapiens
tgggcattagcaaggcagagc

SEQ ID NO: 6528042 - DNA, 23 bp, Homo sapiens
tgggcattagtgtccccccttga

SEQ ID NO: 6528043 - DNA, 14 bp, Homo sapiens
tgggcattctctct

SEQ ID NO: 6528044 - DNA, 15 bp, Homo sapiens
tgggcattgcagcct

SEQ ID NO: 6528045 - DNA, 18 bp, Homo sapiens
tgggcattgccatgtgga

SEQ ID NO: 6528046 - DNA, 13 bp, Homo sapiens
tgggcattgggct

SEQ ID NO: 6528047 - DNA, 16 bp, Homo sapiens
tgggcattgggctgac

SEQ ID NO: 6528048 - DNA, 19 bp, Homo sapiens
tgggcattgggttctaaag

SEQ ID NO: 6528049 - DNA, 13 bp, Homo sapiens
tgggcatttattt

SEQ ID NO: 6528050 - DNA, 19 bp, Homo sapiens
tgggcatttattttataac

SEQ ID NO: 6528051 - DNA, 21 bp, Homo sapiens
tgggcatttcacgaactgttc

SEQ ID NO: 6528052 - DNA, 22 bp, Homo sapiens
tgggcatttctaaaatgttaaa

SEQ ID NO: 6528053 - DNA, 16 bp, Homo sapiens
tgggcatttgtgaggc

SEQ ID NO: 6528054 - DNA, 20 bp, Homo sapiens
tgggcattttacaagaagta

SEQ ID NO: 6528055 - DNA, 19 bp, Homo sapiens
tgggcattttcctcctctg

SEQ ID NO: 6528056 - DNA, 14 bp, Homo sapiens
tgggcattttttta

SEQ ID NO: 6528057 - DNA, 20 bp, Homo sapiens
tgggccaaaagggcagccag

SEQ ID NO: 6528058 - DNA, 21 bp, Homo sapiens
tgggccaaaagggcagccagg

SEQ ID NO: 6528059 - DNA, 21 bp, Homo sapiens
tgggccaaatccgctctcttc

SEQ ID NO: 6528060 - DNA, 14 bp, Homo sapiens
tgggccaagccagc

SEQ ID NO: 6528061 - DNA, 15 bp, Homo sapiens
tgggccaagccagct

SEQ ID NO: 6528062 - DNA, 21 bp, Homo sapiens
tgggccaagccagctgcctag

SEQ ID NO: 6528063 - DNA, 16 bp, Homo sapiens
tgggccaattaaaata

SEQ ID NO: 6528064 - DNA, 20 bp, Homo sapiens
tgggccaatttactggccac

SEQ ID NO: 6528065 - DNA, 16 bp, Homo sapiens
tgggccaccagggatc

SEQ ID NO: 6528066 - DNA, 12 bp, Homo sapiens
tgggccacccac

SEQ ID NO: 6528067 - DNA, 14 bp, Homo sapiens
tgggccacccacca

SEQ ID NO: 6528068 - DNA, 21 bp, Homo sapiens
tgggccacccaccagggctca

SEQ ID NO: 6528069 - DNA, 17 bp, Homo sapiens
tgggccacccctcctag

SEQ ID NO: 6528070 - DNA, 16 bp, Homo sapiens
tgggccaccgccttgc

SEQ ID NO: 6528071 - DNA, 17 bp, Homo sapiens
tgggccaccgccttgcc

SEQ ID NO: 6528072 - DNA, 17 bp, Homo sapiens
tgggccaccggggcaag

SEQ ID NO: 6528073 - DNA, 19 bp, Homo sapiens
tgggccaccgtgcctggct

SEQ ID NO: 6528074 - DNA, 20 bp, Homo sapiens
tgggccacctcctacccctt

SEQ ID NO: 6528075 - DNA, 18 bp, Homo sapiens
tgggccacgccggccaca

SEQ ID NO: 6528076 - DNA, 16 bp, Homo sapiens
tgggccacggaggagg

SEQ ID NO: 6528077 - DNA, 15 bp, Homo sapiens
tgggccactcctctt

SEQ ID NO: 6528078 - DNA, 21 bp, Homo sapiens
tgggccactctcccctccctc

SEQ ID NO: 6528079 - DNA, 22 bp, Homo sapiens
tgggccactgcactctagcctg

SEQ ID NO: 6528080 - DNA, 13 bp, Homo sapiens
tgggccactgcca

SEQ ID NO: 6528081 - DNA, 22 bp, Homo sapiens
tgggccactggggactttattt

SEQ ID NO: 6528082 - DNA, 15 bp, Homo sapiens
tgggccactgtggtg

SEQ ID NO: 6528083 - DNA, 18 bp, Homo sapiens
tgggccagaatttcaaac

SEQ ID NO: 6528084 - DNA, 13 bp, Homo sapiens
tgggccagacatg

SEQ ID NO: 6528085 - DNA, 11 bp, Homo sapiens
tgggccagagc

SEQ ID NO: 6528086 - DNA, 13 bp, Homo sapiens
tgggccagagctg

SEQ ID NO: 6528087 - DNA, 14 bp, Homo sapiens
tgggccagagctga

SEQ ID NO: 6528088 - DNA, 13 bp, Homo sapiens
tgggccagagttg

SEQ ID NO: 6528089 - DNA, 17 bp, Homo sapiens
tgggccagcagagcatg

SEQ ID NO: 6528090 - DNA, 22 bp, Homo sapiens
tgggccagcataggggggaggg

SEQ ID NO: 6528091 - DNA, 22 bp, Homo sapiens
tgggccagcccctccatctgta

SEQ ID NO: 6528092 - DNA, 18 bp, Homo sapiens
tgggccagcccctcccac

SEQ ID NO: 6528093 - DNA, 13 bp, Homo sapiens
tgggccagccctg

SEQ ID NO: 6528094 - DNA, 20 bp, Homo sapiens
tgggccagccctgcagccca

SEQ ID NO: 6528095 - DNA, 21 bp, Homo sapiens
tgggccagccctgcagcccaa

SEQ ID NO: 6528096 - DNA, 16 bp, Homo sapiens
tgggccagcccttgct

SEQ ID NO: 6528097 - DNA, 23 bp, Homo sapiens
tgggccagcccttgctctacctg

SEQ ID NO: 6528098 - DNA, 15 bp, Homo sapiens
tgggccagcctcagc

SEQ ID NO: 6528099 - DNA, 20 bp, Homo sapiens
tgggccagcggggctgctca

SEQ ID NO: 6528100 - DNA, 17 bp, Homo sapiens
tgggccaggacaggccc

SEQ ID NO: 6528101 - DNA, 14 bp, Homo sapiens
tgggccaggagcct

SEQ ID NO: 6528102 - DNA, 16 bp, Homo sapiens
tgggccaggagcctcc

SEQ ID NO: 6528103 - DNA, 19 bp, Homo sapiens
tgggccaggatccccctct

SEQ ID NO: 6528104 - DNA, 13 bp, Homo sapiens
tgggccaggcagg

SEQ ID NO: 6528105 - DNA, 10 bp, Homo sapiens
tgggccaggg

SEQ ID NO: 6528106 - DNA, 13 bp, Homo sapiens
tgggccagggaaa

SEQ ID NO: 6528107 - DNA, 21 bp, Homo sapiens
tgggccagggtctcgtcagga

SEQ ID NO: 6528108 - DNA, 14 bp, Homo sapiens
tgggccagggtctg

SEQ ID NO: 6528109 - DNA, 12 bp, Homo sapiens
tgggccaggtct

SEQ ID NO: 6528110 - DNA, 18 bp, Homo sapiens
tgggccagtccccgagga

SEQ ID NO: 6528111 - DNA, 12 bp, Homo sapiens
tgggccagtcct

SEQ ID NO: 6528112 - DNA, 16 bp, Homo sapiens
tgggccagtctgtgga

SEQ ID NO: 6528113 - DNA, 12 bp, Homo sapiens
tgggccagtggc

SEQ ID NO: 6528114 - DNA, 17 bp, Homo sapiens
tgggccagtggctgggg

SEQ ID NO: 6528115 - DNA, 14 bp, Homo sapiens
tgggccagtgtggg

SEQ ID NO: 6528116 - DNA, 16 bp, Homo sapiens
tgggccatactggcct

SEQ ID NO: 6528117 - DNA, 20 bp, Homo sapiens
tgggccatactggcctcgcc

SEQ ID NO: 6528118 - DNA, 19 bp, Homo sapiens
tgggccatccttccgccaa

SEQ ID NO: 6528119 - DNA, 14 bp, Homo sapiens
tgggccatgcgagg

SEQ ID NO: 6528120 - DNA, 19 bp, Homo sapiens
tgggccatgggtcctcggc

SEQ ID NO: 6528121 - DNA, 18 bp, Homo sapiens
tgggccatgtccaaagag

SEQ ID NO: 6528122 - DNA, 19 bp, Homo sapiens
tgggccatgtccaaagagg

SEQ ID NO: 6528123 - DNA, 16 bp, Homo sapiens
tgggccattaccccat

SEQ ID NO: 6528124 - DNA, 19 bp, Homo sapiens
tgggccattctccacagca

SEQ ID NO: 6528125 - DNA, 19 bp, Homo sapiens
tgggcccaaaggcccaggg

SEQ ID NO: 6528126 - DNA, 14 bp, Homo sapiens
tgggcccaaccctg

SEQ ID NO: 6528127 - DNA, 15 bp, Homo sapiens
tgggcccaagaactg

SEQ ID NO: 6528128 - DNA, 20 bp, Homo sapiens
tgggcccaagaactgcagat

SEQ ID NO: 6528129 - DNA, 20 bp, Homo sapiens
tgggcccaatgcactttgtt

SEQ ID NO: 6528130 - DNA, 16 bp, Homo sapiens
tgggcccacacctcct

SEQ ID NO: 6528131 - DNA, 20 bp, Homo sapiens
tgggcccacacctccttccc

SEQ ID NO: 6528132 - DNA, 13 bp, Homo sapiens
tgggcccacagag

SEQ ID NO: 6528133 - DNA, 17 bp, Homo sapiens
tgggcccacagagatgc

SEQ ID NO: 6528134 - DNA, 15 bp, Homo sapiens
tgggcccacagagcc

SEQ ID NO: 6528135 - DNA, 16 bp, Homo sapiens
tgggcccacagagcct

SEQ ID NO: 6528136 - DNA, 17 bp, Homo sapiens
tgggcccacagagcctg

SEQ ID NO: 6528137 - DNA, 20 bp, Homo sapiens
tgggcccacagagcctggct

SEQ ID NO: 6528138 - DNA, 14 bp, Homo sapiens
tgggcccacagccc

SEQ ID NO: 6528139 - DNA, 22 bp, Homo sapiens
tgggcccacccaagcaggaggc

SEQ ID NO: 6528140 - DNA, 14 bp, Homo sapiens
tgggcccagaactg

SEQ ID NO: 6528141 - DNA, 19 bp, Homo sapiens
tgggcccagaactgccccc

SEQ ID NO: 6528142 - DNA, 21 bp, Homo sapiens
tgggcccagaactgcccccac

SEQ ID NO: 6528143 - DNA, 12 bp, Homo sapiens
tgggcccagaag

SEQ ID NO: 6528144 - DNA, 22 bp, Homo sapiens
tgggcccagaccactgtctcca

SEQ ID NO: 6528145 - DNA, 11 bp, Homo sapiens
tgggcccagag

SEQ ID NO: 6528146 - DNA, 23 bp, Homo sapiens
tgggcccagaggagaggagacag

SEQ ID NO: 6528147 - DNA, 18 bp, Homo sapiens
tgggcccagaggcacagc

SEQ ID NO: 6528148 - DNA, 19 bp, Homo sapiens
tgggcccagaggcacagcc

SEQ ID NO: 6528149 - DNA, 12 bp, Homo sapiens
ttcaactccaga

SEQ ID NO: 6528150 - DNA, 13 bp, Homo sapiens
ttcaactcctggc

SEQ ID NO: 6528151 - DNA, 17 bp, Homo sapiens
ttcaactctgaatcaaa

SEQ ID NO: 6528152 - DNA, 15 bp, Homo sapiens
ttcaactctgtgagg

SEQ ID NO: 6528153 - DNA, 16 bp, Homo sapiens
ttcaactgcccagcaa

SEQ ID NO: 6528154 - DNA, 13 bp, Homo sapiens
ttcaactgctttg

SEQ ID NO: 6528155 - DNA, 18 bp, Homo sapiens
ttcaactggaaattaaaa

SEQ ID NO: 6528156 - DNA, 12 bp, Homo sapiens
ttcaactggaac

SEQ ID NO: 6528157 - DNA, 23 bp, Homo sapiens
ttcaactgtataccgtgtgctcc

SEQ ID NO: 6528158 - DNA, 15 bp, Homo sapiens
ttcaactgtcttcct

SEQ ID NO: 6528159 - DNA, 19 bp, Homo sapiens
ttcaactgtcttcctcaaa

SEQ ID NO: 6528160 - DNA, 19 bp, Homo sapiens
ttcaacttattaacaatta

SEQ ID NO: 6528161 - DNA, 19 bp, Homo sapiens
ttcaacttatttcataatt

SEQ ID NO: 6528162 - DNA, 21 bp, Homo sapiens
ttcaacttatttcataattgc

SEQ ID NO: 6528163 - DNA, 17 bp, Homo sapiens
ttcaacttatttctgaa

SEQ ID NO: 6528164 - DNA, 16 bp, Homo sapiens
ttcaacttcaggaaag

SEQ ID NO: 6528165 - DNA, 22 bp, Homo sapiens
ttcaacttcttctatatccaaa

SEQ ID NO: 6528166 - DNA, 16 bp, Homo sapiens
ttcaactttgaataaa

SEQ ID NO: 6528167 - DNA, 20 bp, Homo sapiens
ttcaactttgaataaagaat

SEQ ID NO: 6528168 - DNA, 14 bp, Homo sapiens
ttcaagaaaataaa

SEQ ID NO: 6528169 - DNA, 23 bp, Homo sapiens
ttcaagaaactgaggaattttct

SEQ ID NO: 6528170 - DNA, 17 bp, Homo sapiens
ttcaagaaagatatcta

SEQ ID NO: 6528171 - DNA, 18 bp, Homo sapiens
ttcaagaaagatatctat

SEQ ID NO: 6528172 - DNA, 21 bp, Homo sapiens
ttcaagaaagccagtcttaac

SEQ ID NO: 6528173 - DNA, 12 bp, Homo sapiens
ttcaagaaataa

SEQ ID NO: 6528174 - DNA, 15 bp, Homo sapiens
ttcaagaaatgaaga

SEQ ID NO: 6528175 - DNA, 16 bp, Homo sapiens
ttcaagaacaagcaat

SEQ ID NO: 6528176 - DNA, 16 bp, Homo sapiens
ttcaagaacctggaaa

SEQ ID NO: 6528177 - DNA, 15 bp, Homo sapiens
ttcaagaacttgttt

SEQ ID NO: 6528178 - DNA, 20 bp, Homo sapiens
ttcaagaagacggattatct

SEQ ID NO: 6528179 - DNA, 23 bp, Homo sapiens
ttcaagaagtatttttttaattt

SEQ ID NO: 6528180 - DNA, 23 bp, Homo sapiens
ttcaagaagtcccctctcctcca

SEQ ID NO: 6528181 - DNA, 23 bp, Homo sapiens
ttcaagaagttctttgattctgt

SEQ ID NO: 6528182 - DNA, 17 bp, Homo sapiens
ttcaagaatcagacagc

SEQ ID NO: 6528183 - DNA, 16 bp, Homo sapiens
ttcaagaatgaaaaat

SEQ ID NO: 6528184 - DNA, 17 bp, Homo sapiens
ttcaagaatgaaaaata

SEQ ID NO: 6528185 - DNA, 18 bp, Homo sapiens
ttcaagaatgaaaaatat

SEQ ID NO: 6528186 - DNA, 20 bp, Homo sapiens
ttcaagaatgaaaaatataa

SEQ ID NO: 6528187 - DNA, 14 bp, Homo sapiens
ttcaagaatgtttc

SEQ ID NO: 6528188 - DNA, 13 bp, Homo sapiens
ttcaagacaagag

SEQ ID NO: 6528189 - DNA, 21 bp, Homo sapiens
ttcaagacaccaaattccaaa

SEQ ID NO: 6528190 - DNA, 17 bp, Homo sapiens
ttcaagaccagcctggc

SEQ ID NO: 6528191 - DNA, 17 bp, Homo sapiens
ttcaagacgaggggcag

SEQ ID NO: 6528192 - DNA, 19 bp, Homo sapiens
ttcaagactgaaatggctt

SEQ ID NO: 6528193 - DNA, 18 bp, Homo sapiens
ttcaagactgaattccaa

SEQ ID NO: 6528194 - DNA, 13 bp, Homo sapiens
ttcaagacttgat

SEQ ID NO: 6528195 - DNA, 14 bp, Homo sapiens
ttcaagacttgata

SEQ ID NO: 6528196 - DNA, 16 bp, Homo sapiens
ttcaagagaagaaaaa

SEQ ID NO: 6528197 - DNA, 12 bp, Homo sapiens
ttcaagagattc

SEQ ID NO: 6528198 - DNA, 18 bp, Homo sapiens
ttcaagagctagaaaaat

SEQ ID NO: 6528199 - DNA, 20 bp, Homo sapiens
ttcaagagctagaaaaataa

SEQ ID NO: 6528200 - DNA, 15 bp, Homo sapiens
ttcaagaggagcccc

SEQ ID NO: 6528201 - DNA, 17 bp, Homo sapiens
ttcaagatcccatttga

SEQ ID NO: 6528202 - DNA, 22 bp, Homo sapiens
ttcaagatcctcttgccacatc

SEQ ID NO: 6528203 - DNA, 23 bp, Homo sapiens
ttcaagatctaaatcatatataa

SEQ ID NO: 6528204 - DNA, 15 bp, Homo sapiens
ttcaagattctaaag

SEQ ID NO: 6528205 - DNA, 21 bp, Homo sapiens
ttcaagattctaaagctcaat

SEQ ID NO: 6528206 - DNA, 16 bp, Homo sapiens
ttcaagcaaaacagtt

SEQ ID NO: 6528207 - DNA, 13 bp, Homo sapiens
ttcaagcaaacat

SEQ ID NO: 6528208 - DNA, 17 bp, Homo sapiens
ttcaagcaaacatcaaa

SEQ ID NO: 6528209 - DNA, 17 bp, Homo sapiens
ttcaagcaatcctccta

SEQ ID NO: 6528210 - DNA, 21 bp, Homo sapiens
ttcaagcaccctgttccctct

SEQ ID NO: 6528211 - DNA, 17 bp, Homo sapiens
ttcaagcagattggaga

SEQ ID NO: 6528212 - DNA, 16 bp, Homo sapiens
ttcaagcagcatcttc

SEQ ID NO: 6528213 - DNA, 17 bp, Homo sapiens
ttcaagcatcctcagaa

SEQ ID NO: 6528214 - DNA, 23 bp, Homo sapiens
ttcaagcatctcctgaggatcag

SEQ ID NO: 6528215 - DNA, 15 bp, Homo sapiens
ttcaagcattaagaa

SEQ ID NO: 6528216 - DNA, 17 bp, Homo sapiens
ttcaagccagctctagg

SEQ ID NO: 6528217 - DNA, 20 bp, Homo sapiens
ttcaagcccaggcttcctgg

SEQ ID NO: 6528218 - DNA, 23 bp, Homo sapiens
ttcaagccctcctccccagagct

SEQ ID NO: 6528219 - DNA, 16 bp, Homo sapiens
ttcaagcctctaaaca

SEQ ID NO: 6528220 - DNA, 17 bp, Homo sapiens
ttcaagcctctaaacag

SEQ ID NO: 6528221 - DNA, 18 bp, Homo sapiens
ttcaagcctctaaacaga

SEQ ID NO: 6528222 - DNA, 14 bp, Homo sapiens
ttcaagcctgtggg

SEQ ID NO: 6528223 - DNA, 20 bp, Homo sapiens
ttcaagcctgtgggagtaga

SEQ ID NO: 6528224 - DNA, 18 bp, Homo sapiens
ttcaagcgactctcctgc

SEQ ID NO: 6528225 - DNA, 15 bp, Homo sapiens
ttcaagcgattctca

SEQ ID NO: 6528226 - DNA, 20 bp, Homo sapiens
ttcaagcgattctcccgcct

SEQ ID NO: 6528227 - DNA, 21 bp, Homo sapiens
ttcaagcgattctcctgcctc

SEQ ID NO: 6528228 - DNA, 22 bp, Homo sapiens
ttcaagcgattctcctgcctca

SEQ ID NO: 6528229 - DNA, 22 bp, Homo sapiens
ttcaagcgattcttgtgcctca

SEQ ID NO: 6528230 - DNA, 18 bp, Homo sapiens
ttcaagctcaccctgctc

SEQ ID NO: 6528231 - DNA, 20 bp, Homo sapiens
ttcaagctcaccctgctcct

SEQ ID NO: 6528232 - DNA, 16 bp, Homo sapiens
ttcaagctcatgtcat

SEQ ID NO: 6528233 - DNA, 19 bp, Homo sapiens
ttcaagctcatgtcattat

SEQ ID NO: 6528234 - DNA, 22 bp, Homo sapiens
ttcaagctctctgttgcgctcc

SEQ ID NO: 6528235 - DNA, 12 bp, Homo sapiens
ttcaagctctga

SEQ ID NO: 6528236 - DNA, 16 bp, Homo sapiens
ttcaagctctgaggga

SEQ ID NO: 6528237 - DNA, 16 bp, Homo sapiens
ttcaagctgagaaaag

SEQ ID NO: 6528238 - DNA, 11 bp, Homo sapiens
ttcaagctgca

SEQ ID NO: 6528239 - DNA, 20 bp, Homo sapiens
ttcaagctgtcccctctgtc

SEQ ID NO: 6528240 - DNA, 11 bp, Homo sapiens
ttcaagctttc

SEQ ID NO: 6528241 - DNA, 16 bp, Homo sapiens
ttcaagctttttgtga

SEQ ID NO: 6528242 - DNA, 21 bp, Homo sapiens
ttcaagctttttgtgagaaag

SEQ ID NO: 6528243 - DNA, 20 bp, Homo sapiens
ttcaaggaaaaatgctgctt

SEQ ID NO: 6528244 - DNA, 22 bp, Homo sapiens
ttcaaggaaaataagtgaaatt

SEQ ID NO: 6528245 - DNA, 23 bp, Homo sapiens
ttcaaggaaaataagtgaaattt

SEQ ID NO: 6528246 - DNA, 13 bp, Homo sapiens
ttcaaggaagaaa

SEQ ID NO: 6528247 - DNA, 20 bp, Homo sapiens
ttcaaggaagaaaacggaaa

SEQ ID NO: 6528248 - DNA, 21 bp, Homo sapiens
ttcaaggactaacgaacgttt

SEQ ID NO: 6528249 - DNA, 15 bp, Homo sapiens
ttcaaggactagaac

SEQ ID NO: 6528250 - DNA, 19 bp, Homo sapiens
ttcaaggagcaagaaatga

SEQ ID NO: 6528251 - DNA, 16 bp, Homo sapiens
ttcaaggaggcccact

SEQ ID NO: 6528252 - DNA, 19 bp, Homo sapiens
ttcaaggagtatgcaggga

SEQ ID NO: 6528253 - DNA, 16 bp, Homo sapiens
ttcaaggcacattgaa

SEQ ID NO: 6528254 - DNA, 22 bp, Homo sapiens
ttcaaggcactctagattccat

SEQ ID NO: 6528255 - DNA, 20 bp, Homo sapiens
ttcaaggcatcatgcagagt

SEQ ID NO: 6528256 - DNA, 16 bp, Homo sapiens
ttcaaggccatccttc

SEQ ID NO: 6528257 - DNA, 17 bp, Homo sapiens
ttcaaggccatccttcc

SEQ ID NO: 6528258 - DNA, 10 bp, Homo sapiens
ttcaaggcct

SEQ ID NO: 6528259 - DNA, 11 bp, Homo sapiens
ttcaaggcctt

SEQ ID NO: 6528260 - DNA, 14 bp, Homo sapiens
ttcaaggccttcag

SEQ ID NO: 6528261 - DNA, 17 bp, Homo sapiens
ttcaaggccttcagttt

SEQ ID NO: 6528262 - DNA, 15 bp, Homo sapiens
ttcaaggctggggca

SEQ ID NO: 6528263 - DNA, 15 bp, Homo sapiens
ttcaaggcttccact

SEQ ID NO: 6528264 - DNA, 22 bp, Homo sapiens
ttcaagggaattaaataaataa

SEQ ID NO: 6528265 - DNA, 15 bp, Homo sapiens
ttcaagggtaatctt

SEQ ID NO: 6528266 - DNA, 20 bp, Homo sapiens
ttcaaggtaaaattctaaat

SEQ ID NO: 6528267 - DNA, 22 bp, Homo sapiens
ttcaaggtcactgtttcctggg

SEQ ID NO: 6528268 - DNA, 17 bp, Homo sapiens
ttcaaggtctgcttttc

SEQ ID NO: 6528269 - DNA, 14 bp, Homo sapiens
ttcaaggtgacaga

SEQ ID NO: 6528270 - DNA, 14 bp, Homo sapiens
ttcaaggttctaac

SEQ ID NO: 6528271 - DNA, 15 bp, Homo sapiens
ttcaaggttctaacc

SEQ ID NO: 6528272 - DNA, 15 bp, Homo sapiens
ttcaagtaacacttt

SEQ ID NO: 6528273 - DNA, 22 bp, Homo sapiens
ttcaagtaagtagatgcctgtt

SEQ ID NO: 6528274 - DNA, 15 bp, Homo sapiens
ttcaagtaattctgc

SEQ ID NO: 6528275 - DNA, 16 bp, Homo sapiens
ttcaagtaattttcat

SEQ ID NO: 6528276 - DNA, 21 bp, Homo sapiens
ttcaagtactgtaactgtgtc

SEQ ID NO: 6528277 - DNA, 20 bp, Homo sapiens
ttcaagtagctgggatttta

SEQ ID NO: 6528278 - DNA, 15 bp, Homo sapiens
ttcaagtatctaact

SEQ ID NO: 6528279 - DNA, 17 bp, Homo sapiens
ttcaagtattatatttt

SEQ ID NO: 6528280 - DNA, 14 bp, Homo sapiens
ttcaagtatttaag

SEQ ID NO: 6528281 - DNA, 19 bp, Homo sapiens
ttcaagtcagttctgtgat

SEQ ID NO: 6528282 - DNA, 22 bp, Homo sapiens
ttcaagtcattccacacatttc

SEQ ID NO: 6528283 - DNA, 17 bp, Homo sapiens
ttcaagtgaaaccagct

SEQ ID NO: 6528284 - DNA, 17 bp, Homo sapiens
ttcaagtgactctcctg

SEQ ID NO: 6528285 - DNA, 17 bp, Homo sapiens
ttcaagtgatatatgta

SEQ ID NO: 6528286 - DNA, 17 bp, Homo sapiens
ttcaagtgatctttcaa

SEQ ID NO: 6528287 - DNA, 20 bp, Homo sapiens
ttcaagtgattctcatgcct

SEQ ID NO: 6528288 - DNA, 22 bp, Homo sapiens
ttcaagtgattctcatgcctca

SEQ ID NO: 6528289 - DNA, 14 bp, Homo sapiens
ttcaagtgcaatcc

SEQ ID NO: 6528290 - DNA, 11 bp, Homo sapiens
ttcaagtgcct

SEQ ID NO: 6528291 - DNA, 18 bp, Homo sapiens
ttcaagtgcctagactgt

SEQ ID NO: 6528292 - DNA, 20 bp, Homo sapiens
ttcaagtgcctcttgttgca

SEQ ID NO: 6528293 - DNA, 14 bp, Homo sapiens
ttcaagtgctaaaa

SEQ ID NO: 6528294 - DNA, 19 bp, Homo sapiens
ttcaagtgcttaaaaatac

SEQ ID NO: 6528295 - DNA, 12 bp, Homo sapiens
ttcaagttattc

SEQ ID NO: 6528296 - DNA, 20 bp, Homo sapiens
ttcaagttattcaaatttgt

SEQ ID NO: 6528297 - DNA, 20 bp, Homo sapiens
ttcaagttattgtacagctg

SEQ ID NO: 6528298 - DNA, 13 bp, Homo sapiens
ttcaagttgtaaa

SEQ ID NO: 6528299 - DNA, 19 bp, Homo sapiens
ttcaagttgtgtctgaaaa

SEQ ID NO: 6528300 - DNA, 15 bp, Homo sapiens
ttcaagtttacactt

SEQ ID NO: 6528301 - DNA, 22 bp, Homo sapiens
ttcaagtttgctgcaacccaag

SEQ ID NO: 6528302 - DNA, 18 bp, Homo sapiens
ttcaagttttaaagttca

SEQ ID NO: 6528303 - DNA, 22 bp, Homo sapiens
ttcaagttttgggtatgtttaa

SEQ ID NO: 6528304 - DNA, 17 bp, Homo sapiens
ttcaagtttttcatact

SEQ ID NO: 6528305 - DNA, 19 bp, Homo sapiens
ttcaagtttttcatactgt

SEQ ID NO: 6528306 - DNA, 21 bp, Homo sapiens
ttcaagtttttcatactgtac

SEQ ID NO: 6528307 - DNA, 22 bp, Homo sapiens
ttcaagtttttcatactgtaca

SEQ ID NO: 6528308 - DNA, 23 bp, Homo sapiens
ttcaataaaaaaaagaaatgaaa

SEQ ID NO: 6528309 - DNA, 22 bp, Homo sapiens
ttcaataaaccacaagcatctc

SEQ ID NO: 6528310 - DNA, 17 bp, Homo sapiens
ttcaataaagaaaaaaa

SEQ ID NO: 6528311 - DNA, 16 bp, Homo sapiens
ttcaataaagcattta

SEQ ID NO: 6528312 - DNA, 21 bp, Homo sapiens
ttcaataaagtatttaattag

SEQ ID NO: 6528313 - DNA, 12 bp, Homo sapiens
ttcaataaagtt

SEQ ID NO: 6528314 - DNA, 13 bp, Homo sapiens
ttcaataaagttg

SEQ ID NO: 6528315 - DNA, 19 bp, Homo sapiens
ttcaataaagttgttgcat

SEQ ID NO: 6528316 - DNA, 20 bp, Homo sapiens
ttcaataaagttgttgcatt

SEQ ID NO: 6528317 - DNA, 13 bp, Homo sapiens
ttcaataaagttt

SEQ ID NO: 6528318 - DNA, 18 bp, Homo sapiens
ttcaataaagtttgatct

SEQ ID NO: 6528319 - DNA, 16 bp, Homo sapiens
ttcaataaatgatata

SEQ ID NO: 6528320 - DNA, 18 bp, Homo sapiens
ttcaataaatgtctgttg

SEQ ID NO: 6528321 - DNA, 16 bp, Homo sapiens
ttcaataactggaaca

SEQ ID NO: 6528322 - DNA, 22 bp, Homo sapiens
ttcaataactggaacactctat

SEQ ID NO: 6528323 - DNA, 22 bp, Homo sapiens
ttcaataagtgttgtaccatat

SEQ ID NO: 6528324 - DNA, 22 bp, Homo sapiens
ttcaataatagacttatatgca

SEQ ID NO: 6528325 - DNA, 14 bp, Homo sapiens
ttcaataccaggga

SEQ ID NO: 6528326 - DNA, 16 bp, Homo sapiens
ttcaataccagggaag

SEQ ID NO: 6528327 - DNA, 16 bp, Homo sapiens
tgggcccagccggggt

SEQ ID NO: 6528328 - DNA, 12 bp, Homo sapiens
tgggcccagctg

SEQ ID NO: 6528329 - DNA, 14 bp, Homo sapiens
tgggcccaggacca

SEQ ID NO: 6528330 - DNA, 21 bp, Homo sapiens
tgggcccaggaccagctgggg

SEQ ID NO: 6528331 - DNA, 11 bp, Homo sapiens
tgggcccaggc

SEQ ID NO: 6528332 - DNA, 16 bp, Homo sapiens
tgggcccaggcaggtc

SEQ ID NO: 6528333 - DNA, 13 bp, Homo sapiens
tgggcccaggctc

SEQ ID NO: 6528334 - DNA, 16 bp, Homo sapiens
tgggcccaggctctgg

SEQ ID NO: 6528335 - DNA, 22 bp, Homo sapiens
tgggcccaggctctgggaaggg

SEQ ID NO: 6528336 - DNA, 13 bp, Homo sapiens
tgggcccagggac

SEQ ID NO: 6528337 - DNA, 22 bp, Homo sapiens
tgggcccataatagttagccct

SEQ ID NO: 6528338 - DNA, 16 bp, Homo sapiens
tgggcccatctccctg

SEQ ID NO: 6528339 - DNA, 17 bp, Homo sapiens
tgggcccatctccctgc

SEQ ID NO: 6528340 - DNA, 19 bp, Homo sapiens
tgggcccatctccctgctt

SEQ ID NO: 6528341 - DNA, 12 bp, Homo sapiens
tgggccccacag

SEQ ID NO: 6528342 - DNA, 13 bp, Homo sapiens
tgggccccacagt

SEQ ID NO: 6528343 - DNA, 19 bp, Homo sapiens
tgggccccacagtggtcag

SEQ ID NO: 6528344 - DNA, 20 bp, Homo sapiens
tgggccccacagtggtcagc

SEQ ID NO: 6528345 - DNA, 13 bp, Homo sapiens
tgggccccacatg

SEQ ID NO: 6528346 - DNA, 17 bp, Homo sapiens
tgggccccaccacctag

SEQ ID NO: 6528347 - DNA, 13 bp, Homo sapiens
tgggccccactgg

SEQ ID NO: 6528348 - DNA, 12 bp, Homo sapiens
tgggccccagcc

SEQ ID NO: 6528349 - DNA, 14 bp, Homo sapiens
tgggccccagccca

SEQ ID NO: 6528350 - DNA, 17 bp, Homo sapiens
tgggccccagcccaccc

SEQ ID NO: 6528351 - DNA, 20 bp, Homo sapiens
tgggccccagcccaccctcc

SEQ ID NO: 6528352 - DNA, 22 bp, Homo sapiens
tgggccccagcccaccctcctg

SEQ ID NO: 6528353 - DNA, 16 bp, Homo sapiens
tgggccccatctccac

SEQ ID NO: 6528354 - DNA, 20 bp, Homo sapiens
tgggccccatgctctgcccc

SEQ ID NO: 6528355 - DNA, 21 bp, Homo sapiens
tgggccccatgctctgcccca

SEQ ID NO: 6528356 - DNA, 16 bp, Homo sapiens
tgggccccattcagaa

SEQ ID NO: 6528357 - DNA, 22 bp, Homo sapiens
tgggcccccagagacctttgcc

SEQ ID NO: 6528358 - DNA, 15 bp, Homo sapiens
tgggcccccaggtct

SEQ ID NO: 6528359 - DNA, 16 bp, Homo sapiens
tgggccccgcctcaag

SEQ ID NO: 6528360 - DNA, 18 bp, Homo sapiens
tgggccccgggctggaga

SEQ ID NO: 6528361 - DNA, 20 bp, Homo sapiens
tgggcccctcaacagccaag

SEQ ID NO: 6528362 - DNA, 12 bp, Homo sapiens
tgggcccctcag

SEQ ID NO: 6528363 - DNA, 16 bp, Homo sapiens
tgggcccctcagagcc

SEQ ID NO: 6528364 - DNA, 15 bp, Homo sapiens
tgggcccctcagcca

SEQ ID NO: 6528365 - DNA, 19 bp, Homo sapiens
tgggcccctcatctgctca

SEQ ID NO: 6528366 - DNA, 13 bp, Homo sapiens
tgggcccctccac

SEQ ID NO: 6528367 - DNA, 23 bp, Homo sapiens
tgggcccctccacgcctcctggc

SEQ ID NO: 6528368 - DNA, 14 bp, Homo sapiens
tgggcccctccagg

SEQ ID NO: 6528369 - DNA, 15 bp, Homo sapiens
tgggcccctcccctc

SEQ ID NO: 6528370 - DNA, 16 bp, Homo sapiens
tgggcccctccctacc

SEQ ID NO: 6528371 - DNA, 20 bp, Homo sapiens
tgggcccctccctacctcaa

SEQ ID NO: 6528372 - DNA, 23 bp, Homo sapiens
tgggcccctcttattcctctagg

SEQ ID NO: 6528373 - DNA, 13 bp, Homo sapiens
tgggcccctgagg

SEQ ID NO: 6528374 - DNA, 15 bp, Homo sapiens
tgggcccctgaggag

SEQ ID NO: 6528375 - DNA, 17 bp, Homo sapiens
tgggcccctgaggagct

SEQ ID NO: 6528376 - DNA, 15 bp, Homo sapiens
tgggcccctgcctct

SEQ ID NO: 6528377 - DNA, 19 bp, Homo sapiens
tgggcccctgcctctctgc

SEQ ID NO: 6528378 - DNA, 12 bp, Homo sapiens
tgggcccctggc

SEQ ID NO: 6528379 - DNA, 14 bp, Homo sapiens
tgggcccctggccc

SEQ ID NO: 6528380 - DNA, 15 bp, Homo sapiens
tgggcccctggcccc

SEQ ID NO: 6528381 - DNA, 23 bp, Homo sapiens
tgggcccctggccccgcctgcct

SEQ ID NO: 6528382 - DNA, 16 bp, Homo sapiens
tgggcccctgtcccca

SEQ ID NO: 6528383 - DNA, 21 bp, Homo sapiens
tgggcccctgtccccagtccc

SEQ ID NO: 6528384 - DNA, 22 bp, Homo sapiens
tgggcccgcctcggcctcccaa

SEQ ID NO: 6528385 - DNA, 20 bp, Homo sapiens
tgggcccgctgcctcttggc

SEQ ID NO: 6528386 - DNA, 15 bp, Homo sapiens
tgggcccggtccaca

SEQ ID NO: 6528387 - DNA, 19 bp, Homo sapiens
tgggcccggtccacaggtc

SEQ ID NO: 6528388 - DNA, 20 bp, Homo sapiens
tgggcccggtccacaggtcc

SEQ ID NO: 6528389 - DNA, 17 bp, Homo sapiens
tgggccctaccctcctg

SEQ ID NO: 6528390 - DNA, 21 bp, Homo sapiens
tgggccctaccctcctgctga

SEQ ID NO: 6528391 - DNA, 19 bp, Homo sapiens
tgggccctatgtctcagga

SEQ ID NO: 6528392 - DNA, 13 bp, Homo sapiens
tgggccctcagcg

SEQ ID NO: 6528393 - DNA, 22 bp, Homo sapiens
tgggccctcagcgtctccccat

SEQ ID NO: 6528394 - DNA, 18 bp, Homo sapiens
tgggccctctctctgggc

SEQ ID NO: 6528395 - DNA, 21 bp, Homo sapiens
tgggccctgagtctgggcagc

SEQ ID NO: 6528396 - DNA, 11 bp, Homo sapiens
tgggccctgca

SEQ ID NO: 6528397 - DNA, 12 bp, Homo sapiens
tgggccctgcaa

SEQ ID NO: 6528398 - DNA, 14 bp, Homo sapiens
tgggccctgcacag

SEQ ID NO: 6528399 - DNA, 13 bp, Homo sapiens
tgggccctgcagg

SEQ ID NO: 6528400 - DNA, 17 bp, Homo sapiens
tgggccctgcaggaggc

SEQ ID NO: 6528401 - DNA, 20 bp, Homo sapiens
tgggccctgcaggaggcctg

SEQ ID NO: 6528402 - DNA, 14 bp, Homo sapiens
tgggccctgcatgt

SEQ ID NO: 6528403 - DNA, 22 bp, Homo sapiens
tgggccctgcattggcctggcc

SEQ ID NO: 6528404 - DNA, 18 bp, Homo sapiens
tgggccctgcctctgttt

SEQ ID NO: 6528405 - DNA, 12 bp, Homo sapiens
tgggccctggag

SEQ ID NO: 6528406 - DNA, 12 bp, Homo sapiens
tgggccctggct

SEQ ID NO: 6528407 - DNA, 13 bp, Homo sapiens
tgggccctggctc

SEQ ID NO: 6528408 - DNA, 15 bp, Homo sapiens
tgggccctggctctg

SEQ ID NO: 6528409 - DNA, 16 bp, Homo sapiens
tgggccctgggctggc

SEQ ID NO: 6528410 - DNA, 13 bp, Homo sapiens
tgggccctggggc

SEQ ID NO: 6528411 - DNA, 14 bp, Homo sapiens
tgggccctggggcc

SEQ ID NO: 6528412 - DNA, 19 bp, Homo sapiens
tgggccctggggcctgtac

SEQ ID NO: 6528413 - DNA, 20 bp, Homo sapiens
tgggccctggggctgccctc

SEQ ID NO: 6528414 - DNA, 21 bp, Homo sapiens
tgggccctggttcccccagga

SEQ ID NO: 6528415 - DNA, 16 bp, Homo sapiens
tgggccctgtcgcccc

SEQ ID NO: 6528416 - DNA, 14 bp, Homo sapiens
tgggccgagccacc

SEQ ID NO: 6528417 - DNA, 15 bp, Homo sapiens
tgggccgagccacct

SEQ ID NO: 6528418 - DNA, 17 bp, Homo sapiens
tgggccgcaagggcctg

SEQ ID NO: 6528419 - DNA, 20 bp, Homo sapiens
tgggccgcaagggcctggac

SEQ ID NO: 6528420 - DNA, 14 bp, Homo sapiens
tgggccggcagcct

SEQ ID NO: 6528421 - DNA, 15 bp, Homo sapiens
tgggccggcagcctg

SEQ ID NO: 6528422 - DNA, 14 bp, Homo sapiens
tgggccggccagcc

SEQ ID NO: 6528423 - DNA, 17 bp, Homo sapiens
tgggccggccagccttg

SEQ ID NO: 6528424 - DNA, 17 bp, Homo sapiens
tgggccgggaggcagtg

SEQ ID NO: 6528425 - DNA, 21 bp, Homo sapiens
tgggccgggggcggggccggg

SEQ ID NO: 6528426 - DNA, 19 bp, Homo sapiens
tgggccgtcccctctcccc

SEQ ID NO: 6528427 - DNA, 21 bp, Homo sapiens
tgggccgtcccctctcccctt

SEQ ID NO: 6528428 - DNA, 23 bp, Homo sapiens
tgggccgtcccctctccccttgg

SEQ ID NO: 6528429 - DNA, 18 bp, Homo sapiens
tgggccgtggcacagctg

SEQ ID NO: 6528430 - DNA, 19 bp, Homo sapiens
tgggccgtggcacagctgg

SEQ ID NO: 6528431 - DNA, 17 bp, Homo sapiens
tgggcctatggagagcc

SEQ ID NO: 6528432 - DNA, 19 bp, Homo sapiens
tgggcctatggagagccct

SEQ ID NO: 6528433 - DNA, 16 bp, Homo sapiens
tgggcctcaaggactt

SEQ ID NO: 6528434 - DNA, 23 bp, Homo sapiens
tgggcctcacctgcccctctgtt

SEQ ID NO: 6528435 - DNA, 12 bp, Homo sapiens
tgggcctcagcc

SEQ ID NO: 6528436 - DNA, 16 bp, Homo sapiens
tgggcctcagccccgc

SEQ ID NO: 6528437 - DNA, 13 bp, Homo sapiens
tgggcctcagttt

SEQ ID NO: 6528438 - DNA, 15 bp, Homo sapiens
tgggcctccatgccc

SEQ ID NO: 6528439 - DNA, 23 bp, Homo sapiens
tgggcctccatgccccagctctg

SEQ ID NO: 6528440 - DNA, 10 bp, Homo sapiens
tgggcctccc

SEQ ID NO: 6528441 - DNA, 13 bp, Homo sapiens
tgggcctcccact

SEQ ID NO: 6528442 - DNA, 14 bp, Homo sapiens
tgggcctcccactc

SEQ ID NO: 6528443 - DNA, 18 bp, Homo sapiens
tgggcctcccactcccat

SEQ ID NO: 6528444 - DNA, 20 bp, Homo sapiens
tgggcctccccccagcccct

SEQ ID NO: 6528445 - DNA, 14 bp, Homo sapiens
tgggcctcccctgg

SEQ ID NO: 6528446 - DNA, 19 bp, Homo sapiens
tgggcctcccctgggcagg

SEQ ID NO: 6528447 - DNA, 21 bp, Homo sapiens
tgggcctcccgtccgtccgcc

SEQ ID NO: 6528448 - DNA, 20 bp, Homo sapiens
tgggcctcctcacaacatgg

SEQ ID NO: 6528449 - DNA, 19 bp, Homo sapiens
tgggcctcctcctagctgg

SEQ ID NO: 6528450 - DNA, 24 bp, Homo sapiens
tgggcctccttcccatgcctgtct

SEQ ID NO: 6528451 - DNA, 17 bp, Homo sapiens
tgggcctctcctgccct

SEQ ID NO: 6528452 - DNA, 19 bp, Homo sapiens
tgggcctctttttgccctt

SEQ ID NO: 6528453 - DNA, 21 bp, Homo sapiens
tgggcctgacctccagtcctg

SEQ ID NO: 6528454 - DNA, 20 bp, Homo sapiens
tgggcctgagggtccacctg

SEQ ID NO: 6528455 - DNA, 21 bp, Homo sapiens
tgggcctgagggtccacctgg

SEQ ID NO: 6528456 - DNA, 17 bp, Homo sapiens
tgggcctgatggagagg

SEQ ID NO: 6528457 - DNA, 16 bp, Homo sapiens
tgggcctgcccaatgc

SEQ ID NO: 6528458 - DNA, 19 bp, Homo sapiens
tgggcctgccgggctgagg

SEQ ID NO: 6528459 - DNA, 11 bp, Homo sapiens
tgggcctgcct

SEQ ID NO: 6528460 - DNA, 21 bp, Homo sapiens
tgggcctgcctgcctccaccc

SEQ ID NO: 6528461 - DNA, 14 bp, Homo sapiens
tgggcctgctccag

SEQ ID NO: 6528462 - DNA, 21 bp, Homo sapiens
tgggcctgctgaggccttctc

SEQ ID NO: 6528463 - DNA, 13 bp, Homo sapiens
tgggcctgctgct

SEQ ID NO: 6528464 - DNA, 15 bp, Homo sapiens
tgggcctgctgctga

SEQ ID NO: 6528465 - DNA, 17 bp, Homo sapiens
tgggcctgctgctgaga

SEQ ID NO: 6528466 - DNA, 18 bp, Homo sapiens
tgggcctgctgctgagaa

SEQ ID NO: 6528467 - DNA, 23 bp, Homo sapiens
tgggcctgctgctgagaacctgg

SEQ ID NO: 6528468 - DNA, 15 bp, Homo sapiens
tgggcctgcttcctg

SEQ ID NO: 6528469 - DNA, 14 bp, Homo sapiens
tgggcctggcctga

SEQ ID NO: 6528470 - DNA, 16 bp, Homo sapiens
tgggcctggcctgagc

SEQ ID NO: 6528471 - DNA, 18 bp, Homo sapiens
tgggcctggcctgagctg

SEQ ID NO: 6528472 - DNA, 23 bp, Homo sapiens
tgggcctggcctgagctggggcc

SEQ ID NO: 6528473 - DNA, 19 bp, Homo sapiens
tgggcctggctccctcact

SEQ ID NO: 6528474 - DNA, 16 bp, Homo sapiens
tgggcctgggcctgct

SEQ ID NO: 6528475 - DNA, 16 bp, Homo sapiens
tgggcctgggctaggg

SEQ ID NO: 6528476 - DNA, 13 bp, Homo sapiens
tgggcctgggctc

SEQ ID NO: 6528477 - DNA, 19 bp, Homo sapiens
tgggcctgggctcctggac

SEQ ID NO: 6528478 - DNA, 22 bp, Homo sapiens
tgggcctgggggttttccaagc

SEQ ID NO: 6528479 - DNA, 13 bp, Homo sapiens
tgggcctgtcccc

SEQ ID NO: 6528480 - DNA, 12 bp, Homo sapiens
tgggcctgtgca

SEQ ID NO: 6528481 - DNA, 21 bp, Homo sapiens
tgggcctgtgcactgggcagg

SEQ ID NO: 6528482 - DNA, 13 bp, Homo sapiens
tgggcctgtgcag

SEQ ID NO: 6528483 - DNA, 16 bp, Homo sapiens
tgggcctgtgcagcag

SEQ ID NO: 6528484 - DNA, 19 bp, Homo sapiens
tgggcctgtgcagcagccc

SEQ ID NO: 6528485 - DNA, 21 bp, Homo sapiens
tgggcctgtggggactgaacc

SEQ ID NO: 6528486 - DNA, 22 bp, Homo sapiens
tgggcctgtggggactgaacct

SEQ ID NO: 6528487 - DNA, 19 bp, Homo sapiens
tgggcctgttctcttggct

SEQ ID NO: 6528488 - DNA, 18 bp, Homo sapiens
tgggccttagtgggccag

SEQ ID NO: 6528489 - DNA, 19 bp, Homo sapiens
tgggccttagtgggccagg

SEQ ID NO: 6528490 - DNA, 16 bp, Homo sapiens
tgggccttcaccaagc

SEQ ID NO: 6528491 - DNA, 15 bp, Homo sapiens
tgggccttcagggag

SEQ ID NO: 6528492 - DNA, 16 bp, Homo sapiens
tgggccttctcagctc

SEQ ID NO: 6528493 - DNA, 15 bp, Homo sapiens
tgggccttgctgctg

SEQ ID NO: 6528494 - DNA, 14 bp, Homo sapiens
tgggccttgctggg

SEQ ID NO: 6528495 - DNA, 14 bp, Homo sapiens
tgggccttgctttg

SEQ ID NO: 6528496 - DNA, 17 bp, Homo sapiens
tgggccttgctttgggc

SEQ ID NO: 6528497 - DNA, 13 bp, Homo sapiens
tgggccttggcct

SEQ ID NO: 6528498 - DNA, 16 bp, Homo sapiens
tgggccttggcctgga

SEQ ID NO: 6528499 - DNA, 18 bp, Homo sapiens
tgggccttggcctggagc

SEQ ID NO: 6528500 - DNA, 19 bp, Homo sapiens
tgggccttggcctggagca

SEQ ID NO: 6528501 - DNA, 18 bp, Homo sapiens
tgggccttggctgggcct

SEQ ID NO: 6528502 - DNA, 20 bp, Homo sapiens
tgggccttggctgggcctct

SEQ ID NO: 6528503 - DNA, 14 bp, Homo sapiens
tgggccttgggctc

SEQ ID NO: 6528504 - DNA, 16 bp, Homo sapiens
tgggccttgggctccg

SEQ ID NO: 6528505 - DNA, 17 bp, Homo sapiens
tgggccttgtgacaatc

SEQ ID NO: 6528506 - DNA, 21 bp, Homo sapiens
tgggcctttaagaaccttaat

SEQ ID NO: 6528507 - DNA, 23 bp, Homo sapiens
ttcaatactcttgaaatgtagaa

SEQ ID NO: 6528508 - DNA, 21 bp, Homo sapiens
ttcaatacttacatatctgac

SEQ ID NO: 6528509 - DNA, 17 bp, Homo sapiens
ttcaatagccactaacc

SEQ ID NO: 6528510 - DNA, 19 bp, Homo sapiens
ttcaatagctaagcatctc

SEQ ID NO: 6528511 - DNA, 13 bp, Homo sapiens
ttcaataggaaaa

SEQ ID NO: 6528512 - DNA, 15 bp, Homo sapiens
ttcaataggaaaaac

SEQ ID NO: 6528513 - DNA, 18 bp, Homo sapiens
ttcaataggaaaaactga

SEQ ID NO: 6528514 - DNA, 21 bp, Homo sapiens
ttcaataggaaaaactgattt

SEQ ID NO: 6528515 - DNA, 22 bp, Homo sapiens
ttcaataggaaaaactgatttt

SEQ ID NO: 6528516 - DNA, 22 bp, Homo sapiens
ttcaatataagaagcaatcttt

SEQ ID NO: 6528517 - DNA, 11 bp, Homo sapiens
ttcaatatcag

SEQ ID NO: 6528518 - DNA, 20 bp, Homo sapiens
ttcaatatcagctttgataa

SEQ ID NO: 6528519 - DNA, 22 bp, Homo sapiens
ttcaatatgaatctataagtag

SEQ ID NO: 6528520 - DNA, 11 bp, Homo sapiens
ttcaatatgca

SEQ ID NO: 6528521 - DNA, 16 bp, Homo sapiens
ttcaatattgacattt

SEQ ID NO: 6528522 - DNA, 17 bp, Homo sapiens
ttcaatattgacatttg

SEQ ID NO: 6528523 - DNA, 19 bp, Homo sapiens
ttcaatattgacatttgta

SEQ ID NO: 6528524 - DNA, 11 bp, Homo sapiens
ttcaatattta

SEQ ID NO: 6528525 - DNA, 15 bp, Homo sapiens
ttcaatatttagaaa

SEQ ID NO: 6528526 - DNA, 17 bp, Homo sapiens
ttcaatcaaagctacct

SEQ ID NO: 6528527 - DNA, 20 bp, Homo sapiens
ttcaatcaacagaattgttc

SEQ ID NO: 6528528 - DNA, 16 bp, Homo sapiens
ttcaatcaacatctct

SEQ ID NO: 6528529 - DNA, 15 bp, Homo sapiens
ttcaatcaaccaaag

SEQ ID NO: 6528530 - DNA, 22 bp, Homo sapiens
ttcaatcactgtaacctgattc

SEQ ID NO: 6528531 - DNA, 16 bp, Homo sapiens
ttcaatcatttattca

SEQ ID NO: 6528532 - DNA, 13 bp, Homo sapiens
ttcaatccccata

SEQ ID NO: 6528533 - DNA, 22 bp, Homo sapiens
ttcaatccccataatgcttctt

SEQ ID NO: 6528534 - DNA, 18 bp, Homo sapiens
ttcaatctcaattgcttt

SEQ ID NO: 6528535 - DNA, 20 bp, Homo sapiens
ttcaatctcccgctgctgct

SEQ ID NO: 6528536 - DNA, 22 bp, Homo sapiens
ttcaatctcgtttagtgccaat

SEQ ID NO: 6528537 - DNA, 13 bp, Homo sapiens
ttcaatctctgtt

SEQ ID NO: 6528538 - DNA, 17 bp, Homo sapiens
ttcaatctctgttctgc

SEQ ID NO: 6528539 - DNA, 18 bp, Homo sapiens
ttcaatctctgttctgct

SEQ ID NO: 6528540 - DNA, 20 bp, Homo sapiens
ttcaatctggattcatattt

SEQ ID NO: 6528541 - DNA, 14 bp, Homo sapiens
ttcaatctgtaaac

SEQ ID NO: 6528542 - DNA, 14 bp, Homo sapiens
ttcaatgaaacaaa

SEQ ID NO: 6528543 - DNA, 23 bp, Homo sapiens
ttcaatgaaacaaagaaagagat

SEQ ID NO: 6528544 - DNA, 16 bp, Homo sapiens
ttcaatgaattaagaa

SEQ ID NO: 6528545 - DNA, 20 bp, Homo sapiens
ttcaatgacttctaatttat

SEQ ID NO: 6528546 - DNA, 12 bp, Homo sapiens
ttcaatgatcta

SEQ ID NO: 6528547 - DNA, 17 bp, Homo sapiens
ttcaatgcaaagtaaaa

SEQ ID NO: 6528548 - DNA, 19 bp, Homo sapiens
ttcaatgcaatgaaaacaa

SEQ ID NO: 6528549 - DNA, 15 bp, Homo sapiens
ttcaatgcaatgcat

SEQ ID NO: 6528550 - DNA, 21 bp, Homo sapiens
ttcaatgccaatgagtctgta

SEQ ID NO: 6528551 - DNA, 16 bp, Homo sapiens
ttcaatgcttctttta

SEQ ID NO: 6528552 - DNA, 19 bp, Homo sapiens
ttcaatggcaccttcattc

SEQ ID NO: 6528553 - DNA, 16 bp, Homo sapiens
ttcaatggctgctgaa

SEQ ID NO: 6528554 - DNA, 21 bp, Homo sapiens
ttcaatgggagtgaacatttc

SEQ ID NO: 6528555 - DNA, 17 bp, Homo sapiens
ttcaatgggctcttcca

SEQ ID NO: 6528556 - DNA, 16 bp, Homo sapiens
ttcaatgggtaaataa

SEQ ID NO: 6528557 - DNA, 20 bp, Homo sapiens
ttcaatgggtaaataaatgc

SEQ ID NO: 6528558 - DNA, 12 bp, Homo sapiens
ttcaatggtaga

SEQ ID NO: 6528559 - DNA, 16 bp, Homo sapiens
ttcaatgtaattaaac

SEQ ID NO: 6528560 - DNA, 16 bp, Homo sapiens
ttcaatgtactgtatt

SEQ ID NO: 6528561 - DNA, 22 bp, Homo sapiens
ttcaatgtgaaacacatgccag

SEQ ID NO: 6528562 - DNA, 16 bp, Homo sapiens
ttcaatgtgaaactga

SEQ ID NO: 6528563 - DNA, 16 bp, Homo sapiens
ttcaatgtgaatttta

SEQ ID NO: 6528564 - DNA, 17 bp, Homo sapiens
ttcaatgtgattcttct

SEQ ID NO: 6528565 - DNA, 15 bp, Homo sapiens
ttcaatgttagcctc

SEQ ID NO: 6528566 - DNA, 14 bp, Homo sapiens
ttcaatgtttgaaa

SEQ ID NO: 6528567 - DNA, 15 bp, Homo sapiens
ttcaattaaaaccat

SEQ ID NO: 6528568 - DNA, 11 bp, Homo sapiens
ttcaattaaac

SEQ ID NO: 6528569 - DNA, 18 bp, Homo sapiens
ttcaattaaacggattat

SEQ ID NO: 6528570 - DNA, 19 bp, Homo sapiens
ttcaattaaacggattatt

SEQ ID NO: 6528571 - DNA, 21 bp, Homo sapiens
ttcaattaatggaaaactgtt

SEQ ID NO: 6528572 - DNA, 21 bp, Homo sapiens
ttcaattagggatgctcaaac

SEQ ID NO: 6528573 - DNA, 16 bp, Homo sapiens
ttcaattatgtttgaa

SEQ ID NO: 6528574 - DNA, 19 bp, Homo sapiens
ttcaattatgtttgaaaat

SEQ ID NO: 6528575 - DNA, 21 bp, Homo sapiens
ttcaattcagattgtcttgca

SEQ ID NO: 6528576 - DNA, 19 bp, Homo sapiens
ttcaattcagtgctgtact

SEQ ID NO: 6528577 - DNA, 20 bp, Homo sapiens
ttcaattcatagaataacaa

SEQ ID NO: 6528578 - DNA, 15 bp, Homo sapiens
ttcaattcctggccc

SEQ ID NO: 6528579 - DNA, 13 bp, Homo sapiens
ttcaattcctggg

SEQ ID NO: 6528580 - DNA, 14 bp, Homo sapiens
ttcaattcctgggc

SEQ ID NO: 6528581 - DNA, 18 bp, Homo sapiens
ttcaattctcatttgtca

SEQ ID NO: 6528582 - DNA, 16 bp, Homo sapiens
ttcaattctgtaatta

SEQ ID NO: 6528583 - DNA, 20 bp, Homo sapiens
ttcaattgcagatgccaaaa

SEQ ID NO: 6528584 - DNA, 17 bp, Homo sapiens
ttcaattgcatctccca

SEQ ID NO: 6528585 - DNA, 19 bp, Homo sapiens
ttcaattgcatctcccaga

SEQ ID NO: 6528586 - DNA, 14 bp, Homo sapiens
ttcaattgtaaatt

SEQ ID NO: 6528587 - DNA, 20 bp, Homo sapiens
ttcaattgtattttatatga

SEQ ID NO: 6528588 - DNA, 14 bp, Homo sapiens
ttcaattgtcactt

SEQ ID NO: 6528589 - DNA, 16 bp, Homo sapiens
ttcaatttaattctta

SEQ ID NO: 6528590 - DNA, 20 bp, Homo sapiens
ttcaatttaattcttatttc

SEQ ID NO: 6528591 - DNA, 22 bp, Homo sapiens
ttcaatttactttttaaacagt

SEQ ID NO: 6528592 - DNA, 23 bp, Homo sapiens
ttcaatttactttttaaacagtg

SEQ ID NO: 6528593 - DNA, 16 bp, Homo sapiens
ttcaatttattcaaga

SEQ ID NO: 6528594 - DNA, 19 bp, Homo sapiens
ttcaatttattcaagaaaa

SEQ ID NO: 6528595 - DNA, 16 bp, Homo sapiens
ttcaatttattgcaca

SEQ ID NO: 6528596 - DNA, 14 bp, Homo sapiens
ttcaatttctcaca

SEQ ID NO: 6528597 - DNA, 15 bp, Homo sapiens
ttcaatttgatgtgg

SEQ ID NO: 6528598 - DNA, 22 bp, Homo sapiens
ttcaatttgatgtggtgaaaag

SEQ ID NO: 6528599 - DNA, 19 bp, Homo sapiens
ttcaatttgccattggttt

SEQ ID NO: 6528600 - DNA, 20 bp, Homo sapiens
ttcaatttggatatttggag

SEQ ID NO: 6528601 - DNA, 15 bp, Homo sapiens
ttcaattttaaagac

SEQ ID NO: 6528602 - DNA, 16 bp, Homo sapiens
ttcaatttttctttaa

SEQ ID NO: 6528603 - DNA, 18 bp, Homo sapiens
ttcaattttttaatgttt

SEQ ID NO: 6528604 - DNA, 19 bp, Homo sapiens
ttcaattttttttccgtaa

SEQ ID NO: 6528605 - DNA, 20 bp, Homo sapiens
ttcacaaaatgcacttctat

SEQ ID NO: 6528606 - DNA, 15 bp, Homo sapiens
ttcacaaaatttcca

SEQ ID NO: 6528607 - DNA, 17 bp, Homo sapiens
ttcacaaacagaaaaca

SEQ ID NO: 6528608 - DNA, 15 bp, Homo sapiens
ttcacaaactgtgaa

SEQ ID NO: 6528609 - DNA, 22 bp, Homo sapiens
ttcacaaacttttatactcttt

SEQ ID NO: 6528610 - DNA, 13 bp, Homo sapiens
ttcacaaataata

SEQ ID NO: 6528611 - DNA, 17 bp, Homo sapiens
ttcacaacacaatcaaa

SEQ ID NO: 6528612 - DNA, 20 bp, Homo sapiens
ttcacaacacaatcaaaaga

SEQ ID NO: 6528613 - DNA, 18 bp, Homo sapiens
ttcacaaccagccacaca

SEQ ID NO: 6528614 - DNA, 20 bp, Homo sapiens
ttcacaaccagccacacaga

SEQ ID NO: 6528615 - DNA, 20 bp, Homo sapiens
ttcacaacctcaccaaacta

SEQ ID NO: 6528616 - DNA, 16 bp, Homo sapiens
ttcacaactaggacct

SEQ ID NO: 6528617 - DNA, 19 bp, Homo sapiens
ttcacaactaggacctcat

SEQ ID NO: 6528618 - DNA, 20 bp, Homo sapiens
ttcacaactaggacctcata

SEQ ID NO: 6528619 - DNA, 14 bp, Homo sapiens
ttcacaagcctcct

SEQ ID NO: 6528620 - DNA, 19 bp, Homo sapiens
ttcacaagctgcctccctg

SEQ ID NO: 6528621 - DNA, 23 bp, Homo sapiens
ttcacaaggtgactgggatgtag

SEQ ID NO: 6528622 - DNA, 18 bp, Homo sapiens
ttcacaagtcctgccaag

SEQ ID NO: 6528623 - DNA, 13 bp, Homo sapiens
ttcacaatagaaa

SEQ ID NO: 6528624 - DNA, 21 bp, Homo sapiens
ttcacaatcttggggctgatg

SEQ ID NO: 6528625 - DNA, 14 bp, Homo sapiens
ttcacaatgtgaaa

SEQ ID NO: 6528626 - DNA, 23 bp, Homo sapiens
ttcacaatgtgaaactgaaggtc

SEQ ID NO: 6528627 - DNA, 13 bp, Homo sapiens
ttcacaatgttaa

SEQ ID NO: 6528628 - DNA, 16 bp, Homo sapiens
ttcacaattattaaat

SEQ ID NO: 6528629 - DNA, 16 bp, Homo sapiens
ttcacaattattccaa

SEQ ID NO: 6528630 - DNA, 23 bp, Homo sapiens
ttcacaattccatttccagttca

SEQ ID NO: 6528631 - DNA, 14 bp, Homo sapiens
ttcacaatttcaat

SEQ ID NO: 6528632 - DNA, 15 bp, Homo sapiens
ttcacaatttcaatg

SEQ ID NO: 6528633 - DNA, 21 bp, Homo sapiens
ttcacacaaagtgaaattagt

SEQ ID NO: 6528634 - DNA, 11 bp, Homo sapiens
ttcacacacag

SEQ ID NO: 6528635 - DNA, 20 bp, Homo sapiens
ttcacacacagactgttgtc

SEQ ID NO: 6528636 - DNA, 14 bp, Homo sapiens
ttcacacacccctc

SEQ ID NO: 6528637 - DNA, 13 bp, Homo sapiens
ttcacacagacaa

SEQ ID NO: 6528638 - DNA, 23 bp, Homo sapiens
ttcacacatctgggtgccctgaa

SEQ ID NO: 6528639 - DNA, 21 bp, Homo sapiens
ttcacacatgcctatattatc

SEQ ID NO: 6528640 - DNA, 21 bp, Homo sapiens
ttcacaccagtcacacattat

SEQ ID NO: 6528641 - DNA, 15 bp, Homo sapiens
ttcacaccccacctg

SEQ ID NO: 6528642 - DNA, 14 bp, Homo sapiens
ttcacaccttacaa

SEQ ID NO: 6528643 - DNA, 18 bp, Homo sapiens
ttcacacgctgttctaat

SEQ ID NO: 6528644 - DNA, 10 bp, Homo sapiens
ttcacactcc

SEQ ID NO: 6528645 - DNA, 13 bp, Homo sapiens
ttcacactgaact

SEQ ID NO: 6528646 - DNA, 19 bp, Homo sapiens
ttcacactggtaaatgtta

SEQ ID NO: 6528647 - DNA, 16 bp, Homo sapiens
ttcacactgtgcgttt

SEQ ID NO: 6528648 - DNA, 20 bp, Homo sapiens
ttcacacttccaccagcctg

SEQ ID NO: 6528649 - DNA, 18 bp, Homo sapiens
ttcacacttgttcaacag

SEQ ID NO: 6528650 - DNA, 20 bp, Homo sapiens
ttcacacttgttcaacagtt

SEQ ID NO: 6528651 - DNA, 22 bp, Homo sapiens
ttcacagacctcagcagggcat

SEQ ID NO: 6528652 - DNA, 14 bp, Homo sapiens
ttcacagactgatt

SEQ ID NO: 6528653 - DNA, 21 bp, Homo sapiens
ttcacagagtgtgctggagga

SEQ ID NO: 6528654 - DNA, 15 bp, Homo sapiens
ttcacagataacata

SEQ ID NO: 6528655 - DNA, 11 bp, Homo sapiens
ttcacagatgc

SEQ ID NO: 6528656 - DNA, 15 bp, Homo sapiens
ttcacagcaacattt

SEQ ID NO: 6528657 - DNA, 18 bp, Homo sapiens
ttcacagcaacattttct

SEQ ID NO: 6528658 - DNA, 23 bp, Homo sapiens
ttcacagcaacattttcttgaat

SEQ ID NO: 6528659 - DNA, 21 bp, Homo sapiens
ttcacagcaccaaaggctcag

SEQ ID NO: 6528660 - DNA, 22 bp, Homo sapiens
ttcacagcacgggcacagctgc

SEQ ID NO: 6528661 - DNA, 17 bp, Homo sapiens
ttcacagcacttacaat

SEQ ID NO: 6528662 - DNA, 15 bp, Homo sapiens
ttcacagcagctttg

SEQ ID NO: 6528663 - DNA, 11 bp, Homo sapiens
ttcacagcctc

SEQ ID NO: 6528664 - DNA, 18 bp, Homo sapiens
ttcacagcctttctgaac

SEQ ID NO: 6528665 - DNA, 16 bp, Homo sapiens
ttcacagcgcctcctg

SEQ ID NO: 6528666 - DNA, 17 bp, Homo sapiens
ttcacagcgcctcctgg

SEQ ID NO: 6528667 - DNA, 18 bp, Homo sapiens
ttcacagcgcctcctgga

SEQ ID NO: 6528668 - DNA, 18 bp, Homo sapiens
ttcacagcgtctgctcat

SEQ ID NO: 6528669 - DNA, 12 bp, Homo sapiens
ttcacagctcct

SEQ ID NO: 6528670 - DNA, 13 bp, Homo sapiens
ttcacagctcctc

SEQ ID NO: 6528671 - DNA, 15 bp, Homo sapiens
ttcacagctcctccc

SEQ ID NO: 6528672 - DNA, 17 bp, Homo sapiens
ttcacagctcctcccac

SEQ ID NO: 6528673 - DNA, 13 bp, Homo sapiens
ttcacagctggag

SEQ ID NO: 6528674 - DNA, 23 bp, Homo sapiens
ttcacagctttgaggaacatgca

SEQ ID NO: 6528675 - DNA, 16 bp, Homo sapiens
ttcacagcttttatca

SEQ ID NO: 6528676 - DNA, 16 bp, Homo sapiens
ttcacagcttttcttg

SEQ ID NO: 6528677 - DNA, 17 bp, Homo sapiens
ttcacagcttttcttga

SEQ ID NO: 6528678 - DNA, 19 bp, Homo sapiens
ttcacaggactctgcagat

SEQ ID NO: 6528679 - DNA, 16 bp, Homo sapiens
ttcacaggcagccagt

SEQ ID NO: 6528680 - DNA, 21 bp, Homo sapiens
ttcacaggctgtaaattgaac

SEQ ID NO: 6528681 - DNA, 23 bp, Homo sapiens
ttcacaggctgtaaattgaactt

SEQ ID NO: 6528682 - DNA, 18 bp, Homo sapiens
ttcacagtaccatctgaa

SEQ ID NO: 6528683 - DNA, 19 bp, Homo sapiens
ttcacagtagagccagctt

SEQ ID NO: 6528684 - DNA, 15 bp, Homo sapiens
ttcacagtctctgga

SEQ ID NO: 6528685 - DNA, 16 bp, Homo sapiens
ttcacagtctctggaa

SEQ ID NO: 6528686 - DNA, 16 bp, Homo sapiens
tgggcctttgagcctg

SEQ ID NO: 6528687 - DNA, 14 bp, Homo sapiens
tgggcgaccagggc

SEQ ID NO: 6528688 - DNA, 17 bp, Homo sapiens
tgggcgaggcctgacac

SEQ ID NO: 6528689 - DNA, 19 bp, Homo sapiens
tgggcgatttgggggctcg

SEQ ID NO: 6528690 - DNA, 16 bp, Homo sapiens
tgggcgcaggcccagt

SEQ ID NO: 6528691 - DNA, 17 bp, Homo sapiens
tgggcgcaggcccagtg

SEQ ID NO: 6528692 - DNA, 18 bp, Homo sapiens
tgggcgcaggcccagtga

SEQ ID NO: 6528693 - DNA, 19 bp, Homo sapiens
tgggcgcccaccctgggct

SEQ ID NO: 6528694 - DNA, 20 bp, Homo sapiens
tgggcgcccccccctcccca

SEQ ID NO: 6528695 - DNA, 15 bp, Homo sapiens
tgggcgccctggaag

SEQ ID NO: 6528696 - DNA, 16 bp, Homo sapiens
tgggcgccctggaagc

SEQ ID NO: 6528697 - DNA, 22 bp, Homo sapiens
tgggcgccggttccacgtgggg

SEQ ID NO: 6528698 - DNA, 23 bp, Homo sapiens
tgggcgcggtggctcacgcctgt

SEQ ID NO: 6528699 - DNA, 15 bp, Homo sapiens
tgggcgctcccgggc

SEQ ID NO: 6528700 - DNA, 16 bp, Homo sapiens
tgggcgctcggtctcc

SEQ ID NO: 6528701 - DNA, 23 bp, Homo sapiens
tgggcgctcggtctccaccccag

SEQ ID NO: 6528702 - DNA, 15 bp, Homo sapiens
tgggcgctctcccta

SEQ ID NO: 6528703 - DNA, 14 bp, Homo sapiens
tgggcgctgcttcc

SEQ ID NO: 6528704 - DNA, 22 bp, Homo sapiens
tgggcgctggtcctttcttccg

SEQ ID NO: 6528705 - DNA, 18 bp, Homo sapiens
tgggcgcttcccacctgc

SEQ ID NO: 6528706 - DNA, 13 bp, Homo sapiens
tgggcggcagaga

SEQ ID NO: 6528707 - DNA, 19 bp, Homo sapiens
tgggcggcagagaggactg

SEQ ID NO: 6528708 - DNA, 23 bp, Homo sapiens
tgggcggccagtgcggctgccag

SEQ ID NO: 6528709 - DNA, 17 bp, Homo sapiens
tgggcggcggccacgca

SEQ ID NO: 6528710 - DNA, 17 bp, Homo sapiens
tgggcggctcctggtgc

SEQ ID NO: 6528711 - DNA, 14 bp, Homo sapiens
tgggcggctgagag

SEQ ID NO: 6528712 - DNA, 22 bp, Homo sapiens
tgggcgggcaggggagggtcag

SEQ ID NO: 6528713 - DNA, 14 bp, Homo sapiens
tgggcgggccatga

SEQ ID NO: 6528714 - DNA, 15 bp, Homo sapiens
tgggcggggccttgc

SEQ ID NO: 6528715 - DNA, 21 bp, Homo sapiens
tgggcggtccagaaggagcag

SEQ ID NO: 6528716 - DNA, 23 bp, Homo sapiens
tgggcggtccagaaggagcaggc

SEQ ID NO: 6528717 - DNA, 16 bp, Homo sapiens
tgggcggtgtgtcttt

SEQ ID NO: 6528718 - DNA, 19 bp, Homo sapiens
tgggcgtacgctggtgctg

SEQ ID NO: 6528719 - DNA, 21 bp, Homo sapiens
tgggcgtccagctcagccctg

SEQ ID NO: 6528720 - DNA, 22 bp, Homo sapiens
tgggcgtccagctcagccctgg

SEQ ID NO: 6528721 - DNA, 16 bp, Homo sapiens
tgggcgtctcccccag

SEQ ID NO: 6528722 - DNA, 19 bp, Homo sapiens
tgggcgtctgactccctcc

SEQ ID NO: 6528723 - DNA, 19 bp, Homo sapiens
tgggcgtctgagctggggt

SEQ ID NO: 6528724 - DNA, 17 bp, Homo sapiens
tgggcgtgagacctgcc

SEQ ID NO: 6528725 - DNA, 18 bp, Homo sapiens
tgggcgtgagacctgccc

SEQ ID NO: 6528726 - DNA, 19 bp, Homo sapiens
tgggcgtggtcactgctgt

SEQ ID NO: 6528727 - DNA, 20 bp, Homo sapiens
tgggcgtgtgtgacactgat

SEQ ID NO: 6528728 - DNA, 12 bp, Homo sapiens
tgggctaacatt

SEQ ID NO: 6528729 - DNA, 23 bp, Homo sapiens
tgggctaaggaagtatcagcact

SEQ ID NO: 6528730 - DNA, 17 bp, Homo sapiens
tgggctaattaaataaa

SEQ ID NO: 6528731 - DNA, 20 bp, Homo sapiens
tgggctacaaaccaggagca

SEQ ID NO: 6528732 - DNA, 13 bp, Homo sapiens
tgggctacaagga

SEQ ID NO: 6528733 - DNA, 19 bp, Homo sapiens
tgggctacatgctggggtc

SEQ ID NO: 6528734 - DNA, 18 bp, Homo sapiens
tgggctaccctaaaggga

SEQ ID NO: 6528735 - DNA, 22 bp, Homo sapiens
tgggctaccctaaagggagaag

SEQ ID NO: 6528736 - DNA, 15 bp, Homo sapiens
tgggctactggcagc

SEQ ID NO: 6528737 - DNA, 16 bp, Homo sapiens
tgggctactggcagct

SEQ ID NO: 6528738 - DNA, 17 bp, Homo sapiens
tgggctactggcagctc

SEQ ID NO: 6528739 - DNA, 19 bp, Homo sapiens
tgggctaggtagtggggac

SEQ ID NO: 6528740 - DNA, 22 bp, Homo sapiens
tgggctagtgtgagtggcagcc

SEQ ID NO: 6528741 - DNA, 15 bp, Homo sapiens
tgggctataaaatat

SEQ ID NO: 6528742 - DNA, 12 bp, Homo sapiens
tgggctatattc

SEQ ID NO: 6528743 - DNA, 22 bp, Homo sapiens
tgggctatgccactaggccctg

SEQ ID NO: 6528744 - DNA, 13 bp, Homo sapiens
tgggctatggaca

SEQ ID NO: 6528745 - DNA, 17 bp, Homo sapiens
tgggctatggacacagg

SEQ ID NO: 6528746 - DNA, 15 bp, Homo sapiens
tgggctcaaagccct

SEQ ID NO: 6528747 - DNA, 21 bp, Homo sapiens
tgggctcaaatgatcctccca

SEQ ID NO: 6528748 - DNA, 22 bp, Homo sapiens
tgggctcaaatgatcctcccac

SEQ ID NO: 6528749 - DNA, 21 bp, Homo sapiens
tgggctcaagcaatcctcctg

SEQ ID NO: 6528750 - DNA, 23 bp, Homo sapiens
tgggctcaagcaatcctcctgag

SEQ ID NO: 6528751 - DNA, 20 bp, Homo sapiens
tgggctcaaggcaccgcagc

SEQ ID NO: 6528752 - DNA, 16 bp, Homo sapiens
tgggctcacaccagcc

SEQ ID NO: 6528753 - DNA, 21 bp, Homo sapiens
tgggctcacaccagccctggt

SEQ ID NO: 6528754 - DNA, 20 bp, Homo sapiens
tgggctcactacatgggcca

SEQ ID NO: 6528755 - DNA, 22 bp, Homo sapiens
tgggctcactacatgggccagc

SEQ ID NO: 6528756 - DNA, 13 bp, Homo sapiens
tgggctcactgca

SEQ ID NO: 6528757 - DNA, 18 bp, Homo sapiens
tgggctcagatcctgggc

SEQ ID NO: 6528758 - DNA, 11 bp, Homo sapiens
tgggctcaggg

SEQ ID NO: 6528759 - DNA, 13 bp, Homo sapiens
tgggctcagggcc

SEQ ID NO: 6528760 - DNA, 15 bp, Homo sapiens
tgggctcagggccag

SEQ ID NO: 6528761 - DNA, 16 bp, Homo sapiens
tgggctcagggccagg

SEQ ID NO: 6528762 - DNA, 19 bp, Homo sapiens
tgggctcagggccaggtcc

SEQ ID NO: 6528763 - DNA, 20 bp, Homo sapiens
tgggctcagggccaggtcct

SEQ ID NO: 6528764 - DNA, 13 bp, Homo sapiens
tgggctcagggct

SEQ ID NO: 6528765 - DNA, 14 bp, Homo sapiens
tgggctcagggctg

SEQ ID NO: 6528766 - DNA, 20 bp, Homo sapiens
tgggctcagggctggagtgc

SEQ ID NO: 6528767 - DNA, 14 bp, Homo sapiens
tgggctcagggttg

SEQ ID NO: 6528768 - DNA, 20 bp, Homo sapiens
tgggctcagggttggccatt

SEQ ID NO: 6528769 - DNA, 14 bp, Homo sapiens
tgggctcagtgaag

SEQ ID NO: 6528770 - DNA, 19 bp, Homo sapiens
tgggctcagtgaagttgct

SEQ ID NO: 6528771 - DNA, 18 bp, Homo sapiens
tgggctccacgggcaggg

SEQ ID NO: 6528772 - DNA, 17 bp, Homo sapiens
tgggctccagagggcac

SEQ ID NO: 6528773 - DNA, 13 bp, Homo sapiens
tgggctccagagt

SEQ ID NO: 6528774 - DNA, 15 bp, Homo sapiens
tgggctcccacgccc

SEQ ID NO: 6528775 - DNA, 19 bp, Homo sapiens
tgggctcccgtgttttgta

SEQ ID NO: 6528776 - DNA, 12 bp, Homo sapiens
tgggctccctct

SEQ ID NO: 6528777 - DNA, 15 bp, Homo sapiens
tgggctccctgatga

SEQ ID NO: 6528778 - DNA, 13 bp, Homo sapiens
tgggctccctgga

SEQ ID NO: 6528779 - DNA, 16 bp, Homo sapiens
tgggctccctggagga

SEQ ID NO: 6528780 - DNA, 18 bp, Homo sapiens
tgggctccctggcccagc

SEQ ID NO: 6528781 - DNA, 14 bp, Homo sapiens
tgggctcccttcct

SEQ ID NO: 6528782 - DNA, 19 bp, Homo sapiens
tgggctcccttcctcccaa

SEQ ID NO: 6528783 - DNA, 18 bp, Homo sapiens
tgggctccgtgtgggaga

SEQ ID NO: 6528784 - DNA, 12 bp, Homo sapiens
tgggctcctgga

SEQ ID NO: 6528785 - DNA, 17 bp, Homo sapiens
tgggctcctggaaccaa

SEQ ID NO: 6528786 - DNA, 15 bp, Homo sapiens
tgggctcctggcaga

SEQ ID NO: 6528787 - DNA, 18 bp, Homo sapiens
tgggctcctggctgccag

SEQ ID NO: 6528788 - DNA, 20 bp, Homo sapiens
tgggctcctggctgccaggc

SEQ ID NO: 6528789 - DNA, 21 bp, Homo sapiens
tgggctcctggctgccaggcg

SEQ ID NO: 6528790 - DNA, 15 bp, Homo sapiens
tgggctcgcactgcc

SEQ ID NO: 6528791 - DNA, 14 bp, Homo sapiens
tgggctcgcccacc

SEQ ID NO: 6528792 - DNA, 21 bp, Homo sapiens
tgggctcgccgtgtctcagcc

SEQ ID NO: 6528793 - DNA, 17 bp, Homo sapiens
tgggctcggaggctgcc

SEQ ID NO: 6528794 - DNA, 15 bp, Homo sapiens
tgggctcgtctttgc

SEQ ID NO: 6528795 - DNA, 17 bp, Homo sapiens
tgggctcgtctttgcag

SEQ ID NO: 6528796 - DNA, 17 bp, Homo sapiens
tgggctctaaggtactg

SEQ ID NO: 6528797 - DNA, 19 bp, Homo sapiens
tgggctctacctctctttc

SEQ ID NO: 6528798 - DNA, 20 bp, Homo sapiens
tgggctctacctctctttct

SEQ ID NO: 6528799 - DNA, 16 bp, Homo sapiens
tgggctctccacctca

SEQ ID NO: 6528800 - DNA, 23 bp, Homo sapiens
tgggctctccacctcagccttgg

SEQ ID NO: 6528801 - DNA, 13 bp, Homo sapiens
tgggctctgatga

SEQ ID NO: 6528802 - DNA, 15 bp, Homo sapiens
tgggctctgccaccc

SEQ ID NO: 6528803 - DNA, 12 bp, Homo sapiens
tgggctctgccc

SEQ ID NO: 6528804 - DNA, 13 bp, Homo sapiens
tgggctctgcctg

SEQ ID NO: 6528805 - DNA, 13 bp, Homo sapiens
tgggctctgctga

SEQ ID NO: 6528806 - DNA, 22 bp, Homo sapiens
tgggctctggacctcaggaggg

SEQ ID NO: 6528807 - DNA, 15 bp, Homo sapiens
tgggctctggactcc

SEQ ID NO: 6528808 - DNA, 14 bp, Homo sapiens
tgggctctggctcc

SEQ ID NO: 6528809 - DNA, 15 bp, Homo sapiens
tgggctctgggagca

SEQ ID NO: 6528810 - DNA, 14 bp, Homo sapiens
tgggctctgggttc

SEQ ID NO: 6528811 - DNA, 16 bp, Homo sapiens
tgggctctggtggggg

SEQ ID NO: 6528812 - DNA, 17 bp, Homo sapiens
tgggctctggtgggggc

SEQ ID NO: 6528813 - DNA, 18 bp, Homo sapiens
tgggctctggtgggggct

SEQ ID NO: 6528814 - DNA, 17 bp, Homo sapiens
tgggctctgtgcagtca

SEQ ID NO: 6528815 - DNA, 22 bp, Homo sapiens
tgggctgacacctaccatgctg

SEQ ID NO: 6528816 - DNA, 17 bp, Homo sapiens
tgggctgaccaggcttc

SEQ ID NO: 6528817 - DNA, 14 bp, Homo sapiens
tgggctgacccagc

SEQ ID NO: 6528818 - DNA, 23 bp, Homo sapiens
tgggctgagactggatactgccc

SEQ ID NO: 6528819 - DNA, 21 bp, Homo sapiens
tgggctgagccaaagccagag

SEQ ID NO: 6528820 - DNA, 14 bp, Homo sapiens
tgggctgagcccct

SEQ ID NO: 6528821 - DNA, 15 bp, Homo sapiens
tgggctgagcccctg

SEQ ID NO: 6528822 - DNA, 16 bp, Homo sapiens
tgggctgagcccctgg

SEQ ID NO: 6528823 - DNA, 16 bp, Homo sapiens
tgggctgagccctggc

SEQ ID NO: 6528824 - DNA, 17 bp, Homo sapiens
tgggctgagctagcctc

SEQ ID NO: 6528825 - DNA, 14 bp, Homo sapiens
tgggctgagtgcag

SEQ ID NO: 6528826 - DNA, 15 bp, Homo sapiens
tgggctgagtgcagc

SEQ ID NO: 6528827 - DNA, 17 bp, Homo sapiens
tgggctgagtgcagcca

SEQ ID NO: 6528828 - DNA, 21 bp, Homo sapiens
tgggctgagtgcagccaaagg

SEQ ID NO: 6528829 - DNA, 13 bp, Homo sapiens
tgggctgatgctg

SEQ ID NO: 6528830 - DNA, 15 bp, Homo sapiens
tgggctgatgctggg

SEQ ID NO: 6528831 - DNA, 21 bp, Homo sapiens
tgggctgatggcctggctgcc

SEQ ID NO: 6528832 - DNA, 19 bp, Homo sapiens
tgggctgcacgctcccctc

SEQ ID NO: 6528833 - DNA, 19 bp, Homo sapiens
tgggctgcactctgtgccc

SEQ ID NO: 6528834 - DNA, 20 bp, Homo sapiens
tgggctgcactctgtgccca

SEQ ID NO: 6528835 - DNA, 16 bp, Homo sapiens
tgggctgcagagtctg

SEQ ID NO: 6528836 - DNA, 20 bp, Homo sapiens
tgggctgcagagtctgcccc

SEQ ID NO: 6528837 - DNA, 19 bp, Homo sapiens
tgggctgccaccagccccc

SEQ ID NO: 6528838 - DNA, 21 bp, Homo sapiens
tgggctgcccctcgcacacag

SEQ ID NO: 6528839 - DNA, 14 bp, Homo sapiens
tgggctgccctggt

SEQ ID NO: 6528840 - DNA, 11 bp, Homo sapiens
tgggctgcctc

SEQ ID NO: 6528841 - DNA, 22 bp, Homo sapiens
tgggctgcctcctcctgagagc

SEQ ID NO: 6528842 - DNA, 15 bp, Homo sapiens
tgggctgcctgggga

SEQ ID NO: 6528843 - DNA, 19 bp, Homo sapiens
tgggctgcgggaggccctg

SEQ ID NO: 6528844 - DNA, 17 bp, Homo sapiens
tgggctgctacccagaa

SEQ ID NO: 6528845 - DNA, 23 bp, Homo sapiens
tgggctgctggaaaggcccggag

SEQ ID NO: 6528846 - DNA, 21 bp, Homo sapiens
tgggctgctggggcagggccc

SEQ ID NO: 6528847 - DNA, 12 bp, Homo sapiens
tgggctgctgtc

SEQ ID NO: 6528848 - DNA, 23 bp, Homo sapiens
tgggctggacttctacctgccct

SEQ ID NO: 6528849 - DNA, 12 bp, Homo sapiens
tgggctggagca

SEQ ID NO: 6528850 - DNA, 15 bp, Homo sapiens
tgggctggagctcct

SEQ ID NO: 6528851 - DNA, 16 bp, Homo sapiens
tgggctggagctcctc

SEQ ID NO: 6528852 - DNA, 17 bp, Homo sapiens
tgggctggagctcctcc

SEQ ID NO: 6528853 - DNA, 18 bp, Homo sapiens
tgggctggatgagctccc

SEQ ID NO: 6528854 - DNA, 15 bp, Homo sapiens
tgggctggcacagcc

SEQ ID NO: 6528855 - DNA, 20 bp, Homo sapiens
tgggctggcacagcccctgg

SEQ ID NO: 6528856 - DNA, 20 bp, Homo sapiens
tgggctggcacccactggag

SEQ ID NO: 6528857 - DNA, 13 bp, Homo sapiens
tgggctggcagag

SEQ ID NO: 6528858 - DNA, 14 bp, Homo sapiens
tgggctggcagagg

SEQ ID NO: 6528859 - DNA, 14 bp, Homo sapiens
tgggctggcccagc

SEQ ID NO: 6528860 - DNA, 14 bp, Homo sapiens
tgggctggccgctg

SEQ ID NO: 6528861 - DNA, 23 bp, Homo sapiens
tgggctggccgctgtgccaggcg

SEQ ID NO: 6528862 - DNA, 18 bp, Homo sapiens
tgggctggcgggccctgg

SEQ ID NO: 6528863 - DNA, 23 bp, Homo sapiens
tgggctggcgggccctggagctc

SEQ ID NO: 6528864 - DNA, 19 bp, Homo sapiens
tgggctggctccctcttgg

SEQ ID NO: 6528865 - DNA, 17 bp, Homo sapiens
ttcacagtgaagtgcct

SEQ ID NO: 6528866 - DNA, 21 bp, Homo sapiens
ttcacagtgccaggaaagagt

SEQ ID NO: 6528867 - DNA, 15 bp, Homo sapiens
ttcacagtgggcggc

SEQ ID NO: 6528868 - DNA, 22 bp, Homo sapiens
ttcacagtgtttcgacagctga

SEQ ID NO: 6528869 - DNA, 15 bp, Homo sapiens
ttcacagttctgtaa

SEQ ID NO: 6528870 - DNA, 16 bp, Homo sapiens
ttcacagtttgaaata

SEQ ID NO: 6528871 - DNA, 22 bp, Homo sapiens
ttcacagtttgaaataagctat

SEQ ID NO: 6528872 - DNA, 14 bp, Homo sapiens
ttcacataaatgca

SEQ ID NO: 6528873 - DNA, 20 bp, Homo sapiens
ttcacataagctcagaatcc

SEQ ID NO: 6528874 - DNA, 13 bp, Homo sapiens
ttcacataataaa

SEQ ID NO: 6528875 - DNA, 17 bp, Homo sapiens
ttcacataccctccccc

SEQ ID NO: 6528876 - DNA, 21 bp, Homo sapiens
ttcacatacgtgtctgtgtgt

SEQ ID NO: 6528877 - DNA, 17 bp, Homo sapiens
ttcacatagatgtccct

SEQ ID NO: 6528878 - DNA, 15 bp, Homo sapiens
ttcacatagctgtct

SEQ ID NO: 6528879 - DNA, 21 bp, Homo sapiens
ttcacatatctagtatgaaat

SEQ ID NO: 6528880 - DNA, 17 bp, Homo sapiens
ttcacatattgatttcc

SEQ ID NO: 6528881 - DNA, 20 bp, Homo sapiens
ttcacatctaacctcatctt

SEQ ID NO: 6528882 - DNA, 13 bp, Homo sapiens
ttcacatctcatt

SEQ ID NO: 6528883 - DNA, 11 bp, Homo sapiens
ttcacatgaaa

SEQ ID NO: 6528884 - DNA, 19 bp, Homo sapiens
ttcacatgagctatttcca

SEQ ID NO: 6528885 - DNA, 23 bp, Homo sapiens
ttcacatgccctcggtcactgag

SEQ ID NO: 6528886 - DNA, 10 bp, Homo sapiens
ttcacatgga

SEQ ID NO: 6528887 - DNA, 14 bp, Homo sapiens
ttcacatgtgccct

SEQ ID NO: 6528888 - DNA, 15 bp, Homo sapiens
ttcacatgtgccctg

SEQ ID NO: 6528889 - DNA, 21 bp, Homo sapiens
ttcacatgtgccctgccttga

SEQ ID NO: 6528890 - DNA, 18 bp, Homo sapiens
ttcacattaaaaaatgaa

SEQ ID NO: 6528891 - DNA, 15 bp, Homo sapiens
ttcacattagaagac

SEQ ID NO: 6528892 - DNA, 16 bp, Homo sapiens
ttcacattagaagaca

SEQ ID NO: 6528893 - DNA, 16 bp, Homo sapiens
ttcacattaggctgtt

SEQ ID NO: 6528894 - DNA, 14 bp, Homo sapiens
ttcacattattctg

SEQ ID NO: 6528895 - DNA, 20 bp, Homo sapiens
ttcacattcttataaatatg

SEQ ID NO: 6528896 - DNA, 16 bp, Homo sapiens
ttcacattcttggctt

SEQ ID NO: 6528897 - DNA, 15 bp, Homo sapiens
ttcacattgcagtta

SEQ ID NO: 6528898 - DNA, 13 bp, Homo sapiens
ttcacattggaaa

SEQ ID NO: 6528899 - DNA, 17 bp, Homo sapiens
ttcacattgtgtgaata

SEQ ID NO: 6528900 - DNA, 21 bp, Homo sapiens
ttcacattgttaagaaaaata

SEQ ID NO: 6528901 - DNA, 21 bp, Homo sapiens
ttcacatttaaatggttctgt

SEQ ID NO: 6528902 - DNA, 14 bp, Homo sapiens
ttcacatttagaat

SEQ ID NO: 6528903 - DNA, 20 bp, Homo sapiens
ttcacatttcaagatccaaa

SEQ ID NO: 6528904 - DNA, 20 bp, Homo sapiens
ttcacatttgatgtacatgt

SEQ ID NO: 6528905 - DNA, 20 bp, Homo sapiens
ttcacatttggaatttaaag

SEQ ID NO: 6528906 - DNA, 17 bp, Homo sapiens
ttcacatttttgtattt

SEQ ID NO: 6528907 - DNA, 13 bp, Homo sapiens
ttcaccaaaatta

SEQ ID NO: 6528908 - DNA, 15 bp, Homo sapiens
ttcaccaaaattatc

SEQ ID NO: 6528909 - DNA, 19 bp, Homo sapiens
ttcaccaaagatctgctcc

SEQ ID NO: 6528910 - DNA, 14 bp, Homo sapiens
ttcaccaaatcttg

SEQ ID NO: 6528911 - DNA, 23 bp, Homo sapiens
ttcaccaaatgatgccacttccc

SEQ ID NO: 6528912 - DNA, 21 bp, Homo sapiens
ttcaccaacaacagtcagcca

SEQ ID NO: 6528913 - DNA, 15 bp, Homo sapiens
ttcaccaagaacagc

SEQ ID NO: 6528914 - DNA, 20 bp, Homo sapiens
ttcaccaagcttagaagcca

SEQ ID NO: 6528915 - DNA, 15 bp, Homo sapiens
ttcaccaatgttgta

SEQ ID NO: 6528916 - DNA, 23 bp, Homo sapiens
ttcaccaatgttgtacagagaag

SEQ ID NO: 6528917 - DNA, 13 bp, Homo sapiens
ttcaccaccccct

SEQ ID NO: 6528918 - DNA, 12 bp, Homo sapiens
ttcaccaccctg

SEQ ID NO: 6528919 - DNA, 22 bp, Homo sapiens
ttcaccaccctgggaccccccc

SEQ ID NO: 6528920 - DNA, 18 bp, Homo sapiens
ttcaccactcctctccct

SEQ ID NO: 6528921 - DNA, 19 bp, Homo sapiens
ttcaccactcctctccctt

SEQ ID NO: 6528922 - DNA, 19 bp, Homo sapiens
ttcaccagaggaatcactc

SEQ ID NO: 6528923 - DNA, 18 bp, Homo sapiens
ttcaccagatttgctaat

SEQ ID NO: 6528924 - DNA, 12 bp, Homo sapiens
ttcaccagccct

SEQ ID NO: 6528925 - DNA, 16 bp, Homo sapiens
ttcaccagtctgtcta

SEQ ID NO: 6528926 - DNA, 19 bp, Homo sapiens
ttcaccagtctgtctactg

SEQ ID NO: 6528927 - DNA, 14 bp, Homo sapiens
ttcaccagtgttcc

SEQ ID NO: 6528928 - DNA, 15 bp, Homo sapiens
ttcaccagtgttttt

SEQ ID NO: 6528929 - DNA, 20 bp, Homo sapiens
ttcaccatcatgtaccaagt

SEQ ID NO: 6528930 - DNA, 16 bp, Homo sapiens
ttcaccatctttgagg

SEQ ID NO: 6528931 - DNA, 21 bp, Homo sapiens
ttcaccatgatggccaggctg

SEQ ID NO: 6528932 - DNA, 16 bp, Homo sapiens
ttcaccatggccccct

SEQ ID NO: 6528933 - DNA, 12 bp, Homo sapiens
ttcaccatgtaa

SEQ ID NO: 6528934 - DNA, 23 bp, Homo sapiens
ttcaccatgtaaaacaaaaaaca

SEQ ID NO: 6528935 - DNA, 18 bp, Homo sapiens
ttcaccatgttagccggg

SEQ ID NO: 6528936 - DNA, 17 bp, Homo sapiens
ttcaccattcaaacagg

SEQ ID NO: 6528937 - DNA, 13 bp, Homo sapiens
ttcaccattcgta

SEQ ID NO: 6528938 - DNA, 16 bp, Homo sapiens
ttcacccacagaaaga

SEQ ID NO: 6528939 - DNA, 17 bp, Homo sapiens
ttcacccacagaaagag

SEQ ID NO: 6528940 - DNA, 19 bp, Homo sapiens
ttcacccacagaaagagag

SEQ ID NO: 6528941 - DNA, 18 bp, Homo sapiens
ttcacccaccaggccagc

SEQ ID NO: 6528942 - DNA, 14 bp, Homo sapiens
ttcacccaccatgc

SEQ ID NO: 6528943 - DNA, 21 bp, Homo sapiens
ttcacccaggcctatgttgat

SEQ ID NO: 6528944 - DNA, 11 bp, Homo sapiens
ttcacccatcc

SEQ ID NO: 6528945 - DNA, 16 bp, Homo sapiens
ttcacccatcttatca

SEQ ID NO: 6528946 - DNA, 13 bp, Homo sapiens
ttcaccccaccct

SEQ ID NO: 6528947 - DNA, 17 bp, Homo sapiens
ttcaccccagggcctga

SEQ ID NO: 6528948 - DNA, 20 bp, Homo sapiens
ttcaccccagggcctgagcc

SEQ ID NO: 6528949 - DNA, 23 bp, Homo sapiens
ttcaccccatccctccttaagag

SEQ ID NO: 6528950 - DNA, 23 bp, Homo sapiens
ttcacccccatccacagttgtca

SEQ ID NO: 6528951 - DNA, 23 bp, Homo sapiens
ttcaccccccactcaccagtgtc

SEQ ID NO: 6528952 - DNA, 20 bp, Homo sapiens
ttcacccccctctgctgccg

SEQ ID NO: 6528953 - DNA, 18 bp, Homo sapiens
ttcaccccggcaggccct

SEQ ID NO: 6528954 - DNA, 15 bp, Homo sapiens
ttcacccctcccacc

SEQ ID NO: 6528955 - DNA, 18 bp, Homo sapiens
ttcacccctccctttctc

SEQ ID NO: 6528956 - DNA, 12 bp, Homo sapiens
ttcacccctgca

SEQ ID NO: 6528957 - DNA, 16 bp, Homo sapiens
ttcaccctccacttcc

SEQ ID NO: 6528958 - DNA, 13 bp, Homo sapiens
ttcaccctctgta

SEQ ID NO: 6528959 - DNA, 14 bp, Homo sapiens
ttcaccctgggcag

SEQ ID NO: 6528960 - DNA, 22 bp, Homo sapiens
ttcaccctgtccaaactgccta

SEQ ID NO: 6528961 - DNA, 17 bp, Homo sapiens
ttcaccctgtccctcta

SEQ ID NO: 6528962 - DNA, 16 bp, Homo sapiens
ttcaccgcattccagg

SEQ ID NO: 6528963 - DNA, 19 bp, Homo sapiens
ttcaccgtattagccagga

SEQ ID NO: 6528964 - DNA, 19 bp, Homo sapiens
ttcaccgtgttagccagga

SEQ ID NO: 6528965 - DNA, 19 bp, Homo sapiens
ttcacctaagagattctga

SEQ ID NO: 6528966 - DNA, 20 bp, Homo sapiens
ttcacctaagagattctgat

SEQ ID NO: 6528967 - DNA, 19 bp, Homo sapiens
ttcacctactaatgtctct

SEQ ID NO: 6528968 - DNA, 23 bp, Homo sapiens
ttcacctactaatgtctcttcta

SEQ ID NO: 6528969 - DNA, 18 bp, Homo sapiens
ttcacctatttcaaaaat

SEQ ID NO: 6528970 - DNA, 11 bp, Homo sapiens
ttcacctcagc

SEQ ID NO: 6528971 - DNA, 15 bp, Homo sapiens
ttcacctcagcctgg

SEQ ID NO: 6528972 - DNA, 16 bp, Homo sapiens
ttcacctcagcctgga

SEQ ID NO: 6528973 - DNA, 14 bp, Homo sapiens
ttcacctcagtaga

SEQ ID NO: 6528974 - DNA, 21 bp, Homo sapiens
ttcacctccaagcatttcatg

SEQ ID NO: 6528975 - DNA, 22 bp, Homo sapiens
ttcacctccctgctcagtgctt

SEQ ID NO: 6528976 - DNA, 17 bp, Homo sapiens
ttcacctcctaaaacaa

SEQ ID NO: 6528977 - DNA, 13 bp, Homo sapiens
ttcacctcctcgc

SEQ ID NO: 6528978 - DNA, 17 bp, Homo sapiens
ttcacctccttagtccc

SEQ ID NO: 6528979 - DNA, 16 bp, Homo sapiens
ttcacctccttcaatt

SEQ ID NO: 6528980 - DNA, 12 bp, Homo sapiens
ttcacctctatc

SEQ ID NO: 6528981 - DNA, 16 bp, Homo sapiens
ttcacctctgtacaga

SEQ ID NO: 6528982 - DNA, 21 bp, Homo sapiens
ttcacctcttccactccttct

SEQ ID NO: 6528983 - DNA, 14 bp, Homo sapiens
ttcacctcttcctc

SEQ ID NO: 6528984 - DNA, 17 bp, Homo sapiens
ttcacctcttcctctgg

SEQ ID NO: 6528985 - DNA, 17 bp, Homo sapiens
ttcacctctttgctccc

SEQ ID NO: 6528986 - DNA, 21 bp, Homo sapiens
ttcacctgattcaactaaaaa

SEQ ID NO: 6528987 - DNA, 18 bp, Homo sapiens
ttcacctgccccaactct

SEQ ID NO: 6528988 - DNA, 21 bp, Homo sapiens
ttcacctgggtttgcaagaat

SEQ ID NO: 6528989 - DNA, 13 bp, Homo sapiens
ttcacctgtaaaa

SEQ ID NO: 6528990 - DNA, 16 bp, Homo sapiens
ttcacctgtaaaactt

SEQ ID NO: 6528991 - DNA, 18 bp, Homo sapiens
ttcacctgtaaacctgag

SEQ ID NO: 6528992 - DNA, 16 bp, Homo sapiens
ttcacctgtatatttc

SEQ ID NO: 6528993 - DNA, 17 bp, Homo sapiens
ttcacctgtatatttct

SEQ ID NO: 6528994 - DNA, 23 bp, Homo sapiens
ttcacctgttaaggtggaaaatg

SEQ ID NO: 6528995 - DNA, 12 bp, Homo sapiens
ttcacctgttat

SEQ ID NO: 6528996 - DNA, 23 bp, Homo sapiens
ttcacctgtttttaagctgtttc

SEQ ID NO: 6528997 - DNA, 15 bp, Homo sapiens
ttcaccttatgtatt

SEQ ID NO: 6528998 - DNA, 17 bp, Homo sapiens
ttcaccttatgtattat

SEQ ID NO: 6528999 - DNA, 16 bp, Homo sapiens
ttcaccttcccctaaa

SEQ ID NO: 6529000 - DNA, 23 bp, Homo sapiens
ttcaccttcgtttactatgcctg

SEQ ID NO: 6529001 - DNA, 21 bp, Homo sapiens
ttcaccttctgtgcatctggc

SEQ ID NO: 6529002 - DNA, 14 bp, Homo sapiens
ttcaccttgaagaa

SEQ ID NO: 6529003 - DNA, 16 bp, Homo sapiens
ttcaccttgggatgat

SEQ ID NO: 6529004 - DNA, 15 bp, Homo sapiens
ttcacctttggtgca

SEQ ID NO: 6529005 - DNA, 19 bp, Homo sapiens
ttcacctttggtgcagagg

SEQ ID NO: 6529006 - DNA, 22 bp, Homo sapiens
ttcacctttggtgcagaggttt

SEQ ID NO: 6529007 - DNA, 23 bp, Homo sapiens
ttcacctttgtaagacatttgta

SEQ ID NO: 6529008 - DNA, 19 bp, Homo sapiens
ttcacctttgtccccaccg

SEQ ID NO: 6529009 - DNA, 22 bp, Homo sapiens
ttcacctttgtccccaccgcag

SEQ ID NO: 6529010 - DNA, 21 bp, Homo sapiens
ttcacgacaatgttgagaagt

SEQ ID NO: 6529011 - DNA, 14 bp, Homo sapiens
ttcacgaggaatct

SEQ ID NO: 6529012 - DNA, 22 bp, Homo sapiens
ttcacgccattctcctgcctca

SEQ ID NO: 6529013 - DNA, 23 bp, Homo sapiens
ttcacgcctgtaatcccagcact

SEQ ID NO: 6529014 - DNA, 22 bp, Homo sapiens
ttcacgctcacccagtcacctc

SEQ ID NO: 6529015 - DNA, 13 bp, Homo sapiens
ttcacggaagagc

SEQ ID NO: 6529016 - DNA, 16 bp, Homo sapiens
ttcacggcagaccaga

SEQ ID NO: 6529017 - DNA, 15 bp, Homo sapiens
ttcacggcctggcat

SEQ ID NO: 6529018 - DNA, 21 bp, Homo sapiens
ttcacgggaactctccaaata

SEQ ID NO: 6529019 - DNA, 22 bp, Homo sapiens
ttcacggggcccttacctgtga

SEQ ID NO: 6529020 - DNA, 14 bp, Homo sapiens
ttcacggtgacaca

SEQ ID NO: 6529021 - DNA, 14 bp, Homo sapiens
ttcacgtgcagctc

SEQ ID NO: 6529022 - DNA, 20 bp, Homo sapiens
ttcacgtgttttccatccca

SEQ ID NO: 6529023 - DNA, 14 bp, Homo sapiens
ttcactaaaaaggg

SEQ ID NO: 6529024 - DNA, 23 bp, Homo sapiens
ttcactaaaagtgtgtgaaacct

SEQ ID NO: 6529025 - DNA, 17 bp, Homo sapiens
ttcactaaagtgtcatc

SEQ ID NO: 6529026 - DNA, 15 bp, Homo sapiens
ttcactaaatgtaaa

SEQ ID NO: 6529027 - DNA, 14 bp, Homo sapiens
ttcactaacctttt

SEQ ID NO: 6529028 - DNA, 14 bp, Homo sapiens
ttcactaagccatg

SEQ ID NO: 6529029 - DNA, 14 bp, Homo sapiens
ttcactaagctcct

SEQ ID NO: 6529030 - DNA, 23 bp, Homo sapiens
ttcactacccatcggtgtccatt

SEQ ID NO: 6529031 - DNA, 17 bp, Homo sapiens
ttcactactttaataaa

SEQ ID NO: 6529032 - DNA, 19 bp, Homo sapiens
ttcactagagacaaatctt

SEQ ID NO: 6529033 - DNA, 13 bp, Homo sapiens
ttcactagctttg

SEQ ID NO: 6529034 - DNA, 14 bp, Homo sapiens
ttcactagggctga

SEQ ID NO: 6529035 - DNA, 15 bp, Homo sapiens
ttcactagggctgag

SEQ ID NO: 6529036 - DNA, 18 bp, Homo sapiens
ttcactataaatggtgtt

SEQ ID NO: 6529037 - DNA, 20 bp, Homo sapiens
ttcactataatgatctaaga

SEQ ID NO: 6529038 - DNA, 14 bp, Homo sapiens
ttcactatttcctt

SEQ ID NO: 6529039 - DNA, 14 bp, Homo sapiens
ttcactcagctgga

SEQ ID NO: 6529040 - DNA, 21 bp, Homo sapiens
ttcactcatagccacttttat

SEQ ID NO: 6529041 - DNA, 20 bp, Homo sapiens
ttcactcatgcaaactgctt

SEQ ID NO: 6529042 - DNA, 14 bp, Homo sapiens
ttcactcattgaca

SEQ ID NO: 6529043 - DNA, 16 bp, Homo sapiens
ttcactcattgacatg

SEQ ID NO: 6529044 - DNA, 16 bp, Homo sapiens
tgggctggctgaagaa

SEQ ID NO: 6529045 - DNA, 13 bp, Homo sapiens
tgggctggctgcc

SEQ ID NO: 6529046 - DNA, 13 bp, Homo sapiens
tgggctggctgct

SEQ ID NO: 6529047 - DNA, 13 bp, Homo sapiens
tgggctgggagaa

SEQ ID NO: 6529048 - DNA, 23 bp, Homo sapiens
tgggctgggagaaggtgcttggg

SEQ ID NO: 6529049 - DNA, 21 bp, Homo sapiens
tgggctgggcacctgacttgg

SEQ ID NO: 6529050 - DNA, 14 bp, Homo sapiens
tgggctgggcactg

SEQ ID NO: 6529051 - DNA, 16 bp, Homo sapiens
tgggctgggcagcctt

SEQ ID NO: 6529052 - DNA, 19 bp, Homo sapiens
tgggctgggcagccttggg

SEQ ID NO: 6529053 - DNA, 16 bp, Homo sapiens
tgggctgggcccacaa

SEQ ID NO: 6529054 - DNA, 22 bp, Homo sapiens
tgggctgggccctctcttctca

SEQ ID NO: 6529055 - DNA, 22 bp, Homo sapiens
tgggctgggcccttcctggcta

SEQ ID NO: 6529056 - DNA, 15 bp, Homo sapiens
tgggctgggcgtggg

SEQ ID NO: 6529057 - DNA, 12 bp, Homo sapiens
tgggctgggctg

SEQ ID NO: 6529058 - DNA, 17 bp, Homo sapiens
tgggctgggctgggctg

SEQ ID NO: 6529059 - DNA, 17 bp, Homo sapiens
tgggctggggactctgg

SEQ ID NO: 6529060 - DNA, 15 bp, Homo sapiens
tgggctggggaggag

SEQ ID NO: 6529061 - DNA, 16 bp, Homo sapiens
tgggctggggcagggg

SEQ ID NO: 6529062 - DNA, 17 bp, Homo sapiens
tgggctggggcaggggc

SEQ ID NO: 6529063 - DNA, 17 bp, Homo sapiens
tgggctggggccacctt

SEQ ID NO: 6529064 - DNA, 21 bp, Homo sapiens
tgggctggggccacctttgtg

SEQ ID NO: 6529065 - DNA, 18 bp, Homo sapiens
tgggctggggcctcagac

SEQ ID NO: 6529066 - DNA, 12 bp, Homo sapiens
tgggctggggct

SEQ ID NO: 6529067 - DNA, 17 bp, Homo sapiens
tgggctggggctgctcc

SEQ ID NO: 6529068 - DNA, 20 bp, Homo sapiens
tgggctggggctgctcccct

SEQ ID NO: 6529069 - DNA, 15 bp, Homo sapiens
tgggctgggggactg

SEQ ID NO: 6529070 - DNA, 20 bp, Homo sapiens
tgggctgggtgcgaccccat

SEQ ID NO: 6529071 - DNA, 16 bp, Homo sapiens
tgggctgggtgctggg

SEQ ID NO: 6529072 - DNA, 18 bp, Homo sapiens
tgggctgggtggcccctg

SEQ ID NO: 6529073 - DNA, 18 bp, Homo sapiens
tgggctgggttctaccca

SEQ ID NO: 6529074 - DNA, 19 bp, Homo sapiens
tgggctgggttctacccag

SEQ ID NO: 6529075 - DNA, 23 bp, Homo sapiens
tgggctgggttctacccaggtgc

SEQ ID NO: 6529076 - DNA, 17 bp, Homo sapiens
tgggctgggtttgctgt

SEQ ID NO: 6529077 - DNA, 18 bp, Homo sapiens
tgggctggtatctcagaa

SEQ ID NO: 6529078 - DNA, 22 bp, Homo sapiens
tgggctggtattggtggctttc

SEQ ID NO: 6529079 - DNA, 19 bp, Homo sapiens
tgggctggtgccccacagc

SEQ ID NO: 6529080 - DNA, 20 bp, Homo sapiens
tgggctggtgccccacagct

SEQ ID NO: 6529081 - DNA, 17 bp, Homo sapiens
tgggctggttgctgtag

SEQ ID NO: 6529082 - DNA, 23 bp, Homo sapiens
tgggctggttggagaaggtcaca

SEQ ID NO: 6529083 - DNA, 12 bp, Homo sapiens
tgggctgtccag

SEQ ID NO: 6529084 - DNA, 15 bp, Homo sapiens
tgggctgtctctccc

SEQ ID NO: 6529085 - DNA, 22 bp, Homo sapiens
tgggctgtgagtgtaagtgtga

SEQ ID NO: 6529086 - DNA, 19 bp, Homo sapiens
tgggctgtgcctgaggctg

SEQ ID NO: 6529087 - DNA, 12 bp, Homo sapiens
tgggctgtgcta

SEQ ID NO: 6529088 - DNA, 14 bp, Homo sapiens
tgggctgtggggcc

SEQ ID NO: 6529089 - DNA, 20 bp, Homo sapiens
tgggctgtgttgactgctgc

SEQ ID NO: 6529090 - DNA, 19 bp, Homo sapiens
tgggctgttggcactcaca

SEQ ID NO: 6529091 - DNA, 23 bp, Homo sapiens
tgggctgttggcactcacagacc

SEQ ID NO: 6529092 - DNA, 17 bp, Homo sapiens
tgggctgttgtgtctgg

SEQ ID NO: 6529093 - DNA, 20 bp, Homo sapiens
tgggctgttgtgtctggagc

SEQ ID NO: 6529094 - DNA, 23 bp, Homo sapiens
tgggctgttgtgtctggagcctg

SEQ ID NO: 6529095 - DNA, 19 bp, Homo sapiens
tgggctgtttctgcttatt

SEQ ID NO: 6529096 - DNA, 20 bp, Homo sapiens
tgggcttaaagcagaagccc

SEQ ID NO: 6529097 - DNA, 14 bp, Homo sapiens
tgggcttaagaaat

SEQ ID NO: 6529098 - DNA, 22 bp, Homo sapiens
tgggcttacaggcatgagccac

SEQ ID NO: 6529099 - DNA, 21 bp, Homo sapiens
tgggcttatatctggcctctg

SEQ ID NO: 6529100 - DNA, 17 bp, Homo sapiens
tgggcttatgtctctgc

SEQ ID NO: 6529101 - DNA, 13 bp, Homo sapiens
tgggcttcagcct

SEQ ID NO: 6529102 - DNA, 13 bp, Homo sapiens
tgggcttcagggc

SEQ ID NO: 6529103 - DNA, 15 bp, Homo sapiens
tgggcttcagggcag

SEQ ID NO: 6529104 - DNA, 15 bp, Homo sapiens
tgggcttcagtggca

SEQ ID NO: 6529105 - DNA, 17 bp, Homo sapiens
tgggcttcagtggcagc

SEQ ID NO: 6529106 - DNA, 19 bp, Homo sapiens
tgggcttcagtggcagctg

SEQ ID NO: 6529107 - DNA, 20 bp, Homo sapiens
tgggcttcagtggcagctgc

SEQ ID NO: 6529108 - DNA, 22 bp, Homo sapiens
tgggcttcagtggcagctgctt

SEQ ID NO: 6529109 - DNA, 17 bp, Homo sapiens
tgggcttcattctggaa

SEQ ID NO: 6529110 - DNA, 19 bp, Homo sapiens
tgggcttccatttgtgtgt

SEQ ID NO: 6529111 - DNA, 20 bp, Homo sapiens
tgggcttcctgcccttccct

SEQ ID NO: 6529112 - DNA, 18 bp, Homo sapiens
tgggcttcctgctgggac

SEQ ID NO: 6529113 - DNA, 20 bp, Homo sapiens
tgggcttcctgctgggactg

SEQ ID NO: 6529114 - DNA, 13 bp, Homo sapiens
tgggcttcctgga

SEQ ID NO: 6529115 - DNA, 17 bp, Homo sapiens
tgggcttcctggagcag

SEQ ID NO: 6529116 - DNA, 20 bp, Homo sapiens
tgggcttcctggagcagaag

SEQ ID NO: 6529117 - DNA, 23 bp, Homo sapiens
tgggcttctgcggtgaggcaggg

SEQ ID NO: 6529118 - DNA, 12 bp, Homo sapiens
tgggcttctgtt

SEQ ID NO: 6529119 - DNA, 18 bp, Homo sapiens
tgggcttctgttctctgc

SEQ ID NO: 6529120 - DNA, 21 bp, Homo sapiens
tgggcttctgttctctgctga

SEQ ID NO: 6529121 - DNA, 14 bp, Homo sapiens
tgggcttcttcctc

SEQ ID NO: 6529122 - DNA, 16 bp, Homo sapiens
tgggcttcttcctcct

SEQ ID NO: 6529123 - DNA, 20 bp, Homo sapiens
tgggcttcttcctcctccat

SEQ ID NO: 6529124 - DNA, 14 bp, Homo sapiens
tgggcttggaccac

SEQ ID NO: 6529125 - DNA, 17 bp, Homo sapiens
tgggcttggacttcctg

SEQ ID NO: 6529126 - DNA, 12 bp, Homo sapiens
tgggcttggcca

SEQ ID NO: 6529127 - DNA, 24 bp, Homo sapiens
tgggcttggcccgcggcctgcacc

SEQ ID NO: 6529128 - DNA, 18 bp, Homo sapiens
tgggcttggcctgctgtg

SEQ ID NO: 6529129 - DNA, 15 bp, Homo sapiens
tgggcttggccttgt

SEQ ID NO: 6529130 - DNA, 14 bp, Homo sapiens
tgggcttgggccta

SEQ ID NO: 6529131 - DNA, 21 bp, Homo sapiens
tgggcttgtctgtagatttta

SEQ ID NO: 6529132 - DNA, 16 bp, Homo sapiens
tgggcttgtgctcggg

SEQ ID NO: 6529133 - DNA, 16 bp, Homo sapiens
tgggctttaaaagaaa

SEQ ID NO: 6529134 - DNA, 16 bp, Homo sapiens
tgggctttaacaaaac

SEQ ID NO: 6529135 - DNA, 19 bp, Homo sapiens
tgggctttaacaaaacaag

SEQ ID NO: 6529136 - DNA, 23 bp, Homo sapiens
tgggctttaacaaaacaagaaag

SEQ ID NO: 6529137 - DNA, 14 bp, Homo sapiens
tgggctttccaggg

SEQ ID NO: 6529138 - DNA, 18 bp, Homo sapiens
tgggctttctccggggtc

SEQ ID NO: 6529139 - DNA, 14 bp, Homo sapiens
tgggctttctcctg

SEQ ID NO: 6529140 - DNA, 16 bp, Homo sapiens
tgggctttctcctgga

SEQ ID NO: 6529141 - DNA, 24 bp, Homo sapiens
tgggctttctcctggagatagctg

SEQ ID NO: 6529142 - DNA, 12 bp, Homo sapiens
tgggctttctgg

SEQ ID NO: 6529143 - DNA, 16 bp, Homo sapiens
tgggctttgcaggctc

SEQ ID NO: 6529144 - DNA, 20 bp, Homo sapiens
tgggctttgcaggctctggg

SEQ ID NO: 6529145 - DNA, 22 bp, Homo sapiens
tgggctttgcaggctctgggct

SEQ ID NO: 6529146 - DNA, 17 bp, Homo sapiens
tgggctttgttgtgaga

SEQ ID NO: 6529147 - DNA, 22 bp, Homo sapiens
tgggctttgttgtgagaatggc

SEQ ID NO: 6529148 - DNA, 15 bp, Homo sapiens
tgggcttttccctgg

SEQ ID NO: 6529149 - DNA, 18 bp, Homo sapiens
tgggcttttccctgggtg

SEQ ID NO: 6529150 - DNA, 20 bp, Homo sapiens
tgggcttttccctgggtgga

SEQ ID NO: 6529151 - DNA, 14 bp, Homo sapiens
tggggaaaaaagca

SEQ ID NO: 6529152 - DNA, 15 bp, Homo sapiens
tggggaaaaaagcac

SEQ ID NO: 6529153 - DNA, 13 bp, Homo sapiens
tggggaaaaattc

SEQ ID NO: 6529154 - DNA, 22 bp, Homo sapiens
tggggaaaactacaaacgtttg

SEQ ID NO: 6529155 - DNA, 18 bp, Homo sapiens
tggggaaacagcatctcc

SEQ ID NO: 6529156 - DNA, 21 bp, Homo sapiens
tggggaaaccctggagccatc

SEQ ID NO: 6529157 - DNA, 14 bp, Homo sapiens
tggggaaacttggg

SEQ ID NO: 6529158 - DNA, 19 bp, Homo sapiens
tggggaaagacactgcctg

SEQ ID NO: 6529159 - DNA, 21 bp, Homo sapiens
tggggaaagacactgcctggg

SEQ ID NO: 6529160 - DNA, 18 bp, Homo sapiens
tggggaaagcctgaaggg

SEQ ID NO: 6529161 - DNA, 22 bp, Homo sapiens
tggggaaaggaatcaattattt

SEQ ID NO: 6529162 - DNA, 12 bp, Homo sapiens
tggggaaatgtg

SEQ ID NO: 6529163 - DNA, 23 bp, Homo sapiens
tggggaacaggtcccacgccagg

SEQ ID NO: 6529164 - DNA, 18 bp, Homo sapiens
tggggaacatttctgtaa

SEQ ID NO: 6529165 - DNA, 19 bp, Homo sapiens
tggggaacggaggaggaca

SEQ ID NO: 6529166 - DNA, 18 bp, Homo sapiens
tggggaactcccccagag

SEQ ID NO: 6529167 - DNA, 22 bp, Homo sapiens
tggggaactcccccagaggtgg

SEQ ID NO: 6529168 - DNA, 14 bp, Homo sapiens
tggggaactgaggg

SEQ ID NO: 6529169 - DNA, 20 bp, Homo sapiens
tggggaactgagggcaaggg

SEQ ID NO: 6529170 - DNA, 17 bp, Homo sapiens
tggggaagaaaaaatgt

SEQ ID NO: 6529171 - DNA, 13 bp, Homo sapiens
tggggaagacagt

SEQ ID NO: 6529172 - DNA, 24 bp, Homo sapiens
tggggaagacccattccttcccag

SEQ ID NO: 6529173 - DNA, 24 bp, Homo sapiens
tggggaagactgtggctgctagca

SEQ ID NO: 6529174 - DNA, 23 bp, Homo sapiens
tggggaagacttatgccatcccg

SEQ ID NO: 6529175 - DNA, 14 bp, Homo sapiens
tggggaagagagcc

SEQ ID NO: 6529176 - DNA, 17 bp, Homo sapiens
tggggaagagagcctgc

SEQ ID NO: 6529177 - DNA, 18 bp, Homo sapiens
tggggaagagagcctgcc

SEQ ID NO: 6529178 - DNA, 19 bp, Homo sapiens
tggggaagaggatgagcag

SEQ ID NO: 6529179 - DNA, 17 bp, Homo sapiens
tggggaagaggttttat

SEQ ID NO: 6529180 - DNA, 22 bp, Homo sapiens
tggggaagattagaaagaatta

SEQ ID NO: 6529181 - DNA, 22 bp, Homo sapiens
tggggaagcttccatgatgcac

SEQ ID NO: 6529182 - DNA, 22 bp, Homo sapiens
tggggaaggagaaggagtgcca

SEQ ID NO: 6529183 - DNA, 15 bp, Homo sapiens
tggggaaggagccag

SEQ ID NO: 6529184 - DNA, 17 bp, Homo sapiens
tggggaaggagggactt

SEQ ID NO: 6529185 - DNA, 19 bp, Homo sapiens
tggggaaggagggacttgg

SEQ ID NO: 6529186 - DNA, 14 bp, Homo sapiens
tggggaaggcaaga

SEQ ID NO: 6529187 - DNA, 15 bp, Homo sapiens
tggggaaggcagagg

SEQ ID NO: 6529188 - DNA, 20 bp, Homo sapiens
tggggaaggcagaggctggc

SEQ ID NO: 6529189 - DNA, 16 bp, Homo sapiens
tggggaagggcctgcc

SEQ ID NO: 6529190 - DNA, 15 bp, Homo sapiens
tggggaaggggcctg

SEQ ID NO: 6529191 - DNA, 17 bp, Homo sapiens
tggggaaggggcctggg

SEQ ID NO: 6529192 - DNA, 19 bp, Homo sapiens
tggggaaggggcctgggct

SEQ ID NO: 6529193 - DNA, 20 bp, Homo sapiens
tggggaaggggcctgggctg

SEQ ID NO: 6529194 - DNA, 17 bp, Homo sapiens
tggggaagggggctcca

SEQ ID NO: 6529195 - DNA, 17 bp, Homo sapiens
tggggaagggtggggag

SEQ ID NO: 6529196 - DNA, 20 bp, Homo sapiens
tggggaagggtggggagaaa

SEQ ID NO: 6529197 - DNA, 15 bp, Homo sapiens
tggggaagtcagggg

SEQ ID NO: 6529198 - DNA, 17 bp, Homo sapiens
tggggaagtcaggggag

SEQ ID NO: 6529199 - DNA, 21 bp, Homo sapiens
tggggaagtttatttgagaaa

SEQ ID NO: 6529200 - DNA, 24 bp, Homo sapiens
tggggaataatttccttcaggcag

SEQ ID NO: 6529201 - DNA, 14 bp, Homo sapiens
tggggaatcatttt

SEQ ID NO: 6529202 - DNA, 14 bp, Homo sapiens
tggggaatgaagat

SEQ ID NO: 6529203 - DNA, 15 bp, Homo sapiens
tggggaatgaagata

SEQ ID NO: 6529204 - DNA, 20 bp, Homo sapiens
tggggacacagcatcagctc

SEQ ID NO: 6529205 - DNA, 19 bp, Homo sapiens
tggggacaccctcctgccc

SEQ ID NO: 6529206 - DNA, 12 bp, Homo sapiens
tggggacactaa

SEQ ID NO: 6529207 - DNA, 20 bp, Homo sapiens
tggggacactaatgaagata

SEQ ID NO: 6529208 - DNA, 20 bp, Homo sapiens
tggggacagaccagcccttc

SEQ ID NO: 6529209 - DNA, 13 bp, Homo sapiens
tggggacagagcc

SEQ ID NO: 6529210 - DNA, 16 bp, Homo sapiens
tggggacagagccacc

SEQ ID NO: 6529211 - DNA, 20 bp, Homo sapiens
tggggacagagccaccccat

SEQ ID NO: 6529212 - DNA, 11 bp, Homo sapiens
tggggacagat

SEQ ID NO: 6529213 - DNA, 14 bp, Homo sapiens
tggggacagcttcc

SEQ ID NO: 6529214 - DNA, 20 bp, Homo sapiens
tggggacaggggcaggagga

SEQ ID NO: 6529215 - DNA, 18 bp, Homo sapiens
tggggacagggggtggga

SEQ ID NO: 6529216 - DNA, 21 bp, Homo sapiens
tggggacagtgcgtgatttct

SEQ ID NO: 6529217 - DNA, 15 bp, Homo sapiens
tggggacagttggca

SEQ ID NO: 6529218 - DNA, 19 bp, Homo sapiens
tggggacagttggcagaga

SEQ ID NO: 6529219 - DNA, 21 bp, Homo sapiens
tggggacagttggcagagaag

SEQ ID NO: 6529220 - DNA, 23 bp, Homo sapiens
tggggacagttggcagagaaggc

SEQ ID NO: 6529221 - DNA, 11 bp, Homo sapiens
ttcactccaaa

SEQ ID NO: 6529222 - DNA, 12 bp, Homo sapiens
ttcactccaaag

SEQ ID NO: 6529223 - DNA, 13 bp, Homo sapiens
ttcactccagtca

SEQ ID NO: 6529224 - DNA, 18 bp, Homo sapiens
ttcactccagtcaacaga

SEQ ID NO: 6529225 - DNA, 12 bp, Homo sapiens
ttcactccctct

SEQ ID NO: 6529226 - DNA, 13 bp, Homo sapiens
ttcactccctctt

SEQ ID NO: 6529227 - DNA, 22 bp, Homo sapiens
ttcactccggtgtgcctgcagc

SEQ ID NO: 6529228 - DNA, 21 bp, Homo sapiens
ttcactctccatttaataatt

SEQ ID NO: 6529229 - DNA, 19 bp, Homo sapiens
ttcactctcctatgccttt

SEQ ID NO: 6529230 - DNA, 14 bp, Homo sapiens
ttcactctccttgg

SEQ ID NO: 6529231 - DNA, 21 bp, Homo sapiens
ttcactctgggcacactctgc

SEQ ID NO: 6529232 - DNA, 14 bp, Homo sapiens
ttcactcttccaga

SEQ ID NO: 6529233 - DNA, 16 bp, Homo sapiens
ttcactcttccagaat

SEQ ID NO: 6529234 - DNA, 14 bp, Homo sapiens
ttcactcttggagc

SEQ ID NO: 6529235 - DNA, 21 bp, Homo sapiens
ttcactgaagtgaatacatgg

SEQ ID NO: 6529236 - DNA, 21 bp, Homo sapiens
ttcactgaatttcaaacattt

SEQ ID NO: 6529237 - DNA, 17 bp, Homo sapiens
ttcactgaccagcggct

SEQ ID NO: 6529238 - DNA, 22 bp, Homo sapiens
ttcactgaccagcggctgctca

SEQ ID NO: 6529239 - DNA, 17 bp, Homo sapiens
ttcactgagagctgcct

SEQ ID NO: 6529240 - DNA, 12 bp, Homo sapiens
ttcactgagctc

SEQ ID NO: 6529241 - DNA, 20 bp, Homo sapiens
ttcactgcaaacacaccttg

SEQ ID NO: 6529242 - DNA, 13 bp, Homo sapiens
ttcactgcaattt

SEQ ID NO: 6529243 - DNA, 13 bp, Homo sapiens
ttcactgcactgt

SEQ ID NO: 6529244 - DNA, 21 bp, Homo sapiens
ttcactgccaacttttagtgg

SEQ ID NO: 6529245 - DNA, 17 bp, Homo sapiens
ttcactgccagttgtct

SEQ ID NO: 6529246 - DNA, 20 bp, Homo sapiens
ttcactgccatgatagctgg

SEQ ID NO: 6529247 - DNA, 24 bp, Homo sapiens
ttcactgccatgatagctggggct

SEQ ID NO: 6529248 - DNA, 17 bp, Homo sapiens
ttcactgcctgtagaga

SEQ ID NO: 6529249 - DNA, 12 bp, Homo sapiens
ttcactgctgca

SEQ ID NO: 6529250 - DNA, 13 bp, Homo sapiens
ttcactgctgcaa

SEQ ID NO: 6529251 - DNA, 19 bp, Homo sapiens
ttcactgctgcaaggcctt

SEQ ID NO: 6529252 - DNA, 13 bp, Homo sapiens
ttcactgctggct

SEQ ID NO: 6529253 - DNA, 16 bp, Homo sapiens
ttcactgctggctgcc

SEQ ID NO: 6529254 - DNA, 15 bp, Homo sapiens
ttcactgctgttata

SEQ ID NO: 6529255 - DNA, 17 bp, Homo sapiens
ttcactggaagatttat

SEQ ID NO: 6529256 - DNA, 14 bp, Homo sapiens
ttcactggagcaca

SEQ ID NO: 6529257 - DNA, 18 bp, Homo sapiens
ttcactggcataaatctg

SEQ ID NO: 6529258 - DNA, 17 bp, Homo sapiens
ttcactggcgccttctc

SEQ ID NO: 6529259 - DNA, 19 bp, Homo sapiens
ttcactgtactgcatgtga

SEQ ID NO: 6529260 - DNA, 22 bp, Homo sapiens
ttcactgtactgcatgtgactt

SEQ ID NO: 6529261 - DNA, 19 bp, Homo sapiens
ttcactgtataaataggag

SEQ ID NO: 6529262 - DNA, 15 bp, Homo sapiens
ttcactgtatataaa

SEQ ID NO: 6529263 - DNA, 16 bp, Homo sapiens
ttcactgtatataaac

SEQ ID NO: 6529264 - DNA, 17 bp, Homo sapiens
ttcactgtatataaaca

SEQ ID NO: 6529265 - DNA, 21 bp, Homo sapiens
ttcactgtcaggaagaaatca

SEQ ID NO: 6529266 - DNA, 15 bp, Homo sapiens
ttcactgtctgtctg

SEQ ID NO: 6529267 - DNA, 15 bp, Homo sapiens
ttcactgtctgttgt

SEQ ID NO: 6529268 - DNA, 20 bp, Homo sapiens
ttcactgtcttactcaagat

SEQ ID NO: 6529269 - DNA, 19 bp, Homo sapiens
ttcactgtctttaattctg

SEQ ID NO: 6529270 - DNA, 13 bp, Homo sapiens
ttcactgtctttt

SEQ ID NO: 6529271 - DNA, 20 bp, Homo sapiens
ttcactgtgctccaacctga

SEQ ID NO: 6529272 - DNA, 13 bp, Homo sapiens
ttcactgtgctgt

SEQ ID NO: 6529273 - DNA, 22 bp, Homo sapiens
ttcactgttagctttttaaaac

SEQ ID NO: 6529274 - DNA, 16 bp, Homo sapiens
ttcactgttccctctg

SEQ ID NO: 6529275 - DNA, 18 bp, Homo sapiens
ttcacttaaaaaaatgcc

SEQ ID NO: 6529276 - DNA, 20 bp, Homo sapiens
ttcacttaaaagctggcttt

SEQ ID NO: 6529277 - DNA, 18 bp, Homo sapiens
ttcacttaagtttttcca

SEQ ID NO: 6529278 - DNA, 20 bp, Homo sapiens
ttcacttaagtttttccaaa

SEQ ID NO: 6529279 - DNA, 22 bp, Homo sapiens
ttcacttagaacctttctgtgt

SEQ ID NO: 6529280 - DNA, 12 bp, Homo sapiens
ttcacttcaaaa

SEQ ID NO: 6529281 - DNA, 21 bp, Homo sapiens
ttcacttcaaagctaaaaaat

SEQ ID NO: 6529282 - DNA, 15 bp, Homo sapiens
ttcacttcactgtgc

SEQ ID NO: 6529283 - DNA, 20 bp, Homo sapiens
ttcacttcgaaattctgagt

SEQ ID NO: 6529284 - DNA, 21 bp, Homo sapiens
ttcacttcgaaattctgagtt

SEQ ID NO: 6529285 - DNA, 13 bp, Homo sapiens
ttcacttcttcct

SEQ ID NO: 6529286 - DNA, 19 bp, Homo sapiens
ttcacttgagcaagatgat

SEQ ID NO: 6529287 - DNA, 21 bp, Homo sapiens
ttcacttgatgatacaatgaa

SEQ ID NO: 6529288 - DNA, 16 bp, Homo sapiens
ttcacttgatgtttgt

SEQ ID NO: 6529289 - DNA, 12 bp, Homo sapiens
ttcacttgtatt

SEQ ID NO: 6529290 - DNA, 13 bp, Homo sapiens
ttcacttgtctcc

SEQ ID NO: 6529291 - DNA, 19 bp, Homo sapiens
ttcacttgtctcctttctg

SEQ ID NO: 6529292 - DNA, 13 bp, Homo sapiens
ttcacttgtcttg

SEQ ID NO: 6529293 - DNA, 15 bp, Homo sapiens
ttcacttgtcttgct

SEQ ID NO: 6529294 - DNA, 18 bp, Homo sapiens
ttcacttgtcttgctctt

SEQ ID NO: 6529295 - DNA, 20 bp, Homo sapiens
ttcacttgtgtgtgtacctg

SEQ ID NO: 6529296 - DNA, 15 bp, Homo sapiens
ttcactttaaagtct

SEQ ID NO: 6529297 - DNA, 17 bp, Homo sapiens
ttcactttagatgctga

SEQ ID NO: 6529298 - DNA, 19 bp, Homo sapiens
ttcactttcacatagatgt

SEQ ID NO: 6529299 - DNA, 13 bp, Homo sapiens
ttcactttcatct

SEQ ID NO: 6529300 - DNA, 14 bp, Homo sapiens
ttcactttcatttt

SEQ ID NO: 6529301 - DNA, 14 bp, Homo sapiens
ttcactttctcctg

SEQ ID NO: 6529302 - DNA, 19 bp, Homo sapiens
ttcactttcttcaaagcca

SEQ ID NO: 6529303 - DNA, 12 bp, Homo sapiens
ttcactttgaaa

SEQ ID NO: 6529304 - DNA, 14 bp, Homo sapiens
ttcactttgaaaag

SEQ ID NO: 6529305 - DNA, 19 bp, Homo sapiens
ttcactttgtttatgcata

SEQ ID NO: 6529306 - DNA, 22 bp, Homo sapiens
ttcacttttgcaaggttccaca

SEQ ID NO: 6529307 - DNA, 13 bp, Homo sapiens
ttcacttttttct

SEQ ID NO: 6529308 - DNA, 16 bp, Homo sapiens
ttcagaaaaagaaatg

SEQ ID NO: 6529309 - DNA, 19 bp, Homo sapiens
ttcagaaaacagaaaaaaa

SEQ ID NO: 6529310 - DNA, 22 bp, Homo sapiens
ttcagaaaacagaaaaaaaaca

SEQ ID NO: 6529311 - DNA, 13 bp, Homo sapiens
ttcagaaaaccta

SEQ ID NO: 6529312 - DNA, 22 bp, Homo sapiens
ttcagaaaactgagctgcaatc

SEQ ID NO: 6529313 - DNA, 19 bp, Homo sapiens
ttcagaaaagacacttcaa

SEQ ID NO: 6529314 - DNA, 14 bp, Homo sapiens
ttcagaaaatatta

SEQ ID NO: 6529315 - DNA, 21 bp, Homo sapiens
ttcagaaaatattatgtgttt

SEQ ID NO: 6529316 - DNA, 15 bp, Homo sapiens
ttcagaaaatgttct

SEQ ID NO: 6529317 - DNA, 22 bp, Homo sapiens
ttcagaaacaaagcatttgact

SEQ ID NO: 6529318 - DNA, 20 bp, Homo sapiens
ttcagaaacccggcttcctg

SEQ ID NO: 6529319 - DNA, 16 bp, Homo sapiens
ttcagaaagacttggt

SEQ ID NO: 6529320 - DNA, 19 bp, Homo sapiens
ttcagaaagcctttcattt

SEQ ID NO: 6529321 - DNA, 22 bp, Homo sapiens
ttcagaaagggcagcccctccc

SEQ ID NO: 6529322 - DNA, 19 bp, Homo sapiens
ttcagaaatacagataaat

SEQ ID NO: 6529323 - DNA, 15 bp, Homo sapiens
ttcagaaatatgaaa

SEQ ID NO: 6529324 - DNA, 13 bp, Homo sapiens
ttcagaaatcctt

SEQ ID NO: 6529325 - DNA, 18 bp, Homo sapiens
ttcagaaatgctgcctgc

SEQ ID NO: 6529326 - DNA, 13 bp, Homo sapiens
ttcagaaatgtgt

SEQ ID NO: 6529327 - DNA, 13 bp, Homo sapiens
ttcagaaattaaa

SEQ ID NO: 6529328 - DNA, 23 bp, Homo sapiens
ttcagaaattccaactcctgatg

SEQ ID NO: 6529329 - DNA, 14 bp, Homo sapiens
ttcagaaattctca

SEQ ID NO: 6529330 - DNA, 20 bp, Homo sapiens
ttcagaaattggaacagaat

SEQ ID NO: 6529331 - DNA, 13 bp, Homo sapiens
ttcagaaatttaa

SEQ ID NO: 6529332 - DNA, 22 bp, Homo sapiens
ttcagaacaactgcaaagaaag

SEQ ID NO: 6529333 - DNA, 20 bp, Homo sapiens
ttcagaacaccaagacttga

SEQ ID NO: 6529334 - DNA, 17 bp, Homo sapiens
ttcagaacagtgtttga

SEQ ID NO: 6529335 - DNA, 16 bp, Homo sapiens
ttcagaaccatccata

SEQ ID NO: 6529336 - DNA, 22 bp, Homo sapiens
ttcagaaccccaactactgtgt

SEQ ID NO: 6529337 - DNA, 15 bp, Homo sapiens
ttcagaacctcttcc

SEQ ID NO: 6529338 - DNA, 19 bp, Homo sapiens
ttcagaacctcttccccag

SEQ ID NO: 6529339 - DNA, 21 bp, Homo sapiens
ttcagaactatttaaaataaa

SEQ ID NO: 6529340 - DNA, 22 bp, Homo sapiens
ttcagaactatttaaaataaag

SEQ ID NO: 6529341 - DNA, 14 bp, Homo sapiens
ttcagaactctcag

SEQ ID NO: 6529342 - DNA, 22 bp, Homo sapiens
ttcagaactgagggctctgttt

SEQ ID NO: 6529343 - DNA, 22 bp, Homo sapiens
ttcagaactgctaccatgaagt

SEQ ID NO: 6529344 - DNA, 13 bp, Homo sapiens
ttcagaactgtta

SEQ ID NO: 6529345 - DNA, 17 bp, Homo sapiens
ttcagaacttcatctgc

SEQ ID NO: 6529346 - DNA, 18 bp, Homo sapiens
ttcagaacttcatctgcc

SEQ ID NO: 6529347 - DNA, 15 bp, Homo sapiens
ttcagaagaaaggca

SEQ ID NO: 6529348 - DNA, 22 bp, Homo sapiens
ttcagaagacacaggggagcag

SEQ ID NO: 6529349 - DNA, 13 bp, Homo sapiens
ttcagaagacctc

SEQ ID NO: 6529350 - DNA, 16 bp, Homo sapiens
ttcagaagcaagccag

SEQ ID NO: 6529351 - DNA, 17 bp, Homo sapiens
ttcagaagcaagccaga

SEQ ID NO: 6529352 - DNA, 18 bp, Homo sapiens
ttcagaagcaagccagac

SEQ ID NO: 6529353 - DNA, 17 bp, Homo sapiens
ttcagaagcaggcaggg

SEQ ID NO: 6529354 - DNA, 16 bp, Homo sapiens
ttcagaagctattttt

SEQ ID NO: 6529355 - DNA, 23 bp, Homo sapiens
ttcagaaggaagcaaaatccctt

SEQ ID NO: 6529356 - DNA, 13 bp, Homo sapiens
ttcagaaggagaa

SEQ ID NO: 6529357 - DNA, 18 bp, Homo sapiens
ttcagaaggagaaggaaa

SEQ ID NO: 6529358 - DNA, 20 bp, Homo sapiens
ttcagaagtgcccttcctgc

SEQ ID NO: 6529359 - DNA, 22 bp, Homo sapiens
ttcagaagttaacatcaagcca

SEQ ID NO: 6529360 - DNA, 13 bp, Homo sapiens
ttcagaagttgtt

SEQ ID NO: 6529361 - DNA, 21 bp, Homo sapiens
ttcagaagttgttagtgattt

SEQ ID NO: 6529362 - DNA, 13 bp, Homo sapiens
ttcagaagtttaa

SEQ ID NO: 6529363 - DNA, 13 bp, Homo sapiens
ttcagaataaaat

SEQ ID NO: 6529364 - DNA, 14 bp, Homo sapiens
ttcagaataaaatt

SEQ ID NO: 6529365 - DNA, 15 bp, Homo sapiens
ttcagaataaaatta

SEQ ID NO: 6529366 - DNA, 14 bp, Homo sapiens
ttcagaataaatgg

SEQ ID NO: 6529367 - DNA, 21 bp, Homo sapiens
ttcagaataaattgatccttt

SEQ ID NO: 6529368 - DNA, 15 bp, Homo sapiens
ttcagaatatattga

SEQ ID NO: 6529369 - DNA, 22 bp, Homo sapiens
ttcagaatcaaacctttttata

SEQ ID NO: 6529370 - DNA, 15 bp, Homo sapiens
ttcagaatcacttct

SEQ ID NO: 6529371 - DNA, 19 bp, Homo sapiens
ttcagaatcacttctgaga

SEQ ID NO: 6529372 - DNA, 21 bp, Homo sapiens
ttcagaatcacttctgagaac

SEQ ID NO: 6529373 - DNA, 23 bp, Homo sapiens
ttcagaatcatgtcgatcctggg

SEQ ID NO: 6529374 - DNA, 13 bp, Homo sapiens
ttcagaatctgaa

SEQ ID NO: 6529375 - DNA, 21 bp, Homo sapiens
ttcagaatctgaatgtaattt

SEQ ID NO: 6529376 - DNA, 23 bp, Homo sapiens
ttcagaatctgaatgtaatttgt

SEQ ID NO: 6529377 - DNA, 16 bp, Homo sapiens
ttcagaatcttttcaa

SEQ ID NO: 6529378 - DNA, 22 bp, Homo sapiens
ttcagaatggcagtcctggagg

SEQ ID NO: 6529379 - DNA, 22 bp, Homo sapiens
ttcagaattgaaggagaaaatg

SEQ ID NO: 6529380 - DNA, 23 bp, Homo sapiens
ttcagaattgtttttagaaattt

SEQ ID NO: 6529381 - DNA, 15 bp, Homo sapiens
ttcagaatttagtgt

SEQ ID NO: 6529382 - DNA, 21 bp, Homo sapiens
ttcagaatttagtgtatccat

SEQ ID NO: 6529383 - DNA, 23 bp, Homo sapiens
ttcagaattttatactttcccta

SEQ ID NO: 6529384 - DNA, 20 bp, Homo sapiens
ttcagacaacattatgatct

SEQ ID NO: 6529385 - DNA, 21 bp, Homo sapiens
ttcagacaacattatgatcta

SEQ ID NO: 6529386 - DNA, 15 bp, Homo sapiens
ttcagacaagacaga

SEQ ID NO: 6529387 - DNA, 15 bp, Homo sapiens
ttcagacaagcaaca

SEQ ID NO: 6529388 - DNA, 21 bp, Homo sapiens
ttcagacaagcaacaggtttt

SEQ ID NO: 6529389 - DNA, 19 bp, Homo sapiens
ttcagacacagctcttcca

SEQ ID NO: 6529390 - DNA, 16 bp, Homo sapiens
ttcagacacaggaaaa

SEQ ID NO: 6529391 - DNA, 17 bp, Homo sapiens
ttcagacacaggaaaaa

SEQ ID NO: 6529392 - DNA, 22 bp, Homo sapiens
ttcagacacaggaaaaataaac

SEQ ID NO: 6529393 - DNA, 17 bp, Homo sapiens
ttcagacagctgcctgg

SEQ ID NO: 6529394 - DNA, 10 bp, Homo sapiens
ttcagacagg

SEQ ID NO: 6529395 - DNA, 12 bp, Homo sapiens
ttcagacatatc

SEQ ID NO: 6529396 - DNA, 19 bp, Homo sapiens
ttcagacatttttggaaat

SEQ ID NO: 6529397 - DNA, 10 bp, Homo sapiens
ttcagacccc

SEQ ID NO: 6529398 - DNA, 15 bp, Homo sapiens
ttcagaccccagcgg

SEQ ID NO: 6529399 - DNA, 14 bp, Homo sapiens
ttcagaccccccca

SEQ ID NO: 6529400 - DNA, 17 bp, Homo sapiens
tggggaccacagaggct

SEQ ID NO: 6529401 - DNA, 21 bp, Homo sapiens
tggggaccacagaggctgtgg

SEQ ID NO: 6529402 - DNA, 21 bp, Homo sapiens
tggggaccagcagtctgcctg

SEQ ID NO: 6529403 - DNA, 15 bp, Homo sapiens
tggggacccacccag

SEQ ID NO: 6529404 - DNA, 11 bp, Homo sapiens
tggggacccag

SEQ ID NO: 6529405 - DNA, 22 bp, Homo sapiens
tggggacccccacgattggcca

SEQ ID NO: 6529406 - DNA, 22 bp, Homo sapiens
tggggacccgctgggggctggc

SEQ ID NO: 6529407 - DNA, 15 bp, Homo sapiens
tggggaccctgggcc

SEQ ID NO: 6529408 - DNA, 17 bp, Homo sapiens
tggggacctcagcctgc

SEQ ID NO: 6529409 - DNA, 15 bp, Homo sapiens
tggggacctcaggcc

SEQ ID NO: 6529410 - DNA, 23 bp, Homo sapiens
tggggacctcaggcctgggggct

SEQ ID NO: 6529411 - DNA, 14 bp, Homo sapiens
tggggacctgaact

SEQ ID NO: 6529412 - DNA, 18 bp, Homo sapiens
tggggacctggcactggg

SEQ ID NO: 6529413 - DNA, 20 bp, Homo sapiens
tggggacctggggggaggga

SEQ ID NO: 6529414 - DNA, 22 bp, Homo sapiens
tggggacgaattccactcgtcc

SEQ ID NO: 6529415 - DNA, 20 bp, Homo sapiens
tggggacgccaaggaggtgg

SEQ ID NO: 6529416 - DNA, 15 bp, Homo sapiens
tggggacggggctcc

SEQ ID NO: 6529417 - DNA, 16 bp, Homo sapiens
tggggacggggctccc

SEQ ID NO: 6529418 - DNA, 22 bp, Homo sapiens
tggggacgggggctgcttctcc

SEQ ID NO: 6529419 - DNA, 20 bp, Homo sapiens
tggggacgtcctgccacctg

SEQ ID NO: 6529420 - DNA, 14 bp, Homo sapiens
tggggactcaggga

SEQ ID NO: 6529421 - DNA, 19 bp, Homo sapiens
tggggactcgggggctggt

SEQ ID NO: 6529422 - DNA, 17 bp, Homo sapiens
tggggactgcattggac

SEQ ID NO: 6529423 - DNA, 14 bp, Homo sapiens
tggggactgggcac

SEQ ID NO: 6529424 - DNA, 14 bp, Homo sapiens
tggggactgttcca

SEQ ID NO: 6529425 - DNA, 20 bp, Homo sapiens
tggggactgttccaaagcca

SEQ ID NO: 6529426 - DNA, 23 bp, Homo sapiens
tggggactgttccaaagccagtg

SEQ ID NO: 6529427 - DNA, 22 bp, Homo sapiens
tggggacttcaactgcccagca

SEQ ID NO: 6529428 - DNA, 23 bp, Homo sapiens
tggggacttcaactgcccagcaa

SEQ ID NO: 6529429 - DNA, 15 bp, Homo sapiens
tggggacttcccggg

SEQ ID NO: 6529430 - DNA, 24 bp, Homo sapiens
tggggacttgatgttccttccaga

SEQ ID NO: 6529431 - DNA, 19 bp, Homo sapiens
tggggacttggcctctctc

SEQ ID NO: 6529432 - DNA, 21 bp, Homo sapiens
tggggactttatttatttcta

SEQ ID NO: 6529433 - DNA, 12 bp, Homo sapiens
tggggagaaagg

SEQ ID NO: 6529434 - DNA, 12 bp, Homo sapiens
tggggagaaagt

SEQ ID NO: 6529435 - DNA, 12 bp, Homo sapiens
tggggagaaggg

SEQ ID NO: 6529436 - DNA, 14 bp, Homo sapiens
tggggagacctggt

SEQ ID NO: 6529437 - DNA, 20 bp, Homo sapiens
tggggagacctggttggccg

SEQ ID NO: 6529438 - DNA, 20 bp, Homo sapiens
tggggagacggtgttgcaga

SEQ ID NO: 6529439 - DNA, 21 bp, Homo sapiens
tggggagactgggctgaggga

SEQ ID NO: 6529440 - DNA, 18 bp, Homo sapiens
tggggagagcggctggag

SEQ ID NO: 6529441 - DNA, 12 bp, Homo sapiens
tggggagaggca

SEQ ID NO: 6529442 - DNA, 14 bp, Homo sapiens
tggggagaggcact

SEQ ID NO: 6529443 - DNA, 21 bp, Homo sapiens
tggggagagggaggggagaga

SEQ ID NO: 6529444 - DNA, 20 bp, Homo sapiens
tggggagagggatttccctg

SEQ ID NO: 6529445 - DNA, 21 bp, Homo sapiens
tggggagagggatttccctgc

SEQ ID NO: 6529446 - DNA, 14 bp, Homo sapiens
tggggagagggcat

SEQ ID NO: 6529447 - DNA, 12 bp, Homo sapiens
tggggagatcca

SEQ ID NO: 6529448 - DNA, 20 bp, Homo sapiens
tggggagatcggggccagag

SEQ ID NO: 6529449 - DNA, 15 bp, Homo sapiens
tggggagatgcttct

SEQ ID NO: 6529450 - DNA, 14 bp, Homo sapiens
tggggagatggggg

SEQ ID NO: 6529451 - DNA, 15 bp, Homo sapiens
tggggagatgggggc

SEQ ID NO: 6529452 - DNA, 16 bp, Homo sapiens
tggggagatgggggct

SEQ ID NO: 6529453 - DNA, 22 bp, Homo sapiens
tggggagcagagtataggatgg

SEQ ID NO: 6529454 - DNA, 14 bp, Homo sapiens
tggggagcagctga

SEQ ID NO: 6529455 - DNA, 18 bp, Homo sapiens
tggggagcaggaggccaa

SEQ ID NO: 6529456 - DNA, 16 bp, Homo sapiens
tggggagcaggcagcc

SEQ ID NO: 6529457 - DNA, 19 bp, Homo sapiens
tggggagcaggtctctggc

SEQ ID NO: 6529458 - DNA, 23 bp, Homo sapiens
tggggagcaggtctctggcagag

SEQ ID NO: 6529459 - DNA, 15 bp, Homo sapiens
tggggagcagtggcc

SEQ ID NO: 6529460 - DNA, 20 bp, Homo sapiens
tggggagcagttttcccctg

SEQ ID NO: 6529461 - DNA, 22 bp, Homo sapiens
tggggagcagttttcccctggc

SEQ ID NO: 6529462 - DNA, 18 bp, Homo sapiens
tggggagcccgtctcagt

SEQ ID NO: 6529463 - DNA, 19 bp, Homo sapiens
tggggagcccgtctcagtg

SEQ ID NO: 6529464 - DNA, 21 bp, Homo sapiens
tggggagcccgtctcagtgtt

SEQ ID NO: 6529465 - DNA, 14 bp, Homo sapiens
tggggagccctcag

SEQ ID NO: 6529466 - DNA, 16 bp, Homo sapiens
tggggagccctcaggc

SEQ ID NO: 6529467 - DNA, 21 bp, Homo sapiens
tggggagccgagggcgtcaga

SEQ ID NO: 6529468 - DNA, 12 bp, Homo sapiens
tggggagctgtt

SEQ ID NO: 6529469 - DNA, 23 bp, Homo sapiens
tggggagcttggctgagggtctg

SEQ ID NO: 6529470 - DNA, 13 bp, Homo sapiens
tggggaggaagag

SEQ ID NO: 6529471 - DNA, 14 bp, Homo sapiens
tggggaggaagaga

SEQ ID NO: 6529472 - DNA, 12 bp, Homo sapiens
tggggaggaagg

SEQ ID NO: 6529473 - DNA, 16 bp, Homo sapiens
tggggaggaagggcca

SEQ ID NO: 6529474 - DNA, 18 bp, Homo sapiens
tggggaggaagggccagg

SEQ ID NO: 6529475 - DNA, 19 bp, Homo sapiens
tggggaggaagggccagga

SEQ ID NO: 6529476 - DNA, 22 bp, Homo sapiens
tggggaggaagggccaggagag

SEQ ID NO: 6529477 - DNA, 23 bp, Homo sapiens
tggggaggaagggccaggagaga

SEQ ID NO: 6529478 - DNA, 18 bp, Homo sapiens
tggggaggacccctgccc

SEQ ID NO: 6529479 - DNA, 13 bp, Homo sapiens
tggggaggacctg

SEQ ID NO: 6529480 - DNA, 16 bp, Homo sapiens
tggggaggactaggac

SEQ ID NO: 6529481 - DNA, 12 bp, Homo sapiens
tggggaggagac

SEQ ID NO: 6529482 - DNA, 21 bp, Homo sapiens
tggggaggagactcaggccca

SEQ ID NO: 6529483 - DNA, 23 bp, Homo sapiens
tggggaggagactcaggcccaca

SEQ ID NO: 6529484 - DNA, 18 bp, Homo sapiens
tggggaggcagcagagcg

SEQ ID NO: 6529485 - DNA, 16 bp, Homo sapiens
tggggaggcagctcca

SEQ ID NO: 6529486 - DNA, 21 bp, Homo sapiens
tggggaggcccaaatgatgga

SEQ ID NO: 6529487 - DNA, 12 bp, Homo sapiens
tggggaggccct

SEQ ID NO: 6529488 - DNA, 18 bp, Homo sapiens
tggggaggccctgcctcc

SEQ ID NO: 6529489 - DNA, 19 bp, Homo sapiens
tggggaggctgaggcagga

SEQ ID NO: 6529490 - DNA, 22 bp, Homo sapiens
tggggaggctgcactggagcca

SEQ ID NO: 6529491 - DNA, 23 bp, Homo sapiens
tggggagggacaagggattctgg

SEQ ID NO: 6529492 - DNA, 23 bp, Homo sapiens
tggggagggacacagaggacggc

SEQ ID NO: 6529493 - DNA, 13 bp, Homo sapiens
tggggagggagaa

SEQ ID NO: 6529494 - DNA, 21 bp, Homo sapiens
tggggagggagacagagacag

SEQ ID NO: 6529495 - DNA, 16 bp, Homo sapiens
tggggagggaggggaa

SEQ ID NO: 6529496 - DNA, 14 bp, Homo sapiens
tggggagggatttg

SEQ ID NO: 6529497 - DNA, 22 bp, Homo sapiens
tggggagggatttggggctcag

SEQ ID NO: 6529498 - DNA, 17 bp, Homo sapiens
tggggagggcctctgga

SEQ ID NO: 6529499 - DNA, 21 bp, Homo sapiens
tggggaggggcctggcctggg

SEQ ID NO: 6529500 - DNA, 22 bp, Homo sapiens
tggggaggggcgctggcccagc

SEQ ID NO: 6529501 - DNA, 17 bp, Homo sapiens
tggggaggggctctgcg

SEQ ID NO: 6529502 - DNA, 22 bp, Homo sapiens
tggggagggtcaagggctgggg

SEQ ID NO: 6529503 - DNA, 17 bp, Homo sapiens
tggggagggtgacccac

SEQ ID NO: 6529504 - DNA, 20 bp, Homo sapiens
tggggagggtggaggggtga

SEQ ID NO: 6529505 - DNA, 17 bp, Homo sapiens
tggggaggtgctggggg

SEQ ID NO: 6529506 - DNA, 24 bp, Homo sapiens
tggggaggtgctgggggagccctg

SEQ ID NO: 6529507 - DNA, 20 bp, Homo sapiens
tggggaggtggcactaggga

SEQ ID NO: 6529508 - DNA, 21 bp, Homo sapiens
tggggaggtgggaggccaggc

SEQ ID NO: 6529509 - DNA, 23 bp, Homo sapiens
tggggaggtgttcactgaagacg

SEQ ID NO: 6529510 - DNA, 23 bp, Homo sapiens
tggggagtaaacggcccaggcca

SEQ ID NO: 6529511 - DNA, 20 bp, Homo sapiens
tggggagtattatggaaatc

SEQ ID NO: 6529512 - DNA, 22 bp, Homo sapiens
tggggagtcctcattgaatcct

SEQ ID NO: 6529513 - DNA, 16 bp, Homo sapiens
tggggagtgggacaga

SEQ ID NO: 6529514 - DNA, 16 bp, Homo sapiens
tggggagtgggaggaa

SEQ ID NO: 6529515 - DNA, 23 bp, Homo sapiens
tggggagtgggtggcaggtgggg

SEQ ID NO: 6529516 - DNA, 18 bp, Homo sapiens
tggggagttaagacctgg

SEQ ID NO: 6529517 - DNA, 20 bp, Homo sapiens
tggggagttaagacctggca

SEQ ID NO: 6529518 - DNA, 19 bp, Homo sapiens
tggggagtttagggtgggg

SEQ ID NO: 6529519 - DNA, 20 bp, Homo sapiens
tggggagtttagggtggggg

SEQ ID NO: 6529520 - DNA, 17 bp, Homo sapiens
tggggataaaggagaag

SEQ ID NO: 6529521 - DNA, 14 bp, Homo sapiens
tggggatagaggaa

SEQ ID NO: 6529522 - DNA, 16 bp, Homo sapiens
tggggatagatgtgtg

SEQ ID NO: 6529523 - DNA, 17 bp, Homo sapiens
tggggatagatgtgtgg

SEQ ID NO: 6529524 - DNA, 17 bp, Homo sapiens
tggggataggccagccg

SEQ ID NO: 6529525 - DNA, 13 bp, Homo sapiens
tggggatagtctg

SEQ ID NO: 6529526 - DNA, 13 bp, Homo sapiens
tggggatcacagc

SEQ ID NO: 6529527 - DNA, 23 bp, Homo sapiens
tggggatcacagcctcacccctg

SEQ ID NO: 6529528 - DNA, 18 bp, Homo sapiens
tggggatctcaggggctg

SEQ ID NO: 6529529 - DNA, 16 bp, Homo sapiens
tggggatgggtgggga

SEQ ID NO: 6529530 - DNA, 22 bp, Homo sapiens
tggggatggtgatggagaggga

SEQ ID NO: 6529531 - DNA, 19 bp, Homo sapiens
tggggatggtggcacaggc

SEQ ID NO: 6529532 - DNA, 21 bp, Homo sapiens
tggggatggtggcacaggcac

SEQ ID NO: 6529533 - DNA, 16 bp, Homo sapiens
tggggatgtgggaggg

SEQ ID NO: 6529534 - DNA, 16 bp, Homo sapiens
tggggattcagatttc

SEQ ID NO: 6529535 - DNA, 13 bp, Homo sapiens
tggggattcttaa

SEQ ID NO: 6529536 - DNA, 16 bp, Homo sapiens
tggggattcttaaagt

SEQ ID NO: 6529537 - DNA, 15 bp, Homo sapiens
tggggattgcccctg

SEQ ID NO: 6529538 - DNA, 19 bp, Homo sapiens
tggggattgggagggacag

SEQ ID NO: 6529539 - DNA, 16 bp, Homo sapiens
tggggattggtgggtc

SEQ ID NO: 6529540 - DNA, 17 bp, Homo sapiens
tggggatttctcccagc

SEQ ID NO: 6529541 - DNA, 15 bp, Homo sapiens
tggggatttctggga

SEQ ID NO: 6529542 - DNA, 19 bp, Homo sapiens
tggggcaaacctagccgga

SEQ ID NO: 6529543 - DNA, 20 bp, Homo sapiens
tggggcaaacctagccggaa

SEQ ID NO: 6529544 - DNA, 18 bp, Homo sapiens
tggggcaagatccaggtg

SEQ ID NO: 6529545 - DNA, 18 bp, Homo sapiens
tggggcaagattttcctt

SEQ ID NO: 6529546 - DNA, 18 bp, Homo sapiens
tggggcaagccagggccc

SEQ ID NO: 6529547 - DNA, 13 bp, Homo sapiens
tggggcaagcctg

SEQ ID NO: 6529548 - DNA, 22 bp, Homo sapiens
tggggcaaggggcagccagccc

SEQ ID NO: 6529549 - DNA, 15 bp, Homo sapiens
tggggcaatggggag

SEQ ID NO: 6529550 - DNA, 18 bp, Homo sapiens
tggggcacagggagaggc

SEQ ID NO: 6529551 - DNA, 15 bp, Homo sapiens
tggggcacagtccag

SEQ ID NO: 6529552 - DNA, 18 bp, Homo sapiens
tggggcacggactgtcca

SEQ ID NO: 6529553 - DNA, 16 bp, Homo sapiens
tggggcactcccccag

SEQ ID NO: 6529554 - DNA, 14 bp, Homo sapiens
tggggcagaaaggc

SEQ ID NO: 6529555 - DNA, 14 bp, Homo sapiens
tggggcagacacaa

SEQ ID NO: 6529556 - DNA, 13 bp, Homo sapiens
tggggcagagcct

SEQ ID NO: 6529557 - DNA, 12 bp, Homo sapiens
tggggcagagct

SEQ ID NO: 6529558 - DNA, 13 bp, Homo sapiens
tggggcagagctt

SEQ ID NO: 6529559 - DNA, 16 bp, Homo sapiens
tggggcagaggagaac

SEQ ID NO: 6529560 - DNA, 11 bp, Homo sapiens
tggggcagagt

SEQ ID NO: 6529561 - DNA, 21 bp, Homo sapiens
tggggcagatggcagggctga

SEQ ID NO: 6529562 - DNA, 16 bp, Homo sapiens
tggggcagatgtctcc

SEQ ID NO: 6529563 - DNA, 17 bp, Homo sapiens
tggggcagatgtctccc

SEQ ID NO: 6529564 - DNA, 15 bp, Homo sapiens
tggggcagcccccat

SEQ ID NO: 6529565 - DNA, 15 bp, Homo sapiens
tggggcagctcctct

SEQ ID NO: 6529566 - DNA, 16 bp, Homo sapiens
tggggcagctcctctg

SEQ ID NO: 6529567 - DNA, 18 bp, Homo sapiens
tggggcagctgagcagct

SEQ ID NO: 6529568 - DNA, 13 bp, Homo sapiens
tggggcaggagta

SEQ ID NO: 6529569 - DNA, 14 bp, Homo sapiens
tggggcaggagtag

SEQ ID NO: 6529570 - DNA, 22 bp, Homo sapiens
tggggcaggagtagctgagctc

SEQ ID NO: 6529571 - DNA, 21 bp, Homo sapiens
tggggcaggattctctgcagc

SEQ ID NO: 6529572 - DNA, 17 bp, Homo sapiens
tggggcaggctgggcca

SEQ ID NO: 6529573 - DNA, 14 bp, Homo sapiens
tggggcagggagct

SEQ ID NO: 6529574 - DNA, 21 bp, Homo sapiens
tggggcagggagctgggcccg

SEQ ID NO: 6529575 - DNA, 18 bp, Homo sapiens
tggggcagggcagcaggc

SEQ ID NO: 6529576 - DNA, 17 bp, Homo sapiens
tggggcagggcccaggg

SEQ ID NO: 6529577 - DNA, 13 bp, Homo sapiens
ttcagacctgaca

SEQ ID NO: 6529578 - DNA, 18 bp, Homo sapiens
ttcagacctttgtctgaa

SEQ ID NO: 6529579 - DNA, 22 bp, Homo sapiens
ttcagacctttgtctgaaggat

SEQ ID NO: 6529580 - DNA, 17 bp, Homo sapiens
ttcagactaaaaataca

SEQ ID NO: 6529581 - DNA, 14 bp, Homo sapiens
ttcagactcagact

SEQ ID NO: 6529582 - DNA, 15 bp, Homo sapiens
ttcagactctctcct

SEQ ID NO: 6529583 - DNA, 17 bp, Homo sapiens
ttcagactctctcctct

SEQ ID NO: 6529584 - DNA, 20 bp, Homo sapiens
ttcagactctctcctctctc

SEQ ID NO: 6529585 - DNA, 23 bp, Homo sapiens
ttcagactgcctgtctgcttgca

SEQ ID NO: 6529586 - DNA, 14 bp, Homo sapiens
ttcagactgcttca

SEQ ID NO: 6529587 - DNA, 14 bp, Homo sapiens
ttcagactgtgcaa

SEQ ID NO: 6529588 - DNA, 23 bp, Homo sapiens
ttcagacttgccatgtgactctg

SEQ ID NO: 6529589 - DNA, 19 bp, Homo sapiens
ttcagactttgcttcccat

SEQ ID NO: 6529590 - DNA, 21 bp, Homo sapiens
ttcagacttttatcaaaatcc

SEQ ID NO: 6529591 - DNA, 23 bp, Homo sapiens
ttcagagaaggccttacagaaaa

SEQ ID NO: 6529592 - DNA, 21 bp, Homo sapiens
ttcagagacagctgatacttc

SEQ ID NO: 6529593 - DNA, 15 bp, Homo sapiens
ttcagagactcaggg

SEQ ID NO: 6529594 - DNA, 19 bp, Homo sapiens
ttcagagactcctgcaggc

SEQ ID NO: 6529595 - DNA, 15 bp, Homo sapiens
ttcagagactgccct

SEQ ID NO: 6529596 - DNA, 15 bp, Homo sapiens
ttcagagactggcag

SEQ ID NO: 6529597 - DNA, 19 bp, Homo sapiens
ttcagagactggcagccag

SEQ ID NO: 6529598 - DNA, 13 bp, Homo sapiens
ttcagagagcagt

SEQ ID NO: 6529599 - DNA, 19 bp, Homo sapiens
ttcagagagcagtgctttt

SEQ ID NO: 6529600 - DNA, 21 bp, Homo sapiens
ttcagagagtcaatgtcatta

SEQ ID NO: 6529601 - DNA, 18 bp, Homo sapiens
ttcagagatggacagaga

SEQ ID NO: 6529602 - DNA, 18 bp, Homo sapiens
ttcagagatgtaccatgt

SEQ ID NO: 6529603 - DNA, 22 bp, Homo sapiens
ttcagagatgtaccatgttaaa

SEQ ID NO: 6529604 - DNA, 14 bp, Homo sapiens
ttcagagccaagcc

SEQ ID NO: 6529605 - DNA, 16 bp, Homo sapiens
ttcagagccagcctgg

SEQ ID NO: 6529606 - DNA, 17 bp, Homo sapiens
ttcagagccagcctggc

SEQ ID NO: 6529607 - DNA, 13 bp, Homo sapiens
ttcagagccagtg

SEQ ID NO: 6529608 - DNA, 12 bp, Homo sapiens
ttcagagcctag

SEQ ID NO: 6529609 - DNA, 15 bp, Homo sapiens
ttcagagcctagcca

SEQ ID NO: 6529610 - DNA, 18 bp, Homo sapiens
ttcagagcctagccacct

SEQ ID NO: 6529611 - DNA, 16 bp, Homo sapiens
ttcagagctgaggctt

SEQ ID NO: 6529612 - DNA, 18 bp, Homo sapiens
ttcagagctgccctctcc

SEQ ID NO: 6529613 - DNA, 19 bp, Homo sapiens
ttcagagctgccctctcct

SEQ ID NO: 6529614 - DNA, 20 bp, Homo sapiens
ttcagagctgccctctcctg

SEQ ID NO: 6529615 - DNA, 21 bp, Homo sapiens
ttcagagctgccctctcctgg

SEQ ID NO: 6529616 - DNA, 21 bp, Homo sapiens
ttcagaggagcatcagctgtc

SEQ ID NO: 6529617 - DNA, 22 bp, Homo sapiens
ttcagaggataaatatcaatgg

SEQ ID NO: 6529618 - DNA, 23 bp, Homo sapiens
ttcagaggccctcgctgccagct

SEQ ID NO: 6529619 - DNA, 19 bp, Homo sapiens
ttcagaggctcatctaact

SEQ ID NO: 6529620 - DNA, 14 bp, Homo sapiens
ttcagaggctgcag

SEQ ID NO: 6529621 - DNA, 9 bp, Homo sapiens
ttcagaggg

SEQ ID NO: 6529622 - DNA, 22 bp, Homo sapiens
ttcagagggaaactcagatgtc

SEQ ID NO: 6529623 - DNA, 23 bp, Homo sapiens
ttcagagtcctcattataaaatg

SEQ ID NO: 6529624 - DNA, 15 bp, Homo sapiens
ttcagagtgaatcat

SEQ ID NO: 6529625 - DNA, 22 bp, Homo sapiens
ttcagagttctttttgaagtat

SEQ ID NO: 6529626 - DNA, 14 bp, Homo sapiens
ttcagagtttgtgt

SEQ ID NO: 6529627 - DNA, 23 bp, Homo sapiens
ttcagagtttgtgtgtatttgta

SEQ ID NO: 6529628 - DNA, 12 bp, Homo sapiens
ttcagagtttta

SEQ ID NO: 6529629 - DNA, 14 bp, Homo sapiens
ttcagagttttctg

SEQ ID NO: 6529630 - DNA, 16 bp, Homo sapiens
ttcagagttttctggg

SEQ ID NO: 6529631 - DNA, 18 bp, Homo sapiens
ttcagagttttctgggta

SEQ ID NO: 6529632 - DNA, 17 bp, Homo sapiens
ttcagataaatcatggg

SEQ ID NO: 6529633 - DNA, 15 bp, Homo sapiens
ttcagataaggcaga

SEQ ID NO: 6529634 - DNA, 20 bp, Homo sapiens
ttcagataatcacaatacat

SEQ ID NO: 6529635 - DNA, 14 bp, Homo sapiens
ttcagataatgatg

SEQ ID NO: 6529636 - DNA, 15 bp, Homo sapiens
ttcagataatggtaa

SEQ ID NO: 6529637 - DNA, 17 bp, Homo sapiens
ttcagatacaaactgca

SEQ ID NO: 6529638 - DNA, 16 bp, Homo sapiens
ttcagatactggattg

SEQ ID NO: 6529639 - DNA, 20 bp, Homo sapiens
ttcagatactggattgtact

SEQ ID NO: 6529640 - DNA, 13 bp, Homo sapiens
ttcagatagagat

SEQ ID NO: 6529641 - DNA, 14 bp, Homo sapiens
ttcagatataaaag

SEQ ID NO: 6529642 - DNA, 19 bp, Homo sapiens
ttcagatataaaagactga

SEQ ID NO: 6529643 - DNA, 22 bp, Homo sapiens
ttcagatataaaagactgacca

SEQ ID NO: 6529644 - DNA, 15 bp, Homo sapiens
ttcagatatcaaaat

SEQ ID NO: 6529645 - DNA, 17 bp, Homo sapiens
ttcagatatcaaaattc

SEQ ID NO: 6529646 - DNA, 18 bp, Homo sapiens
ttcagatatcaaaattct

SEQ ID NO: 6529647 - DNA, 22 bp, Homo sapiens
ttcagatatcttggacaaatca

SEQ ID NO: 6529648 - DNA, 19 bp, Homo sapiens
ttcagatatgattcaaatg

SEQ ID NO: 6529649 - DNA, 16 bp, Homo sapiens
ttcagatattttgcac

SEQ ID NO: 6529650 - DNA, 19 bp, Homo sapiens
ttcagatcaaaatgccttt

SEQ ID NO: 6529651 - DNA, 21 bp, Homo sapiens
ttcagatcactgaatttataa

SEQ ID NO: 6529652 - DNA, 23 bp, Homo sapiens
ttcagatcatttaggatactctt

SEQ ID NO: 6529653 - DNA, 15 bp, Homo sapiens
ttcagatcctgctgc

SEQ ID NO: 6529654 - DNA, 15 bp, Homo sapiens
ttcagatctcataga

SEQ ID NO: 6529655 - DNA, 16 bp, Homo sapiens
ttcagatctcatagat

SEQ ID NO: 6529656 - DNA, 18 bp, Homo sapiens
ttcagatctcatagatga

SEQ ID NO: 6529657 - DNA, 20 bp, Homo sapiens
ttcagatctcatagatgacc

SEQ ID NO: 6529658 - DNA, 21 bp, Homo sapiens
ttcagatgaaaagaaaactta

SEQ ID NO: 6529659 - DNA, 17 bp, Homo sapiens
ttcagatgaccttttgg

SEQ ID NO: 6529660 - DNA, 19 bp, Homo sapiens
ttcagatgatttgaaagca

SEQ ID NO: 6529661 - DNA, 15 bp, Homo sapiens
ttcagatgcttctgg

SEQ ID NO: 6529662 - DNA, 14 bp, Homo sapiens
ttcagatgctttag

SEQ ID NO: 6529663 - DNA, 16 bp, Homo sapiens
ttcagatgtgaaccat

SEQ ID NO: 6529664 - DNA, 15 bp, Homo sapiens
ttcagatgtgcaata

SEQ ID NO: 6529665 - DNA, 16 bp, Homo sapiens
ttcagatgtgcaataa

SEQ ID NO: 6529666 - DNA, 17 bp, Homo sapiens
ttcagatgtgcatttca

SEQ ID NO: 6529667 - DNA, 23 bp, Homo sapiens
ttcagatgtgcatttcacctgtg

SEQ ID NO: 6529668 - DNA, 18 bp, Homo sapiens
ttcagatgtggagccagg

SEQ ID NO: 6529669 - DNA, 19 bp, Homo sapiens
ttcagatgtttccaagatg

SEQ ID NO: 6529670 - DNA, 22 bp, Homo sapiens
ttcagattccacacaaaatgtc

SEQ ID NO: 6529671 - DNA, 23 bp, Homo sapiens
ttcagattccacacaaaatgtca

SEQ ID NO: 6529672 - DNA, 21 bp, Homo sapiens
ttcagattcccagagcaaaat

SEQ ID NO: 6529673 - DNA, 19 bp, Homo sapiens
ttcagattggacataactg

SEQ ID NO: 6529674 - DNA, 13 bp, Homo sapiens
ttcagattgtctt

SEQ ID NO: 6529675 - DNA, 18 bp, Homo sapiens
ttcagatttctacacttt

SEQ ID NO: 6529676 - DNA, 17 bp, Homo sapiens
ttcagatttctctttga

SEQ ID NO: 6529677 - DNA, 19 bp, Homo sapiens
ttcagatttctctttgaaa

SEQ ID NO: 6529678 - DNA, 16 bp, Homo sapiens
ttcagatttgccttat

SEQ ID NO: 6529679 - DNA, 20 bp, Homo sapiens
ttcagattttaaaaagtctt

SEQ ID NO: 6529680 - DNA, 17 bp, Homo sapiens
ttcagcaaaaatatttt

SEQ ID NO: 6529681 - DNA, 19 bp, Homo sapiens
ttcagcaaaaatattttat

SEQ ID NO: 6529682 - DNA, 13 bp, Homo sapiens
ttcagcaaaccat

SEQ ID NO: 6529683 - DNA, 15 bp, Homo sapiens
ttcagcaaatgcctt

SEQ ID NO: 6529684 - DNA, 17 bp, Homo sapiens
ttcagcaaatgcctttt

SEQ ID NO: 6529685 - DNA, 16 bp, Homo sapiens
ttcagcaaattccaga

SEQ ID NO: 6529686 - DNA, 14 bp, Homo sapiens
ttcagcaaccctac

SEQ ID NO: 6529687 - DNA, 20 bp, Homo sapiens
ttcagcaacttattttgctt

SEQ ID NO: 6529688 - DNA, 14 bp, Homo sapiens
ttcagcaagagaga

SEQ ID NO: 6529689 - DNA, 15 bp, Homo sapiens
ttcagcacaataaat

SEQ ID NO: 6529690 - DNA, 17 bp, Homo sapiens
ttcagcacaccccaagg

SEQ ID NO: 6529691 - DNA, 20 bp, Homo sapiens
ttcagcacaggaattctcaa

SEQ ID NO: 6529692 - DNA, 22 bp, Homo sapiens
ttcagcacaggaattctcaaga

SEQ ID NO: 6529693 - DNA, 10 bp, Homo sapiens
ttcagcacca

SEQ ID NO: 6529694 - DNA, 16 bp, Homo sapiens
ttcagcaccaccctag

SEQ ID NO: 6529695 - DNA, 13 bp, Homo sapiens
ttcagcaccccca

SEQ ID NO: 6529696 - DNA, 14 bp, Homo sapiens
ttcagcacccccac

SEQ ID NO: 6529697 - DNA, 18 bp, Homo sapiens
ttcagcacccccacccac

SEQ ID NO: 6529698 - DNA, 19 bp, Homo sapiens
ttcagcacccccacccacc

SEQ ID NO: 6529699 - DNA, 22 bp, Homo sapiens
ttcagcacctacagtgtacagt

SEQ ID NO: 6529700 - DNA, 23 bp, Homo sapiens
ttcagcacctacagtgtacagtc

SEQ ID NO: 6529701 - DNA, 19 bp, Homo sapiens
ttcagcactagccaaacct

SEQ ID NO: 6529702 - DNA, 21 bp, Homo sapiens
ttcagcactagccaaacctca

SEQ ID NO: 6529703 - DNA, 23 bp, Homo sapiens
ttcagcactagccaaacctcacc

SEQ ID NO: 6529704 - DNA, 14 bp, Homo sapiens
ttcagcactgtccc

SEQ ID NO: 6529705 - DNA, 21 bp, Homo sapiens
ttcagcactgtcccttgcctc

SEQ ID NO: 6529706 - DNA, 13 bp, Homo sapiens
ttcagcacttgtc

SEQ ID NO: 6529707 - DNA, 19 bp, Homo sapiens
ttcagcacttgtctcattt

SEQ ID NO: 6529708 - DNA, 20 bp, Homo sapiens
ttcagcacttgtctcatttt

SEQ ID NO: 6529709 - DNA, 21 bp, Homo sapiens
ttcagcacttgtctcatttta

SEQ ID NO: 6529710 - DNA, 13 bp, Homo sapiens
ttcagcagaacct

SEQ ID NO: 6529711 - DNA, 17 bp, Homo sapiens
ttcagcagcaaattttc

SEQ ID NO: 6529712 - DNA, 19 bp, Homo sapiens
ttcagcagcaaattttcag

SEQ ID NO: 6529713 - DNA, 18 bp, Homo sapiens
ttcagcagcatctactct

SEQ ID NO: 6529714 - DNA, 12 bp, Homo sapiens
ttcagcaggcag

SEQ ID NO: 6529715 - DNA, 22 bp, Homo sapiens
ttcagcaggggtgggaggctcc

SEQ ID NO: 6529716 - DNA, 13 bp, Homo sapiens
ttcagcagtgcct

SEQ ID NO: 6529717 - DNA, 19 bp, Homo sapiens
ttcagcagtgtctgttctt

SEQ ID NO: 6529718 - DNA, 20 bp, Homo sapiens
ttcagcatcaaacatgaaaa

SEQ ID NO: 6529719 - DNA, 15 bp, Homo sapiens
ttcagcatcactaaa

SEQ ID NO: 6529720 - DNA, 12 bp, Homo sapiens
ttcagcatctga

SEQ ID NO: 6529721 - DNA, 22 bp, Homo sapiens
ttcagcatgaaaatgtgtgttt

SEQ ID NO: 6529722 - DNA, 12 bp, Homo sapiens
ttcagcatgcaa

SEQ ID NO: 6529723 - DNA, 19 bp, Homo sapiens
ttcagcatggtttgcatga

SEQ ID NO: 6529724 - DNA, 13 bp, Homo sapiens
ttcagcatgtcca

SEQ ID NO: 6529725 - DNA, 17 bp, Homo sapiens
ttcagcattaagctgtt

SEQ ID NO: 6529726 - DNA, 13 bp, Homo sapiens
ttcagcattctta

SEQ ID NO: 6529727 - DNA, 19 bp, Homo sapiens
ttcagcatttacttgaaga

SEQ ID NO: 6529728 - DNA, 18 bp, Homo sapiens
ttcagcatttgatttcca

SEQ ID NO: 6529729 - DNA, 16 bp, Homo sapiens
ttcagcattttttatc

SEQ ID NO: 6529730 - DNA, 22 bp, Homo sapiens
ttcagccaaacagtatgatgga

SEQ ID NO: 6529731 - DNA, 19 bp, Homo sapiens
ttcagccaagaattcttaa

SEQ ID NO: 6529732 - DNA, 11 bp, Homo sapiens
ttcagccaagg

SEQ ID NO: 6529733 - DNA, 18 bp, Homo sapiens
ttcagccaatctggacac

SEQ ID NO: 6529734 - DNA, 21 bp, Homo sapiens
ttcagccactgagggacaaaa

SEQ ID NO: 6529735 - DNA, 15 bp, Homo sapiens
ttcagccagcttaaa

SEQ ID NO: 6529736 - DNA, 12 bp, Homo sapiens
ttcagccaggag

SEQ ID NO: 6529737 - DNA, 16 bp, Homo sapiens
ttcagccatgtacaga

SEQ ID NO: 6529738 - DNA, 10 bp, Homo sapiens
ttcagcccac

SEQ ID NO: 6529739 - DNA, 13 bp, Homo sapiens
ttcagcccatctc

SEQ ID NO: 6529740 - DNA, 21 bp, Homo sapiens
ttcagcccccatcacccaagc

SEQ ID NO: 6529741 - DNA, 13 bp, Homo sapiens
ttcagcccctcct

SEQ ID NO: 6529742 - DNA, 15 bp, Homo sapiens
ttcagcccctcctct

SEQ ID NO: 6529743 - DNA, 16 bp, Homo sapiens
ttcagcccctcctctg

SEQ ID NO: 6529744 - DNA, 23 bp, Homo sapiens
ttcagcccctcctctgccacctc

SEQ ID NO: 6529745 - DNA, 15 bp, Homo sapiens
ttcagccctcagaat

SEQ ID NO: 6529746 - DNA, 18 bp, Homo sapiens
ttcagccgactcagcaac

SEQ ID NO: 6529747 - DNA, 13 bp, Homo sapiens
ttcagcctaagag

SEQ ID NO: 6529748 - DNA, 12 bp, Homo sapiens
ttcagcctggcc

SEQ ID NO: 6529749 - DNA, 16 bp, Homo sapiens
ttcagcctggcctgcc

SEQ ID NO: 6529750 - DNA, 23 bp, Homo sapiens
ttcagcctggcctgcccgtgccc

SEQ ID NO: 6529751 - DNA, 15 bp, Homo sapiens
ttcagccttcgtgtg

SEQ ID NO: 6529752 - DNA, 20 bp, Homo sapiens
ttcagccttctttttctgga

SEQ ID NO: 6529753 - DNA, 23 bp, Homo sapiens
ttcagcgaagtctcatgggaagc

SEQ ID NO: 6529754 - DNA, 18 bp, Homo sapiens
ttcagcgagacccttgca

SEQ ID NO: 6529755 - DNA, 16 bp, Homo sapiens
ttcagcgatgtatgca

SEQ ID NO: 6529756 - DNA, 15 bp, Homo sapiens
tggggcagggcctgg

SEQ ID NO: 6529757 - DNA, 11 bp, Homo sapiens
tggggcagggg

SEQ ID NO: 6529758 - DNA, 16 bp, Homo sapiens
tggggcaggggcctgg

SEQ ID NO: 6529759 - DNA, 18 bp, Homo sapiens
tggggcaggggcctgggc

SEQ ID NO: 6529760 - DNA, 11 bp, Homo sapiens
tggggcagggt

SEQ ID NO: 6529761 - DNA, 16 bp, Homo sapiens
tggggcagggtggggg

SEQ ID NO: 6529762 - DNA, 22 bp, Homo sapiens
tggggcagtcacctgcccagat

SEQ ID NO: 6529763 - DNA, 23 bp, Homo sapiens
tggggcagtgcttggcccaggag

SEQ ID NO: 6529764 - DNA, 11 bp, Homo sapiens
tggggcagtgg

SEQ ID NO: 6529765 - DNA, 22 bp, Homo sapiens
tggggcatccaccttcctgccc

SEQ ID NO: 6529766 - DNA, 23 bp, Homo sapiens
tggggcatccaccttcctgccca

SEQ ID NO: 6529767 - DNA, 15 bp, Homo sapiens
tggggcatcctggat

SEQ ID NO: 6529768 - DNA, 21 bp, Homo sapiens
tggggcatgacctcagtcagg

SEQ ID NO: 6529769 - DNA, 15 bp, Homo sapiens
tggggcatggtttta

SEQ ID NO: 6529770 - DNA, 15 bp, Homo sapiens
tggggcatgtgtgcc

SEQ ID NO: 6529771 - DNA, 17 bp, Homo sapiens
tggggcatgtgtgcctg

SEQ ID NO: 6529772 - DNA, 18 bp, Homo sapiens
tggggcatttgtaaaaag

SEQ ID NO: 6529773 - DNA, 13 bp, Homo sapiens
tggggccaagagg

SEQ ID NO: 6529774 - DNA, 18 bp, Homo sapiens
tggggccaagaggaaaaa

SEQ ID NO: 6529775 - DNA, 13 bp, Homo sapiens
tggggccacagcc

SEQ ID NO: 6529776 - DNA, 15 bp, Homo sapiens
tggggccacagccag

SEQ ID NO: 6529777 - DNA, 20 bp, Homo sapiens
tggggccaccaaagctgccc

SEQ ID NO: 6529778 - DNA, 21 bp, Homo sapiens
tggggccaccaaagctgccca

SEQ ID NO: 6529779 - DNA, 11 bp, Homo sapiens
tggggccactt

SEQ ID NO: 6529780 - DNA, 22 bp, Homo sapiens
tggggccacttggtagtgtccc

SEQ ID NO: 6529781 - DNA, 20 bp, Homo sapiens
tggggccagaggctgggagt

SEQ ID NO: 6529782 - DNA, 13 bp, Homo sapiens
tggggccagatcc

SEQ ID NO: 6529783 - DNA, 15 bp, Homo sapiens
tggggccagatccag

SEQ ID NO: 6529784 - DNA, 18 bp, Homo sapiens
tggggccagatccagcct

SEQ ID NO: 6529785 - DNA, 21 bp, Homo sapiens
tggggccagatccagcctggg

SEQ ID NO: 6529786 - DNA, 16 bp, Homo sapiens
tggggccagcccctcc

SEQ ID NO: 6529787 - DNA, 21 bp, Homo sapiens
tggggccagcgctgaacagac

SEQ ID NO: 6529788 - DNA, 14 bp, Homo sapiens
tggggccaggcccc

SEQ ID NO: 6529789 - DNA, 22 bp, Homo sapiens
tggggccaggccccatggaggg

SEQ ID NO: 6529790 - DNA, 13 bp, Homo sapiens
tggggccaggccg

SEQ ID NO: 6529791 - DNA, 20 bp, Homo sapiens
tggggccaggctgggtcgcc

SEQ ID NO: 6529792 - DNA, 22 bp, Homo sapiens
tggggccaggctgggtcgccct

SEQ ID NO: 6529793 - DNA, 14 bp, Homo sapiens
tggggccagggcag

SEQ ID NO: 6529794 - DNA, 20 bp, Homo sapiens
tggggccagttggtccccct

SEQ ID NO: 6529795 - DNA, 15 bp, Homo sapiens
tggggccatggtgga

SEQ ID NO: 6529796 - DNA, 14 bp, Homo sapiens
tggggcccaaatgc

SEQ ID NO: 6529797 - DNA, 13 bp, Homo sapiens
tggggcccaggaa

SEQ ID NO: 6529798 - DNA, 15 bp, Homo sapiens
tggggcccaggaagc

SEQ ID NO: 6529799 - DNA, 22 bp, Homo sapiens
tggggcccaggaagcccacact

SEQ ID NO: 6529800 - DNA, 17 bp, Homo sapiens
tggggcccaggcccgga

SEQ ID NO: 6529801 - DNA, 19 bp, Homo sapiens
tggggcccaggggctttgg

SEQ ID NO: 6529802 - DNA, 19 bp, Homo sapiens
tggggcccagtgcatggtg

SEQ ID NO: 6529803 - DNA, 22 bp, Homo sapiens
tggggcccagtgcatggtggcc

SEQ ID NO: 6529804 - DNA, 18 bp, Homo sapiens
tggggcccatggaggaga

SEQ ID NO: 6529805 - DNA, 20 bp, Homo sapiens
tggggcccatggaggagaca

SEQ ID NO: 6529806 - DNA, 16 bp, Homo sapiens
tggggccccaaagccc

SEQ ID NO: 6529807 - DNA, 18 bp, Homo sapiens
tggggccccaaagcccag

SEQ ID NO: 6529808 - DNA, 12 bp, Homo sapiens
tggggccccatc

SEQ ID NO: 6529809 - DNA, 21 bp, Homo sapiens
tggggccccatcttgatcttt

SEQ ID NO: 6529810 - DNA, 15 bp, Homo sapiens
tggggcccccagcac

SEQ ID NO: 6529811 - DNA, 16 bp, Homo sapiens
tggggcccccagcacc

SEQ ID NO: 6529812 - DNA, 19 bp, Homo sapiens
tggggcccccagcaccctc

SEQ ID NO: 6529813 - DNA, 21 bp, Homo sapiens
tggggccccgggttcagcctg

SEQ ID NO: 6529814 - DNA, 23 bp, Homo sapiens
tggggccccgggttcagcctggc

SEQ ID NO: 6529815 - DNA, 16 bp, Homo sapiens
tggggcccgcctgcca

SEQ ID NO: 6529816 - DNA, 20 bp, Homo sapiens
tggggcccgcctgccacctc

SEQ ID NO: 6529817 - DNA, 21 bp, Homo sapiens
tggggcccgcctgccacctct

SEQ ID NO: 6529818 - DNA, 19 bp, Homo sapiens
tggggccctaattcagcca

SEQ ID NO: 6529819 - DNA, 20 bp, Homo sapiens
tggggccctaattcagccat

SEQ ID NO: 6529820 - DNA, 21 bp, Homo sapiens
tggggccctaattcagccatg

SEQ ID NO: 6529821 - DNA, 20 bp, Homo sapiens
tggggccctcagctcctggg

SEQ ID NO: 6529822 - DNA, 14 bp, Homo sapiens
tggggccctcccag

SEQ ID NO: 6529823 - DNA, 20 bp, Homo sapiens
tggggccctctatgctggct

SEQ ID NO: 6529824 - DNA, 19 bp, Homo sapiens
tggggccctcttgccagcc

SEQ ID NO: 6529825 - DNA, 21 bp, Homo sapiens
tggggccctcttgccagcctc

SEQ ID NO: 6529826 - DNA, 22 bp, Homo sapiens
tggggccctcttgccagcctcc

SEQ ID NO: 6529827 - DNA, 12 bp, Homo sapiens
tggggccctgag

SEQ ID NO: 6529828 - DNA, 12 bp, Homo sapiens
tggggccctgcc

SEQ ID NO: 6529829 - DNA, 12 bp, Homo sapiens
tggggccctggg

SEQ ID NO: 6529830 - DNA, 14 bp, Homo sapiens
tggggccgcctgcc

SEQ ID NO: 6529831 - DNA, 13 bp, Homo sapiens
tggggccgggagc

SEQ ID NO: 6529832 - DNA, 14 bp, Homo sapiens
tggggccgggctgg

SEQ ID NO: 6529833 - DNA, 16 bp, Homo sapiens
tggggccggggctgcc

SEQ ID NO: 6529834 - DNA, 19 bp, Homo sapiens
tggggccggggctgccgca

SEQ ID NO: 6529835 - DNA, 24 bp, Homo sapiens
tggggccggtagaggctccccagg

SEQ ID NO: 6529836 - DNA, 23 bp, Homo sapiens
tggggcctaataaaactgatgtg

SEQ ID NO: 6529837 - DNA, 18 bp, Homo sapiens
tggggcctacagctttga

SEQ ID NO: 6529838 - DNA, 18 bp, Homo sapiens
tggggcctagatccacac

SEQ ID NO: 6529839 - DNA, 22 bp, Homo sapiens
tggggcctagcgatctctcctg

SEQ ID NO: 6529840 - DNA, 22 bp, Homo sapiens
tggggcctatcagtgtgccccc

SEQ ID NO: 6529841 - DNA, 14 bp, Homo sapiens
tggggcctcaagaa

SEQ ID NO: 6529842 - DNA, 18 bp, Homo sapiens
tggggcctcacccagaag

SEQ ID NO: 6529843 - DNA, 13 bp, Homo sapiens
tggggcctcagac

SEQ ID NO: 6529844 - DNA, 13 bp, Homo sapiens
tggggcctcagcc

SEQ ID NO: 6529845 - DNA, 14 bp, Homo sapiens
tggggcctcagcct

SEQ ID NO: 6529846 - DNA, 22 bp, Homo sapiens
tggggcctcagcctggggctct

SEQ ID NO: 6529847 - DNA, 23 bp, Homo sapiens
tggggcctcagcctggggctctc

SEQ ID NO: 6529848 - DNA, 15 bp, Homo sapiens
tggggcctcaggctc

SEQ ID NO: 6529849 - DNA, 16 bp, Homo sapiens
tggggcctcaggctcc

SEQ ID NO: 6529850 - DNA, 14 bp, Homo sapiens
tggggcctccagaa

SEQ ID NO: 6529851 - DNA, 21 bp, Homo sapiens
tggggcctccagaagctgctc

SEQ ID NO: 6529852 - DNA, 22 bp, Homo sapiens
tggggcctccagaagctgctcc

SEQ ID NO: 6529853 - DNA, 14 bp, Homo sapiens
tggggcctccctcc

SEQ ID NO: 6529854 - DNA, 20 bp, Homo sapiens
tggggcctccctccttgggt

SEQ ID NO: 6529855 - DNA, 17 bp, Homo sapiens
tggggcctgactgctca

SEQ ID NO: 6529856 - DNA, 11 bp, Homo sapiens
tggggcctgag

SEQ ID NO: 6529857 - DNA, 12 bp, Homo sapiens
tggggcctgaga

SEQ ID NO: 6529858 - DNA, 11 bp, Homo sapiens
tggggcctgcc

SEQ ID NO: 6529859 - DNA, 17 bp, Homo sapiens
tggggcctggagagggg

SEQ ID NO: 6529860 - DNA, 15 bp, Homo sapiens
tggggcctggagcag

SEQ ID NO: 6529861 - DNA, 11 bp, Homo sapiens
tggggcctggc

SEQ ID NO: 6529862 - DNA, 23 bp, Homo sapiens
tggggcctggcccacgccctccc

SEQ ID NO: 6529863 - DNA, 21 bp, Homo sapiens
tggggcctggcctatttaagc

SEQ ID NO: 6529864 - DNA, 22 bp, Homo sapiens
tggggcctggcttgctccaggg

SEQ ID NO: 6529865 - DNA, 23 bp, Homo sapiens
tggggcctggcttgctccagggt

SEQ ID NO: 6529866 - DNA, 12 bp, Homo sapiens
tggggcctggga

SEQ ID NO: 6529867 - DNA, 14 bp, Homo sapiens
tggggcctgggaca

SEQ ID NO: 6529868 - DNA, 13 bp, Homo sapiens
tggggcctgggag

SEQ ID NO: 6529869 - DNA, 13 bp, Homo sapiens
tggggcctgggct

SEQ ID NO: 6529870 - DNA, 21 bp, Homo sapiens
tggggcctggggagcccactg

SEQ ID NO: 6529871 - DNA, 13 bp, Homo sapiens
tggggcctgggtt

SEQ ID NO: 6529872 - DNA, 14 bp, Homo sapiens
tggggcctggttcc

SEQ ID NO: 6529873 - DNA, 12 bp, Homo sapiens
tggggcctgtgg

SEQ ID NO: 6529874 - DNA, 21 bp, Homo sapiens
tggggcctgtggaatgagtgt

SEQ ID NO: 6529875 - DNA, 21 bp, Homo sapiens
tggggccttcccccttgtggg

SEQ ID NO: 6529876 - DNA, 17 bp, Homo sapiens
tggggccttcctggctt

SEQ ID NO: 6529877 - DNA, 20 bp, Homo sapiens
tggggccttcgggaccctgg

SEQ ID NO: 6529878 - DNA, 22 bp, Homo sapiens
tggggcgaattcatcccctccc

SEQ ID NO: 6529879 - DNA, 15 bp, Homo sapiens
tggggcgaggcagag

SEQ ID NO: 6529880 - DNA, 18 bp, Homo sapiens
tggggcgaggcagaggac

SEQ ID NO: 6529881 - DNA, 15 bp, Homo sapiens
tggggcgcgtgaggc

SEQ ID NO: 6529882 - DNA, 12 bp, Homo sapiens
tggggcgctccc

SEQ ID NO: 6529883 - DNA, 19 bp, Homo sapiens
tggggcgggaaagccagtg

SEQ ID NO: 6529884 - DNA, 16 bp, Homo sapiens
tggggcgggaggccac

SEQ ID NO: 6529885 - DNA, 13 bp, Homo sapiens
tggggcggggccc

SEQ ID NO: 6529886 - DNA, 20 bp, Homo sapiens
tggggcgggggtctatacat

SEQ ID NO: 6529887 - DNA, 17 bp, Homo sapiens
tggggcgggtcctagct

SEQ ID NO: 6529888 - DNA, 20 bp, Homo sapiens
tggggcgggtcctagctgtt

SEQ ID NO: 6529889 - DNA, 15 bp, Homo sapiens
tggggctaaatgaag

SEQ ID NO: 6529890 - DNA, 20 bp, Homo sapiens
tggggctaagcggtggagga

SEQ ID NO: 6529891 - DNA, 18 bp, Homo sapiens
tggggctactgtttcagt

SEQ ID NO: 6529892 - DNA, 19 bp, Homo sapiens
tggggctagactgggctgg

SEQ ID NO: 6529893 - DNA, 23 bp, Homo sapiens
tggggctaggaaatccagggtgg

SEQ ID NO: 6529894 - DNA, 17 bp, Homo sapiens
tggggctaggtcttgcc

SEQ ID NO: 6529895 - DNA, 22 bp, Homo sapiens
tggggctcaagcagttctccca

SEQ ID NO: 6529896 - DNA, 19 bp, Homo sapiens
tggggctcacggggcctcc

SEQ ID NO: 6529897 - DNA, 21 bp, Homo sapiens
tggggctcacggggcctccaa

SEQ ID NO: 6529898 - DNA, 22 bp, Homo sapiens
tggggctcacttttcatccttc

SEQ ID NO: 6529899 - DNA, 23 bp, Homo sapiens
tggggctcagatggactgggagg

SEQ ID NO: 6529900 - DNA, 15 bp, Homo sapiens
tggggctcccagcca

SEQ ID NO: 6529901 - DNA, 18 bp, Homo sapiens
tggggctcccagccaggc

SEQ ID NO: 6529902 - DNA, 17 bp, Homo sapiens
tggggctcccagctcct

SEQ ID NO: 6529903 - DNA, 16 bp, Homo sapiens
tggggctcccgcctcc

SEQ ID NO: 6529904 - DNA, 23 bp, Homo sapiens
tggggctcccgcctccaacccct

SEQ ID NO: 6529905 - DNA, 17 bp, Homo sapiens
tggggctcctacctggg

SEQ ID NO: 6529906 - DNA, 21 bp, Homo sapiens
tggggctcctacctgggggca

SEQ ID NO: 6529907 - DNA, 12 bp, Homo sapiens
tggggctcctgg

SEQ ID NO: 6529908 - DNA, 13 bp, Homo sapiens
tggggctcgccat

SEQ ID NO: 6529909 - DNA, 21 bp, Homo sapiens
tggggctcgccccacccaggg

SEQ ID NO: 6529910 - DNA, 22 bp, Homo sapiens
tggggctcgccccacccagggc

SEQ ID NO: 6529911 - DNA, 18 bp, Homo sapiens
tggggctctaacgcctga

SEQ ID NO: 6529912 - DNA, 21 bp, Homo sapiens
tggggctctaacgcctgagcc

SEQ ID NO: 6529913 - DNA, 23 bp, Homo sapiens
tggggctctaacgcctgagccca

SEQ ID NO: 6529914 - DNA, 14 bp, Homo sapiens
tggggctctctgac

SEQ ID NO: 6529915 - DNA, 16 bp, Homo sapiens
tggggctctctgaccc

SEQ ID NO: 6529916 - DNA, 21 bp, Homo sapiens
tggggctgaacatgcctgcca

SEQ ID NO: 6529917 - DNA, 20 bp, Homo sapiens
tggggctgaaggttgaagag

SEQ ID NO: 6529918 - DNA, 16 bp, Homo sapiens
tggggctgacacccag

SEQ ID NO: 6529919 - DNA, 21 bp, Homo sapiens
tggggctgacacccaggcccg

SEQ ID NO: 6529920 - DNA, 15 bp, Homo sapiens
tggggctgagccctc

SEQ ID NO: 6529921 - DNA, 23 bp, Homo sapiens
tggggctgagccctcctgagggc

SEQ ID NO: 6529922 - DNA, 15 bp, Homo sapiens
tggggctgagctggg

SEQ ID NO: 6529923 - DNA, 20 bp, Homo sapiens
tggggctgatctcagggaag

SEQ ID NO: 6529924 - DNA, 17 bp, Homo sapiens
tggggctgccagcctga

SEQ ID NO: 6529925 - DNA, 18 bp, Homo sapiens
tggggctgccagcctgag

SEQ ID NO: 6529926 - DNA, 12 bp, Homo sapiens
tggggctgccct

SEQ ID NO: 6529927 - DNA, 17 bp, Homo sapiens
tggggctgccctcggca

SEQ ID NO: 6529928 - DNA, 23 bp, Homo sapiens
tggggctgccggatctgggctgt

SEQ ID NO: 6529929 - DNA, 16 bp, Homo sapiens
tggggctgccgtgcac

SEQ ID NO: 6529930 - DNA, 13 bp, Homo sapiens
tggggctgcggga

SEQ ID NO: 6529931 - DNA, 20 bp, Homo sapiens
tggggctgcgggacagagga

SEQ ID NO: 6529932 - DNA, 15 bp, Homo sapiens
tggggctgctcctcc

SEQ ID NO: 6529933 - DNA, 19 bp, Homo sapiens
tggggctgctcctccaggg

SEQ ID NO: 6529934 - DNA, 18 bp, Homo sapiens
ttcagcgcccccaggcct

SEQ ID NO: 6529935 - DNA, 20 bp, Homo sapiens
ttcagctaaagtaacagagc

SEQ ID NO: 6529936 - DNA, 22 bp, Homo sapiens
ttcagctaaagtaacagagcat

SEQ ID NO: 6529937 - DNA, 13 bp, Homo sapiens
ttcagctaaggga

SEQ ID NO: 6529938 - DNA, 21 bp, Homo sapiens
ttcagctaagggaagacattt

SEQ ID NO: 6529939 - DNA, 16 bp, Homo sapiens
ttcagctactttccat

SEQ ID NO: 6529940 - DNA, 14 bp, Homo sapiens
ttcagctagaattt

SEQ ID NO: 6529941 - DNA, 20 bp, Homo sapiens
ttcagctaggaacaaatctt

SEQ ID NO: 6529942 - DNA, 22 bp, Homo sapiens
ttcagctaggaacaaatcttcc

SEQ ID NO: 6529943 - DNA, 18 bp, Homo sapiens
ttcagctattagcaactg

SEQ ID NO: 6529944 - DNA, 20 bp, Homo sapiens
ttcagctatttagtgatata

SEQ ID NO: 6529945 - DNA, 21 bp, Homo sapiens
ttcagctcattatgaaaaaca

SEQ ID NO: 6529946 - DNA, 15 bp, Homo sapiens
ttcagctccagcccc

SEQ ID NO: 6529947 - DNA, 23 bp, Homo sapiens
ttcagctccagcccctttccaaa

SEQ ID NO: 6529948 - DNA, 22 bp, Homo sapiens
ttcagctccagctcaccagccc

SEQ ID NO: 6529949 - DNA, 18 bp, Homo sapiens
ttcagctcccccaggctg

SEQ ID NO: 6529950 - DNA, 14 bp, Homo sapiens
ttcagctcctgacc

SEQ ID NO: 6529951 - DNA, 21 bp, Homo sapiens
ttcagctcctgagtagctggg

SEQ ID NO: 6529952 - DNA, 16 bp, Homo sapiens
ttcagctctctgtata

SEQ ID NO: 6529953 - DNA, 18 bp, Homo sapiens
ttcagctctctgtataaa

SEQ ID NO: 6529954 - DNA, 11 bp, Homo sapiens
ttcagctctga

SEQ ID NO: 6529955 - DNA, 15 bp, Homo sapiens
ttcagctctgaaaga

SEQ ID NO: 6529956 - DNA, 20 bp, Homo sapiens
ttcagctctgatctgaggct

SEQ ID NO: 6529957 - DNA, 12 bp, Homo sapiens
ttcagctctgga

SEQ ID NO: 6529958 - DNA, 18 bp, Homo sapiens
ttcagctcttaaaaagac

SEQ ID NO: 6529959 - DNA, 14 bp, Homo sapiens
ttcagctctttcca

SEQ ID NO: 6529960 - DNA, 17 bp, Homo sapiens
ttcagctctttccaaat

SEQ ID NO: 6529961 - DNA, 19 bp, Homo sapiens
ttcagctctttccaaatta

SEQ ID NO: 6529962 - DNA, 20 bp, Homo sapiens
ttcagctctttccaaattaa

SEQ ID NO: 6529963 - DNA, 17 bp, Homo sapiens
ttcagctgacttttctg

SEQ ID NO: 6529964 - DNA, 14 bp, Homo sapiens
ttcagctgagccct

SEQ ID NO: 6529965 - DNA, 18 bp, Homo sapiens
ttcagctgagccctgggg

SEQ ID NO: 6529966 - DNA, 13 bp, Homo sapiens
ttcagctgcaagg

SEQ ID NO: 6529967 - DNA, 23 bp, Homo sapiens
ttcagctgcagttgaagagcctg

SEQ ID NO: 6529968 - DNA, 13 bp, Homo sapiens
ttcagctgccagt

SEQ ID NO: 6529969 - DNA, 23 bp, Homo sapiens
ttcagctgccagtgtcctgagcc

SEQ ID NO: 6529970 - DNA, 23 bp, Homo sapiens
ttcagctgcctgaaacagccatg

SEQ ID NO: 6529971 - DNA, 19 bp, Homo sapiens
ttcagctgctcagaattca

SEQ ID NO: 6529972 - DNA, 13 bp, Homo sapiens
ttcagctggaaac

SEQ ID NO: 6529973 - DNA, 15 bp, Homo sapiens
ttcagctggcagagt

SEQ ID NO: 6529974 - DNA, 19 bp, Homo sapiens
ttcagctgggtcacatcca

SEQ ID NO: 6529975 - DNA, 19 bp, Homo sapiens
ttcagctggtggatggtga

SEQ ID NO: 6529976 - DNA, 22 bp, Homo sapiens
ttcagctggtggatggtgactt

SEQ ID NO: 6529977 - DNA, 23 bp, Homo sapiens
ttcagctggtggatggtgacttt

SEQ ID NO: 6529978 - DNA, 21 bp, Homo sapiens
ttcagctgtgctttttgcaaa

SEQ ID NO: 6529979 - DNA, 14 bp, Homo sapiens
ttcagctgttgcag

SEQ ID NO: 6529980 - DNA, 14 bp, Homo sapiens
ttcagcttcatttg

SEQ ID NO: 6529981 - DNA, 15 bp, Homo sapiens
ttcagcttgaacctg

SEQ ID NO: 6529982 - DNA, 13 bp, Homo sapiens
ttcagcttgggga

SEQ ID NO: 6529983 - DNA, 17 bp, Homo sapiens
ttcagctttagaaatta

SEQ ID NO: 6529984 - DNA, 21 bp, Homo sapiens
ttcaggaaaaatgcttttgtg

SEQ ID NO: 6529985 - DNA, 18 bp, Homo sapiens
ttcaggaaaattgaatgc

SEQ ID NO: 6529986 - DNA, 11 bp, Homo sapiens
ttcaggaaagt

SEQ ID NO: 6529987 - DNA, 21 bp, Homo sapiens
ttcaggaacaagtaatgtatt

SEQ ID NO: 6529988 - DNA, 23 bp, Homo sapiens
ttcaggaacaagtaatgtattag

SEQ ID NO: 6529989 - DNA, 15 bp, Homo sapiens
ttcaggaacccttct

SEQ ID NO: 6529990 - DNA, 11 bp, Homo sapiens
ttcaggaacct

SEQ ID NO: 6529991 - DNA, 20 bp, Homo sapiens
ttcaggaacctcgagtactg

SEQ ID NO: 6529992 - DNA, 22 bp, Homo sapiens
ttcaggaacctcgagtactgtg

SEQ ID NO: 6529993 - DNA, 22 bp, Homo sapiens
ttcaggaactggggctttgcct

SEQ ID NO: 6529994 - DNA, 19 bp, Homo sapiens
ttcaggaatgtgtggcctg

SEQ ID NO: 6529995 - DNA, 23 bp, Homo sapiens
ttcaggaattacactgtgccttt

SEQ ID NO: 6529996 - DNA, 14 bp, Homo sapiens
ttcaggaatttaaa

SEQ ID NO: 6529997 - DNA, 18 bp, Homo sapiens
ttcaggaatttaaaatta

SEQ ID NO: 6529998 - DNA, 13 bp, Homo sapiens
ttcaggacagctg

SEQ ID NO: 6529999 - DNA, 21 bp, Homo sapiens
ttcaggacataggcacaggca

SEQ ID NO: 6530000 - DNA, 19 bp, Homo sapiens
ttcaggaccccatctgctg

SEQ ID NO: 6530001 - DNA, 22 bp, Homo sapiens
ttcaggaccccatctgctgagc

SEQ ID NO: 6530002 - DNA, 15 bp, Homo sapiens
ttcaggactggctca

SEQ ID NO: 6530003 - DNA, 16 bp, Homo sapiens
ttcaggactttgtgag

SEQ ID NO: 6530004 - DNA, 14 bp, Homo sapiens
ttcaggagatgatg

SEQ ID NO: 6530005 - DNA, 17 bp, Homo sapiens
ttcaggagatggggaat

SEQ ID NO: 6530006 - DNA, 22 bp, Homo sapiens
ttcaggagcagcctcagaacaa

SEQ ID NO: 6530007 - DNA, 13 bp, Homo sapiens
ttcaggagcccta

SEQ ID NO: 6530008 - DNA, 11 bp, Homo sapiens
ttcaggagcct

SEQ ID NO: 6530009 - DNA, 16 bp, Homo sapiens
ttcaggagcctggcca

SEQ ID NO: 6530010 - DNA, 17 bp, Homo sapiens
ttcaggagcgcaagata

SEQ ID NO: 6530011 - DNA, 19 bp, Homo sapiens
ttcaggagcgcaagataga

SEQ ID NO: 6530012 - DNA, 20 bp, Homo sapiens
ttcaggaggagacagtcagg

SEQ ID NO: 6530013 - DNA, 20 bp, Homo sapiens
ttcaggaggccctggtgtca

SEQ ID NO: 6530014 - DNA, 21 bp, Homo sapiens
ttcaggagggtccccagctgg

SEQ ID NO: 6530015 - DNA, 22 bp, Homo sapiens
ttcaggagtccaaaccttctac

SEQ ID NO: 6530016 - DNA, 17 bp, Homo sapiens
ttcaggagttttaatgt

SEQ ID NO: 6530017 - DNA, 17 bp, Homo sapiens
ttcaggatactctgtca

SEQ ID NO: 6530018 - DNA, 14 bp, Homo sapiens
ttcaggatctattt

SEQ ID NO: 6530019 - DNA, 20 bp, Homo sapiens
ttcaggattaactaaagaag

SEQ ID NO: 6530020 - DNA, 22 bp, Homo sapiens
ttcaggattaactaaagaagag

SEQ ID NO: 6530021 - DNA, 20 bp, Homo sapiens
ttcaggatttggtttttctc

SEQ ID NO: 6530022 - DNA, 17 bp, Homo sapiens
ttcaggcaattctcctg

SEQ ID NO: 6530023 - DNA, 18 bp, Homo sapiens
ttcaggcacatgtgttca

SEQ ID NO: 6530024 - DNA, 13 bp, Homo sapiens
ttcaggcaccagc

SEQ ID NO: 6530025 - DNA, 22 bp, Homo sapiens
ttcaggcagaaccggtcccagc

SEQ ID NO: 6530026 - DNA, 22 bp, Homo sapiens
ttcaggcagcaggggctgctgt

SEQ ID NO: 6530027 - DNA, 16 bp, Homo sapiens
ttcaggcattttgttc

SEQ ID NO: 6530028 - DNA, 16 bp, Homo sapiens
ttcaggccagcccagc

SEQ ID NO: 6530029 - DNA, 19 bp, Homo sapiens
ttcaggccaggtagcagca

SEQ ID NO: 6530030 - DNA, 19 bp, Homo sapiens
ttcaggcccatcagctacc

SEQ ID NO: 6530031 - DNA, 14 bp, Homo sapiens
ttcaggctcctaaa

SEQ ID NO: 6530032 - DNA, 17 bp, Homo sapiens
ttcaggctcgccaaggc

SEQ ID NO: 6530033 - DNA, 22 bp, Homo sapiens
ttcaggctcgccaaggcctagg

SEQ ID NO: 6530034 - DNA, 16 bp, Homo sapiens
ttcaggctcttctcct

SEQ ID NO: 6530035 - DNA, 16 bp, Homo sapiens
ttcaggctgcttggga

SEQ ID NO: 6530036 - DNA, 23 bp, Homo sapiens
ttcaggcttgcattaaaagactg

SEQ ID NO: 6530037 - DNA, 16 bp, Homo sapiens
ttcaggcttttatgag

SEQ ID NO: 6530038 - DNA, 20 bp, Homo sapiens
ttcagggaaatggagggtgg

SEQ ID NO: 6530039 - DNA, 23 bp, Homo sapiens
ttcagggaaccgttattataatt

SEQ ID NO: 6530040 - DNA, 16 bp, Homo sapiens
ttcagggaagcaggca

SEQ ID NO: 6530041 - DNA, 18 bp, Homo sapiens
ttcagggaagcaggcaga

SEQ ID NO: 6530042 - DNA, 20 bp, Homo sapiens
ttcagggaaggaggagcctg

SEQ ID NO: 6530043 - DNA, 21 bp, Homo sapiens
ttcagggaaggaggagcctgt

SEQ ID NO: 6530044 - DNA, 22 bp, Homo sapiens
ttcagggaatttcaggaactag

SEQ ID NO: 6530045 - DNA, 16 bp, Homo sapiens
ttcagggagaaactcc

SEQ ID NO: 6530046 - DNA, 23 bp, Homo sapiens
ttcagggagaaactccaaagtcc

SEQ ID NO: 6530047 - DNA, 22 bp, Homo sapiens
ttcagggagaatgttgttgtct

SEQ ID NO: 6530048 - DNA, 13 bp, Homo sapiens
ttcagggaggggc

SEQ ID NO: 6530049 - DNA, 16 bp, Homo sapiens
ttcagggattccctgt

SEQ ID NO: 6530050 - DNA, 16 bp, Homo sapiens
ttcagggcagatttta

SEQ ID NO: 6530051 - DNA, 15 bp, Homo sapiens
ttcagggcagcccct

SEQ ID NO: 6530052 - DNA, 20 bp, Homo sapiens
ttcagggcagcccctgcaga

SEQ ID NO: 6530053 - DNA, 13 bp, Homo sapiens
ttcagggccagaa

SEQ ID NO: 6530054 - DNA, 23 bp, Homo sapiens
ttcagggccagtcctcctgggag

SEQ ID NO: 6530055 - DNA, 12 bp, Homo sapiens
ttcagggcccct

SEQ ID NO: 6530056 - DNA, 16 bp, Homo sapiens
ttcagggcccctgaag

SEQ ID NO: 6530057 - DNA, 19 bp, Homo sapiens
ttcagggcctggttgaaga

SEQ ID NO: 6530058 - DNA, 23 bp, Homo sapiens
ttcagggctggaaaagtcacaca

SEQ ID NO: 6530059 - DNA, 19 bp, Homo sapiens
ttcagggctttaaacatga

SEQ ID NO: 6530060 - DNA, 21 bp, Homo sapiens
ttcagggctttaaacatgatt

SEQ ID NO: 6530061 - DNA, 17 bp, Homo sapiens
ttcaggggaaacttgat

SEQ ID NO: 6530062 - DNA, 20 bp, Homo sapiens
ttcaggggaagagaagacaa

SEQ ID NO: 6530063 - DNA, 17 bp, Homo sapiens
ttcaggggaagggcagg

SEQ ID NO: 6530064 - DNA, 20 bp, Homo sapiens
ttcaggggactcagccctga

SEQ ID NO: 6530065 - DNA, 17 bp, Homo sapiens
ttcaggggatgggtgtg

SEQ ID NO: 6530066 - DNA, 12 bp, Homo sapiens
ttcaggggcttt

SEQ ID NO: 6530067 - DNA, 22 bp, Homo sapiens
ttcaggggggttgtgaggcctg

SEQ ID NO: 6530068 - DNA, 23 bp, Homo sapiens
ttcagggtaaataggaatcattc

SEQ ID NO: 6530069 - DNA, 17 bp, Homo sapiens
ttcagggttggcccctg

SEQ ID NO: 6530070 - DNA, 15 bp, Homo sapiens
ttcagggtttaatag

SEQ ID NO: 6530071 - DNA, 21 bp, Homo sapiens
ttcagggttttctgagggaaa

SEQ ID NO: 6530072 - DNA, 22 bp, Homo sapiens
ttcaggtaaagggcaaataatg

SEQ ID NO: 6530073 - DNA, 17 bp, Homo sapiens
ttcaggtaacaggcaga

SEQ ID NO: 6530074 - DNA, 11 bp, Homo sapiens
ttcaggtacag

SEQ ID NO: 6530075 - DNA, 14 bp, Homo sapiens
ttcaggtactaaat

SEQ ID NO: 6530076 - DNA, 21 bp, Homo sapiens
ttcaggtaggcccttgtcctg

SEQ ID NO: 6530077 - DNA, 17 bp, Homo sapiens
ttcaggtcagggctatg

SEQ ID NO: 6530078 - DNA, 23 bp, Homo sapiens
ttcaggtcaggtggctgtgggat

SEQ ID NO: 6530079 - DNA, 14 bp, Homo sapiens
ttcaggtccaggct

SEQ ID NO: 6530080 - DNA, 23 bp, Homo sapiens
ttcaggtcccctggcccttcctt

SEQ ID NO: 6530081 - DNA, 18 bp, Homo sapiens
ttcaggtcctagggcctc

SEQ ID NO: 6530082 - DNA, 13 bp, Homo sapiens
ttcaggtctctgt

SEQ ID NO: 6530083 - DNA, 15 bp, Homo sapiens
ttcaggtctgtatgt

SEQ ID NO: 6530084 - DNA, 19 bp, Homo sapiens
ttcaggtctgtatgtcatg

SEQ ID NO: 6530085 - DNA, 22 bp, Homo sapiens
ttcaggtctgtatgtcatggat

SEQ ID NO: 6530086 - DNA, 17 bp, Homo sapiens
ttcaggtgaataataaa

SEQ ID NO: 6530087 - DNA, 21 bp, Homo sapiens
ttcaggtgaataataaaatca

SEQ ID NO: 6530088 - DNA, 13 bp, Homo sapiens
ttcaggtgacatg

SEQ ID NO: 6530089 - DNA, 23 bp, Homo sapiens
ttcaggtgacatgtgaaaccttt

SEQ ID NO: 6530090 - DNA, 14 bp, Homo sapiens
ttcaggtgagccaa

SEQ ID NO: 6530091 - DNA, 20 bp, Homo sapiens
ttcaggtggaacaggaggaa

SEQ ID NO: 6530092 - DNA, 20 bp, Homo sapiens
ttcaggtggagagcactaga

SEQ ID NO: 6530093 - DNA, 23 bp, Homo sapiens
ttcaggtgtaaccatttgttaac

SEQ ID NO: 6530094 - DNA, 22 bp, Homo sapiens
ttcaggtgtatagggaattttc

SEQ ID NO: 6530095 - DNA, 22 bp, Homo sapiens
ttcaggttatcgaaataacaat

SEQ ID NO: 6530096 - DNA, 20 bp, Homo sapiens
ttcaggttcctacaggagat

SEQ ID NO: 6530097 - DNA, 18 bp, Homo sapiens
ttcaggttcctcctaggc

SEQ ID NO: 6530098 - DNA, 16 bp, Homo sapiens
ttcaggttttagtttt

SEQ ID NO: 6530099 - DNA, 16 bp, Homo sapiens
ttcagtaacaagtgtt

SEQ ID NO: 6530100 - DNA, 21 bp, Homo sapiens
ttcagtaacccccactggact

SEQ ID NO: 6530101 - DNA, 23 bp, Homo sapiens
ttcagtaacttgtttacatagca

SEQ ID NO: 6530102 - DNA, 16 bp, Homo sapiens
ttcagtaagctgtgtg

SEQ ID NO: 6530103 - DNA, 17 bp, Homo sapiens
ttcagtaagttctgtgg

SEQ ID NO: 6530104 - DNA, 19 bp, Homo sapiens
ttcagtaatagctgaacct

SEQ ID NO: 6530105 - DNA, 14 bp, Homo sapiens
ttcagtaatgtctt

SEQ ID NO: 6530106 - DNA, 14 bp, Homo sapiens
ttcagtacaaccca

SEQ ID NO: 6530107 - DNA, 16 bp, Homo sapiens
ttcagtacaacccata

SEQ ID NO: 6530108 - DNA, 13 bp, Homo sapiens
ttcagtaccaaag

SEQ ID NO: 6530109 - DNA, 17 bp, Homo sapiens
ttcagtaccaaagaaac

SEQ ID NO: 6530110 - DNA, 15 bp, Homo sapiens
tggggctggaagcag

SEQ ID NO: 6530111 - DNA, 17 bp, Homo sapiens
tggggctggagaggaca

SEQ ID NO: 6530112 - DNA, 11 bp, Homo sapiens
tggggctggca

SEQ ID NO: 6530113 - DNA, 19 bp, Homo sapiens
tggggctggcaccagcagg

SEQ ID NO: 6530114 - DNA, 17 bp, Homo sapiens
tggggctggccccatcc

SEQ ID NO: 6530115 - DNA, 15 bp, Homo sapiens
tggggctggctgcag

SEQ ID NO: 6530116 - DNA, 18 bp, Homo sapiens
tggggctgggcccaccca

SEQ ID NO: 6530117 - DNA, 13 bp, Homo sapiens
tggggctgggcct

SEQ ID NO: 6530118 - DNA, 18 bp, Homo sapiens
tggggctggggaagagga

SEQ ID NO: 6530119 - DNA, 21 bp, Homo sapiens
tggggctgggggatgggcctg

SEQ ID NO: 6530120 - DNA, 22 bp, Homo sapiens
tggggctgggggatgggcctga

SEQ ID NO: 6530121 - DNA, 16 bp, Homo sapiens
tggggctggtgaggcc

SEQ ID NO: 6530122 - DNA, 23 bp, Homo sapiens
tggggctggtgaggccggccctg

SEQ ID NO: 6530123 - DNA, 14 bp, Homo sapiens
tggggctggtgggt

SEQ ID NO: 6530124 - DNA, 18 bp, Homo sapiens
tggggctggtgggtctgc

SEQ ID NO: 6530125 - DNA, 18 bp, Homo sapiens
tggggctgtcctgctgcc

SEQ ID NO: 6530126 - DNA, 13 bp, Homo sapiens
tggggctgtgcat

SEQ ID NO: 6530127 - DNA, 23 bp, Homo sapiens
tggggctgtgttttcgatgatga

SEQ ID NO: 6530128 - DNA, 18 bp, Homo sapiens
tggggcttacagaaatga

SEQ ID NO: 6530129 - DNA, 22 bp, Homo sapiens
tggggcttatgggtggctttca

SEQ ID NO: 6530130 - DNA, 18 bp, Homo sapiens
tggggcttcacagccaca

SEQ ID NO: 6530131 - DNA, 22 bp, Homo sapiens
tggggcttcaccagtctgtcta

SEQ ID NO: 6530132 - DNA, 21 bp, Homo sapiens
tggggcttcctgggcagttgg

SEQ ID NO: 6530133 - DNA, 19 bp, Homo sapiens
tggggcttctcctgaaatc

SEQ ID NO: 6530134 - DNA, 13 bp, Homo sapiens
tggggcttcttgg

SEQ ID NO: 6530135 - DNA, 18 bp, Homo sapiens
tggggcttctttctgctg

SEQ ID NO: 6530136 - DNA, 17 bp, Homo sapiens
tggggcttgaatttgca

SEQ ID NO: 6530137 - DNA, 18 bp, Homo sapiens
tggggcttgaatttgcat

SEQ ID NO: 6530138 - DNA, 15 bp, Homo sapiens
tggggcttgccctgg

SEQ ID NO: 6530139 - DNA, 15 bp, Homo sapiens
tggggcttggaaggg

SEQ ID NO: 6530140 - DNA, 16 bp, Homo sapiens
tggggcttggcgtgga

SEQ ID NO: 6530141 - DNA, 16 bp, Homo sapiens
tggggcttgggggctc

SEQ ID NO: 6530142 - DNA, 18 bp, Homo sapiens
tgggggaaaaaaaagaaa

SEQ ID NO: 6530143 - DNA, 15 bp, Homo sapiens
tgggggaaaaagcca

SEQ ID NO: 6530144 - DNA, 22 bp, Homo sapiens
tgggggaaagcaaagcacagag

SEQ ID NO: 6530145 - DNA, 18 bp, Homo sapiens
tgggggaacactgagaaa

SEQ ID NO: 6530146 - DNA, 18 bp, Homo sapiens
tgggggaactcagatcca

SEQ ID NO: 6530147 - DNA, 22 bp, Homo sapiens
tgggggaacttgtagccagaat

SEQ ID NO: 6530148 - DNA, 19 bp, Homo sapiens
tgggggaagagcacagccc

SEQ ID NO: 6530149 - DNA, 21 bp, Homo sapiens
tgggggaagagcacagccctc

SEQ ID NO: 6530150 - DNA, 22 bp, Homo sapiens
tgggggaagagcacagccctcc

SEQ ID NO: 6530151 - DNA, 23 bp, Homo sapiens
tgggggaagagcacagccctccc

SEQ ID NO: 6530152 - DNA, 12 bp, Homo sapiens
tgggggaagagg

SEQ ID NO: 6530153 - DNA, 13 bp, Homo sapiens
tgggggaagagga

SEQ ID NO: 6530154 - DNA, 14 bp, Homo sapiens
tgggggaagccctg

SEQ ID NO: 6530155 - DNA, 16 bp, Homo sapiens
tgggggaagccctgga

SEQ ID NO: 6530156 - DNA, 17 bp, Homo sapiens
tgggggaaggcgctggg

SEQ ID NO: 6530157 - DNA, 23 bp, Homo sapiens
tgggggaatgagcccagagaaca

SEQ ID NO: 6530158 - DNA, 18 bp, Homo sapiens
tgggggaatgcacctccc

SEQ ID NO: 6530159 - DNA, 16 bp, Homo sapiens
tgggggacagggctgg

SEQ ID NO: 6530160 - DNA, 18 bp, Homo sapiens
tgggggacagggctggcc

SEQ ID NO: 6530161 - DNA, 22 bp, Homo sapiens
tgggggacatgctaaataacta

SEQ ID NO: 6530162 - DNA, 20 bp, Homo sapiens
tgggggaccctgtgcatctg

SEQ ID NO: 6530163 - DNA, 16 bp, Homo sapiens
tgggggacgagggcca

SEQ ID NO: 6530164 - DNA, 17 bp, Homo sapiens
tgggggacgagggccag

SEQ ID NO: 6530165 - DNA, 18 bp, Homo sapiens
tgggggacgagggccagg

SEQ ID NO: 6530166 - DNA, 19 bp, Homo sapiens
tgggggacgcccagccccc

SEQ ID NO: 6530167 - DNA, 14 bp, Homo sapiens
tgggggactgggag

SEQ ID NO: 6530168 - DNA, 13 bp, Homo sapiens
tgggggagagcag

SEQ ID NO: 6530169 - DNA, 14 bp, Homo sapiens
tgggggagagccgt

SEQ ID NO: 6530170 - DNA, 14 bp, Homo sapiens
tgggggagagggtg

SEQ ID NO: 6530171 - DNA, 17 bp, Homo sapiens
tgggggagattgaactt

SEQ ID NO: 6530172 - DNA, 13 bp, Homo sapiens
tgggggagcctgg

SEQ ID NO: 6530173 - DNA, 15 bp, Homo sapiens
tgggggagcctggag

SEQ ID NO: 6530174 - DNA, 12 bp, Homo sapiens
tgggggaggcag

SEQ ID NO: 6530175 - DNA, 19 bp, Homo sapiens
tgggggaggcagggctgga

SEQ ID NO: 6530176 - DNA, 18 bp, Homo sapiens
tgggggaggccaccccaa

SEQ ID NO: 6530177 - DNA, 12 bp, Homo sapiens
tgggggaggctc

SEQ ID NO: 6530178 - DNA, 20 bp, Homo sapiens
tgggggaggggggggtgggg

SEQ ID NO: 6530179 - DNA, 21 bp, Homo sapiens
tgggggagtagatctttctag

SEQ ID NO: 6530180 - DNA, 19 bp, Homo sapiens
tgggggagtctgaagcaga

SEQ ID NO: 6530181 - DNA, 18 bp, Homo sapiens
tgggggataccagctgag

SEQ ID NO: 6530182 - DNA, 18 bp, Homo sapiens
tgggggatagaggggctg

SEQ ID NO: 6530183 - DNA, 21 bp, Homo sapiens
tgggggatcacagcctctgaa

SEQ ID NO: 6530184 - DNA, 16 bp, Homo sapiens
tgggggatctgggcaa

SEQ ID NO: 6530185 - DNA, 17 bp, Homo sapiens
tgggggatgcaaataaa

SEQ ID NO: 6530186 - DNA, 14 bp, Homo sapiens
tgggggatgctgag

SEQ ID NO: 6530187 - DNA, 16 bp, Homo sapiens
tgggggatgggcctga

SEQ ID NO: 6530188 - DNA, 17 bp, Homo sapiens
tgggggatgggcctgag

SEQ ID NO: 6530189 - DNA, 17 bp, Homo sapiens
tgggggattcaaatgca

SEQ ID NO: 6530190 - DNA, 19 bp, Homo sapiens
tgggggattcaaatgcatg

SEQ ID NO: 6530191 - DNA, 13 bp, Homo sapiens
tgggggcaagaag

SEQ ID NO: 6530192 - DNA, 23 bp, Homo sapiens
tgggggcaagaagatcacgctcc

SEQ ID NO: 6530193 - DNA, 21 bp, Homo sapiens
tgggggcacagctgtctgcca

SEQ ID NO: 6530194 - DNA, 16 bp, Homo sapiens
tgggggcacaggaggc

SEQ ID NO: 6530195 - DNA, 15 bp, Homo sapiens
tgggggcaccatctg

SEQ ID NO: 6530196 - DNA, 16 bp, Homo sapiens
tgggggcactgaccag

SEQ ID NO: 6530197 - DNA, 16 bp, Homo sapiens
tgggggcagaactcct

SEQ ID NO: 6530198 - DNA, 19 bp, Homo sapiens
tgggggcagcctgcgtggc

SEQ ID NO: 6530199 - DNA, 21 bp, Homo sapiens
tgggggcaggaaagccacatc

SEQ ID NO: 6530200 - DNA, 22 bp, Homo sapiens
tgggggcaggagggccctacct

SEQ ID NO: 6530201 - DNA, 17 bp, Homo sapiens
tgggggcagggcatgac

SEQ ID NO: 6530202 - DNA, 13 bp, Homo sapiens
tgggggcagggct

SEQ ID NO: 6530203 - DNA, 20 bp, Homo sapiens
tgggggcaggtcaggaccag

SEQ ID NO: 6530204 - DNA, 20 bp, Homo sapiens
tgggggcagtgactggcagg

SEQ ID NO: 6530205 - DNA, 18 bp, Homo sapiens
tgggggcatcctgcttcc

SEQ ID NO: 6530206 - DNA, 23 bp, Homo sapiens
tgggggcatctcttccccagaga

SEQ ID NO: 6530207 - DNA, 19 bp, Homo sapiens
tgggggccacctgcctgcg

SEQ ID NO: 6530208 - DNA, 21 bp, Homo sapiens
tgggggccagctggtgctgca

SEQ ID NO: 6530209 - DNA, 18 bp, Homo sapiens
tgggggccaggctgagcc

SEQ ID NO: 6530210 - DNA, 15 bp, Homo sapiens
tgggggccagggctg

SEQ ID NO: 6530211 - DNA, 17 bp, Homo sapiens
tgggggccagggctgga

SEQ ID NO: 6530212 - DNA, 13 bp, Homo sapiens
tgggggccatgag

SEQ ID NO: 6530213 - DNA, 15 bp, Homo sapiens
tgggggcccaaaggg

SEQ ID NO: 6530214 - DNA, 19 bp, Homo sapiens
tgggggccgctggcccagg

SEQ ID NO: 6530215 - DNA, 19 bp, Homo sapiens
tgggggcctgacctccccc

SEQ ID NO: 6530216 - DNA, 15 bp, Homo sapiens
tgggggcctggctgg

SEQ ID NO: 6530217 - DNA, 17 bp, Homo sapiens
tgggggcctggctggct

SEQ ID NO: 6530218 - DNA, 20 bp, Homo sapiens
tgggggcctggctggctgag

SEQ ID NO: 6530219 - DNA, 22 bp, Homo sapiens
tgggggcgccctctctgctcct

SEQ ID NO: 6530220 - DNA, 18 bp, Homo sapiens
tgggggcggctggaaaga

SEQ ID NO: 6530221 - DNA, 20 bp, Homo sapiens
tgggggcggctggaaagagg

SEQ ID NO: 6530222 - DNA, 21 bp, Homo sapiens
tgggggcgggactcctccctg

SEQ ID NO: 6530223 - DNA, 13 bp, Homo sapiens
tgggggctcctgg

SEQ ID NO: 6530224 - DNA, 15 bp, Homo sapiens
tgggggctcctggca

SEQ ID NO: 6530225 - DNA, 19 bp, Homo sapiens
tgggggctcctggcagtga

SEQ ID NO: 6530226 - DNA, 18 bp, Homo sapiens
tgggggctcctggtggcc

SEQ ID NO: 6530227 - DNA, 13 bp, Homo sapiens
tgggggctcctgt

SEQ ID NO: 6530228 - DNA, 17 bp, Homo sapiens
tgggggctcggggaggc

SEQ ID NO: 6530229 - DNA, 13 bp, Homo sapiens
tgggggctctgca

SEQ ID NO: 6530230 - DNA, 12 bp, Homo sapiens
tgggggctctgg

SEQ ID NO: 6530231 - DNA, 18 bp, Homo sapiens
tgggggctgcagggctgg

SEQ ID NO: 6530232 - DNA, 13 bp, Homo sapiens
tgggggctgcagt

SEQ ID NO: 6530233 - DNA, 22 bp, Homo sapiens
tgggggctgctgcactgccctc

SEQ ID NO: 6530234 - DNA, 18 bp, Homo sapiens
tgggggctggacctgctg

SEQ ID NO: 6530235 - DNA, 17 bp, Homo sapiens
tgggggctggcagaggg

SEQ ID NO: 6530236 - DNA, 18 bp, Homo sapiens
tgggggctggctcccagg

SEQ ID NO: 6530237 - DNA, 19 bp, Homo sapiens
tgggggctgggcagaggaa

SEQ ID NO: 6530238 - DNA, 16 bp, Homo sapiens
tgggggcttccctggg

SEQ ID NO: 6530239 - DNA, 19 bp, Homo sapiens
tgggggctttcggggaggg

SEQ ID NO: 6530240 - DNA, 18 bp, Homo sapiens
tggggggaaagagggagc

SEQ ID NO: 6530241 - DNA, 21 bp, Homo sapiens
tggggggaccaaatagccacc

SEQ ID NO: 6530242 - DNA, 11 bp, Homo sapiens
tggggggagaa

SEQ ID NO: 6530243 - DNA, 18 bp, Homo sapiens
tggggggagagacacaga

SEQ ID NO: 6530244 - DNA, 15 bp, Homo sapiens
tggggggaggaagca

SEQ ID NO: 6530245 - DNA, 11 bp, Homo sapiens
tggggggaggg

SEQ ID NO: 6530246 - DNA, 18 bp, Homo sapiens
tggggggataatgtcccc

SEQ ID NO: 6530247 - DNA, 15 bp, Homo sapiens
tggggggcacagcca

SEQ ID NO: 6530248 - DNA, 16 bp, Homo sapiens
tggggggcacagccag

SEQ ID NO: 6530249 - DNA, 12 bp, Homo sapiens
tggggggcaggc

SEQ ID NO: 6530250 - DNA, 15 bp, Homo sapiens
tggggggcattgagt

SEQ ID NO: 6530251 - DNA, 22 bp, Homo sapiens
tggggggccaaagaaggcaggg

SEQ ID NO: 6530252 - DNA, 15 bp, Homo sapiens
tggggggccaccatg

SEQ ID NO: 6530253 - DNA, 17 bp, Homo sapiens
tggggggcgggccaggg

SEQ ID NO: 6530254 - DNA, 15 bp, Homo sapiens
tggggggctgatggc

SEQ ID NO: 6530255 - DNA, 22 bp, Homo sapiens
tggggggctttggcctgtgagc

SEQ ID NO: 6530256 - DNA, 20 bp, Homo sapiens
tgggggggaccgggcccctc

SEQ ID NO: 6530257 - DNA, 20 bp, Homo sapiens
tgggggggagaaggcctccc

SEQ ID NO: 6530258 - DNA, 21 bp, Homo sapiens
tgggggggagaaggcctcccc

SEQ ID NO: 6530259 - DNA, 19 bp, Homo sapiens
tgggggggagggagggcta

SEQ ID NO: 6530260 - DNA, 15 bp, Homo sapiens
tgggggggctgcctt

SEQ ID NO: 6530261 - DNA, 12 bp, Homo sapiens
tggggggtccag

SEQ ID NO: 6530262 - DNA, 13 bp, Homo sapiens
tggggggtgggga

SEQ ID NO: 6530263 - DNA, 20 bp, Homo sapiens
tggggggtgttttgtggggc

SEQ ID NO: 6530264 - DNA, 23 bp, Homo sapiens
tgggggtaaagccctcagatccc

SEQ ID NO: 6530265 - DNA, 21 bp, Homo sapiens
tgggggtagagctgatccaga

SEQ ID NO: 6530266 - DNA, 16 bp, Homo sapiens
tgggggtagcagctgg

SEQ ID NO: 6530267 - DNA, 15 bp, Homo sapiens
tgggggtagcctgga

SEQ ID NO: 6530268 - DNA, 16 bp, Homo sapiens
tgggggtagcctggat

SEQ ID NO: 6530269 - DNA, 19 bp, Homo sapiens
tgggggtagggggctggag

SEQ ID NO: 6530270 - DNA, 23 bp, Homo sapiens
tgggggtcagaagaagtgggagc

SEQ ID NO: 6530271 - DNA, 18 bp, Homo sapiens
tgggggtcaggctacagg

SEQ ID NO: 6530272 - DNA, 13 bp, Homo sapiens
tgggggtcctctc

SEQ ID NO: 6530273 - DNA, 20 bp, Homo sapiens
tgggggtctgctctgtgcct

SEQ ID NO: 6530274 - DNA, 16 bp, Homo sapiens
tgggggtctggcctag

SEQ ID NO: 6530275 - DNA, 15 bp, Homo sapiens
tgggggtctgggagg

SEQ ID NO: 6530276 - DNA, 16 bp, Homo sapiens
tgggggtctgggaggc

SEQ ID NO: 6530277 - DNA, 18 bp, Homo sapiens
tgggggtctgggaggcag

SEQ ID NO: 6530278 - DNA, 20 bp, Homo sapiens
tgggggtctgggaggcaggt

SEQ ID NO: 6530279 - DNA, 18 bp, Homo sapiens
tgggggtctgtgtgttta

SEQ ID NO: 6530280 - DNA, 21 bp, Homo sapiens
tgggggtgaggggccaggcca

SEQ ID NO: 6530281 - DNA, 16 bp, Homo sapiens
tgggggtgctgctctc

SEQ ID NO: 6530282 - DNA, 16 bp, Homo sapiens
tgggggtggaggaccg

SEQ ID NO: 6530283 - DNA, 10 bp, Homo sapiens
tgggggtggc

SEQ ID NO: 6530284 - DNA, 14 bp, Homo sapiens
tgggggtggcaggc

SEQ ID NO: 6530285 - DNA, 19 bp, Homo sapiens
tgggggtggccatccctgg

SEQ ID NO: 6530286 - DNA, 14 bp, Homo sapiens
tgggggtggctggg

SEQ ID NO: 6530287 - DNA, 18 bp, Homo sapiens
tgggggtgggaactcacg

SEQ ID NO: 6530288 - DNA, 16 bp, Homo sapiens
tgggggtgggaagtgg

SEQ ID NO: 6530289 - DNA, 17 bp, Homo sapiens
ttcagtacctggaggag

SEQ ID NO: 6530290 - DNA, 20 bp, Homo sapiens
ttcagtacttcagcaagaga

SEQ ID NO: 6530291 - DNA, 14 bp, Homo sapiens
ttcagtactttttt

SEQ ID NO: 6530292 - DNA, 19 bp, Homo sapiens
ttcagtacttttttaaata

SEQ ID NO: 6530293 - DNA, 14 bp, Homo sapiens
ttcagtagaattac

SEQ ID NO: 6530294 - DNA, 22 bp, Homo sapiens
ttcagtagcaggacctgccaag

SEQ ID NO: 6530295 - DNA, 17 bp, Homo sapiens
ttcagtagcttatctca

SEQ ID NO: 6530296 - DNA, 19 bp, Homo sapiens
ttcagtaggaacaagctgg

SEQ ID NO: 6530297 - DNA, 21 bp, Homo sapiens
ttcagtaggtttgtgtggatg

SEQ ID NO: 6530298 - DNA, 18 bp, Homo sapiens
ttcagtataaattgtcgt

SEQ ID NO: 6530299 - DNA, 21 bp, Homo sapiens
ttcagtatcaaggctgcctgg

SEQ ID NO: 6530300 - DNA, 12 bp, Homo sapiens
ttcagtatctta

SEQ ID NO: 6530301 - DNA, 19 bp, Homo sapiens
ttcagtatgttgtcaaaga

SEQ ID NO: 6530302 - DNA, 16 bp, Homo sapiens
ttcagtatgttttaca

SEQ ID NO: 6530303 - DNA, 22 bp, Homo sapiens
ttcagtattaaactctcctttg

SEQ ID NO: 6530304 - DNA, 17 bp, Homo sapiens
ttcagtattatatgtac

SEQ ID NO: 6530305 - DNA, 19 bp, Homo sapiens
ttcagtatttaatgaaacc

SEQ ID NO: 6530306 - DNA, 13 bp, Homo sapiens
ttcagtattttcc

SEQ ID NO: 6530307 - DNA, 20 bp, Homo sapiens
ttcagtattttggagaaatt

SEQ ID NO: 6530308 - DNA, 18 bp, Homo sapiens
ttcagtcacatgtgctct

SEQ ID NO: 6530309 - DNA, 22 bp, Homo sapiens
ttcagtcacttgtttgtgtttg

SEQ ID NO: 6530310 - DNA, 17 bp, Homo sapiens
ttcagtccaataggtgt

SEQ ID NO: 6530311 - DNA, 20 bp, Homo sapiens
ttcagtcccctctctctggg

SEQ ID NO: 6530312 - DNA, 15 bp, Homo sapiens
ttcagtccctgagca

SEQ ID NO: 6530313 - DNA, 17 bp, Homo sapiens
ttcagtcccttccccat

SEQ ID NO: 6530314 - DNA, 12 bp, Homo sapiens
ttcagtccgcct

SEQ ID NO: 6530315 - DNA, 22 bp, Homo sapiens
ttcagtcctaatgtgctgtgtg

SEQ ID NO: 6530316 - DNA, 16 bp, Homo sapiens
ttcagtcctgctccag

SEQ ID NO: 6530317 - DNA, 18 bp, Homo sapiens
ttcagtcctgctccagaa

SEQ ID NO: 6530318 - DNA, 21 bp, Homo sapiens
ttcagtcctggtctgctcagg

SEQ ID NO: 6530319 - DNA, 17 bp, Homo sapiens
ttcagtcgtctgtccca

SEQ ID NO: 6530320 - DNA, 15 bp, Homo sapiens
ttcagtcgttgtgct

SEQ ID NO: 6530321 - DNA, 14 bp, Homo sapiens
ttcagtctatgctg

SEQ ID NO: 6530322 - DNA, 17 bp, Homo sapiens
ttcagtctatgctgtgt

SEQ ID NO: 6530323 - DNA, 17 bp, Homo sapiens
ttcagtctcacagagaa

SEQ ID NO: 6530324 - DNA, 22 bp, Homo sapiens
ttcagtctctataccaataaag

SEQ ID NO: 6530325 - DNA, 14 bp, Homo sapiens
ttcagtctctgcag

SEQ ID NO: 6530326 - DNA, 20 bp, Homo sapiens
ttcagtctgaatgctgccac

SEQ ID NO: 6530327 - DNA, 16 bp, Homo sapiens
ttcagtctgctccacc

SEQ ID NO: 6530328 - DNA, 17 bp, Homo sapiens
ttcagtctgctccacca

SEQ ID NO: 6530329 - DNA, 22 bp, Homo sapiens
ttcagtctgtgcctacatgttc

SEQ ID NO: 6530330 - DNA, 15 bp, Homo sapiens
ttcagtcttctggat

SEQ ID NO: 6530331 - DNA, 13 bp, Homo sapiens
ttcagtcttttcc

SEQ ID NO: 6530332 - DNA, 19 bp, Homo sapiens
ttcagtgaaaagattttat

SEQ ID NO: 6530333 - DNA, 16 bp, Homo sapiens
ttcagtgaaagcatca

SEQ ID NO: 6530334 - DNA, 12 bp, Homo sapiens
ttcagtgaaatt

SEQ ID NO: 6530335 - DNA, 21 bp, Homo sapiens
ttcagtgaagatgctgtaaat

SEQ ID NO: 6530336 - DNA, 16 bp, Homo sapiens
ttcagtgagacacaga

SEQ ID NO: 6530337 - DNA, 21 bp, Homo sapiens
ttcagtgagatataggataaa

SEQ ID NO: 6530338 - DNA, 16 bp, Homo sapiens
ttcagtgagcccctcc

SEQ ID NO: 6530339 - DNA, 14 bp, Homo sapiens
ttcagtgataactc

SEQ ID NO: 6530340 - DNA, 18 bp, Homo sapiens
ttcagtgatcttcactgt

SEQ ID NO: 6530341 - DNA, 15 bp, Homo sapiens
ttcagtgatgtgcct

SEQ ID NO: 6530342 - DNA, 20 bp, Homo sapiens
ttcagtgatttttcccccca

SEQ ID NO: 6530343 - DNA, 23 bp, Homo sapiens
ttcagtgcacctgcctcagctac

SEQ ID NO: 6530344 - DNA, 10 bp, Homo sapiens
ttcagtgccc

SEQ ID NO: 6530345 - DNA, 15 bp, Homo sapiens
ttcagtgcctgctgt

SEQ ID NO: 6530346 - DNA, 16 bp, Homo sapiens
ttcagtgccttggagc

SEQ ID NO: 6530347 - DNA, 18 bp, Homo sapiens
ttcagtgccttggagcag

SEQ ID NO: 6530348 - DNA, 13 bp, Homo sapiens
ttcagtgctgtgg

SEQ ID NO: 6530349 - DNA, 16 bp, Homo sapiens
ttcagtgctttttcct

SEQ ID NO: 6530350 - DNA, 16 bp, Homo sapiens
ttcagtggaggctggc

SEQ ID NO: 6530351 - DNA, 18 bp, Homo sapiens
ttcagtggaggctggcag

SEQ ID NO: 6530352 - DNA, 13 bp, Homo sapiens
ttcagtggcagct

SEQ ID NO: 6530353 - DNA, 16 bp, Homo sapiens
ttcagtggcagggctc

SEQ ID NO: 6530354 - DNA, 16 bp, Homo sapiens
ttcagtggtcctgtca

SEQ ID NO: 6530355 - DNA, 17 bp, Homo sapiens
ttcagtggtgaaatctt

SEQ ID NO: 6530356 - DNA, 19 bp, Homo sapiens
ttcagtggtgaaatcttgt

SEQ ID NO: 6530357 - DNA, 17 bp, Homo sapiens
ttcagtggttccttctg

SEQ ID NO: 6530358 - DNA, 16 bp, Homo sapiens
ttcagtgtaatttctt

SEQ ID NO: 6530359 - DNA, 20 bp, Homo sapiens
ttcagtgtaatttctttgcc

SEQ ID NO: 6530360 - DNA, 21 bp, Homo sapiens
ttcagtgtaatttctttgcct

SEQ ID NO: 6530361 - DNA, 18 bp, Homo sapiens
ttcagtgtagcgggagga

SEQ ID NO: 6530362 - DNA, 20 bp, Homo sapiens
ttcagtgtagttaatttatc

SEQ ID NO: 6530363 - DNA, 24 bp, Homo sapiens
ttcagtgtagttaatttatctaaa

SEQ ID NO: 6530364 - DNA, 20 bp, Homo sapiens
ttcagtgtatggaaataaat

SEQ ID NO: 6530365 - DNA, 18 bp, Homo sapiens
ttcagtgtcccaccttga

SEQ ID NO: 6530366 - DNA, 16 bp, Homo sapiens
ttcagtgtcccaggca

SEQ ID NO: 6530367 - DNA, 13 bp, Homo sapiens
ttcagtgtcccgg

SEQ ID NO: 6530368 - DNA, 21 bp, Homo sapiens
ttcagtgtcgggaattttccc

SEQ ID NO: 6530369 - DNA, 23 bp, Homo sapiens
ttcagtgtcgggaattttccccg

SEQ ID NO: 6530370 - DNA, 15 bp, Homo sapiens
ttcagtgtctctgtt

SEQ ID NO: 6530371 - DNA, 17 bp, Homo sapiens
ttcagtgtgagtcagaa

SEQ ID NO: 6530372 - DNA, 12 bp, Homo sapiens
ttcagtgttaaa

SEQ ID NO: 6530373 - DNA, 18 bp, Homo sapiens
ttcagtgttaaatgtgat

SEQ ID NO: 6530374 - DNA, 14 bp, Homo sapiens
ttcagtgttgacat

SEQ ID NO: 6530375 - DNA, 16 bp, Homo sapiens
ttcagtgttgacatag

SEQ ID NO: 6530376 - DNA, 19 bp, Homo sapiens
ttcagtgttgacatagcct

SEQ ID NO: 6530377 - DNA, 20 bp, Homo sapiens
ttcagtgttgacatagcctt

SEQ ID NO: 6530378 - DNA, 10 bp, Homo sapiens
ttcagtgttt

SEQ ID NO: 6530379 - DNA, 14 bp, Homo sapiens
ttcagttaagaaaa

SEQ ID NO: 6530380 - DNA, 15 bp, Homo sapiens
ttcagttaagaaaaa

SEQ ID NO: 6530381 - DNA, 17 bp, Homo sapiens
ttcagttaagaaaaaaa

SEQ ID NO: 6530382 - DNA, 13 bp, Homo sapiens
ttcagttacagaa

SEQ ID NO: 6530383 - DNA, 23 bp, Homo sapiens
ttcagttagcagacagaagtgta

SEQ ID NO: 6530384 - DNA, 20 bp, Homo sapiens
ttcagttataatttcaattt

SEQ ID NO: 6530385 - DNA, 13 bp, Homo sapiens
ttcagttcagctt

SEQ ID NO: 6530386 - DNA, 17 bp, Homo sapiens
ttcagttcattcccaga

SEQ ID NO: 6530387 - DNA, 15 bp, Homo sapiens
ttcagttccagcttt

SEQ ID NO: 6530388 - DNA, 22 bp, Homo sapiens
ttcagttcccaccatctgatta

SEQ ID NO: 6530389 - DNA, 17 bp, Homo sapiens
ttcagttcccgctctgc

SEQ ID NO: 6530390 - DNA, 14 bp, Homo sapiens
ttcagttccctcct

SEQ ID NO: 6530391 - DNA, 21 bp, Homo sapiens
ttcagttccgtcagaaagtgt

SEQ ID NO: 6530392 - DNA, 17 bp, Homo sapiens
ttcagttcctctttgca

SEQ ID NO: 6530393 - DNA, 23 bp, Homo sapiens
ttcagttcctctttgcatggaat

SEQ ID NO: 6530394 - DNA, 16 bp, Homo sapiens
ttcagttctaggaaaa

SEQ ID NO: 6530395 - DNA, 19 bp, Homo sapiens
ttcagttctaggaaaataa

SEQ ID NO: 6530396 - DNA, 13 bp, Homo sapiens
ttcagttctaggc

SEQ ID NO: 6530397 - DNA, 21 bp, Homo sapiens
ttcagttctaggcctttcctc

SEQ ID NO: 6530398 - DNA, 23 bp, Homo sapiens
ttcagttctaggcctttcctctg

SEQ ID NO: 6530399 - DNA, 18 bp, Homo sapiens
ttcagttctgtgtacatt

SEQ ID NO: 6530400 - DNA, 20 bp, Homo sapiens
ttcagttgaattcatgtgaa

SEQ ID NO: 6530401 - DNA, 14 bp, Homo sapiens
ttcagttgacacat

SEQ ID NO: 6530402 - DNA, 16 bp, Homo sapiens
ttcagttgatcactgg

SEQ ID NO: 6530403 - DNA, 18 bp, Homo sapiens
ttcagttgatcactggca

SEQ ID NO: 6530404 - DNA, 19 bp, Homo sapiens
ttcagttggctgacttcca

SEQ ID NO: 6530405 - DNA, 18 bp, Homo sapiens
ttcagttggttgtgtctt

SEQ ID NO: 6530406 - DNA, 22 bp, Homo sapiens
ttcagttgtgtttgttgctggc

SEQ ID NO: 6530407 - DNA, 23 bp, Homo sapiens
ttcagttgtttgtttttgcttgt

SEQ ID NO: 6530408 - DNA, 15 bp, Homo sapiens
ttcagtttaatgcaa

SEQ ID NO: 6530409 - DNA, 17 bp, Homo sapiens
ttcagtttaatgtctcc

SEQ ID NO: 6530410 - DNA, 16 bp, Homo sapiens
ttcagtttcataaaag

SEQ ID NO: 6530411 - DNA, 19 bp, Homo sapiens
ttcagtttgaaggctgcac

SEQ ID NO: 6530412 - DNA, 17 bp, Homo sapiens
ttcagtttgtaaagtcg

SEQ ID NO: 6530413 - DNA, 19 bp, Homo sapiens
ttcagttttaccagatgat

SEQ ID NO: 6530414 - DNA, 14 bp, Homo sapiens
ttcagttttactgc

SEQ ID NO: 6530415 - DNA, 17 bp, Homo sapiens
ttcagttttactgcatt

SEQ ID NO: 6530416 - DNA, 17 bp, Homo sapiens
ttcagttttagtttcaa

SEQ ID NO: 6530417 - DNA, 18 bp, Homo sapiens
ttcagttttagtttcaaa

SEQ ID NO: 6530418 - DNA, 13 bp, Homo sapiens
ttcagttttccca

SEQ ID NO: 6530419 - DNA, 19 bp, Homo sapiens
ttcagtttttattaatcta

SEQ ID NO: 6530420 - DNA, 13 bp, Homo sapiens
ttcagtttttcac

SEQ ID NO: 6530421 - DNA, 15 bp, Homo sapiens
ttcagtttttcattt

SEQ ID NO: 6530422 - DNA, 17 bp, Homo sapiens
ttcagtttttcatttgt

SEQ ID NO: 6530423 - DNA, 23 bp, Homo sapiens
ttcagtttttcatttgttttgct

SEQ ID NO: 6530424 - DNA, 16 bp, Homo sapiens
ttcagtttttgtatct

SEQ ID NO: 6530425 - DNA, 18 bp, Homo sapiens
ttcagtttttttaaatgc

SEQ ID NO: 6530426 - DNA, 20 bp, Homo sapiens
ttcagtttttttttttccag

SEQ ID NO: 6530427 - DNA, 22 bp, Homo sapiens
ttcataaaacggtgctttctgt

SEQ ID NO: 6530428 - DNA, 23 bp, Homo sapiens
ttcataaaacggtgctttctgtg

SEQ ID NO: 6530429 - DNA, 19 bp, Homo sapiens
ttcataaacaacttaatgt

SEQ ID NO: 6530430 - DNA, 19 bp, Homo sapiens
ttcataaagagaaaatgat

SEQ ID NO: 6530431 - DNA, 20 bp, Homo sapiens
ttcataaagtacttgagtgt

SEQ ID NO: 6530432 - DNA, 20 bp, Homo sapiens
ttcataaatacaaaaatgaa

SEQ ID NO: 6530433 - DNA, 21 bp, Homo sapiens
ttcataaatacaaaaatgaat

SEQ ID NO: 6530434 - DNA, 14 bp, Homo sapiens
ttcataaatctatt

SEQ ID NO: 6530435 - DNA, 15 bp, Homo sapiens
ttcataaatgaattt

SEQ ID NO: 6530436 - DNA, 14 bp, Homo sapiens
ttcataaattattt

SEQ ID NO: 6530437 - DNA, 20 bp, Homo sapiens
ttcataaattatttgattat

SEQ ID NO: 6530438 - DNA, 18 bp, Homo sapiens
ttcataaattggctcctt

SEQ ID NO: 6530439 - DNA, 21 bp, Homo sapiens
ttcataaattggctcctttcc

SEQ ID NO: 6530440 - DNA, 22 bp, Homo sapiens
ttcataaatttgttgtcatgtg

SEQ ID NO: 6530441 - DNA, 17 bp, Homo sapiens
ttcataacaaaccatct

SEQ ID NO: 6530442 - DNA, 13 bp, Homo sapiens
ttcataacaatgt

SEQ ID NO: 6530443 - DNA, 17 bp, Homo sapiens
ttcataacagtgccatt

SEQ ID NO: 6530444 - DNA, 18 bp, Homo sapiens
ttcataacagtgccattg

SEQ ID NO: 6530445 - DNA, 21 bp, Homo sapiens
ttcataaccaacaatataaac

SEQ ID NO: 6530446 - DNA, 15 bp, Homo sapiens
ttcataacctagcct

SEQ ID NO: 6530447 - DNA, 13 bp, Homo sapiens
ttcataacggaaa

SEQ ID NO: 6530448 - DNA, 19 bp, Homo sapiens
ttcataactaggagactga

SEQ ID NO: 6530449 - DNA, 19 bp, Homo sapiens
ttcataactggtagctata

SEQ ID NO: 6530450 - DNA, 19 bp, Homo sapiens
ttcataagaggttctaact

SEQ ID NO: 6530451 - DNA, 16 bp, Homo sapiens
ttcataagatattctt

SEQ ID NO: 6530452 - DNA, 17 bp, Homo sapiens
ttcataagatattcttt

SEQ ID NO: 6530453 - DNA, 21 bp, Homo sapiens
ttcataagatattctttacaa

SEQ ID NO: 6530454 - DNA, 14 bp, Homo sapiens
ttcataagccaatt

SEQ ID NO: 6530455 - DNA, 12 bp, Homo sapiens
ttcataagtatt

SEQ ID NO: 6530456 - DNA, 17 bp, Homo sapiens
ttcataagtatttcaaa

SEQ ID NO: 6530457 - DNA, 22 bp, Homo sapiens
ttcataataaactagatactgt

SEQ ID NO: 6530458 - DNA, 21 bp, Homo sapiens
ttcataataaatagacacttg

SEQ ID NO: 6530459 - DNA, 15 bp, Homo sapiens
ttcataataaatttt

SEQ ID NO: 6530460 - DNA, 23 bp, Homo sapiens
ttcataatatatggaagataatt

SEQ ID NO: 6530461 - DNA, 17 bp, Homo sapiens
ttcataatgaattataa

SEQ ID NO: 6530462 - DNA, 14 bp, Homo sapiens
ttcataatgtgaga

SEQ ID NO: 6530463 - DNA, 9 bp, Homo sapiens
ttcataatt

SEQ ID NO: 6530464 - DNA, 22 bp, Homo sapiens
ttcataattaaaatttatctta

SEQ ID NO: 6530465 - DNA, 17 bp, Homo sapiens
ttcataattagaacaat

SEQ ID NO: 6530466 - DNA, 19 bp, Homo sapiens
ttcataattattatttggc

SEQ ID NO: 6530467 - DNA, 17 bp, Homo sapiens
tgggggtggggagacct

SEQ ID NO: 6530468 - DNA, 19 bp, Homo sapiens
tgggggtggggggactgcc

SEQ ID NO: 6530469 - DNA, 20 bp, Homo sapiens
tgggggtgtcacagaggcag

SEQ ID NO: 6530470 - DNA, 21 bp, Homo sapiens
tgggggtgtcacagaggcagt

SEQ ID NO: 6530471 - DNA, 17 bp, Homo sapiens
tgggggtgtggctctgc

SEQ ID NO: 6530472 - DNA, 16 bp, Homo sapiens
tgggggttcaggcccg

SEQ ID NO: 6530473 - DNA, 12 bp, Homo sapiens
tgggggttgctg

SEQ ID NO: 6530474 - DNA, 19 bp, Homo sapiens
tgggggttggatgggaaga

SEQ ID NO: 6530475 - DNA, 21 bp, Homo sapiens
tgggggttggatgggaagatg

SEQ ID NO: 6530476 - DNA, 15 bp, Homo sapiens
tgggggttggctggg

SEQ ID NO: 6530477 - DNA, 16 bp, Homo sapiens
tgggggttggctgggt

SEQ ID NO: 6530478 - DNA, 23 bp, Homo sapiens
tgggggtttccctgtgtggacca

SEQ ID NO: 6530479 - DNA, 14 bp, Homo sapiens
tggggtaaggagga

SEQ ID NO: 6530480 - DNA, 20 bp, Homo sapiens
tggggtaagttgaagggaaa

SEQ ID NO: 6530481 - DNA, 20 bp, Homo sapiens
tggggtacaaggggcccagt

SEQ ID NO: 6530482 - DNA, 14 bp, Homo sapiens
tggggtaccagcca

SEQ ID NO: 6530483 - DNA, 16 bp, Homo sapiens
tggggtacccactgct

SEQ ID NO: 6530484 - DNA, 18 bp, Homo sapiens
tggggtacccactgctct

SEQ ID NO: 6530485 - DNA, 21 bp, Homo sapiens
tggggtactactctccagctt

SEQ ID NO: 6530486 - DNA, 19 bp, Homo sapiens
tggggtactcgttggatgt

SEQ ID NO: 6530487 - DNA, 19 bp, Homo sapiens
tggggtactcttgatgtga

SEQ ID NO: 6530488 - DNA, 16 bp, Homo sapiens
tggggtagaaacattg

SEQ ID NO: 6530489 - DNA, 20 bp, Homo sapiens
tggggtagaagtagaatcct

SEQ ID NO: 6530490 - DNA, 17 bp, Homo sapiens
tggggtagactgaggga

SEQ ID NO: 6530491 - DNA, 13 bp, Homo sapiens
tggggtagagagg

SEQ ID NO: 6530492 - DNA, 22 bp, Homo sapiens
tggggtaggaaaccaccctgag

SEQ ID NO: 6530493 - DNA, 17 bp, Homo sapiens
tggggtaggctgctccc

SEQ ID NO: 6530494 - DNA, 13 bp, Homo sapiens
tggggtagggctg

SEQ ID NO: 6530495 - DNA, 20 bp, Homo sapiens
tggggtatgtgtgtgtgggt

SEQ ID NO: 6530496 - DNA, 16 bp, Homo sapiens
tggggtatgttctggg

SEQ ID NO: 6530497 - DNA, 21 bp, Homo sapiens
tggggtatttggggcttattt

SEQ ID NO: 6530498 - DNA, 21 bp, Homo sapiens
tggggtcaagaaacagccagc

SEQ ID NO: 6530499 - DNA, 22 bp, Homo sapiens
tggggtcaagctgagctggctt

SEQ ID NO: 6530500 - DNA, 14 bp, Homo sapiens
tggggtcacagagg

SEQ ID NO: 6530501 - DNA, 21 bp, Homo sapiens
tggggtcaccaccctcccctg

SEQ ID NO: 6530502 - DNA, 19 bp, Homo sapiens
tggggtcactctggcagct

SEQ ID NO: 6530503 - DNA, 17 bp, Homo sapiens
tggggtcagagactgct

SEQ ID NO: 6530504 - DNA, 15 bp, Homo sapiens
tggggtcagcaggcc

SEQ ID NO: 6530505 - DNA, 17 bp, Homo sapiens
tggggtcagcaggccca

SEQ ID NO: 6530506 - DNA, 19 bp, Homo sapiens
tggggtcagcaggcccagg

SEQ ID NO: 6530507 - DNA, 19 bp, Homo sapiens
tggggtcagccagggccag

SEQ ID NO: 6530508 - DNA, 21 bp, Homo sapiens
tggggtcagccagggccaggg

SEQ ID NO: 6530509 - DNA, 22 bp, Homo sapiens
tggggtcaggaacagtggctgg

SEQ ID NO: 6530510 - DNA, 19 bp, Homo sapiens
tggggtcaggccgggcaga

SEQ ID NO: 6530511 - DNA, 14 bp, Homo sapiens
tggggtcaggtgcc

SEQ ID NO: 6530512 - DNA, 15 bp, Homo sapiens
tggggtcaggtgcca

SEQ ID NO: 6530513 - DNA, 22 bp, Homo sapiens
tggggtcaggttgacaggaggt

SEQ ID NO: 6530514 - DNA, 18 bp, Homo sapiens
tggggtcatgaagggctg

SEQ ID NO: 6530515 - DNA, 19 bp, Homo sapiens
tggggtcatgaagggctgg

SEQ ID NO: 6530516 - DNA, 18 bp, Homo sapiens
tggggtcatgccctcctc

SEQ ID NO: 6530517 - DNA, 13 bp, Homo sapiens
tggggtccagggc

SEQ ID NO: 6530518 - DNA, 22 bp, Homo sapiens
tggggtccaggtcaccagcctg

SEQ ID NO: 6530519 - DNA, 14 bp, Homo sapiens
tggggtcccagcag

SEQ ID NO: 6530520 - DNA, 21 bp, Homo sapiens
tggggtcccagcagctgccag

SEQ ID NO: 6530521 - DNA, 17 bp, Homo sapiens
tggggtccccactccct

SEQ ID NO: 6530522 - DNA, 18 bp, Homo sapiens
tggggtccccactccctg

SEQ ID NO: 6530523 - DNA, 12 bp, Homo sapiens
tggggtccccag

SEQ ID NO: 6530524 - DNA, 13 bp, Homo sapiens
tggggtccccatc

SEQ ID NO: 6530525 - DNA, 12 bp, Homo sapiens
tggggtcccccc

SEQ ID NO: 6530526 - DNA, 15 bp, Homo sapiens
tggggtcccccctcc

SEQ ID NO: 6530527 - DNA, 16 bp, Homo sapiens
tggggtcccccctgag

SEQ ID NO: 6530528 - DNA, 13 bp, Homo sapiens
tggggtccctcta

SEQ ID NO: 6530529 - DNA, 16 bp, Homo sapiens
tggggtcctcctgtgc

SEQ ID NO: 6530530 - DNA, 17 bp, Homo sapiens
tggggtcctcctgtgct

SEQ ID NO: 6530531 - DNA, 16 bp, Homo sapiens
tggggtcctggccatc

SEQ ID NO: 6530532 - DNA, 13 bp, Homo sapiens
tggggtcctgggc

SEQ ID NO: 6530533 - DNA, 23 bp, Homo sapiens
tggggtcctgtggggcccccaca

SEQ ID NO: 6530534 - DNA, 19 bp, Homo sapiens
tggggtctacactgcaatc

SEQ ID NO: 6530535 - DNA, 23 bp, Homo sapiens
tggggtctcaaagtttgacagga

SEQ ID NO: 6530536 - DNA, 21 bp, Homo sapiens
tggggtctcacagtgttgccc

SEQ ID NO: 6530537 - DNA, 16 bp, Homo sapiens
tggggtctcagtccag

SEQ ID NO: 6530538 - DNA, 19 bp, Homo sapiens
tggggtctccctctcctgc

SEQ ID NO: 6530539 - DNA, 22 bp, Homo sapiens
tggggtctccctctcctgccta

SEQ ID NO: 6530540 - DNA, 22 bp, Homo sapiens
tggggtctcctcaggaccaggg

SEQ ID NO: 6530541 - DNA, 12 bp, Homo sapiens
tggggtctctct

SEQ ID NO: 6530542 - DNA, 15 bp, Homo sapiens
tggggtctctctccc

SEQ ID NO: 6530543 - DNA, 22 bp, Homo sapiens
tggggtctctgagcagtgggga

SEQ ID NO: 6530544 - DNA, 14 bp, Homo sapiens
tggggtctgacccc

SEQ ID NO: 6530545 - DNA, 15 bp, Homo sapiens
tggggtctgggaggg

SEQ ID NO: 6530546 - DNA, 15 bp, Homo sapiens
tggggtctgggcagt

SEQ ID NO: 6530547 - DNA, 16 bp, Homo sapiens
tggggtctgggcagtg

SEQ ID NO: 6530548 - DNA, 17 bp, Homo sapiens
tggggtctgggcagtgc

SEQ ID NO: 6530549 - DNA, 19 bp, Homo sapiens
tggggtctgggcagtgcca

SEQ ID NO: 6530550 - DNA, 15 bp, Homo sapiens
tggggtgaatactta

SEQ ID NO: 6530551 - DNA, 17 bp, Homo sapiens
tggggtgacagtcatca

SEQ ID NO: 6530552 - DNA, 23 bp, Homo sapiens
tggggtgacccggcaccccctgc

SEQ ID NO: 6530553 - DNA, 21 bp, Homo sapiens
tggggtgagaagtacagggca

SEQ ID NO: 6530554 - DNA, 17 bp, Homo sapiens
tggggtgagcctgactg

SEQ ID NO: 6530555 - DNA, 14 bp, Homo sapiens
tggggtgaggacca

SEQ ID NO: 6530556 - DNA, 17 bp, Homo sapiens
tggggtgaggaccactc

SEQ ID NO: 6530557 - DNA, 20 bp, Homo sapiens
tggggtgagggacagagccc

SEQ ID NO: 6530558 - DNA, 15 bp, Homo sapiens
tggggtgagggagtt

SEQ ID NO: 6530559 - DNA, 19 bp, Homo sapiens
tggggtgataaggggcctt

SEQ ID NO: 6530560 - DNA, 22 bp, Homo sapiens
tggggtgcactcgccatttcct

SEQ ID NO: 6530561 - DNA, 15 bp, Homo sapiens
tggggtgcagggatg

SEQ ID NO: 6530562 - DNA, 23 bp, Homo sapiens
tggggtgcatcctcctcagcccc

SEQ ID NO: 6530563 - DNA, 23 bp, Homo sapiens
tggggtgccccagctaggaagca

SEQ ID NO: 6530564 - DNA, 17 bp, Homo sapiens
tggggtgccgcctgccc

SEQ ID NO: 6530565 - DNA, 17 bp, Homo sapiens
tggggtgccttcactgg

SEQ ID NO: 6530566 - DNA, 16 bp, Homo sapiens
tggggtgctggggctg

SEQ ID NO: 6530567 - DNA, 22 bp, Homo sapiens
tggggtggaatagggaactgta

SEQ ID NO: 6530568 - DNA, 13 bp, Homo sapiens
tggggtggacctg

SEQ ID NO: 6530569 - DNA, 17 bp, Homo sapiens
tggggtggacctgggac

SEQ ID NO: 6530570 - DNA, 13 bp, Homo sapiens
tggggtggagcac

SEQ ID NO: 6530571 - DNA, 15 bp, Homo sapiens
tggggtggagcactg

SEQ ID NO: 6530572 - DNA, 20 bp, Homo sapiens
tggggtggagcactggactc

SEQ ID NO: 6530573 - DNA, 23 bp, Homo sapiens
tggggtggagcactggactccgg

SEQ ID NO: 6530574 - DNA, 12 bp, Homo sapiens
tggggtggccag

SEQ ID NO: 6530575 - DNA, 13 bp, Homo sapiens
tggggtggccagg

SEQ ID NO: 6530576 - DNA, 14 bp, Homo sapiens
tggggtggccaggg

SEQ ID NO: 6530577 - DNA, 15 bp, Homo sapiens
tggggtggccagggc

SEQ ID NO: 6530578 - DNA, 20 bp, Homo sapiens
tggggtggcctggccctcct

SEQ ID NO: 6530579 - DNA, 17 bp, Homo sapiens
tggggtggcctgtgtgg

SEQ ID NO: 6530580 - DNA, 20 bp, Homo sapiens
tggggtggcctgtgtggcca

SEQ ID NO: 6530581 - DNA, 20 bp, Homo sapiens
tggggtggctgcagcctcag

SEQ ID NO: 6530582 - DNA, 17 bp, Homo sapiens
tggggtgggacagggag

SEQ ID NO: 6530583 - DNA, 18 bp, Homo sapiens
tggggtgggacagggagg

SEQ ID NO: 6530584 - DNA, 20 bp, Homo sapiens
tggggtgggagactttccat

SEQ ID NO: 6530585 - DNA, 15 bp, Homo sapiens
tggggtgggagaggt

SEQ ID NO: 6530586 - DNA, 19 bp, Homo sapiens
tggggtgggagggcgtcag

SEQ ID NO: 6530587 - DNA, 19 bp, Homo sapiens
tggggtgggagggggcagg

SEQ ID NO: 6530588 - DNA, 20 bp, Homo sapiens
tggggtgggagggggcaggg

SEQ ID NO: 6530589 - DNA, 21 bp, Homo sapiens
tggggtgggagggggcagggg

SEQ ID NO: 6530590 - DNA, 13 bp, Homo sapiens
tggggtgggctgg

SEQ ID NO: 6530591 - DNA, 13 bp, Homo sapiens
tggggtggggcag

SEQ ID NO: 6530592 - DNA, 15 bp, Homo sapiens
tggggtggggcagga

SEQ ID NO: 6530593 - DNA, 16 bp, Homo sapiens
tggggtggggcttgga

SEQ ID NO: 6530594 - DNA, 13 bp, Homo sapiens
tggggtgggggcc

SEQ ID NO: 6530595 - DNA, 16 bp, Homo sapiens
tggggtgggggccagg

SEQ ID NO: 6530596 - DNA, 21 bp, Homo sapiens
tggggtgggggggggtcctaa

SEQ ID NO: 6530597 - DNA, 15 bp, Homo sapiens
tggggtgggtataaa

SEQ ID NO: 6530598 - DNA, 23 bp, Homo sapiens
tggggtgggtttagcaggctgca

SEQ ID NO: 6530599 - DNA, 16 bp, Homo sapiens
tggggtggtgctgggt

SEQ ID NO: 6530600 - DNA, 14 bp, Homo sapiens
tggggtggttgagg

SEQ ID NO: 6530601 - DNA, 15 bp, Homo sapiens
tggggtgtgctggga

SEQ ID NO: 6530602 - DNA, 15 bp, Homo sapiens
tggggtgtgggaggc

SEQ ID NO: 6530603 - DNA, 15 bp, Homo sapiens
tggggtgtgtgcagg

SEQ ID NO: 6530604 - DNA, 21 bp, Homo sapiens
tggggtgtgttccaactgccc

SEQ ID NO: 6530605 - DNA, 15 bp, Homo sapiens
tggggtgttgaagac

SEQ ID NO: 6530606 - DNA, 18 bp, Homo sapiens
tggggttatctctgtgtt

SEQ ID NO: 6530607 - DNA, 15 bp, Homo sapiens
tggggttatgtgagg

SEQ ID NO: 6530608 - DNA, 16 bp, Homo sapiens
tggggttcaagcccag

SEQ ID NO: 6530609 - DNA, 18 bp, Homo sapiens
tggggttcaagcccaggc

SEQ ID NO: 6530610 - DNA, 19 bp, Homo sapiens
tggggttcaagcccaggct

SEQ ID NO: 6530611 - DNA, 17 bp, Homo sapiens
tggggttcagcccctcc

SEQ ID NO: 6530612 - DNA, 19 bp, Homo sapiens
tggggttcagcccctcctc

SEQ ID NO: 6530613 - DNA, 18 bp, Homo sapiens
tggggttcataggggcag

SEQ ID NO: 6530614 - DNA, 16 bp, Homo sapiens
tggggttcccgaggga

SEQ ID NO: 6530615 - DNA, 21 bp, Homo sapiens
tggggttcctggttgttcctg

SEQ ID NO: 6530616 - DNA, 15 bp, Homo sapiens
tggggttctggaaat

SEQ ID NO: 6530617 - DNA, 16 bp, Homo sapiens
tggggttgcaaccact

SEQ ID NO: 6530618 - DNA, 15 bp, Homo sapiens
tggggttgccagagg

SEQ ID NO: 6530619 - DNA, 18 bp, Homo sapiens
tggggttgcgtctgaggc

SEQ ID NO: 6530620 - DNA, 23 bp, Homo sapiens
tggggttgcgtctgaggcctgcc

SEQ ID NO: 6530621 - DNA, 14 bp, Homo sapiens
tggggttgctgaag

SEQ ID NO: 6530622 - DNA, 20 bp, Homo sapiens
tggggttgctgaagatgcct

SEQ ID NO: 6530623 - DNA, 15 bp, Homo sapiens
tggggttggcaacag

SEQ ID NO: 6530624 - DNA, 17 bp, Homo sapiens
tggggttggcaacagga

SEQ ID NO: 6530625 - DNA, 18 bp, Homo sapiens
tggggttggcttccctgg

SEQ ID NO: 6530626 - DNA, 15 bp, Homo sapiens
tggggttgggacagg

SEQ ID NO: 6530627 - DNA, 19 bp, Homo sapiens
tggggttgggattgggggc

SEQ ID NO: 6530628 - DNA, 12 bp, Homo sapiens
tggggttgtttt

SEQ ID NO: 6530629 - DNA, 22 bp, Homo sapiens
tggggtttagaaccccaggtga

SEQ ID NO: 6530630 - DNA, 19 bp, Homo sapiens
tggggtttatcagaattct

SEQ ID NO: 6530631 - DNA, 19 bp, Homo sapiens
tggggtttccacacaggcc

SEQ ID NO: 6530632 - DNA, 20 bp, Homo sapiens
tggggtttcctgcatggaca

SEQ ID NO: 6530633 - DNA, 21 bp, Homo sapiens
tggggtttcctgcatggacag

SEQ ID NO: 6530634 - DNA, 15 bp, Homo sapiens
tggggtttcctggca

SEQ ID NO: 6530635 - DNA, 17 bp, Homo sapiens
tggggtttcctggcact

SEQ ID NO: 6530636 - DNA, 21 bp, Homo sapiens
tggggtttgcttttgttttgt

SEQ ID NO: 6530637 - DNA, 12 bp, Homo sapiens
tggggtttgtac

SEQ ID NO: 6530638 - DNA, 23 bp, Homo sapiens
tggggttttatgtgtgggaaagg

SEQ ID NO: 6530639 - DNA, 18 bp, Homo sapiens
tggggttttcacttccta

SEQ ID NO: 6530640 - DNA, 19 bp, Homo sapiens
tggggttttcacttcctag

SEQ ID NO: 6530641 - DNA, 18 bp, Homo sapiens
tggggtttttattatttt

SEQ ID NO: 6530642 - DNA, 20 bp, Homo sapiens
tggggtttttattattttta

SEQ ID NO: 6530643 - DNA, 19 bp, Homo sapiens
tggggttttttttttctga

SEQ ID NO: 6530644 - DNA, 19 bp, Homo sapiens
tgggtaaaagcagggcagc

SEQ ID NO: 6530645 - DNA, 16 bp, Homo sapiens
ttcataattcatttaa

SEQ ID NO: 6530646 - DNA, 13 bp, Homo sapiens
ttcataattctga

SEQ ID NO: 6530647 - DNA, 15 bp, Homo sapiens
ttcataattctgaaa

SEQ ID NO: 6530648 - DNA, 18 bp, Homo sapiens
ttcataattctgaaacaa

SEQ ID NO: 6530649 - DNA, 20 bp, Homo sapiens
ttcataattttcaaaagaaa

SEQ ID NO: 6530650 - DNA, 15 bp, Homo sapiens
ttcatacacaacgta

SEQ ID NO: 6530651 - DNA, 14 bp, Homo sapiens
ttcatacagtttta

SEQ ID NO: 6530652 - DNA, 21 bp, Homo sapiens
ttcatacatatatatatttgt

SEQ ID NO: 6530653 - DNA, 14 bp, Homo sapiens
ttcatacattccta

SEQ ID NO: 6530654 - DNA, 15 bp, Homo sapiens
ttcataccacttgaa

SEQ ID NO: 6530655 - DNA, 16 bp, Homo sapiens
ttcataccacttgaat

SEQ ID NO: 6530656 - DNA, 16 bp, Homo sapiens
ttcatacctaagtact

SEQ ID NO: 6530657 - DNA, 21 bp, Homo sapiens
ttcatacctaagtactgtaat

SEQ ID NO: 6530658 - DNA, 19 bp, Homo sapiens
ttcatacctacatgtattt

SEQ ID NO: 6530659 - DNA, 16 bp, Homo sapiens
ttcatacctccctcct

SEQ ID NO: 6530660 - DNA, 14 bp, Homo sapiens
ttcataccttgatg

SEQ ID NO: 6530661 - DNA, 22 bp, Homo sapiens
ttcatacgcatcccatctctcc

SEQ ID NO: 6530662 - DNA, 16 bp, Homo sapiens
ttcatacgtaaaattt

SEQ ID NO: 6530663 - DNA, 16 bp, Homo sapiens
ttcatactaaactgat

SEQ ID NO: 6530664 - DNA, 16 bp, Homo sapiens
ttcatactacatttga

SEQ ID NO: 6530665 - DNA, 15 bp, Homo sapiens
ttcatactacccttt

SEQ ID NO: 6530666 - DNA, 13 bp, Homo sapiens
ttcatactgtaca

SEQ ID NO: 6530667 - DNA, 14 bp, Homo sapiens
ttcatactgtacac

SEQ ID NO: 6530668 - DNA, 15 bp, Homo sapiens
ttcatactgtacaca

SEQ ID NO: 6530669 - DNA, 16 bp, Homo sapiens
ttcatactgtacacat

SEQ ID NO: 6530670 - DNA, 22 bp, Homo sapiens
ttcatactgtacacatttctta

SEQ ID NO: 6530671 - DNA, 23 bp, Homo sapiens
ttcatactgtacacatttcttaa

SEQ ID NO: 6530672 - DNA, 21 bp, Homo sapiens
ttcatactgtagaaaccagct

SEQ ID NO: 6530673 - DNA, 14 bp, Homo sapiens
ttcatacttaaaaa

SEQ ID NO: 6530674 - DNA, 21 bp, Homo sapiens
ttcatacttacggcctttaca

SEQ ID NO: 6530675 - DNA, 19 bp, Homo sapiens
ttcatacttctaaatcaga

SEQ ID NO: 6530676 - DNA, 12 bp, Homo sapiens
ttcatagaaata

SEQ ID NO: 6530677 - DNA, 13 bp, Homo sapiens
ttcatagaagtgt

SEQ ID NO: 6530678 - DNA, 12 bp, Homo sapiens
ttcatagaataa

SEQ ID NO: 6530679 - DNA, 13 bp, Homo sapiens
ttcatagaataac

SEQ ID NO: 6530680 - DNA, 17 bp, Homo sapiens
ttcatagaccctctcaa

SEQ ID NO: 6530681 - DNA, 18 bp, Homo sapiens
ttcatagagaatataaaa

SEQ ID NO: 6530682 - DNA, 22 bp, Homo sapiens
ttcatagagccctattctctca

SEQ ID NO: 6530683 - DNA, 12 bp, Homo sapiens
ttcatagatatt

SEQ ID NO: 6530684 - DNA, 18 bp, Homo sapiens
ttcatagatattggaaga

SEQ ID NO: 6530685 - DNA, 19 bp, Homo sapiens
ttcatagatgagaaaactg

SEQ ID NO: 6530686 - DNA, 17 bp, Homo sapiens
ttcatagatgcaggagg

SEQ ID NO: 6530687 - DNA, 13 bp, Homo sapiens
ttcatagcactgc

SEQ ID NO: 6530688 - DNA, 15 bp, Homo sapiens
ttcatagctccttgg

SEQ ID NO: 6530689 - DNA, 22 bp, Homo sapiens
ttcatagctggttcctgctaga

SEQ ID NO: 6530690 - DNA, 16 bp, Homo sapiens
ttcataggagacacat

SEQ ID NO: 6530691 - DNA, 22 bp, Homo sapiens
ttcataggcagcatctcagatc

SEQ ID NO: 6530692 - DNA, 20 bp, Homo sapiens
ttcataggcggtcatgtgtg

SEQ ID NO: 6530693 - DNA, 23 bp, Homo sapiens
ttcataggcggtcatgtgtgcat

SEQ ID NO: 6530694 - DNA, 22 bp, Homo sapiens
ttcatagggaaaggttttgtat

SEQ ID NO: 6530695 - DNA, 19 bp, Homo sapiens
ttcataggtcactggctct

SEQ ID NO: 6530696 - DNA, 22 bp, Homo sapiens
ttcataggtctgaaatttttct

SEQ ID NO: 6530697 - DNA, 17 bp, Homo sapiens
ttcatagtaacttctta

SEQ ID NO: 6530698 - DNA, 14 bp, Homo sapiens
ttcatagtgccttt

SEQ ID NO: 6530699 - DNA, 14 bp, Homo sapiens
ttcatagttcagaa

SEQ ID NO: 6530700 - DNA, 19 bp, Homo sapiens
ttcatagttcagaatttag

SEQ ID NO: 6530701 - DNA, 14 bp, Homo sapiens
ttcatagttctgtt

SEQ ID NO: 6530702 - DNA, 14 bp, Homo sapiens
ttcatagttggaaa

SEQ ID NO: 6530703 - DNA, 18 bp, Homo sapiens
ttcatagttggaaatatt

SEQ ID NO: 6530704 - DNA, 15 bp, Homo sapiens
ttcatagtttattat

SEQ ID NO: 6530705 - DNA, 15 bp, Homo sapiens
ttcatagtttctgta

SEQ ID NO: 6530706 - DNA, 16 bp, Homo sapiens
ttcatagtttctgtaa

SEQ ID NO: 6530707 - DNA, 17 bp, Homo sapiens
ttcatagtttctgtaat

SEQ ID NO: 6530708 - DNA, 14 bp, Homo sapiens
ttcatagttttcta

SEQ ID NO: 6530709 - DNA, 23 bp, Homo sapiens
ttcatataataaattaatttttc

SEQ ID NO: 6530710 - DNA, 16 bp, Homo sapiens
ttcatataatttaaag

SEQ ID NO: 6530711 - DNA, 17 bp, Homo sapiens
ttcatataatttaaaga

SEQ ID NO: 6530712 - DNA, 17 bp, Homo sapiens
ttcatatactataattg

SEQ ID NO: 6530713 - DNA, 20 bp, Homo sapiens
ttcatatagtcaatgtaaaa

SEQ ID NO: 6530714 - DNA, 15 bp, Homo sapiens
ttcatatatctatat

SEQ ID NO: 6530715 - DNA, 16 bp, Homo sapiens
ttcatatcccgtgaaa

SEQ ID NO: 6530716 - DNA, 18 bp, Homo sapiens
ttcatatctaatttacca

SEQ ID NO: 6530717 - DNA, 23 bp, Homo sapiens
ttcatatgaaaggtgccatggaa

SEQ ID NO: 6530718 - DNA, 20 bp, Homo sapiens
ttcatatgacattcatgcct

SEQ ID NO: 6530719 - DNA, 23 bp, Homo sapiens
ttcatatgacattcatgcctggc

SEQ ID NO: 6530720 - DNA, 23 bp, Homo sapiens
ttcatatgaggggacccagcgcc

SEQ ID NO: 6530721 - DNA, 22 bp, Homo sapiens
ttcatatgatacaccattatgt

SEQ ID NO: 6530722 - DNA, 13 bp, Homo sapiens
ttcatatgctgta

SEQ ID NO: 6530723 - DNA, 16 bp, Homo sapiens
ttcatatgtggaaata

SEQ ID NO: 6530724 - DNA, 18 bp, Homo sapiens
ttcatatgttgctcagtc

SEQ ID NO: 6530725 - DNA, 16 bp, Homo sapiens
ttcatattaagaatga

SEQ ID NO: 6530726 - DNA, 14 bp, Homo sapiens
ttcatattaagaca

SEQ ID NO: 6530727 - DNA, 18 bp, Homo sapiens
ttcatattaagacagtgt

SEQ ID NO: 6530728 - DNA, 22 bp, Homo sapiens
ttcatattaatataagtttctt

SEQ ID NO: 6530729 - DNA, 18 bp, Homo sapiens
ttcatattattttagtgt

SEQ ID NO: 6530730 - DNA, 23 bp, Homo sapiens
ttcatattattttagtgtgtaaa

SEQ ID NO: 6530731 - DNA, 14 bp, Homo sapiens
ttcatattcagctt

SEQ ID NO: 6530732 - DNA, 18 bp, Homo sapiens
ttcatattcatgcaagta

SEQ ID NO: 6530733 - DNA, 22 bp, Homo sapiens
ttcatattcttcatatccttct

SEQ ID NO: 6530734 - DNA, 13 bp, Homo sapiens
ttcatattctttt

SEQ ID NO: 6530735 - DNA, 14 bp, Homo sapiens
ttcatattgaatat

SEQ ID NO: 6530736 - DNA, 17 bp, Homo sapiens
ttcatattgcatcatag

SEQ ID NO: 6530737 - DNA, 23 bp, Homo sapiens
ttcatattgcatcatagtttgct

SEQ ID NO: 6530738 - DNA, 12 bp, Homo sapiens
ttcatattgtgc

SEQ ID NO: 6530739 - DNA, 14 bp, Homo sapiens
ttcatattgtgcca

SEQ ID NO: 6530740 - DNA, 22 bp, Homo sapiens
ttcatattgtgccaatatgtat

SEQ ID NO: 6530741 - DNA, 13 bp, Homo sapiens
ttcatatttaaag

SEQ ID NO: 6530742 - DNA, 18 bp, Homo sapiens
ttcatatttaatttgaag

SEQ ID NO: 6530743 - DNA, 20 bp, Homo sapiens
ttcatatttaatttgaaggt

SEQ ID NO: 6530744 - DNA, 13 bp, Homo sapiens
ttcatatttctac

SEQ ID NO: 6530745 - DNA, 14 bp, Homo sapiens
ttcatatttgcact

SEQ ID NO: 6530746 - DNA, 15 bp, Homo sapiens
ttcatatttgtactt

SEQ ID NO: 6530747 - DNA, 20 bp, Homo sapiens
ttcatatttgtactttctgt

SEQ ID NO: 6530748 - DNA, 20 bp, Homo sapiens
ttcatatttgtctttgaatc

SEQ ID NO: 6530749 - DNA, 22 bp, Homo sapiens
ttcatattttaatttcaagctt

SEQ ID NO: 6530750 - DNA, 15 bp, Homo sapiens
ttcatattttataat

SEQ ID NO: 6530751 - DNA, 23 bp, Homo sapiens
ttcatatttttgatcatcccttt

SEQ ID NO: 6530752 - DNA, 19 bp, Homo sapiens
ttcatcaaatggaagacac

SEQ ID NO: 6530753 - DNA, 18 bp, Homo sapiens
ttcatcaagagtttatta

SEQ ID NO: 6530754 - DNA, 20 bp, Homo sapiens
ttcatcaatatccctcttgt

SEQ ID NO: 6530755 - DNA, 22 bp, Homo sapiens
ttcatcaatatccctcttgtaa

SEQ ID NO: 6530756 - DNA, 13 bp, Homo sapiens
ttcatcaatcaaa

SEQ ID NO: 6530757 - DNA, 16 bp, Homo sapiens
ttcatcaatcattgta

SEQ ID NO: 6530758 - DNA, 20 bp, Homo sapiens
ttcatcaatttttatacata

SEQ ID NO: 6530759 - DNA, 22 bp, Homo sapiens
ttcatcaatttttatacatatc

SEQ ID NO: 6530760 - DNA, 22 bp, Homo sapiens
ttcatcaccttcctcctgtagt

SEQ ID NO: 6530761 - DNA, 15 bp, Homo sapiens
ttcatcagaaaaagt

SEQ ID NO: 6530762 - DNA, 13 bp, Homo sapiens
ttcatcagaactc

SEQ ID NO: 6530763 - DNA, 13 bp, Homo sapiens
ttcatcagcattt

SEQ ID NO: 6530764 - DNA, 21 bp, Homo sapiens
ttcatcaggctctgttcctca

SEQ ID NO: 6530765 - DNA, 18 bp, Homo sapiens
ttcatcagggaggaaagt

SEQ ID NO: 6530766 - DNA, 15 bp, Homo sapiens
ttcatcagtgttaaa

SEQ ID NO: 6530767 - DNA, 19 bp, Homo sapiens
ttcatcatgaggaaagcag

SEQ ID NO: 6530768 - DNA, 21 bp, Homo sapiens
ttcatcatgttggccaggctg

SEQ ID NO: 6530769 - DNA, 20 bp, Homo sapiens
ttcatcattcacttcactgt

SEQ ID NO: 6530770 - DNA, 19 bp, Homo sapiens
ttcatcattccctctcatc

SEQ ID NO: 6530771 - DNA, 20 bp, Homo sapiens
ttcatcattccctctcatct

SEQ ID NO: 6530772 - DNA, 15 bp, Homo sapiens
ttcatcatttgcaca

SEQ ID NO: 6530773 - DNA, 22 bp, Homo sapiens
ttcatccaatcctcactgggtg

SEQ ID NO: 6530774 - DNA, 15 bp, Homo sapiens
ttcatccaccaatat

SEQ ID NO: 6530775 - DNA, 18 bp, Homo sapiens
ttcatccaccaatatcat

SEQ ID NO: 6530776 - DNA, 23 bp, Homo sapiens
ttcatccaccaatatcatgtgta

SEQ ID NO: 6530777 - DNA, 16 bp, Homo sapiens
ttcatccagagttctt

SEQ ID NO: 6530778 - DNA, 18 bp, Homo sapiens
ttcatccagccactgccc

SEQ ID NO: 6530779 - DNA, 22 bp, Homo sapiens
ttcatccagctacttagctggc

SEQ ID NO: 6530780 - DNA, 22 bp, Homo sapiens
ttcatccaggcccaactgtgag

SEQ ID NO: 6530781 - DNA, 23 bp, Homo sapiens
ttcatccagttgcaataaaatag

SEQ ID NO: 6530782 - DNA, 20 bp, Homo sapiens
ttcatccatcatctgctgca

SEQ ID NO: 6530783 - DNA, 14 bp, Homo sapiens
ttcatccatcctga

SEQ ID NO: 6530784 - DNA, 21 bp, Homo sapiens
ttcatccatcctgagccaaat

SEQ ID NO: 6530785 - DNA, 24 bp, Homo sapiens
ttcatcccaaaggacagccgcctg

SEQ ID NO: 6530786 - DNA, 13 bp, Homo sapiens
ttcatcccagctg

SEQ ID NO: 6530787 - DNA, 14 bp, Homo sapiens
ttcatcccagctgc

SEQ ID NO: 6530788 - DNA, 14 bp, Homo sapiens
ttcatcccattcca

SEQ ID NO: 6530789 - DNA, 15 bp, Homo sapiens
ttcatccccttaccc

SEQ ID NO: 6530790 - DNA, 17 bp, Homo sapiens
ttcatcccgtatcacag

SEQ ID NO: 6530791 - DNA, 18 bp, Homo sapiens
ttcatccctatttatagt

SEQ ID NO: 6530792 - DNA, 17 bp, Homo sapiens
ttcatccctctggggct

SEQ ID NO: 6530793 - DNA, 19 bp, Homo sapiens
ttcatccgttgtgactcta

SEQ ID NO: 6530794 - DNA, 20 bp, Homo sapiens
ttcatcctaacatgacagta

SEQ ID NO: 6530795 - DNA, 22 bp, Homo sapiens
ttcatcctgcatgggaaaaatg

SEQ ID NO: 6530796 - DNA, 11 bp, Homo sapiens
ttcatcctggc

SEQ ID NO: 6530797 - DNA, 18 bp, Homo sapiens
ttcatcctgtgtcccctg

SEQ ID NO: 6530798 - DNA, 22 bp, Homo sapiens
ttcatcctgtgtcccctgacct

SEQ ID NO: 6530799 - DNA, 20 bp, Homo sapiens
ttcatcctgttggctgctgc

SEQ ID NO: 6530800 - DNA, 16 bp, Homo sapiens
ttcatccttccatcca

SEQ ID NO: 6530801 - DNA, 17 bp, Homo sapiens
ttcatccttcccactct

SEQ ID NO: 6530802 - DNA, 22 bp, Homo sapiens
ttcatccttttttctcttctgt

SEQ ID NO: 6530803 - DNA, 15 bp, Homo sapiens
ttcatctaatttaat

SEQ ID NO: 6530804 - DNA, 14 bp, Homo sapiens
ttcatctacctttt

SEQ ID NO: 6530805 - DNA, 17 bp, Homo sapiens
ttcatctaccttttctg

SEQ ID NO: 6530806 - DNA, 15 bp, Homo sapiens
ttcatctaggatttt

SEQ ID NO: 6530807 - DNA, 23 bp, Homo sapiens
ttcatctatgagggtgtttcctc

SEQ ID NO: 6530808 - DNA, 16 bp, Homo sapiens
ttcatctatttctgag

SEQ ID NO: 6530809 - DNA, 17 bp, Homo sapiens
ttcatctatttctgaga

SEQ ID NO: 6530810 - DNA, 23 bp, Homo sapiens
ttcatctatttttggcagtctga

SEQ ID NO: 6530811 - DNA, 21 bp, Homo sapiens
ttcatctcatgaggatttctt

SEQ ID NO: 6530812 - DNA, 12 bp, Homo sapiens
ttcatctcattt

SEQ ID NO: 6530813 - DNA, 16 bp, Homo sapiens
ttcatctcccagatcc

SEQ ID NO: 6530814 - DNA, 17 bp, Homo sapiens
ttcatctcccagatcct

SEQ ID NO: 6530815 - DNA, 17 bp, Homo sapiens
ttcatctctcagaaggg

SEQ ID NO: 6530816 - DNA, 20 bp, Homo sapiens
ttcatctctctacctccacc

SEQ ID NO: 6530817 - DNA, 18 bp, Homo sapiens
ttcatctctgctgaacat

SEQ ID NO: 6530818 - DNA, 13 bp, Homo sapiens
ttcatctctttgt

SEQ ID NO: 6530819 - DNA, 16 bp, Homo sapiens
ttcatctctttgtcct

SEQ ID NO: 6530820 - DNA, 15 bp, Homo sapiens
ttcatctgaaaagca

SEQ ID NO: 6530821 - DNA, 17 bp, Homo sapiens
ttcatctgaaaagcagt

SEQ ID NO: 6530822 - DNA, 20 bp, Homo sapiens
ttcatctgactatgacataa

SEQ ID NO: 6530823 - DNA, 14 bp, Homo sapiens
tgggtaaaattaga

SEQ ID NO: 6530824 - DNA, 19 bp, Homo sapiens
tgggtaaaattagatgcat

SEQ ID NO: 6530825 - DNA, 20 bp, Homo sapiens
tgggtaaagggacagttaca

SEQ ID NO: 6530826 - DNA, 21 bp, Homo sapiens
tgggtaaataaatgctgcttt

SEQ ID NO: 6530827 - DNA, 12 bp, Homo sapiens
tgggtaaatata

SEQ ID NO: 6530828 - DNA, 18 bp, Homo sapiens
tgggtaaatgcaaagttc

SEQ ID NO: 6530829 - DNA, 14 bp, Homo sapiens
tgggtaacactgat

SEQ ID NO: 6530830 - DNA, 23 bp, Homo sapiens
tgggtaacagggagactgcatct

SEQ ID NO: 6530831 - DNA, 14 bp, Homo sapiens
tgggtaactgtcaa

SEQ ID NO: 6530832 - DNA, 15 bp, Homo sapiens
tgggtaactgtcaag

SEQ ID NO: 6530833 - DNA, 17 bp, Homo sapiens
tgggtaacttagaagga

SEQ ID NO: 6530834 - DNA, 22 bp, Homo sapiens
tgggtaagaaagccaccttgtt

SEQ ID NO: 6530835 - DNA, 16 bp, Homo sapiens
tgggtaagaagaaagc

SEQ ID NO: 6530836 - DNA, 17 bp, Homo sapiens
tgggtaagaggagcaga

SEQ ID NO: 6530837 - DNA, 22 bp, Homo sapiens
tgggtaagaggagcagagggca

SEQ ID NO: 6530838 - DNA, 23 bp, Homo sapiens
tgggtaagaggagcagagggcag

SEQ ID NO: 6530839 - DNA, 20 bp, Homo sapiens
tgggtaagggactccagaag

SEQ ID NO: 6530840 - DNA, 16 bp, Homo sapiens
tgggtaagggagggaa

SEQ ID NO: 6530841 - DNA, 18 bp, Homo sapiens
tgggtaagtcccccaggg

SEQ ID NO: 6530842 - DNA, 21 bp, Homo sapiens
tgggtaattaaaaacagaaaa

SEQ ID NO: 6530843 - DNA, 17 bp, Homo sapiens
tgggtaattcaagaggc

SEQ ID NO: 6530844 - DNA, 17 bp, Homo sapiens
tgggtaattgtacaata

SEQ ID NO: 6530845 - DNA, 16 bp, Homo sapiens
tgggtacaagagccat

SEQ ID NO: 6530846 - DNA, 16 bp, Homo sapiens
tgggtaccaggccacc

SEQ ID NO: 6530847 - DNA, 14 bp, Homo sapiens
tgggtaccatgctt

SEQ ID NO: 6530848 - DNA, 17 bp, Homo sapiens
tgggtacccaagtgaag

SEQ ID NO: 6530849 - DNA, 22 bp, Homo sapiens
tgggtacccagactctaaatat

SEQ ID NO: 6530850 - DNA, 13 bp, Homo sapiens
tgggtacccaggc

SEQ ID NO: 6530851 - DNA, 15 bp, Homo sapiens
tgggtacctattttc

SEQ ID NO: 6530852 - DNA, 16 bp, Homo sapiens
tgggtacctgcaagca

SEQ ID NO: 6530853 - DNA, 21 bp, Homo sapiens
tgggtacctgcaagcagaact

SEQ ID NO: 6530854 - DNA, 17 bp, Homo sapiens
tgggtactgactgagat

SEQ ID NO: 6530855 - DNA, 19 bp, Homo sapiens
tgggtactggagcttttaa

SEQ ID NO: 6530856 - DNA, 20 bp, Homo sapiens
tgggtactgtctcggcagag

SEQ ID NO: 6530857 - DNA, 16 bp, Homo sapiens
tgggtacttcttgaag

SEQ ID NO: 6530858 - DNA, 14 bp, Homo sapiens
tgggtagaaaaatt

SEQ ID NO: 6530859 - DNA, 18 bp, Homo sapiens
tgggtagaggggtgcttt

SEQ ID NO: 6530860 - DNA, 19 bp, Homo sapiens
tgggtagatgggtgggggc

SEQ ID NO: 6530861 - DNA, 22 bp, Homo sapiens
tgggtagctgccacttgaacaa

SEQ ID NO: 6530862 - DNA, 22 bp, Homo sapiens
tgggtagctgtaaggcatgaag

SEQ ID NO: 6530863 - DNA, 21 bp, Homo sapiens
tgggtagcttctgacctcagc

SEQ ID NO: 6530864 - DNA, 16 bp, Homo sapiens
tgggtaggccccacaa

SEQ ID NO: 6530865 - DNA, 15 bp, Homo sapiens
tgggtagggcagaca

SEQ ID NO: 6530866 - DNA, 20 bp, Homo sapiens
tgggtagggtgttctggctt

SEQ ID NO: 6530867 - DNA, 24 bp, Homo sapiens
tgggtagtgaattggcttccttga

SEQ ID NO: 6530868 - DNA, 21 bp, Homo sapiens
tgggtagtgagcagtgagcag

SEQ ID NO: 6530869 - DNA, 16 bp, Homo sapiens
tgggtagtgccatggc

SEQ ID NO: 6530870 - DNA, 18 bp, Homo sapiens
tgggtagtgccatggcca

SEQ ID NO: 6530871 - DNA, 21 bp, Homo sapiens
tgggtagtgccatggccagga

SEQ ID NO: 6530872 - DNA, 22 bp, Homo sapiens
tgggtagtgccatggccaggag

SEQ ID NO: 6530873 - DNA, 14 bp, Homo sapiens
tgggtagtgcttta

SEQ ID NO: 6530874 - DNA, 15 bp, Homo sapiens
tgggtataaaagatg

SEQ ID NO: 6530875 - DNA, 17 bp, Homo sapiens
tgggtataaaagatggg

SEQ ID NO: 6530876 - DNA, 16 bp, Homo sapiens
tgggtatattgataaa

SEQ ID NO: 6530877 - DNA, 19 bp, Homo sapiens
tgggtatattgataaattt

SEQ ID NO: 6530878 - DNA, 20 bp, Homo sapiens
tgggtatattgataaatttt

SEQ ID NO: 6530879 - DNA, 17 bp, Homo sapiens
tgggtatcaaacagctc

SEQ ID NO: 6530880 - DNA, 18 bp, Homo sapiens
tgggtatcaagacatagc

SEQ ID NO: 6530881 - DNA, 12 bp, Homo sapiens
tgggtatcccac

SEQ ID NO: 6530882 - DNA, 15 bp, Homo sapiens
tgggtatcccacctc

SEQ ID NO: 6530883 - DNA, 16 bp, Homo sapiens
tgggtatcccctgcct

SEQ ID NO: 6530884 - DNA, 19 bp, Homo sapiens
tgggtatcccctgcctcct

SEQ ID NO: 6530885 - DNA, 19 bp, Homo sapiens
tgggtatcctgcccagtgt

SEQ ID NO: 6530886 - DNA, 20 bp, Homo sapiens
tgggtatcctgcccagtgtt

SEQ ID NO: 6530887 - DNA, 23 bp, Homo sapiens
tgggtatctcaaatctgctttca

SEQ ID NO: 6530888 - DNA, 15 bp, Homo sapiens
tgggtatgctcaggt

SEQ ID NO: 6530889 - DNA, 14 bp, Homo sapiens
tgggtatgtgtagg

SEQ ID NO: 6530890 - DNA, 13 bp, Homo sapiens
tgggtatgtgttg

SEQ ID NO: 6530891 - DNA, 19 bp, Homo sapiens
tgggtatgtgttgccaaag

SEQ ID NO: 6530892 - DNA, 15 bp, Homo sapiens
tgggtatgttcctaa

SEQ ID NO: 6530893 - DNA, 16 bp, Homo sapiens
tgggtatgttcctaag

SEQ ID NO: 6530894 - DNA, 14 bp, Homo sapiens
tgggtattaccatg

SEQ ID NO: 6530895 - DNA, 17 bp, Homo sapiens
tgggtattaccatgtaa

SEQ ID NO: 6530896 - DNA, 21 bp, Homo sapiens
tgggtattaccatgtaaataa

SEQ ID NO: 6530897 - DNA, 15 bp, Homo sapiens
tgggtatttcctgct

SEQ ID NO: 6530898 - DNA, 18 bp, Homo sapiens
tgggtattttgtcagttt

SEQ ID NO: 6530899 - DNA, 23 bp, Homo sapiens
tgggtatttttataacaatataa

SEQ ID NO: 6530900 - DNA, 21 bp, Homo sapiens
tgggtcaaaagagccctggct

SEQ ID NO: 6530901 - DNA, 22 bp, Homo sapiens
tgggtcaaaagagccctggctc

SEQ ID NO: 6530902 - DNA, 23 bp, Homo sapiens
tgggtcaaaagagccctggctct

SEQ ID NO: 6530903 - DNA, 23 bp, Homo sapiens
tgggtcaactccaaggcaaatgt

SEQ ID NO: 6530904 - DNA, 16 bp, Homo sapiens
tgggtcaaggacaggg

SEQ ID NO: 6530905 - DNA, 14 bp, Homo sapiens
tgggtcacacacac

SEQ ID NO: 6530906 - DNA, 21 bp, Homo sapiens
tgggtcacacctgacaaatgg

SEQ ID NO: 6530907 - DNA, 22 bp, Homo sapiens
tgggtcacacctgacaaatgga

SEQ ID NO: 6530908 - DNA, 12 bp, Homo sapiens
tgggtcacagga

SEQ ID NO: 6530909 - DNA, 13 bp, Homo sapiens
tgggtcacaggaa

SEQ ID NO: 6530910 - DNA, 15 bp, Homo sapiens
tgggtcacaggaagg

SEQ ID NO: 6530911 - DNA, 18 bp, Homo sapiens
tgggtcacaggaaggaaa

SEQ ID NO: 6530912 - DNA, 21 bp, Homo sapiens
tgggtcaccagacggggctgg

SEQ ID NO: 6530913 - DNA, 17 bp, Homo sapiens
tgggtcaccttcctggg

SEQ ID NO: 6530914 - DNA, 17 bp, Homo sapiens
tgggtcacgctcaagga

SEQ ID NO: 6530915 - DNA, 15 bp, Homo sapiens
tgggtcactcattaa

SEQ ID NO: 6530916 - DNA, 18 bp, Homo sapiens
tgggtcagaacatgttaa

SEQ ID NO: 6530917 - DNA, 19 bp, Homo sapiens
tgggtcagaacatgttaag

SEQ ID NO: 6530918 - DNA, 19 bp, Homo sapiens
tgggtcagaaccctgccat

SEQ ID NO: 6530919 - DNA, 20 bp, Homo sapiens
tgggtcagacccatctctcc

SEQ ID NO: 6530920 - DNA, 19 bp, Homo sapiens
tgggtcagatttatttgtt

SEQ ID NO: 6530921 - DNA, 14 bp, Homo sapiens
tgggtcagcccagc

SEQ ID NO: 6530922 - DNA, 21 bp, Homo sapiens
tgggtcagcccagcacctgct

SEQ ID NO: 6530923 - DNA, 17 bp, Homo sapiens
tgggtcagggtgtgagg

SEQ ID NO: 6530924 - DNA, 23 bp, Homo sapiens
tgggtcagggtgtgaggccacac

SEQ ID NO: 6530925 - DNA, 17 bp, Homo sapiens
tgggtcaggttcttgcc

SEQ ID NO: 6530926 - DNA, 18 bp, Homo sapiens
tgggtcaggttcttgcct

SEQ ID NO: 6530927 - DNA, 12 bp, Homo sapiens
tgggtcagtctg

SEQ ID NO: 6530928 - DNA, 22 bp, Homo sapiens
tgggtcatcccagcacctgcca

SEQ ID NO: 6530929 - DNA, 20 bp, Homo sapiens
tgggtcattacttctgagcc

SEQ ID NO: 6530930 - DNA, 17 bp, Homo sapiens
tgggtcatttagaagcc

SEQ ID NO: 6530931 - DNA, 14 bp, Homo sapiens
tgggtccaagtggc

SEQ ID NO: 6530932 - DNA, 19 bp, Homo sapiens
tgggtccaggaaggcagct

SEQ ID NO: 6530933 - DNA, 20 bp, Homo sapiens
tgggtccaggaaggcagctg

SEQ ID NO: 6530934 - DNA, 13 bp, Homo sapiens
tgggtccaggaga

SEQ ID NO: 6530935 - DNA, 14 bp, Homo sapiens
tgggtccaggagat

SEQ ID NO: 6530936 - DNA, 20 bp, Homo sapiens
tgggtccaggattcctcttt

SEQ ID NO: 6530937 - DNA, 18 bp, Homo sapiens
tgggtccaggcctggcca

SEQ ID NO: 6530938 - DNA, 21 bp, Homo sapiens
tgggtccaggggatgggaggt

SEQ ID NO: 6530939 - DNA, 18 bp, Homo sapiens
tgggtccaggggcccctc

SEQ ID NO: 6530940 - DNA, 15 bp, Homo sapiens
tgggtccatcctggt

SEQ ID NO: 6530941 - DNA, 14 bp, Homo sapiens
tgggtccatgggca

SEQ ID NO: 6530942 - DNA, 17 bp, Homo sapiens
tgggtccatgggcagag

SEQ ID NO: 6530943 - DNA, 18 bp, Homo sapiens
tgggtccatgggcagagc

SEQ ID NO: 6530944 - DNA, 19 bp, Homo sapiens
tgggtcccacttcccctcc

SEQ ID NO: 6530945 - DNA, 20 bp, Homo sapiens
tgggtcccacttcccctcct

SEQ ID NO: 6530946 - DNA, 18 bp, Homo sapiens
tgggtcccagagacctca

SEQ ID NO: 6530947 - DNA, 17 bp, Homo sapiens
tgggtcccagggctggc

SEQ ID NO: 6530948 - DNA, 16 bp, Homo sapiens
tgggtccccagccctt

SEQ ID NO: 6530949 - DNA, 19 bp, Homo sapiens
tgggtccccagcccttcct

SEQ ID NO: 6530950 - DNA, 17 bp, Homo sapiens
tgggtcccccacgtgac

SEQ ID NO: 6530951 - DNA, 22 bp, Homo sapiens
tgggtccccctcagcaagccct

SEQ ID NO: 6530952 - DNA, 14 bp, Homo sapiens
tgggtccccctcct

SEQ ID NO: 6530953 - DNA, 16 bp, Homo sapiens
tgggtccccctcctgc

SEQ ID NO: 6530954 - DNA, 18 bp, Homo sapiens
tgggtccccctcctgcac

SEQ ID NO: 6530955 - DNA, 12 bp, Homo sapiens
tgggtcccctcc

SEQ ID NO: 6530956 - DNA, 12 bp, Homo sapiens
tgggtccctgcg

SEQ ID NO: 6530957 - DNA, 12 bp, Homo sapiens
tgggtccctgct

SEQ ID NO: 6530958 - DNA, 17 bp, Homo sapiens
tgggtccctgctcccct

SEQ ID NO: 6530959 - DNA, 18 bp, Homo sapiens
tgggtccgataatatctt

SEQ ID NO: 6530960 - DNA, 18 bp, Homo sapiens
tgggtcctactcctggag

SEQ ID NO: 6530961 - DNA, 13 bp, Homo sapiens
tgggtcctagccc

SEQ ID NO: 6530962 - DNA, 19 bp, Homo sapiens
tgggtcctagcccttccct

SEQ ID NO: 6530963 - DNA, 21 bp, Homo sapiens
tgggtcctagcccttccctga

SEQ ID NO: 6530964 - DNA, 13 bp, Homo sapiens
tgggtcctccaaa

SEQ ID NO: 6530965 - DNA, 14 bp, Homo sapiens
tgggtcctcccagc

SEQ ID NO: 6530966 - DNA, 16 bp, Homo sapiens
tgggtcctcccagctg

SEQ ID NO: 6530967 - DNA, 20 bp, Homo sapiens
tgggtcctcctttctgaggg

SEQ ID NO: 6530968 - DNA, 17 bp, Homo sapiens
tgggtcctcggccctgt

SEQ ID NO: 6530969 - DNA, 23 bp, Homo sapiens
tgggtcctcgggcccctgagcct

SEQ ID NO: 6530970 - DNA, 23 bp, Homo sapiens
tgggtcctgaagtgacctcactg

SEQ ID NO: 6530971 - DNA, 22 bp, Homo sapiens
tgggtcctgcaatctccagggc

SEQ ID NO: 6530972 - DNA, 23 bp, Homo sapiens
tgggtcctgcaatctccagggct

SEQ ID NO: 6530973 - DNA, 12 bp, Homo sapiens
tgggtcctgcca

SEQ ID NO: 6530974 - DNA, 11 bp, Homo sapiens
tgggtcctgct

SEQ ID NO: 6530975 - DNA, 13 bp, Homo sapiens
tgggtcctgctgc

SEQ ID NO: 6530976 - DNA, 14 bp, Homo sapiens
tgggtcctgctgct

SEQ ID NO: 6530977 - DNA, 11 bp, Homo sapiens
tgggtcctggg

SEQ ID NO: 6530978 - DNA, 18 bp, Homo sapiens
tgggtcctgggcaggtgg

SEQ ID NO: 6530979 - DNA, 13 bp, Homo sapiens
tgggtcctggggt

SEQ ID NO: 6530980 - DNA, 17 bp, Homo sapiens
tgggtccttgatgccag

SEQ ID NO: 6530981 - DNA, 19 bp, Homo sapiens
tgggtccttgatgccagag

SEQ ID NO: 6530982 - DNA, 22 bp, Homo sapiens
tgggtccttgatgccagagggc

SEQ ID NO: 6530983 - DNA, 15 bp, Homo sapiens
tgggtccttgggcct

SEQ ID NO: 6530984 - DNA, 14 bp, Homo sapiens
tgggtcgcccctcc

SEQ ID NO: 6530985 - DNA, 21 bp, Homo sapiens
tgggtcgccctggactgtgtg

SEQ ID NO: 6530986 - DNA, 16 bp, Homo sapiens
tgggtcggccctgccc

SEQ ID NO: 6530987 - DNA, 17 bp, Homo sapiens
tgggtcgggagagggga

SEQ ID NO: 6530988 - DNA, 15 bp, Homo sapiens
tgggtctattccagc

SEQ ID NO: 6530989 - DNA, 20 bp, Homo sapiens
tgggtctattccagctcatt

SEQ ID NO: 6530990 - DNA, 22 bp, Homo sapiens
tgggtctcaatccttaacatat

SEQ ID NO: 6530991 - DNA, 23 bp, Homo sapiens
tgggtctcaccggctctcacctg

SEQ ID NO: 6530992 - DNA, 13 bp, Homo sapiens
tgggtctcactcc

SEQ ID NO: 6530993 - DNA, 15 bp, Homo sapiens
tgggtctcagtgtcc

SEQ ID NO: 6530994 - DNA, 13 bp, Homo sapiens
tgggtctctgggg

SEQ ID NO: 6530995 - DNA, 15 bp, Homo sapiens
tgggtctgaaaggaa

SEQ ID NO: 6530996 - DNA, 18 bp, Homo sapiens
tgggtctgaaaggaaaag

SEQ ID NO: 6530997 - DNA, 17 bp, Homo sapiens
tgggtctgattttctca

SEQ ID NO: 6530998 - DNA, 18 bp, Homo sapiens
tgggtctgcacagattct

SEQ ID NO: 6530999 - DNA, 13 bp, Homo sapiens
tgggtctgccctg

SEQ ID NO: 6531000 - DNA, 17 bp, Homo sapiens
tgggtctgccctgccca

SEQ ID NO: 6531001 - DNA, 15 bp, Homo sapiens
ttcatctgaggagtc

SEQ ID NO: 6531002 - DNA, 14 bp, Homo sapiens
ttcatctgcaaagg

SEQ ID NO: 6531003 - DNA, 12 bp, Homo sapiens
ttcatctgctac

SEQ ID NO: 6531004 - DNA, 15 bp, Homo sapiens
ttcatctgctctcct

SEQ ID NO: 6531005 - DNA, 16 bp, Homo sapiens
ttcatctgctctcctt

SEQ ID NO: 6531006 - DNA, 19 bp, Homo sapiens
ttcatctgctctccttcct

SEQ ID NO: 6531007 - DNA, 17 bp, Homo sapiens
ttcatctggaaccatca

SEQ ID NO: 6531008 - DNA, 13 bp, Homo sapiens
ttcatctggaggc

SEQ ID NO: 6531009 - DNA, 18 bp, Homo sapiens
ttcatctggaggctgcgt

SEQ ID NO: 6531010 - DNA, 22 bp, Homo sapiens
ttcatctggagtccctcctccc

SEQ ID NO: 6531011 - DNA, 16 bp, Homo sapiens
ttcatctggggatgac

SEQ ID NO: 6531012 - DNA, 17 bp, Homo sapiens
ttcatctggggtggggt

SEQ ID NO: 6531013 - DNA, 11 bp, Homo sapiens
ttcatctggtt

SEQ ID NO: 6531014 - DNA, 21 bp, Homo sapiens
ttcatctggttgaatggcttt

SEQ ID NO: 6531015 - DNA, 13 bp, Homo sapiens
ttcatctgtaact

SEQ ID NO: 6531016 - DNA, 19 bp, Homo sapiens
ttcatctgtaactctaaaa

SEQ ID NO: 6531017 - DNA, 21 bp, Homo sapiens
ttcatctgtaactctaaaaga

SEQ ID NO: 6531018 - DNA, 14 bp, Homo sapiens
ttcatctgttgaca

SEQ ID NO: 6531019 - DNA, 17 bp, Homo sapiens
ttcatctgttgttctgt

SEQ ID NO: 6531020 - DNA, 13 bp, Homo sapiens
ttcatcttaaact

SEQ ID NO: 6531021 - DNA, 13 bp, Homo sapiens
ttcatcttcctgt

SEQ ID NO: 6531022 - DNA, 14 bp, Homo sapiens
ttcatcttctggaa

SEQ ID NO: 6531023 - DNA, 12 bp, Homo sapiens
ttcatcttgaat

SEQ ID NO: 6531024 - DNA, 21 bp, Homo sapiens
ttcatcttgaattgtaaggaa

SEQ ID NO: 6531025 - DNA, 18 bp, Homo sapiens
ttcatcttgagcctgagc

SEQ ID NO: 6531026 - DNA, 18 bp, Homo sapiens
ttcatcttgcagcattta

SEQ ID NO: 6531027 - DNA, 21 bp, Homo sapiens
ttcatcttgcagcatttacta

SEQ ID NO: 6531028 - DNA, 22 bp, Homo sapiens
ttcatcttgcagcatttactat

SEQ ID NO: 6531029 - DNA, 22 bp, Homo sapiens
ttcatcttgtacaaactttgtt

SEQ ID NO: 6531030 - DNA, 16 bp, Homo sapiens
ttcatctttcagaaat

SEQ ID NO: 6531031 - DNA, 14 bp, Homo sapiens
ttcatctttccaaa

SEQ ID NO: 6531032 - DNA, 16 bp, Homo sapiens
ttcatctttccaaatt

SEQ ID NO: 6531033 - DNA, 16 bp, Homo sapiens
ttcatcttttaaagaa

SEQ ID NO: 6531034 - DNA, 15 bp, Homo sapiens
ttcatcttttaatca

SEQ ID NO: 6531035 - DNA, 21 bp, Homo sapiens
ttcatcttttattttggaact

SEQ ID NO: 6531036 - DNA, 16 bp, Homo sapiens
ttcatcttttgtatag

SEQ ID NO: 6531037 - DNA, 18 bp, Homo sapiens
ttcatgaaaactttttaa

SEQ ID NO: 6531038 - DNA, 17 bp, Homo sapiens
ttcatgaaaataccatt

SEQ ID NO: 6531039 - DNA, 17 bp, Homo sapiens
ttcatgaaaatcctacc

SEQ ID NO: 6531040 - DNA, 14 bp, Homo sapiens
ttcatgaaaatgta

SEQ ID NO: 6531041 - DNA, 17 bp, Homo sapiens
ttcatgaaagattcaat

SEQ ID NO: 6531042 - DNA, 15 bp, Homo sapiens
ttcatgaaatgctat

SEQ ID NO: 6531043 - DNA, 22 bp, Homo sapiens
ttcatgaaatgctatgtcattt

SEQ ID NO: 6531044 - DNA, 22 bp, Homo sapiens
ttcatgaacttcgcatcaaaag

SEQ ID NO: 6531045 - DNA, 21 bp, Homo sapiens
ttcatgaaggtcctagcttta

SEQ ID NO: 6531046 - DNA, 23 bp, Homo sapiens
ttcatgaagtgaattaatgatga

SEQ ID NO: 6531047 - DNA, 21 bp, Homo sapiens
ttcatgaatattttcaagttt

SEQ ID NO: 6531048 - DNA, 20 bp, Homo sapiens
ttcatgaatctttcatacat

SEQ ID NO: 6531049 - DNA, 21 bp, Homo sapiens
ttcatgaatgtgctggtgaac

SEQ ID NO: 6531050 - DNA, 22 bp, Homo sapiens
ttcatgaattagaagaaaatgg

SEQ ID NO: 6531051 - DNA, 12 bp, Homo sapiens
ttcatgacagaa

SEQ ID NO: 6531052 - DNA, 19 bp, Homo sapiens
ttcatgacagaatatacac

SEQ ID NO: 6531053 - DNA, 15 bp, Homo sapiens
ttcatgacagcctcc

SEQ ID NO: 6531054 - DNA, 16 bp, Homo sapiens
ttcatgacagcctcca

SEQ ID NO: 6531055 - DNA, 16 bp, Homo sapiens
ttcatgaccagtaaag

SEQ ID NO: 6531056 - DNA, 23 bp, Homo sapiens
ttcatgagctactcatgactgaa

SEQ ID NO: 6531057 - DNA, 18 bp, Homo sapiens
ttcatgataatgaacaga

SEQ ID NO: 6531058 - DNA, 14 bp, Homo sapiens
ttcatgatagaaag

SEQ ID NO: 6531059 - DNA, 16 bp, Homo sapiens
ttcatgatagaaagaa

SEQ ID NO: 6531060 - DNA, 22 bp, Homo sapiens
ttcatgatagaaagaataaaat

SEQ ID NO: 6531061 - DNA, 12 bp, Homo sapiens
ttcatgatgcag

SEQ ID NO: 6531062 - DNA, 17 bp, Homo sapiens
ttcatgatgcagtctcc

SEQ ID NO: 6531063 - DNA, 15 bp, Homo sapiens
ttcatgattagaaat

SEQ ID NO: 6531064 - DNA, 23 bp, Homo sapiens
ttcatgattagaaattacctgtg

SEQ ID NO: 6531065 - DNA, 18 bp, Homo sapiens
ttcatgattagacaatgt

SEQ ID NO: 6531066 - DNA, 16 bp, Homo sapiens
ttcatgatttcaagat

SEQ ID NO: 6531067 - DNA, 17 bp, Homo sapiens
ttcatgatttcatttca

SEQ ID NO: 6531068 - DNA, 15 bp, Homo sapiens
ttcatgcaagagttt

SEQ ID NO: 6531069 - DNA, 20 bp, Homo sapiens
ttcatgcaaggggaaaatct

SEQ ID NO: 6531070 - DNA, 14 bp, Homo sapiens
ttcatgcaatgaca

SEQ ID NO: 6531071 - DNA, 18 bp, Homo sapiens
ttcatgcacagtagattc

SEQ ID NO: 6531072 - DNA, 19 bp, Homo sapiens
ttcatgcacttaaagaagt

SEQ ID NO: 6531073 - DNA, 14 bp, Homo sapiens
ttcatgcagctgtg

SEQ ID NO: 6531074 - DNA, 15 bp, Homo sapiens
ttcatgcagctgtgg

SEQ ID NO: 6531075 - DNA, 14 bp, Homo sapiens
ttcatgcagtgctc

SEQ ID NO: 6531076 - DNA, 20 bp, Homo sapiens
ttcatgcattctagtgcaga

SEQ ID NO: 6531077 - DNA, 21 bp, Homo sapiens
ttcatgcattctagtgcagaa

SEQ ID NO: 6531078 - DNA, 22 bp, Homo sapiens
ttcatgcattctagtgcagaag

SEQ ID NO: 6531079 - DNA, 21 bp, Homo sapiens
ttcatgccagctacttcctcc

SEQ ID NO: 6531080 - DNA, 18 bp, Homo sapiens
ttcatgccagtgcatgcc

SEQ ID NO: 6531081 - DNA, 18 bp, Homo sapiens
ttcatgccatctgttttc

SEQ ID NO: 6531082 - DNA, 18 bp, Homo sapiens
ttcatgccattctgcctc

SEQ ID NO: 6531083 - DNA, 13 bp, Homo sapiens
ttcatgccccggc

SEQ ID NO: 6531084 - DNA, 12 bp, Homo sapiens
ttcatgcctcag

SEQ ID NO: 6531085 - DNA, 17 bp, Homo sapiens
ttcatgcctcagtttcc

SEQ ID NO: 6531086 - DNA, 18 bp, Homo sapiens
ttcatgcctcagtttccc

SEQ ID NO: 6531087 - DNA, 10 bp, Homo sapiens
ttcatgcctg

SEQ ID NO: 6531088 - DNA, 16 bp, Homo sapiens
ttcatgcctggcttcg

SEQ ID NO: 6531089 - DNA, 12 bp, Homo sapiens
ttcatgcctggg

SEQ ID NO: 6531090 - DNA, 20 bp, Homo sapiens
ttcatgcctggggtggaggc

SEQ ID NO: 6531091 - DNA, 15 bp, Homo sapiens
ttcatgcctttcata

SEQ ID NO: 6531092 - DNA, 19 bp, Homo sapiens
ttcatgcctttcatagttt

SEQ ID NO: 6531093 - DNA, 14 bp, Homo sapiens
ttcatgcctttgta

SEQ ID NO: 6531094 - DNA, 15 bp, Homo sapiens
ttcatgcctttgtaa

SEQ ID NO: 6531095 - DNA, 23 bp, Homo sapiens
ttcatgcgatgacacttgtacaa

SEQ ID NO: 6531096 - DNA, 19 bp, Homo sapiens
ttcatgcgcagtccccagg

SEQ ID NO: 6531097 - DNA, 15 bp, Homo sapiens
ttcatgctatcagaa

SEQ ID NO: 6531098 - DNA, 23 bp, Homo sapiens
ttcatgctccaagactttagtta

SEQ ID NO: 6531099 - DNA, 14 bp, Homo sapiens
ttcatgctctgcaa

SEQ ID NO: 6531100 - DNA, 15 bp, Homo sapiens
ttcatgctctgcaaa

SEQ ID NO: 6531101 - DNA, 18 bp, Homo sapiens
ttcatgctgagcaaagtt

SEQ ID NO: 6531102 - DNA, 14 bp, Homo sapiens
ttcatgctttatca

SEQ ID NO: 6531103 - DNA, 16 bp, Homo sapiens
ttcatgctttctcctt

SEQ ID NO: 6531104 - DNA, 13 bp, Homo sapiens
ttcatgcttttct

SEQ ID NO: 6531105 - DNA, 17 bp, Homo sapiens
ttcatgcttttctcatg

SEQ ID NO: 6531106 - DNA, 19 bp, Homo sapiens
ttcatgcttttctcatggt

SEQ ID NO: 6531107 - DNA, 22 bp, Homo sapiens
ttcatggaatggacatcctgta

SEQ ID NO: 6531108 - DNA, 22 bp, Homo sapiens
ttcatggaattggtttaaactt

SEQ ID NO: 6531109 - DNA, 14 bp, Homo sapiens
ttcatggacacttt

SEQ ID NO: 6531110 - DNA, 15 bp, Homo sapiens
ttcatggattattta

SEQ ID NO: 6531111 - DNA, 19 bp, Homo sapiens
ttcatggcaatgaaaattt

SEQ ID NO: 6531112 - DNA, 23 bp, Homo sapiens
ttcatggcacccgggaatgactt

SEQ ID NO: 6531113 - DNA, 17 bp, Homo sapiens
ttcatggcagtaattct

SEQ ID NO: 6531114 - DNA, 19 bp, Homo sapiens
ttcatggctacctcagaaa

SEQ ID NO: 6531115 - DNA, 19 bp, Homo sapiens
ttcatggctgctgttgctt

SEQ ID NO: 6531116 - DNA, 22 bp, Homo sapiens
ttcatggctgctgttgcttaaa

SEQ ID NO: 6531117 - DNA, 12 bp, Homo sapiens
ttcatgggtggt

SEQ ID NO: 6531118 - DNA, 22 bp, Homo sapiens
ttcatggtatcttgagtcttgg

SEQ ID NO: 6531119 - DNA, 14 bp, Homo sapiens
ttcatggtctagaa

SEQ ID NO: 6531120 - DNA, 15 bp, Homo sapiens
ttcatggtctctgca

SEQ ID NO: 6531121 - DNA, 19 bp, Homo sapiens
ttcatggtgaaaatgtact

SEQ ID NO: 6531122 - DNA, 15 bp, Homo sapiens
ttcatggttcaagta

SEQ ID NO: 6531123 - DNA, 17 bp, Homo sapiens
ttcatggttcaagtatt

SEQ ID NO: 6531124 - DNA, 19 bp, Homo sapiens
ttcatgtaaacaaaattta

SEQ ID NO: 6531125 - DNA, 19 bp, Homo sapiens
ttcatgtaaactgtgcacc

SEQ ID NO: 6531126 - DNA, 17 bp, Homo sapiens
ttcatgtaacagttgtg

SEQ ID NO: 6531127 - DNA, 18 bp, Homo sapiens
ttcatgtaacagttgtgt

SEQ ID NO: 6531128 - DNA, 13 bp, Homo sapiens
ttcatgtaataaa

SEQ ID NO: 6531129 - DNA, 16 bp, Homo sapiens
ttcatgtaataaatct

SEQ ID NO: 6531130 - DNA, 14 bp, Homo sapiens
ttcatgtaattatc

SEQ ID NO: 6531131 - DNA, 22 bp, Homo sapiens
ttcatgtacaaggcccctctgc

SEQ ID NO: 6531132 - DNA, 19 bp, Homo sapiens
ttcatgtactaccctcagt

SEQ ID NO: 6531133 - DNA, 15 bp, Homo sapiens
ttcatgtagaactca

SEQ ID NO: 6531134 - DNA, 14 bp, Homo sapiens
ttcatgtatttctt

SEQ ID NO: 6531135 - DNA, 15 bp, Homo sapiens
ttcatgtatttcttt

SEQ ID NO: 6531136 - DNA, 18 bp, Homo sapiens
ttcatgtatttctttaga

SEQ ID NO: 6531137 - DNA, 23 bp, Homo sapiens
ttcatgtatttctttagaacaac

SEQ ID NO: 6531138 - DNA, 14 bp, Homo sapiens
ttcatgtcatcaaa

SEQ ID NO: 6531139 - DNA, 17 bp, Homo sapiens
ttcatgtccagtgagca

SEQ ID NO: 6531140 - DNA, 22 bp, Homo sapiens
ttcatgtcccagaacttagcct

SEQ ID NO: 6531141 - DNA, 23 bp, Homo sapiens
ttcatgtcctaaagaagacattt

SEQ ID NO: 6531142 - DNA, 22 bp, Homo sapiens
ttcatgtcctgtgtcagtttat

SEQ ID NO: 6531143 - DNA, 14 bp, Homo sapiens
ttcatgtctattcc

SEQ ID NO: 6531144 - DNA, 17 bp, Homo sapiens
ttcatgtctattccatt

SEQ ID NO: 6531145 - DNA, 21 bp, Homo sapiens
ttcatgtctattccattccct

SEQ ID NO: 6531146 - DNA, 14 bp, Homo sapiens
ttcatgtctctgat

SEQ ID NO: 6531147 - DNA, 14 bp, Homo sapiens
ttcatgtgagaaag

SEQ ID NO: 6531148 - DNA, 16 bp, Homo sapiens
ttcatgtgcaaagtga

SEQ ID NO: 6531149 - DNA, 16 bp, Homo sapiens
ttcatgtgcctctgcg

SEQ ID NO: 6531150 - DNA, 17 bp, Homo sapiens
ttcatgtgcctctgcgg

SEQ ID NO: 6531151 - DNA, 23 bp, Homo sapiens
ttcatgtggcacttgggcattta

SEQ ID NO: 6531152 - DNA, 24 bp, Homo sapiens
ttcatgtggcagggagcagtacac

SEQ ID NO: 6531153 - DNA, 22 bp, Homo sapiens
ttcatgtggcattctctctgct

SEQ ID NO: 6531154 - DNA, 14 bp, Homo sapiens
ttcatgtggctgta

SEQ ID NO: 6531155 - DNA, 22 bp, Homo sapiens
ttcatgtgggatcccatctttt

SEQ ID NO: 6531156 - DNA, 20 bp, Homo sapiens
ttcatgtggtgaatatgcaa

SEQ ID NO: 6531157 - DNA, 18 bp, Homo sapiens
ttcatgtgtcccagaaga

SEQ ID NO: 6531158 - DNA, 17 bp, Homo sapiens
ttcatgtgttgcaaatt

SEQ ID NO: 6531159 - DNA, 22 bp, Homo sapiens
ttcatgtgttgcaaattattct

SEQ ID NO: 6531160 - DNA, 18 bp, Homo sapiens
ttcatgttagttacctta

SEQ ID NO: 6531161 - DNA, 22 bp, Homo sapiens
ttcatgttagttaccttatagt

SEQ ID NO: 6531162 - DNA, 14 bp, Homo sapiens
ttcatgttcatgtg

SEQ ID NO: 6531163 - DNA, 13 bp, Homo sapiens
ttcatgttctgtg

SEQ ID NO: 6531164 - DNA, 15 bp, Homo sapiens
ttcatgttctgtgtc

SEQ ID NO: 6531165 - DNA, 16 bp, Homo sapiens
ttcatgtttaagaaat

SEQ ID NO: 6531166 - DNA, 12 bp, Homo sapiens
ttcatgtttctt

SEQ ID NO: 6531167 - DNA, 14 bp, Homo sapiens
ttcatgtttgcttc

SEQ ID NO: 6531168 - DNA, 23 bp, Homo sapiens
ttcatgtttggaaaataatttct

SEQ ID NO: 6531169 - DNA, 22 bp, Homo sapiens
ttcatgtttggtgcatagaact

SEQ ID NO: 6531170 - DNA, 18 bp, Homo sapiens
ttcatgtttgtaaattaa

SEQ ID NO: 6531171 - DNA, 15 bp, Homo sapiens
ttcatgttttaacaa

SEQ ID NO: 6531172 - DNA, 16 bp, Homo sapiens
ttcatgttttgctaat

SEQ ID NO: 6531173 - DNA, 15 bp, Homo sapiens
ttcattaaaagctac

SEQ ID NO: 6531174 - DNA, 15 bp, Homo sapiens
ttcattaaaagtttt

SEQ ID NO: 6531175 - DNA, 10 bp, Homo sapiens
ttcattaaag

SEQ ID NO: 6531176 - DNA, 16 bp, Homo sapiens
ttcattaaagaaaaac

SEQ ID NO: 6531177 - DNA, 23 bp, Homo sapiens
ttcattaaaggcttctctctcac

SEQ ID NO: 6531178 - DNA, 15 bp, Homo sapiens
ttcattaagtaatct

SEQ ID NO: 6531179 - DNA, 15 bp, Homo sapiens
ttcattaatctgttt

SEQ ID NO: 6531180 - DNA, 21 bp, Homo sapiens
tgggtctggaggacctgcccg

SEQ ID NO: 6531181 - DNA, 17 bp, Homo sapiens
tgggtctggatgggagg

SEQ ID NO: 6531182 - DNA, 17 bp, Homo sapiens
tgggtctggccagggct

SEQ ID NO: 6531183 - DNA, 17 bp, Homo sapiens
tgggtctggctgagctg

SEQ ID NO: 6531184 - DNA, 24 bp, Homo sapiens
tgggtctgggatatggctgcccag

SEQ ID NO: 6531185 - DNA, 14 bp, Homo sapiens
tgggtctggggagg

SEQ ID NO: 6531186 - DNA, 15 bp, Homo sapiens
tgggtctgtcctctc

SEQ ID NO: 6531187 - DNA, 19 bp, Homo sapiens
tgggtctgtgtctcttttc

SEQ ID NO: 6531188 - DNA, 15 bp, Homo sapiens
tgggtctgtgtgtgt

SEQ ID NO: 6531189 - DNA, 19 bp, Homo sapiens
tgggtctgttttcctttct

SEQ ID NO: 6531190 - DNA, 13 bp, Homo sapiens
tgggtcttcagct

SEQ ID NO: 6531191 - DNA, 15 bp, Homo sapiens
tgggtcttcagcttt

SEQ ID NO: 6531192 - DNA, 14 bp, Homo sapiens
tgggtcttccaggg

SEQ ID NO: 6531193 - DNA, 22 bp, Homo sapiens
tgggtcttcttttactggactg

SEQ ID NO: 6531194 - DNA, 20 bp, Homo sapiens
tgggtcttgccatgtgctgg

SEQ ID NO: 6531195 - DNA, 17 bp, Homo sapiens
tgggtctttaataaaac

SEQ ID NO: 6531196 - DNA, 13 bp, Homo sapiens
tgggtcttttata

SEQ ID NO: 6531197 - DNA, 16 bp, Homo sapiens
tgggtgaaaccacatg

SEQ ID NO: 6531198 - DNA, 20 bp, Homo sapiens
tgggtgaaagaaatcatgtt

SEQ ID NO: 6531199 - DNA, 15 bp, Homo sapiens
tgggtgaaggctggc

SEQ ID NO: 6531200 - DNA, 15 bp, Homo sapiens
tgggtgaagggagag

SEQ ID NO: 6531201 - DNA, 21 bp, Homo sapiens
tgggtgaatatggtggaaaat

SEQ ID NO: 6531202 - DNA, 15 bp, Homo sapiens
tgggtgaatgtgtga

SEQ ID NO: 6531203 - DNA, 17 bp, Homo sapiens
tgggtgacacctccgag

SEQ ID NO: 6531204 - DNA, 18 bp, Homo sapiens
tgggtgacagagcaagac

SEQ ID NO: 6531205 - DNA, 23 bp, Homo sapiens
tgggtgaccagttgcacttggcc

SEQ ID NO: 6531206 - DNA, 23 bp, Homo sapiens
tgggtgacggtcctttaggcagc

SEQ ID NO: 6531207 - DNA, 19 bp, Homo sapiens
tgggtgactagaacaactt

SEQ ID NO: 6531208 - DNA, 17 bp, Homo sapiens
tgggtgagaaattttag

SEQ ID NO: 6531209 - DNA, 19 bp, Homo sapiens
tgggtgagaaattttagtt

SEQ ID NO: 6531210 - DNA, 18 bp, Homo sapiens
tgggtgagaatcctgcct

SEQ ID NO: 6531211 - DNA, 13 bp, Homo sapiens
tgggtgagagaga

SEQ ID NO: 6531212 - DNA, 15 bp, Homo sapiens
tgggtgagagaggaa

SEQ ID NO: 6531213 - DNA, 18 bp, Homo sapiens
tgggtgagcgggtggggt

SEQ ID NO: 6531214 - DNA, 22 bp, Homo sapiens
tgggtgaggatccctgaaggcc

SEQ ID NO: 6531215 - DNA, 19 bp, Homo sapiens
tgggtgaggctgggcaggg

SEQ ID NO: 6531216 - DNA, 15 bp, Homo sapiens
tgggtgagtttttct

SEQ ID NO: 6531217 - DNA, 20 bp, Homo sapiens
tgggtgatgcttttgctgct

SEQ ID NO: 6531218 - DNA, 23 bp, Homo sapiens
tgggtgatgcttttgctgctgct

SEQ ID NO: 6531219 - DNA, 20 bp, Homo sapiens
tgggtgatggaaactgccaa

SEQ ID NO: 6531220 - DNA, 22 bp, Homo sapiens
tgggtgatggaaactgccaaac

SEQ ID NO: 6531221 - DNA, 17 bp, Homo sapiens
tgggtgattatttttta

SEQ ID NO: 6531222 - DNA, 17 bp, Homo sapiens
tgggtgattcctcccag

SEQ ID NO: 6531223 - DNA, 18 bp, Homo sapiens
tgggtgattcctcccagg

SEQ ID NO: 6531224 - DNA, 14 bp, Homo sapiens
tgggtgcagaccct

SEQ ID NO: 6531225 - DNA, 17 bp, Homo sapiens
tgggtgcccaagctcag

SEQ ID NO: 6531226 - DNA, 13 bp, Homo sapiens
tgggtgccctgtt

SEQ ID NO: 6531227 - DNA, 21 bp, Homo sapiens
tgggtgccctttcctggcagt

SEQ ID NO: 6531228 - DNA, 23 bp, Homo sapiens
tgggtgcctaggcctgggcagtg

SEQ ID NO: 6531229 - DNA, 14 bp, Homo sapiens
tgggtgcctcctgc

SEQ ID NO: 6531230 - DNA, 18 bp, Homo sapiens
tgggtgcctgcagcgcct

SEQ ID NO: 6531231 - DNA, 16 bp, Homo sapiens
tgggtgcgaaggcaga

SEQ ID NO: 6531232 - DNA, 19 bp, Homo sapiens
tgggtgctcaccgcctgct

SEQ ID NO: 6531233 - DNA, 13 bp, Homo sapiens
tgggtgctcagaa

SEQ ID NO: 6531234 - DNA, 15 bp, Homo sapiens
tgggtgctcagaata

SEQ ID NO: 6531235 - DNA, 16 bp, Homo sapiens
tgggtgctcagggcat

SEQ ID NO: 6531236 - DNA, 21 bp, Homo sapiens
tgggtgctctggctggagagg

SEQ ID NO: 6531237 - DNA, 18 bp, Homo sapiens
tgggtgctgataattgtg

SEQ ID NO: 6531238 - DNA, 14 bp, Homo sapiens
tgggtgctgccctg

SEQ ID NO: 6531239 - DNA, 15 bp, Homo sapiens
tgggtgctggaggat

SEQ ID NO: 6531240 - DNA, 11 bp, Homo sapiens
tgggtgctggc

SEQ ID NO: 6531241 - DNA, 23 bp, Homo sapiens
tgggtgctgtcatgcccagcttg

SEQ ID NO: 6531242 - DNA, 20 bp, Homo sapiens
tgggtggaagtgcccagccc

SEQ ID NO: 6531243 - DNA, 14 bp, Homo sapiens
tgggtggagaagcc

SEQ ID NO: 6531244 - DNA, 15 bp, Homo sapiens
tgggtggagaaggga

SEQ ID NO: 6531245 - DNA, 14 bp, Homo sapiens
tgggtggagcagga

SEQ ID NO: 6531246 - DNA, 22 bp, Homo sapiens
tgggtggaggaccgttctctgt

SEQ ID NO: 6531247 - DNA, 24 bp, Homo sapiens
tgggtggaggaccgttctctgtcc

SEQ ID NO: 6531248 - DNA, 14 bp, Homo sapiens
tgggtggatgcctg

SEQ ID NO: 6531249 - DNA, 21 bp, Homo sapiens
tgggtggcaacatttggggag

SEQ ID NO: 6531250 - DNA, 17 bp, Homo sapiens
tgggtggcaccagcagc

SEQ ID NO: 6531251 - DNA, 20 bp, Homo sapiens
tgggtggcaccagcagcctg

SEQ ID NO: 6531252 - DNA, 14 bp, Homo sapiens
tgggtggcacctcc

SEQ ID NO: 6531253 - DNA, 16 bp, Homo sapiens
tgggtggcacctcctg

SEQ ID NO: 6531254 - DNA, 21 bp, Homo sapiens
tgggtggcccatcccccctca

SEQ ID NO: 6531255 - DNA, 17 bp, Homo sapiens
tgggtggctcactactg

SEQ ID NO: 6531256 - DNA, 23 bp, Homo sapiens
tgggtggctcactactgaacaca

SEQ ID NO: 6531257 - DNA, 14 bp, Homo sapiens
tgggtggctcctgc

SEQ ID NO: 6531258 - DNA, 16 bp, Homo sapiens
tgggtggctcctgcca

SEQ ID NO: 6531259 - DNA, 15 bp, Homo sapiens
tgggtggctttcaag

SEQ ID NO: 6531260 - DNA, 14 bp, Homo sapiens
tgggtgggacacag

SEQ ID NO: 6531261 - DNA, 14 bp, Homo sapiens
tgggtgggacagcc

SEQ ID NO: 6531262 - DNA, 23 bp, Homo sapiens
tgggtgggacagggcttctcctg

SEQ ID NO: 6531263 - DNA, 22 bp, Homo sapiens
tgggtgggaggggcccacagga

SEQ ID NO: 6531264 - DNA, 23 bp, Homo sapiens
tgggtgggagtgtgtctgctgag

SEQ ID NO: 6531265 - DNA, 18 bp, Homo sapiens
tgggtgggattttgcaaa

SEQ ID NO: 6531266 - DNA, 16 bp, Homo sapiens
tgggtgggcagggagg

SEQ ID NO: 6531267 - DNA, 18 bp, Homo sapiens
tgggtgggcagggagggg

SEQ ID NO: 6531268 - DNA, 20 bp, Homo sapiens
tgggtgggccccacagtggt

SEQ ID NO: 6531269 - DNA, 16 bp, Homo sapiens
tgggtgggcctgactg

SEQ ID NO: 6531270 - DNA, 19 bp, Homo sapiens
tgggtgggcctggccctgc

SEQ ID NO: 6531271 - DNA, 16 bp, Homo sapiens
tgggtgggctctgtgc

SEQ ID NO: 6531272 - DNA, 20 bp, Homo sapiens
tgggtggggaggaaatagaa

SEQ ID NO: 6531273 - DNA, 22 bp, Homo sapiens
tgggtggggaggccctgcctga

SEQ ID NO: 6531274 - DNA, 14 bp, Homo sapiens
tgggtggggaggga

SEQ ID NO: 6531275 - DNA, 21 bp, Homo sapiens
tgggtggggcagggcctggcc

SEQ ID NO: 6531276 - DNA, 17 bp, Homo sapiens
tgggtggggctcctggg

SEQ ID NO: 6531277 - DNA, 12 bp, Homo sapiens
tgggtggggctg

SEQ ID NO: 6531278 - DNA, 13 bp, Homo sapiens
tgggtggggcttc

SEQ ID NO: 6531279 - DNA, 14 bp, Homo sapiens
tgggtggggcttct

SEQ ID NO: 6531280 - DNA, 12 bp, Homo sapiens
tgggtgggggct

SEQ ID NO: 6531281 - DNA, 13 bp, Homo sapiens
tgggtgggggctg

SEQ ID NO: 6531282 - DNA, 15 bp, Homo sapiens
tgggtggggtgagga

SEQ ID NO: 6531283 - DNA, 20 bp, Homo sapiens
tgggtggggtgaggaccact

SEQ ID NO: 6531284 - DNA, 15 bp, Homo sapiens
tgggtgggtggtggg

SEQ ID NO: 6531285 - DNA, 16 bp, Homo sapiens
tgggtggtaagaggga

SEQ ID NO: 6531286 - DNA, 15 bp, Homo sapiens
tgggtggtacccagg

SEQ ID NO: 6531287 - DNA, 22 bp, Homo sapiens
tgggtggtaccctctggagggg

SEQ ID NO: 6531288 - DNA, 17 bp, Homo sapiens
tgggtggtttggttttt

SEQ ID NO: 6531289 - DNA, 14 bp, Homo sapiens
tgggtggtttgtga

SEQ ID NO: 6531290 - DNA, 21 bp, Homo sapiens
tgggtggtttgtgagccttgc

SEQ ID NO: 6531291 - DNA, 24 bp, Homo sapiens
tgggtggtttgtgagccttgctgc

SEQ ID NO: 6531292 - DNA, 15 bp, Homo sapiens
tgggtggtttttatt

SEQ ID NO: 6531293 - DNA, 15 bp, Homo sapiens
tgggtgtaaacacat

SEQ ID NO: 6531294 - DNA, 23 bp, Homo sapiens
tgggtgtaacaggtctcctctta

SEQ ID NO: 6531295 - DNA, 19 bp, Homo sapiens
tgggtgtaccacccatccc

SEQ ID NO: 6531296 - DNA, 17 bp, Homo sapiens
tgggtgtagatttctga

SEQ ID NO: 6531297 - DNA, 17 bp, Homo sapiens
tgggtgtatataatttt

SEQ ID NO: 6531298 - DNA, 20 bp, Homo sapiens
tgggtgtattaggactggct

SEQ ID NO: 6531299 - DNA, 16 bp, Homo sapiens
tgggtgtattctctgt

SEQ ID NO: 6531300 - DNA, 17 bp, Homo sapiens
tgggtgtattctctgta

SEQ ID NO: 6531301 - DNA, 21 bp, Homo sapiens
tgggtgtcaagagggtctgag

SEQ ID NO: 6531302 - DNA, 21 bp, Homo sapiens
tgggtgtcaagtgcctgcacc

SEQ ID NO: 6531303 - DNA, 14 bp, Homo sapiens
tgggtgtccatgtg

SEQ ID NO: 6531304 - DNA, 15 bp, Homo sapiens
tgggtgtccatgtgc

SEQ ID NO: 6531305 - DNA, 20 bp, Homo sapiens
tgggtgtccatgtgcacccg

SEQ ID NO: 6531306 - DNA, 17 bp, Homo sapiens
tgggtgtcctgcctgtc

SEQ ID NO: 6531307 - DNA, 15 bp, Homo sapiens
tgggtgtctccctcg

SEQ ID NO: 6531308 - DNA, 18 bp, Homo sapiens
tgggtgtgaagggatgag

SEQ ID NO: 6531309 - DNA, 22 bp, Homo sapiens
tgggtgtgagaatgatcaagga

SEQ ID NO: 6531310 - DNA, 13 bp, Homo sapiens
tgggtgtgccctg

SEQ ID NO: 6531311 - DNA, 16 bp, Homo sapiens
tgggtgtgccctggct

SEQ ID NO: 6531312 - DNA, 11 bp, Homo sapiens
tgggtgtggat

SEQ ID NO: 6531313 - DNA, 15 bp, Homo sapiens
tgggtgtggatggca

SEQ ID NO: 6531314 - DNA, 13 bp, Homo sapiens
tgggtgtggccag

SEQ ID NO: 6531315 - DNA, 23 bp, Homo sapiens
tgggtgtggccagcacaccaagt

SEQ ID NO: 6531316 - DNA, 15 bp, Homo sapiens
tgggtgtgggtggaa

SEQ ID NO: 6531317 - DNA, 14 bp, Homo sapiens
tgggtgtgtccagg

SEQ ID NO: 6531318 - DNA, 14 bp, Homo sapiens
tgggtgtgtgactc

SEQ ID NO: 6531319 - DNA, 16 bp, Homo sapiens
tgggtgtgtggcctcc

SEQ ID NO: 6531320 - DNA, 20 bp, Homo sapiens
tgggtgtgtttcaggacagc

SEQ ID NO: 6531321 - DNA, 22 bp, Homo sapiens
tgggtgttgaccactccagaga

SEQ ID NO: 6531322 - DNA, 14 bp, Homo sapiens
tgggtgttgctgtt

SEQ ID NO: 6531323 - DNA, 18 bp, Homo sapiens
tgggtgtttgggaaaggc

SEQ ID NO: 6531324 - DNA, 23 bp, Homo sapiens
tgggttaaacaaaatgaaaatat

SEQ ID NO: 6531325 - DNA, 24 bp, Homo sapiens
tgggttaaatattttgctaactgg

SEQ ID NO: 6531326 - DNA, 23 bp, Homo sapiens
tgggttaacagtaaatatacact

SEQ ID NO: 6531327 - DNA, 14 bp, Homo sapiens
tgggttaagtatta

SEQ ID NO: 6531328 - DNA, 17 bp, Homo sapiens
tgggttaattcatttgg

SEQ ID NO: 6531329 - DNA, 20 bp, Homo sapiens
tgggttagactgccagctct

SEQ ID NO: 6531330 - DNA, 23 bp, Homo sapiens
tgggttaggtggccgctcctccc

SEQ ID NO: 6531331 - DNA, 24 bp, Homo sapiens
tgggttaggtggccgctcctccct

SEQ ID NO: 6531332 - DNA, 20 bp, Homo sapiens
tgggttatcatggaagaaaa

SEQ ID NO: 6531333 - DNA, 20 bp, Homo sapiens
tgggttatttttattaaatg

SEQ ID NO: 6531334 - DNA, 16 bp, Homo sapiens
tgggttcaagagactc

SEQ ID NO: 6531335 - DNA, 22 bp, Homo sapiens
tgggttcacgtaatcctcctga

SEQ ID NO: 6531336 - DNA, 21 bp, Homo sapiens
tgggttcagaaccaagatgcc

SEQ ID NO: 6531337 - DNA, 24 bp, Homo sapiens
tgggttcaggggactcagccctga

SEQ ID NO: 6531338 - DNA, 19 bp, Homo sapiens
tgggttcatgatgcagtct

SEQ ID NO: 6531339 - DNA, 11 bp, Homo sapiens
tgggttcatta

SEQ ID NO: 6531340 - DNA, 18 bp, Homo sapiens
tgggttcattattggaat

SEQ ID NO: 6531341 - DNA, 16 bp, Homo sapiens
tgggttccaaaatatt

SEQ ID NO: 6531342 - DNA, 13 bp, Homo sapiens
tgggttccacaga

SEQ ID NO: 6531343 - DNA, 19 bp, Homo sapiens
tgggttccagacagagtgg

SEQ ID NO: 6531344 - DNA, 16 bp, Homo sapiens
tgggttccatcttgct

SEQ ID NO: 6531345 - DNA, 21 bp, Homo sapiens
tgggttcccacgtagcaaatc

SEQ ID NO: 6531346 - DNA, 14 bp, Homo sapiens
tgggttcccactcc

SEQ ID NO: 6531347 - DNA, 20 bp, Homo sapiens
tgggttccgggaggcagaga

SEQ ID NO: 6531348 - DNA, 13 bp, Homo sapiens
tgggttcctcttc

SEQ ID NO: 6531349 - DNA, 23 bp, Homo sapiens
tgggttcctttttcaacttggaa

SEQ ID NO: 6531350 - DNA, 17 bp, Homo sapiens
tgggttcgttggggaca

SEQ ID NO: 6531351 - DNA, 15 bp, Homo sapiens
tgggttctacccagg

SEQ ID NO: 6531352 - DNA, 17 bp, Homo sapiens
tgggttctgatattgcc

SEQ ID NO: 6531353 - DNA, 16 bp, Homo sapiens
tgggttctgcctgcca

SEQ ID NO: 6531354 - DNA, 14 bp, Homo sapiens
tgggttctgggtgg

SEQ ID NO: 6531355 - DNA, 19 bp, Homo sapiens
tgggttgaatatagcctgc

SEQ ID NO: 6531356 - DNA, 21 bp, Homo sapiens
tgggttgaatatagcctgcct

SEQ ID NO: 6531357 - DNA, 23 bp, Homo sapiens
tgggttgaatatagcctgcctca

SEQ ID NO: 6531358 - DNA, 20 bp, Homo sapiens
ttcattacaatggaaacaat

SEQ ID NO: 6531359 - DNA, 13 bp, Homo sapiens
ttcattacagctt

SEQ ID NO: 6531360 - DNA, 21 bp, Homo sapiens
ttcattaccttttttgataaa

SEQ ID NO: 6531361 - DNA, 16 bp, Homo sapiens
ttcattactgcccaga

SEQ ID NO: 6531362 - DNA, 15 bp, Homo sapiens
ttcattacttgaatg

SEQ ID NO: 6531363 - DNA, 16 bp, Homo sapiens
ttcattacttgaatgt

SEQ ID NO: 6531364 - DNA, 21 bp, Homo sapiens
ttcattacttgattaagattt

SEQ ID NO: 6531365 - DNA, 13 bp, Homo sapiens
ttcattagataca

SEQ ID NO: 6531366 - DNA, 18 bp, Homo sapiens
ttcattagcagttgctca

SEQ ID NO: 6531367 - DNA, 14 bp, Homo sapiens
ttcattaggcaaag

SEQ ID NO: 6531368 - DNA, 16 bp, Homo sapiens
ttcattagtcatgttt

SEQ ID NO: 6531369 - DNA, 23 bp, Homo sapiens
ttcattataatttgggtgactag

SEQ ID NO: 6531370 - DNA, 22 bp, Homo sapiens
ttcattatagacaacgatgaat

SEQ ID NO: 6531371 - DNA, 19 bp, Homo sapiens
ttcattatgcaacgtttaa

SEQ ID NO: 6531372 - DNA, 23 bp, Homo sapiens
ttcattatgcaacgtttaacatt

SEQ ID NO: 6531373 - DNA, 13 bp, Homo sapiens
ttcattatgcttt

SEQ ID NO: 6531374 - DNA, 16 bp, Homo sapiens
ttcattatgctttgaa

SEQ ID NO: 6531375 - DNA, 14 bp, Homo sapiens
ttcattatgtaaaa

SEQ ID NO: 6531376 - DNA, 13 bp, Homo sapiens
ttcattatgttca

SEQ ID NO: 6531377 - DNA, 15 bp, Homo sapiens
ttcattattcctcag

SEQ ID NO: 6531378 - DNA, 13 bp, Homo sapiens
ttcattattctca

SEQ ID NO: 6531379 - DNA, 20 bp, Homo sapiens
ttcattattctccacttttt

SEQ ID NO: 6531380 - DNA, 15 bp, Homo sapiens
ttcattattctctgc

SEQ ID NO: 6531381 - DNA, 13 bp, Homo sapiens
ttcattattggaa

SEQ ID NO: 6531382 - DNA, 16 bp, Homo sapiens
ttcattatttcaagga

SEQ ID NO: 6531383 - DNA, 20 bp, Homo sapiens
ttcattatttggaaatttag

SEQ ID NO: 6531384 - DNA, 15 bp, Homo sapiens
ttcattatttgtcaa

SEQ ID NO: 6531385 - DNA, 21 bp, Homo sapiens
ttcattatttgtcaaattgtc

SEQ ID NO: 6531386 - DNA, 17 bp, Homo sapiens
ttcattcaaatcagtga

SEQ ID NO: 6531387 - DNA, 16 bp, Homo sapiens
ttcattcaatagatac

SEQ ID NO: 6531388 - DNA, 17 bp, Homo sapiens
ttcattcaatattgaca

SEQ ID NO: 6531389 - DNA, 18 bp, Homo sapiens
ttcattcaatattgacat

SEQ ID NO: 6531390 - DNA, 21 bp, Homo sapiens
ttcattcaatattgacatttg

SEQ ID NO: 6531391 - DNA, 15 bp, Homo sapiens
ttcattcacttctct

SEQ ID NO: 6531392 - DNA, 16 bp, Homo sapiens
ttcattcatacttaaa

SEQ ID NO: 6531393 - DNA, 16 bp, Homo sapiens
ttcattcatatcctcc

SEQ ID NO: 6531394 - DNA, 18 bp, Homo sapiens
ttcattcatattacaata

SEQ ID NO: 6531395 - DNA, 23 bp, Homo sapiens
ttcattcatattacaatatttgt

SEQ ID NO: 6531396 - DNA, 18 bp, Homo sapiens
ttcattcatggaccactg

SEQ ID NO: 6531397 - DNA, 23 bp, Homo sapiens
ttcattcatggaccactgtttct

SEQ ID NO: 6531398 - DNA, 13 bp, Homo sapiens
ttcattcattcag

SEQ ID NO: 6531399 - DNA, 15 bp, Homo sapiens
ttcattcattggtga

SEQ ID NO: 6531400 - DNA, 13 bp, Homo sapiens
ttcattccatttg

SEQ ID NO: 6531401 - DNA, 15 bp, Homo sapiens
ttcattcccactgca

SEQ ID NO: 6531402 - DNA, 12 bp, Homo sapiens
ttcattcccaga

SEQ ID NO: 6531403 - DNA, 12 bp, Homo sapiens
ttcattccccag

SEQ ID NO: 6531404 - DNA, 15 bp, Homo sapiens
ttcattcccccttcc

SEQ ID NO: 6531405 - DNA, 15 bp, Homo sapiens
ttcattccctgtagt

SEQ ID NO: 6531406 - DNA, 20 bp, Homo sapiens
ttcattccgaaaaaaaaatg

SEQ ID NO: 6531407 - DNA, 16 bp, Homo sapiens
ttcattcctaaagaaa

SEQ ID NO: 6531408 - DNA, 18 bp, Homo sapiens
ttcattcctaacacagca

SEQ ID NO: 6531409 - DNA, 21 bp, Homo sapiens
ttcattccttcagatttggct

SEQ ID NO: 6531410 - DNA, 19 bp, Homo sapiens
ttcattcggtgtgaacttt

SEQ ID NO: 6531411 - DNA, 23 bp, Homo sapiens
ttcattcgtcttgttgttattga

SEQ ID NO: 6531412 - DNA, 16 bp, Homo sapiens
ttcattctaaaccaaa

SEQ ID NO: 6531413 - DNA, 13 bp, Homo sapiens
ttcattctaccaa

SEQ ID NO: 6531414 - DNA, 17 bp, Homo sapiens
ttcattctaccaagctg

SEQ ID NO: 6531415 - DNA, 21 bp, Homo sapiens
ttcattctaccaagctgtcac

SEQ ID NO: 6531416 - DNA, 22 bp, Homo sapiens
ttcattctcccgcttcctggcc

SEQ ID NO: 6531417 - DNA, 17 bp, Homo sapiens
ttcattctcctcctcct

SEQ ID NO: 6531418 - DNA, 23 bp, Homo sapiens
ttcattctcctcctcctccctcc

SEQ ID NO: 6531419 - DNA, 17 bp, Homo sapiens
ttcattctccttgttgt

SEQ ID NO: 6531420 - DNA, 14 bp, Homo sapiens
ttcattctctttta

SEQ ID NO: 6531421 - DNA, 21 bp, Homo sapiens
ttcattctgaaccctccaaag

SEQ ID NO: 6531422 - DNA, 12 bp, Homo sapiens
ttcattctgcat

SEQ ID NO: 6531423 - DNA, 15 bp, Homo sapiens
ttcattctgccaaag

SEQ ID NO: 6531424 - DNA, 18 bp, Homo sapiens
ttcattctggaggggcag

SEQ ID NO: 6531425 - DNA, 15 bp, Homo sapiens
ttcattctggtcatt

SEQ ID NO: 6531426 - DNA, 23 bp, Homo sapiens
ttcattctggtccttagtaaatt

SEQ ID NO: 6531427 - DNA, 12 bp, Homo sapiens
ttcattctgtga

SEQ ID NO: 6531428 - DNA, 17 bp, Homo sapiens
ttcattcttaacaagat

SEQ ID NO: 6531429 - DNA, 23 bp, Homo sapiens
ttcattcttaatttatgtaaggt

SEQ ID NO: 6531430 - DNA, 13 bp, Homo sapiens
ttcattcttagct

SEQ ID NO: 6531431 - DNA, 18 bp, Homo sapiens
ttcattcttaggctttca

SEQ ID NO: 6531432 - DNA, 14 bp, Homo sapiens
ttcattcttctcac

SEQ ID NO: 6531433 - DNA, 18 bp, Homo sapiens
ttcattcttctctagctg

SEQ ID NO: 6531434 - DNA, 13 bp, Homo sapiens
ttcattcttgaaa

SEQ ID NO: 6531435 - DNA, 13 bp, Homo sapiens
ttcattcttgtat

SEQ ID NO: 6531436 - DNA, 16 bp, Homo sapiens
ttcattctttatatat

SEQ ID NO: 6531437 - DNA, 20 bp, Homo sapiens
ttcattgacctcatcattaa

SEQ ID NO: 6531438 - DNA, 22 bp, Homo sapiens
ttcattgacctcatcattaata

SEQ ID NO: 6531439 - DNA, 20 bp, Homo sapiens
ttcattgaggataaattgcc

SEQ ID NO: 6531440 - DNA, 18 bp, Homo sapiens
ttcattgatatgaaaaat

SEQ ID NO: 6531441 - DNA, 20 bp, Homo sapiens
ttcattgatggatgtcttct

SEQ ID NO: 6531442 - DNA, 21 bp, Homo sapiens
ttcattgatttagtaagtgtt

SEQ ID NO: 6531443 - DNA, 16 bp, Homo sapiens
ttcattgcacaatata

SEQ ID NO: 6531444 - DNA, 13 bp, Homo sapiens
ttcattgcactgc

SEQ ID NO: 6531445 - DNA, 12 bp, Homo sapiens
ttcattgcactt

SEQ ID NO: 6531446 - DNA, 19 bp, Homo sapiens
ttcattgccagtgtctttc

SEQ ID NO: 6531447 - DNA, 20 bp, Homo sapiens
ttcattgcccccagggcact

SEQ ID NO: 6531448 - DNA, 17 bp, Homo sapiens
ttcattgcctttccagg

SEQ ID NO: 6531449 - DNA, 18 bp, Homo sapiens
ttcattgctcaacaagaa

SEQ ID NO: 6531450 - DNA, 21 bp, Homo sapiens
ttcattggatttttgttaatt

SEQ ID NO: 6531451 - DNA, 23 bp, Homo sapiens
ttcattggatttttgttaatttt

SEQ ID NO: 6531452 - DNA, 17 bp, Homo sapiens
ttcattgggaaaggaca

SEQ ID NO: 6531453 - DNA, 20 bp, Homo sapiens
ttcattgggaagattctcta

SEQ ID NO: 6531454 - DNA, 18 bp, Homo sapiens
ttcattggtgaagtaaat

SEQ ID NO: 6531455 - DNA, 17 bp, Homo sapiens
ttcattggttaattttt

SEQ ID NO: 6531456 - DNA, 13 bp, Homo sapiens
ttcattgtataaa

SEQ ID NO: 6531457 - DNA, 14 bp, Homo sapiens
ttcattgtatgatg

SEQ ID NO: 6531458 - DNA, 16 bp, Homo sapiens
ttcattgtctcagtga

SEQ ID NO: 6531459 - DNA, 17 bp, Homo sapiens
ttcattgtctcagtgaa

SEQ ID NO: 6531460 - DNA, 12 bp, Homo sapiens
ttcattgtggtt

SEQ ID NO: 6531461 - DNA, 21 bp, Homo sapiens
ttcattgtggttatttttata

SEQ ID NO: 6531462 - DNA, 12 bp, Homo sapiens
ttcattgttaaa

SEQ ID NO: 6531463 - DNA, 16 bp, Homo sapiens
ttcattgttttgcaaa

SEQ ID NO: 6531464 - DNA, 17 bp, Homo sapiens
ttcattgttttgcaaaa

SEQ ID NO: 6531465 - DNA, 13 bp, Homo sapiens
ttcatttaaaatg

SEQ ID NO: 6531466 - DNA, 15 bp, Homo sapiens
ttcatttaaaatgat

SEQ ID NO: 6531467 - DNA, 16 bp, Homo sapiens
ttcatttaaactaaat

SEQ ID NO: 6531468 - DNA, 17 bp, Homo sapiens
ttcatttaactctttga

SEQ ID NO: 6531469 - DNA, 19 bp, Homo sapiens
ttcatttacaatttcaaaa

SEQ ID NO: 6531470 - DNA, 16 bp, Homo sapiens
ttcatttactcaccat

SEQ ID NO: 6531471 - DNA, 19 bp, Homo sapiens
ttcatttactgtggcttct

SEQ ID NO: 6531472 - DNA, 21 bp, Homo sapiens
ttcatttagataatttgaaaa

SEQ ID NO: 6531473 - DNA, 16 bp, Homo sapiens
ttcatttatcaagcag

SEQ ID NO: 6531474 - DNA, 18 bp, Homo sapiens
ttcatttatctataattt

SEQ ID NO: 6531475 - DNA, 15 bp, Homo sapiens
ttcatttcaactgtt

SEQ ID NO: 6531476 - DNA, 14 bp, Homo sapiens
ttcatttcaatcat

SEQ ID NO: 6531477 - DNA, 16 bp, Homo sapiens
ttcatttcaatcattg

SEQ ID NO: 6531478 - DNA, 21 bp, Homo sapiens
ttcatttcacacagtgaaacg

SEQ ID NO: 6531479 - DNA, 15 bp, Homo sapiens
ttcatttcacatttt

SEQ ID NO: 6531480 - DNA, 13 bp, Homo sapiens
ttcatttcatcta

SEQ ID NO: 6531481 - DNA, 12 bp, Homo sapiens
ttcatttcattg

SEQ ID NO: 6531482 - DNA, 19 bp, Homo sapiens
ttcatttccaactcaggtt

SEQ ID NO: 6531483 - DNA, 13 bp, Homo sapiens
ttcatttcctgcc

SEQ ID NO: 6531484 - DNA, 14 bp, Homo sapiens
ttcatttcctgccc

SEQ ID NO: 6531485 - DNA, 23 bp, Homo sapiens
ttcatttctaacataagtaagac

SEQ ID NO: 6531486 - DNA, 15 bp, Homo sapiens
ttcatttctagactc

SEQ ID NO: 6531487 - DNA, 18 bp, Homo sapiens
ttcatttctatagccaaa

SEQ ID NO: 6531488 - DNA, 14 bp, Homo sapiens
ttcatttctgcaga

SEQ ID NO: 6531489 - DNA, 19 bp, Homo sapiens
ttcatttcttatcacataa

SEQ ID NO: 6531490 - DNA, 19 bp, Homo sapiens
ttcatttcttcctcagctg

SEQ ID NO: 6531491 - DNA, 21 bp, Homo sapiens
ttcatttcttcctcagctggt

SEQ ID NO: 6531492 - DNA, 20 bp, Homo sapiens
ttcatttgagttattttaat

SEQ ID NO: 6531493 - DNA, 16 bp, Homo sapiens
ttcatttgatgctaaa

SEQ ID NO: 6531494 - DNA, 14 bp, Homo sapiens
ttcatttgcaattc

SEQ ID NO: 6531495 - DNA, 19 bp, Homo sapiens
ttcatttgcaattcatgta

SEQ ID NO: 6531496 - DNA, 13 bp, Homo sapiens
ttcatttgctatc

SEQ ID NO: 6531497 - DNA, 19 bp, Homo sapiens
ttcatttgctgttcatctt

SEQ ID NO: 6531498 - DNA, 20 bp, Homo sapiens
ttcatttggtgttcctggaa

SEQ ID NO: 6531499 - DNA, 21 bp, Homo sapiens
ttcatttggtgttcctggaag

SEQ ID NO: 6531500 - DNA, 14 bp, Homo sapiens
ttcatttgtacaag

SEQ ID NO: 6531501 - DNA, 16 bp, Homo sapiens
ttcatttgttattctt

SEQ ID NO: 6531502 - DNA, 15 bp, Homo sapiens
ttcattttaaaaagt

SEQ ID NO: 6531503 - DNA, 15 bp, Homo sapiens
ttcattttaatttat

SEQ ID NO: 6531504 - DNA, 19 bp, Homo sapiens
ttcattttacagttacttt

SEQ ID NO: 6531505 - DNA, 19 bp, Homo sapiens
ttcattttaggaataataa

SEQ ID NO: 6531506 - DNA, 20 bp, Homo sapiens
ttcattttaggaataataaa

SEQ ID NO: 6531507 - DNA, 21 bp, Homo sapiens
ttcattttagtgtatctttaa

SEQ ID NO: 6531508 - DNA, 17 bp, Homo sapiens
ttcattttatatttaaa

SEQ ID NO: 6531509 - DNA, 14 bp, Homo sapiens
ttcattttcagagt

SEQ ID NO: 6531510 - DNA, 16 bp, Homo sapiens
ttcattttcatcactg

SEQ ID NO: 6531511 - DNA, 17 bp, Homo sapiens
ttcattttcatcactgg

SEQ ID NO: 6531512 - DNA, 13 bp, Homo sapiens
ttcattttccaat

SEQ ID NO: 6531513 - DNA, 12 bp, Homo sapiens
ttcattttcctg

SEQ ID NO: 6531514 - DNA, 15 bp, Homo sapiens
ttcattttcctgtgc

SEQ ID NO: 6531515 - DNA, 14 bp, Homo sapiens
ttcattttcctgtt

SEQ ID NO: 6531516 - DNA, 20 bp, Homo sapiens
ttcattttcctgttcagtga

SEQ ID NO: 6531517 - DNA, 12 bp, Homo sapiens
ttcattttctct

SEQ ID NO: 6531518 - DNA, 13 bp, Homo sapiens
ttcattttctctc

SEQ ID NO: 6531519 - DNA, 21 bp, Homo sapiens
ttcattttctgacatgcattg

SEQ ID NO: 6531520 - DNA, 23 bp, Homo sapiens
ttcattttctgacatgcattgtt

SEQ ID NO: 6531521 - DNA, 14 bp, Homo sapiens
ttcattttctgcaa

SEQ ID NO: 6531522 - DNA, 18 bp, Homo sapiens
ttcattttctgcaagcct

SEQ ID NO: 6531523 - DNA, 17 bp, Homo sapiens
ttcattttgagctgaaa

SEQ ID NO: 6531524 - DNA, 21 bp, Homo sapiens
ttcattttgcacctgcagcca

SEQ ID NO: 6531525 - DNA, 15 bp, Homo sapiens
ttcattttgctttaa

SEQ ID NO: 6531526 - DNA, 16 bp, Homo sapiens
ttcattttggttttgt

SEQ ID NO: 6531527 - DNA, 19 bp, Homo sapiens
ttcattttgttttgctctg

SEQ ID NO: 6531528 - DNA, 20 bp, Homo sapiens
ttcatttttaaagcctggct

SEQ ID NO: 6531529 - DNA, 21 bp, Homo sapiens
ttcatttttaaagcctggctt

SEQ ID NO: 6531530 - DNA, 14 bp, Homo sapiens
ttcatttttaaatg

SEQ ID NO: 6531531 - DNA, 18 bp, Homo sapiens
ttcatttttaagactgta

SEQ ID NO: 6531532 - DNA, 17 bp, Homo sapiens
ttcatttttaatcatga

SEQ ID NO: 6531533 - DNA, 21 bp, Homo sapiens
ttcatttttccatgacatttt

SEQ ID NO: 6531534 - DNA, 17 bp, Homo sapiens
ttcatttttctctccct

SEQ ID NO: 6531535 - DNA, 23 bp, Homo sapiens
ttcatttttgatagctgtcccat

SEQ ID NO: 6531536 - DNA, 17 bp, Homo sapiens
ttcattttttaatgtgc

SEQ ID NO: 6531537 - DNA, 20 bp, Homo sapiens
ttcattttttatgtattgtt

SEQ ID NO: 6531538 - DNA, 12 bp, Homo sapiens
tgggttgacccc

SEQ ID NO: 6531539 - DNA, 22 bp, Homo sapiens
tgggttgattctcgactgcttt

SEQ ID NO: 6531540 - DNA, 15 bp, Homo sapiens
tgggttgcaaagcta

SEQ ID NO: 6531541 - DNA, 19 bp, Homo sapiens
tgggttgcgtcctgacggc

SEQ ID NO: 6531542 - DNA, 23 bp, Homo sapiens
tgggttgctgctgtccagtgcct

SEQ ID NO: 6531543 - DNA, 15 bp, Homo sapiens
tgggttggcgcaccc

SEQ ID NO: 6531544 - DNA, 23 bp, Homo sapiens
tgggttggcgcaccctcccctcc

SEQ ID NO: 6531545 - DNA, 23 bp, Homo sapiens
tgggttgttaatactatattgct

SEQ ID NO: 6531546 - DNA, 14 bp, Homo sapiens
tgggttgttgcaga

SEQ ID NO: 6531547 - DNA, 16 bp, Homo sapiens
tgggttgttggtctgt

SEQ ID NO: 6531548 - DNA, 19 bp, Homo sapiens
tgggttgttgtttttttct

SEQ ID NO: 6531549 - DNA, 17 bp, Homo sapiens
tgggttgtttccaggag

SEQ ID NO: 6531550 - DNA, 18 bp, Homo sapiens
tgggtttacaacaaacac

SEQ ID NO: 6531551 - DNA, 11 bp, Homo sapiens
tgggtttactc

SEQ ID NO: 6531552 - DNA, 20 bp, Homo sapiens
tgggtttactctcaatgcat

SEQ ID NO: 6531553 - DNA, 23 bp, Homo sapiens
tgggtttagcaggctgcagcagg

SEQ ID NO: 6531554 - DNA, 13 bp, Homo sapiens
tgggtttcaagaa

SEQ ID NO: 6531555 - DNA, 19 bp, Homo sapiens
tgggtttcaagaaaatctt

SEQ ID NO: 6531556 - DNA, 13 bp, Homo sapiens
tgggtttcaattt

SEQ ID NO: 6531557 - DNA, 14 bp, Homo sapiens
tgggtttcaattta

SEQ ID NO: 6531558 - DNA, 23 bp, Homo sapiens
tgggtttcccttgccctttccat

SEQ ID NO: 6531559 - DNA, 14 bp, Homo sapiens
tgggtttcctgcag

SEQ ID NO: 6531560 - DNA, 17 bp, Homo sapiens
tgggtttcctgcaggca

SEQ ID NO: 6531561 - DNA, 15 bp, Homo sapiens
tgggtttgaagctgc

SEQ ID NO: 6531562 - DNA, 17 bp, Homo sapiens
tgggtttgaagctgctg

SEQ ID NO: 6531563 - DNA, 14 bp, Homo sapiens
tgggtttgccaagc

SEQ ID NO: 6531564 - DNA, 21 bp, Homo sapiens
tgggtttgccaagccctttgc

SEQ ID NO: 6531565 - DNA, 22 bp, Homo sapiens
tgggtttgcccagtcctgggtt

SEQ ID NO: 6531566 - DNA, 15 bp, Homo sapiens
tgggtttgctcatgt

SEQ ID NO: 6531567 - DNA, 23 bp, Homo sapiens
tgggtttgctcatgtaatgtggt

SEQ ID NO: 6531568 - DNA, 16 bp, Homo sapiens
tgggtttgctccctga

SEQ ID NO: 6531569 - DNA, 18 bp, Homo sapiens
tgggtttggccagggagg

SEQ ID NO: 6531570 - DNA, 19 bp, Homo sapiens
tgggtttggccagggaggc

SEQ ID NO: 6531571 - DNA, 21 bp, Homo sapiens
tgggtttggccagggaggcgc

SEQ ID NO: 6531572 - DNA, 22 bp, Homo sapiens
tgggtttggccagggaggcgca

SEQ ID NO: 6531573 - DNA, 13 bp, Homo sapiens
tgggtttggccca

SEQ ID NO: 6531574 - DNA, 14 bp, Homo sapiens
tgggtttggcccct

SEQ ID NO: 6531575 - DNA, 14 bp, Homo sapiens
tgggtttgggagcc

SEQ ID NO: 6531576 - DNA, 22 bp, Homo sapiens
tgggtttgggagccaggactcc

SEQ ID NO: 6531577 - DNA, 15 bp, Homo sapiens
tgggtttgggcagtg

SEQ ID NO: 6531578 - DNA, 21 bp, Homo sapiens
tgggtttgggcagtggagagg

SEQ ID NO: 6531579 - DNA, 20 bp, Homo sapiens
tgggtttggggccatggtgg

SEQ ID NO: 6531580 - DNA, 17 bp, Homo sapiens
tgggtttgggtgcctcc

SEQ ID NO: 6531581 - DNA, 20 bp, Homo sapiens
tgggtttgggtgcctcctgc

SEQ ID NO: 6531582 - DNA, 16 bp, Homo sapiens
tgggtttggttagagg

SEQ ID NO: 6531583 - DNA, 19 bp, Homo sapiens
tgggtttggttagaggaag

SEQ ID NO: 6531584 - DNA, 14 bp, Homo sapiens
tgggttttatcagt

SEQ ID NO: 6531585 - DNA, 21 bp, Homo sapiens
tgggttttctaactgtaaatc

SEQ ID NO: 6531586 - DNA, 19 bp, Homo sapiens
tgggttttctatttgaaca

SEQ ID NO: 6531587 - DNA, 19 bp, Homo sapiens
tgggttttcttaaccatct

SEQ ID NO: 6531588 - DNA, 15 bp, Homo sapiens
tgggttttcttccct

SEQ ID NO: 6531589 - DNA, 19 bp, Homo sapiens
tgggttttgatctcagcat

SEQ ID NO: 6531590 - DNA, 15 bp, Homo sapiens
tgggttttgcctctg

SEQ ID NO: 6531591 - DNA, 19 bp, Homo sapiens
tgggttttgtccattatta

SEQ ID NO: 6531592 - DNA, 16 bp, Homo sapiens
tgggttttgttcttgt

SEQ ID NO: 6531593 - DNA, 15 bp, Homo sapiens
tgggtttttaactca

SEQ ID NO: 6531594 - DNA, 14 bp, Homo sapiens
tgggtttttccctg

SEQ ID NO: 6531595 - DNA, 18 bp, Homo sapiens
tggtaaaaaagaaatgaa

SEQ ID NO: 6531596 - DNA, 14 bp, Homo sapiens
tggtaaaaagaaaa

SEQ ID NO: 6531597 - DNA, 22 bp, Homo sapiens
tggtaaaaagatccagggatgg

SEQ ID NO: 6531598 - DNA, 18 bp, Homo sapiens
tggtaaaaagattatata

SEQ ID NO: 6531599 - DNA, 18 bp, Homo sapiens
tggtaaaaatgctgctct

SEQ ID NO: 6531600 - DNA, 15 bp, Homo sapiens
tggtaaaacattact

SEQ ID NO: 6531601 - DNA, 21 bp, Homo sapiens
tggtaaaagggatacacagga

SEQ ID NO: 6531602 - DNA, 22 bp, Homo sapiens
tggtaaaatagtggatctcagt

SEQ ID NO: 6531603 - DNA, 19 bp, Homo sapiens
tggtaaaatgaagaattta

SEQ ID NO: 6531604 - DNA, 18 bp, Homo sapiens
tggtaaacattcctccag

SEQ ID NO: 6531605 - DNA, 24 bp, Homo sapiens
tggtaaacattcctccagcctccc

SEQ ID NO: 6531606 - DNA, 22 bp, Homo sapiens
tggtaaacggtttttattaaag

SEQ ID NO: 6531607 - DNA, 13 bp, Homo sapiens
tggtaaactattt

SEQ ID NO: 6531608 - DNA, 13 bp, Homo sapiens
tggtaaagccatg

SEQ ID NO: 6531609 - DNA, 15 bp, Homo sapiens
tggtaaagccatgtt

SEQ ID NO: 6531610 - DNA, 16 bp, Homo sapiens
tggtaaagccatgtta

SEQ ID NO: 6531611 - DNA, 18 bp, Homo sapiens
tggtaaaggtatgtaaac

SEQ ID NO: 6531612 - DNA, 17 bp, Homo sapiens
tggtaaagtagttgatt

SEQ ID NO: 6531613 - DNA, 20 bp, Homo sapiens
tggtaaagtgttaaggaata

SEQ ID NO: 6531614 - DNA, 17 bp, Homo sapiens
tggtaaataactgtgac

SEQ ID NO: 6531615 - DNA, 11 bp, Homo sapiens
tggtaaatatg

SEQ ID NO: 6531616 - DNA, 13 bp, Homo sapiens
tggtaaatgtttc

SEQ ID NO: 6531617 - DNA, 15 bp, Homo sapiens
tggtaaatgtttctt

SEQ ID NO: 6531618 - DNA, 21 bp, Homo sapiens
tggtaaattagtatttattta

SEQ ID NO: 6531619 - DNA, 21 bp, Homo sapiens
tggtaaattcagacaacatta

SEQ ID NO: 6531620 - DNA, 23 bp, Homo sapiens
tggtaaattcagacaacattatg

SEQ ID NO: 6531621 - DNA, 16 bp, Homo sapiens
tggtaaattctggtat

SEQ ID NO: 6531622 - DNA, 22 bp, Homo sapiens
tggtaaattctggtatacattg

SEQ ID NO: 6531623 - DNA, 22 bp, Homo sapiens
tggtaaatttccccaacagtgt

SEQ ID NO: 6531624 - DNA, 23 bp, Homo sapiens
tggtaaatttccccaacagtgtg

SEQ ID NO: 6531625 - DNA, 19 bp, Homo sapiens
tggtaaatttttgaaaaat

SEQ ID NO: 6531626 - DNA, 22 bp, Homo sapiens
tggtaaatttttgaaaaatatt

SEQ ID NO: 6531627 - DNA, 22 bp, Homo sapiens
tggtaacaaataacctataaag

SEQ ID NO: 6531628 - DNA, 21 bp, Homo sapiens
tggtaacaagaggagcaggaa

SEQ ID NO: 6531629 - DNA, 14 bp, Homo sapiens
tggtaacagatttg

SEQ ID NO: 6531630 - DNA, 15 bp, Homo sapiens
tggtaacagctctct

SEQ ID NO: 6531631 - DNA, 17 bp, Homo sapiens
tggtaacagttcatgtt

SEQ ID NO: 6531632 - DNA, 21 bp, Homo sapiens
tggtaacatcctttctattga

SEQ ID NO: 6531633 - DNA, 15 bp, Homo sapiens
tggtaaccaaatatt

SEQ ID NO: 6531634 - DNA, 19 bp, Homo sapiens
tggtaacgtggctccacct

SEQ ID NO: 6531635 - DNA, 21 bp, Homo sapiens
tggtaactgattacctgccaa

SEQ ID NO: 6531636 - DNA, 14 bp, Homo sapiens
tggtaactgctttc

SEQ ID NO: 6531637 - DNA, 13 bp, Homo sapiens
tggtaactgttaa

SEQ ID NO: 6531638 - DNA, 13 bp, Homo sapiens
tggtaacttgaga

SEQ ID NO: 6531639 - DNA, 21 bp, Homo sapiens
tggtaacttgagattcaagac

SEQ ID NO: 6531640 - DNA, 20 bp, Homo sapiens
tggtaacttttgtagtctta

SEQ ID NO: 6531641 - DNA, 16 bp, Homo sapiens
tggtaacttttgtgaa

SEQ ID NO: 6531642 - DNA, 12 bp, Homo sapiens
tggtaagaaaaa

SEQ ID NO: 6531643 - DNA, 13 bp, Homo sapiens
tggtaagagaaaa

SEQ ID NO: 6531644 - DNA, 14 bp, Homo sapiens
tggtaagagaaaag

SEQ ID NO: 6531645 - DNA, 14 bp, Homo sapiens
tggtaagagaagtg

SEQ ID NO: 6531646 - DNA, 16 bp, Homo sapiens
tggtaagagaatgtta

SEQ ID NO: 6531647 - DNA, 15 bp, Homo sapiens
tggtaagagacagaa

SEQ ID NO: 6531648 - DNA, 20 bp, Homo sapiens
tggtaagagacagaatgtat

SEQ ID NO: 6531649 - DNA, 20 bp, Homo sapiens
tggtaagattgttattaaat

SEQ ID NO: 6531650 - DNA, 20 bp, Homo sapiens
tggtaagcaacatggctttg

SEQ ID NO: 6531651 - DNA, 18 bp, Homo sapiens
tggtaagcgatttgaaac

SEQ ID NO: 6531652 - DNA, 13 bp, Homo sapiens
tggtaagctctgg

SEQ ID NO: 6531653 - DNA, 14 bp, Homo sapiens
tggtaagctctggc

SEQ ID NO: 6531654 - DNA, 13 bp, Homo sapiens
tggtaagggaagt

SEQ ID NO: 6531655 - DNA, 18 bp, Homo sapiens
tggtaagggaccttcagg

SEQ ID NO: 6531656 - DNA, 16 bp, Homo sapiens
tggtaagggccaagtc

SEQ ID NO: 6531657 - DNA, 20 bp, Homo sapiens
tggtaaggggaattgaggac

SEQ ID NO: 6531658 - DNA, 17 bp, Homo sapiens
tggtaagggggtccctg

SEQ ID NO: 6531659 - DNA, 20 bp, Homo sapiens
tggtaagggggtccctgtgc

SEQ ID NO: 6531660 - DNA, 21 bp, Homo sapiens
tggtaagggggtccctgtgct

SEQ ID NO: 6531661 - DNA, 22 bp, Homo sapiens
tggtaaggtgtgtactcagggc

SEQ ID NO: 6531662 - DNA, 21 bp, Homo sapiens
tggtaagtaatgagggctgag

SEQ ID NO: 6531663 - DNA, 18 bp, Homo sapiens
tggtaagtgaatttatga

SEQ ID NO: 6531664 - DNA, 12 bp, Homo sapiens
tggtaagtggag

SEQ ID NO: 6531665 - DNA, 13 bp, Homo sapiens
tggtaatagaata

SEQ ID NO: 6531666 - DNA, 13 bp, Homo sapiens
tggtaatatacaa

SEQ ID NO: 6531667 - DNA, 16 bp, Homo sapiens
tggtaatcatattaga

SEQ ID NO: 6531668 - DNA, 16 bp, Homo sapiens
tggtaatcttttctga

SEQ ID NO: 6531669 - DNA, 14 bp, Homo sapiens
tggtaatgacagat

SEQ ID NO: 6531670 - DNA, 20 bp, Homo sapiens
tggtaatgatgttgataatt

SEQ ID NO: 6531671 - DNA, 13 bp, Homo sapiens
tggtaatgtgtca

SEQ ID NO: 6531672 - DNA, 18 bp, Homo sapiens
tggtaatgtgtcaaagag

SEQ ID NO: 6531673 - DNA, 12 bp, Homo sapiens
tggtaattcact

SEQ ID NO: 6531674 - DNA, 17 bp, Homo sapiens
tggtaattcttattctt

SEQ ID NO: 6531675 - DNA, 20 bp, Homo sapiens
tggtaatttagtgtatatgt

SEQ ID NO: 6531676 - DNA, 22 bp, Homo sapiens
tggtaatttagtgtatatgtga

SEQ ID NO: 6531677 - DNA, 19 bp, Homo sapiens
tggtaatttgtatctgaag

SEQ ID NO: 6531678 - DNA, 16 bp, Homo sapiens
tggtaattttgatttc

SEQ ID NO: 6531679 - DNA, 15 bp, Homo sapiens
tggtaatttttgtac

SEQ ID NO: 6531680 - DNA, 14 bp, Homo sapiens
tggtacaaaaataa

SEQ ID NO: 6531681 - DNA, 21 bp, Homo sapiens
tggtacaaaaataaatttata

SEQ ID NO: 6531682 - DNA, 15 bp, Homo sapiens
tggtacaacggaggc

SEQ ID NO: 6531683 - DNA, 16 bp, Homo sapiens
tggtacaaggtggaga

SEQ ID NO: 6531684 - DNA, 17 bp, Homo sapiens
tggtacaatctggctca

SEQ ID NO: 6531685 - DNA, 12 bp, Homo sapiens
tggtacacatgt

SEQ ID NO: 6531686 - DNA, 17 bp, Homo sapiens
tggtacactgcatctca

SEQ ID NO: 6531687 - DNA, 12 bp, Homo sapiens
tggtacagagaa

SEQ ID NO: 6531688 - DNA, 16 bp, Homo sapiens
tggtacagagaagcca

SEQ ID NO: 6531689 - DNA, 18 bp, Homo sapiens
tggtacagagaagccagc

SEQ ID NO: 6531690 - DNA, 19 bp, Homo sapiens
tggtacagagaagccagct

SEQ ID NO: 6531691 - DNA, 22 bp, Homo sapiens
tggtacagagaagccagcttgt

SEQ ID NO: 6531692 - DNA, 13 bp, Homo sapiens
tggtacaggaagg

SEQ ID NO: 6531693 - DNA, 15 bp, Homo sapiens
tggtacaggtatatt

SEQ ID NO: 6531694 - DNA, 22 bp, Homo sapiens
tggtacagtatgggggttgtaa

SEQ ID NO: 6531695 - DNA, 15 bp, Homo sapiens
tggtacatggccagt

SEQ ID NO: 6531696 - DNA, 21 bp, Homo sapiens
tggtaccaatcatgaatcttt

SEQ ID NO: 6531697 - DNA, 13 bp, Homo sapiens
tggtaccagataa

SEQ ID NO: 6531698 - DNA, 15 bp, Homo sapiens
tggtaccagataaaa

SEQ ID NO: 6531699 - DNA, 18 bp, Homo sapiens
tggtaccagataaaatta

SEQ ID NO: 6531700 - DNA, 13 bp, Homo sapiens
tggtaccagatgc

SEQ ID NO: 6531701 - DNA, 20 bp, Homo sapiens
tggtaccagccctggggctg

SEQ ID NO: 6531702 - DNA, 21 bp, Homo sapiens
tggtaccagccctggggctgg

SEQ ID NO: 6531703 - DNA, 14 bp, Homo sapiens
tggtaccaggcccg

SEQ ID NO: 6531704 - DNA, 16 bp, Homo sapiens
tggtaccccccctttt

SEQ ID NO: 6531705 - DNA, 21 bp, Homo sapiens
tggtaccctcctggctcttga

SEQ ID NO: 6531706 - DNA, 15 bp, Homo sapiens
tggtacctgccctct

SEQ ID NO: 6531707 - DNA, 18 bp, Homo sapiens
tggtaccttcagccctgg

SEQ ID NO: 6531708 - DNA, 21 bp, Homo sapiens
tggtaccttcccccagctttc

SEQ ID NO: 6531709 - DNA, 16 bp, Homo sapiens
tggtaccttgcacaca

SEQ ID NO: 6531710 - DNA, 18 bp, Homo sapiens
tggtacggagatgtttca

SEQ ID NO: 6531711 - DNA, 15 bp, Homo sapiens
tggtacgtgaccctc

SEQ ID NO: 6531712 - DNA, 15 bp, Homo sapiens
tggtacgtgggtacc

SEQ ID NO: 6531713 - DNA, 21 bp, Homo sapiens
tggtactaatgaaatttacag

SEQ ID NO: 6531714 - DNA, 17 bp, Homo sapiens
tggtactagtgtggtgt

SEQ ID NO: 6531715 - DNA, 21 bp, Homo sapiens
tggtactagtgtggtgtgttt

SEQ ID NO: 6531716 - DNA, 18 bp, Homo sapiens
tggtactcaagccagcct

SEQ ID NO: 6531717 - DNA, 14 bp, Homo sapiens
ttcatttttttcca

SEQ ID NO: 6531718 - DNA, 19 bp, Homo sapiens
ttcatttttttttcaatca

SEQ ID NO: 6531719 - DNA, 13 bp, Homo sapiens
ttccaaaaaaata

SEQ ID NO: 6531720 - DNA, 21 bp, Homo sapiens
ttccaaaaacaaagtgcaaag

SEQ ID NO: 6531721 - DNA, 23 bp, Homo sapiens
ttccaaaaacaaagtgcaaagct

SEQ ID NO: 6531722 - DNA, 21 bp, Homo sapiens
ttccaaaaagattttcagaaa

SEQ ID NO: 6531723 - DNA, 18 bp, Homo sapiens
ttccaaaaaggttgctgt

SEQ ID NO: 6531724 - DNA, 16 bp, Homo sapiens
ttccaaaacctaaaga

SEQ ID NO: 6531725 - DNA, 15 bp, Homo sapiens
ttccaaaacctgctt

SEQ ID NO: 6531726 - DNA, 23 bp, Homo sapiens
ttccaaaacctgcttccttcagt

SEQ ID NO: 6531727 - DNA, 15 bp, Homo sapiens
ttccaaaagccaatg

SEQ ID NO: 6531728 - DNA, 15 bp, Homo sapiens
ttccaaaaggaagca

SEQ ID NO: 6531729 - DNA, 21 bp, Homo sapiens
ttccaaaagtactagcaataa

SEQ ID NO: 6531730 - DNA, 17 bp, Homo sapiens
ttccaaaagtggcctct

SEQ ID NO: 6531731 - DNA, 17 bp, Homo sapiens
ttccaaaataaaatgaa

SEQ ID NO: 6531732 - DNA, 21 bp, Homo sapiens
ttccaaaataattttaagaaa

SEQ ID NO: 6531733 - DNA, 14 bp, Homo sapiens
ttccaaaatattat

SEQ ID NO: 6531734 - DNA, 16 bp, Homo sapiens
ttccaaaatccaaaaa

SEQ ID NO: 6531735 - DNA, 20 bp, Homo sapiens
ttccaaaatctaaaagctgt

SEQ ID NO: 6531736 - DNA, 13 bp, Homo sapiens
ttccaaaattcca

SEQ ID NO: 6531737 - DNA, 14 bp, Homo sapiens
ttccaaaattctta

SEQ ID NO: 6531738 - DNA, 20 bp, Homo sapiens
ttccaaaattcttatttttc

SEQ ID NO: 6531739 - DNA, 15 bp, Homo sapiens
ttccaaacagacaaa

SEQ ID NO: 6531740 - DNA, 15 bp, Homo sapiens
ttccaaacccaggct

SEQ ID NO: 6531741 - DNA, 15 bp, Homo sapiens
ttccaaacttttgca

SEQ ID NO: 6531742 - DNA, 14 bp, Homo sapiens
ttccaaagaaagtt

SEQ ID NO: 6531743 - DNA, 16 bp, Homo sapiens
ttccaaagaatatttt

SEQ ID NO: 6531744 - DNA, 11 bp, Homo sapiens
ttccaaagatc

SEQ ID NO: 6531745 - DNA, 20 bp, Homo sapiens
ttccaaagcacattgaaaga

SEQ ID NO: 6531746 - DNA, 20 bp, Homo sapiens
ttccaaagcattttcagcat

SEQ ID NO: 6531747 - DNA, 16 bp, Homo sapiens
ttccaaagctttatta

SEQ ID NO: 6531748 - DNA, 23 bp, Homo sapiens
ttccaaaggccatggagagctgg

SEQ ID NO: 6531749 - DNA, 16 bp, Homo sapiens
ttccaaagtcacagga

SEQ ID NO: 6531750 - DNA, 19 bp, Homo sapiens
ttccaaagtcacaggaaga

SEQ ID NO: 6531751 - DNA, 14 bp, Homo sapiens
ttccaaagttaaca

SEQ ID NO: 6531752 - DNA, 13 bp, Homo sapiens
ttccaaataaaac

SEQ ID NO: 6531753 - DNA, 15 bp, Homo sapiens
ttccaaataaaatgt

SEQ ID NO: 6531754 - DNA, 17 bp, Homo sapiens
ttccaaataaaatgttc

SEQ ID NO: 6531755 - DNA, 22 bp, Homo sapiens
ttccaaataaggatttgttcac

SEQ ID NO: 6531756 - DNA, 15 bp, Homo sapiens
ttccaaatattctaa

SEQ ID NO: 6531757 - DNA, 17 bp, Homo sapiens
ttccaaatcctggaagg

SEQ ID NO: 6531758 - DNA, 19 bp, Homo sapiens
ttccaaatgatcctagtaa

SEQ ID NO: 6531759 - DNA, 17 bp, Homo sapiens
ttccaaatgcaatttga

SEQ ID NO: 6531760 - DNA, 22 bp, Homo sapiens
ttccaaatgcagttcattgcag

SEQ ID NO: 6531761 - DNA, 12 bp, Homo sapiens
ttccaaatgctt

SEQ ID NO: 6531762 - DNA, 16 bp, Homo sapiens
ttccaaatgcttctat

SEQ ID NO: 6531763 - DNA, 13 bp, Homo sapiens
ttccaaatgcttt

SEQ ID NO: 6531764 - DNA, 19 bp, Homo sapiens
ttccaaattaaaacaaata

SEQ ID NO: 6531765 - DNA, 13 bp, Homo sapiens
ttccaaattatta

SEQ ID NO: 6531766 - DNA, 16 bp, Homo sapiens
ttccaaattatttctt

SEQ ID NO: 6531767 - DNA, 15 bp, Homo sapiens
ttccaaattcacaag

SEQ ID NO: 6531768 - DNA, 23 bp, Homo sapiens
ttccaaattcacaagttgtgttt

SEQ ID NO: 6531769 - DNA, 20 bp, Homo sapiens
ttccaaattcagtttcataa

SEQ ID NO: 6531770 - DNA, 23 bp, Homo sapiens
ttccaaattgccctatgctgtgc

SEQ ID NO: 6531771 - DNA, 19 bp, Homo sapiens
ttccaaatttgctttacat

SEQ ID NO: 6531772 - DNA, 18 bp, Homo sapiens
ttccaaatttttttctta

SEQ ID NO: 6531773 - DNA, 20 bp, Homo sapiens
ttccaacaaacttactgtca

SEQ ID NO: 6531774 - DNA, 16 bp, Homo sapiens
ttccaacaaagggttt

SEQ ID NO: 6531775 - DNA, 23 bp, Homo sapiens
ttccaacaaagggttttaatgta

SEQ ID NO: 6531776 - DNA, 17 bp, Homo sapiens
ttccaacaaggacagcc

SEQ ID NO: 6531777 - DNA, 16 bp, Homo sapiens
ttccaacacacaatta

SEQ ID NO: 6531778 - DNA, 16 bp, Homo sapiens
ttccaacacatttcac

SEQ ID NO: 6531779 - DNA, 12 bp, Homo sapiens
ttccaacaccac

SEQ ID NO: 6531780 - DNA, 18 bp, Homo sapiens
ttccaacaccacagacac

SEQ ID NO: 6531781 - DNA, 23 bp, Homo sapiens
ttccaacaccacagacacacaca

SEQ ID NO: 6531782 - DNA, 16 bp, Homo sapiens
ttccaacagacagggc

SEQ ID NO: 6531783 - DNA, 11 bp, Homo sapiens
ttccaacagca

SEQ ID NO: 6531784 - DNA, 17 bp, Homo sapiens
ttccaacaggcgtggga

SEQ ID NO: 6531785 - DNA, 14 bp, Homo sapiens
ttccaacagtgagt

SEQ ID NO: 6531786 - DNA, 13 bp, Homo sapiens
ttccaaccccagc

SEQ ID NO: 6531787 - DNA, 14 bp, Homo sapiens
ttccaaccccagct

SEQ ID NO: 6531788 - DNA, 16 bp, Homo sapiens
ttccaaccccagctgg

SEQ ID NO: 6531789 - DNA, 19 bp, Homo sapiens
ttccaaccctcatcaccaa

SEQ ID NO: 6531790 - DNA, 18 bp, Homo sapiens
ttccaacctcacttcccg

SEQ ID NO: 6531791 - DNA, 20 bp, Homo sapiens
ttccaacctcctgctctggg

SEQ ID NO: 6531792 - DNA, 21 bp, Homo sapiens
ttccaacctcctgctctggga

SEQ ID NO: 6531793 - DNA, 19 bp, Homo sapiens
ttccaacctgttcacgtga

SEQ ID NO: 6531794 - DNA, 16 bp, Homo sapiens
ttccaaccttcctttt

SEQ ID NO: 6531795 - DNA, 13 bp, Homo sapiens
ttccaacgtaaat

SEQ ID NO: 6531796 - DNA, 18 bp, Homo sapiens
ttccaactactaatagaa

SEQ ID NO: 6531797 - DNA, 15 bp, Homo sapiens
ttccaactcctgatg

SEQ ID NO: 6531798 - DNA, 19 bp, Homo sapiens
ttccaactcgtatagcatg

SEQ ID NO: 6531799 - DNA, 16 bp, Homo sapiens
ttccaactgctgcccc

SEQ ID NO: 6531800 - DNA, 17 bp, Homo sapiens
ttccaacttgaaggatt

SEQ ID NO: 6531801 - DNA, 17 bp, Homo sapiens
ttccaacttggctgcag

SEQ ID NO: 6531802 - DNA, 13 bp, Homo sapiens
ttccaagaaagat

SEQ ID NO: 6531803 - DNA, 23 bp, Homo sapiens
ttccaagaaagatgaatacattt

SEQ ID NO: 6531804 - DNA, 14 bp, Homo sapiens
ttccaagaacctat

SEQ ID NO: 6531805 - DNA, 23 bp, Homo sapiens
ttccaagaatagcatctgtacaa

SEQ ID NO: 6531806 - DNA, 22 bp, Homo sapiens
ttccaagacagtatacagtcct

SEQ ID NO: 6531807 - DNA, 16 bp, Homo sapiens
ttccaagacattgtca

SEQ ID NO: 6531808 - DNA, 16 bp, Homo sapiens
ttccaagacctgactc

SEQ ID NO: 6531809 - DNA, 17 bp, Homo sapiens
ttccaagactgaagact

SEQ ID NO: 6531810 - DNA, 22 bp, Homo sapiens
ttccaagagcctgagagtgagg

SEQ ID NO: 6531811 - DNA, 13 bp, Homo sapiens
ttccaagagctga

SEQ ID NO: 6531812 - DNA, 15 bp, Homo sapiens
ttccaagaggctgta

SEQ ID NO: 6531813 - DNA, 15 bp, Homo sapiens
ttccaagagtctaaa

SEQ ID NO: 6531814 - DNA, 19 bp, Homo sapiens
ttccaagcaaaatctaaaa

SEQ ID NO: 6531815 - DNA, 22 bp, Homo sapiens
ttccaagcctgggccactggca

SEQ ID NO: 6531816 - DNA, 15 bp, Homo sapiens
ttccaagctccaaat

SEQ ID NO: 6531817 - DNA, 19 bp, Homo sapiens
ttccaagctgttagttgct

SEQ ID NO: 6531818 - DNA, 23 bp, Homo sapiens
ttccaagcttccatagctgctgc

SEQ ID NO: 6531819 - DNA, 20 bp, Homo sapiens
ttccaaggaaaattgaaagt

SEQ ID NO: 6531820 - DNA, 21 bp, Homo sapiens
ttccaaggaaaattgaaagta

SEQ ID NO: 6531821 - DNA, 13 bp, Homo sapiens
ttccaaggaaata

SEQ ID NO: 6531822 - DNA, 13 bp, Homo sapiens
ttccaaggagacc

SEQ ID NO: 6531823 - DNA, 22 bp, Homo sapiens
ttccaaggagctgagaatagaa

SEQ ID NO: 6531824 - DNA, 23 bp, Homo sapiens
ttccaaggagctgagaatagaag

SEQ ID NO: 6531825 - DNA, 19 bp, Homo sapiens
ttccaaggctttaaagctg

SEQ ID NO: 6531826 - DNA, 18 bp, Homo sapiens
ttccaaggggcaaatttt

SEQ ID NO: 6531827 - DNA, 15 bp, Homo sapiens
ttccaagggtactaa

SEQ ID NO: 6531828 - DNA, 20 bp, Homo sapiens
ttccaaggtcactcttggtc

SEQ ID NO: 6531829 - DNA, 20 bp, Homo sapiens
ttccaaggtggtctgctcgg

SEQ ID NO: 6531830 - DNA, 17 bp, Homo sapiens
ttccaagtcatttttgt

SEQ ID NO: 6531831 - DNA, 20 bp, Homo sapiens
ttccaagtcatttttgtttt

SEQ ID NO: 6531832 - DNA, 19 bp, Homo sapiens
ttccaagtctctgtgtaac

SEQ ID NO: 6531833 - DNA, 16 bp, Homo sapiens
ttccaagtgcattttt

SEQ ID NO: 6531834 - DNA, 20 bp, Homo sapiens
ttccaagtgcatttttctta

SEQ ID NO: 6531835 - DNA, 18 bp, Homo sapiens
ttccaagtggacggcaga

SEQ ID NO: 6531836 - DNA, 14 bp, Homo sapiens
ttccaagtgtgcat

SEQ ID NO: 6531837 - DNA, 17 bp, Homo sapiens
ttccaagtgtgtgtgca

SEQ ID NO: 6531838 - DNA, 21 bp, Homo sapiens
ttccaataaaccaggtttaga

SEQ ID NO: 6531839 - DNA, 21 bp, Homo sapiens
ttccaatacttcattaatttc

SEQ ID NO: 6531840 - DNA, 17 bp, Homo sapiens
ttccaatagaaagaaac

SEQ ID NO: 6531841 - DNA, 20 bp, Homo sapiens
ttccaatagaaagaaactaa

SEQ ID NO: 6531842 - DNA, 13 bp, Homo sapiens
ttccaatatgtga

SEQ ID NO: 6531843 - DNA, 14 bp, Homo sapiens
ttccaatatgtgat

SEQ ID NO: 6531844 - DNA, 23 bp, Homo sapiens
ttccaatatttataattaaagaa

SEQ ID NO: 6531845 - DNA, 15 bp, Homo sapiens
ttccaatatttctgc

SEQ ID NO: 6531846 - DNA, 21 bp, Homo sapiens
ttccaatattttaataaagta

SEQ ID NO: 6531847 - DNA, 15 bp, Homo sapiens
ttccaatcacagtgt

SEQ ID NO: 6531848 - DNA, 15 bp, Homo sapiens
ttccaatcttgcttt

SEQ ID NO: 6531849 - DNA, 19 bp, Homo sapiens
ttccaatgccaattcatct

SEQ ID NO: 6531850 - DNA, 22 bp, Homo sapiens
ttccaatgccaattcatctcag

SEQ ID NO: 6531851 - DNA, 17 bp, Homo sapiens
ttccaatgccacagaca

SEQ ID NO: 6531852 - DNA, 17 bp, Homo sapiens
ttccaatgtgaaagatt

SEQ ID NO: 6531853 - DNA, 14 bp, Homo sapiens
ttccaatgtgccca

SEQ ID NO: 6531854 - DNA, 21 bp, Homo sapiens
ttccaatgtgcccagtcatga

SEQ ID NO: 6531855 - DNA, 22 bp, Homo sapiens
ttccaatttacatactctgctt

SEQ ID NO: 6531856 - DNA, 11 bp, Homo sapiens
ttccacaaaat

SEQ ID NO: 6531857 - DNA, 16 bp, Homo sapiens
ttccacaaaattagaa

SEQ ID NO: 6531858 - DNA, 22 bp, Homo sapiens
ttccacaaaattagaaaggaca

SEQ ID NO: 6531859 - DNA, 17 bp, Homo sapiens
ttccacaaagcagtggc

SEQ ID NO: 6531860 - DNA, 15 bp, Homo sapiens
ttccacaattcttct

SEQ ID NO: 6531861 - DNA, 15 bp, Homo sapiens
ttccacacaaaatgt

SEQ ID NO: 6531862 - DNA, 19 bp, Homo sapiens
ttccacacaaaatgtcaca

SEQ ID NO: 6531863 - DNA, 19 bp, Homo sapiens
ttccacacagaatgcaacc

SEQ ID NO: 6531864 - DNA, 13 bp, Homo sapiens
ttccacacagcct

SEQ ID NO: 6531865 - DNA, 18 bp, Homo sapiens
ttccacacatttaaaaca

SEQ ID NO: 6531866 - DNA, 15 bp, Homo sapiens
ttccacacccccacc

SEQ ID NO: 6531867 - DNA, 17 bp, Homo sapiens
ttccacacccccacccc

SEQ ID NO: 6531868 - DNA, 19 bp, Homo sapiens
ttccacacctagcatctca

SEQ ID NO: 6531869 - DNA, 21 bp, Homo sapiens
ttccacacctggcactgctgt

SEQ ID NO: 6531870 - DNA, 19 bp, Homo sapiens
ttccacactccttgtcaac

SEQ ID NO: 6531871 - DNA, 21 bp, Homo sapiens
ttccacacttccacccccagc

SEQ ID NO: 6531872 - DNA, 10 bp, Homo sapiens
ttccacagac

SEQ ID NO: 6531873 - DNA, 12 bp, Homo sapiens
ttccacagacgg

SEQ ID NO: 6531874 - DNA, 13 bp, Homo sapiens
ttccacagaggac

SEQ ID NO: 6531875 - DNA, 12 bp, Homo sapiens
ttccacagattg

SEQ ID NO: 6531876 - DNA, 19 bp, Homo sapiens
ttccacagattgtttctat

SEQ ID NO: 6531877 - DNA, 15 bp, Homo sapiens
ttccacagcagcaga

SEQ ID NO: 6531878 - DNA, 22 bp, Homo sapiens
ttccacagcagcagaacaagtg

SEQ ID NO: 6531879 - DNA, 15 bp, Homo sapiens
ttccacagcagtgtc

SEQ ID NO: 6531880 - DNA, 22 bp, Homo sapiens
ttccacagcagtgtcacagacg

SEQ ID NO: 6531881 - DNA, 16 bp, Homo sapiens
ttccacagctggcctg

SEQ ID NO: 6531882 - DNA, 21 bp, Homo sapiens
ttccacaggacgaatgcatat

SEQ ID NO: 6531883 - DNA, 11 bp, Homo sapiens
ttccacaggat

SEQ ID NO: 6531884 - DNA, 18 bp, Homo sapiens
ttccacaggatcatcatt

SEQ ID NO: 6531885 - DNA, 22 bp, Homo sapiens
ttccacagggtcccacagccac

SEQ ID NO: 6531886 - DNA, 18 bp, Homo sapiens
ttccacagtctctgggag

SEQ ID NO: 6531887 - DNA, 10 bp, Homo sapiens
ttccacagtg

SEQ ID NO: 6531888 - DNA, 13 bp, Homo sapiens
ttccacagttatc

SEQ ID NO: 6531889 - DNA, 16 bp, Homo sapiens
ttccacagttatctta

SEQ ID NO: 6531890 - DNA, 20 bp, Homo sapiens
ttccacagttatcttagctg

SEQ ID NO: 6531891 - DNA, 17 bp, Homo sapiens
ttccacagttgccacca

SEQ ID NO: 6531892 - DNA, 18 bp, Homo sapiens
ttccacagttgccaccac

SEQ ID NO: 6531893 - DNA, 13 bp, Homo sapiens
ttccacataaagg

SEQ ID NO: 6531894 - DNA, 15 bp, Homo sapiens
ttccacataaatttt

SEQ ID NO: 6531895 - DNA, 12 bp, Homo sapiens
ttccacatcatg

SEQ ID NO: 6531896 - DNA, 17 bp, Homo sapiens
tggtactcattaaaaaa

SEQ ID NO: 6531897 - DNA, 20 bp, Homo sapiens
tggtactcccaaactgacaa

SEQ ID NO: 6531898 - DNA, 17 bp, Homo sapiens
tggtactcccccagccc

SEQ ID NO: 6531899 - DNA, 22 bp, Homo sapiens
tggtactccctctcaggatcca

SEQ ID NO: 6531900 - DNA, 23 bp, Homo sapiens
tggtactctggcaaatgatgatg

SEQ ID NO: 6531901 - DNA, 16 bp, Homo sapiens
tggtactctgtgtctg

SEQ ID NO: 6531902 - DNA, 21 bp, Homo sapiens
tggtactgactttgcttgctt

SEQ ID NO: 6531903 - DNA, 18 bp, Homo sapiens
tggtactgcacattttgt

SEQ ID NO: 6531904 - DNA, 13 bp, Homo sapiens
tggtactgctgag

SEQ ID NO: 6531905 - DNA, 19 bp, Homo sapiens
tggtactgctgtcttccaa

SEQ ID NO: 6531906 - DNA, 21 bp, Homo sapiens
tggtactgtacagctggctct

SEQ ID NO: 6531907 - DNA, 14 bp, Homo sapiens
tggtacttcctctg

SEQ ID NO: 6531908 - DNA, 17 bp, Homo sapiens
tggtacttgctgctatt

SEQ ID NO: 6531909 - DNA, 18 bp, Homo sapiens
tggtacttgctgctattt

SEQ ID NO: 6531910 - DNA, 20 bp, Homo sapiens
tggtacttggcaccaataaa

SEQ ID NO: 6531911 - DNA, 16 bp, Homo sapiens
tggtactttctgtact

SEQ ID NO: 6531912 - DNA, 17 bp, Homo sapiens
tggtacttttgagtgtg

SEQ ID NO: 6531913 - DNA, 18 bp, Homo sapiens
tggtacttttgagtgtgt

SEQ ID NO: 6531914 - DNA, 21 bp, Homo sapiens
tggtagaaaaacatctgaaga

SEQ ID NO: 6531915 - DNA, 21 bp, Homo sapiens
tggtagaaaaaggggcctgag

SEQ ID NO: 6531916 - DNA, 19 bp, Homo sapiens
tggtagaaaatgcaccaaa

SEQ ID NO: 6531917 - DNA, 22 bp, Homo sapiens
tggtagaaaatgcaccaaatag

SEQ ID NO: 6531918 - DNA, 12 bp, Homo sapiens
tggtagaaattt

SEQ ID NO: 6531919 - DNA, 13 bp, Homo sapiens
tggtagaagccag

SEQ ID NO: 6531920 - DNA, 18 bp, Homo sapiens
tggtagaattgggaagct

SEQ ID NO: 6531921 - DNA, 17 bp, Homo sapiens
tggtagaccaaaataaa

SEQ ID NO: 6531922 - DNA, 16 bp, Homo sapiens
tggtagagacccccag

SEQ ID NO: 6531923 - DNA, 13 bp, Homo sapiens
tggtagagatgga

SEQ ID NO: 6531924 - DNA, 16 bp, Homo sapiens
tggtagagccctcaga

SEQ ID NO: 6531925 - DNA, 19 bp, Homo sapiens
tggtagagctggtgccaga

SEQ ID NO: 6531926 - DNA, 19 bp, Homo sapiens
tggtagaggcctggggccg

SEQ ID NO: 6531927 - DNA, 17 bp, Homo sapiens
tggtagaggtgtgtgcc

SEQ ID NO: 6531928 - DNA, 20 bp, Homo sapiens
tggtagagtgtgcctgaagt

SEQ ID NO: 6531929 - DNA, 16 bp, Homo sapiens
tggtagagttcctttc

SEQ ID NO: 6531930 - DNA, 19 bp, Homo sapiens
tggtagatattcaggaaat

SEQ ID NO: 6531931 - DNA, 21 bp, Homo sapiens
tggtagatcttcaatttggat

SEQ ID NO: 6531932 - DNA, 15 bp, Homo sapiens
tggtagatgctgagg

SEQ ID NO: 6531933 - DNA, 16 bp, Homo sapiens
tggtagatgctgaggc

SEQ ID NO: 6531934 - DNA, 18 bp, Homo sapiens
tggtagatgctgaggccc

SEQ ID NO: 6531935 - DNA, 19 bp, Homo sapiens
tggtagattcgctgtcccc

SEQ ID NO: 6531936 - DNA, 20 bp, Homo sapiens
tggtagattcgctgtcccct

SEQ ID NO: 6531937 - DNA, 17 bp, Homo sapiens
tggtagatttcctcctc

SEQ ID NO: 6531938 - DNA, 14 bp, Homo sapiens
tggtagcaaagtaa

SEQ ID NO: 6531939 - DNA, 15 bp, Homo sapiens
tggtagcagcaggct

SEQ ID NO: 6531940 - DNA, 15 bp, Homo sapiens
tggtagcagcctggg

SEQ ID NO: 6531941 - DNA, 18 bp, Homo sapiens
tggtagcagggtctttgt

SEQ ID NO: 6531942 - DNA, 17 bp, Homo sapiens
tggtagcatgacctttt

SEQ ID NO: 6531943 - DNA, 18 bp, Homo sapiens
tggtagcattttaaacaa

SEQ ID NO: 6531944 - DNA, 19 bp, Homo sapiens
tggtagccagttgaattta

SEQ ID NO: 6531945 - DNA, 18 bp, Homo sapiens
tggtagccatcaagcact

SEQ ID NO: 6531946 - DNA, 14 bp, Homo sapiens
tggtagctcaggtg

SEQ ID NO: 6531947 - DNA, 23 bp, Homo sapiens
tggtagctcatgcctgtaaccct

SEQ ID NO: 6531948 - DNA, 22 bp, Homo sapiens
tggtagctctgaagggagggga

SEQ ID NO: 6531949 - DNA, 16 bp, Homo sapiens
tggtagctctgagccc

SEQ ID NO: 6531950 - DNA, 20 bp, Homo sapiens
tggtaggaaaaagctttact

SEQ ID NO: 6531951 - DNA, 17 bp, Homo sapiens
tggtaggaatagcatgt

SEQ ID NO: 6531952 - DNA, 12 bp, Homo sapiens
tggtaggaccct

SEQ ID NO: 6531953 - DNA, 22 bp, Homo sapiens
tggtaggaccctcgagagcctt

SEQ ID NO: 6531954 - DNA, 14 bp, Homo sapiens
tggtaggaggaggc

SEQ ID NO: 6531955 - DNA, 18 bp, Homo sapiens
tggtaggaggaggcatgg

SEQ ID NO: 6531956 - DNA, 15 bp, Homo sapiens
tggtaggcttatcaa

SEQ ID NO: 6531957 - DNA, 17 bp, Homo sapiens
tggtagggacttaaaaa

SEQ ID NO: 6531958 - DNA, 15 bp, Homo sapiens
tggtaggggcaggga

SEQ ID NO: 6531959 - DNA, 17 bp, Homo sapiens
tggtaggggcagggagg

SEQ ID NO: 6531960 - DNA, 19 bp, Homo sapiens
tggtagggtataatgtgtc

SEQ ID NO: 6531961 - DNA, 20 bp, Homo sapiens
tggtaggtactttttgtgaa

SEQ ID NO: 6531962 - DNA, 16 bp, Homo sapiens
tggtaggtagcacagt

SEQ ID NO: 6531963 - DNA, 19 bp, Homo sapiens
tggtaggtctggattttca

SEQ ID NO: 6531964 - DNA, 21 bp, Homo sapiens
tggtaggttgggacaccaggg

SEQ ID NO: 6531965 - DNA, 14 bp, Homo sapiens
tggtagtaaaacac

SEQ ID NO: 6531966 - DNA, 22 bp, Homo sapiens
tggtagtaatcacagttggcct

SEQ ID NO: 6531967 - DNA, 22 bp, Homo sapiens
tggtagtaatttcctttattat

SEQ ID NO: 6531968 - DNA, 13 bp, Homo sapiens
tggtagtcacttg

SEQ ID NO: 6531969 - DNA, 17 bp, Homo sapiens
tggtagtcctcccaagc

SEQ ID NO: 6531970 - DNA, 19 bp, Homo sapiens
tggtagtcctcccaagctg

SEQ ID NO: 6531971 - DNA, 23 bp, Homo sapiens
tggtagtcctcccaagctgtgct

SEQ ID NO: 6531972 - DNA, 22 bp, Homo sapiens
tggtagtgtagctgtgtggctt

SEQ ID NO: 6531973 - DNA, 14 bp, Homo sapiens
tggtagttaacaca

SEQ ID NO: 6531974 - DNA, 17 bp, Homo sapiens
tggtagttagtagcatg

SEQ ID NO: 6531975 - DNA, 17 bp, Homo sapiens
tggtataaaaggttgcc

SEQ ID NO: 6531976 - DNA, 15 bp, Homo sapiens
tggtataagtaactt

SEQ ID NO: 6531977 - DNA, 16 bp, Homo sapiens
tggtataattgaaact

SEQ ID NO: 6531978 - DNA, 16 bp, Homo sapiens
tggtatacctatttca

SEQ ID NO: 6531979 - DNA, 14 bp, Homo sapiens
tggtatagaaatgc

SEQ ID NO: 6531980 - DNA, 20 bp, Homo sapiens
tggtatagatttctataaaa

SEQ ID NO: 6531981 - DNA, 14 bp, Homo sapiens
tggtatatatacat

SEQ ID NO: 6531982 - DNA, 19 bp, Homo sapiens
tggtatatccaaaagcttt

SEQ ID NO: 6531983 - DNA, 22 bp, Homo sapiens
tggtatatctggccacactggg

SEQ ID NO: 6531984 - DNA, 15 bp, Homo sapiens
tggtatatgtcatta

SEQ ID NO: 6531985 - DNA, 18 bp, Homo sapiens
tggtatattattgcttca

SEQ ID NO: 6531986 - DNA, 17 bp, Homo sapiens
tggtatattgtgtaaat

SEQ ID NO: 6531987 - DNA, 15 bp, Homo sapiens
tggtatatttgtaga

SEQ ID NO: 6531988 - DNA, 15 bp, Homo sapiens
tggtatcaagaaagt

SEQ ID NO: 6531989 - DNA, 14 bp, Homo sapiens
tggtatcatatatt

SEQ ID NO: 6531990 - DNA, 14 bp, Homo sapiens
tggtatcctactga

SEQ ID NO: 6531991 - DNA, 15 bp, Homo sapiens
tggtatctaattctt

SEQ ID NO: 6531992 - DNA, 21 bp, Homo sapiens
tggtatctaattctttaatga

SEQ ID NO: 6531993 - DNA, 16 bp, Homo sapiens
tggtatctcagaaagt

SEQ ID NO: 6531994 - DNA, 19 bp, Homo sapiens
tggtatctcaggtctgaat

SEQ ID NO: 6531995 - DNA, 22 bp, Homo sapiens
tggtatctgttctttaatttat

SEQ ID NO: 6531996 - DNA, 23 bp, Homo sapiens
tggtatctgttctttaatttatt

SEQ ID NO: 6531997 - DNA, 20 bp, Homo sapiens
tggtatcttgttagagagct

SEQ ID NO: 6531998 - DNA, 13 bp, Homo sapiens
tggtatgaaacaa

SEQ ID NO: 6531999 - DNA, 17 bp, Homo sapiens
tggtatgaaacaaatat

SEQ ID NO: 6532000 - DNA, 23 bp, Homo sapiens
tggtatgaacttgaggacacatg

SEQ ID NO: 6532001 - DNA, 12 bp, Homo sapiens
tggtatgagaca

SEQ ID NO: 6532002 - DNA, 15 bp, Homo sapiens
tggtatgagctgagg

SEQ ID NO: 6532003 - DNA, 14 bp, Homo sapiens
tggtatgagggggt

SEQ ID NO: 6532004 - DNA, 18 bp, Homo sapiens
tggtatgatgctgccggc

SEQ ID NO: 6532005 - DNA, 15 bp, Homo sapiens
tggtatgatgtatat

SEQ ID NO: 6532006 - DNA, 19 bp, Homo sapiens
tggtatgcagcatacaaaa

SEQ ID NO: 6532007 - DNA, 17 bp, Homo sapiens
tggtatgcattctttat

SEQ ID NO: 6532008 - DNA, 22 bp, Homo sapiens
tggtatgcattctttatagtga

SEQ ID NO: 6532009 - DNA, 15 bp, Homo sapiens
tggtatgctggccag

SEQ ID NO: 6532010 - DNA, 21 bp, Homo sapiens
tggtatggagctgtgccgagg

SEQ ID NO: 6532011 - DNA, 21 bp, Homo sapiens
tggtatggagttggcagacag

SEQ ID NO: 6532012 - DNA, 22 bp, Homo sapiens
tggtatgggggatttcaaactt

SEQ ID NO: 6532013 - DNA, 20 bp, Homo sapiens
tggtatgtaatttatgcaag

SEQ ID NO: 6532014 - DNA, 21 bp, Homo sapiens
tggtatgtagcccggccaggg

SEQ ID NO: 6532015 - DNA, 20 bp, Homo sapiens
tggtatgtgccaggcttgcc

SEQ ID NO: 6532016 - DNA, 12 bp, Homo sapiens
tggtatgtgtgt

SEQ ID NO: 6532017 - DNA, 17 bp, Homo sapiens
tggtatgtgtgtgtatg

SEQ ID NO: 6532018 - DNA, 21 bp, Homo sapiens
tggtatgtgtgtgtatgctac

SEQ ID NO: 6532019 - DNA, 13 bp, Homo sapiens
tggtatgttttca

SEQ ID NO: 6532020 - DNA, 16 bp, Homo sapiens
tggtattaataaaaag

SEQ ID NO: 6532021 - DNA, 20 bp, Homo sapiens
tggtattaatcttgtgtagt

SEQ ID NO: 6532022 - DNA, 15 bp, Homo sapiens
tggtattacacagtc

SEQ ID NO: 6532023 - DNA, 18 bp, Homo sapiens
tggtattacactgtattt

SEQ ID NO: 6532024 - DNA, 20 bp, Homo sapiens
tggtattacactgtatttgt

SEQ ID NO: 6532025 - DNA, 18 bp, Homo sapiens
tggtattatatctctgta

SEQ ID NO: 6532026 - DNA, 17 bp, Homo sapiens
tggtattatttacaatg

SEQ ID NO: 6532027 - DNA, 20 bp, Homo sapiens
tggtattcaactaatacatg

SEQ ID NO: 6532028 - DNA, 16 bp, Homo sapiens
tggtattcctgcctcc

SEQ ID NO: 6532029 - DNA, 12 bp, Homo sapiens
tggtattctgtc

SEQ ID NO: 6532030 - DNA, 14 bp, Homo sapiens
tggtattctgtcat

SEQ ID NO: 6532031 - DNA, 16 bp, Homo sapiens
tggtattgactcaaca

SEQ ID NO: 6532032 - DNA, 18 bp, Homo sapiens
tggtattggaatagcagc

SEQ ID NO: 6532033 - DNA, 23 bp, Homo sapiens
tggtattggccataagcaacaat

SEQ ID NO: 6532034 - DNA, 20 bp, Homo sapiens
tggtattgggcagttgggag

SEQ ID NO: 6532035 - DNA, 15 bp, Homo sapiens
tggtattggtgcttt

SEQ ID NO: 6532036 - DNA, 17 bp, Homo sapiens
tggtattgtaaaacatt

SEQ ID NO: 6532037 - DNA, 13 bp, Homo sapiens
tggtattgtaata

SEQ ID NO: 6532038 - DNA, 14 bp, Homo sapiens
tggtattgtattta

SEQ ID NO: 6532039 - DNA, 16 bp, Homo sapiens
tggtattgtcttaaat

SEQ ID NO: 6532040 - DNA, 17 bp, Homo sapiens
tggtattgtgagatgat

SEQ ID NO: 6532041 - DNA, 13 bp, Homo sapiens
tggtatttactgc

SEQ ID NO: 6532042 - DNA, 18 bp, Homo sapiens
tggtatttactgcaatgt

SEQ ID NO: 6532043 - DNA, 13 bp, Homo sapiens
tggtatttatatt

SEQ ID NO: 6532044 - DNA, 20 bp, Homo sapiens
tggtatttatctattgtaag

SEQ ID NO: 6532045 - DNA, 21 bp, Homo sapiens
tggtatttatgtaaaaggatt

SEQ ID NO: 6532046 - DNA, 13 bp, Homo sapiens
tggtatttctaat

SEQ ID NO: 6532047 - DNA, 14 bp, Homo sapiens
tggtatttctaatt

SEQ ID NO: 6532048 - DNA, 16 bp, Homo sapiens
tggtatttctttctcg

SEQ ID NO: 6532049 - DNA, 15 bp, Homo sapiens
tggtatttgctgtca

SEQ ID NO: 6532050 - DNA, 18 bp, Homo sapiens
tggtatttggatatctgt

SEQ ID NO: 6532051 - DNA, 15 bp, Homo sapiens
tggtatttgtttaat

SEQ ID NO: 6532052 - DNA, 16 bp, Homo sapiens
tggtatttgtttaata

SEQ ID NO: 6532053 - DNA, 22 bp, Homo sapiens
tggtatttgtttgtagctttcc

SEQ ID NO: 6532054 - DNA, 17 bp, Homo sapiens
tggtattttataagcac

SEQ ID NO: 6532055 - DNA, 13 bp, Homo sapiens
tggtattttcaat

SEQ ID NO: 6532056 - DNA, 17 bp, Homo sapiens
tggtattttcaatagcc

SEQ ID NO: 6532057 - DNA, 20 bp, Homo sapiens
tggtattttcaatagccact

SEQ ID NO: 6532058 - DNA, 18 bp, Homo sapiens
tggtattttccagcactt

SEQ ID NO: 6532059 - DNA, 18 bp, Homo sapiens
tggtattttggcattttg

SEQ ID NO: 6532060 - DNA, 17 bp, Homo sapiens
tggtattttttgtgaat

SEQ ID NO: 6532061 - DNA, 21 bp, Homo sapiens
tggtcaaaccgcactcaccca

SEQ ID NO: 6532062 - DNA, 18 bp, Homo sapiens
tggtcaaacttgttttct

SEQ ID NO: 6532063 - DNA, 20 bp, Homo sapiens
tggtcaaactttttccagca

SEQ ID NO: 6532064 - DNA, 21 bp, Homo sapiens
tggtcaaactttttccagcaa

SEQ ID NO: 6532065 - DNA, 22 bp, Homo sapiens
tggtcaacatagtgagacactg

SEQ ID NO: 6532066 - DNA, 14 bp, Homo sapiens
tggtcaacatttct

SEQ ID NO: 6532067 - DNA, 18 bp, Homo sapiens
tggtcaacctcctggaca

SEQ ID NO: 6532068 - DNA, 13 bp, Homo sapiens
tggtcaacttaag

SEQ ID NO: 6532069 - DNA, 14 bp, Homo sapiens
tggtcaacttaagg

SEQ ID NO: 6532070 - DNA, 21 bp, Homo sapiens
tggtcaagaaaggaggggaga

SEQ ID NO: 6532071 - DNA, 23 bp, Homo sapiens
tggtcaatacacataagaccgtg

SEQ ID NO: 6532072 - DNA, 15 bp, Homo sapiens
tggtcacaagcacaa

SEQ ID NO: 6532073 - DNA, 23 bp, Homo sapiens
tggtcacaagtaggagacacaga

SEQ ID NO: 6532074 - DNA, 17 bp, Homo sapiens
ttccacatcatgttact

SEQ ID NO: 6532075 - DNA, 16 bp, Homo sapiens
ttccacatgctctgag

SEQ ID NO: 6532076 - DNA, 18 bp, Homo sapiens
ttccacatggcagatgat

SEQ ID NO: 6532077 - DNA, 15 bp, Homo sapiens
ttccacatgtacata

SEQ ID NO: 6532078 - DNA, 13 bp, Homo sapiens
ttccacattaatt

SEQ ID NO: 6532079 - DNA, 19 bp, Homo sapiens
ttccacatttttgcacaga

SEQ ID NO: 6532080 - DNA, 12 bp, Homo sapiens
ttccaccagcct

SEQ ID NO: 6532081 - DNA, 19 bp, Homo sapiens
ttccaccatcaagccacca

SEQ ID NO: 6532082 - DNA, 19 bp, Homo sapiens
ttccacccacaaactccag

SEQ ID NO: 6532083 - DNA, 22 bp, Homo sapiens
ttccacccacaaactccaggct

SEQ ID NO: 6532084 - DNA, 22 bp, Homo sapiens
ttccacccacacgactgcaaca

SEQ ID NO: 6532085 - DNA, 19 bp, Homo sapiens
ttccacccacgagcacttt

SEQ ID NO: 6532086 - DNA, 15 bp, Homo sapiens
ttccacccagaccct

SEQ ID NO: 6532087 - DNA, 20 bp, Homo sapiens
ttccacccagaccctccttc

SEQ ID NO: 6532088 - DNA, 22 bp, Homo sapiens
ttccacccagaccctccttccc

SEQ ID NO: 6532089 - DNA, 19 bp, Homo sapiens
ttccacccaggggcagccc

SEQ ID NO: 6532090 - DNA, 23 bp, Homo sapiens
ttccacccagtgctgaatttccc

SEQ ID NO: 6532091 - DNA, 13 bp, Homo sapiens
ttccacccccagc

SEQ ID NO: 6532092 - DNA, 20 bp, Homo sapiens
ttccacccccgttagcttcc

SEQ ID NO: 6532093 - DNA, 14 bp, Homo sapiens
ttccacccctcctc

SEQ ID NO: 6532094 - DNA, 20 bp, Homo sapiens
ttccacccctccttccctgg

SEQ ID NO: 6532095 - DNA, 16 bp, Homo sapiens
ttccacccctctcctc

SEQ ID NO: 6532096 - DNA, 13 bp, Homo sapiens
ttccacccgtctc

SEQ ID NO: 6532097 - DNA, 11 bp, Homo sapiens
ttccaccctgg

SEQ ID NO: 6532098 - DNA, 14 bp, Homo sapiens
ttccaccctggaga

SEQ ID NO: 6532099 - DNA, 19 bp, Homo sapiens
ttccaccggcactcatgac

SEQ ID NO: 6532100 - DNA, 14 bp, Homo sapiens
ttccacctccagcc

SEQ ID NO: 6532101 - DNA, 13 bp, Homo sapiens
ttccacctccctc

SEQ ID NO: 6532102 - DNA, 18 bp, Homo sapiens
ttccacctggaaagccag

SEQ ID NO: 6532103 - DNA, 14 bp, Homo sapiens
ttccaccttaaatt

SEQ ID NO: 6532104 - DNA, 17 bp, Homo sapiens
ttccaccttaaattaaa

SEQ ID NO: 6532105 - DNA, 18 bp, Homo sapiens
ttccaccttaaattaaac

SEQ ID NO: 6532106 - DNA, 20 bp, Homo sapiens
ttccaccttaaattaaacaa

SEQ ID NO: 6532107 - DNA, 13 bp, Homo sapiens
ttccacctttctc

SEQ ID NO: 6532108 - DNA, 18 bp, Homo sapiens
ttccacgcagttctttcc

SEQ ID NO: 6532109 - DNA, 18 bp, Homo sapiens
ttccacgctgtctccaga

SEQ ID NO: 6532110 - DNA, 23 bp, Homo sapiens
ttccacggcatcgcatccgtcct

SEQ ID NO: 6532111 - DNA, 17 bp, Homo sapiens
ttccacgggggctgtgg

SEQ ID NO: 6532112 - DNA, 17 bp, Homo sapiens
ttccacgtcttcctcca

SEQ ID NO: 6532113 - DNA, 14 bp, Homo sapiens
ttccacgtgcccct

SEQ ID NO: 6532114 - DNA, 15 bp, Homo sapiens
ttccacgtgcccctt

SEQ ID NO: 6532115 - DNA, 16 bp, Homo sapiens
ttccactaccctccct

SEQ ID NO: 6532116 - DNA, 19 bp, Homo sapiens
ttccactatttgcagaggc

SEQ ID NO: 6532117 - DNA, 19 bp, Homo sapiens
ttccactattttcaaagaa

SEQ ID NO: 6532118 - DNA, 20 bp, Homo sapiens
ttccactcaaaatatgtcaa

SEQ ID NO: 6532119 - DNA, 12 bp, Homo sapiens
ttccactcagct

SEQ ID NO: 6532120 - DNA, 14 bp, Homo sapiens
ttccactcagcttg

SEQ ID NO: 6532121 - DNA, 14 bp, Homo sapiens
ttccactcatgccg

SEQ ID NO: 6532122 - DNA, 17 bp, Homo sapiens
ttccactccaagatgcc

SEQ ID NO: 6532123 - DNA, 19 bp, Homo sapiens
ttccactcccactgccagg

SEQ ID NO: 6532124 - DNA, 17 bp, Homo sapiens
ttccactccttccagaa

SEQ ID NO: 6532125 - DNA, 14 bp, Homo sapiens
ttccactgaaaatt

SEQ ID NO: 6532126 - DNA, 18 bp, Homo sapiens
ttccactgaaaatttaac

SEQ ID NO: 6532127 - DNA, 21 bp, Homo sapiens
ttccactgaaaatttaacagt

SEQ ID NO: 6532128 - DNA, 19 bp, Homo sapiens
ttccactgaaacctctgtt

SEQ ID NO: 6532129 - DNA, 22 bp, Homo sapiens
ttccactgaaacctctgttctc

SEQ ID NO: 6532130 - DNA, 17 bp, Homo sapiens
ttccactgacaacgaaa

SEQ ID NO: 6532131 - DNA, 13 bp, Homo sapiens
ttccactgagctc

SEQ ID NO: 6532132 - DNA, 14 bp, Homo sapiens
ttccactgagctcc

SEQ ID NO: 6532133 - DNA, 19 bp, Homo sapiens
ttccactgccaaaacaatg

SEQ ID NO: 6532134 - DNA, 23 bp, Homo sapiens
ttccactgcctgggatgatgcag

SEQ ID NO: 6532135 - DNA, 22 bp, Homo sapiens
ttccactggacttgagcttggc

SEQ ID NO: 6532136 - DNA, 23 bp, Homo sapiens
ttccactggcttttgcctgtaag

SEQ ID NO: 6532137 - DNA, 23 bp, Homo sapiens
ttccactgtatattttttaatgt

SEQ ID NO: 6532138 - DNA, 22 bp, Homo sapiens
ttccactgtgcaggttcccact

SEQ ID NO: 6532139 - DNA, 13 bp, Homo sapiens
ttccactgtgtgt

SEQ ID NO: 6532140 - DNA, 15 bp, Homo sapiens
ttccacttagagaac

SEQ ID NO: 6532141 - DNA, 19 bp, Homo sapiens
ttccacttataggaattga

SEQ ID NO: 6532142 - DNA, 17 bp, Homo sapiens
ttccacttccagagggg

SEQ ID NO: 6532143 - DNA, 14 bp, Homo sapiens
ttccacttcctgcc

SEQ ID NO: 6532144 - DNA, 17 bp, Homo sapiens
ttccacttcctgcccca

SEQ ID NO: 6532145 - DNA, 19 bp, Homo sapiens
ttccacttctaactccact

SEQ ID NO: 6532146 - DNA, 18 bp, Homo sapiens
ttccacttcttcctttct

SEQ ID NO: 6532147 - DNA, 21 bp, Homo sapiens
ttccacttcttcctttctctt

SEQ ID NO: 6532148 - DNA, 13 bp, Homo sapiens
ttccacttgccct

SEQ ID NO: 6532149 - DNA, 15 bp, Homo sapiens
ttccactttgttctt

SEQ ID NO: 6532150 - DNA, 22 bp, Homo sapiens
ttccagaaatgtttttggcaac

SEQ ID NO: 6532151 - DNA, 14 bp, Homo sapiens
ttccagaaattctt

SEQ ID NO: 6532152 - DNA, 16 bp, Homo sapiens
ttccagaacaaattgt

SEQ ID NO: 6532153 - DNA, 15 bp, Homo sapiens
ttccagaacagccct

SEQ ID NO: 6532154 - DNA, 19 bp, Homo sapiens
ttccagaacagccctcggc

SEQ ID NO: 6532155 - DNA, 17 bp, Homo sapiens
ttccagaacgccctgtg

SEQ ID NO: 6532156 - DNA, 19 bp, Homo sapiens
ttccagaacgccctgtgtc

SEQ ID NO: 6532157 - DNA, 21 bp, Homo sapiens
ttccagaacgccctgtgtcca

SEQ ID NO: 6532158 - DNA, 20 bp, Homo sapiens
ttccagaacgtctctcacct

SEQ ID NO: 6532159 - DNA, 22 bp, Homo sapiens
ttccagaagaaagatggaaatt

SEQ ID NO: 6532160 - DNA, 16 bp, Homo sapiens
ttccagaagaagagaa

SEQ ID NO: 6532161 - DNA, 21 bp, Homo sapiens
ttccagaagaagagaagctgc

SEQ ID NO: 6532162 - DNA, 21 bp, Homo sapiens
ttccagaaggatttcttgtat

SEQ ID NO: 6532163 - DNA, 21 bp, Homo sapiens
ttccagaagtgtgattgggaa

SEQ ID NO: 6532164 - DNA, 19 bp, Homo sapiens
ttccagaatatctgggatt

SEQ ID NO: 6532165 - DNA, 15 bp, Homo sapiens
ttccagaatcccaag

SEQ ID NO: 6532166 - DNA, 14 bp, Homo sapiens
ttccagaatgacct

SEQ ID NO: 6532167 - DNA, 15 bp, Homo sapiens
ttccagaatgctgta

SEQ ID NO: 6532168 - DNA, 22 bp, Homo sapiens
ttccagaatttggaagctagaa

SEQ ID NO: 6532169 - DNA, 15 bp, Homo sapiens
ttccagaccaaaata

SEQ ID NO: 6532170 - DNA, 14 bp, Homo sapiens
ttccagaccacctg

SEQ ID NO: 6532171 - DNA, 20 bp, Homo sapiens
ttccagaccacctgccagcc

SEQ ID NO: 6532172 - DNA, 16 bp, Homo sapiens
ttccagacctgaagaa

SEQ ID NO: 6532173 - DNA, 13 bp, Homo sapiens
ttccagacctgct

SEQ ID NO: 6532174 - DNA, 18 bp, Homo sapiens
ttccagactcaggttcca

SEQ ID NO: 6532175 - DNA, 19 bp, Homo sapiens
ttccagactcaggttccag

SEQ ID NO: 6532176 - DNA, 20 bp, Homo sapiens
ttccagactcaggttccaga

SEQ ID NO: 6532177 - DNA, 23 bp, Homo sapiens
ttccagactgcttccaattttct

SEQ ID NO: 6532178 - DNA, 14 bp, Homo sapiens
ttccagacttcaaa

SEQ ID NO: 6532179 - DNA, 19 bp, Homo sapiens
ttccagagaacctgtgggc

SEQ ID NO: 6532180 - DNA, 11 bp, Homo sapiens
ttccagagaag

SEQ ID NO: 6532181 - DNA, 17 bp, Homo sapiens
ttccagagagtggctcc

SEQ ID NO: 6532182 - DNA, 20 bp, Homo sapiens
ttccagagagtggctcctcc

SEQ ID NO: 6532183 - DNA, 10 bp, Homo sapiens
ttccagagca

SEQ ID NO: 6532184 - DNA, 15 bp, Homo sapiens
ttccagagctgcttc

SEQ ID NO: 6532185 - DNA, 21 bp, Homo sapiens
ttccagagctgcttctgtctg

SEQ ID NO: 6532186 - DNA, 11 bp, Homo sapiens
ttccagaggac

SEQ ID NO: 6532187 - DNA, 19 bp, Homo sapiens
ttccagaggacagctctgg

SEQ ID NO: 6532188 - DNA, 17 bp, Homo sapiens
ttccagaggactctgct

SEQ ID NO: 6532189 - DNA, 22 bp, Homo sapiens
ttccagagggggccagagggac

SEQ ID NO: 6532190 - DNA, 20 bp, Homo sapiens
ttccagagtccggaggcagc

SEQ ID NO: 6532191 - DNA, 21 bp, Homo sapiens
ttccagagtccggaggcagca

SEQ ID NO: 6532192 - DNA, 15 bp, Homo sapiens
ttccagagttgttgt

SEQ ID NO: 6532193 - DNA, 22 bp, Homo sapiens
ttccagatcccaggcccctgga

SEQ ID NO: 6532194 - DNA, 16 bp, Homo sapiens
ttccagatcctctctg

SEQ ID NO: 6532195 - DNA, 19 bp, Homo sapiens
ttccagatcctggaaatca

SEQ ID NO: 6532196 - DNA, 16 bp, Homo sapiens
ttccagatctttcaga

SEQ ID NO: 6532197 - DNA, 20 bp, Homo sapiens
ttccagatctttcagaaata

SEQ ID NO: 6532198 - DNA, 17 bp, Homo sapiens
ttccagatgcccgagca

SEQ ID NO: 6532199 - DNA, 18 bp, Homo sapiens
ttccagatgctatcacag

SEQ ID NO: 6532200 - DNA, 22 bp, Homo sapiens
ttccagatgtctaaaagattct

SEQ ID NO: 6532201 - DNA, 15 bp, Homo sapiens
ttccagattcccagc

SEQ ID NO: 6532202 - DNA, 14 bp, Homo sapiens
ttccagattcctat

SEQ ID NO: 6532203 - DNA, 16 bp, Homo sapiens
ttccagattcctatga

SEQ ID NO: 6532204 - DNA, 19 bp, Homo sapiens
ttccagattgggggccctg

SEQ ID NO: 6532205 - DNA, 14 bp, Homo sapiens
ttccagattgttct

SEQ ID NO: 6532206 - DNA, 22 bp, Homo sapiens
ttccagattttaaattttatgt

SEQ ID NO: 6532207 - DNA, 14 bp, Homo sapiens
ttccagcaaaatcc

SEQ ID NO: 6532208 - DNA, 15 bp, Homo sapiens
ttccagcaaaatcca

SEQ ID NO: 6532209 - DNA, 18 bp, Homo sapiens
ttccagcaaaatccaaac

SEQ ID NO: 6532210 - DNA, 16 bp, Homo sapiens
ttccagcaaaatggaa

SEQ ID NO: 6532211 - DNA, 17 bp, Homo sapiens
ttccagcaaaatggaag

SEQ ID NO: 6532212 - DNA, 15 bp, Homo sapiens
ttccagcaagcaaag

SEQ ID NO: 6532213 - DNA, 11 bp, Homo sapiens
ttccagcaata

SEQ ID NO: 6532214 - DNA, 13 bp, Homo sapiens
ttccagcaataag

SEQ ID NO: 6532215 - DNA, 16 bp, Homo sapiens
ttccagcaataagaaa

SEQ ID NO: 6532216 - DNA, 19 bp, Homo sapiens
ttccagcaataagaaatga

SEQ ID NO: 6532217 - DNA, 20 bp, Homo sapiens
ttccagcaataagaaatgaa

SEQ ID NO: 6532218 - DNA, 18 bp, Homo sapiens
ttccagcagctgcacccc

SEQ ID NO: 6532219 - DNA, 13 bp, Homo sapiens
ttccagcaggagg

SEQ ID NO: 6532220 - DNA, 23 bp, Homo sapiens
ttccagcaggagggacagtctca

SEQ ID NO: 6532221 - DNA, 21 bp, Homo sapiens
ttccagcagtgaaacttgtgc

SEQ ID NO: 6532222 - DNA, 21 bp, Homo sapiens
ttccagcatgtaaagagctgg

SEQ ID NO: 6532223 - DNA, 15 bp, Homo sapiens
ttccagccaaagcat

SEQ ID NO: 6532224 - DNA, 18 bp, Homo sapiens
ttccagccaggcccaggc

SEQ ID NO: 6532225 - DNA, 15 bp, Homo sapiens
ttccagccagggctg

SEQ ID NO: 6532226 - DNA, 16 bp, Homo sapiens
ttccagccagggctgc

SEQ ID NO: 6532227 - DNA, 12 bp, Homo sapiens
ttccagccatca

SEQ ID NO: 6532228 - DNA, 14 bp, Homo sapiens
ttccagccattctg

SEQ ID NO: 6532229 - DNA, 20 bp, Homo sapiens
ttccagcccagacatcctgt

SEQ ID NO: 6532230 - DNA, 14 bp, Homo sapiens
ttccagcccctctg

SEQ ID NO: 6532231 - DNA, 16 bp, Homo sapiens
ttccagcccctctggt

SEQ ID NO: 6532232 - DNA, 20 bp, Homo sapiens
ttccagcccctctggtcgct

SEQ ID NO: 6532233 - DNA, 19 bp, Homo sapiens
ttccagcctatagcagaag

SEQ ID NO: 6532234 - DNA, 12 bp, Homo sapiens
ttccagcctgcc

SEQ ID NO: 6532235 - DNA, 16 bp, Homo sapiens
ttccagcctgccactc

SEQ ID NO: 6532236 - DNA, 12 bp, Homo sapiens
ttccagcctggg

SEQ ID NO: 6532237 - DNA, 15 bp, Homo sapiens
ttccagcctgggaca

SEQ ID NO: 6532238 - DNA, 20 bp, Homo sapiens
ttccagcctgggacacacac

SEQ ID NO: 6532239 - DNA, 15 bp, Homo sapiens
ttccagcgggccctc

SEQ ID NO: 6532240 - DNA, 13 bp, Homo sapiens
ttccagctcagtc

SEQ ID NO: 6532241 - DNA, 15 bp, Homo sapiens
ttccagctcagtccc

SEQ ID NO: 6532242 - DNA, 19 bp, Homo sapiens
ttccagctcattcatttta

SEQ ID NO: 6532243 - DNA, 18 bp, Homo sapiens
ttccagctccctcccctg

SEQ ID NO: 6532244 - DNA, 16 bp, Homo sapiens
ttccagctccgtgttt

SEQ ID NO: 6532245 - DNA, 18 bp, Homo sapiens
ttccagctccgtgtttct

SEQ ID NO: 6532246 - DNA, 21 bp, Homo sapiens
ttccagctccgtgtttctcta

SEQ ID NO: 6532247 - DNA, 18 bp, Homo sapiens
ttccagctctcccatgga

SEQ ID NO: 6532248 - DNA, 13 bp, Homo sapiens
ttccagctctgcc

SEQ ID NO: 6532249 - DNA, 14 bp, Homo sapiens
ttccagctctgccc

SEQ ID NO: 6532250 - DNA, 16 bp, Homo sapiens
ttccagctctgccccc

SEQ ID NO: 6532251 - DNA, 21 bp, Homo sapiens
ttccagctctgcccccgcggg

SEQ ID NO: 6532252 - DNA, 15 bp, Homo sapiens
ttccagctgctgtct

SEQ ID NO: 6532253 - DNA, 22 bp, Homo sapiens
ttccagctgctgtcttctggac

SEQ ID NO: 6532254 - DNA, 14 bp, Homo sapiens
tggtcacacactga

SEQ ID NO: 6532255 - DNA, 13 bp, Homo sapiens
tggtcacagaccc

SEQ ID NO: 6532256 - DNA, 14 bp, Homo sapiens
tggtcacagacccc

SEQ ID NO: 6532257 - DNA, 21 bp, Homo sapiens
tggtcacagacccctggggga

SEQ ID NO: 6532258 - DNA, 14 bp, Homo sapiens
tggtcacagccagg

SEQ ID NO: 6532259 - DNA, 13 bp, Homo sapiens
tggtcacagcctc

SEQ ID NO: 6532260 - DNA, 16 bp, Homo sapiens
tggtcacagcctcctc

SEQ ID NO: 6532261 - DNA, 17 bp, Homo sapiens
tggtcacagcctcctct

SEQ ID NO: 6532262 - DNA, 18 bp, Homo sapiens
tggtcacagcctcctctg

SEQ ID NO: 6532263 - DNA, 15 bp, Homo sapiens
tggtcacagcggagg

SEQ ID NO: 6532264 - DNA, 21 bp, Homo sapiens
tggtcacagcggaggtgtgga

SEQ ID NO: 6532265 - DNA, 22 bp, Homo sapiens
tggtcacaggactctgcctcct

SEQ ID NO: 6532266 - DNA, 13 bp, Homo sapiens
tggtcacaggctg

SEQ ID NO: 6532267 - DNA, 20 bp, Homo sapiens
tggtcacagtaaagagtaca

SEQ ID NO: 6532268 - DNA, 20 bp, Homo sapiens
tggtcacagtcctatgtaca

SEQ ID NO: 6532269 - DNA, 22 bp, Homo sapiens
tggtcacagtcctatgtacaga

SEQ ID NO: 6532270 - DNA, 23 bp, Homo sapiens
tggtcaccaaatcagctgctact

SEQ ID NO: 6532271 - DNA, 17 bp, Homo sapiens
tggtcaccaaggcagtg

SEQ ID NO: 6532272 - DNA, 22 bp, Homo sapiens
tggtcaccaaggcagtgcatgc

SEQ ID NO: 6532273 - DNA, 15 bp, Homo sapiens
tggtcaccagctcct

SEQ ID NO: 6532274 - DNA, 14 bp, Homo sapiens
tggtcaccatgaaa

SEQ ID NO: 6532275 - DNA, 16 bp, Homo sapiens
tggtcaccatgaaact

SEQ ID NO: 6532276 - DNA, 13 bp, Homo sapiens
tggtcaccctcag

SEQ ID NO: 6532277 - DNA, 15 bp, Homo sapiens
tggtcaccctcagga

SEQ ID NO: 6532278 - DNA, 18 bp, Homo sapiens
tggtcaccctggggctgc

SEQ ID NO: 6532279 - DNA, 22 bp, Homo sapiens
tggtcaccctggggctgcttag

SEQ ID NO: 6532280 - DNA, 16 bp, Homo sapiens
tggtcacccttaatat

SEQ ID NO: 6532281 - DNA, 22 bp, Homo sapiens
tggtcaccgagactcagcctct

SEQ ID NO: 6532282 - DNA, 16 bp, Homo sapiens
tggtcacctaggaagc

SEQ ID NO: 6532283 - DNA, 21 bp, Homo sapiens
tggtcacctaggaagcctcag

SEQ ID NO: 6532284 - DNA, 22 bp, Homo sapiens
tggtcacctaggaagcctcaga

SEQ ID NO: 6532285 - DNA, 19 bp, Homo sapiens
tggtcaccttcctctgcct

SEQ ID NO: 6532286 - DNA, 19 bp, Homo sapiens
tggtcacggatttgtgtct

SEQ ID NO: 6532287 - DNA, 19 bp, Homo sapiens
tggtcacgtttggtgcttc

SEQ ID NO: 6532288 - DNA, 18 bp, Homo sapiens
tggtcactaaccaacaag

SEQ ID NO: 6532289 - DNA, 13 bp, Homo sapiens
tggtcactccagt

SEQ ID NO: 6532290 - DNA, 14 bp, Homo sapiens
tggtcactccagta

SEQ ID NO: 6532291 - DNA, 14 bp, Homo sapiens
tggtcactgctgtc

SEQ ID NO: 6532292 - DNA, 20 bp, Homo sapiens
tggtcactggtcagggcagt

SEQ ID NO: 6532293 - DNA, 19 bp, Homo sapiens
tggtcactgtgcactgccc

SEQ ID NO: 6532294 - DNA, 22 bp, Homo sapiens
tggtcacttaaaatgtgcagta

SEQ ID NO: 6532295 - DNA, 24 bp, Homo sapiens
tggtcacttcaaacatgccctcag

SEQ ID NO: 6532296 - DNA, 19 bp, Homo sapiens
tggtcagaactgcagggcc

SEQ ID NO: 6532297 - DNA, 22 bp, Homo sapiens
tggtcagacacaaacaaacaag

SEQ ID NO: 6532298 - DNA, 12 bp, Homo sapiens
tggtcagagcca

SEQ ID NO: 6532299 - DNA, 14 bp, Homo sapiens
tggtcagagcccag

SEQ ID NO: 6532300 - DNA, 10 bp, Homo sapiens
tggtcagagg

SEQ ID NO: 6532301 - DNA, 22 bp, Homo sapiens
tggtcagagggactgtcagctg

SEQ ID NO: 6532302 - DNA, 17 bp, Homo sapiens
tggtcagagtgaattga

SEQ ID NO: 6532303 - DNA, 15 bp, Homo sapiens
tggtcagagtgccac

SEQ ID NO: 6532304 - DNA, 17 bp, Homo sapiens
tggtcagagtgccactg

SEQ ID NO: 6532305 - DNA, 21 bp, Homo sapiens
tggtcagcagatgccagtgaa

SEQ ID NO: 6532306 - DNA, 19 bp, Homo sapiens
tggtcagccctagggtgga

SEQ ID NO: 6532307 - DNA, 20 bp, Homo sapiens
tggtcagcgattcctgccaa

SEQ ID NO: 6532308 - DNA, 18 bp, Homo sapiens
tggtcagcggcctgggga

SEQ ID NO: 6532309 - DNA, 14 bp, Homo sapiens
tggtcagctcacac

SEQ ID NO: 6532310 - DNA, 19 bp, Homo sapiens
tggtcagctcccttctctg

SEQ ID NO: 6532311 - DNA, 17 bp, Homo sapiens
tggtcagcttgctcaga

SEQ ID NO: 6532312 - DNA, 15 bp, Homo sapiens
tggtcagcttttgtt

SEQ ID NO: 6532313 - DNA, 20 bp, Homo sapiens
tggtcaggaagtttgcagat

SEQ ID NO: 6532314 - DNA, 23 bp, Homo sapiens
tggtcaggagggtcaccctggcc

SEQ ID NO: 6532315 - DNA, 19 bp, Homo sapiens
tggtcaggatctcatgaca

SEQ ID NO: 6532316 - DNA, 18 bp, Homo sapiens
tggtcaggcccactgcag

SEQ ID NO: 6532317 - DNA, 15 bp, Homo sapiens
tggtcaggcccagcc

SEQ ID NO: 6532318 - DNA, 17 bp, Homo sapiens
tggtcaggcccagcctc

SEQ ID NO: 6532319 - DNA, 15 bp, Homo sapiens
tggtcaggccctggt

SEQ ID NO: 6532320 - DNA, 13 bp, Homo sapiens
tggtcaggctggt

SEQ ID NO: 6532321 - DNA, 13 bp, Homo sapiens
tggtcagggcagt

SEQ ID NO: 6532322 - DNA, 15 bp, Homo sapiens
tggtcagggcagtgg

SEQ ID NO: 6532323 - DNA, 21 bp, Homo sapiens
tggtcaggtatttcagttctt

SEQ ID NO: 6532324 - DNA, 19 bp, Homo sapiens
tggtcaggtccccatggct

SEQ ID NO: 6532325 - DNA, 22 bp, Homo sapiens
tggtcagtagtttcatgtttta

SEQ ID NO: 6532326 - DNA, 15 bp, Homo sapiens
tggtcagtctttgct

SEQ ID NO: 6532327 - DNA, 21 bp, Homo sapiens
tggtcagtgtggagaggggtg

SEQ ID NO: 6532328 - DNA, 21 bp, Homo sapiens
tggtcatagcccagatcagct

SEQ ID NO: 6532329 - DNA, 19 bp, Homo sapiens
tggtcatcagtattgtgta

SEQ ID NO: 6532330 - DNA, 21 bp, Homo sapiens
tggtcatccttggtgctcttg

SEQ ID NO: 6532331 - DNA, 19 bp, Homo sapiens
tggtcatcgagatggagct

SEQ ID NO: 6532332 - DNA, 18 bp, Homo sapiens
tggtcatctctcctgtgt

SEQ ID NO: 6532333 - DNA, 15 bp, Homo sapiens
tggtcatgaatagaa

SEQ ID NO: 6532334 - DNA, 13 bp, Homo sapiens
tggtcatgctcag

SEQ ID NO: 6532335 - DNA, 14 bp, Homo sapiens
tggtcatgctcagc

SEQ ID NO: 6532336 - DNA, 21 bp, Homo sapiens
tggtcatgctcagccttgctg

SEQ ID NO: 6532337 - DNA, 13 bp, Homo sapiens
tggtcatggacag

SEQ ID NO: 6532338 - DNA, 18 bp, Homo sapiens
tggtcatgggtctgccct

SEQ ID NO: 6532339 - DNA, 20 bp, Homo sapiens
tggtcatgtgagtctgggat

SEQ ID NO: 6532340 - DNA, 21 bp, Homo sapiens
tggtcatgtgagtctgggata

SEQ ID NO: 6532341 - DNA, 23 bp, Homo sapiens
tggtcattcatatcactatgaac

SEQ ID NO: 6532342 - DNA, 16 bp, Homo sapiens
tggtcatttcccccaa

SEQ ID NO: 6532343 - DNA, 22 bp, Homo sapiens
tggtcatttggcagcccctgtt

SEQ ID NO: 6532344 - DNA, 18 bp, Homo sapiens
tggtcatttggtggctct

SEQ ID NO: 6532345 - DNA, 18 bp, Homo sapiens
tggtcattttatgttaag

SEQ ID NO: 6532346 - DNA, 23 bp, Homo sapiens
tggtccaaaagattgctgaaatt

SEQ ID NO: 6532347 - DNA, 21 bp, Homo sapiens
tggtccaaaataaaacctcag

SEQ ID NO: 6532348 - DNA, 14 bp, Homo sapiens
tggtccaacagttt

SEQ ID NO: 6532349 - DNA, 16 bp, Homo sapiens
tggtccaactgcaact

SEQ ID NO: 6532350 - DNA, 15 bp, Homo sapiens
tggtccaagattccg

SEQ ID NO: 6532351 - DNA, 18 bp, Homo sapiens
tggtccaattagtttcct

SEQ ID NO: 6532352 - DNA, 23 bp, Homo sapiens
tggtccaattagtttccttttta

SEQ ID NO: 6532353 - DNA, 23 bp, Homo sapiens
tggtccacactagaaagaagctc

SEQ ID NO: 6532354 - DNA, 13 bp, Homo sapiens
tggtccacagggc

SEQ ID NO: 6532355 - DNA, 15 bp, Homo sapiens
tggtccacagggcac

SEQ ID NO: 6532356 - DNA, 22 bp, Homo sapiens
tggtccacagggctcctgaagg

SEQ ID NO: 6532357 - DNA, 17 bp, Homo sapiens
tggtccacattctgctg

SEQ ID NO: 6532358 - DNA, 12 bp, Homo sapiens
tggtccactgtg

SEQ ID NO: 6532359 - DNA, 13 bp, Homo sapiens
tggtccactgtgt

SEQ ID NO: 6532360 - DNA, 17 bp, Homo sapiens
tggtccagaaacaaaaa

SEQ ID NO: 6532361 - DNA, 13 bp, Homo sapiens
tggtccagaaact

SEQ ID NO: 6532362 - DNA, 21 bp, Homo sapiens
tggtccagaaactcctgtttc

SEQ ID NO: 6532363 - DNA, 21 bp, Homo sapiens
tggtccagaagaaattattta

SEQ ID NO: 6532364 - DNA, 14 bp, Homo sapiens
tggtccagcctggt

SEQ ID NO: 6532365 - DNA, 15 bp, Homo sapiens
tggtccagctctgac

SEQ ID NO: 6532366 - DNA, 16 bp, Homo sapiens
tggtccagctctgaca

SEQ ID NO: 6532367 - DNA, 18 bp, Homo sapiens
tggtccagctctgacatc

SEQ ID NO: 6532368 - DNA, 20 bp, Homo sapiens
tggtccagctctgacatccc

SEQ ID NO: 6532369 - DNA, 15 bp, Homo sapiens
tggtccagctcttgg

SEQ ID NO: 6532370 - DNA, 13 bp, Homo sapiens
tggtccaggccag

SEQ ID NO: 6532371 - DNA, 19 bp, Homo sapiens
tggtccaggccctgtggca

SEQ ID NO: 6532372 - DNA, 16 bp, Homo sapiens
tggtccagggtccagc

SEQ ID NO: 6532373 - DNA, 21 bp, Homo sapiens
tggtccaggtcttcagtttcc

SEQ ID NO: 6532374 - DNA, 22 bp, Homo sapiens
tggtccagtcgggaggagcagc

SEQ ID NO: 6532375 - DNA, 23 bp, Homo sapiens
tggtccagtttctagagggcact

SEQ ID NO: 6532376 - DNA, 14 bp, Homo sapiens
tggtccatctcatt

SEQ ID NO: 6532377 - DNA, 15 bp, Homo sapiens
tggtccatgcagggg

SEQ ID NO: 6532378 - DNA, 12 bp, Homo sapiens
tggtccatgccc

SEQ ID NO: 6532379 - DNA, 13 bp, Homo sapiens
tggtccatgccca

SEQ ID NO: 6532380 - DNA, 18 bp, Homo sapiens
tggtccatgcccactgct

SEQ ID NO: 6532381 - DNA, 19 bp, Homo sapiens
tggtccatgcccactgctg

SEQ ID NO: 6532382 - DNA, 15 bp, Homo sapiens
tggtccatgctgatg

SEQ ID NO: 6532383 - DNA, 16 bp, Homo sapiens
tggtccatttgttcct

SEQ ID NO: 6532384 - DNA, 21 bp, Homo sapiens
tggtcccaacaggaggacaat

SEQ ID NO: 6532385 - DNA, 18 bp, Homo sapiens
tggtcccaagacagtgag

SEQ ID NO: 6532386 - DNA, 13 bp, Homo sapiens
tggtcccacccca

SEQ ID NO: 6532387 - DNA, 17 bp, Homo sapiens
tggtcccacttcacagc

SEQ ID NO: 6532388 - DNA, 20 bp, Homo sapiens
tggtcccacttccccatctg

SEQ ID NO: 6532389 - DNA, 17 bp, Homo sapiens
tggtcccaggaagcagg

SEQ ID NO: 6532390 - DNA, 13 bp, Homo sapiens
tggtcccatccag

SEQ ID NO: 6532391 - DNA, 15 bp, Homo sapiens
tggtcccatccaggc

SEQ ID NO: 6532392 - DNA, 17 bp, Homo sapiens
tggtcccatccaggcag

SEQ ID NO: 6532393 - DNA, 18 bp, Homo sapiens
tggtcccatccaggcagt

SEQ ID NO: 6532394 - DNA, 13 bp, Homo sapiens
tggtcccatggct

SEQ ID NO: 6532395 - DNA, 20 bp, Homo sapiens
tggtccccaaaacactgtct

SEQ ID NO: 6532396 - DNA, 19 bp, Homo sapiens
tggtccccaacaatgtgag

SEQ ID NO: 6532397 - DNA, 14 bp, Homo sapiens
tggtcccccttcca

SEQ ID NO: 6532398 - DNA, 13 bp, Homo sapiens
tggtcccctccct

SEQ ID NO: 6532399 - DNA, 18 bp, Homo sapiens
tggtcccctccctcgtgg

SEQ ID NO: 6532400 - DNA, 21 bp, Homo sapiens
tggtcccctccctcgtgggct

SEQ ID NO: 6532401 - DNA, 20 bp, Homo sapiens
tggtcccgtggatgctcttt

SEQ ID NO: 6532402 - DNA, 21 bp, Homo sapiens
tggtccctaaatttgcatgaa

SEQ ID NO: 6532403 - DNA, 14 bp, Homo sapiens
tggtccctgggagg

SEQ ID NO: 6532404 - DNA, 19 bp, Homo sapiens
tggtccctgggaggaaatt

SEQ ID NO: 6532405 - DNA, 21 bp, Homo sapiens
tggtccctgggccaccgggca

SEQ ID NO: 6532406 - DNA, 13 bp, Homo sapiens
tggtcccttcagt

SEQ ID NO: 6532407 - DNA, 18 bp, Homo sapiens
tggtcccttccaatgctg

SEQ ID NO: 6532408 - DNA, 23 bp, Homo sapiens
tggtcccttgtatcccctgcagg

SEQ ID NO: 6532409 - DNA, 22 bp, Homo sapiens
tggtccgtgcgggaaattcagt

SEQ ID NO: 6532410 - DNA, 18 bp, Homo sapiens
tggtccgtgctaaggact

SEQ ID NO: 6532411 - DNA, 17 bp, Homo sapiens
tggtcctaaaagcaaaa

SEQ ID NO: 6532412 - DNA, 12 bp, Homo sapiens
tggtcctaccca

SEQ ID NO: 6532413 - DNA, 17 bp, Homo sapiens
tggtcctagaggccctt

SEQ ID NO: 6532414 - DNA, 21 bp, Homo sapiens
tggtcctagaggccctttgct

SEQ ID NO: 6532415 - DNA, 23 bp, Homo sapiens
tggtcctaggctggaaggaggaa

SEQ ID NO: 6532416 - DNA, 21 bp, Homo sapiens
tggtcctatttttgtgaagag

SEQ ID NO: 6532417 - DNA, 23 bp, Homo sapiens
tggtcctcacaagcctcttctga

SEQ ID NO: 6532418 - DNA, 16 bp, Homo sapiens
tggtcctccctcccaa

SEQ ID NO: 6532419 - DNA, 17 bp, Homo sapiens
tggtcctccgcctactg

SEQ ID NO: 6532420 - DNA, 23 bp, Homo sapiens
tggtcctccgcctactgtccctc

SEQ ID NO: 6532421 - DNA, 23 bp, Homo sapiens
tggtcctctctctgtggggctga

SEQ ID NO: 6532422 - DNA, 19 bp, Homo sapiens
tggtcctctgatttcacat

SEQ ID NO: 6532423 - DNA, 19 bp, Homo sapiens
tggtcctgactcaacatgt

SEQ ID NO: 6532424 - DNA, 18 bp, Homo sapiens
tggtcctgacttccctgg

SEQ ID NO: 6532425 - DNA, 17 bp, Homo sapiens
tggtcctgcacatgagt

SEQ ID NO: 6532426 - DNA, 13 bp, Homo sapiens
tggtcctgctgca

SEQ ID NO: 6532427 - DNA, 15 bp, Homo sapiens
tggtcctgctgcagt

SEQ ID NO: 6532428 - DNA, 20 bp, Homo sapiens
tggtcctggacacctcccag

SEQ ID NO: 6532429 - DNA, 20 bp, Homo sapiens
tggtcctggaggctcaaatt

SEQ ID NO: 6532430 - DNA, 17 bp, Homo sapiens
tggtcctggctgcactc

SEQ ID NO: 6532431 - DNA, 20 bp, Homo sapiens
ttccagctgtcactctgtgc

SEQ ID NO: 6532432 - DNA, 18 bp, Homo sapiens
ttccagcttcaggcacca

SEQ ID NO: 6532433 - DNA, 22 bp, Homo sapiens
ttccagcttcaggcaccagcat

SEQ ID NO: 6532434 - DNA, 16 bp, Homo sapiens
ttccagcttccagaac

SEQ ID NO: 6532435 - DNA, 18 bp, Homo sapiens
ttccagcttccagaactg

SEQ ID NO: 6532436 - DNA, 19 bp, Homo sapiens
ttccagcttcctctgagcc

SEQ ID NO: 6532437 - DNA, 13 bp, Homo sapiens
ttccagcttttgt

SEQ ID NO: 6532438 - DNA, 21 bp, Homo sapiens
ttccaggaaactccacatctg

SEQ ID NO: 6532439 - DNA, 18 bp, Homo sapiens
ttccaggaagatccagga

SEQ ID NO: 6532440 - DNA, 17 bp, Homo sapiens
ttccaggaagcacaggc

SEQ ID NO: 6532441 - DNA, 16 bp, Homo sapiens
ttccaggaatgctggg

SEQ ID NO: 6532442 - DNA, 18 bp, Homo sapiens
ttccaggaatgctgggcc

SEQ ID NO: 6532443 - DNA, 14 bp, Homo sapiens
ttccaggaattcct

SEQ ID NO: 6532444 - DNA, 14 bp, Homo sapiens
ttccaggactcttt

SEQ ID NO: 6532445 - DNA, 16 bp, Homo sapiens
ttccaggactgtttca

SEQ ID NO: 6532446 - DNA, 18 bp, Homo sapiens
ttccaggagaaagccggg

SEQ ID NO: 6532447 - DNA, 18 bp, Homo sapiens
ttccaggagacatatata

SEQ ID NO: 6532448 - DNA, 21 bp, Homo sapiens
ttccaggagcacacggccctg

SEQ ID NO: 6532449 - DNA, 23 bp, Homo sapiens
ttccaggagcacacggccctgcc

SEQ ID NO: 6532450 - DNA, 23 bp, Homo sapiens
ttccaggaggagttagccaaaca

SEQ ID NO: 6532451 - DNA, 17 bp, Homo sapiens
ttccaggagttctgaag

SEQ ID NO: 6532452 - DNA, 14 bp, Homo sapiens
ttccaggatggtgt

SEQ ID NO: 6532453 - DNA, 11 bp, Homo sapiens
ttccaggcagc

SEQ ID NO: 6532454 - DNA, 11 bp, Homo sapiens
ttccaggcccc

SEQ ID NO: 6532455 - DNA, 17 bp, Homo sapiens
ttccaggccccaggctg

SEQ ID NO: 6532456 - DNA, 19 bp, Homo sapiens
ttccaggccccaggctgga

SEQ ID NO: 6532457 - DNA, 13 bp, Homo sapiens
ttccaggcccctg

SEQ ID NO: 6532458 - DNA, 16 bp, Homo sapiens
ttccaggccctccagt

SEQ ID NO: 6532459 - DNA, 19 bp, Homo sapiens
ttccaggcgtagggccagg

SEQ ID NO: 6532460 - DNA, 11 bp, Homo sapiens
ttccaggctga

SEQ ID NO: 6532461 - DNA, 15 bp, Homo sapiens
ttccaggctgagcca

SEQ ID NO: 6532462 - DNA, 20 bp, Homo sapiens
ttccaggctgcatagaagga

SEQ ID NO: 6532463 - DNA, 15 bp, Homo sapiens
ttccaggctgggaga

SEQ ID NO: 6532464 - DNA, 17 bp, Homo sapiens
ttccaggctgggagagc

SEQ ID NO: 6532465 - DNA, 12 bp, Homo sapiens
ttccaggctgtg

SEQ ID NO: 6532466 - DNA, 22 bp, Homo sapiens
ttccaggcttctgctggggcct

SEQ ID NO: 6532467 - DNA, 19 bp, Homo sapiens
ttccagggcataaaactca

SEQ ID NO: 6532468 - DNA, 14 bp, Homo sapiens
ttccagggctgggg

SEQ ID NO: 6532469 - DNA, 15 bp, Homo sapiens
ttccaggggaacctg

SEQ ID NO: 6532470 - DNA, 17 bp, Homo sapiens
ttccaggggaacctgcc

SEQ ID NO: 6532471 - DNA, 18 bp, Homo sapiens
ttccaggggaacctgcca

SEQ ID NO: 6532472 - DNA, 21 bp, Homo sapiens
ttccaggggtgggacaccctg

SEQ ID NO: 6532473 - DNA, 22 bp, Homo sapiens
ttccagggtcaaagtacagaat

SEQ ID NO: 6532474 - DNA, 22 bp, Homo sapiens
ttccagggtctttactgggaag

SEQ ID NO: 6532475 - DNA, 16 bp, Homo sapiens
ttccaggtaacaggtg

SEQ ID NO: 6532476 - DNA, 22 bp, Homo sapiens
ttccaggtagctgaaaggggaa

SEQ ID NO: 6532477 - DNA, 17 bp, Homo sapiens
ttccaggtatctccagg

SEQ ID NO: 6532478 - DNA, 15 bp, Homo sapiens
ttccaggtctgcctg

SEQ ID NO: 6532479 - DNA, 17 bp, Homo sapiens
ttccaggtctgcctggt

SEQ ID NO: 6532480 - DNA, 19 bp, Homo sapiens
ttccaggtgcctggccctt

SEQ ID NO: 6532481 - DNA, 17 bp, Homo sapiens
ttccaggtgtttatagt

SEQ ID NO: 6532482 - DNA, 13 bp, Homo sapiens
ttccagtaacttt

SEQ ID NO: 6532483 - DNA, 17 bp, Homo sapiens
ttccagtacctttgtca

SEQ ID NO: 6532484 - DNA, 18 bp, Homo sapiens
ttccagtacctttgtcac

SEQ ID NO: 6532485 - DNA, 14 bp, Homo sapiens
ttccagtattgaaa

SEQ ID NO: 6532486 - DNA, 15 bp, Homo sapiens
ttccagtattgaaaa

SEQ ID NO: 6532487 - DNA, 12 bp, Homo sapiens
ttccagtcacat

SEQ ID NO: 6532488 - DNA, 22 bp, Homo sapiens
ttccagtcaggctctctgggct

SEQ ID NO: 6532489 - DNA, 14 bp, Homo sapiens
ttccagtcctaaca

SEQ ID NO: 6532490 - DNA, 17 bp, Homo sapiens
ttccagtcctaacaaat

SEQ ID NO: 6532491 - DNA, 22 bp, Homo sapiens
ttccagtcgggggaactgaggc

SEQ ID NO: 6532492 - DNA, 18 bp, Homo sapiens
ttccagtctctgcatgta

SEQ ID NO: 6532493 - DNA, 22 bp, Homo sapiens
ttccagtgaaatcagttactct

SEQ ID NO: 6532494 - DNA, 17 bp, Homo sapiens
ttccagtgaacattccc

SEQ ID NO: 6532495 - DNA, 23 bp, Homo sapiens
ttccagtgaacattcccagccca

SEQ ID NO: 6532496 - DNA, 16 bp, Homo sapiens
ttccagtgaggctctg

SEQ ID NO: 6532497 - DNA, 22 bp, Homo sapiens
ttccagtgatgtgtgagctatg

SEQ ID NO: 6532498 - DNA, 22 bp, Homo sapiens
ttccagtgcagtagtgccaaaa

SEQ ID NO: 6532499 - DNA, 13 bp, Homo sapiens
ttccagtgcatgt

SEQ ID NO: 6532500 - DNA, 14 bp, Homo sapiens
ttccagtggatgag

SEQ ID NO: 6532501 - DNA, 17 bp, Homo sapiens
ttccagtggcctggctc

SEQ ID NO: 6532502 - DNA, 14 bp, Homo sapiens
ttccagtggcttct

SEQ ID NO: 6532503 - DNA, 17 bp, Homo sapiens
ttccagtgggttatctt

SEQ ID NO: 6532504 - DNA, 22 bp, Homo sapiens
ttccagtggtcatgctcagcct

SEQ ID NO: 6532505 - DNA, 18 bp, Homo sapiens
ttccagtgtccttagaac

SEQ ID NO: 6532506 - DNA, 11 bp, Homo sapiens
ttccagtgtgt

SEQ ID NO: 6532507 - DNA, 13 bp, Homo sapiens
ttccagtgttcta

SEQ ID NO: 6532508 - DNA, 20 bp, Homo sapiens
ttccagtgttggctgtgtga

SEQ ID NO: 6532509 - DNA, 16 bp, Homo sapiens
ttccagttaacctatt

SEQ ID NO: 6532510 - DNA, 22 bp, Homo sapiens
ttccagttcatctatggcagtc

SEQ ID NO: 6532511 - DNA, 18 bp, Homo sapiens
ttccagttgcgtgtctgt

SEQ ID NO: 6532512 - DNA, 17 bp, Homo sapiens
ttccagttgctgtggac

SEQ ID NO: 6532513 - DNA, 13 bp, Homo sapiens
ttccagtttctcc

SEQ ID NO: 6532514 - DNA, 17 bp, Homo sapiens
ttccagtttctccttga

SEQ ID NO: 6532515 - DNA, 20 bp, Homo sapiens
ttccagtttgtttattactt

SEQ ID NO: 6532516 - DNA, 15 bp, Homo sapiens
ttccataaacaccca

SEQ ID NO: 6532517 - DNA, 15 bp, Homo sapiens
ttccataagctattt

SEQ ID NO: 6532518 - DNA, 16 bp, Homo sapiens
ttccataagctatttt

SEQ ID NO: 6532519 - DNA, 17 bp, Homo sapiens
ttccataaggaatgtag

SEQ ID NO: 6532520 - DNA, 22 bp, Homo sapiens
ttccataatctggactcctctg

SEQ ID NO: 6532521 - DNA, 19 bp, Homo sapiens
ttccataatgtataaagaa

SEQ ID NO: 6532522 - DNA, 13 bp, Homo sapiens
ttccataattatg

SEQ ID NO: 6532523 - DNA, 14 bp, Homo sapiens
ttccataattatga

SEQ ID NO: 6532524 - DNA, 22 bp, Homo sapiens
ttccatacgtgcccatttcaca

SEQ ID NO: 6532525 - DNA, 17 bp, Homo sapiens
ttccatacttctctcag

SEQ ID NO: 6532526 - DNA, 18 bp, Homo sapiens
ttccataggaatcatgtt

SEQ ID NO: 6532527 - DNA, 23 bp, Homo sapiens
ttccatagtatattaaaaatggt

SEQ ID NO: 6532528 - DNA, 16 bp, Homo sapiens
ttccatagttaaagaa

SEQ ID NO: 6532529 - DNA, 23 bp, Homo sapiens
ttccatatccgggtgctcaataa

SEQ ID NO: 6532530 - DNA, 21 bp, Homo sapiens
ttccatatcttgcgaatccaa

SEQ ID NO: 6532531 - DNA, 14 bp, Homo sapiens
ttccatatgctcca

SEQ ID NO: 6532532 - DNA, 22 bp, Homo sapiens
ttccatatggatccactggctg

SEQ ID NO: 6532533 - DNA, 12 bp, Homo sapiens
ttccatattaaa

SEQ ID NO: 6532534 - DNA, 18 bp, Homo sapiens
ttccatattaaaatcaca

SEQ ID NO: 6532535 - DNA, 21 bp, Homo sapiens
ttccatattagaaaactttgt

SEQ ID NO: 6532536 - DNA, 14 bp, Homo sapiens
ttccatattcatgt

SEQ ID NO: 6532537 - DNA, 13 bp, Homo sapiens
ttccatatttgga

SEQ ID NO: 6532538 - DNA, 13 bp, Homo sapiens
ttccatatttttt

SEQ ID NO: 6532539 - DNA, 23 bp, Homo sapiens
ttccatatttttttccttacata

SEQ ID NO: 6532540 - DNA, 21 bp, Homo sapiens
ttccatcaaagccctccctgt

SEQ ID NO: 6532541 - DNA, 20 bp, Homo sapiens
ttccatcacagccagcccag

SEQ ID NO: 6532542 - DNA, 19 bp, Homo sapiens
ttccatcaccccaacctct

SEQ ID NO: 6532543 - DNA, 15 bp, Homo sapiens
ttccatcagcagtga

SEQ ID NO: 6532544 - DNA, 19 bp, Homo sapiens
ttccatcagcagtgattga

SEQ ID NO: 6532545 - DNA, 23 bp, Homo sapiens
ttccatcagcgggtctcctccca

SEQ ID NO: 6532546 - DNA, 15 bp, Homo sapiens
ttccatcagctttat

SEQ ID NO: 6532547 - DNA, 19 bp, Homo sapiens
ttccatcaggttccatccc

SEQ ID NO: 6532548 - DNA, 13 bp, Homo sapiens
ttccatcatcact

SEQ ID NO: 6532549 - DNA, 15 bp, Homo sapiens
ttccatcatcactgt

SEQ ID NO: 6532550 - DNA, 16 bp, Homo sapiens
ttccatcatcactgta

SEQ ID NO: 6532551 - DNA, 18 bp, Homo sapiens
ttccatcatcactgtaaa

SEQ ID NO: 6532552 - DNA, 19 bp, Homo sapiens
ttccatcatcactgtaaag

SEQ ID NO: 6532553 - DNA, 18 bp, Homo sapiens
ttccatcatcactttgga

SEQ ID NO: 6532554 - DNA, 23 bp, Homo sapiens
ttccatcatctcttttcccactc

SEQ ID NO: 6532555 - DNA, 16 bp, Homo sapiens
ttccatcatgtcccca

SEQ ID NO: 6532556 - DNA, 17 bp, Homo sapiens
ttccatcatgtccccaa

SEQ ID NO: 6532557 - DNA, 15 bp, Homo sapiens
ttccatcatgtctgt

SEQ ID NO: 6532558 - DNA, 13 bp, Homo sapiens
ttccatcatttta

SEQ ID NO: 6532559 - DNA, 19 bp, Homo sapiens
ttccatcattttacagtga

SEQ ID NO: 6532560 - DNA, 19 bp, Homo sapiens
ttccatccacctttcccaa

SEQ ID NO: 6532561 - DNA, 23 bp, Homo sapiens
ttccatccataaatccagttcta

SEQ ID NO: 6532562 - DNA, 22 bp, Homo sapiens
ttccatccatctttccatccat

SEQ ID NO: 6532563 - DNA, 15 bp, Homo sapiens
ttccatccatggcca

SEQ ID NO: 6532564 - DNA, 17 bp, Homo sapiens
ttccatccatggccagc

SEQ ID NO: 6532565 - DNA, 18 bp, Homo sapiens
ttccatccatggccagca

SEQ ID NO: 6532566 - DNA, 13 bp, Homo sapiens
ttccatcccactc

SEQ ID NO: 6532567 - DNA, 20 bp, Homo sapiens
ttccatcccctagaaatcct

SEQ ID NO: 6532568 - DNA, 12 bp, Homo sapiens
ttccatccctaa

SEQ ID NO: 6532569 - DNA, 20 bp, Homo sapiens
ttccatcctgaggtgcctcc

SEQ ID NO: 6532570 - DNA, 19 bp, Homo sapiens
ttccatcctgtacaagtgc

SEQ ID NO: 6532571 - DNA, 20 bp, Homo sapiens
ttccatcctgtacaagtgct

SEQ ID NO: 6532572 - DNA, 21 bp, Homo sapiens
ttccatcctgtacaagtgctc

SEQ ID NO: 6532573 - DNA, 22 bp, Homo sapiens
ttccatcctgtacaagtgctca

SEQ ID NO: 6532574 - DNA, 17 bp, Homo sapiens
ttccatccttgactgaa

SEQ ID NO: 6532575 - DNA, 19 bp, Homo sapiens
ttccatcctttgcatttct

SEQ ID NO: 6532576 - DNA, 21 bp, Homo sapiens
ttccatcctttgcatttctct

SEQ ID NO: 6532577 - DNA, 15 bp, Homo sapiens
ttccatctaaaatac

SEQ ID NO: 6532578 - DNA, 14 bp, Homo sapiens
ttccatctaggact

SEQ ID NO: 6532579 - DNA, 13 bp, Homo sapiens
ttccatctagttt

SEQ ID NO: 6532580 - DNA, 17 bp, Homo sapiens
ttccatctatcactgca

SEQ ID NO: 6532581 - DNA, 23 bp, Homo sapiens
ttccatctcgccacccctccttc

SEQ ID NO: 6532582 - DNA, 12 bp, Homo sapiens
ttccatctctgc

SEQ ID NO: 6532583 - DNA, 16 bp, Homo sapiens
ttccatctcttccttt

SEQ ID NO: 6532584 - DNA, 12 bp, Homo sapiens
ttccatctgatt

SEQ ID NO: 6532585 - DNA, 22 bp, Homo sapiens
ttccatctgcttgtattttcca

SEQ ID NO: 6532586 - DNA, 18 bp, Homo sapiens
ttccatcttacttgccct

SEQ ID NO: 6532587 - DNA, 23 bp, Homo sapiens
ttccatcttattcccaattaaaa

SEQ ID NO: 6532588 - DNA, 22 bp, Homo sapiens
ttccatcttctccccacagcct

SEQ ID NO: 6532589 - DNA, 12 bp, Homo sapiens
ttccatcttgct

SEQ ID NO: 6532590 - DNA, 16 bp, Homo sapiens
ttccatgaaggcagag

SEQ ID NO: 6532591 - DNA, 15 bp, Homo sapiens
ttccatgaatcgctt

SEQ ID NO: 6532592 - DNA, 20 bp, Homo sapiens
ttccatgaatgtatcaggaa

SEQ ID NO: 6532593 - DNA, 17 bp, Homo sapiens
ttccatgaatgttcctg

SEQ ID NO: 6532594 - DNA, 13 bp, Homo sapiens
ttccatgaatttt

SEQ ID NO: 6532595 - DNA, 13 bp, Homo sapiens
ttccatgacagta

SEQ ID NO: 6532596 - DNA, 14 bp, Homo sapiens
ttccatgacatttt

SEQ ID NO: 6532597 - DNA, 19 bp, Homo sapiens
ttccatgacctcccctccc

SEQ ID NO: 6532598 - DNA, 22 bp, Homo sapiens
ttccatgacctcccctccccag

SEQ ID NO: 6532599 - DNA, 18 bp, Homo sapiens
ttccatgagaacagcagg

SEQ ID NO: 6532600 - DNA, 15 bp, Homo sapiens
ttccatgatgcacag

SEQ ID NO: 6532601 - DNA, 20 bp, Homo sapiens
ttccatgatgcacagtatct

SEQ ID NO: 6532602 - DNA, 20 bp, Homo sapiens
ttccatgatggattcccccc

SEQ ID NO: 6532603 - DNA, 17 bp, Homo sapiens
ttccatgatgttacatt

SEQ ID NO: 6532604 - DNA, 17 bp, Homo sapiens
ttccatgattctattta

SEQ ID NO: 6532605 - DNA, 18 bp, Homo sapiens
ttccatgattctatttat

SEQ ID NO: 6532606 - DNA, 14 bp, Homo sapiens
ttccatgcaactgg

SEQ ID NO: 6532607 - DNA, 14 bp, Homo sapiens
ttccatgccccagg

SEQ ID NO: 6532608 - DNA, 15 bp, Homo sapiens
ttccatgccccagga

SEQ ID NO: 6532609 - DNA, 23 bp, Homo sapiens
ttccatgcccgagtccgcccatc

SEQ ID NO: 6532610 - DNA, 19 bp, Homo sapiens
tggtcctggctgcactctt

SEQ ID NO: 6532611 - DNA, 14 bp, Homo sapiens
tggtcctggtgctg

SEQ ID NO: 6532612 - DNA, 15 bp, Homo sapiens
tggtcctggtgctgc

SEQ ID NO: 6532613 - DNA, 21 bp, Homo sapiens
tggtcctgtcaccctggcccc

SEQ ID NO: 6532614 - DNA, 17 bp, Homo sapiens
tggtcctgtctgtcctt

SEQ ID NO: 6532615 - DNA, 18 bp, Homo sapiens
tggtcctgtctgtccttc

SEQ ID NO: 6532616 - DNA, 16 bp, Homo sapiens
tggtcctgtgccccga

SEQ ID NO: 6532617 - DNA, 20 bp, Homo sapiens
tggtcctgtgtgcagtgaag

SEQ ID NO: 6532618 - DNA, 16 bp, Homo sapiens
tggtccttaccagaga

SEQ ID NO: 6532619 - DNA, 22 bp, Homo sapiens
tggtccttaggagacgctgcac

SEQ ID NO: 6532620 - DNA, 15 bp, Homo sapiens
tggtccttagtaaat

SEQ ID NO: 6532621 - DNA, 17 bp, Homo sapiens
tggtccttagtaaattc

SEQ ID NO: 6532622 - DNA, 13 bp, Homo sapiens
tggtccttattta

SEQ ID NO: 6532623 - DNA, 22 bp, Homo sapiens
tggtccttcactggcgccttct

SEQ ID NO: 6532624 - DNA, 20 bp, Homo sapiens
tggtccttctcgtttgctct

SEQ ID NO: 6532625 - DNA, 14 bp, Homo sapiens
tggtcctttacact

SEQ ID NO: 6532626 - DNA, 15 bp, Homo sapiens
tggtcctttctggaa

SEQ ID NO: 6532627 - DNA, 18 bp, Homo sapiens
tggtcgccttccacctct

SEQ ID NO: 6532628 - DNA, 13 bp, Homo sapiens
tggtcgctcctgc

SEQ ID NO: 6532629 - DNA, 17 bp, Homo sapiens
tggtcggaaaacatgct

SEQ ID NO: 6532630 - DNA, 16 bp, Homo sapiens
tggtcggatctcacag

SEQ ID NO: 6532631 - DNA, 22 bp, Homo sapiens
tggtcgtcaactttcctcaaat

SEQ ID NO: 6532632 - DNA, 17 bp, Homo sapiens
tggtcgtcatgctgtcc

SEQ ID NO: 6532633 - DNA, 22 bp, Homo sapiens
tggtcgttttttttttgtttgt

SEQ ID NO: 6532634 - DNA, 12 bp, Homo sapiens
tggtctaaaact

SEQ ID NO: 6532635 - DNA, 22 bp, Homo sapiens
tggtctaatcctagtttgctgt

SEQ ID NO: 6532636 - DNA, 14 bp, Homo sapiens
tggtctaatgttta

SEQ ID NO: 6532637 - DNA, 15 bp, Homo sapiens
tggtctacactgtgc

SEQ ID NO: 6532638 - DNA, 19 bp, Homo sapiens
tggtctacactgtgctgag

SEQ ID NO: 6532639 - DNA, 17 bp, Homo sapiens
tggtctaccaagtaaga

SEQ ID NO: 6532640 - DNA, 21 bp, Homo sapiens
tggtctaccaatctgggaaga

SEQ ID NO: 6532641 - DNA, 15 bp, Homo sapiens
tggtctactctagaa

SEQ ID NO: 6532642 - DNA, 14 bp, Homo sapiens
tggtctagaccagg

SEQ ID NO: 6532643 - DNA, 22 bp, Homo sapiens
tggtctaggagctgtctccagg

SEQ ID NO: 6532644 - DNA, 16 bp, Homo sapiens
tggtctataaaataaa

SEQ ID NO: 6532645 - DNA, 22 bp, Homo sapiens
tggtctataaaataaacttctt

SEQ ID NO: 6532646 - DNA, 23 bp, Homo sapiens
tggtctataaaataaacttctta

SEQ ID NO: 6532647 - DNA, 23 bp, Homo sapiens
tggtctataagatgaaacatcat

SEQ ID NO: 6532648 - DNA, 13 bp, Homo sapiens
tggtctatttctc

SEQ ID NO: 6532649 - DNA, 17 bp, Homo sapiens
tggtctattttctgcag

SEQ ID NO: 6532650 - DNA, 18 bp, Homo sapiens
tggtctattttctgcaga

SEQ ID NO: 6532651 - DNA, 22 bp, Homo sapiens
tggtctcaaaatggtgtgctat

SEQ ID NO: 6532652 - DNA, 23 bp, Homo sapiens
tggtctcaaactcttgacctcag

SEQ ID NO: 6532653 - DNA, 23 bp, Homo sapiens
tggtctcaggatatccttatcag

SEQ ID NO: 6532654 - DNA, 15 bp, Homo sapiens
tggtctcatctcctt

SEQ ID NO: 6532655 - DNA, 19 bp, Homo sapiens
tggtctcatctcctttgct

SEQ ID NO: 6532656 - DNA, 14 bp, Homo sapiens
tggtctcatgcccc

SEQ ID NO: 6532657 - DNA, 21 bp, Homo sapiens
tggtctcatgtaacacataaa

SEQ ID NO: 6532658 - DNA, 18 bp, Homo sapiens
tggtctccacctgtgctt

SEQ ID NO: 6532659 - DNA, 13 bp, Homo sapiens
tggtctccagctc

SEQ ID NO: 6532660 - DNA, 20 bp, Homo sapiens
tggtctccagctcctctcca

SEQ ID NO: 6532661 - DNA, 18 bp, Homo sapiens
tggtctccatatcagctc

SEQ ID NO: 6532662 - DNA, 20 bp, Homo sapiens
tggtctccatttttcccagg

SEQ ID NO: 6532663 - DNA, 13 bp, Homo sapiens
tggtctcctccca

SEQ ID NO: 6532664 - DNA, 15 bp, Homo sapiens
tggtctcctctcagc

SEQ ID NO: 6532665 - DNA, 21 bp, Homo sapiens
tggtctcctctgattatcagg

SEQ ID NO: 6532666 - DNA, 16 bp, Homo sapiens
tggtctccttggaaat

SEQ ID NO: 6532667 - DNA, 18 bp, Homo sapiens
tggtctcgaactcctgac

SEQ ID NO: 6532668 - DNA, 17 bp, Homo sapiens
tggtctcgaactcctgg

SEQ ID NO: 6532669 - DNA, 18 bp, Homo sapiens
tggtctcgatgctgctgg

SEQ ID NO: 6532670 - DNA, 21 bp, Homo sapiens
tggtctcgatgctgctggcct

SEQ ID NO: 6532671 - DNA, 22 bp, Homo sapiens
tggtctcgtcttccgtctcccc

SEQ ID NO: 6532672 - DNA, 20 bp, Homo sapiens
tggtctcgtgttcgctggct

SEQ ID NO: 6532673 - DNA, 23 bp, Homo sapiens
tggtctcgtgttcgctggctgat

SEQ ID NO: 6532674 - DNA, 23 bp, Homo sapiens
tggtctctagagggttgctgcct

SEQ ID NO: 6532675 - DNA, 15 bp, Homo sapiens
tggtctctaggcctg

SEQ ID NO: 6532676 - DNA, 17 bp, Homo sapiens
tggtctctaggcctgaa

SEQ ID NO: 6532677 - DNA, 18 bp, Homo sapiens
tggtctctaggctgggga

SEQ ID NO: 6532678 - DNA, 21 bp, Homo sapiens
tggtctctctccctctgtctt

SEQ ID NO: 6532679 - DNA, 17 bp, Homo sapiens
tggtctctgcacccagt

SEQ ID NO: 6532680 - DNA, 15 bp, Homo sapiens
tggtctctgcatttt

SEQ ID NO: 6532681 - DNA, 13 bp, Homo sapiens
tggtctctgccat

SEQ ID NO: 6532682 - DNA, 17 bp, Homo sapiens
tggtctctggttcttga

SEQ ID NO: 6532683 - DNA, 13 bp, Homo sapiens
tggtctctttctt

SEQ ID NO: 6532684 - DNA, 18 bp, Homo sapiens
tggtctctttctttccaa

SEQ ID NO: 6532685 - DNA, 12 bp, Homo sapiens
tggtctgaatgt

SEQ ID NO: 6532686 - DNA, 22 bp, Homo sapiens
tggtctgaatgttctgacatta

SEQ ID NO: 6532687 - DNA, 20 bp, Homo sapiens
tggtctgagcaccccctcat

SEQ ID NO: 6532688 - DNA, 16 bp, Homo sapiens
tggtctgatttcagga

SEQ ID NO: 6532689 - DNA, 12 bp, Homo sapiens
tggtctgccaat

SEQ ID NO: 6532690 - DNA, 18 bp, Homo sapiens
tggtctgccaatctgtac

SEQ ID NO: 6532691 - DNA, 13 bp, Homo sapiens
tggtctgccagaa

SEQ ID NO: 6532692 - DNA, 17 bp, Homo sapiens
tggtctgccagaatact

SEQ ID NO: 6532693 - DNA, 13 bp, Homo sapiens
tggtctgcgcctt

SEQ ID NO: 6532694 - DNA, 19 bp, Homo sapiens
tggtctgctcaggaattga

SEQ ID NO: 6532695 - DNA, 18 bp, Homo sapiens
tggtctgctcgggcccag

SEQ ID NO: 6532696 - DNA, 21 bp, Homo sapiens
tggtctgctcgggcccaggcc

SEQ ID NO: 6532697 - DNA, 22 bp, Homo sapiens
tggtctgctggtgtcattgctg

SEQ ID NO: 6532698 - DNA, 19 bp, Homo sapiens
tggtctgcttaaagcttcc

SEQ ID NO: 6532699 - DNA, 21 bp, Homo sapiens
tggtctgcttaaagcttccct

SEQ ID NO: 6532700 - DNA, 22 bp, Homo sapiens
tggtctggaatggactgggtgc

SEQ ID NO: 6532701 - DNA, 18 bp, Homo sapiens
tggtctggagttgctgaa

SEQ ID NO: 6532702 - DNA, 16 bp, Homo sapiens
tggtctgggactctct

SEQ ID NO: 6532703 - DNA, 21 bp, Homo sapiens
tggtctgggacttccttgctc

SEQ ID NO: 6532704 - DNA, 18 bp, Homo sapiens
tggtctgggtggatgtga

SEQ ID NO: 6532705 - DNA, 23 bp, Homo sapiens
tggtctgggtggatgtgagcaga

SEQ ID NO: 6532706 - DNA, 13 bp, Homo sapiens
tggtctggtcagg

SEQ ID NO: 6532707 - DNA, 17 bp, Homo sapiens
tggtctggttcctgtgt

SEQ ID NO: 6532708 - DNA, 18 bp, Homo sapiens
tggtctggttcctgtgtg

SEQ ID NO: 6532709 - DNA, 15 bp, Homo sapiens
tggtctgtgaagagc

SEQ ID NO: 6532710 - DNA, 22 bp, Homo sapiens
tggtctgtgagatgctagaact

SEQ ID NO: 6532711 - DNA, 13 bp, Homo sapiens
tggtctgtgcatt

SEQ ID NO: 6532712 - DNA, 20 bp, Homo sapiens
tggtctgtggagatggactc

SEQ ID NO: 6532713 - DNA, 12 bp, Homo sapiens
tggtctgtgtgt

SEQ ID NO: 6532714 - DNA, 14 bp, Homo sapiens
tggtctgtgtgtgt

SEQ ID NO: 6532715 - DNA, 17 bp, Homo sapiens
tggtctgtgtgtgttct

SEQ ID NO: 6532716 - DNA, 18 bp, Homo sapiens
tggtctgttaatcttttt

SEQ ID NO: 6532717 - DNA, 14 bp, Homo sapiens
tggtctgttggcag

SEQ ID NO: 6532718 - DNA, 18 bp, Homo sapiens
tggtctgttggcaggctg

SEQ ID NO: 6532719 - DNA, 23 bp, Homo sapiens
tggtctgtttccaggtcagaaac

SEQ ID NO: 6532720 - DNA, 13 bp, Homo sapiens
tggtctgttttct

SEQ ID NO: 6532721 - DNA, 14 bp, Homo sapiens
tggtcttaaatgct

SEQ ID NO: 6532722 - DNA, 20 bp, Homo sapiens
tggtcttaaatgctcatttt

SEQ ID NO: 6532723 - DNA, 20 bp, Homo sapiens
tggtcttaactaatgtaaat

SEQ ID NO: 6532724 - DNA, 22 bp, Homo sapiens
tggtcttaactaatgtaaatat

SEQ ID NO: 6532725 - DNA, 20 bp, Homo sapiens
tggtcttacagcaggcagta

SEQ ID NO: 6532726 - DNA, 24 bp, Homo sapiens
tggtcttactttgttaatttatct

SEQ ID NO: 6532727 - DNA, 18 bp, Homo sapiens
tggtcttaggtcttcctg

SEQ ID NO: 6532728 - DNA, 19 bp, Homo sapiens
tggtcttaggtcttcctgt

SEQ ID NO: 6532729 - DNA, 13 bp, Homo sapiens
tggtcttatattt

SEQ ID NO: 6532730 - DNA, 13 bp, Homo sapiens
tggtcttatcctg

SEQ ID NO: 6532731 - DNA, 21 bp, Homo sapiens
tggtcttatgattttattaca

SEQ ID NO: 6532732 - DNA, 14 bp, Homo sapiens
tggtcttcagcctc

SEQ ID NO: 6532733 - DNA, 19 bp, Homo sapiens
tggtcttcagcctccctca

SEQ ID NO: 6532734 - DNA, 21 bp, Homo sapiens
tggtcttcagcctccctcagc

SEQ ID NO: 6532735 - DNA, 16 bp, Homo sapiens
tggtcttccatgggat

SEQ ID NO: 6532736 - DNA, 17 bp, Homo sapiens
tggtcttcccaggctgg

SEQ ID NO: 6532737 - DNA, 14 bp, Homo sapiens
tggtcttccttttt

SEQ ID NO: 6532738 - DNA, 11 bp, Homo sapiens
tggtcttctca

SEQ ID NO: 6532739 - DNA, 19 bp, Homo sapiens
tggtcttctctacagttca

SEQ ID NO: 6532740 - DNA, 20 bp, Homo sapiens
tggtcttgaactcttggcct

SEQ ID NO: 6532741 - DNA, 15 bp, Homo sapiens
tggtcttgaagtcct

SEQ ID NO: 6532742 - DNA, 20 bp, Homo sapiens
tggtcttgatcctccaatgt

SEQ ID NO: 6532743 - DNA, 18 bp, Homo sapiens
tggtcttgatctcctgag

SEQ ID NO: 6532744 - DNA, 22 bp, Homo sapiens
tggtcttgccctattataattg

SEQ ID NO: 6532745 - DNA, 20 bp, Homo sapiens
tggtcttggaattccatttg

SEQ ID NO: 6532746 - DNA, 12 bp, Homo sapiens
tggtcttggaga

SEQ ID NO: 6532747 - DNA, 16 bp, Homo sapiens
tggtcttgtggaattg

SEQ ID NO: 6532748 - DNA, 19 bp, Homo sapiens
tggtcttgtttccaggagc

SEQ ID NO: 6532749 - DNA, 14 bp, Homo sapiens
tggtctttccatct

SEQ ID NO: 6532750 - DNA, 14 bp, Homo sapiens
tggtctttctgtgc

SEQ ID NO: 6532751 - DNA, 20 bp, Homo sapiens
tggtctttcttacaaggaag

SEQ ID NO: 6532752 - DNA, 10 bp, Homo sapiens
tggtctttga

SEQ ID NO: 6532753 - DNA, 15 bp, Homo sapiens
tggtctttgaataaa

SEQ ID NO: 6532754 - DNA, 18 bp, Homo sapiens
tggtctttgaataaagtc

SEQ ID NO: 6532755 - DNA, 11 bp, Homo sapiens
tggtctttgag

SEQ ID NO: 6532756 - DNA, 14 bp, Homo sapiens
tggtctttgctcca

SEQ ID NO: 6532757 - DNA, 21 bp, Homo sapiens
tggtctttgtaagagtgtaga

SEQ ID NO: 6532758 - DNA, 23 bp, Homo sapiens
tggtctttgtaagagtgtagaag

SEQ ID NO: 6532759 - DNA, 12 bp, Homo sapiens
tggtcttttcct

SEQ ID NO: 6532760 - DNA, 23 bp, Homo sapiens
tggtgaaaccaaacaaatacaaa

SEQ ID NO: 6532761 - DNA, 19 bp, Homo sapiens
tggtgaaacccccatctct

SEQ ID NO: 6532762 - DNA, 13 bp, Homo sapiens
tggtgaaagagta

SEQ ID NO: 6532763 - DNA, 16 bp, Homo sapiens
tggtgaaataataaaa

SEQ ID NO: 6532764 - DNA, 11 bp, Homo sapiens
tggtgaaatct

SEQ ID NO: 6532765 - DNA, 20 bp, Homo sapiens
tggtgaaattataactatta

SEQ ID NO: 6532766 - DNA, 16 bp, Homo sapiens
tggtgaacactgtgac

SEQ ID NO: 6532767 - DNA, 20 bp, Homo sapiens
tggtgaacagaacctcccaa

SEQ ID NO: 6532768 - DNA, 14 bp, Homo sapiens
tggtgaacatttta

SEQ ID NO: 6532769 - DNA, 16 bp, Homo sapiens
tggtgaactgaagcag

SEQ ID NO: 6532770 - DNA, 13 bp, Homo sapiens
tggtgaagagtag

SEQ ID NO: 6532771 - DNA, 20 bp, Homo sapiens
tggtgaagggaagtggggag

SEQ ID NO: 6532772 - DNA, 12 bp, Homo sapiens
tggtgaaggggc

SEQ ID NO: 6532773 - DNA, 19 bp, Homo sapiens
tggtgaaggggctggtgga

SEQ ID NO: 6532774 - DNA, 23 bp, Homo sapiens
tggtgaagtaaattaggcagtgc

SEQ ID NO: 6532775 - DNA, 15 bp, Homo sapiens
tggtgaagtgcttgg

SEQ ID NO: 6532776 - DNA, 16 bp, Homo sapiens
tggtgaagtgtgactt

SEQ ID NO: 6532777 - DNA, 13 bp, Homo sapiens
tggtgaagtgtgg

SEQ ID NO: 6532778 - DNA, 17 bp, Homo sapiens
tggtgaagtgtggctgg

SEQ ID NO: 6532779 - DNA, 15 bp, Homo sapiens
tggtgaagtttgtca

SEQ ID NO: 6532780 - DNA, 15 bp, Homo sapiens
tggtgaataaaacct

SEQ ID NO: 6532781 - DNA, 18 bp, Homo sapiens
tggtgaataactatgcca

SEQ ID NO: 6532782 - DNA, 13 bp, Homo sapiens
tggtgaatattgt

SEQ ID NO: 6532783 - DNA, 14 bp, Homo sapiens
tggtgaatcacctg

SEQ ID NO: 6532784 - DNA, 14 bp, Homo sapiens
tggtgaatggattt

SEQ ID NO: 6532785 - DNA, 19 bp, Homo sapiens
tggtgaatggccttccttc

SEQ ID NO: 6532786 - DNA, 13 bp, Homo sapiens
tggtgaatttgaa

SEQ ID NO: 6532787 - DNA, 14 bp, Homo sapiens
tggtgacacacagc

SEQ ID NO: 6532788 - DNA, 15 bp, Homo sapiens
tggtgacagccttgg

SEQ ID NO: 6532789 - DNA, 13 bp, Homo sapiens
ttccatgcctgag

SEQ ID NO: 6532790 - DNA, 18 bp, Homo sapiens
ttccatgcctgagggtgg

SEQ ID NO: 6532791 - DNA, 23 bp, Homo sapiens
ttccatgcctgagggtggagact

SEQ ID NO: 6532792 - DNA, 18 bp, Homo sapiens
ttccatgcctgctctcga

SEQ ID NO: 6532793 - DNA, 15 bp, Homo sapiens
ttccatgcctggccc

SEQ ID NO: 6532794 - DNA, 18 bp, Homo sapiens
ttccatgcgtgtttctga

SEQ ID NO: 6532795 - DNA, 16 bp, Homo sapiens
ttccatgctaagcaag

SEQ ID NO: 6532796 - DNA, 23 bp, Homo sapiens
ttccatgctgtgcgcccagggct

SEQ ID NO: 6532797 - DNA, 17 bp, Homo sapiens
ttccatggcaggaaggc

SEQ ID NO: 6532798 - DNA, 16 bp, Homo sapiens
ttccatggcctcttca

SEQ ID NO: 6532799 - DNA, 23 bp, Homo sapiens
ttccatgggactttccttccctc

SEQ ID NO: 6532800 - DNA, 17 bp, Homo sapiens
ttccatgggcccgctgc

SEQ ID NO: 6532801 - DNA, 22 bp, Homo sapiens
ttccatgggcccgctgcctctt

SEQ ID NO: 6532802 - DNA, 17 bp, Homo sapiens
ttccatgggttgaacaa

SEQ ID NO: 6532803 - DNA, 17 bp, Homo sapiens
ttccatgtatcttttga

SEQ ID NO: 6532804 - DNA, 18 bp, Homo sapiens
ttccatgtcgcctctgca

SEQ ID NO: 6532805 - DNA, 20 bp, Homo sapiens
ttccatgtcgcctctgcatt

SEQ ID NO: 6532806 - DNA, 19 bp, Homo sapiens
ttccatgtctccattttct

SEQ ID NO: 6532807 - DNA, 16 bp, Homo sapiens
ttccatgtgaaaataa

SEQ ID NO: 6532808 - DNA, 23 bp, Homo sapiens
ttccatgtgagggttttcagcat

SEQ ID NO: 6532809 - DNA, 17 bp, Homo sapiens
ttccatgtgcccagtta

SEQ ID NO: 6532810 - DNA, 20 bp, Homo sapiens
ttccatgtgcctttctttgc

SEQ ID NO: 6532811 - DNA, 23 bp, Homo sapiens
ttccatgtgcctttctttgcctc

SEQ ID NO: 6532812 - DNA, 15 bp, Homo sapiens
ttccatgttgctgcc

SEQ ID NO: 6532813 - DNA, 20 bp, Homo sapiens
ttccatgttttgttttcttg

SEQ ID NO: 6532814 - DNA, 21 bp, Homo sapiens
ttccatgttttttcttcaaat

SEQ ID NO: 6532815 - DNA, 23 bp, Homo sapiens
ttccattaaacgatttttaaaat

SEQ ID NO: 6532816 - DNA, 17 bp, Homo sapiens
ttccattaacaaatgct

SEQ ID NO: 6532817 - DNA, 15 bp, Homo sapiens
ttccattaacagcaa

SEQ ID NO: 6532818 - DNA, 22 bp, Homo sapiens
ttccattaataactgaataaaa

SEQ ID NO: 6532819 - DNA, 23 bp, Homo sapiens
ttccattaataactgaataaaaa

SEQ ID NO: 6532820 - DNA, 19 bp, Homo sapiens
ttccattagtaaaacacaa

SEQ ID NO: 6532821 - DNA, 15 bp, Homo sapiens
ttccattatgaaaat

SEQ ID NO: 6532822 - DNA, 19 bp, Homo sapiens
ttccattatgaaaatctta

SEQ ID NO: 6532823 - DNA, 14 bp, Homo sapiens
ttccattatgattc

SEQ ID NO: 6532824 - DNA, 15 bp, Homo sapiens
ttccattatgattct

SEQ ID NO: 6532825 - DNA, 16 bp, Homo sapiens
ttccattatgttcatc

SEQ ID NO: 6532826 - DNA, 20 bp, Homo sapiens
ttccattattgagttcctcc

SEQ ID NO: 6532827 - DNA, 15 bp, Homo sapiens
ttccattcagacaat

SEQ ID NO: 6532828 - DNA, 15 bp, Homo sapiens
ttccattcatggata

SEQ ID NO: 6532829 - DNA, 16 bp, Homo sapiens
ttccattccagaatat

SEQ ID NO: 6532830 - DNA, 16 bp, Homo sapiens
ttccattccattgttt

SEQ ID NO: 6532831 - DNA, 13 bp, Homo sapiens
ttccattccttca

SEQ ID NO: 6532832 - DNA, 13 bp, Homo sapiens
ttccattcgcatg

SEQ ID NO: 6532833 - DNA, 15 bp, Homo sapiens
ttccattctatgact

SEQ ID NO: 6532834 - DNA, 14 bp, Homo sapiens
ttccattctttctt

SEQ ID NO: 6532835 - DNA, 16 bp, Homo sapiens
ttccattctttcttcc

SEQ ID NO: 6532836 - DNA, 18 bp, Homo sapiens
ttccattgacatttgaat

SEQ ID NO: 6532837 - DNA, 15 bp, Homo sapiens
ttccattgaccagct

SEQ ID NO: 6532838 - DNA, 23 bp, Homo sapiens
ttccattgccgccgcgggtgtgc

SEQ ID NO: 6532839 - DNA, 16 bp, Homo sapiens
ttccattgctcccagt

SEQ ID NO: 6532840 - DNA, 13 bp, Homo sapiens
ttccattgcttat

SEQ ID NO: 6532841 - DNA, 21 bp, Homo sapiens
ttccattgctttgaaaaagtt

SEQ ID NO: 6532842 - DNA, 14 bp, Homo sapiens
ttccattggaaata

SEQ ID NO: 6532843 - DNA, 17 bp, Homo sapiens
ttccattggtccaagat

SEQ ID NO: 6532844 - DNA, 19 bp, Homo sapiens
ttccattggtccaagattc

SEQ ID NO: 6532845 - DNA, 24 bp, Homo sapiens
ttccattggttcttcctttccctg

SEQ ID NO: 6532846 - DNA, 13 bp, Homo sapiens
ttccattgtgtga

SEQ ID NO: 6532847 - DNA, 13 bp, Homo sapiens
ttccattgtttaa

SEQ ID NO: 6532848 - DNA, 13 bp, Homo sapiens
ttccattgtttta

SEQ ID NO: 6532849 - DNA, 18 bp, Homo sapiens
ttccatttacttaagact

SEQ ID NO: 6532850 - DNA, 19 bp, Homo sapiens
ttccatttatctttctaca

SEQ ID NO: 6532851 - DNA, 16 bp, Homo sapiens
ttccatttctactgta

SEQ ID NO: 6532852 - DNA, 13 bp, Homo sapiens
ttccatttctcaa

SEQ ID NO: 6532853 - DNA, 11 bp, Homo sapiens
ttccatttctg

SEQ ID NO: 6532854 - DNA, 12 bp, Homo sapiens
ttccatttctga

SEQ ID NO: 6532855 - DNA, 16 bp, Homo sapiens
ttccatttcttcagag

SEQ ID NO: 6532856 - DNA, 18 bp, Homo sapiens
ttccatttcttcagaggg

SEQ ID NO: 6532857 - DNA, 13 bp, Homo sapiens
ttccatttcttct

SEQ ID NO: 6532858 - DNA, 17 bp, Homo sapiens
ttccatttgcaagggaa

SEQ ID NO: 6532859 - DNA, 19 bp, Homo sapiens
ttccatttggcactatggt

SEQ ID NO: 6532860 - DNA, 11 bp, Homo sapiens
ttccatttgtc

SEQ ID NO: 6532861 - DNA, 11 bp, Homo sapiens
ttccattttat

SEQ ID NO: 6532862 - DNA, 12 bp, Homo sapiens
ttccattttatg

SEQ ID NO: 6532863 - DNA, 16 bp, Homo sapiens
ttccattttatgcaga

SEQ ID NO: 6532864 - DNA, 16 bp, Homo sapiens
ttccattttcccccac

SEQ ID NO: 6532865 - DNA, 14 bp, Homo sapiens
ttccattttggaaa

SEQ ID NO: 6532866 - DNA, 23 bp, Homo sapiens
ttccattttggcgctattacaaa

SEQ ID NO: 6532867 - DNA, 22 bp, Homo sapiens
ttccatttttcctctgttcaca

SEQ ID NO: 6532868 - DNA, 23 bp, Homo sapiens
ttccatttttcctctgttcacaa

SEQ ID NO: 6532869 - DNA, 16 bp, Homo sapiens
ttccattttttgtatt

SEQ ID NO: 6532870 - DNA, 17 bp, Homo sapiens
ttcccaaaacaatctat

SEQ ID NO: 6532871 - DNA, 19 bp, Homo sapiens
ttcccaaaacaatctattt

SEQ ID NO: 6532872 - DNA, 17 bp, Homo sapiens
ttcccaaaacaatggtg

SEQ ID NO: 6532873 - DNA, 19 bp, Homo sapiens
ttcccaaaatgttgaaata

SEQ ID NO: 6532874 - DNA, 22 bp, Homo sapiens
ttcccaaaatgttgaaatatga

SEQ ID NO: 6532875 - DNA, 17 bp, Homo sapiens
ttcccaaaattagggag

SEQ ID NO: 6532876 - DNA, 23 bp, Homo sapiens
ttcccaaaattagggagctcttg

SEQ ID NO: 6532877 - DNA, 13 bp, Homo sapiens
ttcccaaagcact

SEQ ID NO: 6532878 - DNA, 23 bp, Homo sapiens
ttcccaaagcagtgcatgctgtc

SEQ ID NO: 6532879 - DNA, 23 bp, Homo sapiens
ttcccaaaggcattataaaaaga

SEQ ID NO: 6532880 - DNA, 15 bp, Homo sapiens
ttcccaaagggaggg

SEQ ID NO: 6532881 - DNA, 18 bp, Homo sapiens
ttcccaaagtgaactctc

SEQ ID NO: 6532882 - DNA, 18 bp, Homo sapiens
ttcccaacccccagcccc

SEQ ID NO: 6532883 - DNA, 21 bp, Homo sapiens
ttcccaaccccttaagccctg

SEQ ID NO: 6532884 - DNA, 17 bp, Homo sapiens
ttcccaacctcctgtgg

SEQ ID NO: 6532885 - DNA, 15 bp, Homo sapiens
ttcccaacgtgcaaa

SEQ ID NO: 6532886 - DNA, 15 bp, Homo sapiens
ttcccaactgcaagt

SEQ ID NO: 6532887 - DNA, 21 bp, Homo sapiens
ttcccaagaaaggaaaccttt

SEQ ID NO: 6532888 - DNA, 14 bp, Homo sapiens
ttcccaagaaatgc

SEQ ID NO: 6532889 - DNA, 20 bp, Homo sapiens
ttcccaagagcatcatgcct

SEQ ID NO: 6532890 - DNA, 16 bp, Homo sapiens
ttcccaagatgcctga

SEQ ID NO: 6532891 - DNA, 21 bp, Homo sapiens
ttcccaagctagactgtgtct

SEQ ID NO: 6532892 - DNA, 11 bp, Homo sapiens
ttcccaagctc

SEQ ID NO: 6532893 - DNA, 16 bp, Homo sapiens
ttcccaagctctgctc

SEQ ID NO: 6532894 - DNA, 19 bp, Homo sapiens
ttcccaaggcagctggatt

SEQ ID NO: 6532895 - DNA, 13 bp, Homo sapiens
ttcccaagggaga

SEQ ID NO: 6532896 - DNA, 16 bp, Homo sapiens
ttcccaagtatgcctt

SEQ ID NO: 6532897 - DNA, 21 bp, Homo sapiens
ttcccaagtatgccttaagca

SEQ ID NO: 6532898 - DNA, 16 bp, Homo sapiens
ttcccaagtattgcga

SEQ ID NO: 6532899 - DNA, 23 bp, Homo sapiens
ttcccaagtgagtctctctgggc

SEQ ID NO: 6532900 - DNA, 23 bp, Homo sapiens
ttcccaatagcaacgtagcttct

SEQ ID NO: 6532901 - DNA, 15 bp, Homo sapiens
ttcccaatatgtagc

SEQ ID NO: 6532902 - DNA, 18 bp, Homo sapiens
ttcccaatcagcactgaa

SEQ ID NO: 6532903 - DNA, 18 bp, Homo sapiens
ttcccaatctgaaattca

SEQ ID NO: 6532904 - DNA, 17 bp, Homo sapiens
ttcccaatgatcttgca

SEQ ID NO: 6532905 - DNA, 12 bp, Homo sapiens
ttcccaatggtg

SEQ ID NO: 6532906 - DNA, 21 bp, Homo sapiens
ttcccaatggtgtttttcttg

SEQ ID NO: 6532907 - DNA, 22 bp, Homo sapiens
ttcccaatggtgtttttcttgt

SEQ ID NO: 6532908 - DNA, 16 bp, Homo sapiens
ttcccaattgccacat

SEQ ID NO: 6532909 - DNA, 19 bp, Homo sapiens
ttcccacaaaagacagacc

SEQ ID NO: 6532910 - DNA, 20 bp, Homo sapiens
ttcccacaaaagacagaccc

SEQ ID NO: 6532911 - DNA, 21 bp, Homo sapiens
ttcccacaaaagacagaccca

SEQ ID NO: 6532912 - DNA, 19 bp, Homo sapiens
ttcccacacatattcaaat

SEQ ID NO: 6532913 - DNA, 16 bp, Homo sapiens
ttcccacacctccaca

SEQ ID NO: 6532914 - DNA, 21 bp, Homo sapiens
ttcccacacctccacagttca

SEQ ID NO: 6532915 - DNA, 16 bp, Homo sapiens
ttcccacacctgcctg

SEQ ID NO: 6532916 - DNA, 17 bp, Homo sapiens
ttcccacacctgcctgc

SEQ ID NO: 6532917 - DNA, 18 bp, Homo sapiens
ttcccacacctgcctgcg

SEQ ID NO: 6532918 - DNA, 15 bp, Homo sapiens
ttcccacacggcagc

SEQ ID NO: 6532919 - DNA, 17 bp, Homo sapiens
ttcccacacggcagccc

SEQ ID NO: 6532920 - DNA, 15 bp, Homo sapiens
ttcccacactgaaat

SEQ ID NO: 6532921 - DNA, 16 bp, Homo sapiens
ttcccacactgaaatt

SEQ ID NO: 6532922 - DNA, 13 bp, Homo sapiens
ttcccacagcatt

SEQ ID NO: 6532923 - DNA, 15 bp, Homo sapiens
ttcccacatctttcc

SEQ ID NO: 6532924 - DNA, 15 bp, Homo sapiens
ttcccacatgcctgc

SEQ ID NO: 6532925 - DNA, 16 bp, Homo sapiens
ttcccacatttgtctt

SEQ ID NO: 6532926 - DNA, 23 bp, Homo sapiens
ttcccaccaactctctctgcccc

SEQ ID NO: 6532927 - DNA, 16 bp, Homo sapiens
ttcccaccagctccca

SEQ ID NO: 6532928 - DNA, 19 bp, Homo sapiens
ttcccacccactagccctc

SEQ ID NO: 6532929 - DNA, 16 bp, Homo sapiens
ttcccacccagcctgg

SEQ ID NO: 6532930 - DNA, 17 bp, Homo sapiens
ttcccacccaggaaagg

SEQ ID NO: 6532931 - DNA, 14 bp, Homo sapiens
ttcccacccatctc

SEQ ID NO: 6532932 - DNA, 22 bp, Homo sapiens
ttcccacccccaggcaaggctg

SEQ ID NO: 6532933 - DNA, 22 bp, Homo sapiens
ttcccacccctacacacacact

SEQ ID NO: 6532934 - DNA, 23 bp, Homo sapiens
ttcccacccctcatacctacacc

SEQ ID NO: 6532935 - DNA, 12 bp, Homo sapiens
ttcccaccctcc

SEQ ID NO: 6532936 - DNA, 21 bp, Homo sapiens
ttcccaccctccacctctcac

SEQ ID NO: 6532937 - DNA, 16 bp, Homo sapiens
ttcccacctccctgcc

SEQ ID NO: 6532938 - DNA, 18 bp, Homo sapiens
ttcccacctctctcccca

SEQ ID NO: 6532939 - DNA, 17 bp, Homo sapiens
ttcccacctctgaggac

SEQ ID NO: 6532940 - DNA, 19 bp, Homo sapiens
ttcccacgtgggcctccca

SEQ ID NO: 6532941 - DNA, 22 bp, Homo sapiens
ttcccacgttgacaccaagaaa

SEQ ID NO: 6532942 - DNA, 19 bp, Homo sapiens
ttcccactaagctttctcc

SEQ ID NO: 6532943 - DNA, 21 bp, Homo sapiens
ttcccactaagctttctcctt

SEQ ID NO: 6532944 - DNA, 15 bp, Homo sapiens
ttcccactcaccccg

SEQ ID NO: 6532945 - DNA, 13 bp, Homo sapiens
ttcccactcacct

SEQ ID NO: 6532946 - DNA, 17 bp, Homo sapiens
ttcccactcagcagtga

SEQ ID NO: 6532947 - DNA, 11 bp, Homo sapiens
ttcccactccc

SEQ ID NO: 6532948 - DNA, 14 bp, Homo sapiens
ttcccactccttca

SEQ ID NO: 6532949 - DNA, 18 bp, Homo sapiens
ttcccactctagggcagt

SEQ ID NO: 6532950 - DNA, 15 bp, Homo sapiens
ttcccactgaaatgg

SEQ ID NO: 6532951 - DNA, 13 bp, Homo sapiens
ttcccactgcacc

SEQ ID NO: 6532952 - DNA, 19 bp, Homo sapiens
ttcccactgcaccccctcc

SEQ ID NO: 6532953 - DNA, 24 bp, Homo sapiens
ttcccactgcaccccctcctgctg

SEQ ID NO: 6532954 - DNA, 20 bp, Homo sapiens
ttcccactgcactccagcct

SEQ ID NO: 6532955 - DNA, 15 bp, Homo sapiens
ttcccactgcacttg

SEQ ID NO: 6532956 - DNA, 18 bp, Homo sapiens
ttcccactggcctcaagt

SEQ ID NO: 6532957 - DNA, 17 bp, Homo sapiens
ttcccactgtcctttct

SEQ ID NO: 6532958 - DNA, 13 bp, Homo sapiens
ttcccacttccac

SEQ ID NO: 6532959 - DNA, 16 bp, Homo sapiens
ttcccactttttggta

SEQ ID NO: 6532960 - DNA, 22 bp, Homo sapiens
ttcccagaaatacaacagaagt

SEQ ID NO: 6532961 - DNA, 23 bp, Homo sapiens
ttcccagaaccttgatggggtga

SEQ ID NO: 6532962 - DNA, 23 bp, Homo sapiens
ttcccagaatatatttaaatgca

SEQ ID NO: 6532963 - DNA, 18 bp, Homo sapiens
ttcccagagaacttcaca

SEQ ID NO: 6532964 - DNA, 20 bp, Homo sapiens
ttcccagagaagctcattta

SEQ ID NO: 6532965 - DNA, 17 bp, Homo sapiens
ttcccagagagacgctg

SEQ ID NO: 6532966 - DNA, 18 bp, Homo sapiens
ttcccagagcaaaataat

SEQ ID NO: 6532967 - DNA, 19 bp, Homo sapiens
tggtgacaggacgctgacc

SEQ ID NO: 6532968 - DNA, 15 bp, Homo sapiens
tggtgacaggcagac

SEQ ID NO: 6532969 - DNA, 16 bp, Homo sapiens
tggtgacaggcagaca

SEQ ID NO: 6532970 - DNA, 21 bp, Homo sapiens
tggtgacatttcccaagtcag

SEQ ID NO: 6532971 - DNA, 13 bp, Homo sapiens
tggtgaccagact

SEQ ID NO: 6532972 - DNA, 14 bp, Homo sapiens
tggtgaccagactt

SEQ ID NO: 6532973 - DNA, 15 bp, Homo sapiens
tggtgaccagtttct

SEQ ID NO: 6532974 - DNA, 14 bp, Homo sapiens
tggtgacctcacac

SEQ ID NO: 6532975 - DNA, 17 bp, Homo sapiens
tggtgacctctgcctga

SEQ ID NO: 6532976 - DNA, 19 bp, Homo sapiens
tggtgacctgatgtaaaca

SEQ ID NO: 6532977 - DNA, 22 bp, Homo sapiens
tggtgaccttccaagagcctga

SEQ ID NO: 6532978 - DNA, 15 bp, Homo sapiens
tggtgacctttttaa

SEQ ID NO: 6532979 - DNA, 21 bp, Homo sapiens
tggtgacgtggtagtcacttg

SEQ ID NO: 6532980 - DNA, 20 bp, Homo sapiens
tggtgactcctgaaacctct

SEQ ID NO: 6532981 - DNA, 22 bp, Homo sapiens
tggtgactcgggggctgtctca

SEQ ID NO: 6532982 - DNA, 16 bp, Homo sapiens
tggtgactgattcttc

SEQ ID NO: 6532983 - DNA, 15 bp, Homo sapiens
tggtgactgtcccac

SEQ ID NO: 6532984 - DNA, 16 bp, Homo sapiens
tggtgacttctgctgc

SEQ ID NO: 6532985 - DNA, 19 bp, Homo sapiens
tggtgacttgtctgcctcc

SEQ ID NO: 6532986 - DNA, 21 bp, Homo sapiens
tggtgacttgtctgcctcctg

SEQ ID NO: 6532987 - DNA, 18 bp, Homo sapiens
tggtgactttggataata

SEQ ID NO: 6532988 - DNA, 23 bp, Homo sapiens
tggtgactttggataataaggaa

SEQ ID NO: 6532989 - DNA, 20 bp, Homo sapiens
tggtgactttggggacaggg

SEQ ID NO: 6532990 - DNA, 14 bp, Homo sapiens
tggtgacttttgaa

SEQ ID NO: 6532991 - DNA, 14 bp, Homo sapiens
tggtgactttttaa

SEQ ID NO: 6532992 - DNA, 21 bp, Homo sapiens
tggtgagaaaatatatgcctg

SEQ ID NO: 6532993 - DNA, 20 bp, Homo sapiens
tggtgagaaacctgtatctt

SEQ ID NO: 6532994 - DNA, 23 bp, Homo sapiens
tggtgagaattaaaataaaacgt

SEQ ID NO: 6532995 - DNA, 14 bp, Homo sapiens
tggtgagaggcatc

SEQ ID NO: 6532996 - DNA, 17 bp, Homo sapiens
tggtgagatgcagctgg

SEQ ID NO: 6532997 - DNA, 19 bp, Homo sapiens
tggtgaggacctgcggcct

SEQ ID NO: 6532998 - DNA, 23 bp, Homo sapiens
tggtgaggacctgcggccttggg

SEQ ID NO: 6532999 - DNA, 18 bp, Homo sapiens
tggtgaggcccagcctgt

SEQ ID NO: 6533000 - DNA, 19 bp, Homo sapiens
tggtgaggcccagcctgtc

SEQ ID NO: 6533001 - DNA, 21 bp, Homo sapiens
tggtgaggcccagcctgtcct

SEQ ID NO: 6533002 - DNA, 17 bp, Homo sapiens
tggtgaggccggccctg

SEQ ID NO: 6533003 - DNA, 19 bp, Homo sapiens
tggtgaggccggccctgcc

SEQ ID NO: 6533004 - DNA, 20 bp, Homo sapiens
tggtgaggccggccctgccc

SEQ ID NO: 6533005 - DNA, 12 bp, Homo sapiens
tggtgaggggcc

SEQ ID NO: 6533006 - DNA, 23 bp, Homo sapiens
tggtgagggtgccccgcctgagt

SEQ ID NO: 6533007 - DNA, 19 bp, Homo sapiens
tggtgaggtggcccaggcc

SEQ ID NO: 6533008 - DNA, 20 bp, Homo sapiens
tggtgaggtggcccaggccc

SEQ ID NO: 6533009 - DNA, 17 bp, Homo sapiens
tggtgaggttgtggaga

SEQ ID NO: 6533010 - DNA, 19 bp, Homo sapiens
tggtgaggtttaaaggata

SEQ ID NO: 6533011 - DNA, 18 bp, Homo sapiens
tggtgagtcttggcggca

SEQ ID NO: 6533012 - DNA, 15 bp, Homo sapiens
tggtgataaggacat

SEQ ID NO: 6533013 - DNA, 12 bp, Homo sapiens
tggtgataagta

SEQ ID NO: 6533014 - DNA, 13 bp, Homo sapiens
tggtgataagtgg

SEQ ID NO: 6533015 - DNA, 18 bp, Homo sapiens
tggtgataagtggaaaaa

SEQ ID NO: 6533016 - DNA, 16 bp, Homo sapiens
tggtgatataaagaat

SEQ ID NO: 6533017 - DNA, 21 bp, Homo sapiens
tggtgatataaagaatgaaag

SEQ ID NO: 6533018 - DNA, 17 bp, Homo sapiens
tggtgatcaattaaatg

SEQ ID NO: 6533019 - DNA, 15 bp, Homo sapiens
tggtgatcctctatt

SEQ ID NO: 6533020 - DNA, 18 bp, Homo sapiens
tggtgatcctctattttg

SEQ ID NO: 6533021 - DNA, 21 bp, Homo sapiens
tggtgatctcccaagctatct

SEQ ID NO: 6533022 - DNA, 15 bp, Homo sapiens
tggtgatctgtagac

SEQ ID NO: 6533023 - DNA, 13 bp, Homo sapiens
tggtgatgcaagt

SEQ ID NO: 6533024 - DNA, 20 bp, Homo sapiens
tggtgatggaggtttcatac

SEQ ID NO: 6533025 - DNA, 14 bp, Homo sapiens
tggtgatgtaaaac

SEQ ID NO: 6533026 - DNA, 20 bp, Homo sapiens
tggtgatgtaaaacagaata

SEQ ID NO: 6533027 - DNA, 20 bp, Homo sapiens
tggtgatgtacgctgcgtgc

SEQ ID NO: 6533028 - DNA, 21 bp, Homo sapiens
tggtgatgtacgctgcgtgcc

SEQ ID NO: 6533029 - DNA, 20 bp, Homo sapiens
tggtgatgtcataataaagt

SEQ ID NO: 6533030 - DNA, 16 bp, Homo sapiens
tggtgatgtgcctgta

SEQ ID NO: 6533031 - DNA, 20 bp, Homo sapiens
tggtgattaaaatgagttta

SEQ ID NO: 6533032 - DNA, 20 bp, Homo sapiens
tggtgattaaggtcctgctt

SEQ ID NO: 6533033 - DNA, 22 bp, Homo sapiens
tggtgatttagcaggaagctgt

SEQ ID NO: 6533034 - DNA, 14 bp, Homo sapiens
tggtgatttgaaaa

SEQ ID NO: 6533035 - DNA, 21 bp, Homo sapiens
tggtgatttgaaaaatataaa

SEQ ID NO: 6533036 - DNA, 22 bp, Homo sapiens
tggtgatttgaaaaatataaaa

SEQ ID NO: 6533037 - DNA, 12 bp, Homo sapiens
tggtgcaaaaaa

SEQ ID NO: 6533038 - DNA, 11 bp, Homo sapiens
tggtgcaatat

SEQ ID NO: 6533039 - DNA, 16 bp, Homo sapiens
tggtgcaatttgtctt

SEQ ID NO: 6533040 - DNA, 20 bp, Homo sapiens
tggtgcacaagtaacacatt

SEQ ID NO: 6533041 - DNA, 17 bp, Homo sapiens
tggtgcacagattgctg

SEQ ID NO: 6533042 - DNA, 23 bp, Homo sapiens
tggtgcacagcacaaattagtta

SEQ ID NO: 6533043 - DNA, 23 bp, Homo sapiens
tggtgcacgctggggaagaattt

SEQ ID NO: 6533044 - DNA, 15 bp, Homo sapiens
tggtgcactttgtaa

SEQ ID NO: 6533045 - DNA, 20 bp, Homo sapiens
tggtgcagaaaaaaaaaaag

SEQ ID NO: 6533046 - DNA, 15 bp, Homo sapiens
tggtgcagacagaag

SEQ ID NO: 6533047 - DNA, 20 bp, Homo sapiens
tggtgcagagaagctggact

SEQ ID NO: 6533048 - DNA, 21 bp, Homo sapiens
tggtgcagagaagctggactt

SEQ ID NO: 6533049 - DNA, 19 bp, Homo sapiens
tggtgcagaggtttcttga

SEQ ID NO: 6533050 - DNA, 19 bp, Homo sapiens
tggtgcagggagacatctg

SEQ ID NO: 6533051 - DNA, 21 bp, Homo sapiens
tggtgcaggtctccacctgca

SEQ ID NO: 6533052 - DNA, 14 bp, Homo sapiens
tggtgcagtgaaga

SEQ ID NO: 6533053 - DNA, 14 bp, Homo sapiens
tggtgcagtgtgtg

SEQ ID NO: 6533054 - DNA, 15 bp, Homo sapiens
tggtgcatgttcttt

SEQ ID NO: 6533055 - DNA, 13 bp, Homo sapiens
tggtgcattacag

SEQ ID NO: 6533056 - DNA, 16 bp, Homo sapiens
tggtgcattacagaga

SEQ ID NO: 6533057 - DNA, 19 bp, Homo sapiens
tggtgccaaaaccaggcct

SEQ ID NO: 6533058 - DNA, 18 bp, Homo sapiens
tggtgccaaatagcccca

SEQ ID NO: 6533059 - DNA, 23 bp, Homo sapiens
tggtgccaaatagccccagactg

SEQ ID NO: 6533060 - DNA, 23 bp, Homo sapiens
tggtgccaccgtccctctgcaga

SEQ ID NO: 6533061 - DNA, 17 bp, Homo sapiens
tggtgccagagaggggc

SEQ ID NO: 6533062 - DNA, 20 bp, Homo sapiens
tggtgccagatcctcttctc

SEQ ID NO: 6533063 - DNA, 13 bp, Homo sapiens
tggtgccagggtg

SEQ ID NO: 6533064 - DNA, 18 bp, Homo sapiens
tggtgccatcattgctgt

SEQ ID NO: 6533065 - DNA, 22 bp, Homo sapiens
tggtgccatcattgctgtctgc

SEQ ID NO: 6533066 - DNA, 16 bp, Homo sapiens
tggtgccatccccagg

SEQ ID NO: 6533067 - DNA, 22 bp, Homo sapiens
tggtgcccaccagctggctctg

SEQ ID NO: 6533068 - DNA, 13 bp, Homo sapiens
tggtgccccacag

SEQ ID NO: 6533069 - DNA, 12 bp, Homo sapiens
tggtgccccacc

SEQ ID NO: 6533070 - DNA, 18 bp, Homo sapiens
tggtgccccacctgcctg

SEQ ID NO: 6533071 - DNA, 19 bp, Homo sapiens
tggtgccccacctgcctgg

SEQ ID NO: 6533072 - DNA, 23 bp, Homo sapiens
tggtgccccacctgcctggtgca

SEQ ID NO: 6533073 - DNA, 14 bp, Homo sapiens
tggtgccccctggg

SEQ ID NO: 6533074 - DNA, 15 bp, Homo sapiens
tggtgcccctgctca

SEQ ID NO: 6533075 - DNA, 22 bp, Homo sapiens
tggtgcccctgctcactgggcc

SEQ ID NO: 6533076 - DNA, 17 bp, Homo sapiens
tggtgcccgtgcccgca

SEQ ID NO: 6533077 - DNA, 24 bp, Homo sapiens
tggtgccctgaacctctgatgcct

SEQ ID NO: 6533078 - DNA, 15 bp, Homo sapiens
tggtgccctggccca

SEQ ID NO: 6533079 - DNA, 20 bp, Homo sapiens
tggtgccctgttctctacca

SEQ ID NO: 6533080 - DNA, 19 bp, Homo sapiens
tggtgccgatgttgaactt

SEQ ID NO: 6533081 - DNA, 22 bp, Homo sapiens
tggtgcctaaagtttaaccaaa

SEQ ID NO: 6533082 - DNA, 23 bp, Homo sapiens
tggtgcctatatctgagagacct

SEQ ID NO: 6533083 - DNA, 22 bp, Homo sapiens
tggtgcctatttattcattcag

SEQ ID NO: 6533084 - DNA, 23 bp, Homo sapiens
tggtgcctcactgggggctttgg

SEQ ID NO: 6533085 - DNA, 14 bp, Homo sapiens
tggtgcctcctcaa

SEQ ID NO: 6533086 - DNA, 18 bp, Homo sapiens
tggtgcctgagaggcagg

SEQ ID NO: 6533087 - DNA, 14 bp, Homo sapiens
tggtgcctgagccc

SEQ ID NO: 6533088 - DNA, 11 bp, Homo sapiens
tggtgcctgcc

SEQ ID NO: 6533089 - DNA, 13 bp, Homo sapiens
tggtgcctgcctc

SEQ ID NO: 6533090 - DNA, 14 bp, Homo sapiens
tggtgcctgctttg

SEQ ID NO: 6533091 - DNA, 12 bp, Homo sapiens
tggtgcctggcc

SEQ ID NO: 6533092 - DNA, 23 bp, Homo sapiens
tggtgcctggcctggcacacatc

SEQ ID NO: 6533093 - DNA, 13 bp, Homo sapiens
tggtgcctttcct

SEQ ID NO: 6533094 - DNA, 19 bp, Homo sapiens
tggtgcctttcctgttcag

SEQ ID NO: 6533095 - DNA, 20 bp, Homo sapiens
tggtgcctttcctgttcagc

SEQ ID NO: 6533096 - DNA, 14 bp, Homo sapiens
tggtgccttttgtg

SEQ ID NO: 6533097 - DNA, 20 bp, Homo sapiens
tggtgcgatcatggctcact

SEQ ID NO: 6533098 - DNA, 14 bp, Homo sapiens
tggtgcgctgtgct

SEQ ID NO: 6533099 - DNA, 14 bp, Homo sapiens
tggtgcggctggcc

SEQ ID NO: 6533100 - DNA, 17 bp, Homo sapiens
tggtgcggctggccatg

SEQ ID NO: 6533101 - DNA, 18 bp, Homo sapiens
tggtgcgggcacaataaa

SEQ ID NO: 6533102 - DNA, 14 bp, Homo sapiens
tggtgcgggccagg

SEQ ID NO: 6533103 - DNA, 18 bp, Homo sapiens
tggtgcgggccaggtctg

SEQ ID NO: 6533104 - DNA, 22 bp, Homo sapiens
tggtgcgggccaggtctggcgc

SEQ ID NO: 6533105 - DNA, 14 bp, Homo sapiens
tggtgcgggcctgg

SEQ ID NO: 6533106 - DNA, 15 bp, Homo sapiens
tggtgcgggcctggc

SEQ ID NO: 6533107 - DNA, 20 bp, Homo sapiens
tggtgcggtaggtgctggcc

SEQ ID NO: 6533108 - DNA, 22 bp, Homo sapiens
tggtgcggtaggtgctggcctc

SEQ ID NO: 6533109 - DNA, 14 bp, Homo sapiens
tggtgcgtgtggcc

SEQ ID NO: 6533110 - DNA, 19 bp, Homo sapiens
tggtgcgtgtggccctgtg

SEQ ID NO: 6533111 - DNA, 21 bp, Homo sapiens
tggtgcgtgtggccctgtggg

SEQ ID NO: 6533112 - DNA, 21 bp, Homo sapiens
tggtgctaaagattgttaaat

SEQ ID NO: 6533113 - DNA, 14 bp, Homo sapiens
tggtgctaatgtgt

SEQ ID NO: 6533114 - DNA, 14 bp, Homo sapiens
tggtgctataacat

SEQ ID NO: 6533115 - DNA, 18 bp, Homo sapiens
tggtgctatttgaagaaa

SEQ ID NO: 6533116 - DNA, 22 bp, Homo sapiens
tggtgctcacgactcttcctgc

SEQ ID NO: 6533117 - DNA, 18 bp, Homo sapiens
tggtgctcacgtgtcctt

SEQ ID NO: 6533118 - DNA, 20 bp, Homo sapiens
tggtgctccccttcctgcca

SEQ ID NO: 6533119 - DNA, 19 bp, Homo sapiens
tggtgctcctgcccagcca

SEQ ID NO: 6533120 - DNA, 22 bp, Homo sapiens
tggtgctcgccttcggcctctc

SEQ ID NO: 6533121 - DNA, 13 bp, Homo sapiens
tggtgctctgtgt

SEQ ID NO: 6533122 - DNA, 16 bp, Homo sapiens
tggtgctcttgctttt

SEQ ID NO: 6533123 - DNA, 15 bp, Homo sapiens
tggtgctgagtgcta

SEQ ID NO: 6533124 - DNA, 14 bp, Homo sapiens
tggtgctgatggag

SEQ ID NO: 6533125 - DNA, 21 bp, Homo sapiens
tggtgctgcattgagtccagc

SEQ ID NO: 6533126 - DNA, 18 bp, Homo sapiens
tggtgctgccacacttca

SEQ ID NO: 6533127 - DNA, 14 bp, Homo sapiens
tggtgctgccgagg

SEQ ID NO: 6533128 - DNA, 18 bp, Homo sapiens
tggtgctgccgagggctg

SEQ ID NO: 6533129 - DNA, 19 bp, Homo sapiens
tggtgctgccgagggctgg

SEQ ID NO: 6533130 - DNA, 18 bp, Homo sapiens
tggtgctgccttgcttct

SEQ ID NO: 6533131 - DNA, 19 bp, Homo sapiens
tggtgctgcgcccagggag

SEQ ID NO: 6533132 - DNA, 14 bp, Homo sapiens
tggtgctgctcagg

SEQ ID NO: 6533133 - DNA, 19 bp, Homo sapiens
tggtgctgctgctgctgtg

SEQ ID NO: 6533134 - DNA, 20 bp, Homo sapiens
tggtgctggaaccagctctc

SEQ ID NO: 6533135 - DNA, 17 bp, Homo sapiens
tggtgctggatattttc

SEQ ID NO: 6533136 - DNA, 11 bp, Homo sapiens
tggtgctggga

SEQ ID NO: 6533137 - DNA, 13 bp, Homo sapiens
tggtgctgggact

SEQ ID NO: 6533138 - DNA, 20 bp, Homo sapiens
tggtgctgggagaggcagcc

SEQ ID NO: 6533139 - DNA, 22 bp, Homo sapiens
tggtgctgggagatgctctctg

SEQ ID NO: 6533140 - DNA, 20 bp, Homo sapiens
tggtgctggggagccaaagg

SEQ ID NO: 6533141 - DNA, 12 bp, Homo sapiens
tggtgctggttt

SEQ ID NO: 6533142 - DNA, 13 bp, Homo sapiens
tggtgctggttta

SEQ ID NO: 6533143 - DNA, 17 bp, Homo sapiens
tggtgctgttgaaaata

SEQ ID NO: 6533144 - DNA, 11 bp, Homo sapiens
ttcccagaggc

SEQ ID NO: 6533145 - DNA, 15 bp, Homo sapiens
ttcccagagggagca

SEQ ID NO: 6533146 - DNA, 21 bp, Homo sapiens
ttcccagcaaagttttcagat

SEQ ID NO: 6533147 - DNA, 16 bp, Homo sapiens
ttcccagcacaggcag

SEQ ID NO: 6533148 - DNA, 17 bp, Homo sapiens
ttcccagcacaggcagg

SEQ ID NO: 6533149 - DNA, 21 bp, Homo sapiens
ttcccagcactatgctttcct

SEQ ID NO: 6533150 - DNA, 23 bp, Homo sapiens
ttcccagcactatgctttccttc

SEQ ID NO: 6533151 - DNA, 21 bp, Homo sapiens
ttcccagcagtgggggtcaga

SEQ ID NO: 6533152 - DNA, 21 bp, Homo sapiens
ttcccagcattcagtggtcct

SEQ ID NO: 6533153 - DNA, 18 bp, Homo sapiens
ttcccagccatgcccagg

SEQ ID NO: 6533154 - DNA, 16 bp, Homo sapiens
ttcccagcccatatct

SEQ ID NO: 6533155 - DNA, 14 bp, Homo sapiens
ttcccagcccctgc

SEQ ID NO: 6533156 - DNA, 15 bp, Homo sapiens
ttcccagcccctgca

SEQ ID NO: 6533157 - DNA, 18 bp, Homo sapiens
ttcccagcggttcctgtg

SEQ ID NO: 6533158 - DNA, 19 bp, Homo sapiens
ttcccagcggttcctgtgc

SEQ ID NO: 6533159 - DNA, 21 bp, Homo sapiens
ttcccagctacacctttctcc

SEQ ID NO: 6533160 - DNA, 14 bp, Homo sapiens
ttcccagctccccc

SEQ ID NO: 6533161 - DNA, 15 bp, Homo sapiens
ttcccagctcccccc

SEQ ID NO: 6533162 - DNA, 18 bp, Homo sapiens
ttcccagctccccccgcc

SEQ ID NO: 6533163 - DNA, 22 bp, Homo sapiens
ttcccagctccccccgcccacc

SEQ ID NO: 6533164 - DNA, 20 bp, Homo sapiens
ttcccagctctacattctgc

SEQ ID NO: 6533165 - DNA, 16 bp, Homo sapiens
ttcccagctctccctc

SEQ ID NO: 6533166 - DNA, 15 bp, Homo sapiens
ttcccagctgcccct

SEQ ID NO: 6533167 - DNA, 22 bp, Homo sapiens
ttcccagctggcagcgcctccc

SEQ ID NO: 6533168 - DNA, 12 bp, Homo sapiens
ttcccaggaccc

SEQ ID NO: 6533169 - DNA, 19 bp, Homo sapiens
ttcccaggagaaagatgaa

SEQ ID NO: 6533170 - DNA, 21 bp, Homo sapiens
ttcccaggagatgggtccagg

SEQ ID NO: 6533171 - DNA, 21 bp, Homo sapiens
ttcccaggaggtgcagacttc

SEQ ID NO: 6533172 - DNA, 20 bp, Homo sapiens
ttcccaggagttctgctcat

SEQ ID NO: 6533173 - DNA, 20 bp, Homo sapiens
ttcccaggcaaataaaattc

SEQ ID NO: 6533174 - DNA, 22 bp, Homo sapiens
ttcccaggcaaataaaattccc

SEQ ID NO: 6533175 - DNA, 12 bp, Homo sapiens
ttcccaggcagg

SEQ ID NO: 6533176 - DNA, 22 bp, Homo sapiens
ttcccaggcagggagggaaacc

SEQ ID NO: 6533177 - DNA, 13 bp, Homo sapiens
ttcccaggccagc

SEQ ID NO: 6533178 - DNA, 17 bp, Homo sapiens
ttcccaggccagcgagg

SEQ ID NO: 6533179 - DNA, 22 bp, Homo sapiens
ttcccaggcccactgtgcctca

SEQ ID NO: 6533180 - DNA, 17 bp, Homo sapiens
ttcccaggccctttggc

SEQ ID NO: 6533181 - DNA, 18 bp, Homo sapiens
ttcccaggccctttggct

SEQ ID NO: 6533182 - DNA, 20 bp, Homo sapiens
ttcccaggccctttggcttc

SEQ ID NO: 6533183 - DNA, 22 bp, Homo sapiens
ttcccaggccctttggcttctg

SEQ ID NO: 6533184 - DNA, 12 bp, Homo sapiens
ttcccaggcctt

SEQ ID NO: 6533185 - DNA, 22 bp, Homo sapiens
ttcccagggaagtgctctgata

SEQ ID NO: 6533186 - DNA, 12 bp, Homo sapiens
ttcccagggaga

SEQ ID NO: 6533187 - DNA, 22 bp, Homo sapiens
ttcccagggagaaacccacgac

SEQ ID NO: 6533188 - DNA, 11 bp, Homo sapiens
ttcccagggca

SEQ ID NO: 6533189 - DNA, 14 bp, Homo sapiens
ttcccagggccgct

SEQ ID NO: 6533190 - DNA, 20 bp, Homo sapiens
ttcccagggccgcttctcct

SEQ ID NO: 6533191 - DNA, 23 bp, Homo sapiens
ttcccagggtagcccgcctgcca

SEQ ID NO: 6533192 - DNA, 20 bp, Homo sapiens
ttcccaggtaatttaaattg

SEQ ID NO: 6533193 - DNA, 22 bp, Homo sapiens
ttcccaggtaatttaaattggt

SEQ ID NO: 6533194 - DNA, 12 bp, Homo sapiens
ttcccaggtgct

SEQ ID NO: 6533195 - DNA, 17 bp, Homo sapiens
ttcccaggttacaatgg

SEQ ID NO: 6533196 - DNA, 18 bp, Homo sapiens
ttcccaggttctgtttat

SEQ ID NO: 6533197 - DNA, 14 bp, Homo sapiens
ttcccagtataaga

SEQ ID NO: 6533198 - DNA, 20 bp, Homo sapiens
ttcccagtcttctgacaaac

SEQ ID NO: 6533199 - DNA, 14 bp, Homo sapiens
ttcccagtgagcct

SEQ ID NO: 6533200 - DNA, 15 bp, Homo sapiens
ttcccagtgagcctc

SEQ ID NO: 6533201 - DNA, 16 bp, Homo sapiens
ttcccagtgagcctct

SEQ ID NO: 6533202 - DNA, 19 bp, Homo sapiens
ttcccagtgagcctctgcg

SEQ ID NO: 6533203 - DNA, 21 bp, Homo sapiens
ttcccataccacccaatgctg

SEQ ID NO: 6533204 - DNA, 18 bp, Homo sapiens
ttcccatacttgcataca

SEQ ID NO: 6533205 - DNA, 13 bp, Homo sapiens
ttcccatagattt

SEQ ID NO: 6533206 - DNA, 14 bp, Homo sapiens
ttcccatcaccaga

SEQ ID NO: 6533207 - DNA, 14 bp, Homo sapiens
ttcccatcctaccc

SEQ ID NO: 6533208 - DNA, 17 bp, Homo sapiens
ttcccatctccagggaa

SEQ ID NO: 6533209 - DNA, 18 bp, Homo sapiens
ttcccatctccagggaag

SEQ ID NO: 6533210 - DNA, 13 bp, Homo sapiens
ttcccatctgtgg

SEQ ID NO: 6533211 - DNA, 16 bp, Homo sapiens
ttcccatctttactcc

SEQ ID NO: 6533212 - DNA, 21 bp, Homo sapiens
ttcccatgacctaaaacactg

SEQ ID NO: 6533213 - DNA, 18 bp, Homo sapiens
ttcccatgactcttggag

SEQ ID NO: 6533214 - DNA, 16 bp, Homo sapiens
ttcccatgactgcacc

SEQ ID NO: 6533215 - DNA, 19 bp, Homo sapiens
ttcccatgactgcacccag

SEQ ID NO: 6533216 - DNA, 15 bp, Homo sapiens
ttcccatgatccaga

SEQ ID NO: 6533217 - DNA, 16 bp, Homo sapiens
ttcccatgatccagaa

SEQ ID NO: 6533218 - DNA, 21 bp, Homo sapiens
ttcccatgatttcatgtactg

SEQ ID NO: 6533219 - DNA, 14 bp, Homo sapiens
ttcccatgctgaat

SEQ ID NO: 6533220 - DNA, 16 bp, Homo sapiens
ttcccatgctgaatta

SEQ ID NO: 6533221 - DNA, 18 bp, Homo sapiens
ttcccatgctgaattatt

SEQ ID NO: 6533222 - DNA, 15 bp, Homo sapiens
ttcccatggggaggg

SEQ ID NO: 6533223 - DNA, 17 bp, Homo sapiens
ttcccatgtagccccct

SEQ ID NO: 6533224 - DNA, 16 bp, Homo sapiens
ttcccatgtatttgtt

SEQ ID NO: 6533225 - DNA, 13 bp, Homo sapiens
ttcccatgtggaa

SEQ ID NO: 6533226 - DNA, 19 bp, Homo sapiens
ttcccattaaaaatgagat

SEQ ID NO: 6533227 - DNA, 11 bp, Homo sapiens
ttcccattcca

SEQ ID NO: 6533228 - DNA, 20 bp, Homo sapiens
ttcccattgcatcacctctg

SEQ ID NO: 6533229 - DNA, 15 bp, Homo sapiens
ttcccattggctttc

SEQ ID NO: 6533230 - DNA, 23 bp, Homo sapiens
ttcccattggttcacctgtgact

SEQ ID NO: 6533231 - DNA, 17 bp, Homo sapiens
ttcccattgtggctcct

SEQ ID NO: 6533232 - DNA, 17 bp, Homo sapiens
ttcccatttactcttga

SEQ ID NO: 6533233 - DNA, 13 bp, Homo sapiens
ttcccatttagaa

SEQ ID NO: 6533234 - DNA, 22 bp, Homo sapiens
ttcccatttagaatggtgattt

SEQ ID NO: 6533235 - DNA, 13 bp, Homo sapiens
ttcccatttcttc

SEQ ID NO: 6533236 - DNA, 16 bp, Homo sapiens
ttcccatttgctcctt

SEQ ID NO: 6533237 - DNA, 13 bp, Homo sapiens
ttcccatttgtaa

SEQ ID NO: 6533238 - DNA, 19 bp, Homo sapiens
ttcccatttgttgctgctg

SEQ ID NO: 6533239 - DNA, 12 bp, Homo sapiens
ttcccattttaa

SEQ ID NO: 6533240 - DNA, 13 bp, Homo sapiens
ttcccattttgga

SEQ ID NO: 6533241 - DNA, 14 bp, Homo sapiens
ttccccaaaggcat

SEQ ID NO: 6533242 - DNA, 14 bp, Homo sapiens
ttccccaaatacaa

SEQ ID NO: 6533243 - DNA, 16 bp, Homo sapiens
ttccccaacagtgtga

SEQ ID NO: 6533244 - DNA, 23 bp, Homo sapiens
ttccccaacagtgtgaagttaga

SEQ ID NO: 6533245 - DNA, 20 bp, Homo sapiens
ttccccaacggggtggggag

SEQ ID NO: 6533246 - DNA, 21 bp, Homo sapiens
ttccccaacggggtggggagg

SEQ ID NO: 6533247 - DNA, 21 bp, Homo sapiens
ttccccaagatctgccagacc

SEQ ID NO: 6533248 - DNA, 13 bp, Homo sapiens
ttccccaaggacc

SEQ ID NO: 6533249 - DNA, 19 bp, Homo sapiens
ttccccaataaagcctttt

SEQ ID NO: 6533250 - DNA, 16 bp, Homo sapiens
ttccccacacagggca

SEQ ID NO: 6533251 - DNA, 22 bp, Homo sapiens
ttccccacacagggcactgact

SEQ ID NO: 6533252 - DNA, 13 bp, Homo sapiens
ttccccacaggtc

SEQ ID NO: 6533253 - DNA, 22 bp, Homo sapiens
ttccccacagtgacagtcactt

SEQ ID NO: 6533254 - DNA, 20 bp, Homo sapiens
ttccccaccagatgctgaaa

SEQ ID NO: 6533255 - DNA, 12 bp, Homo sapiens
ttccccacccca

SEQ ID NO: 6533256 - DNA, 13 bp, Homo sapiens
ttccccaccccat

SEQ ID NO: 6533257 - DNA, 22 bp, Homo sapiens
ttccccaccctccccttcccag

SEQ ID NO: 6533258 - DNA, 13 bp, Homo sapiens
ttccccaccgcag

SEQ ID NO: 6533259 - DNA, 17 bp, Homo sapiens
ttccccaccgccctgcc

SEQ ID NO: 6533260 - DNA, 15 bp, Homo sapiens
ttccccacctcttcc

SEQ ID NO: 6533261 - DNA, 21 bp, Homo sapiens
ttccccacctcttccttccgc

SEQ ID NO: 6533262 - DNA, 17 bp, Homo sapiens
ttccccaccttccccca

SEQ ID NO: 6533263 - DNA, 19 bp, Homo sapiens
ttccccaccttcccccaac

SEQ ID NO: 6533264 - DNA, 12 bp, Homo sapiens
ttccccactccc

SEQ ID NO: 6533265 - DNA, 20 bp, Homo sapiens
ttccccactctgctcccagc

SEQ ID NO: 6533266 - DNA, 22 bp, Homo sapiens
ttccccactctgctcccagccc

SEQ ID NO: 6533267 - DNA, 17 bp, Homo sapiens
ttccccactgcacacac

SEQ ID NO: 6533268 - DNA, 14 bp, Homo sapiens
ttccccactggagc

SEQ ID NO: 6533269 - DNA, 14 bp, Homo sapiens
ttccccagacacat

SEQ ID NO: 6533270 - DNA, 21 bp, Homo sapiens
ttccccagaccgatccttccc

SEQ ID NO: 6533271 - DNA, 17 bp, Homo sapiens
ttccccagactcagctc

SEQ ID NO: 6533272 - DNA, 21 bp, Homo sapiens
ttccccagactcagctccaga

SEQ ID NO: 6533273 - DNA, 19 bp, Homo sapiens
ttccccagagagcaggcag

SEQ ID NO: 6533274 - DNA, 20 bp, Homo sapiens
ttccccagagagcaggcagg

SEQ ID NO: 6533275 - DNA, 18 bp, Homo sapiens
ttccccagaggctcccaa

SEQ ID NO: 6533276 - DNA, 18 bp, Homo sapiens
ttccccagccacaggcca

SEQ ID NO: 6533277 - DNA, 12 bp, Homo sapiens
ttccccagccct

SEQ ID NO: 6533278 - DNA, 13 bp, Homo sapiens
ttccccagcctct

SEQ ID NO: 6533279 - DNA, 14 bp, Homo sapiens
ttccccagcctctc

SEQ ID NO: 6533280 - DNA, 12 bp, Homo sapiens
ttccccagctca

SEQ ID NO: 6533281 - DNA, 20 bp, Homo sapiens
ttccccagctcagagccccg

SEQ ID NO: 6533282 - DNA, 21 bp, Homo sapiens
ttccccagctcagagccccgc

SEQ ID NO: 6533283 - DNA, 19 bp, Homo sapiens
ttccccagctcccccaggc

SEQ ID NO: 6533284 - DNA, 20 bp, Homo sapiens
ttccccagctcccccaggca

SEQ ID NO: 6533285 - DNA, 11 bp, Homo sapiens
ttccccaggag

SEQ ID NO: 6533286 - DNA, 20 bp, Homo sapiens
ttccccaggagctctctgct

SEQ ID NO: 6533287 - DNA, 17 bp, Homo sapiens
ttccccaggaggccagc

SEQ ID NO: 6533288 - DNA, 19 bp, Homo sapiens
ttccccaggaggccagcct

SEQ ID NO: 6533289 - DNA, 23 bp, Homo sapiens
ttccccaggctgcccactctggg

SEQ ID NO: 6533290 - DNA, 16 bp, Homo sapiens
ttccccagggaaggaa

SEQ ID NO: 6533291 - DNA, 19 bp, Homo sapiens
ttccccagggttctgtatt

SEQ ID NO: 6533292 - DNA, 16 bp, Homo sapiens
ttccccagtgactcca

SEQ ID NO: 6533293 - DNA, 18 bp, Homo sapiens
ttccccagtgactccagg

SEQ ID NO: 6533294 - DNA, 11 bp, Homo sapiens
ttccccagtgt

SEQ ID NO: 6533295 - DNA, 22 bp, Homo sapiens
ttccccagtgtggccccagccc

SEQ ID NO: 6533296 - DNA, 18 bp, Homo sapiens
ttccccatacaaataagc

SEQ ID NO: 6533297 - DNA, 19 bp, Homo sapiens
ttccccatcagctcccaac

SEQ ID NO: 6533298 - DNA, 22 bp, Homo sapiens
ttccccatcccaaggcaagcat

SEQ ID NO: 6533299 - DNA, 23 bp, Homo sapiens
ttccccatcgccttctggctgct

SEQ ID NO: 6533300 - DNA, 14 bp, Homo sapiens
ttccccatctctgt

SEQ ID NO: 6533301 - DNA, 15 bp, Homo sapiens
ttccccatctgggtc

SEQ ID NO: 6533302 - DNA, 12 bp, Homo sapiens
ttccccatctgt

SEQ ID NO: 6533303 - DNA, 18 bp, Homo sapiens
ttccccatcttctaaacc

SEQ ID NO: 6533304 - DNA, 19 bp, Homo sapiens
ttccccatgaaccctgccc

SEQ ID NO: 6533305 - DNA, 12 bp, Homo sapiens
ttccccatgaca

SEQ ID NO: 6533306 - DNA, 21 bp, Homo sapiens
ttccccatgcttccttgcctg

SEQ ID NO: 6533307 - DNA, 22 bp, Homo sapiens
ttccccatgttggtcaggctgg

SEQ ID NO: 6533308 - DNA, 18 bp, Homo sapiens
ttccccattcctacccac

SEQ ID NO: 6533309 - DNA, 18 bp, Homo sapiens
ttccccattgccttctgg

SEQ ID NO: 6533310 - DNA, 23 bp, Homo sapiens
ttcccccaaactttttgttcatg

SEQ ID NO: 6533311 - DNA, 20 bp, Homo sapiens
ttcccccaaatcttcctctg

SEQ ID NO: 6533312 - DNA, 23 bp, Homo sapiens
ttcccccaccaccaaaactgctc

SEQ ID NO: 6533313 - DNA, 18 bp, Homo sapiens
ttcccccaccagctgcag

SEQ ID NO: 6533314 - DNA, 17 bp, Homo sapiens
ttcccccaccccagagt

SEQ ID NO: 6533315 - DNA, 18 bp, Homo sapiens
ttcccccaccccagagtt

SEQ ID NO: 6533316 - DNA, 21 bp, Homo sapiens
ttcccccaccccatttctctc

SEQ ID NO: 6533317 - DNA, 13 bp, Homo sapiens
ttcccccaccctc

SEQ ID NO: 6533318 - DNA, 22 bp, Homo sapiens
ttcccccaccggtccagctggc

SEQ ID NO: 6533319 - DNA, 14 bp, Homo sapiens
ttcccccagcccaa

SEQ ID NO: 6533320 - DNA, 17 bp, Homo sapiens
ttcccccagcccaataa

SEQ ID NO: 6533321 - DNA, 21 bp, Homo sapiens
ttcccccagcccaataaaggt

SEQ ID NO: 6533322 - DNA, 17 bp, Homo sapiens
tggtgcttaagttccag

SEQ ID NO: 6533323 - DNA, 13 bp, Homo sapiens
tggtgcttagttt

SEQ ID NO: 6533324 - DNA, 18 bp, Homo sapiens
tggtgcttattcttaact

SEQ ID NO: 6533325 - DNA, 22 bp, Homo sapiens
tggtgcttcagccctggcccct

SEQ ID NO: 6533326 - DNA, 19 bp, Homo sapiens
tggtgcttccaaatattgt

SEQ ID NO: 6533327 - DNA, 14 bp, Homo sapiens
tggtgcttccccca

SEQ ID NO: 6533328 - DNA, 23 bp, Homo sapiens
tggtgcttctcagatttctgagg

SEQ ID NO: 6533329 - DNA, 16 bp, Homo sapiens
tggtgcttggaggggg

SEQ ID NO: 6533330 - DNA, 19 bp, Homo sapiens
tggtgcttggagggggaag

SEQ ID NO: 6533331 - DNA, 17 bp, Homo sapiens
tggtgctttcaggtctg

SEQ ID NO: 6533332 - DNA, 15 bp, Homo sapiens
tggtgctttccttca

SEQ ID NO: 6533333 - DNA, 17 bp, Homo sapiens
tggtgctttttataaaa

SEQ ID NO: 6533334 - DNA, 22 bp, Homo sapiens
tggtggaaaaaacattttaagt

SEQ ID NO: 6533335 - DNA, 18 bp, Homo sapiens
tggtggaaaacgaagctc

SEQ ID NO: 6533336 - DNA, 12 bp, Homo sapiens
tggtggaagagg

SEQ ID NO: 6533337 - DNA, 19 bp, Homo sapiens
tggtggaagaggggacagg

SEQ ID NO: 6533338 - DNA, 16 bp, Homo sapiens
tggtggacagtcctgg

SEQ ID NO: 6533339 - DNA, 18 bp, Homo sapiens
tggtggacagtcctggga

SEQ ID NO: 6533340 - DNA, 15 bp, Homo sapiens
tggtggactacaaaa

SEQ ID NO: 6533341 - DNA, 16 bp, Homo sapiens
tggtggagcagccaga

SEQ ID NO: 6533342 - DNA, 15 bp, Homo sapiens
tggtggagccagggc

SEQ ID NO: 6533343 - DNA, 23 bp, Homo sapiens
tggtggaggaaacttccaacttt

SEQ ID NO: 6533344 - DNA, 19 bp, Homo sapiens
tggtggaggaagggctggg

SEQ ID NO: 6533345 - DNA, 14 bp, Homo sapiens
tggtggaggattgc

SEQ ID NO: 6533346 - DNA, 21 bp, Homo sapiens
tggtggaggattgctgccaga

SEQ ID NO: 6533347 - DNA, 13 bp, Homo sapiens
tggtggagggcca

SEQ ID NO: 6533348 - DNA, 22 bp, Homo sapiens
tggtggaggggcgcccagggtc

SEQ ID NO: 6533349 - DNA, 15 bp, Homo sapiens
tggtggagggggctg

SEQ ID NO: 6533350 - DNA, 18 bp, Homo sapiens
tggtggagtcaggaaaga

SEQ ID NO: 6533351 - DNA, 16 bp, Homo sapiens
tggtggagtgagagcc

SEQ ID NO: 6533352 - DNA, 16 bp, Homo sapiens
tggtggatgaggcttc

SEQ ID NO: 6533353 - DNA, 16 bp, Homo sapiens
tggtggatgggccctg

SEQ ID NO: 6533354 - DNA, 19 bp, Homo sapiens
tggtggcaaccccagaccc

SEQ ID NO: 6533355 - DNA, 16 bp, Homo sapiens
tggtggcaagagcccc

SEQ ID NO: 6533356 - DNA, 15 bp, Homo sapiens
tggtggcacaggccc

SEQ ID NO: 6533357 - DNA, 11 bp, Homo sapiens
tggtggcacat

SEQ ID NO: 6533358 - DNA, 21 bp, Homo sapiens
tggtggcaccagatgcaacct

SEQ ID NO: 6533359 - DNA, 17 bp, Homo sapiens
tggtggcacgtgcctgt

SEQ ID NO: 6533360 - DNA, 18 bp, Homo sapiens
tggtggcagtgggagctg

SEQ ID NO: 6533361 - DNA, 20 bp, Homo sapiens
tggtggcagtgggagctgcc

SEQ ID NO: 6533362 - DNA, 15 bp, Homo sapiens
tggtggcatcacaga

SEQ ID NO: 6533363 - DNA, 16 bp, Homo sapiens
tggtggcatgtgcctg

SEQ ID NO: 6533364 - DNA, 21 bp, Homo sapiens
tggtggcatttttgcttccta

SEQ ID NO: 6533365 - DNA, 17 bp, Homo sapiens
tggtggccaagcctgcc

SEQ ID NO: 6533366 - DNA, 18 bp, Homo sapiens
tggtggccaagcctgccc

SEQ ID NO: 6533367 - DNA, 17 bp, Homo sapiens
tggtggccactgagctg

SEQ ID NO: 6533368 - DNA, 18 bp, Homo sapiens
tggtggccactgagctgg

SEQ ID NO: 6533369 - DNA, 15 bp, Homo sapiens
tggtggccaggctgg

SEQ ID NO: 6533370 - DNA, 17 bp, Homo sapiens
tggtggccaggctggta

SEQ ID NO: 6533371 - DNA, 14 bp, Homo sapiens
tggtggccatgctc

SEQ ID NO: 6533372 - DNA, 20 bp, Homo sapiens
tggtggccatgtcgcctgcc

SEQ ID NO: 6533373 - DNA, 13 bp, Homo sapiens
tggtggcccagct

SEQ ID NO: 6533374 - DNA, 11 bp, Homo sapiens
tggtggcccca

SEQ ID NO: 6533375 - DNA, 19 bp, Homo sapiens
tggtggccccgacaggtct

SEQ ID NO: 6533376 - DNA, 22 bp, Homo sapiens
tggtggccccgacaggtcttcc

SEQ ID NO: 6533377 - DNA, 19 bp, Homo sapiens
tggtggcccgacagcctgg

SEQ ID NO: 6533378 - DNA, 21 bp, Homo sapiens
tggtggcccgacagcctggca

SEQ ID NO: 6533379 - DNA, 22 bp, Homo sapiens
tggtggccctctcccctgcccc

SEQ ID NO: 6533380 - DNA, 13 bp, Homo sapiens
tggtggccctggg

SEQ ID NO: 6533381 - DNA, 21 bp, Homo sapiens
tggtggccctgtgcctgggcc

SEQ ID NO: 6533382 - DNA, 10 bp, Homo sapiens
tggtggcctc

SEQ ID NO: 6533383 - DNA, 13 bp, Homo sapiens
tggtggcctcagc

SEQ ID NO: 6533384 - DNA, 22 bp, Homo sapiens
tggtggcggcggcacttcaagc

SEQ ID NO: 6533385 - DNA, 19 bp, Homo sapiens
tggtggctcatgcctgtga

SEQ ID NO: 6533386 - DNA, 14 bp, Homo sapiens
tggtggctcatggc

SEQ ID NO: 6533387 - DNA, 20 bp, Homo sapiens
tggtggctccccctctgctt

SEQ ID NO: 6533388 - DNA, 21 bp, Homo sapiens
tggtggctcccggagggccct

SEQ ID NO: 6533389 - DNA, 13 bp, Homo sapiens
tggtggctggagg

SEQ ID NO: 6533390 - DNA, 16 bp, Homo sapiens
tggtggctgggctgct

SEQ ID NO: 6533391 - DNA, 20 bp, Homo sapiens
tggtggctgggctgctcctg

SEQ ID NO: 6533392 - DNA, 14 bp, Homo sapiens
tggtggctgtgtct

SEQ ID NO: 6533393 - DNA, 14 bp, Homo sapiens
tggtggcttcagct

SEQ ID NO: 6533394 - DNA, 16 bp, Homo sapiens
tggtggcttcagctcc

SEQ ID NO: 6533395 - DNA, 17 bp, Homo sapiens
tggtggcttcagctcca

SEQ ID NO: 6533396 - DNA, 14 bp, Homo sapiens
tggtggcttctcca

SEQ ID NO: 6533397 - DNA, 13 bp, Homo sapiens
tggtggctttcct

SEQ ID NO: 6533398 - DNA, 20 bp, Homo sapiens
tggtggctttttttaaaatt

SEQ ID NO: 6533399 - DNA, 14 bp, Homo sapiens
tggtgggaaaatgt

SEQ ID NO: 6533400 - DNA, 18 bp, Homo sapiens
tggtgggaaccctcccca

SEQ ID NO: 6533401 - DNA, 19 bp, Homo sapiens
tggtgggaagcaagcaggg

SEQ ID NO: 6533402 - DNA, 21 bp, Homo sapiens
tggtgggaagcgtctgtccgt

SEQ ID NO: 6533403 - DNA, 19 bp, Homo sapiens
tggtgggacactgggcagc

SEQ ID NO: 6533404 - DNA, 22 bp, Homo sapiens
tggtgggacactgggcagcaag

SEQ ID NO: 6533405 - DNA, 23 bp, Homo sapiens
tggtgggagacgaacggaagggt

SEQ ID NO: 6533406 - DNA, 12 bp, Homo sapiens
tggtgggagggg

SEQ ID NO: 6533407 - DNA, 22 bp, Homo sapiens
tggtgggaggggcgcccacctc

SEQ ID NO: 6533408 - DNA, 23 bp, Homo sapiens
tggtgggaggggcgcccacctcc

SEQ ID NO: 6533409 - DNA, 15 bp, Homo sapiens
tggtgggagggggag

SEQ ID NO: 6533410 - DNA, 15 bp, Homo sapiens
tggtgggaggggtgt

SEQ ID NO: 6533411 - DNA, 23 bp, Homo sapiens
tggtgggagggttggcacctgca

SEQ ID NO: 6533412 - DNA, 20 bp, Homo sapiens
tggtgggataggagggtgcc

SEQ ID NO: 6533413 - DNA, 14 bp, Homo sapiens
tggtgggatccacg

SEQ ID NO: 6533414 - DNA, 22 bp, Homo sapiens
tggtgggcaggatctcaagcca

SEQ ID NO: 6533415 - DNA, 23 bp, Homo sapiens
tggtgggccaacaaagaacacta

SEQ ID NO: 6533416 - DNA, 21 bp, Homo sapiens
tggtgggctgatttacatgta

SEQ ID NO: 6533417 - DNA, 18 bp, Homo sapiens
tggtgggctggcccagcc

SEQ ID NO: 6533418 - DNA, 16 bp, Homo sapiens
tggtggggatattttt

SEQ ID NO: 6533419 - DNA, 14 bp, Homo sapiens
tggtggggcagctc

SEQ ID NO: 6533420 - DNA, 24 bp, Homo sapiens
tggtggggccaggccaggaccaca

SEQ ID NO: 6533421 - DNA, 15 bp, Homo sapiens
tggtggggcccccag

SEQ ID NO: 6533422 - DNA, 20 bp, Homo sapiens
tggtggggcccccagcaccc

SEQ ID NO: 6533423 - DNA, 21 bp, Homo sapiens
tggtggggcccccagcaccct

SEQ ID NO: 6533424 - DNA, 19 bp, Homo sapiens
tggtgggggagcctctgga

SEQ ID NO: 6533425 - DNA, 13 bp, Homo sapiens
tggtggggggcag

SEQ ID NO: 6533426 - DNA, 13 bp, Homo sapiens
tggtggggtggca

SEQ ID NO: 6533427 - DNA, 23 bp, Homo sapiens
tggtggggtgtgttccaactgcc

SEQ ID NO: 6533428 - DNA, 12 bp, Homo sapiens
tggtgggtaatt

SEQ ID NO: 6533429 - DNA, 22 bp, Homo sapiens
tggtgggtaattgtacaataaa

SEQ ID NO: 6533430 - DNA, 21 bp, Homo sapiens
tggtgggttcaggggactcag

SEQ ID NO: 6533431 - DNA, 22 bp, Homo sapiens
tggtgggttgaatatagcctgc

SEQ ID NO: 6533432 - DNA, 16 bp, Homo sapiens
tggtggtaaccctggt

SEQ ID NO: 6533433 - DNA, 14 bp, Homo sapiens
tggtggtactttat

SEQ ID NO: 6533434 - DNA, 18 bp, Homo sapiens
tggtggtactttattctt

SEQ ID NO: 6533435 - DNA, 22 bp, Homo sapiens
tggtggtactttattcttgctg

SEQ ID NO: 6533436 - DNA, 13 bp, Homo sapiens
tggtggtagaaat

SEQ ID NO: 6533437 - DNA, 12 bp, Homo sapiens
tggtggtatctg

SEQ ID NO: 6533438 - DNA, 14 bp, Homo sapiens
tggtggtattctgt

SEQ ID NO: 6533439 - DNA, 17 bp, Homo sapiens
tggtggtattctgtcat

SEQ ID NO: 6533440 - DNA, 18 bp, Homo sapiens
tggtggtcacaggctgtg

SEQ ID NO: 6533441 - DNA, 14 bp, Homo sapiens
tggtggtccctggg

SEQ ID NO: 6533442 - DNA, 15 bp, Homo sapiens
tggtggtccctgggt

SEQ ID NO: 6533443 - DNA, 13 bp, Homo sapiens
tggtggtgaaggg

SEQ ID NO: 6533444 - DNA, 16 bp, Homo sapiens
tggtggtgaaggggct

SEQ ID NO: 6533445 - DNA, 12 bp, Homo sapiens
tggtggtgcagc

SEQ ID NO: 6533446 - DNA, 13 bp, Homo sapiens
tggtggtgctaaa

SEQ ID NO: 6533447 - DNA, 18 bp, Homo sapiens
tggtggttaaggccaggg

SEQ ID NO: 6533448 - DNA, 17 bp, Homo sapiens
tggtggttcattccaca

SEQ ID NO: 6533449 - DNA, 22 bp, Homo sapiens
tggtggttcctttgcaccctgt

SEQ ID NO: 6533450 - DNA, 14 bp, Homo sapiens
tggtggttgctgtt

SEQ ID NO: 6533451 - DNA, 15 bp, Homo sapiens
tggtggttgtgcctt

SEQ ID NO: 6533452 - DNA, 17 bp, Homo sapiens
tggtggtttcagaaatg

SEQ ID NO: 6533453 - DNA, 18 bp, Homo sapiens
tggtggtttcagaaatgt

SEQ ID NO: 6533454 - DNA, 18 bp, Homo sapiens
tggtggtttctatacatg

SEQ ID NO: 6533455 - DNA, 17 bp, Homo sapiens
tggtggtttgattgttt

SEQ ID NO: 6533456 - DNA, 22 bp, Homo sapiens
tggtggttttcagagcaggagg

SEQ ID NO: 6533457 - DNA, 19 bp, Homo sapiens
tggtggttttctgttcttt

SEQ ID NO: 6533458 - DNA, 16 bp, Homo sapiens
tggtggtttttcagct

SEQ ID NO: 6533459 - DNA, 18 bp, Homo sapiens
tggtgtaaagctggccct

SEQ ID NO: 6533460 - DNA, 19 bp, Homo sapiens
tggtgtaaagctggccctg

SEQ ID NO: 6533461 - DNA, 16 bp, Homo sapiens
tggtgtaataagacat

SEQ ID NO: 6533462 - DNA, 17 bp, Homo sapiens
tggtgtaataagacata

SEQ ID NO: 6533463 - DNA, 16 bp, Homo sapiens
tggtgtaatctcaatg

SEQ ID NO: 6533464 - DNA, 20 bp, Homo sapiens
tggtgtactctaggacttca

SEQ ID NO: 6533465 - DNA, 22 bp, Homo sapiens
tggtgtactctaggacttcaaa

SEQ ID NO: 6533466 - DNA, 15 bp, Homo sapiens
tggtgtagaacacta

SEQ ID NO: 6533467 - DNA, 21 bp, Homo sapiens
tggtgtagaacactaattcat

SEQ ID NO: 6533468 - DNA, 13 bp, Homo sapiens
tggtgtagtcttt

SEQ ID NO: 6533469 - DNA, 15 bp, Homo sapiens
tggtgtatgcacagg

SEQ ID NO: 6533470 - DNA, 15 bp, Homo sapiens
tggtgtcaccagcct

SEQ ID NO: 6533471 - DNA, 14 bp, Homo sapiens
tggtgtcaccccag

SEQ ID NO: 6533472 - DNA, 15 bp, Homo sapiens
tggtgtcaccccaga

SEQ ID NO: 6533473 - DNA, 16 bp, Homo sapiens
tggtgtcaccccagag

SEQ ID NO: 6533474 - DNA, 17 bp, Homo sapiens
tggtgtcaccccagagc

SEQ ID NO: 6533475 - DNA, 21 bp, Homo sapiens
tggtgtcaccccagagccaca

SEQ ID NO: 6533476 - DNA, 16 bp, Homo sapiens
tggtgtcacctgaaga

SEQ ID NO: 6533477 - DNA, 12 bp, Homo sapiens
tggtgtcactgt

SEQ ID NO: 6533478 - DNA, 21 bp, Homo sapiens
tggtgtcactgtccctcctgg

SEQ ID NO: 6533479 - DNA, 22 bp, Homo sapiens
tggtgtcactgtccctcctggt

SEQ ID NO: 6533480 - DNA, 16 bp, Homo sapiens
tggtgtcacttactgt

SEQ ID NO: 6533481 - DNA, 20 bp, Homo sapiens
tggtgtcacttactgtttct

SEQ ID NO: 6533482 - DNA, 18 bp, Homo sapiens
tggtgtcagaccctggag

SEQ ID NO: 6533483 - DNA, 19 bp, Homo sapiens
tggtgtcagaccctggagg

SEQ ID NO: 6533484 - DNA, 21 bp, Homo sapiens
tggtgtcagcccctcttccct

SEQ ID NO: 6533485 - DNA, 14 bp, Homo sapiens
tggtgtcaggcagg

SEQ ID NO: 6533486 - DNA, 15 bp, Homo sapiens
tggtgtcataactag

SEQ ID NO: 6533487 - DNA, 20 bp, Homo sapiens
tggtgtcatagaatagcatg

SEQ ID NO: 6533488 - DNA, 23 bp, Homo sapiens
tggtgtcatctgctccttcctgt

SEQ ID NO: 6533489 - DNA, 22 bp, Homo sapiens
tggtgtcatgaggaaaaaaaat

SEQ ID NO: 6533490 - DNA, 19 bp, Homo sapiens
tggtgtcattattccatct

SEQ ID NO: 6533491 - DNA, 16 bp, Homo sapiens
tggtgtcattctgcct

SEQ ID NO: 6533492 - DNA, 18 bp, Homo sapiens
tggtgtcattctgcctgc

SEQ ID NO: 6533493 - DNA, 17 bp, Homo sapiens
tggtgtcattttcttga

SEQ ID NO: 6533494 - DNA, 18 bp, Homo sapiens
tggtgtccagacagagcc

SEQ ID NO: 6533495 - DNA, 21 bp, Homo sapiens
tggtgtccagacagagccctg

SEQ ID NO: 6533496 - DNA, 20 bp, Homo sapiens
tggtgtccagcatggatgaa

SEQ ID NO: 6533497 - DNA, 13 bp, Homo sapiens
tggtgtccagctg

SEQ ID NO: 6533498 - DNA, 17 bp, Homo sapiens
tggtgtccagctgagtt

SEQ ID NO: 6533499 - DNA, 13 bp, Homo sapiens
tggtgtccccttc

SEQ ID NO: 6533500 - DNA, 18 bp, Homo sapiens
tggtgtccctgcctggcc

SEQ ID NO: 6533501 - DNA, 13 bp, Homo sapiens
ttcccccagccct

SEQ ID NO: 6533502 - DNA, 19 bp, Homo sapiens
ttcccccaggcgcctgcgc

SEQ ID NO: 6533503 - DNA, 18 bp, Homo sapiens
ttcccccagggtcccctg

SEQ ID NO: 6533504 - DNA, 13 bp, Homo sapiens
ttcccccatccct

SEQ ID NO: 6533505 - DNA, 16 bp, Homo sapiens
ttcccccatccctacc

SEQ ID NO: 6533506 - DNA, 18 bp, Homo sapiens
ttccccccaccccccagc

SEQ ID NO: 6533507 - DNA, 20 bp, Homo sapiens
ttccccccatctctgagtgg

SEQ ID NO: 6533508 - DNA, 17 bp, Homo sapiens
ttcccccccctttccta

SEQ ID NO: 6533509 - DNA, 20 bp, Homo sapiens
ttcccccctctcctcccagc

SEQ ID NO: 6533510 - DNA, 19 bp, Homo sapiens
ttcccccgctggcagccac

SEQ ID NO: 6533511 - DNA, 14 bp, Homo sapiens
ttccccctccccca

SEQ ID NO: 6533512 - DNA, 20 bp, Homo sapiens
ttccccctccccctcctgct

SEQ ID NO: 6533513 - DNA, 14 bp, Homo sapiens
ttccccctgccctg

SEQ ID NO: 6533514 - DNA, 22 bp, Homo sapiens
ttccccctgcttccacctcacc

SEQ ID NO: 6533515 - DNA, 10 bp, Homo sapiens
ttcccccttc

SEQ ID NO: 6533516 - DNA, 11 bp, Homo sapiens
ttcccccttcc

SEQ ID NO: 6533517 - DNA, 17 bp, Homo sapiens
ttcccccttccaaataa

SEQ ID NO: 6533518 - DNA, 21 bp, Homo sapiens
ttcccccttccaaataataaa

SEQ ID NO: 6533519 - DNA, 17 bp, Homo sapiens
ttccccctttctctgcc

SEQ ID NO: 6533520 - DNA, 23 bp, Homo sapiens
ttccccctttctctgcctggcaa

SEQ ID NO: 6533521 - DNA, 14 bp, Homo sapiens
ttccccctttcttc

SEQ ID NO: 6533522 - DNA, 15 bp, Homo sapiens
ttccccctttcttcc

SEQ ID NO: 6533523 - DNA, 20 bp, Homo sapiens
ttccccgaagagtcagcccc

SEQ ID NO: 6533524 - DNA, 16 bp, Homo sapiens
ttccccgagggatgat

SEQ ID NO: 6533525 - DNA, 22 bp, Homo sapiens
ttccccgagggatgatgccaca

SEQ ID NO: 6533526 - DNA, 23 bp, Homo sapiens
ttccccgagggatgatgccacac

SEQ ID NO: 6533527 - DNA, 18 bp, Homo sapiens
ttccccgagtgactctgg

SEQ ID NO: 6533528 - DNA, 21 bp, Homo sapiens
ttccccgatgtgagccgcctc

SEQ ID NO: 6533529 - DNA, 19 bp, Homo sapiens
ttccccgcaacccacagct

SEQ ID NO: 6533530 - DNA, 15 bp, Homo sapiens
ttccccgcctgcagt

SEQ ID NO: 6533531 - DNA, 17 bp, Homo sapiens
ttccccggtcccttgag

SEQ ID NO: 6533532 - DNA, 22 bp, Homo sapiens
ttccccgtgcatgatttactct

SEQ ID NO: 6533533 - DNA, 19 bp, Homo sapiens
ttcccctaacctcattccc

SEQ ID NO: 6533534 - DNA, 15 bp, Homo sapiens
ttcccctaagtggat

SEQ ID NO: 6533535 - DNA, 16 bp, Homo sapiens
ttcccctaattttcca

SEQ ID NO: 6533536 - DNA, 18 bp, Homo sapiens
ttcccctatcctgttctt

SEQ ID NO: 6533537 - DNA, 13 bp, Homo sapiens
ttcccctccacca

SEQ ID NO: 6533538 - DNA, 13 bp, Homo sapiens
ttcccctccagga

SEQ ID NO: 6533539 - DNA, 16 bp, Homo sapiens
ttcccctcccccactc

SEQ ID NO: 6533540 - DNA, 21 bp, Homo sapiens
ttcccctcccccactcctcta

SEQ ID NO: 6533541 - DNA, 13 bp, Homo sapiens
ttcccctccccct

SEQ ID NO: 6533542 - DNA, 21 bp, Homo sapiens
ttcccctcccgattgagcctt

SEQ ID NO: 6533543 - DNA, 22 bp, Homo sapiens
ttcccctcccgcttcctccggc

SEQ ID NO: 6533544 - DNA, 12 bp, Homo sapiens
ttcccctcccta

SEQ ID NO: 6533545 - DNA, 17 bp, Homo sapiens
ttcccctccctcccaca

SEQ ID NO: 6533546 - DNA, 13 bp, Homo sapiens
ttcccctccctgg

SEQ ID NO: 6533547 - DNA, 16 bp, Homo sapiens
ttcccctcctacccct

SEQ ID NO: 6533548 - DNA, 19 bp, Homo sapiens
ttcccctcctacccctccc

SEQ ID NO: 6533549 - DNA, 20 bp, Homo sapiens
ttcccctcctacccctccca

SEQ ID NO: 6533550 - DNA, 21 bp, Homo sapiens
ttcccctcctacccctcccag

SEQ ID NO: 6533551 - DNA, 18 bp, Homo sapiens
ttcccctcctttgtcttt

SEQ ID NO: 6533552 - DNA, 15 bp, Homo sapiens
ttcccctcgctgtcc

SEQ ID NO: 6533553 - DNA, 19 bp, Homo sapiens
ttcccctcgctgtcctgct

SEQ ID NO: 6533554 - DNA, 13 bp, Homo sapiens
ttcccctctcgcg

SEQ ID NO: 6533555 - DNA, 15 bp, Homo sapiens
ttcccctctgctgct

SEQ ID NO: 6533556 - DNA, 18 bp, Homo sapiens
ttcccctctgctgctgtc

SEQ ID NO: 6533557 - DNA, 14 bp, Homo sapiens
ttcccctctggctt

SEQ ID NO: 6533558 - DNA, 22 bp, Homo sapiens
ttcccctctgtgtcctctcccc

SEQ ID NO: 6533559 - DNA, 23 bp, Homo sapiens
ttcccctctgtgtcctctcccct

SEQ ID NO: 6533560 - DNA, 16 bp, Homo sapiens
ttcccctcttgtctcc

SEQ ID NO: 6533561 - DNA, 12 bp, Homo sapiens
ttcccctgaaga

SEQ ID NO: 6533562 - DNA, 13 bp, Homo sapiens
ttcccctgcaatg

SEQ ID NO: 6533563 - DNA, 22 bp, Homo sapiens
ttcccctgcaatgcgtcttgtg

SEQ ID NO: 6533564 - DNA, 23 bp, Homo sapiens
ttcccctgcaatgcgtcttgtga

SEQ ID NO: 6533565 - DNA, 13 bp, Homo sapiens
ttcccctgcacct

SEQ ID NO: 6533566 - DNA, 18 bp, Homo sapiens
ttcccctgcacctggcct

SEQ ID NO: 6533567 - DNA, 17 bp, Homo sapiens
ttcccctgcgccctccc

SEQ ID NO: 6533568 - DNA, 19 bp, Homo sapiens
ttcccctgctgaccttgga

SEQ ID NO: 6533569 - DNA, 12 bp, Homo sapiens
ttcccctggcct

SEQ ID NO: 6533570 - DNA, 13 bp, Homo sapiens
ttcccctggcctt

SEQ ID NO: 6533571 - DNA, 12 bp, Homo sapiens
ttcccctgggaa

SEQ ID NO: 6533572 - DNA, 21 bp, Homo sapiens
ttcccctgtcagtttcccctc

SEQ ID NO: 6533573 - DNA, 16 bp, Homo sapiens
ttcccctgtcctgtga

SEQ ID NO: 6533574 - DNA, 17 bp, Homo sapiens
ttcccctgtcctgtgaa

SEQ ID NO: 6533575 - DNA, 18 bp, Homo sapiens
ttcccctgtcctgtgaat

SEQ ID NO: 6533576 - DNA, 12 bp, Homo sapiens
ttcccctgtctt

SEQ ID NO: 6533577 - DNA, 22 bp, Homo sapiens
ttcccctgtcttcacctgccac

SEQ ID NO: 6533578 - DNA, 12 bp, Homo sapiens
ttcccctgtgtc

SEQ ID NO: 6533579 - DNA, 14 bp, Homo sapiens
ttcccctgttcact

SEQ ID NO: 6533580 - DNA, 19 bp, Homo sapiens
ttccccttagaaacactgc

SEQ ID NO: 6533581 - DNA, 20 bp, Homo sapiens
ttccccttagagtgctgtga

SEQ ID NO: 6533582 - DNA, 17 bp, Homo sapiens
ttccccttatcctccct

SEQ ID NO: 6533583 - DNA, 18 bp, Homo sapiens
ttccccttcagaccttgc

SEQ ID NO: 6533584 - DNA, 14 bp, Homo sapiens
ttccccttccctta

SEQ ID NO: 6533585 - DNA, 12 bp, Homo sapiens
ttccccttccta

SEQ ID NO: 6533586 - DNA, 13 bp, Homo sapiens
ttccccttccttc

SEQ ID NO: 6533587 - DNA, 19 bp, Homo sapiens
ttccccttctgtgtcacag

SEQ ID NO: 6533588 - DNA, 23 bp, Homo sapiens
ttccccttgccacggtttatcct

SEQ ID NO: 6533589 - DNA, 23 bp, Homo sapiens
ttccccttgcccagggctcagcc

SEQ ID NO: 6533590 - DNA, 17 bp, Homo sapiens
ttccccttgtccctggg

SEQ ID NO: 6533591 - DNA, 17 bp, Homo sapiens
ttcccctttactcagcc

SEQ ID NO: 6533592 - DNA, 14 bp, Homo sapiens
ttcccctttcccca

SEQ ID NO: 6533593 - DNA, 12 bp, Homo sapiens
ttcccctttcct

SEQ ID NO: 6533594 - DNA, 12 bp, Homo sapiens
ttcccctttctc

SEQ ID NO: 6533595 - DNA, 17 bp, Homo sapiens
ttcccctttctttcctt

SEQ ID NO: 6533596 - DNA, 20 bp, Homo sapiens
ttccccttttgcctggctgt

SEQ ID NO: 6533597 - DNA, 22 bp, Homo sapiens
ttccccttttgcctggctgtgg

SEQ ID NO: 6533598 - DNA, 23 bp, Homo sapiens
ttcccgaaccccaaggagggaga

SEQ ID NO: 6533599 - DNA, 16 bp, Homo sapiens
ttcccgaagtaaaata

SEQ ID NO: 6533600 - DNA, 21 bp, Homo sapiens
ttcccgacccagccagctgca

SEQ ID NO: 6533601 - DNA, 15 bp, Homo sapiens
ttcccgagggagctg

SEQ ID NO: 6533602 - DNA, 23 bp, Homo sapiens
ttcccgatggtctctctccctct

SEQ ID NO: 6533603 - DNA, 13 bp, Homo sapiens
ttcccgcacatgg

SEQ ID NO: 6533604 - DNA, 15 bp, Homo sapiens
ttcccgcagcaccag

SEQ ID NO: 6533605 - DNA, 19 bp, Homo sapiens
ttcccgcagcaccagcctg

SEQ ID NO: 6533606 - DNA, 16 bp, Homo sapiens
ttcccgcatggttttt

SEQ ID NO: 6533607 - DNA, 15 bp, Homo sapiens
ttcccgccccacctc

SEQ ID NO: 6533608 - DNA, 18 bp, Homo sapiens
ttcccgccccacctccca

SEQ ID NO: 6533609 - DNA, 16 bp, Homo sapiens
ttcccgccctccccct

SEQ ID NO: 6533610 - DNA, 19 bp, Homo sapiens
ttcccgccgcccagcccac

SEQ ID NO: 6533611 - DNA, 17 bp, Homo sapiens
ttcccgccggaggccag

SEQ ID NO: 6533612 - DNA, 16 bp, Homo sapiens
ttcccgcctcagcctc

SEQ ID NO: 6533613 - DNA, 14 bp, Homo sapiens
ttcccgcctcggct

SEQ ID NO: 6533614 - DNA, 18 bp, Homo sapiens
ttcccgccttcaggttcc

SEQ ID NO: 6533615 - DNA, 20 bp, Homo sapiens
ttcccgccttgggcttgcag

SEQ ID NO: 6533616 - DNA, 12 bp, Homo sapiens
ttcccgctcagc

SEQ ID NO: 6533617 - DNA, 15 bp, Homo sapiens
ttcccgctcagccct

SEQ ID NO: 6533618 - DNA, 14 bp, Homo sapiens
ttcccgctccccac

SEQ ID NO: 6533619 - DNA, 21 bp, Homo sapiens
ttcccgctgcacatggacaga

SEQ ID NO: 6533620 - DNA, 21 bp, Homo sapiens
ttcccggactgcaagcagggc

SEQ ID NO: 6533621 - DNA, 18 bp, Homo sapiens
ttcccggagcacagccct

SEQ ID NO: 6533622 - DNA, 23 bp, Homo sapiens
ttcccggagcacagccctgggag

SEQ ID NO: 6533623 - DNA, 22 bp, Homo sapiens
ttcccggcccccggccaaggac

SEQ ID NO: 6533624 - DNA, 14 bp, Homo sapiens
ttcccggctggact

SEQ ID NO: 6533625 - DNA, 22 bp, Homo sapiens
ttcccgggagctgggccctgcc

SEQ ID NO: 6533626 - DNA, 23 bp, Homo sapiens
ttcccgggagctgggccctgcct

SEQ ID NO: 6533627 - DNA, 18 bp, Homo sapiens
ttcccgggccctcagccc

SEQ ID NO: 6533628 - DNA, 17 bp, Homo sapiens
ttcccgtataataaaac

SEQ ID NO: 6533629 - DNA, 17 bp, Homo sapiens
ttcccgtgcctgggaga

SEQ ID NO: 6533630 - DNA, 15 bp, Homo sapiens
ttcccgtggccccag

SEQ ID NO: 6533631 - DNA, 17 bp, Homo sapiens
ttcccgtgtgcctgagc

SEQ ID NO: 6533632 - DNA, 23 bp, Homo sapiens
ttccctaaacaaaagcaaagatg

SEQ ID NO: 6533633 - DNA, 13 bp, Homo sapiens
ttccctaaactgc

SEQ ID NO: 6533634 - DNA, 14 bp, Homo sapiens
ttccctaaactgca

SEQ ID NO: 6533635 - DNA, 18 bp, Homo sapiens
ttccctaacttgtgaaga

SEQ ID NO: 6533636 - DNA, 12 bp, Homo sapiens
ttccctaagcca

SEQ ID NO: 6533637 - DNA, 15 bp, Homo sapiens
ttccctaagccaagg

SEQ ID NO: 6533638 - DNA, 20 bp, Homo sapiens
ttccctaattctgccttaaa

SEQ ID NO: 6533639 - DNA, 17 bp, Homo sapiens
ttccctacacagggcct

SEQ ID NO: 6533640 - DNA, 17 bp, Homo sapiens
ttccctacagaaaagaa

SEQ ID NO: 6533641 - DNA, 19 bp, Homo sapiens
ttccctacagcctagggca

SEQ ID NO: 6533642 - DNA, 15 bp, Homo sapiens
ttccctacccacagg

SEQ ID NO: 6533643 - DNA, 16 bp, Homo sapiens
ttccctaccctctaga

SEQ ID NO: 6533644 - DNA, 20 bp, Homo sapiens
ttccctaccctctagagaaa

SEQ ID NO: 6533645 - DNA, 17 bp, Homo sapiens
ttccctacccttcctgc

SEQ ID NO: 6533646 - DNA, 14 bp, Homo sapiens
ttccctacctcagg

SEQ ID NO: 6533647 - DNA, 19 bp, Homo sapiens
ttccctactaacatcccaa

SEQ ID NO: 6533648 - DNA, 16 bp, Homo sapiens
ttccctacttcctgtg

SEQ ID NO: 6533649 - DNA, 18 bp, Homo sapiens
ttccctagaaagccatat

SEQ ID NO: 6533650 - DNA, 15 bp, Homo sapiens
ttccctagactctgt

SEQ ID NO: 6533651 - DNA, 11 bp, Homo sapiens
ttccctagaga

SEQ ID NO: 6533652 - DNA, 13 bp, Homo sapiens
ttccctagcagga

SEQ ID NO: 6533653 - DNA, 18 bp, Homo sapiens
ttccctagcttattttgt

SEQ ID NO: 6533654 - DNA, 22 bp, Homo sapiens
ttccctaggatcccgtcttcca

SEQ ID NO: 6533655 - DNA, 14 bp, Homo sapiens
ttccctagttcttt

SEQ ID NO: 6533656 - DNA, 17 bp, Homo sapiens
ttccctagttctttgca

SEQ ID NO: 6533657 - DNA, 22 bp, Homo sapiens
ttccctataggaacagcccagc

SEQ ID NO: 6533658 - DNA, 23 bp, Homo sapiens
ttccctatcaaaacatatcaatt

SEQ ID NO: 6533659 - DNA, 14 bp, Homo sapiens
ttccctatctgcaa

SEQ ID NO: 6533660 - DNA, 16 bp, Homo sapiens
ttccctatctttgcca

SEQ ID NO: 6533661 - DNA, 13 bp, Homo sapiens
ttccctatctttt

SEQ ID NO: 6533662 - DNA, 16 bp, Homo sapiens
ttccctatggagaggc

SEQ ID NO: 6533663 - DNA, 21 bp, Homo sapiens
ttccctatggagaggcttccc

SEQ ID NO: 6533664 - DNA, 20 bp, Homo sapiens
ttccctatttgtgaattctg

SEQ ID NO: 6533665 - DNA, 23 bp, Homo sapiens
ttccctcaaagcttccattccac

SEQ ID NO: 6533666 - DNA, 20 bp, Homo sapiens
ttccctcacaccctgcctcg

SEQ ID NO: 6533667 - DNA, 12 bp, Homo sapiens
ttccctcacccc

SEQ ID NO: 6533668 - DNA, 13 bp, Homo sapiens
ttccctcaccccc

SEQ ID NO: 6533669 - DNA, 14 bp, Homo sapiens
ttccctcaccccca

SEQ ID NO: 6533670 - DNA, 13 bp, Homo sapiens
ttccctcactctt

SEQ ID NO: 6533671 - DNA, 17 bp, Homo sapiens
ttccctcactcttcctc

SEQ ID NO: 6533672 - DNA, 13 bp, Homo sapiens
ttccctcagccta

SEQ ID NO: 6533673 - DNA, 11 bp, Homo sapiens
ttccctcaggc

SEQ ID NO: 6533674 - DNA, 22 bp, Homo sapiens
ttccctcaggttctattttctt

SEQ ID NO: 6533675 - DNA, 15 bp, Homo sapiens
ttccctcatctctcc

SEQ ID NO: 6533676 - DNA, 17 bp, Homo sapiens
ttccctcatctctcctc

SEQ ID NO: 6533677 - DNA, 24 bp, Homo sapiens
ttccctccagagaaagcacaattt

SEQ ID NO: 6533678 - DNA, 12 bp, Homo sapiens
ttccctccattt

SEQ ID NO: 6533679 - DNA, 20 bp, Homo sapiens
ttccctccatttttctccca

SEQ ID NO: 6533680 - DNA, 23 bp, Homo sapiens
ttccctccatttttctcccaaga

SEQ ID NO: 6533681 - DNA, 19 bp, Homo sapiens
tggtgtccctgcctggccc

SEQ ID NO: 6533682 - DNA, 14 bp, Homo sapiens
tggtgtcctgacca

SEQ ID NO: 6533683 - DNA, 17 bp, Homo sapiens
tggtgtcctgaccaccc

SEQ ID NO: 6533684 - DNA, 19 bp, Homo sapiens
tggtgtcctgaccaccctc

SEQ ID NO: 6533685 - DNA, 21 bp, Homo sapiens
tggtgtcctgaccaccctccc

SEQ ID NO: 6533686 - DNA, 23 bp, Homo sapiens
tggtgtcctgaggcctccaagga

SEQ ID NO: 6533687 - DNA, 19 bp, Homo sapiens
tggtgtcctgcatgtatgc

SEQ ID NO: 6533688 - DNA, 14 bp, Homo sapiens
tggtgtccttccct

SEQ ID NO: 6533689 - DNA, 13 bp, Homo sapiens
tggtgtccttctc

SEQ ID NO: 6533690 - DNA, 15 bp, Homo sapiens
tggtgtccttcttcc

SEQ ID NO: 6533691 - DNA, 17 bp, Homo sapiens
tggtgtccttcttcctc

SEQ ID NO: 6533692 - DNA, 19 bp, Homo sapiens
tggtgtcgggcatgacacg

SEQ ID NO: 6533693 - DNA, 20 bp, Homo sapiens
tggtgtctattatagtgaaa

SEQ ID NO: 6533694 - DNA, 11 bp, Homo sapiens
tggtgtctcca

SEQ ID NO: 6533695 - DNA, 23 bp, Homo sapiens
tggtgtctcttctttagaacagg

SEQ ID NO: 6533696 - DNA, 13 bp, Homo sapiens
tggtgtctgcctg

SEQ ID NO: 6533697 - DNA, 22 bp, Homo sapiens
tggtgtcttcattttacattgt

SEQ ID NO: 6533698 - DNA, 14 bp, Homo sapiens
tggtgtcttgagac

SEQ ID NO: 6533699 - DNA, 13 bp, Homo sapiens
tggtgtgaaaatg

SEQ ID NO: 6533700 - DNA, 18 bp, Homo sapiens
tggtgtgaaacaaattaa

SEQ ID NO: 6533701 - DNA, 15 bp, Homo sapiens
tggtgtgaaagtcag

SEQ ID NO: 6533702 - DNA, 22 bp, Homo sapiens
tggtgtgaactaagttattgct

SEQ ID NO: 6533703 - DNA, 15 bp, Homo sapiens
tggtgtgaagaaagc

SEQ ID NO: 6533704 - DNA, 18 bp, Homo sapiens
tggtgtgagatcctcttt

SEQ ID NO: 6533705 - DNA, 13 bp, Homo sapiens
tggtgtgaggccc

SEQ ID NO: 6533706 - DNA, 17 bp, Homo sapiens
tggtgtgagtatcagaa

SEQ ID NO: 6533707 - DNA, 15 bp, Homo sapiens
tggtgtgatcccagc

SEQ ID NO: 6533708 - DNA, 17 bp, Homo sapiens
tggtgtgatcccagctc

SEQ ID NO: 6533709 - DNA, 18 bp, Homo sapiens
tggtgtgcatctgtgtgt

SEQ ID NO: 6533710 - DNA, 20 bp, Homo sapiens
tggtgtgccacaggctgcaa

SEQ ID NO: 6533711 - DNA, 15 bp, Homo sapiens
tggtgtgcttatgtt

SEQ ID NO: 6533712 - DNA, 19 bp, Homo sapiens
tggtgtggagttggggctg

SEQ ID NO: 6533713 - DNA, 16 bp, Homo sapiens
tggtgtggcaaagcct

SEQ ID NO: 6533714 - DNA, 15 bp, Homo sapiens
tggtgtggcctgtgg

SEQ ID NO: 6533715 - DNA, 20 bp, Homo sapiens
tggtgtgggtaaagggacag

SEQ ID NO: 6533716 - DNA, 15 bp, Homo sapiens
tggtgtgggtgtcct

SEQ ID NO: 6533717 - DNA, 16 bp, Homo sapiens
tggtgtggtacagaga

SEQ ID NO: 6533718 - DNA, 15 bp, Homo sapiens
tggtgtggtgaatgt

SEQ ID NO: 6533719 - DNA, 15 bp, Homo sapiens
tggtgtgtccctgga

SEQ ID NO: 6533720 - DNA, 16 bp, Homo sapiens
tggtgtgtccctggac

SEQ ID NO: 6533721 - DNA, 19 bp, Homo sapiens
tggtgtgtccctggacaca

SEQ ID NO: 6533722 - DNA, 22 bp, Homo sapiens
tggtgtgtccctggacacagct

SEQ ID NO: 6533723 - DNA, 16 bp, Homo sapiens
tggtgtgtgtctctga

SEQ ID NO: 6533724 - DNA, 20 bp, Homo sapiens
tggtgtgttcgtggagccac

SEQ ID NO: 6533725 - DNA, 11 bp, Homo sapiens
tggtgtgtttc

SEQ ID NO: 6533726 - DNA, 20 bp, Homo sapiens
tggtgttaaagctgtacacc

SEQ ID NO: 6533727 - DNA, 14 bp, Homo sapiens
tggtgttaacagaa

SEQ ID NO: 6533728 - DNA, 14 bp, Homo sapiens
tggtgttaatgagt

SEQ ID NO: 6533729 - DNA, 21 bp, Homo sapiens
tggtgttacacagcccaagag

SEQ ID NO: 6533730 - DNA, 23 bp, Homo sapiens
tggtgttacacagcccaagagga

SEQ ID NO: 6533731 - DNA, 14 bp, Homo sapiens
tggtgttatgttta

SEQ ID NO: 6533732 - DNA, 20 bp, Homo sapiens
tggtgttcaccaaaaccaaa

SEQ ID NO: 6533733 - DNA, 13 bp, Homo sapiens
tggtgttcctgaa

SEQ ID NO: 6533734 - DNA, 14 bp, Homo sapiens
tggtgttcctggaa

SEQ ID NO: 6533735 - DNA, 20 bp, Homo sapiens
tggtgttcgtttccatcatg

SEQ ID NO: 6533736 - DNA, 14 bp, Homo sapiens
tggtgttctcctgc

SEQ ID NO: 6533737 - DNA, 13 bp, Homo sapiens
tggtgttctgaag

SEQ ID NO: 6533738 - DNA, 15 bp, Homo sapiens
tggtgttctggcctc

SEQ ID NO: 6533739 - DNA, 16 bp, Homo sapiens
tggtgttgacatacat

SEQ ID NO: 6533740 - DNA, 16 bp, Homo sapiens
tggtgttgcagccgca

SEQ ID NO: 6533741 - DNA, 20 bp, Homo sapiens
tggtgttgcagccgcagaga

SEQ ID NO: 6533742 - DNA, 11 bp, Homo sapiens
tggtgttgccc

SEQ ID NO: 6533743 - DNA, 20 bp, Homo sapiens
tggtgttggacaagcttctg

SEQ ID NO: 6533744 - DNA, 17 bp, Homo sapiens
tggtgttggcagtgttt

SEQ ID NO: 6533745 - DNA, 22 bp, Homo sapiens
tggtgttgggaaggggtcctgc

SEQ ID NO: 6533746 - DNA, 13 bp, Homo sapiens
tggtgttggtgaa

SEQ ID NO: 6533747 - DNA, 16 bp, Homo sapiens
tggtgtttatgcacac

SEQ ID NO: 6533748 - DNA, 15 bp, Homo sapiens
tggtgtttcctggca

SEQ ID NO: 6533749 - DNA, 17 bp, Homo sapiens
tggtgtttcctggcact

SEQ ID NO: 6533750 - DNA, 18 bp, Homo sapiens
tggtgtttctagcactgg

SEQ ID NO: 6533751 - DNA, 16 bp, Homo sapiens
tggtgtttctccctct

SEQ ID NO: 6533752 - DNA, 14 bp, Homo sapiens
tggtgtttgggaat

SEQ ID NO: 6533753 - DNA, 21 bp, Homo sapiens
tggtgtttgtaggctgtgggg

SEQ ID NO: 6533754 - DNA, 22 bp, Homo sapiens
tggtgtttgtcatggtgaaatt

SEQ ID NO: 6533755 - DNA, 16 bp, Homo sapiens
tggtgtttgtctgtgt

SEQ ID NO: 6533756 - DNA, 17 bp, Homo sapiens
tggtgttttaaagagaa

SEQ ID NO: 6533757 - DNA, 20 bp, Homo sapiens
tggtgttttggggatgagag

SEQ ID NO: 6533758 - DNA, 15 bp, Homo sapiens
tggtgtttttctctc

SEQ ID NO: 6533759 - DNA, 20 bp, Homo sapiens
tggtgttttttgttactgtt

SEQ ID NO: 6533760 - DNA, 17 bp, Homo sapiens
tggttaaaaaaaagaat

SEQ ID NO: 6533761 - DNA, 13 bp, Homo sapiens
tggttaaaaaggc

SEQ ID NO: 6533762 - DNA, 14 bp, Homo sapiens
tggttaaaaaggcc

SEQ ID NO: 6533763 - DNA, 21 bp, Homo sapiens
tggttaaaaaggccaaagata

SEQ ID NO: 6533764 - DNA, 20 bp, Homo sapiens
tggttaaaataaagcctatt

SEQ ID NO: 6533765 - DNA, 12 bp, Homo sapiens
tggttaaataaa

SEQ ID NO: 6533766 - DNA, 14 bp, Homo sapiens
tggttaaattaaca

SEQ ID NO: 6533767 - DNA, 12 bp, Homo sapiens
tggttaaatttt

SEQ ID NO: 6533768 - DNA, 24 bp, Homo sapiens
tggttaacgaggaagacgatgtgt

SEQ ID NO: 6533769 - DNA, 16 bp, Homo sapiens
tggttaagaactgtga

SEQ ID NO: 6533770 - DNA, 16 bp, Homo sapiens
tggttaagctttgaca

SEQ ID NO: 6533771 - DNA, 18 bp, Homo sapiens
tggttaagtctgttttat

SEQ ID NO: 6533772 - DNA, 19 bp, Homo sapiens
tggttaataaaactgcaca

SEQ ID NO: 6533773 - DNA, 22 bp, Homo sapiens
tggttaataaaactgcacagtg

SEQ ID NO: 6533774 - DNA, 19 bp, Homo sapiens
tggttaatacatctttccc

SEQ ID NO: 6533775 - DNA, 13 bp, Homo sapiens
tggttaatcactt

SEQ ID NO: 6533776 - DNA, 18 bp, Homo sapiens
tggttaatcagtgttgat

SEQ ID NO: 6533777 - DNA, 20 bp, Homo sapiens
tggttaatccaatcaattta

SEQ ID NO: 6533778 - DNA, 23 bp, Homo sapiens
tggttaatccaatcaatttaaat

SEQ ID NO: 6533779 - DNA, 21 bp, Homo sapiens
tggttaatttttcctgcatgt

SEQ ID NO: 6533780 - DNA, 19 bp, Homo sapiens
tggttacagtgcagacagg

SEQ ID NO: 6533781 - DNA, 14 bp, Homo sapiens
tggttaccaggcac

SEQ ID NO: 6533782 - DNA, 18 bp, Homo sapiens
tggttaccatgggtgtgg

SEQ ID NO: 6533783 - DNA, 20 bp, Homo sapiens
tggttaccatgggtgtggat

SEQ ID NO: 6533784 - DNA, 18 bp, Homo sapiens
tggttaccccgggctggg

SEQ ID NO: 6533785 - DNA, 16 bp, Homo sapiens
tggttaccgagtatct

SEQ ID NO: 6533786 - DNA, 20 bp, Homo sapiens
tggttaccgagtatctgtaa

SEQ ID NO: 6533787 - DNA, 15 bp, Homo sapiens
tggttacctattgct

SEQ ID NO: 6533788 - DNA, 20 bp, Homo sapiens
tggttacctgttccattgtt

SEQ ID NO: 6533789 - DNA, 23 bp, Homo sapiens
tggttactcagggttcatctgtc

SEQ ID NO: 6533790 - DNA, 15 bp, Homo sapiens
tggttactctggtgc

SEQ ID NO: 6533791 - DNA, 16 bp, Homo sapiens
tggttactctggtgct

SEQ ID NO: 6533792 - DNA, 19 bp, Homo sapiens
tggttactggtgatgttga

SEQ ID NO: 6533793 - DNA, 15 bp, Homo sapiens
tggttacttcttctc

SEQ ID NO: 6533794 - DNA, 16 bp, Homo sapiens
tggttactttcaaaat

SEQ ID NO: 6533795 - DNA, 17 bp, Homo sapiens
tggttactttcaaaatg

SEQ ID NO: 6533796 - DNA, 20 bp, Homo sapiens
tggttagaagggttacatgg

SEQ ID NO: 6533797 - DNA, 23 bp, Homo sapiens
tggttagacgccttccaggtcag

SEQ ID NO: 6533798 - DNA, 15 bp, Homo sapiens
tggttagctcagccc

SEQ ID NO: 6533799 - DNA, 18 bp, Homo sapiens
tggttagctcagccccag

SEQ ID NO: 6533800 - DNA, 12 bp, Homo sapiens
tggttaggatgg

SEQ ID NO: 6533801 - DNA, 21 bp, Homo sapiens
tggttagtcacctgccccagc

SEQ ID NO: 6533802 - DNA, 15 bp, Homo sapiens
tggttagtgatgcag

SEQ ID NO: 6533803 - DNA, 16 bp, Homo sapiens
tggttagtgcatgtca

SEQ ID NO: 6533804 - DNA, 20 bp, Homo sapiens
tggttatagtgcaatatatt

SEQ ID NO: 6533805 - DNA, 13 bp, Homo sapiens
tggttatatttca

SEQ ID NO: 6533806 - DNA, 12 bp, Homo sapiens
tggttatgaaac

SEQ ID NO: 6533807 - DNA, 17 bp, Homo sapiens
tggttatgaaacatgtg

SEQ ID NO: 6533808 - DNA, 13 bp, Homo sapiens
tggttatgaaaga

SEQ ID NO: 6533809 - DNA, 15 bp, Homo sapiens
tggttatgaaagaat

SEQ ID NO: 6533810 - DNA, 17 bp, Homo sapiens
tggttatgcagaagcag

SEQ ID NO: 6533811 - DNA, 13 bp, Homo sapiens
tggttatgttttt

SEQ ID NO: 6533812 - DNA, 20 bp, Homo sapiens
tggttattcattattcctca

SEQ ID NO: 6533813 - DNA, 21 bp, Homo sapiens
tggttattcattattcctcag

SEQ ID NO: 6533814 - DNA, 19 bp, Homo sapiens
tggttattctaagcccttt

SEQ ID NO: 6533815 - DNA, 14 bp, Homo sapiens
tggttattggactc

SEQ ID NO: 6533816 - DNA, 17 bp, Homo sapiens
tggttatttcagccccc

SEQ ID NO: 6533817 - DNA, 15 bp, Homo sapiens
tggttatttctaaac

SEQ ID NO: 6533818 - DNA, 21 bp, Homo sapiens
tggttattttaaatataaata

SEQ ID NO: 6533819 - DNA, 16 bp, Homo sapiens
tggttattttctccat

SEQ ID NO: 6533820 - DNA, 20 bp, Homo sapiens
tggttattttctccatgtct

SEQ ID NO: 6533821 - DNA, 21 bp, Homo sapiens
tggttatttttctcttgtacc

SEQ ID NO: 6533822 - DNA, 23 bp, Homo sapiens
tggttatttttctcttgtaccat

SEQ ID NO: 6533823 - DNA, 21 bp, Homo sapiens
tggttcaaatgtgttttggtc

SEQ ID NO: 6533824 - DNA, 15 bp, Homo sapiens
tggttcaagtattaa

SEQ ID NO: 6533825 - DNA, 19 bp, Homo sapiens
tggttcaagtattaagcag

SEQ ID NO: 6533826 - DNA, 21 bp, Homo sapiens
tggttcaagtattaagcagtt

SEQ ID NO: 6533827 - DNA, 20 bp, Homo sapiens
tggttcactcttggagcctg

SEQ ID NO: 6533828 - DNA, 22 bp, Homo sapiens
tggttcactcttggagcctgca

SEQ ID NO: 6533829 - DNA, 20 bp, Homo sapiens
tggttcacttcaaagctaaa

SEQ ID NO: 6533830 - DNA, 21 bp, Homo sapiens
tggttcagaattaaactttta

SEQ ID NO: 6533831 - DNA, 20 bp, Homo sapiens
tggttcagagactggcagcc

SEQ ID NO: 6533832 - DNA, 23 bp, Homo sapiens
tggttcagagactggcagccagg

SEQ ID NO: 6533833 - DNA, 18 bp, Homo sapiens
tggttcagctactttcca

SEQ ID NO: 6533834 - DNA, 19 bp, Homo sapiens
tggttcagctactttccat

SEQ ID NO: 6533835 - DNA, 22 bp, Homo sapiens
tggttcagctactttccatttg

SEQ ID NO: 6533836 - DNA, 22 bp, Homo sapiens
tggttcagggttggcccctgcc

SEQ ID NO: 6533837 - DNA, 17 bp, Homo sapiens
tggttcaggtacacata

SEQ ID NO: 6533838 - DNA, 23 bp, Homo sapiens
tggttcagtttttttttttccag

SEQ ID NO: 6533839 - DNA, 16 bp, Homo sapiens
tggttcataaatgaat

SEQ ID NO: 6533840 - DNA, 15 bp, Homo sapiens
tggttcatattttat

SEQ ID NO: 6533841 - DNA, 16 bp, Homo sapiens
tggttcatcagtgtta

SEQ ID NO: 6533842 - DNA, 22 bp, Homo sapiens
tggttcatccatcatctgctgc

SEQ ID NO: 6533843 - DNA, 18 bp, Homo sapiens
tggttcatgcagacaaag

SEQ ID NO: 6533844 - DNA, 13 bp, Homo sapiens
tggttcatgcctg

SEQ ID NO: 6533845 - DNA, 15 bp, Homo sapiens
tggttcatgcctggg

SEQ ID NO: 6533846 - DNA, 16 bp, Homo sapiens
tggttcatgcctgggg

SEQ ID NO: 6533847 - DNA, 17 bp, Homo sapiens
tggttcatgcctggggt

SEQ ID NO: 6533848 - DNA, 18 bp, Homo sapiens
tggttcatgcctggggtg

SEQ ID NO: 6533849 - DNA, 19 bp, Homo sapiens
tggttcatgcctggggtgg

SEQ ID NO: 6533850 - DNA, 23 bp, Homo sapiens
tggttcatgcctggggtggaggc

SEQ ID NO: 6533851 - DNA, 13 bp, Homo sapiens
tggttcattccac

SEQ ID NO: 6533852 - DNA, 18 bp, Homo sapiens
tggttcattccacaggac

SEQ ID NO: 6533853 - DNA, 17 bp, Homo sapiens
tggttcattttcagatt

SEQ ID NO: 6533854 - DNA, 20 bp, Homo sapiens
tggttccaaaccagtttatt

SEQ ID NO: 6533855 - DNA, 17 bp, Homo sapiens
tggttccaagccctgga

SEQ ID NO: 6533856 - DNA, 20 bp, Homo sapiens
tggttccaagtctttgctat

SEQ ID NO: 6533857 - DNA, 23 bp, Homo sapiens
tggttccagaacgtctctcacct

SEQ ID NO: 6533858 - DNA, 19 bp, Homo sapiens
tggttccatgcctgctctc

SEQ ID NO: 6533859 - DNA, 13 bp, Homo sapiens
ttccctccccagc

SEQ ID NO: 6533860 - DNA, 22 bp, Homo sapiens
ttccctccccctccttgtgcct

SEQ ID NO: 6533861 - DNA, 13 bp, Homo sapiens
ttccctcccggga

SEQ ID NO: 6533862 - DNA, 13 bp, Homo sapiens
ttccctccctgct

SEQ ID NO: 6533863 - DNA, 16 bp, Homo sapiens
ttccctccctgctgtc

SEQ ID NO: 6533864 - DNA, 23 bp, Homo sapiens
ttccctccgggcaggggagccag

SEQ ID NO: 6533865 - DNA, 19 bp, Homo sapiens
ttccctcctagctctccca

SEQ ID NO: 6533866 - DNA, 21 bp, Homo sapiens
ttccctcctagctctcccagt

SEQ ID NO: 6533867 - DNA, 13 bp, Homo sapiens
ttccctcctgaca

SEQ ID NO: 6533868 - DNA, 14 bp, Homo sapiens
ttccctcctgcagc

SEQ ID NO: 6533869 - DNA, 17 bp, Homo sapiens
ttccctcctgcccagga

SEQ ID NO: 6533870 - DNA, 19 bp, Homo sapiens
ttccctcctggtcctggac

SEQ ID NO: 6533871 - DNA, 14 bp, Homo sapiens
ttccctccttccct

SEQ ID NO: 6533872 - DNA, 18 bp, Homo sapiens
ttccctccttcccttctc

SEQ ID NO: 6533873 - DNA, 13 bp, Homo sapiens
ttccctccttggt

SEQ ID NO: 6533874 - DNA, 13 bp, Homo sapiens
ttccctcctttta

SEQ ID NO: 6533875 - DNA, 14 bp, Homo sapiens
ttccctcgggaccc

SEQ ID NO: 6533876 - DNA, 16 bp, Homo sapiens
ttccctcgtccgtctg

SEQ ID NO: 6533877 - DNA, 17 bp, Homo sapiens
ttccctcgtctttccca

SEQ ID NO: 6533878 - DNA, 19 bp, Homo sapiens
ttccctctaaatgtatatg

SEQ ID NO: 6533879 - DNA, 16 bp, Homo sapiens
ttccctctcagctgct

SEQ ID NO: 6533880 - DNA, 14 bp, Homo sapiens
ttccctctcatctc

SEQ ID NO: 6533881 - DNA, 14 bp, Homo sapiens
ttccctctcccagg

SEQ ID NO: 6533882 - DNA, 13 bp, Homo sapiens
ttccctctccctc

SEQ ID NO: 6533883 - DNA, 16 bp, Homo sapiens
ttccctctcctgccca

SEQ ID NO: 6533884 - DNA, 14 bp, Homo sapiens
ttccctctcctgct

SEQ ID NO: 6533885 - DNA, 18 bp, Homo sapiens
ttccctctcctgcttcct

SEQ ID NO: 6533886 - DNA, 16 bp, Homo sapiens
ttccctctcctgtcct

SEQ ID NO: 6533887 - DNA, 19 bp, Homo sapiens
ttccctctctcagcacagc

SEQ ID NO: 6533888 - DNA, 18 bp, Homo sapiens
ttccctctctccctgcct

SEQ ID NO: 6533889 - DNA, 20 bp, Homo sapiens
ttccctctctccctgcctca

SEQ ID NO: 6533890 - DNA, 20 bp, Homo sapiens
ttccctctctgatgtcccag

SEQ ID NO: 6533891 - DNA, 15 bp, Homo sapiens
ttccctctctggaga

SEQ ID NO: 6533892 - DNA, 11 bp, Homo sapiens
ttccctctgag

SEQ ID NO: 6533893 - DNA, 13 bp, Homo sapiens
ttccctctgcatt

SEQ ID NO: 6533894 - DNA, 21 bp, Homo sapiens
ttccctctgcattgacctgga

SEQ ID NO: 6533895 - DNA, 11 bp, Homo sapiens
ttccctctgcc

SEQ ID NO: 6533896 - DNA, 19 bp, Homo sapiens
ttccctctgcctgggatgc

SEQ ID NO: 6533897 - DNA, 17 bp, Homo sapiens
ttccctctgcctgtccc

SEQ ID NO: 6533898 - DNA, 19 bp, Homo sapiens
ttccctctgctcctggagc

SEQ ID NO: 6533899 - DNA, 20 bp, Homo sapiens
ttccctctgggcacgcctgc

SEQ ID NO: 6533900 - DNA, 23 bp, Homo sapiens
ttccctctgggcctgttctcttg

SEQ ID NO: 6533901 - DNA, 15 bp, Homo sapiens
ttccctcttcccaga

SEQ ID NO: 6533902 - DNA, 16 bp, Homo sapiens
ttccctcttccctctc

SEQ ID NO: 6533903 - DNA, 19 bp, Homo sapiens
ttccctcttccctctccct

SEQ ID NO: 6533904 - DNA, 21 bp, Homo sapiens
ttccctcttgtccctttccct

SEQ ID NO: 6533905 - DNA, 16 bp, Homo sapiens
ttccctcttgtgctca

SEQ ID NO: 6533906 - DNA, 23 bp, Homo sapiens
ttccctcttgtgctcagtcgccc

SEQ ID NO: 6533907 - DNA, 19 bp, Homo sapiens
ttccctctttcctgtgcca

SEQ ID NO: 6533908 - DNA, 13 bp, Homo sapiens
ttccctcttttct

SEQ ID NO: 6533909 - DNA, 19 bp, Homo sapiens
ttccctgaaaacccagaga

SEQ ID NO: 6533910 - DNA, 16 bp, Homo sapiens
ttccctgaacatctgt

SEQ ID NO: 6533911 - DNA, 20 bp, Homo sapiens
ttccctgaacgttttcttct

SEQ ID NO: 6533912 - DNA, 13 bp, Homo sapiens
ttccctgaagctc

SEQ ID NO: 6533913 - DNA, 15 bp, Homo sapiens
ttccctgaatcctct

SEQ ID NO: 6533914 - DNA, 13 bp, Homo sapiens
ttccctgaatctg

SEQ ID NO: 6533915 - DNA, 17 bp, Homo sapiens
ttccctgacactgcggg

SEQ ID NO: 6533916 - DNA, 13 bp, Homo sapiens
ttccctgactcat

SEQ ID NO: 6533917 - DNA, 12 bp, Homo sapiens
ttccctgaggaa

SEQ ID NO: 6533918 - DNA, 15 bp, Homo sapiens
ttccctgaggaatga

SEQ ID NO: 6533919 - DNA, 20 bp, Homo sapiens
ttccctgatggcctttggac

SEQ ID NO: 6533920 - DNA, 11 bp, Homo sapiens
ttccctgcaca

SEQ ID NO: 6533921 - DNA, 15 bp, Homo sapiens
ttccctgcaccctgg

SEQ ID NO: 6533922 - DNA, 11 bp, Homo sapiens
ttccctgcaga

SEQ ID NO: 6533923 - DNA, 16 bp, Homo sapiens
ttccctgcagctgacc

SEQ ID NO: 6533924 - DNA, 14 bp, Homo sapiens
ttccctgcatccct

SEQ ID NO: 6533925 - DNA, 16 bp, Homo sapiens
ttccctgcatcccttg

SEQ ID NO: 6533926 - DNA, 20 bp, Homo sapiens
ttccctgccacatccagctt

SEQ ID NO: 6533927 - DNA, 23 bp, Homo sapiens
ttccctgcccaaacccttaactg

SEQ ID NO: 6533928 - DNA, 22 bp, Homo sapiens
ttccctgcccaatcctccctgg

SEQ ID NO: 6533929 - DNA, 20 bp, Homo sapiens
ttccctgcctaggagctggg

SEQ ID NO: 6533930 - DNA, 18 bp, Homo sapiens
ttccctgcctccagctgt

SEQ ID NO: 6533931 - DNA, 13 bp, Homo sapiens
ttccctgcctgtg

SEQ ID NO: 6533932 - DNA, 11 bp, Homo sapiens
ttccctgcctt

SEQ ID NO: 6533933 - DNA, 18 bp, Homo sapiens
ttccctgccttgctgaca

SEQ ID NO: 6533934 - DNA, 11 bp, Homo sapiens
ttccctgctga

SEQ ID NO: 6533935 - DNA, 12 bp, Homo sapiens
ttccctgctgaa

SEQ ID NO: 6533936 - DNA, 13 bp, Homo sapiens
ttccctgctgaat

SEQ ID NO: 6533937 - DNA, 22 bp, Homo sapiens
ttccctgctgtcgtcttagcaa

SEQ ID NO: 6533938 - DNA, 15 bp, Homo sapiens
ttccctgcttccagg

SEQ ID NO: 6533939 - DNA, 18 bp, Homo sapiens
ttccctgctttgcatctt

SEQ ID NO: 6533940 - DNA, 18 bp, Homo sapiens
ttccctgcttttctccca

SEQ ID NO: 6533941 - DNA, 22 bp, Homo sapiens
ttccctggaaaccttccaccca

SEQ ID NO: 6533942 - DNA, 23 bp, Homo sapiens
ttccctggaaaccttccacccag

SEQ ID NO: 6533943 - DNA, 12 bp, Homo sapiens
ttccctggcctt

SEQ ID NO: 6533944 - DNA, 17 bp, Homo sapiens
ttccctggcctttcata

SEQ ID NO: 6533945 - DNA, 24 bp, Homo sapiens
ttccctggctacttcccttcctcc

SEQ ID NO: 6533946 - DNA, 13 bp, Homo sapiens
ttccctggctcag

SEQ ID NO: 6533947 - DNA, 23 bp, Homo sapiens
ttccctggcttgtaactccacca

SEQ ID NO: 6533948 - DNA, 20 bp, Homo sapiens
ttccctgggatctggtggtc

SEQ ID NO: 6533949 - DNA, 13 bp, Homo sapiens
ttccctgggcctc

SEQ ID NO: 6533950 - DNA, 23 bp, Homo sapiens
ttccctgggctgccaccagcccc

SEQ ID NO: 6533951 - DNA, 17 bp, Homo sapiens
ttccctgggctgtgcta

SEQ ID NO: 6533952 - DNA, 10 bp, Homo sapiens
ttccctgggg

SEQ ID NO: 6533953 - DNA, 20 bp, Homo sapiens
ttccctggggaaaacttgca

SEQ ID NO: 6533954 - DNA, 17 bp, Homo sapiens
ttccctggggagccctc

SEQ ID NO: 6533955 - DNA, 19 bp, Homo sapiens
ttccctggggagccctcag

SEQ ID NO: 6533956 - DNA, 12 bp, Homo sapiens
ttccctggggcc

SEQ ID NO: 6533957 - DNA, 23 bp, Homo sapiens
ttccctgggggcagatatttccc

SEQ ID NO: 6533958 - DNA, 20 bp, Homo sapiens
ttccctgggtttgggagcca

SEQ ID NO: 6533959 - DNA, 17 bp, Homo sapiens
ttccctggtaagaaaaa

SEQ ID NO: 6533960 - DNA, 15 bp, Homo sapiens
ttccctggtcaccaa

SEQ ID NO: 6533961 - DNA, 22 bp, Homo sapiens
ttccctggtcaccaaggcagtg

SEQ ID NO: 6533962 - DNA, 14 bp, Homo sapiens
ttccctggtccaga

SEQ ID NO: 6533963 - DNA, 20 bp, Homo sapiens
ttccctgtattttctttctc

SEQ ID NO: 6533964 - DNA, 14 bp, Homo sapiens
ttccctgtcagagg

SEQ ID NO: 6533965 - DNA, 15 bp, Homo sapiens
ttccctgtgcctcct

SEQ ID NO: 6533966 - DNA, 11 bp, Homo sapiens
ttccctgtgct

SEQ ID NO: 6533967 - DNA, 18 bp, Homo sapiens
ttccctgtggccttatga

SEQ ID NO: 6533968 - DNA, 15 bp, Homo sapiens
ttccctgtgtctttt

SEQ ID NO: 6533969 - DNA, 13 bp, Homo sapiens
ttccctgtgtgga

SEQ ID NO: 6533970 - DNA, 12 bp, Homo sapiens
ttccctgttctt

SEQ ID NO: 6533971 - DNA, 15 bp, Homo sapiens
ttccctgttcttcct

SEQ ID NO: 6533972 - DNA, 20 bp, Homo sapiens
ttccctgttctttaagactt

SEQ ID NO: 6533973 - DNA, 18 bp, Homo sapiens
ttcccttatttttattta

SEQ ID NO: 6533974 - DNA, 18 bp, Homo sapiens
ttcccttcaaggtcattt

SEQ ID NO: 6533975 - DNA, 20 bp, Homo sapiens
ttcccttccagtttattcca

SEQ ID NO: 6533976 - DNA, 19 bp, Homo sapiens
ttcccttccatctcttcct

SEQ ID NO: 6533977 - DNA, 21 bp, Homo sapiens
ttcccttccatctcttccttt

SEQ ID NO: 6533978 - DNA, 18 bp, Homo sapiens
ttcccttcccagaccagg

SEQ ID NO: 6533979 - DNA, 16 bp, Homo sapiens
ttcccttccctcaccc

SEQ ID NO: 6533980 - DNA, 13 bp, Homo sapiens
ttcccttcctcca

SEQ ID NO: 6533981 - DNA, 20 bp, Homo sapiens
ttcccttcctcggtggctct

SEQ ID NO: 6533982 - DNA, 12 bp, Homo sapiens
ttcccttcctct

SEQ ID NO: 6533983 - DNA, 15 bp, Homo sapiens
ttcccttcctctgat

SEQ ID NO: 6533984 - DNA, 13 bp, Homo sapiens
ttcccttcctctt

SEQ ID NO: 6533985 - DNA, 15 bp, Homo sapiens
ttcccttcctcttcc

SEQ ID NO: 6533986 - DNA, 15 bp, Homo sapiens
ttcccttcctgccag

SEQ ID NO: 6533987 - DNA, 12 bp, Homo sapiens
ttcccttctccc

SEQ ID NO: 6533988 - DNA, 13 bp, Homo sapiens
ttcccttctcccc

SEQ ID NO: 6533989 - DNA, 18 bp, Homo sapiens
ttcccttctccccagcca

SEQ ID NO: 6533990 - DNA, 23 bp, Homo sapiens
ttcccttctcccccttgtcttcc

SEQ ID NO: 6533991 - DNA, 20 bp, Homo sapiens
ttcccttctccttccaactg

SEQ ID NO: 6533992 - DNA, 11 bp, Homo sapiens
ttcccttctct

SEQ ID NO: 6533993 - DNA, 13 bp, Homo sapiens
ttcccttctctca

SEQ ID NO: 6533994 - DNA, 19 bp, Homo sapiens
ttcccttctctggtctcct

SEQ ID NO: 6533995 - DNA, 14 bp, Homo sapiens
ttcccttctcttgg

SEQ ID NO: 6533996 - DNA, 22 bp, Homo sapiens
ttcccttctgatcttggaaaga

SEQ ID NO: 6533997 - DNA, 22 bp, Homo sapiens
ttcccttctgggcttcattctg

SEQ ID NO: 6533998 - DNA, 22 bp, Homo sapiens
ttcccttcttggtttccaaagg

SEQ ID NO: 6533999 - DNA, 17 bp, Homo sapiens
ttcccttcttttcctgg

SEQ ID NO: 6534000 - DNA, 21 bp, Homo sapiens
ttcccttcttttcctgggtgc

SEQ ID NO: 6534001 - DNA, 14 bp, Homo sapiens
ttcccttgaaactt

SEQ ID NO: 6534002 - DNA, 14 bp, Homo sapiens
ttcccttgaccatt

SEQ ID NO: 6534003 - DNA, 23 bp, Homo sapiens
ttcccttgagatgagtttctggg

SEQ ID NO: 6534004 - DNA, 18 bp, Homo sapiens
ttcccttgatgaagaagt

SEQ ID NO: 6534005 - DNA, 15 bp, Homo sapiens
ttcccttgccctggg

SEQ ID NO: 6534006 - DNA, 15 bp, Homo sapiens
ttcccttgctcatga

SEQ ID NO: 6534007 - DNA, 20 bp, Homo sapiens
ttcccttgctcatgagctcc

SEQ ID NO: 6534008 - DNA, 13 bp, Homo sapiens
ttcccttgctgta

SEQ ID NO: 6534009 - DNA, 19 bp, Homo sapiens
ttcccttgcttttccctct

SEQ ID NO: 6534010 - DNA, 17 bp, Homo sapiens
ttcccttggatgtagtc

SEQ ID NO: 6534011 - DNA, 14 bp, Homo sapiens
ttcccttggcctca

SEQ ID NO: 6534012 - DNA, 17 bp, Homo sapiens
ttcccttgggctggaga

SEQ ID NO: 6534013 - DNA, 20 bp, Homo sapiens
ttcccttgtagctcctcccc

SEQ ID NO: 6534014 - DNA, 15 bp, Homo sapiens
ttcccttgtgtctgt

SEQ ID NO: 6534015 - DNA, 23 bp, Homo sapiens
ttccctttaaccctcacactgct

SEQ ID NO: 6534016 - DNA, 21 bp, Homo sapiens
ttccctttagcacgtttaaag

SEQ ID NO: 6534017 - DNA, 17 bp, Homo sapiens
ttccctttatttctctt

SEQ ID NO: 6534018 - DNA, 12 bp, Homo sapiens
ttccctttcccc

SEQ ID NO: 6534019 - DNA, 23 bp, Homo sapiens
ttccctttctttaaaagaaactt

SEQ ID NO: 6534020 - DNA, 14 bp, Homo sapiens
ttccctttgacttc

SEQ ID NO: 6534021 - DNA, 11 bp, Homo sapiens
ttccctttgcc

SEQ ID NO: 6534022 - DNA, 14 bp, Homo sapiens
ttccctttgcctta

SEQ ID NO: 6534023 - DNA, 15 bp, Homo sapiens
ttccctttgccttaa

SEQ ID NO: 6534024 - DNA, 17 bp, Homo sapiens
ttccctttgctccaccc

SEQ ID NO: 6534025 - DNA, 17 bp, Homo sapiens
ttccctttggagatgct

SEQ ID NO: 6534026 - DNA, 22 bp, Homo sapiens
ttccctttggggatagtctgga

SEQ ID NO: 6534027 - DNA, 14 bp, Homo sapiens
ttccctttgttgct

SEQ ID NO: 6534028 - DNA, 18 bp, Homo sapiens
ttccctttgttgctgtct

SEQ ID NO: 6534029 - DNA, 14 bp, Homo sapiens
ttcccttttaaaga

SEQ ID NO: 6534030 - DNA, 23 bp, Homo sapiens
ttcccttttaaagaatttttgcc

SEQ ID NO: 6534031 - DNA, 21 bp, Homo sapiens
ttcccttttacatactgctgt

SEQ ID NO: 6534032 - DNA, 17 bp, Homo sapiens
ttcccttttccatcatc

SEQ ID NO: 6534033 - DNA, 14 bp, Homo sapiens
ttcccttttctgtt

SEQ ID NO: 6534034 - DNA, 16 bp, Homo sapiens
ttcccttttctgttta

SEQ ID NO: 6534035 - DNA, 16 bp, Homo sapiens
ttcccttttgactctt

SEQ ID NO: 6534036 - DNA, 15 bp, Homo sapiens
ttccctttttaaaaa

SEQ ID NO: 6534037 - DNA, 20 bp, Homo sapiens
ttccctttttaaaaaatacc

SEQ ID NO: 6534038 - DNA, 18 bp, Homo sapiens
ttcccttttttggctgct

SEQ ID NO: 6534039 - DNA, 19 bp, Homo sapiens
ttcccttttttggctgctg

SEQ ID NO: 6534040 - DNA, 15 bp, Homo sapiens
tggttccatgttgac

SEQ ID NO: 6534041 - DNA, 20 bp, Homo sapiens
tggttcccaatatcatgtga

SEQ ID NO: 6534042 - DNA, 15 bp, Homo sapiens
tggttcccagaaaac

SEQ ID NO: 6534043 - DNA, 15 bp, Homo sapiens
tggttccccaggagg

SEQ ID NO: 6534044 - DNA, 19 bp, Homo sapiens
tggttcccctgttcactct

SEQ ID NO: 6534045 - DNA, 20 bp, Homo sapiens
tggttcccctgttcactcta

SEQ ID NO: 6534046 - DNA, 12 bp, Homo sapiens
tggttccctctt

SEQ ID NO: 6534047 - DNA, 17 bp, Homo sapiens
tggttccctctttcctg

SEQ ID NO: 6534048 - DNA, 14 bp, Homo sapiens
tggttccctgctgc

SEQ ID NO: 6534049 - DNA, 14 bp, Homo sapiens
tggttcccttccta

SEQ ID NO: 6534050 - DNA, 23 bp, Homo sapiens
tggttccgacttgtccctctctc

SEQ ID NO: 6534051 - DNA, 16 bp, Homo sapiens
tggttcctaagcctgt

SEQ ID NO: 6534052 - DNA, 17 bp, Homo sapiens
tggttcctaagcctgtt

SEQ ID NO: 6534053 - DNA, 14 bp, Homo sapiens
tggttcctcatggc

SEQ ID NO: 6534054 - DNA, 18 bp, Homo sapiens
tggttcctccagccacct

SEQ ID NO: 6534055 - DNA, 12 bp, Homo sapiens
tggttcctcccc

SEQ ID NO: 6534056 - DNA, 18 bp, Homo sapiens
tggttcctcccctcctcc

SEQ ID NO: 6534057 - DNA, 14 bp, Homo sapiens
tggttcctctacta

SEQ ID NO: 6534058 - DNA, 19 bp, Homo sapiens
tggttcctgctagaaatgg

SEQ ID NO: 6534059 - DNA, 22 bp, Homo sapiens
tggttcctgctgtcctggtggc

SEQ ID NO: 6534060 - DNA, 12 bp, Homo sapiens
tggttcctggga

SEQ ID NO: 6534061 - DNA, 14 bp, Homo sapiens
tggttcctggggca

SEQ ID NO: 6534062 - DNA, 16 bp, Homo sapiens
tggttcctgtttgaaa

SEQ ID NO: 6534063 - DNA, 18 bp, Homo sapiens
tggttcctgtttgaaact

SEQ ID NO: 6534064 - DNA, 20 bp, Homo sapiens
tggttcctgtttgaaactaa

SEQ ID NO: 6534065 - DNA, 16 bp, Homo sapiens
tggttccttccctggg

SEQ ID NO: 6534066 - DNA, 23 bp, Homo sapiens
tggttccttctgatccacagcct

SEQ ID NO: 6534067 - DNA, 17 bp, Homo sapiens
tggttcctttctcagcc

SEQ ID NO: 6534068 - DNA, 17 bp, Homo sapiens
tggttctaactgctgtt

SEQ ID NO: 6534069 - DNA, 22 bp, Homo sapiens
tggttctaaggacctgaaattc

SEQ ID NO: 6534070 - DNA, 14 bp, Homo sapiens
tggttctataataa

SEQ ID NO: 6534071 - DNA, 14 bp, Homo sapiens
tggttctatgctaa

SEQ ID NO: 6534072 - DNA, 14 bp, Homo sapiens
tggttctatttaat

SEQ ID NO: 6534073 - DNA, 11 bp, Homo sapiens
tggttctcaat

SEQ ID NO: 6534074 - DNA, 14 bp, Homo sapiens
tggttctcaatgaa

SEQ ID NO: 6534075 - DNA, 18 bp, Homo sapiens
tggttctcaattccaaca

SEQ ID NO: 6534076 - DNA, 16 bp, Homo sapiens
tggttctcaattgtat

SEQ ID NO: 6534077 - DNA, 13 bp, Homo sapiens
tggttctcaattt

SEQ ID NO: 6534078 - DNA, 15 bp, Homo sapiens
tggttctcatctttc

SEQ ID NO: 6534079 - DNA, 13 bp, Homo sapiens
tggttctccatcc

SEQ ID NO: 6534080 - DNA, 22 bp, Homo sapiens
tggttctccttcctcagcctcc

SEQ ID NO: 6534081 - DNA, 14 bp, Homo sapiens
tggttctctgcctt

SEQ ID NO: 6534082 - DNA, 16 bp, Homo sapiens
tggttctctgggcctc

SEQ ID NO: 6534083 - DNA, 17 bp, Homo sapiens
tggttctgaaagtggct

SEQ ID NO: 6534084 - DNA, 19 bp, Homo sapiens
tggttctgaggccagaaag

SEQ ID NO: 6534085 - DNA, 20 bp, Homo sapiens
tggttctgatgatgtgcctg

SEQ ID NO: 6534086 - DNA, 15 bp, Homo sapiens
tggttctgcttcaat

SEQ ID NO: 6534087 - DNA, 12 bp, Homo sapiens
tggttctggcca

SEQ ID NO: 6534088 - DNA, 21 bp, Homo sapiens
tggttctgtgctaatcaaaac

SEQ ID NO: 6534089 - DNA, 19 bp, Homo sapiens
tggttcttagttctcactg

SEQ ID NO: 6534090 - DNA, 15 bp, Homo sapiens
tggttcttattcact

SEQ ID NO: 6534091 - DNA, 22 bp, Homo sapiens
tggttcttcaaatcttaagaga

SEQ ID NO: 6534092 - DNA, 22 bp, Homo sapiens
tggttcttcctttccctggagc

SEQ ID NO: 6534093 - DNA, 15 bp, Homo sapiens
tggttcttctctttt

SEQ ID NO: 6534094 - DNA, 23 bp, Homo sapiens
tggttcttctgacacttgtggta

SEQ ID NO: 6534095 - DNA, 14 bp, Homo sapiens
tggttcttgtatta

SEQ ID NO: 6534096 - DNA, 18 bp, Homo sapiens
tggttcttgtattaagaa

SEQ ID NO: 6534097 - DNA, 15 bp, Homo sapiens
tggttctttcagctg

SEQ ID NO: 6534098 - DNA, 22 bp, Homo sapiens
tggttcttttaccccacgaaga

SEQ ID NO: 6534099 - DNA, 18 bp, Homo sapiens
tggttgaaaagattccat

SEQ ID NO: 6534100 - DNA, 19 bp, Homo sapiens
tggttgaaggtcacagaag

SEQ ID NO: 6534101 - DNA, 20 bp, Homo sapiens
tggttgaaggtcacagaagt

SEQ ID NO: 6534102 - DNA, 12 bp, Homo sapiens
tggttgaataaa

SEQ ID NO: 6534103 - DNA, 23 bp, Homo sapiens
tggttgaatacagttacttaatg

SEQ ID NO: 6534104 - DNA, 12 bp, Homo sapiens
tggttgaatatg

SEQ ID NO: 6534105 - DNA, 14 bp, Homo sapiens
tggttgaatgaata

SEQ ID NO: 6534106 - DNA, 20 bp, Homo sapiens
tggttgaatgaataaaacaa

SEQ ID NO: 6534107 - DNA, 23 bp, Homo sapiens
tggttgacccaaaaatgttccct

SEQ ID NO: 6534108 - DNA, 17 bp, Homo sapiens
tggttgagaaatgaata

SEQ ID NO: 6534109 - DNA, 22 bp, Homo sapiens
tggttgaggtggaagccctcct

SEQ ID NO: 6534110 - DNA, 22 bp, Homo sapiens
tggttgagttcaggtagctgcc

SEQ ID NO: 6534111 - DNA, 18 bp, Homo sapiens
tggttgatgatctttgca

SEQ ID NO: 6534112 - DNA, 15 bp, Homo sapiens
tggttgatggaaaat

SEQ ID NO: 6534113 - DNA, 17 bp, Homo sapiens
tggttgatggaaaataa

SEQ ID NO: 6534114 - DNA, 16 bp, Homo sapiens
tggttgatggttttgc

SEQ ID NO: 6534115 - DNA, 15 bp, Homo sapiens
tggttgatgtttaaa

SEQ ID NO: 6534116 - DNA, 12 bp, Homo sapiens
tggttgatttca

SEQ ID NO: 6534117 - DNA, 20 bp, Homo sapiens
tggttgcaattgtttaagaa

SEQ ID NO: 6534118 - DNA, 20 bp, Homo sapiens
tggttgcacttatgatttca

SEQ ID NO: 6534119 - DNA, 16 bp, Homo sapiens
tggttgcactttgtag

SEQ ID NO: 6534120 - DNA, 14 bp, Homo sapiens
tggttgcagcctga

SEQ ID NO: 6534121 - DNA, 11 bp, Homo sapiens
tggttgcatgg

SEQ ID NO: 6534122 - DNA, 22 bp, Homo sapiens
tggttgccagtagtaccttgtt

SEQ ID NO: 6534123 - DNA, 19 bp, Homo sapiens
tggttgccgtctctggccc

SEQ ID NO: 6534124 - DNA, 15 bp, Homo sapiens
tggttgcctgccctc

SEQ ID NO: 6534125 - DNA, 17 bp, Homo sapiens
tggttgccttaaaagaa

SEQ ID NO: 6534126 - DNA, 18 bp, Homo sapiens
tggttgccttaaagaaag

SEQ ID NO: 6534127 - DNA, 13 bp, Homo sapiens
tggttgctgtgtg

SEQ ID NO: 6534128 - DNA, 19 bp, Homo sapiens
tggttgctgttttcctccc

SEQ ID NO: 6534129 - DNA, 14 bp, Homo sapiens
tggttgctttaata

SEQ ID NO: 6534130 - DNA, 17 bp, Homo sapiens
tggttggaagcctcccc

SEQ ID NO: 6534131 - DNA, 18 bp, Homo sapiens
tggttggacctattgcca

SEQ ID NO: 6534132 - DNA, 21 bp, Homo sapiens
tggttggccgtggtccagctc

SEQ ID NO: 6534133 - DNA, 23 bp, Homo sapiens
tggttggccgtggtccagctctt

SEQ ID NO: 6534134 - DNA, 18 bp, Homo sapiens
tggttggctgggaaatcg

SEQ ID NO: 6534135 - DNA, 17 bp, Homo sapiens
tggttggctggttgttt

SEQ ID NO: 6534136 - DNA, 18 bp, Homo sapiens
tggttgggctgtgcctgg

SEQ ID NO: 6534137 - DNA, 19 bp, Homo sapiens
tggttggggccctgccctg

SEQ ID NO: 6534138 - DNA, 18 bp, Homo sapiens
tggttggggtggggcagg

SEQ ID NO: 6534139 - DNA, 22 bp, Homo sapiens
tggttgggtcaaggacagggct

SEQ ID NO: 6534140 - DNA, 15 bp, Homo sapiens
tggttgggtcctcac

SEQ ID NO: 6534141 - DNA, 22 bp, Homo sapiens
tggttggtaacacaaattttca

SEQ ID NO: 6534142 - DNA, 19 bp, Homo sapiens
tggttggttagtgcatgtc

SEQ ID NO: 6534143 - DNA, 24 bp, Homo sapiens
tggttggttttgacttcagattga

SEQ ID NO: 6534144 - DNA, 17 bp, Homo sapiens
tggttgtaaatgctcgt

SEQ ID NO: 6534145 - DNA, 18 bp, Homo sapiens
tggttgtaattaaatttt

SEQ ID NO: 6534146 - DNA, 15 bp, Homo sapiens
tggttgtagaaggag

SEQ ID NO: 6534147 - DNA, 14 bp, Homo sapiens
tggttgtatctgtg

SEQ ID NO: 6534148 - DNA, 15 bp, Homo sapiens
tggttgtattctttg

SEQ ID NO: 6534149 - DNA, 12 bp, Homo sapiens
tggttgtatttc

SEQ ID NO: 6534150 - DNA, 14 bp, Homo sapiens
tggttgtatttcta

SEQ ID NO: 6534151 - DNA, 16 bp, Homo sapiens
tggttgtcactctaca

SEQ ID NO: 6534152 - DNA, 15 bp, Homo sapiens
tggttgtccaggtct

SEQ ID NO: 6534153 - DNA, 20 bp, Homo sapiens
tggttgtctagtcattgtca

SEQ ID NO: 6534154 - DNA, 22 bp, Homo sapiens
tggttgtctgaacccaggcagc

SEQ ID NO: 6534155 - DNA, 16 bp, Homo sapiens
tggttgtcttattgca

SEQ ID NO: 6534156 - DNA, 18 bp, Homo sapiens
tggttgtgaaatgtaaca

SEQ ID NO: 6534157 - DNA, 21 bp, Homo sapiens
tggttgtgaaccaactgcctt

SEQ ID NO: 6534158 - DNA, 15 bp, Homo sapiens
tggttgtgacttccc

SEQ ID NO: 6534159 - DNA, 15 bp, Homo sapiens
tggttgtgcacatgc

SEQ ID NO: 6534160 - DNA, 16 bp, Homo sapiens
tggttgtgccttttgt

SEQ ID NO: 6534161 - DNA, 16 bp, Homo sapiens
tggttgtgggcttgga

SEQ ID NO: 6534162 - DNA, 15 bp, Homo sapiens
tggttgtgtctgctt

SEQ ID NO: 6534163 - DNA, 17 bp, Homo sapiens
tggttgtgtgtgttctg

SEQ ID NO: 6534164 - DNA, 14 bp, Homo sapiens
tggttgttgcatat

SEQ ID NO: 6534165 - DNA, 16 bp, Homo sapiens
tggttgttgcatatag

SEQ ID NO: 6534166 - DNA, 16 bp, Homo sapiens
tggttgtttctctgag

SEQ ID NO: 6534167 - DNA, 17 bp, Homo sapiens
tggttgtttctgttcca

SEQ ID NO: 6534168 - DNA, 14 bp, Homo sapiens
tggttgtttcttcc

SEQ ID NO: 6534169 - DNA, 22 bp, Homo sapiens
tggtttaaaaagtttcacgtct

SEQ ID NO: 6534170 - DNA, 19 bp, Homo sapiens
tggtttaaatatgaatgaa

SEQ ID NO: 6534171 - DNA, 17 bp, Homo sapiens
tggtttaattcagcaga

SEQ ID NO: 6534172 - DNA, 17 bp, Homo sapiens
tggtttacatgaacaca

SEQ ID NO: 6534173 - DNA, 11 bp, Homo sapiens
tggtttactgc

SEQ ID NO: 6534174 - DNA, 15 bp, Homo sapiens
tggtttactgctgtc

SEQ ID NO: 6534175 - DNA, 21 bp, Homo sapiens
tggtttagaatgctgcgctta

SEQ ID NO: 6534176 - DNA, 16 bp, Homo sapiens
tggtttagctttggaa

SEQ ID NO: 6534177 - DNA, 20 bp, Homo sapiens
tggtttagtgtaaaaatgag

SEQ ID NO: 6534178 - DNA, 21 bp, Homo sapiens
tggtttagtgtaaaaatgaga

SEQ ID NO: 6534179 - DNA, 17 bp, Homo sapiens
tggtttagtgttctgta

SEQ ID NO: 6534180 - DNA, 11 bp, Homo sapiens
tggtttataga

SEQ ID NO: 6534181 - DNA, 17 bp, Homo sapiens
tggtttatataagacca

SEQ ID NO: 6534182 - DNA, 20 bp, Homo sapiens
tggtttatattcttatgtta

SEQ ID NO: 6534183 - DNA, 16 bp, Homo sapiens
tggtttatgactttgt

SEQ ID NO: 6534184 - DNA, 22 bp, Homo sapiens
tggtttatgagaactggttctt

SEQ ID NO: 6534185 - DNA, 12 bp, Homo sapiens
tggtttatgtca

SEQ ID NO: 6534186 - DNA, 15 bp, Homo sapiens
tggtttattcccaag

SEQ ID NO: 6534187 - DNA, 20 bp, Homo sapiens
tggtttattcccaagtatgc

SEQ ID NO: 6534188 - DNA, 23 bp, Homo sapiens
tggtttattccctccagggtcta

SEQ ID NO: 6534189 - DNA, 17 bp, Homo sapiens
tggtttattctttgcaa

SEQ ID NO: 6534190 - DNA, 22 bp, Homo sapiens
tggtttattggtgagttaggaa

SEQ ID NO: 6534191 - DNA, 20 bp, Homo sapiens
tggtttatttgttgttttct

SEQ ID NO: 6534192 - DNA, 11 bp, Homo sapiens
tggtttcaaag

SEQ ID NO: 6534193 - DNA, 23 bp, Homo sapiens
tggtttcaaagtaaaggcctcct

SEQ ID NO: 6534194 - DNA, 16 bp, Homo sapiens
tggtttcaattcagat

SEQ ID NO: 6534195 - DNA, 14 bp, Homo sapiens
tggtttcaccttcc

SEQ ID NO: 6534196 - DNA, 16 bp, Homo sapiens
tggtttcaccttccct

SEQ ID NO: 6534197 - DNA, 17 bp, Homo sapiens
tggtttcaccttccctc

SEQ ID NO: 6534198 - DNA, 20 bp, Homo sapiens
tggtttcagatgtgcaataa

SEQ ID NO: 6534199 - DNA, 22 bp, Homo sapiens
tggtttcataacttcctgtact

SEQ ID NO: 6534200 - DNA, 15 bp, Homo sapiens
tggtttcatgttagt

SEQ ID NO: 6534201 - DNA, 16 bp, Homo sapiens
tggtttcattgccttc

SEQ ID NO: 6534202 - DNA, 16 bp, Homo sapiens
tggtttccaaggagct

SEQ ID NO: 6534203 - DNA, 14 bp, Homo sapiens
tggtttccaatgtg

SEQ ID NO: 6534204 - DNA, 16 bp, Homo sapiens
tggtttccaatgtgtt

SEQ ID NO: 6534205 - DNA, 18 bp, Homo sapiens
tggtttccacatgctctg

SEQ ID NO: 6534206 - DNA, 18 bp, Homo sapiens
tggtttccagtcatgagc

SEQ ID NO: 6534207 - DNA, 17 bp, Homo sapiens
tggtttcccaagagcta

SEQ ID NO: 6534208 - DNA, 18 bp, Homo sapiens
tggtttcccattggttca

SEQ ID NO: 6534209 - DNA, 16 bp, Homo sapiens
tggtttccctgcccct

SEQ ID NO: 6534210 - DNA, 17 bp, Homo sapiens
tggtttccctgcccctg

SEQ ID NO: 6534211 - DNA, 19 bp, Homo sapiens
tggtttcctcattcctgaa

SEQ ID NO: 6534212 - DNA, 22 bp, Homo sapiens
tggtttcctccatttgagaaaa

SEQ ID NO: 6534213 - DNA, 14 bp, Homo sapiens
tggtttcctcgaga

SEQ ID NO: 6534214 - DNA, 12 bp, Homo sapiens
tggtttcctgcc

SEQ ID NO: 6534215 - DNA, 13 bp, Homo sapiens
tggtttcctgccc

SEQ ID NO: 6534216 - DNA, 15 bp, Homo sapiens
tggtttcctgcccag

SEQ ID NO: 6534217 - DNA, 21 bp, Homo sapiens
tggtttcctgcccagcctggg

SEQ ID NO: 6534218 - DNA, 14 bp, Homo sapiens
tggtttcctgccct

SEQ ID NO: 6534219 - DNA, 15 bp, Homo sapiens
tggtttcctgccctg

SEQ ID NO: 6534220 - DNA, 16 bp, Homo sapiens
ttcccttttttttctg

SEQ ID NO: 6534221 - DNA, 21 bp, Homo sapiens
ttccgaagaccttctgaagat

SEQ ID NO: 6534222 - DNA, 15 bp, Homo sapiens
ttccgacaccactgg

SEQ ID NO: 6534223 - DNA, 16 bp, Homo sapiens
ttccgacaccactggg

SEQ ID NO: 6534224 - DNA, 17 bp, Homo sapiens
ttccgaccctctgggaa

SEQ ID NO: 6534225 - DNA, 16 bp, Homo sapiens
ttccgactgcccagaa

SEQ ID NO: 6534226 - DNA, 19 bp, Homo sapiens
ttccgacttgtccctctct

SEQ ID NO: 6534227 - DNA, 16 bp, Homo sapiens
ttccgagtctttctca

SEQ ID NO: 6534228 - DNA, 16 bp, Homo sapiens
ttccgatcaacattta

SEQ ID NO: 6534229 - DNA, 18 bp, Homo sapiens
ttccgcaccctccctagc

SEQ ID NO: 6534230 - DNA, 14 bp, Homo sapiens
ttccgcaccctgcc

SEQ ID NO: 6534231 - DNA, 20 bp, Homo sapiens
ttccgcactacctgaacatt

SEQ ID NO: 6534232 - DNA, 17 bp, Homo sapiens
ttccgcagcccctttcc

SEQ ID NO: 6534233 - DNA, 18 bp, Homo sapiens
ttccgccaatctggccct

SEQ ID NO: 6534234 - DNA, 18 bp, Homo sapiens
ttccgccactggggctca

SEQ ID NO: 6534235 - DNA, 18 bp, Homo sapiens
ttccgcccactcctggga

SEQ ID NO: 6534236 - DNA, 15 bp, Homo sapiens
ttccgccccttccct

SEQ ID NO: 6534237 - DNA, 17 bp, Homo sapiens
ttccgccccttcccttc

SEQ ID NO: 6534238 - DNA, 13 bp, Homo sapiens
ttccgcctcctgt

SEQ ID NO: 6534239 - DNA, 13 bp, Homo sapiens
ttccgctctgagg

SEQ ID NO: 6534240 - DNA, 18 bp, Homo sapiens
ttccgctgtcacccagca

SEQ ID NO: 6534241 - DNA, 22 bp, Homo sapiens
ttccgctgtcgccccaggccct

SEQ ID NO: 6534242 - DNA, 22 bp, Homo sapiens
ttccggagctgggtatctcaaa

SEQ ID NO: 6534243 - DNA, 17 bp, Homo sapiens
ttccggcacactgccaa

SEQ ID NO: 6534244 - DNA, 18 bp, Homo sapiens
ttccggcacactgccaaa

SEQ ID NO: 6534245 - DNA, 22 bp, Homo sapiens
ttccggcatggacaatggaccg

SEQ ID NO: 6534246 - DNA, 13 bp, Homo sapiens
ttccggcccctcc

SEQ ID NO: 6534247 - DNA, 19 bp, Homo sapiens
ttccggctgagctgtgcca

SEQ ID NO: 6534248 - DNA, 18 bp, Homo sapiens
ttccgggaataacatgat

SEQ ID NO: 6534249 - DNA, 20 bp, Homo sapiens
ttccgggtctcgcagcctga

SEQ ID NO: 6534250 - DNA, 23 bp, Homo sapiens
ttccgggtctcgcagcctgaagc

SEQ ID NO: 6534251 - DNA, 15 bp, Homo sapiens
ttccgtatctccctg

SEQ ID NO: 6534252 - DNA, 17 bp, Homo sapiens
ttccgtatttaaagttg

SEQ ID NO: 6534253 - DNA, 15 bp, Homo sapiens
ttccgtcagaaagtg

SEQ ID NO: 6534254 - DNA, 13 bp, Homo sapiens
ttccgtcatgctc

SEQ ID NO: 6534255 - DNA, 14 bp, Homo sapiens
ttccgtccatcccc

SEQ ID NO: 6534256 - DNA, 17 bp, Homo sapiens
ttccgtccatccccctt

SEQ ID NO: 6534257 - DNA, 13 bp, Homo sapiens
ttccgtccccccc

SEQ ID NO: 6534258 - DNA, 19 bp, Homo sapiens
ttccgtccccccccaggcc

SEQ ID NO: 6534259 - DNA, 19 bp, Homo sapiens
ttccgtctccctaaaataa

SEQ ID NO: 6534260 - DNA, 13 bp, Homo sapiens
ttccgtctcctct

SEQ ID NO: 6534261 - DNA, 17 bp, Homo sapiens
ttccgtgaagggcaccg

SEQ ID NO: 6534262 - DNA, 13 bp, Homo sapiens
ttccgtgccaggc

SEQ ID NO: 6534263 - DNA, 17 bp, Homo sapiens
ttccgtgccgtgtattt

SEQ ID NO: 6534264 - DNA, 16 bp, Homo sapiens
ttccgtgcgtggcact

SEQ ID NO: 6534265 - DNA, 18 bp, Homo sapiens
ttccgtgggtcatcccag

SEQ ID NO: 6534266 - DNA, 19 bp, Homo sapiens
ttccgtggtcagagtgcca

SEQ ID NO: 6534267 - DNA, 12 bp, Homo sapiens
ttccgtgtcctc

SEQ ID NO: 6534268 - DNA, 14 bp, Homo sapiens
ttccgtgtcctctc

SEQ ID NO: 6534269 - DNA, 14 bp, Homo sapiens
ttccgttcattgct

SEQ ID NO: 6534270 - DNA, 13 bp, Homo sapiens
ttccgttccccgc

SEQ ID NO: 6534271 - DNA, 15 bp, Homo sapiens
ttccgttccccgcta

SEQ ID NO: 6534272 - DNA, 16 bp, Homo sapiens
ttccgttcctccccct

SEQ ID NO: 6534273 - DNA, 15 bp, Homo sapiens
ttccgttggaaagaa

SEQ ID NO: 6534274 - DNA, 14 bp, Homo sapiens
ttccgttgtctgtg

SEQ ID NO: 6534275 - DNA, 19 bp, Homo sapiens
ttcctaaaaataagcttta

SEQ ID NO: 6534276 - DNA, 20 bp, Homo sapiens
ttcctaaaaataagctttat

SEQ ID NO: 6534277 - DNA, 19 bp, Homo sapiens
ttcctaaaacacccttcag

SEQ ID NO: 6534278 - DNA, 13 bp, Homo sapiens
ttcctaaaattat

SEQ ID NO: 6534279 - DNA, 12 bp, Homo sapiens
ttcctaaacata

SEQ ID NO: 6534280 - DNA, 16 bp, Homo sapiens
ttcctaaactctgaaa

SEQ ID NO: 6534281 - DNA, 18 bp, Homo sapiens
ttcctaaagaaaaagata

SEQ ID NO: 6534282 - DNA, 15 bp, Homo sapiens
ttcctaaagccatca

SEQ ID NO: 6534283 - DNA, 20 bp, Homo sapiens
ttcctaaatcagcatttttc

SEQ ID NO: 6534284 - DNA, 13 bp, Homo sapiens
ttcctaaatgcag

SEQ ID NO: 6534285 - DNA, 14 bp, Homo sapiens
ttcctaaatgcagt

SEQ ID NO: 6534286 - DNA, 12 bp, Homo sapiens
ttcctaaatttt

SEQ ID NO: 6534287 - DNA, 14 bp, Homo sapiens
ttcctaacaaaatg

SEQ ID NO: 6534288 - DNA, 19 bp, Homo sapiens
ttcctaacacagcatgtgt

SEQ ID NO: 6534289 - DNA, 19 bp, Homo sapiens
ttcctaacaggattagaca

SEQ ID NO: 6534290 - DNA, 24 bp, Homo sapiens
ttcctaactagaattagtatgtct

SEQ ID NO: 6534291 - DNA, 11 bp, Homo sapiens
ttcctaactta

SEQ ID NO: 6534292 - DNA, 19 bp, Homo sapiens
ttcctaagaagtccccagg

SEQ ID NO: 6534293 - DNA, 18 bp, Homo sapiens
ttcctaagacatttttca

SEQ ID NO: 6534294 - DNA, 23 bp, Homo sapiens
ttcctaagacatttttcattcat

SEQ ID NO: 6534295 - DNA, 20 bp, Homo sapiens
ttcctaagactgctgctgaa

SEQ ID NO: 6534296 - DNA, 21 bp, Homo sapiens
ttcctaagagtggaggaggag

SEQ ID NO: 6534297 - DNA, 22 bp, Homo sapiens
ttcctaagccacttgaaatgtt

SEQ ID NO: 6534298 - DNA, 17 bp, Homo sapiens
ttcctaagcctgtggct

SEQ ID NO: 6534299 - DNA, 20 bp, Homo sapiens
ttcctaaggccactgtttta

SEQ ID NO: 6534300 - DNA, 14 bp, Homo sapiens
ttcctaaggcccag

SEQ ID NO: 6534301 - DNA, 17 bp, Homo sapiens
ttcctaaggcccagctg

SEQ ID NO: 6534302 - DNA, 22 bp, Homo sapiens
ttcctaaggcccagctgccagg

SEQ ID NO: 6534303 - DNA, 14 bp, Homo sapiens
ttcctaaggctgca

SEQ ID NO: 6534304 - DNA, 16 bp, Homo sapiens
ttcctaagttcccttc

SEQ ID NO: 6534305 - DNA, 17 bp, Homo sapiens
ttcctaagttcttagat

SEQ ID NO: 6534306 - DNA, 22 bp, Homo sapiens
ttcctaataaagttctgtactc

SEQ ID NO: 6534307 - DNA, 16 bp, Homo sapiens
ttcctaatatcaaatg

SEQ ID NO: 6534308 - DNA, 13 bp, Homo sapiens
ttcctaatcctct

SEQ ID NO: 6534309 - DNA, 14 bp, Homo sapiens
ttcctaattctatg

SEQ ID NO: 6534310 - DNA, 17 bp, Homo sapiens
ttcctaattgtgcccct

SEQ ID NO: 6534311 - DNA, 13 bp, Homo sapiens
ttcctaattttag

SEQ ID NO: 6534312 - DNA, 13 bp, Homo sapiens
ttcctacaaaatg

SEQ ID NO: 6534313 - DNA, 18 bp, Homo sapiens
ttcctacaaagaaaaaag

SEQ ID NO: 6534314 - DNA, 16 bp, Homo sapiens
ttcctacaaagatgtt

SEQ ID NO: 6534315 - DNA, 20 bp, Homo sapiens
ttcctacaagagcagcctgt

SEQ ID NO: 6534316 - DNA, 14 bp, Homo sapiens
ttcctacacaggac

SEQ ID NO: 6534317 - DNA, 23 bp, Homo sapiens
ttcctacagagccaaaatgccat

SEQ ID NO: 6534318 - DNA, 18 bp, Homo sapiens
ttcctacagatagtcaaa

SEQ ID NO: 6534319 - DNA, 15 bp, Homo sapiens
ttcctacagcactac

SEQ ID NO: 6534320 - DNA, 22 bp, Homo sapiens
ttcctacagcactactgggtgt

SEQ ID NO: 6534321 - DNA, 23 bp, Homo sapiens
ttcctacagcactactgggtgtc

SEQ ID NO: 6534322 - DNA, 20 bp, Homo sapiens
ttcctacatgccccctccct

SEQ ID NO: 6534323 - DNA, 20 bp, Homo sapiens
ttcctacccacacctctgcc

SEQ ID NO: 6534324 - DNA, 17 bp, Homo sapiens
ttcctacccctcttcca

SEQ ID NO: 6534325 - DNA, 22 bp, Homo sapiens
ttcctacccctcttccagcttc

SEQ ID NO: 6534326 - DNA, 23 bp, Homo sapiens
ttcctacccctcttccagcttct

SEQ ID NO: 6534327 - DNA, 16 bp, Homo sapiens
ttcctaccctgcctcc

SEQ ID NO: 6534328 - DNA, 23 bp, Homo sapiens
ttcctaccgtactccctgcaccg

SEQ ID NO: 6534329 - DNA, 16 bp, Homo sapiens
ttcctaccttggtcct

SEQ ID NO: 6534330 - DNA, 23 bp, Homo sapiens
ttcctacgtaggatgaaaagatt

SEQ ID NO: 6534331 - DNA, 16 bp, Homo sapiens
ttcctactcacacttc

SEQ ID NO: 6534332 - DNA, 19 bp, Homo sapiens
ttcctactccctcttccaa

SEQ ID NO: 6534333 - DNA, 20 bp, Homo sapiens
ttcctactccctcttccaaa

SEQ ID NO: 6534334 - DNA, 14 bp, Homo sapiens
ttcctactcctcat

SEQ ID NO: 6534335 - DNA, 12 bp, Homo sapiens
ttcctactcttc

SEQ ID NO: 6534336 - DNA, 18 bp, Homo sapiens
ttcctactcttctctctg

SEQ ID NO: 6534337 - DNA, 19 bp, Homo sapiens
ttcctactgacaacattat

SEQ ID NO: 6534338 - DNA, 17 bp, Homo sapiens
ttcctactgcgcctcgt

SEQ ID NO: 6534339 - DNA, 15 bp, Homo sapiens
ttcctactgtcctca

SEQ ID NO: 6534340 - DNA, 16 bp, Homo sapiens
ttcctacttaaacaaa

SEQ ID NO: 6534341 - DNA, 16 bp, Homo sapiens
ttcctagaaattgaac

SEQ ID NO: 6534342 - DNA, 15 bp, Homo sapiens
ttcctagaagtggtt

SEQ ID NO: 6534343 - DNA, 22 bp, Homo sapiens
ttcctagaagttactgaatgca

SEQ ID NO: 6534344 - DNA, 20 bp, Homo sapiens
ttcctagactaattaaaatc

SEQ ID NO: 6534345 - DNA, 23 bp, Homo sapiens
ttcctagagcatctgtcccactg

SEQ ID NO: 6534346 - DNA, 18 bp, Homo sapiens
ttcctagaggcagaggtt

SEQ ID NO: 6534347 - DNA, 18 bp, Homo sapiens
ttcctagataaaaagatg

SEQ ID NO: 6534348 - DNA, 19 bp, Homo sapiens
ttcctagattacatctgcc

SEQ ID NO: 6534349 - DNA, 20 bp, Homo sapiens
ttcctagattacatctgcct

SEQ ID NO: 6534350 - DNA, 22 bp, Homo sapiens
ttcctagattacatctgcctta

SEQ ID NO: 6534351 - DNA, 21 bp, Homo sapiens
ttcctagcaaatttctctctt

SEQ ID NO: 6534352 - DNA, 22 bp, Homo sapiens
ttcctagcaaatttctctcttt

SEQ ID NO: 6534353 - DNA, 19 bp, Homo sapiens
ttcctagcacacacttttg

SEQ ID NO: 6534354 - DNA, 21 bp, Homo sapiens
ttcctagcactgccccacatg

SEQ ID NO: 6534355 - DNA, 22 bp, Homo sapiens
ttcctagcactgccccacatgc

SEQ ID NO: 6534356 - DNA, 14 bp, Homo sapiens
ttcctagccaccgc

SEQ ID NO: 6534357 - DNA, 21 bp, Homo sapiens
ttcctagccaccgcctcctac

SEQ ID NO: 6534358 - DNA, 15 bp, Homo sapiens
ttcctagctgtaaat

SEQ ID NO: 6534359 - DNA, 17 bp, Homo sapiens
ttcctaggatgtcatgt

SEQ ID NO: 6534360 - DNA, 19 bp, Homo sapiens
ttcctaggcattgcaggac

SEQ ID NO: 6534361 - DNA, 18 bp, Homo sapiens
ttcctaggggaatgaggg

SEQ ID NO: 6534362 - DNA, 20 bp, Homo sapiens
ttcctaggtataattcacat

SEQ ID NO: 6534363 - DNA, 14 bp, Homo sapiens
ttcctagtatatta

SEQ ID NO: 6534364 - DNA, 19 bp, Homo sapiens
ttcctagtgaaccacaggt

SEQ ID NO: 6534365 - DNA, 24 bp, Homo sapiens
ttcctagtgaaccacaggttttag

SEQ ID NO: 6534366 - DNA, 20 bp, Homo sapiens
ttcctagtggatgactgttg

SEQ ID NO: 6534367 - DNA, 21 bp, Homo sapiens
ttcctagtggatgactgttga

SEQ ID NO: 6534368 - DNA, 17 bp, Homo sapiens
ttcctagttctgtagaa

SEQ ID NO: 6534369 - DNA, 21 bp, Homo sapiens
ttcctagttggtgagaaacct

SEQ ID NO: 6534370 - DNA, 15 bp, Homo sapiens
ttcctagttttctcc

SEQ ID NO: 6534371 - DNA, 20 bp, Homo sapiens
ttcctataacttcttcctgc

SEQ ID NO: 6534372 - DNA, 20 bp, Homo sapiens
ttcctataccggagctccag

SEQ ID NO: 6534373 - DNA, 20 bp, Homo sapiens
ttcctatatacctaataccc

SEQ ID NO: 6534374 - DNA, 12 bp, Homo sapiens
ttcctatatgca

SEQ ID NO: 6534375 - DNA, 18 bp, Homo sapiens
ttcctatcaaaaagatat

SEQ ID NO: 6534376 - DNA, 16 bp, Homo sapiens
ttcctatcataaaaat

SEQ ID NO: 6534377 - DNA, 15 bp, Homo sapiens
ttcctatcatgttaa

SEQ ID NO: 6534378 - DNA, 15 bp, Homo sapiens
ttcctatcccatccc

SEQ ID NO: 6534379 - DNA, 14 bp, Homo sapiens
ttcctatgacacag

SEQ ID NO: 6534380 - DNA, 15 bp, Homo sapiens
ttcctatgactaatt

SEQ ID NO: 6534381 - DNA, 13 bp, Homo sapiens
ttcctatgatgga

SEQ ID NO: 6534382 - DNA, 14 bp, Homo sapiens
ttcctatgatgtat

SEQ ID NO: 6534383 - DNA, 21 bp, Homo sapiens
ttcctatgatgtatactgcca

SEQ ID NO: 6534384 - DNA, 18 bp, Homo sapiens
ttcctatgctattgacaa

SEQ ID NO: 6534385 - DNA, 19 bp, Homo sapiens
ttcctattccaagcttcca

SEQ ID NO: 6534386 - DNA, 17 bp, Homo sapiens
ttcctattctgttgcca

SEQ ID NO: 6534387 - DNA, 12 bp, Homo sapiens
ttcctattgtga

SEQ ID NO: 6534388 - DNA, 22 bp, Homo sapiens
ttcctatttcagtgttacctgt

SEQ ID NO: 6534389 - DNA, 22 bp, Homo sapiens
ttcctatttgccatgggcttca

SEQ ID NO: 6534390 - DNA, 19 bp, Homo sapiens
ttcctatttgttttcatgg

SEQ ID NO: 6534391 - DNA, 21 bp, Homo sapiens
ttcctatttgttttcatggtg

SEQ ID NO: 6534392 - DNA, 21 bp, Homo sapiens
ttcctattttggagtggtcag

SEQ ID NO: 6534393 - DNA, 16 bp, Homo sapiens
ttcctatttttaaata

SEQ ID NO: 6534394 - DNA, 17 bp, Homo sapiens
ttcctatttttaaataa

SEQ ID NO: 6534395 - DNA, 19 bp, Homo sapiens
ttcctcaaaaagcagaagg

SEQ ID NO: 6534396 - DNA, 20 bp, Homo sapiens
ttcctcaaaataaagaagta

SEQ ID NO: 6534397 - DNA, 14 bp, Homo sapiens
ttcctcaaatcaaa

SEQ ID NO: 6534398 - DNA, 22 bp, Homo sapiens
tggtttcggaaaaaaaaaaaga

SEQ ID NO: 6534399 - DNA, 24 bp, Homo sapiens
tggtttctacttcccctgggatgc

SEQ ID NO: 6534400 - DNA, 16 bp, Homo sapiens
tggtttctagacttgt

SEQ ID NO: 6534401 - DNA, 15 bp, Homo sapiens
tggtttctatacatg

SEQ ID NO: 6534402 - DNA, 17 bp, Homo sapiens
tggtttctcatgagctg

SEQ ID NO: 6534403 - DNA, 15 bp, Homo sapiens
tggtttctcattctt

SEQ ID NO: 6534404 - DNA, 16 bp, Homo sapiens
tggtttctcattcttg

SEQ ID NO: 6534405 - DNA, 21 bp, Homo sapiens
tggtttctctctacagtgcca

SEQ ID NO: 6534406 - DNA, 15 bp, Homo sapiens
tggtttctcttctcc

SEQ ID NO: 6534407 - DNA, 17 bp, Homo sapiens
tggtttctgaaaatgtt

SEQ ID NO: 6534408 - DNA, 19 bp, Homo sapiens
tggtttctgcgtgtgtata

SEQ ID NO: 6534409 - DNA, 14 bp, Homo sapiens
tggtttctgcttct

SEQ ID NO: 6534410 - DNA, 23 bp, Homo sapiens
tggtttctgtttgaattttcaaa

SEQ ID NO: 6534411 - DNA, 11 bp, Homo sapiens
tggtttcttat

SEQ ID NO: 6534412 - DNA, 15 bp, Homo sapiens
tggtttcttcattct

SEQ ID NO: 6534413 - DNA, 16 bp, Homo sapiens
tggtttcttcattctt

SEQ ID NO: 6534414 - DNA, 22 bp, Homo sapiens
tggtttcttgtgcactggcacc

SEQ ID NO: 6534415 - DNA, 23 bp, Homo sapiens
tggtttgaaaatattttcattat

SEQ ID NO: 6534416 - DNA, 16 bp, Homo sapiens
tggtttgaaagattat

SEQ ID NO: 6534417 - DNA, 21 bp, Homo sapiens
tggtttgacaattttgtctta

SEQ ID NO: 6534418 - DNA, 21 bp, Homo sapiens
tggtttgagacactggtttac

SEQ ID NO: 6534419 - DNA, 23 bp, Homo sapiens
tggtttgagcttagtgaaattac

SEQ ID NO: 6534420 - DNA, 15 bp, Homo sapiens
tggtttgcaggtggc

SEQ ID NO: 6534421 - DNA, 16 bp, Homo sapiens
tggtttgcatgacttt

SEQ ID NO: 6534422 - DNA, 13 bp, Homo sapiens
tggtttgccatgt

SEQ ID NO: 6534423 - DNA, 15 bp, Homo sapiens
tggtttgcccagagc

SEQ ID NO: 6534424 - DNA, 16 bp, Homo sapiens
tggtttgccttccaga

SEQ ID NO: 6534425 - DNA, 12 bp, Homo sapiens
tggtttgctagt

SEQ ID NO: 6534426 - DNA, 13 bp, Homo sapiens
tggtttggaaaat

SEQ ID NO: 6534427 - DNA, 22 bp, Homo sapiens
tggtttggattactattgcaaa

SEQ ID NO: 6534428 - DNA, 20 bp, Homo sapiens
tggtttggccatctctggat

SEQ ID NO: 6534429 - DNA, 23 bp, Homo sapiens
tggtttggcccttctccttttga

SEQ ID NO: 6534430 - DNA, 17 bp, Homo sapiens
tggtttggcctccatcc

SEQ ID NO: 6534431 - DNA, 20 bp, Homo sapiens
tggtttgggcaagcagactg

SEQ ID NO: 6534432 - DNA, 21 bp, Homo sapiens
tggtttgggccccattcagaa

SEQ ID NO: 6534433 - DNA, 15 bp, Homo sapiens
tggtttggggagaaa

SEQ ID NO: 6534434 - DNA, 16 bp, Homo sapiens
tggtttggggagaaat

SEQ ID NO: 6534435 - DNA, 19 bp, Homo sapiens
tggtttggggcgaggcaga

SEQ ID NO: 6534436 - DNA, 23 bp, Homo sapiens
tggtttggtccctggttttcagt

SEQ ID NO: 6534437 - DNA, 19 bp, Homo sapiens
tggtttggttcatggtgaa

SEQ ID NO: 6534438 - DNA, 13 bp, Homo sapiens
tggtttggttttg

SEQ ID NO: 6534439 - DNA, 11 bp, Homo sapiens
tggtttgtaat

SEQ ID NO: 6534440 - DNA, 17 bp, Homo sapiens
tggtttgtacatatcaa

SEQ ID NO: 6534441 - DNA, 15 bp, Homo sapiens
tggtttgtactcaaa

SEQ ID NO: 6534442 - DNA, 13 bp, Homo sapiens
tggtttgtcctga

SEQ ID NO: 6534443 - DNA, 23 bp, Homo sapiens
tggtttgtgaatccatcttgctt

SEQ ID NO: 6534444 - DNA, 21 bp, Homo sapiens
tggtttgtgagccttgctgcc

SEQ ID NO: 6534445 - DNA, 22 bp, Homo sapiens
tggtttgtgtcaaaactggttt

SEQ ID NO: 6534446 - DNA, 13 bp, Homo sapiens
tggtttgttattc

SEQ ID NO: 6534447 - DNA, 13 bp, Homo sapiens
tggtttgtttgct

SEQ ID NO: 6534448 - DNA, 12 bp, Homo sapiens
tggttttaaaat

SEQ ID NO: 6534449 - DNA, 13 bp, Homo sapiens
tggttttaaaata

SEQ ID NO: 6534450 - DNA, 20 bp, Homo sapiens
tggttttaaacctttaatga

SEQ ID NO: 6534451 - DNA, 16 bp, Homo sapiens
tggttttaaagctaaa

SEQ ID NO: 6534452 - DNA, 12 bp, Homo sapiens
tggttttaacaa

SEQ ID NO: 6534453 - DNA, 20 bp, Homo sapiens
tggttttaacaactgtgctt

SEQ ID NO: 6534454 - DNA, 16 bp, Homo sapiens
tggttttacacagaga

SEQ ID NO: 6534455 - DNA, 18 bp, Homo sapiens
tggttttacacagagaaa

SEQ ID NO: 6534456 - DNA, 16 bp, Homo sapiens
tggttttacacaggaa

SEQ ID NO: 6534457 - DNA, 23 bp, Homo sapiens
tggttttacagtgaatttctgat

SEQ ID NO: 6534458 - DNA, 16 bp, Homo sapiens
tggttttacttacaaa

SEQ ID NO: 6534459 - DNA, 13 bp, Homo sapiens
tggttttagattt

SEQ ID NO: 6534460 - DNA, 20 bp, Homo sapiens
tggttttatactatattaac

SEQ ID NO: 6534461 - DNA, 21 bp, Homo sapiens
tggttttatactatattaact

SEQ ID NO: 6534462 - DNA, 23 bp, Homo sapiens
tggttttatactgaaggaaaaac

SEQ ID NO: 6534463 - DNA, 12 bp, Homo sapiens
tggttttatgca

SEQ ID NO: 6534464 - DNA, 14 bp, Homo sapiens
tggttttcaaaata

SEQ ID NO: 6534465 - DNA, 18 bp, Homo sapiens
tggttttcagagcaggag

SEQ ID NO: 6534466 - DNA, 20 bp, Homo sapiens
tggttttcagagcaggaggc

SEQ ID NO: 6534467 - DNA, 12 bp, Homo sapiens
tggttttcatta

SEQ ID NO: 6534468 - DNA, 13 bp, Homo sapiens
tggttttcattat

SEQ ID NO: 6534469 - DNA, 12 bp, Homo sapiens
tggttttccatg

SEQ ID NO: 6534470 - DNA, 14 bp, Homo sapiens
tggttttcccctcc

SEQ ID NO: 6534471 - DNA, 20 bp, Homo sapiens
tggttttcgtcatcttccct

SEQ ID NO: 6534472 - DNA, 19 bp, Homo sapiens
tggttttctccaagagcta

SEQ ID NO: 6534473 - DNA, 12 bp, Homo sapiens
tggttttctcct

SEQ ID NO: 6534474 - DNA, 15 bp, Homo sapiens
tggttttctctctgg

SEQ ID NO: 6534475 - DNA, 21 bp, Homo sapiens
tggttttctgccaatgaccaa

SEQ ID NO: 6534476 - DNA, 16 bp, Homo sapiens
tggttttctgttcttt

SEQ ID NO: 6534477 - DNA, 19 bp, Homo sapiens
tggttttcttgccaccctc

SEQ ID NO: 6534478 - DNA, 23 bp, Homo sapiens
tggttttcttgccaccctctggg

SEQ ID NO: 6534479 - DNA, 17 bp, Homo sapiens
tggttttctttttcctt

SEQ ID NO: 6534480 - DNA, 21 bp, Homo sapiens
tggttttgccctccctctctg

SEQ ID NO: 6534481 - DNA, 15 bp, Homo sapiens
tggttttgcctcttt

SEQ ID NO: 6534482 - DNA, 16 bp, Homo sapiens
tggttttggccacccc

SEQ ID NO: 6534483 - DNA, 20 bp, Homo sapiens
tggttttggctctcccaccc

SEQ ID NO: 6534484 - DNA, 21 bp, Homo sapiens
tggttttggggaaatgtggag

SEQ ID NO: 6534485 - DNA, 18 bp, Homo sapiens
tggttttgtaagatgctg

SEQ ID NO: 6534486 - DNA, 13 bp, Homo sapiens
tggttttgtaatt

SEQ ID NO: 6534487 - DNA, 15 bp, Homo sapiens
tggttttgtgcttta

SEQ ID NO: 6534488 - DNA, 17 bp, Homo sapiens
tggttttgttcccctcc

SEQ ID NO: 6534489 - DNA, 14 bp, Homo sapiens
tggttttgtttctg

SEQ ID NO: 6534490 - DNA, 20 bp, Homo sapiens
tggttttgttttcaatgaat

SEQ ID NO: 6534491 - DNA, 23 bp, Homo sapiens
tggttttgttttcaatgaattaa

SEQ ID NO: 6534492 - DNA, 21 bp, Homo sapiens
tggtttttaaaaaactgctga

SEQ ID NO: 6534493 - DNA, 23 bp, Homo sapiens
tggtttttaaaaaactgctgact

SEQ ID NO: 6534494 - DNA, 23 bp, Homo sapiens
tggtttttaaaaaatgttttctg

SEQ ID NO: 6534495 - DNA, 21 bp, Homo sapiens
tggtttttaaattttgtaatg

SEQ ID NO: 6534496 - DNA, 18 bp, Homo sapiens
tggtttttactgctctga

SEQ ID NO: 6534497 - DNA, 13 bp, Homo sapiens
tggtttttataat

SEQ ID NO: 6534498 - DNA, 16 bp, Homo sapiens
tggtttttcagttttc

SEQ ID NO: 6534499 - DNA, 16 bp, Homo sapiens
tggtttttcttttctt

SEQ ID NO: 6534500 - DNA, 19 bp, Homo sapiens
tggtttttcttttcttgga

SEQ ID NO: 6534501 - DNA, 24 bp, Homo sapiens
tggtttttgcaagatttaacacta

SEQ ID NO: 6534502 - DNA, 22 bp, Homo sapiens
tggtttttgtagccttcctcca

SEQ ID NO: 6534503 - DNA, 22 bp, Homo sapiens
tggttttttttttttttttggc

SEQ ID NO: 6534504 - DNA, 19 bp, Homo sapiens
tgtaaaaaaaaatgccttt

SEQ ID NO: 6534505 - DNA, 16 bp, Homo sapiens
tgtaaaaaaagcaaaa

SEQ ID NO: 6534506 - DNA, 13 bp, Homo sapiens
tgtaaaaaacaaa

SEQ ID NO: 6534507 - DNA, 17 bp, Homo sapiens
tgtaaaaaacaaaaaaa

SEQ ID NO: 6534508 - DNA, 21 bp, Homo sapiens
tgtaaaaaacaaaaaaaacaa

SEQ ID NO: 6534509 - DNA, 22 bp, Homo sapiens
tgtaaaaaacaaaaaaaacaac

SEQ ID NO: 6534510 - DNA, 12 bp, Homo sapiens
tgtaaaaaagaa

SEQ ID NO: 6534511 - DNA, 14 bp, Homo sapiens
tgtaaaaaatacaa

SEQ ID NO: 6534512 - DNA, 14 bp, Homo sapiens
tgtaaaaaatatta

SEQ ID NO: 6534513 - DNA, 16 bp, Homo sapiens
tgtaaaaaatattaaa

SEQ ID NO: 6534514 - DNA, 12 bp, Homo sapiens
tgtaaaaaatgg

SEQ ID NO: 6534515 - DNA, 15 bp, Homo sapiens
tgtaaaaaatggaaa

SEQ ID NO: 6534516 - DNA, 16 bp, Homo sapiens
tgtaaaaaatggaaaa

SEQ ID NO: 6534517 - DNA, 21 bp, Homo sapiens
tgtaaaaaatggaaaaaaaca

SEQ ID NO: 6534518 - DNA, 22 bp, Homo sapiens
tgtaaaaaatgtctcatgtcaa

SEQ ID NO: 6534519 - DNA, 16 bp, Homo sapiens
tgtaaaaaattcacat

SEQ ID NO: 6534520 - DNA, 19 bp, Homo sapiens
tgtaaaaaattcacataat

SEQ ID NO: 6534521 - DNA, 22 bp, Homo sapiens
tgtaaaaaattcacataataaa

SEQ ID NO: 6534522 - DNA, 14 bp, Homo sapiens
tgtaaaaacactga

SEQ ID NO: 6534523 - DNA, 22 bp, Homo sapiens
tgtaaaaacagcattgctttct

SEQ ID NO: 6534524 - DNA, 22 bp, Homo sapiens
tgtaaaaacccaagtccctgtc

SEQ ID NO: 6534525 - DNA, 13 bp, Homo sapiens
tgtaaaaactgaa

SEQ ID NO: 6534526 - DNA, 14 bp, Homo sapiens
tgtaaaaactgtgg

SEQ ID NO: 6534527 - DNA, 13 bp, Homo sapiens
tgtaaaaagaaaa

SEQ ID NO: 6534528 - DNA, 13 bp, Homo sapiens
tgtaaaaagaaat

SEQ ID NO: 6534529 - DNA, 18 bp, Homo sapiens
tgtaaaaagcctccttgt

SEQ ID NO: 6534530 - DNA, 16 bp, Homo sapiens
tgtaaaaagggaaaaa

SEQ ID NO: 6534531 - DNA, 19 bp, Homo sapiens
tgtaaaaagggaaaaagac

SEQ ID NO: 6534532 - DNA, 18 bp, Homo sapiens
tgtaaaaaggggaggaga

SEQ ID NO: 6534533 - DNA, 19 bp, Homo sapiens
tgtaaaaaggggaggagaa

SEQ ID NO: 6534534 - DNA, 22 bp, Homo sapiens
tgtaaaaagtagattaaaatat

SEQ ID NO: 6534535 - DNA, 17 bp, Homo sapiens
tgtaaaaatgaaggaat

SEQ ID NO: 6534536 - DNA, 11 bp, Homo sapiens
tgtaaaacaaa

SEQ ID NO: 6534537 - DNA, 23 bp, Homo sapiens
tgtaaaacaaaaatgtaatgatc

SEQ ID NO: 6534538 - DNA, 20 bp, Homo sapiens
tgtaaaacaatgccatgaac

SEQ ID NO: 6534539 - DNA, 14 bp, Homo sapiens
tgtaaaacaggtag

SEQ ID NO: 6534540 - DNA, 14 bp, Homo sapiens
tgtaaaacagtggt

SEQ ID NO: 6534541 - DNA, 21 bp, Homo sapiens
tgtaaaaccatcagatatttc

SEQ ID NO: 6534542 - DNA, 21 bp, Homo sapiens
tgtaaaaccatgtagttttaa

SEQ ID NO: 6534543 - DNA, 16 bp, Homo sapiens
tgtaaaacctgtcaat

SEQ ID NO: 6534544 - DNA, 16 bp, Homo sapiens
tgtaaaacgctgtcaa

SEQ ID NO: 6534545 - DNA, 17 bp, Homo sapiens
tgtaaaactcgctttta

SEQ ID NO: 6534546 - DNA, 22 bp, Homo sapiens
tgtaaaactgtgacattccaca

SEQ ID NO: 6534547 - DNA, 23 bp, Homo sapiens
tgtaaaactgtgacattccacag

SEQ ID NO: 6534548 - DNA, 12 bp, Homo sapiens
tgtaaaactgtt

SEQ ID NO: 6534549 - DNA, 14 bp, Homo sapiens
tgtaaaacttctgc

SEQ ID NO: 6534550 - DNA, 17 bp, Homo sapiens
tgtaaaacttctgctcg

SEQ ID NO: 6534551 - DNA, 12 bp, Homo sapiens
tgtaaaacttta

SEQ ID NO: 6534552 - DNA, 13 bp, Homo sapiens
tgtaaaactttat

SEQ ID NO: 6534553 - DNA, 17 bp, Homo sapiens
tgtaaaactttggtgca

SEQ ID NO: 6534554 - DNA, 23 bp, Homo sapiens
tgtaaaagaaaattttttttcaa

SEQ ID NO: 6534555 - DNA, 21 bp, Homo sapiens
tgtaaaagaaaggttgcgttt

SEQ ID NO: 6534556 - DNA, 12 bp, Homo sapiens
tgtaaaagacat

SEQ ID NO: 6534557 - DNA, 14 bp, Homo sapiens
tgtaaaagagaaac

SEQ ID NO: 6534558 - DNA, 18 bp, Homo sapiens
tgtaaaagcattttgtaa

SEQ ID NO: 6534559 - DNA, 15 bp, Homo sapiens
tgtaaaagttactaa

SEQ ID NO: 6534560 - DNA, 16 bp, Homo sapiens
tgtaaaagttataata

SEQ ID NO: 6534561 - DNA, 16 bp, Homo sapiens
tgtaaaataaaaccac

SEQ ID NO: 6534562 - DNA, 14 bp, Homo sapiens
tgtaaaataaaatt

SEQ ID NO: 6534563 - DNA, 18 bp, Homo sapiens
tgtaaaataagaatgatt

SEQ ID NO: 6534564 - DNA, 13 bp, Homo sapiens
tgtaaaatactat

SEQ ID NO: 6534565 - DNA, 16 bp, Homo sapiens
tgtaaaatagaaaaag

SEQ ID NO: 6534566 - DNA, 12 bp, Homo sapiens
tgtaaaatagct

SEQ ID NO: 6534567 - DNA, 17 bp, Homo sapiens
tgtaaaatagcttgtat

SEQ ID NO: 6534568 - DNA, 15 bp, Homo sapiens
tgtaaaatagtctca

SEQ ID NO: 6534569 - DNA, 12 bp, Homo sapiens
tgtaaaatagtt

SEQ ID NO: 6534570 - DNA, 19 bp, Homo sapiens
tgtaaaatatagctgtaca

SEQ ID NO: 6534571 - DNA, 17 bp, Homo sapiens
tgtaaaatatagtcgct

SEQ ID NO: 6534572 - DNA, 17 bp, Homo sapiens
tgtaaaatatctacctg

SEQ ID NO: 6534573 - DNA, 18 bp, Homo sapiens
tgtaaaatatctacctgc

SEQ ID NO: 6534574 - DNA, 19 bp, Homo sapiens
tgtaaaatattttgaatca

SEQ ID NO: 6534575 - DNA, 21 bp, Homo sapiens
tgtaaaatcctacagtgaaat

SEQ ID NO: 6534576 - DNA, 22 bp, Homo sapiens
tgtaaaatcctacagtgaaatg

SEQ ID NO: 6534577 - DNA, 20 bp, Homo sapiens
ttcctcaaatcagtgataat

SEQ ID NO: 6534578 - DNA, 15 bp, Homo sapiens
ttcctcaaatgttga

SEQ ID NO: 6534579 - DNA, 14 bp, Homo sapiens
ttcctcaaattttt

SEQ ID NO: 6534580 - DNA, 22 bp, Homo sapiens
ttcctcaacagtgttttcagaa

SEQ ID NO: 6534581 - DNA, 22 bp, Homo sapiens
ttcctcaagtatcttctatttt

SEQ ID NO: 6534582 - DNA, 18 bp, Homo sapiens
ttcctcaatcacactaca

SEQ ID NO: 6534583 - DNA, 21 bp, Homo sapiens
ttcctcacaccaggcttgcct

SEQ ID NO: 6534584 - DNA, 23 bp, Homo sapiens
ttcctcacacccctgtcccaccc

SEQ ID NO: 6534585 - DNA, 18 bp, Homo sapiens
ttcctcacagccttggct

SEQ ID NO: 6534586 - DNA, 21 bp, Homo sapiens
ttcctcacagccttggctcct

SEQ ID NO: 6534587 - DNA, 13 bp, Homo sapiens
ttcctcacatttg

SEQ ID NO: 6534588 - DNA, 10 bp, Homo sapiens
ttcctcacca

SEQ ID NO: 6534589 - DNA, 14 bp, Homo sapiens
ttcctcaccaataa

SEQ ID NO: 6534590 - DNA, 16 bp, Homo sapiens
ttcctcaccaataact

SEQ ID NO: 6534591 - DNA, 17 bp, Homo sapiens
ttcctcaccaataactt

SEQ ID NO: 6534592 - DNA, 22 bp, Homo sapiens
ttcctcaccaataacttcagag

SEQ ID NO: 6534593 - DNA, 23 bp, Homo sapiens
ttcctcaccaataacttcagaga

SEQ ID NO: 6534594 - DNA, 22 bp, Homo sapiens
ttcctcacctaccctcaaagta

SEQ ID NO: 6534595 - DNA, 15 bp, Homo sapiens
ttcctcactatgaca

SEQ ID NO: 6534596 - DNA, 13 bp, Homo sapiens
ttcctcagatgat

SEQ ID NO: 6534597 - DNA, 19 bp, Homo sapiens
ttcctcagatgatgtttgc

SEQ ID NO: 6534598 - DNA, 22 bp, Homo sapiens
ttcctcagattagatgtgccaa

SEQ ID NO: 6534599 - DNA, 15 bp, Homo sapiens
ttcctcagcaggcca

SEQ ID NO: 6534600 - DNA, 22 bp, Homo sapiens
ttcctcagcaggttggcttttt

SEQ ID NO: 6534601 - DNA, 13 bp, Homo sapiens
ttcctcagcctcc

SEQ ID NO: 6534602 - DNA, 14 bp, Homo sapiens
ttcctcagcctcca

SEQ ID NO: 6534603 - DNA, 13 bp, Homo sapiens
ttcctcagcctgg

SEQ ID NO: 6534604 - DNA, 11 bp, Homo sapiens
ttcctcagctc

SEQ ID NO: 6534605 - DNA, 13 bp, Homo sapiens
ttcctcagctcta

SEQ ID NO: 6534606 - DNA, 17 bp, Homo sapiens
ttcctcagctctaggct

SEQ ID NO: 6534607 - DNA, 15 bp, Homo sapiens
ttcctcagctgccaa

SEQ ID NO: 6534608 - DNA, 15 bp, Homo sapiens
ttcctcagctgcctc

SEQ ID NO: 6534609 - DNA, 16 bp, Homo sapiens
ttcctcagctgcctcc

SEQ ID NO: 6534610 - DNA, 17 bp, Homo sapiens
ttcctcaggaaggacat

SEQ ID NO: 6534611 - DNA, 15 bp, Homo sapiens
ttcctcagtcctgga

SEQ ID NO: 6534612 - DNA, 17 bp, Homo sapiens
ttcctcagtgatggaat

SEQ ID NO: 6534613 - DNA, 17 bp, Homo sapiens
ttcctcagttacacaaa

SEQ ID NO: 6534614 - DNA, 23 bp, Homo sapiens
ttcctcatcaccatcgtgtttgc

SEQ ID NO: 6534615 - DNA, 18 bp, Homo sapiens
ttcctcatccaccccatc

SEQ ID NO: 6534616 - DNA, 14 bp, Homo sapiens
ttcctcatcctgct

SEQ ID NO: 6534617 - DNA, 17 bp, Homo sapiens
ttcctcatcctgcttct

SEQ ID NO: 6534618 - DNA, 19 bp, Homo sapiens
ttcctcatcctttccctct

SEQ ID NO: 6534619 - DNA, 21 bp, Homo sapiens
ttcctcatctatggttctaaa

SEQ ID NO: 6534620 - DNA, 23 bp, Homo sapiens
ttcctcatctatggttctaaata

SEQ ID NO: 6534621 - DNA, 18 bp, Homo sapiens
ttcctcatctgggtctcc

SEQ ID NO: 6534622 - DNA, 13 bp, Homo sapiens
ttcctcatctgtg

SEQ ID NO: 6534623 - DNA, 17 bp, Homo sapiens
ttcctcatgaatgtaaa

SEQ ID NO: 6534624 - DNA, 21 bp, Homo sapiens
ttcctcatgaatgtaaatttg

SEQ ID NO: 6534625 - DNA, 18 bp, Homo sapiens
ttcctcattgatgttaag

SEQ ID NO: 6534626 - DNA, 17 bp, Homo sapiens
ttcctccaaactcctgc

SEQ ID NO: 6534627 - DNA, 12 bp, Homo sapiens
ttcctccacagt

SEQ ID NO: 6534628 - DNA, 15 bp, Homo sapiens
ttcctccacatcctt

SEQ ID NO: 6534629 - DNA, 13 bp, Homo sapiens
ttcctccacccat

SEQ ID NO: 6534630 - DNA, 14 bp, Homo sapiens
ttcctccagacaga

SEQ ID NO: 6534631 - DNA, 12 bp, Homo sapiens
ttcctccagcct

SEQ ID NO: 6534632 - DNA, 20 bp, Homo sapiens
ttcctccagcctcccctccc

SEQ ID NO: 6534633 - DNA, 22 bp, Homo sapiens
ttcctccagctgcaccagagca

SEQ ID NO: 6534634 - DNA, 22 bp, Homo sapiens
ttcctccaggagaaggggccca

SEQ ID NO: 6534635 - DNA, 14 bp, Homo sapiens
ttcctccagtctgt

SEQ ID NO: 6534636 - DNA, 20 bp, Homo sapiens
ttcctccagtgcatactgta

SEQ ID NO: 6534637 - DNA, 13 bp, Homo sapiens
ttcctccatccta

SEQ ID NO: 6534638 - DNA, 18 bp, Homo sapiens
ttcctccatcctcctcct

SEQ ID NO: 6534639 - DNA, 14 bp, Homo sapiens
ttcctccattttta

SEQ ID NO: 6534640 - DNA, 20 bp, Homo sapiens
ttcctcccaagtggtgccta

SEQ ID NO: 6534641 - DNA, 18 bp, Homo sapiens
ttcctcccattcaagatt

SEQ ID NO: 6534642 - DNA, 19 bp, Homo sapiens
ttcctccccacactccact

SEQ ID NO: 6534643 - DNA, 22 bp, Homo sapiens
ttcctccccacactccactctg

SEQ ID NO: 6534644 - DNA, 23 bp, Homo sapiens
ttcctccccacactccactctga

SEQ ID NO: 6534645 - DNA, 13 bp, Homo sapiens
ttcctccccaccc

SEQ ID NO: 6534646 - DNA, 23 bp, Homo sapiens
ttcctccccaccctgtcccaggc

SEQ ID NO: 6534647 - DNA, 23 bp, Homo sapiens
ttcctccccaccttccccagact

SEQ ID NO: 6534648 - DNA, 21 bp, Homo sapiens
ttcctccccaggacttggtct

SEQ ID NO: 6534649 - DNA, 22 bp, Homo sapiens
ttcctccccaggacttggtctt

SEQ ID NO: 6534650 - DNA, 14 bp, Homo sapiens
ttcctccccataca

SEQ ID NO: 6534651 - DNA, 19 bp, Homo sapiens
ttcctccccatacacacac

SEQ ID NO: 6534652 - DNA, 21 bp, Homo sapiens
ttcctccccattagagtcagc

SEQ ID NO: 6534653 - DNA, 23 bp, Homo sapiens
ttcctccccattagagtcagcct

SEQ ID NO: 6534654 - DNA, 16 bp, Homo sapiens
ttcctcccccagagcc

SEQ ID NO: 6534655 - DNA, 21 bp, Homo sapiens
ttcctcccctcaacagtgagt

SEQ ID NO: 6534656 - DNA, 13 bp, Homo sapiens
ttcctcccctctc

SEQ ID NO: 6534657 - DNA, 14 bp, Homo sapiens
ttcctcccctctca

SEQ ID NO: 6534658 - DNA, 12 bp, Homo sapiens
ttcctccctcca

SEQ ID NO: 6534659 - DNA, 17 bp, Homo sapiens
ttcctccctccctgcag

SEQ ID NO: 6534660 - DNA, 18 bp, Homo sapiens
ttcctccctccctgcagg

SEQ ID NO: 6534661 - DNA, 21 bp, Homo sapiens
ttcctccctgcttaaaaatgt

SEQ ID NO: 6534662 - DNA, 12 bp, Homo sapiens
ttcctccctgga

SEQ ID NO: 6534663 - DNA, 15 bp, Homo sapiens
ttcctccctgggggc

SEQ ID NO: 6534664 - DNA, 12 bp, Homo sapiens
ttcctccctgtc

SEQ ID NO: 6534665 - DNA, 15 bp, Homo sapiens
ttcctcccttacaga

SEQ ID NO: 6534666 - DNA, 11 bp, Homo sapiens
ttcctcccttc

SEQ ID NO: 6534667 - DNA, 18 bp, Homo sapiens
ttcctcccttctgctact

SEQ ID NO: 6534668 - DNA, 20 bp, Homo sapiens
ttcctcccttctttgcttct

SEQ ID NO: 6534669 - DNA, 23 bp, Homo sapiens
ttcctccgctcccctttcccatc

SEQ ID NO: 6534670 - DNA, 24 bp, Homo sapiens
ttcctccgctcccctttcccatca

SEQ ID NO: 6534671 - DNA, 17 bp, Homo sapiens
ttcctccggctggacct

SEQ ID NO: 6534672 - DNA, 18 bp, Homo sapiens
ttcctccgtccacccagg

SEQ ID NO: 6534673 - DNA, 21 bp, Homo sapiens
ttcctccgtccacccaggctg

SEQ ID NO: 6534674 - DNA, 12 bp, Homo sapiens
ttcctcctacct

SEQ ID NO: 6534675 - DNA, 22 bp, Homo sapiens
ttcctcctaccttttgtctctt

SEQ ID NO: 6534676 - DNA, 17 bp, Homo sapiens
ttcctcctaggcgctca

SEQ ID NO: 6534677 - DNA, 19 bp, Homo sapiens
ttcctcctcagtcttctca

SEQ ID NO: 6534678 - DNA, 14 bp, Homo sapiens
ttcctcctcatcct

SEQ ID NO: 6534679 - DNA, 12 bp, Homo sapiens
ttcctcctcatg

SEQ ID NO: 6534680 - DNA, 16 bp, Homo sapiens
ttcctcctccacagtg

SEQ ID NO: 6534681 - DNA, 13 bp, Homo sapiens
ttcctcctccacc

SEQ ID NO: 6534682 - DNA, 14 bp, Homo sapiens
ttcctcctccaccc

SEQ ID NO: 6534683 - DNA, 15 bp, Homo sapiens
ttcctcctccctcct

SEQ ID NO: 6534684 - DNA, 23 bp, Homo sapiens
ttcctcctcctcctcctgttcct

SEQ ID NO: 6534685 - DNA, 13 bp, Homo sapiens
ttcctcctctcaa

SEQ ID NO: 6534686 - DNA, 19 bp, Homo sapiens
ttcctcctctcctggaaac

SEQ ID NO: 6534687 - DNA, 20 bp, Homo sapiens
ttcctcctctgcctacagcc

SEQ ID NO: 6534688 - DNA, 18 bp, Homo sapiens
ttcctcctgaagcctctg

SEQ ID NO: 6534689 - DNA, 14 bp, Homo sapiens
ttcctcctgatgga

SEQ ID NO: 6534690 - DNA, 16 bp, Homo sapiens
ttcctcctgcctttct

SEQ ID NO: 6534691 - DNA, 17 bp, Homo sapiens
ttcctcctgcctttctc

SEQ ID NO: 6534692 - DNA, 12 bp, Homo sapiens
ttcctcctgctg

SEQ ID NO: 6534693 - DNA, 13 bp, Homo sapiens
ttcctcctgctgt

SEQ ID NO: 6534694 - DNA, 23 bp, Homo sapiens
ttcctcctgctgtagtcctttct

SEQ ID NO: 6534695 - DNA, 14 bp, Homo sapiens
ttcctcctggaaat

SEQ ID NO: 6534696 - DNA, 14 bp, Homo sapiens
ttcctcctgtctcc

SEQ ID NO: 6534697 - DNA, 21 bp, Homo sapiens
ttcctccttcactgtttcatc

SEQ ID NO: 6534698 - DNA, 15 bp, Homo sapiens
ttcctccttccatgg

SEQ ID NO: 6534699 - DNA, 12 bp, Homo sapiens
ttcctccttccc

SEQ ID NO: 6534700 - DNA, 14 bp, Homo sapiens
ttcctccttccccc

SEQ ID NO: 6534701 - DNA, 15 bp, Homo sapiens
ttcctccttcccccc

SEQ ID NO: 6534702 - DNA, 16 bp, Homo sapiens
ttcctccttcccccca

SEQ ID NO: 6534703 - DNA, 18 bp, Homo sapiens
ttcctcctttacctttca

SEQ ID NO: 6534704 - DNA, 18 bp, Homo sapiens
ttcctcgagaggcacctc

SEQ ID NO: 6534705 - DNA, 16 bp, Homo sapiens
ttcctcgcctaggcct

SEQ ID NO: 6534706 - DNA, 15 bp, Homo sapiens
ttcctcgctctggga

SEQ ID NO: 6534707 - DNA, 13 bp, Homo sapiens
ttcctcgcttctt

SEQ ID NO: 6534708 - DNA, 17 bp, Homo sapiens
ttcctcggtctcccttc

SEQ ID NO: 6534709 - DNA, 18 bp, Homo sapiens
ttcctcggtctcccttcc

SEQ ID NO: 6534710 - DNA, 16 bp, Homo sapiens
ttcctcggtggctctg

SEQ ID NO: 6534711 - DNA, 16 bp, Homo sapiens
ttcctcgtgcagagct

SEQ ID NO: 6534712 - DNA, 21 bp, Homo sapiens
ttcctcgtgcagagctggggc

SEQ ID NO: 6534713 - DNA, 17 bp, Homo sapiens
ttcctctaacatttttg

SEQ ID NO: 6534714 - DNA, 18 bp, Homo sapiens
ttcctctaagatcttgcc

SEQ ID NO: 6534715 - DNA, 18 bp, Homo sapiens
ttcctctaggaaatgtac

SEQ ID NO: 6534716 - DNA, 22 bp, Homo sapiens
ttcctctaggaaatgtacgata

SEQ ID NO: 6534717 - DNA, 22 bp, Homo sapiens
ttcctctaggcaagcaggacct

SEQ ID NO: 6534718 - DNA, 23 bp, Homo sapiens
ttcctctaggcaagcaggacctg

SEQ ID NO: 6534719 - DNA, 21 bp, Homo sapiens
ttcctctaggggctgtacagt

SEQ ID NO: 6534720 - DNA, 23 bp, Homo sapiens
ttcctctagtgccctccacagcc

SEQ ID NO: 6534721 - DNA, 17 bp, Homo sapiens
ttcctctatacatctct

SEQ ID NO: 6534722 - DNA, 22 bp, Homo sapiens
ttcctctatacatctctcccca

SEQ ID NO: 6534723 - DNA, 17 bp, Homo sapiens
ttcctctatactttgtt

SEQ ID NO: 6534724 - DNA, 23 bp, Homo sapiens
ttcctctatactttgttctgttg

SEQ ID NO: 6534725 - DNA, 23 bp, Homo sapiens
ttcctctattgatgtacagtctg

SEQ ID NO: 6534726 - DNA, 12 bp, Homo sapiens
ttcctctcaccc

SEQ ID NO: 6534727 - DNA, 18 bp, Homo sapiens
ttcctctcactaaacttt

SEQ ID NO: 6534728 - DNA, 13 bp, Homo sapiens
ttcctctcactcc

SEQ ID NO: 6534729 - DNA, 16 bp, Homo sapiens
ttcctctcactcctgc

SEQ ID NO: 6534730 - DNA, 17 bp, Homo sapiens
ttcctctcactcctgcc

SEQ ID NO: 6534731 - DNA, 19 bp, Homo sapiens
ttcctctcactcctgcctc

SEQ ID NO: 6534732 - DNA, 23 bp, Homo sapiens
ttcctctcatccttttctcctat

SEQ ID NO: 6534733 - DNA, 19 bp, Homo sapiens
ttcctctcatttccagctt

SEQ ID NO: 6534734 - DNA, 15 bp, Homo sapiens
ttcctctccaattgt

SEQ ID NO: 6534735 - DNA, 15 bp, Homo sapiens
ttcctctccacacag

SEQ ID NO: 6534736 - DNA, 19 bp, Homo sapiens
ttcctctccactgccttcg

SEQ ID NO: 6534737 - DNA, 18 bp, Homo sapiens
ttcctctccactgctgga

SEQ ID NO: 6534738 - DNA, 12 bp, Homo sapiens
ttcctctccagc

SEQ ID NO: 6534739 - DNA, 22 bp, Homo sapiens
ttcctctccagccttctctctc

SEQ ID NO: 6534740 - DNA, 15 bp, Homo sapiens
ttcctctccaggcca

SEQ ID NO: 6534741 - DNA, 14 bp, Homo sapiens
ttcctctccatacc

SEQ ID NO: 6534742 - DNA, 10 bp, Homo sapiens
ttcctctccc

SEQ ID NO: 6534743 - DNA, 12 bp, Homo sapiens
ttcctctcccag

SEQ ID NO: 6534744 - DNA, 17 bp, Homo sapiens
ttcctctccctctctct

SEQ ID NO: 6534745 - DNA, 17 bp, Homo sapiens
ttcctctcctgggtact

SEQ ID NO: 6534746 - DNA, 14 bp, Homo sapiens
ttcctctccttccc

SEQ ID NO: 6534747 - DNA, 22 bp, Homo sapiens
ttcctctccttcccacaaaaga

SEQ ID NO: 6534748 - DNA, 22 bp, Homo sapiens
ttcctctccttcgtatcccgag

SEQ ID NO: 6534749 - DNA, 19 bp, Homo sapiens
ttcctctcggctggaagaa

SEQ ID NO: 6534750 - DNA, 16 bp, Homo sapiens
ttcctctctatatttc

SEQ ID NO: 6534751 - DNA, 11 bp, Homo sapiens
ttcctctctct

SEQ ID NO: 6534752 - DNA, 15 bp, Homo sapiens
ttcctctctctccct

SEQ ID NO: 6534753 - DNA, 23 bp, Homo sapiens
ttcctctctctctctctctctgt

SEQ ID NO: 6534754 - DNA, 18 bp, Homo sapiens
ttcctctctggtggctct

SEQ ID NO: 6534755 - DNA, 12 bp, Homo sapiens
ttcctctctgtc

SEQ ID NO: 6534756 - DNA, 16 bp, Homo sapiens
tgtaaaatcttcagct

SEQ ID NO: 6534757 - DNA, 12 bp, Homo sapiens
tgtaaaatcttg

SEQ ID NO: 6534758 - DNA, 15 bp, Homo sapiens
tgtaaaatcttgata

SEQ ID NO: 6534759 - DNA, 22 bp, Homo sapiens
tgtaaaatcttgtcatgtgtat

SEQ ID NO: 6534760 - DNA, 13 bp, Homo sapiens
tgtaaaatctttc

SEQ ID NO: 6534761 - DNA, 23 bp, Homo sapiens
tgtaaaatctttctttcttagaa

SEQ ID NO: 6534762 - DNA, 15 bp, Homo sapiens
tgtaaaatgaaatta

SEQ ID NO: 6534763 - DNA, 22 bp, Homo sapiens
tgtaaaatgaattgaaaaacaa

SEQ ID NO: 6534764 - DNA, 16 bp, Homo sapiens
tgtaaaatgacaatca

SEQ ID NO: 6534765 - DNA, 23 bp, Homo sapiens
tgtaaaatgagtaggatgtctct

SEQ ID NO: 6534766 - DNA, 16 bp, Homo sapiens
tgtaaaatgatactgt

SEQ ID NO: 6534767 - DNA, 13 bp, Homo sapiens
tgtaaaatgcaaa

SEQ ID NO: 6534768 - DNA, 18 bp, Homo sapiens
tgtaaaatgcaaaaaatc

SEQ ID NO: 6534769 - DNA, 21 bp, Homo sapiens
tgtaaaatgcagtccagaata

SEQ ID NO: 6534770 - DNA, 22 bp, Homo sapiens
tgtaaaatgcttttcactttct

SEQ ID NO: 6534771 - DNA, 23 bp, Homo sapiens
tgtaaaatgcttttcactttctg

SEQ ID NO: 6534772 - DNA, 14 bp, Homo sapiens
tgtaaaatgtaatg

SEQ ID NO: 6534773 - DNA, 13 bp, Homo sapiens
tgtaaaattaatg

SEQ ID NO: 6534774 - DNA, 15 bp, Homo sapiens
tgtaaaattaatgta

SEQ ID NO: 6534775 - DNA, 20 bp, Homo sapiens
tgtaaaattaatgtaataaa

SEQ ID NO: 6534776 - DNA, 14 bp, Homo sapiens
tgtaaaattcatag

SEQ ID NO: 6534777 - DNA, 18 bp, Homo sapiens
tgtaaaattggattatta

SEQ ID NO: 6534778 - DNA, 14 bp, Homo sapiens
tgtaaaattgtata

SEQ ID NO: 6534779 - DNA, 22 bp, Homo sapiens
tgtaaaattgttaaccttgtaa

SEQ ID NO: 6534780 - DNA, 20 bp, Homo sapiens
tgtaaaattttgcctaatac

SEQ ID NO: 6534781 - DNA, 22 bp, Homo sapiens
tgtaaacaaaccacagcaggat

SEQ ID NO: 6534782 - DNA, 14 bp, Homo sapiens
tgtaaacaaactct

SEQ ID NO: 6534783 - DNA, 17 bp, Homo sapiens
tgtaaacaaatcctgtt

SEQ ID NO: 6534784 - DNA, 19 bp, Homo sapiens
tgtaaacaaatctttccat

SEQ ID NO: 6534785 - DNA, 15 bp, Homo sapiens
tgtaaacaacaaact

SEQ ID NO: 6534786 - DNA, 13 bp, Homo sapiens
tgtaaacacatct

SEQ ID NO: 6534787 - DNA, 15 bp, Homo sapiens
tgtaaacagaaggag

SEQ ID NO: 6534788 - DNA, 18 bp, Homo sapiens
tgtaaacagcctcttttt

SEQ ID NO: 6534789 - DNA, 20 bp, Homo sapiens
tgtaaacaggagacaggaag

SEQ ID NO: 6534790 - DNA, 17 bp, Homo sapiens
tgtaaacagtgcctgct
